United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 97

SEQ ID NO: 3450265 - RNA, 17 nt, Pseudomonas aeruginosa PA01
cgcgcuuguccuccagc

SEQ ID NO: 3450266 - RNA, 19 nt, Pseudomonas aeruginosa PA01
cgcgcuuuccggcgcggcc

SEQ ID NO: 3450267 - RNA, 21 nt, Pseudomonas aeruginosa PA01
cgcggaaacccuuccagccgc

SEQ ID NO: 3450268 - RNA, 21 nt, Pseudomonas aeruginosa PA01
cgcggaaaccugcaacucggc

SEQ ID NO: 3450269 - RNA, 22 nt, Pseudomonas aeruginosa PA01
cgcggaaaccugcaacucggcg

SEQ ID NO: 3450270 - RNA, 23 nt, Pseudomonas aeruginosa PA01
cgcggaaaccugcaacucggcgc

SEQ ID NO: 3450271 - RNA, 16 nt, Pseudomonas aeruginosa PA01
cgcggaaccagugcgc

SEQ ID NO: 3450272 - RNA, 22 nt, Pseudomonas aeruginosa PA01
cgcggaaccagugcgcgguccg

SEQ ID NO: 3450273 - RNA, 15 nt, Pseudomonas aeruginosa PA01
cgcggaagccgugca

SEQ ID NO: 3450274 - RNA, 15 nt, Pseudomonas aeruginosa PA01
cgcggaaggcccgcg

SEQ ID NO: 3450275 - RNA, 18 nt, Pseudomonas aeruginosa PA01
cgcggaaggcccgcgagc

SEQ ID NO: 3450276 - RNA, 22 nt, Pseudomonas aeruginosa PA01
cgcggaaggcccgcgagccgcg

SEQ ID NO: 3450277 - RNA, 19 nt, Pseudomonas aeruginosa PA01
cgcggaaguaggcggcgga

SEQ ID NO: 3450278 - RNA, 21 nt, Pseudomonas aeruginosa PA01
cgcggaaguaggcggcggagu

SEQ ID NO: 3450279 - RNA, 23 nt, Pseudomonas aeruginosa PA01
cgcggaauacguacucgucgcuc

SEQ ID NO: 3450280 - RNA, 16 nt, Pseudomonas aeruginosa PA01
cgcggaauccuucgcg

SEQ ID NO: 3450281 - RNA, 20 nt, Pseudomonas aeruginosa PA01
cgcggaauccuucgcggcgg

SEQ ID NO: 3450282 - RNA, 21 nt, Pseudomonas aeruginosa PA01
cgcggaauccuucgcggcggc

SEQ ID NO: 3450283 - RNA, 22 nt, Pseudomonas aeruginosa PA01
cgcggaauccuucgcggcggcg

SEQ ID NO: 3450284 - RNA, 14 nt, Pseudomonas aeruginosa PA01
cgcggaauggcgcg

SEQ ID NO: 3450285 - RNA, 15 nt, Pseudomonas aeruginosa PA01
cgcggacaagcccag

SEQ ID NO: 3450286 - RNA, 17 nt, Pseudomonas aeruginosa PA01
cgcggacagccugggcg

SEQ ID NO: 3450287 - RNA, 22 nt, Pseudomonas aeruginosa PA01
cgcggacaugaaaaagccggag

SEQ ID NO: 3450288 - RNA, 14 nt, Pseudomonas aeruginosa PA01
cgcggacauggcgc

SEQ ID NO: 3450289 - RNA, 16 nt, Pseudomonas aeruginosa PA01
cgcggacauggcgcuc

SEQ ID NO: 3450290 - RNA, 21 nt, Pseudomonas aeruginosa PA01
cgcggacauggcgcucgagcu

SEQ ID NO: 3450291 - RNA, 17 nt, Pseudomonas aeruginosa PA01
cgcggaccacgucccag

SEQ ID NO: 3450292 - RNA, 18 nt, Pseudomonas aeruginosa PA01
cgcggaccacgucccagu

SEQ ID NO: 3450293 - RNA, 14 nt, Pseudomonas aeruginosa PA01
cgcggaccagcucc

SEQ ID NO: 3450294 - RNA, 15 nt, Pseudomonas aeruginosa PA01
cgcggaccagcuccg

SEQ ID NO: 3450295 - RNA, 14 nt, Pseudomonas aeruginosa PA01
cgcggacccaguug

SEQ ID NO: 3450296 - RNA, 13 nt, Pseudomonas aeruginosa PA01
cgcggacccgcgc

SEQ ID NO: 3450297 - RNA, 16 nt, Pseudomonas aeruginosa PA01
cgcggacccgcgccgg

SEQ ID NO: 3450298 - RNA, 18 nt, Pseudomonas aeruginosa PA01
cgcggacccgcgccggca

SEQ ID NO: 3450299 - RNA, 22 nt, Pseudomonas aeruginosa PA01
cgcggacccgcgccggcagcuc

SEQ ID NO: 3450300 - RNA, 20 nt, Pseudomonas aeruginosa PA01
cgcggaccgaaggcaacagc

SEQ ID NO: 3450301 - RNA, 19 nt, Pseudomonas aeruginosa PA01
cgcggaccgggcggcgcgg

SEQ ID NO: 3450302 - RNA, 14 nt, Pseudomonas aeruginosa PA01
cgcggaccuccagc

SEQ ID NO: 3450303 - RNA, 15 nt, Pseudomonas aeruginosa PA01
cgcggaccuccagcc

SEQ ID NO: 3450304 - RNA, 21 nt, Pseudomonas aeruginosa PA01
cgcggaccuccagccggccau

SEQ ID NO: 3450305 - RNA, 22 nt, Pseudomonas aeruginosa PA01
cgcggaccuccagccggccauc

SEQ ID NO: 3450306 - RNA, 17 nt, Pseudomonas aeruginosa PA01
cgcggaccucgggcagc

SEQ ID NO: 3450307 - RNA, 23 nt, Pseudomonas aeruginosa PA01
cgcggaccucgggcagcuuggcg

SEQ ID NO: 3450308 - RNA, 23 nt, Pseudomonas aeruginosa PA01
cgcggaccucugcguucugcugc

SEQ ID NO: 3450309 - RNA, 23 nt, Pseudomonas aeruginosa PA01
cgcggaccuucgacggcaggugg

SEQ ID NO: 3450310 - RNA, 18 nt, Pseudomonas aeruginosa PA01
cgcggaccuugucgccgg

SEQ ID NO: 3450311 - RNA, 16 nt, Pseudomonas aeruginosa PA01
cgcggacgaaccccgg

SEQ ID NO: 3450312 - RNA, 19 nt, Pseudomonas aeruginosa PA01
cgcggacgauggucgccgc

SEQ ID NO: 3450313 - RNA, 20 nt, Pseudomonas aeruginosa PA01
cgcggacgauggucgccgcg

SEQ ID NO: 3450314 - RNA, 22 nt, Pseudomonas aeruginosa PA01
cgcggacgauggucgccgcgac

SEQ ID NO: 3450315 - RNA, 12 nt, Pseudomonas aeruginosa PA01
cgcggacgccga

SEQ ID NO: 3450316 - RNA, 15 nt, Pseudomonas aeruginosa PA01
cgcggacgccgaagc

SEQ ID NO: 3450317 - RNA, 18 nt, Pseudomonas aeruginosa PA01
cgcggacgccgaagcggg

SEQ ID NO: 3450318 - RNA, 14 nt, Pseudomonas aeruginosa PA01
cgcggacgcuggcg

SEQ ID NO: 3450319 - RNA, 17 nt, Pseudomonas aeruginosa PA01
cgcggacgcuggcgauc

SEQ ID NO: 3450320 - RNA, 15 nt, Pseudomonas aeruginosa PA01
cgcggacggccggcu

SEQ ID NO: 3450321 - RNA, 13 nt, Pseudomonas aeruginosa PA01
cgcggacggccug

SEQ ID NO: 3450322 - RNA, 15 nt, Pseudomonas aeruginosa PA01
cgcggacggccugcg

SEQ ID NO: 3450323 - RNA, 13 nt, Pseudomonas aeruginosa PA01
cgcggacgggccg

SEQ ID NO: 3450324 - RNA, 14 nt, Pseudomonas aeruginosa PA01
cgcggacgggccgc

SEQ ID NO: 3450325 - RNA, 15 nt, Pseudomonas aeruginosa PA01
cgcggacgggccgcg

SEQ ID NO: 3450326 - RNA, 16 nt, Pseudomonas aeruginosa PA01
cgcggacgggccgcgc

SEQ ID NO: 3450327 - RNA, 19 nt, Pseudomonas aeruginosa PA01
cgcggacgggccgcgccgc

SEQ ID NO: 3450328 - RNA, 17 nt, Pseudomonas aeruginosa PA01
cgcggacuccggaggcg

SEQ ID NO: 3450329 - RNA, 13 nt, Pseudomonas aeruginosa PA01
cgcggagaacagu

SEQ ID NO: 3450330 - RNA, 23 nt, Pseudomonas aeruginosa PA01
cgcggagaauccgcucggugccu

SEQ ID NO: 3450331 - RNA, 24 nt, Pseudomonas aeruginosa PA01
cgcggagaggaucagcgaacccgg

SEQ ID NO: 3450332 - RNA, 20 nt, Pseudomonas aeruginosa PA01
cgcggagauccccuccucca

SEQ ID NO: 3450333 - RNA, 19 nt, Pseudomonas aeruginosa PA01
cgcggagcaccgcgccuuc

SEQ ID NO: 3450334 - RNA, 20 nt, Pseudomonas aeruginosa PA01
cgcggccugcagcgacucca

SEQ ID NO: 3450335 - RNA, 16 nt, Pseudomonas aeruginosa PA01
cgcggccugcgccgga

SEQ ID NO: 3450336 - RNA, 13 nt, Pseudomonas aeruginosa PA01
cgcggccuguucg

SEQ ID NO: 3450337 - RNA, 15 nt, Pseudomonas aeruginosa PA01
cgcggccuucagcgg

SEQ ID NO: 3450338 - RNA, 20 nt, Pseudomonas aeruginosa PA01
cgcggccuucagcgguggcg

SEQ ID NO: 3450339 - RNA, 18 nt, Pseudomonas aeruginosa PA01
cgcggccuucucgucgcc

SEQ ID NO: 3450340 - RNA, 21 nt, Pseudomonas aeruginosa PA01
cgcggccuucucgucgccgcc

SEQ ID NO: 3450341 - RNA, 15 nt, Pseudomonas aeruginosa PA01
cgcggcgaacaucau

SEQ ID NO: 3450342 - RNA, 22 nt, Pseudomonas aeruginosa PA01
cgcggcgaacaucauccacagc

SEQ ID NO: 3450343 - RNA, 16 nt, Pseudomonas aeruginosa PA01
cgcggcgaagcgcucg

SEQ ID NO: 3450344 - RNA, 20 nt, Pseudomonas aeruginosa PA01
cgcggcgaagcguugcagcg

SEQ ID NO: 3450345 - RNA, 13 nt, Pseudomonas aeruginosa PA01
cgcggcgaagggc

SEQ ID NO: 3450346 - RNA, 19 nt, Pseudomonas aeruginosa PA01
cgcggcgacagcaccacgc

SEQ ID NO: 3450347 - RNA, 13 nt, Pseudomonas aeruginosa PA01
cgcggcgaccagc

SEQ ID NO: 3450348 - RNA, 16 nt, Pseudomonas aeruginosa PA01
cgcggcgaccagcgcg

SEQ ID NO: 3450349 - RNA, 22 nt, Pseudomonas aeruginosa PA01
cgcggcgaccauguucaccagc

SEQ ID NO: 3450350 - RNA, 23 nt, Pseudomonas aeruginosa PA01
cgcggcgaccauguucaccagcg

SEQ ID NO: 3450351 - RNA, 12 nt, Pseudomonas aeruginosa PA01
cgcggcgacgau

SEQ ID NO: 3450352 - RNA, 14 nt, Pseudomonas aeruginosa PA01
cgcggcgacgauca

SEQ ID NO: 3450353 - RNA, 21 nt, Pseudomonas aeruginosa PA01
cgcggcgacggcucuuccccu

SEQ ID NO: 3450354 - RNA, 20 nt, Pseudomonas aeruginosa PA01
cgcggcgagaacucguccgg

SEQ ID NO: 3450355 - RNA, 13 nt, Pseudomonas aeruginosa PA01
cgcggcgagcagc

SEQ ID NO: 3450356 - RNA, 17 nt, Pseudomonas aeruginosa PA01
cgcggcgagcagcggcg

SEQ ID NO: 3450357 - RNA, 19 nt, Pseudomonas aeruginosa PA01
cgcggcgagcagcggcgcu

SEQ ID NO: 3450358 - RNA, 14 nt, Pseudomonas aeruginosa PA01
cgcggcgagccggu

SEQ ID NO: 3450359 - RNA, 14 nt, Pseudomonas aeruginosa PA01
cgcggcgagggcgc

SEQ ID NO: 3450360 - RNA, 14 nt, Pseudomonas aeruginosa PA01
cgcggcgaguugcg

SEQ ID NO: 3450361 - RNA, 18 nt, Pseudomonas aeruginosa PA01
cgcggcgauaggcgcgca

SEQ ID NO: 3450362 - RNA, 13 nt, Pseudomonas aeruginosa PA01
cgcggcgauggcc

SEQ ID NO: 3450363 - RNA, 12 nt, Pseudomonas aeruginosa PA01
cgcggcgcagcg

SEQ ID NO: 3450364 - RNA, 14 nt, Pseudomonas aeruginosa PA01
cgcggcgcagcggc

SEQ ID NO: 3450365 - RNA, 15 nt, Pseudomonas aeruginosa PA01
cgcggcgcagcggcg

SEQ ID NO: 3450366 - RNA, 18 nt, Pseudomonas aeruginosa PA01
cgcggcgcaggcgaugau

SEQ ID NO: 3450367 - RNA, 22 nt, Pseudomonas aeruginosa PA01
cgcggcgcaggcugucggccag

SEQ ID NO: 3450368 - RNA, 23 nt, Pseudomonas aeruginosa PA01
cgcggcgcaggcugucggccagc

SEQ ID NO: 3450369 - RNA, 20 nt, Pseudomonas aeruginosa PA01
cgcggcgccagcgccccacc

SEQ ID NO: 3450370 - RNA, 23 nt, Pseudomonas aeruginosa PA01
cgcggcgccagcgccccaccagg

SEQ ID NO: 3450371 - RNA, 13 nt, Pseudomonas aeruginosa PA01
cgcggcgccccag

SEQ ID NO: 3450372 - RNA, 12 nt, Pseudomonas aeruginosa PA01
cgcggcgcccuc

SEQ ID NO: 3450373 - RNA, 18 nt, Pseudomonas aeruginosa PA01
cgcggcgcccucugccgg

SEQ ID NO: 3450374 - RNA, 24 nt, Pseudomonas aeruginosa PA01
cgcggcgcccucugccggucggaa

SEQ ID NO: 3450375 - RNA, 18 nt, Pseudomonas aeruginosa PA01
cgcggcgcccugccgggc

SEQ ID NO: 3450376 - RNA, 13 nt, Pseudomonas aeruginosa PA01
cgcggcgccugcu

SEQ ID NO: 3450377 - RNA, 15 nt, Pseudomonas aeruginosa PA01
cgcggcgccugcugc

SEQ ID NO: 3450378 - RNA, 22 nt, Pseudomonas aeruginosa PA01
cgcggcgccugcugcgcgggug

SEQ ID NO: 3450379 - RNA, 12 nt, Pseudomonas aeruginosa PA01
cgcggcgccugg

SEQ ID NO: 3450380 - RNA, 21 nt, Pseudomonas aeruginosa PA01
cgcggcgccuucagcgccgcc

SEQ ID NO: 3450381 - RNA, 22 nt, Pseudomonas aeruginosa PA01
cgcggcgccuucagcgccgcca

SEQ ID NO: 3450382 - RNA, 21 nt, Pseudomonas aeruginosa PA01
cgcggcgcgagaugaagcgcc

SEQ ID NO: 3450383 - RNA, 12 nt, Pseudomonas aeruginosa PA01
cgcggcgcgccu

SEQ ID NO: 3450384 - RNA, 13 nt, Pseudomonas aeruginosa PA01
cgcggcgcggcgg

SEQ ID NO: 3450385 - RNA, 13 nt, Pseudomonas aeruginosa PA01
cgcggcgcuccag

SEQ ID NO: 3450386 - RNA, 17 nt, Pseudomonas aeruginosa PA01
cgcggcgcuccaggcgg

SEQ ID NO: 3450387 - RNA, 18 nt, Pseudomonas aeruginosa PA01
cgcggcgcuccaggcggg

SEQ ID NO: 3450388 - RNA, 14 nt, Pseudomonas aeruginosa PA01
cgcggcgcucggca

SEQ ID NO: 3450389 - RNA, 21 nt, Pseudomonas aeruginosa PA01
cgcggcgcucggcaucgacca

SEQ ID NO: 3450390 - RNA, 15 nt, Pseudomonas aeruginosa PA01
cgcggcgcuuggcga

SEQ ID NO: 3450391 - RNA, 15 nt, Pseudomonas aeruginosa PA01
cgcggcgcuuguagc

SEQ ID NO: 3450392 - RNA, 20 nt, Pseudomonas aeruginosa PA01
cgcggcgcuuguagcccagg

SEQ ID NO: 3450393 - RNA, 21 nt, Pseudomonas aeruginosa PA01
cgcggcgcuuguagcccaggg

SEQ ID NO: 3450394 - RNA, 23 nt, Pseudomonas aeruginosa PA01
cgcggcggaagaauaccgccagc

SEQ ID NO: 3450395 - RNA, 16 nt, Pseudomonas aeruginosa PA01
cgcggcggacaggcag

SEQ ID NO: 3450396 - RNA, 17 nt, Pseudomonas aeruginosa PA01
cgcggcggacaggcagc

SEQ ID NO: 3450397 - RNA, 23 nt, Pseudomonas aeruginosa PA01
cgcggcggauaacgcccgcggcg

SEQ ID NO: 3450398 - RNA, 19 nt, Pseudomonas aeruginosa PA01
cgcggcggaugccggcgcu

SEQ ID NO: 3450399 - RNA, 23 nt, Pseudomonas aeruginosa PA01
cgcggcggaugccggcgcugucu

SEQ ID NO: 3450400 - RNA, 21 nt, Pseudomonas aeruginosa PA01
cgcggcggcaggccagcuucc

SEQ ID NO: 3450401 - RNA, 12 nt, Pseudomonas aeruginosa PA01
cgcggcggccuc

SEQ ID NO: 3450402 - RNA, 13 nt, Pseudomonas aeruginosa PA01
cgcggcggcgacg

SEQ ID NO: 3450403 - RNA, 11 nt, Pseudomonas aeruginosa PA01
cgcggcggcgc

SEQ ID NO: 3450404 - RNA, 14 nt, Pseudomonas aeruginosa PA01
cgcggcggcgcgga

SEQ ID NO: 3450405 - RNA, 14 nt, Pseudomonas aeruginosa PA01
cgcggcggcgcguc

SEQ ID NO: 3450406 - RNA, 16 nt, Pseudomonas aeruginosa PA01
cgcggcggcggccagc

SEQ ID NO: 3450407 - RNA, 23 nt, Pseudomonas aeruginosa PA01
cgcggcggcggccagcagcacgg

SEQ ID NO: 3450408 - RNA, 16 nt, Pseudomonas aeruginosa PA01
cgcggcggcggccgca

SEQ ID NO: 3450409 - RNA, 13 nt, Pseudomonas aeruginosa PA01
cgcggcggcgugc

SEQ ID NO: 3450410 - RNA, 19 nt, Pseudomonas aeruginosa PA01
cgcggcggcgugcaggccg

SEQ ID NO: 3450411 - RNA, 19 nt, Pseudomonas aeruginosa PA01
cgcggcggcuccggcgcca

SEQ ID NO: 3450412 - RNA, 23 nt, Pseudomonas aeruginosa PA01
cgcggcggcuccggcgccaggcc

SEQ ID NO: 3450413 - RNA, 23 nt, Pseudomonas aeruginosa PA01
cgcggcggguagagucgcucgcg

SEQ ID NO: 3450414 - RNA, 20 nt, Pseudomonas aeruginosa PA01
cgcggcggguggcgcugucg

SEQ ID NO: 3450415 - RNA, 22 nt, Pseudomonas aeruginosa PA01
cgcggcggguggcgcugucgcc

SEQ ID NO: 3450416 - RNA, 18 nt, Pseudomonas aeruginosa PA01
cgcggcguaccagccgcg

SEQ ID NO: 3450417 - RNA, 20 nt, Pseudomonas aeruginosa PA01
cgcggcguaccuucgagcag

SEQ ID NO: 3450418 - RNA, 21 nt, Pseudomonas aeruginosa PA01
cgcggcguaccuucgagcagg

SEQ ID NO: 3450419 - RNA, 18 nt, Pseudomonas aeruginosa PA01
cgcggcguaggcgcgcca

SEQ ID NO: 3450420 - RNA, 18 nt, Pseudomonas aeruginosa PA01
cgcggcguaggcggugcg

SEQ ID NO: 3450421 - RNA, 14 nt, Pseudomonas aeruginosa PA01
cgcggcgucggcga

SEQ ID NO: 3450422 - RNA, 18 nt, Pseudomonas aeruginosa PA01
cgcggcgucggcgaagcc

SEQ ID NO: 3450423 - RNA, 22 nt, Pseudomonas aeruginosa PA01
cgcggcgucggcgaagccugcg

SEQ ID NO: 3450424 - RNA, 22 nt, Pseudomonas aeruginosa PA01
cgcggcguggccggcgaccagc

SEQ ID NO: 3450425 - RNA, 23 nt, Pseudomonas aeruginosa PA01
cgcggcguggccggcgaccagcu

SEQ ID NO: 3450426 - RNA, 14 nt, Pseudomonas aeruginosa PA01
cgcggcguggcgga

SEQ ID NO: 3450427 - RNA, 17 nt, Pseudomonas aeruginosa PA01
cgcggcguuauccgccc

SEQ ID NO: 3450428 - RNA, 15 nt, Pseudomonas aeruginosa PA01
cgcggcguucaucgc

SEQ ID NO: 3450429 - RNA, 19 nt, Pseudomonas aeruginosa PA01
cgcggcguucaucgcucau

SEQ ID NO: 3450430 - RNA, 14 nt, Pseudomonas aeruginosa PA01
cgcggcguucgccc

SEQ ID NO: 3450431 - RNA, 15 nt, Pseudomonas aeruginosa PA01
cgcggcguucgcccu

SEQ ID NO: 3450432 - RNA, 15 nt, Pseudomonas aeruginosa PA01
cgcggcguugcgcgg

SEQ ID NO: 3450433 - RNA, 16 nt, Pseudomonas aeruginosa PA01
cgcggcguugucggcc

SEQ ID NO: 3450434 - RNA, 17 nt, Pseudomonas aeruginosa PA01
cgcggcguugucggcca

SEQ ID NO: 3450435 - RNA, 19 nt, Pseudomonas aeruginosa PA01
cgcggcguugucggccagc

SEQ ID NO: 3450436 - RNA, 16 nt, Pseudomonas aeruginosa PA01
cgcgggucaccaccgg

SEQ ID NO: 3450437 - RNA, 14 nt, Pseudomonas aeruginosa PA01
cgcgggucaccagc

SEQ ID NO: 3450438 - RNA, 17 nt, Pseudomonas aeruginosa PA01
cgcgggucaccagcgcc

SEQ ID NO: 3450439 - RNA, 17 nt, Pseudomonas aeruginosa PA01
cgcgggucaucggcccg

SEQ ID NO: 3450440 - RNA, 23 nt, Pseudomonas aeruginosa PA01
cgcgggucaucggcccgacgccg

SEQ ID NO: 3450441 - RNA, 23 nt, Pseudomonas aeruginosa PA01
cgcgggucguacaccgcgcggca

SEQ ID NO: 3450442 - RNA, 19 nt, Pseudomonas aeruginosa PA01
cgcgggucucgaucagcgc

SEQ ID NO: 3450443 - RNA, 21 nt, Pseudomonas aeruginosa PA01
cgcgggucucgaucagcgccg

SEQ ID NO: 3450444 - RNA, 22 nt, Pseudomonas aeruginosa PA01
cgcgggucucgaucagcgccgg

SEQ ID NO: 3450445 - RNA, 18 nt, Pseudomonas aeruginosa PA01
cgcgggucugcgccucgc

SEQ ID NO: 3450446 - RNA, 12 nt, Pseudomonas aeruginosa PA01
cgcgggucugcu

SEQ ID NO: 3450447 - RNA, 14 nt, Pseudomonas aeruginosa PA01
cgcgggucugcucg

SEQ ID NO: 3450448 - RNA, 15 nt, Pseudomonas aeruginosa PA01
cgcgggucugcucgg

SEQ ID NO: 3450449 - RNA, 18 nt, Pseudomonas aeruginosa PA01
cgcgggucugcucggcgc

SEQ ID NO: 3450450 - RNA, 19 nt, Pseudomonas aeruginosa PA01
cgcgggucugcucggcgcc

SEQ ID NO: 3450451 - RNA, 21 nt, Pseudomonas aeruginosa PA01
cgcgggucuugccggucugcu

SEQ ID NO: 3450452 - RNA, 18 nt, Pseudomonas aeruginosa PA01
cgcgggucuugcgcaggg

SEQ ID NO: 3450453 - RNA, 20 nt, Pseudomonas aeruginosa PA01
cgcgggucuugcgcagggcg

SEQ ID NO: 3450454 - RNA, 16 nt, Pseudomonas aeruginosa PA01
cgcgggugcggcuggc

SEQ ID NO: 3450455 - RNA, 17 nt, Pseudomonas aeruginosa PA01
cgcggguggcaaccgac

SEQ ID NO: 3450456 - RNA, 17 nt, Pseudomonas aeruginosa PA01
cgcggguuacuucgccg

SEQ ID NO: 3450457 - RNA, 19 nt, Pseudomonas aeruginosa PA01
cgcggguuccucacggcgc

SEQ ID NO: 3450458 - RNA, 18 nt, Pseudomonas aeruginosa PA01
cgcggguuuccgugcgcu

SEQ ID NO: 3450459 - RNA, 12 nt, Pseudomonas aeruginosa PA01
cgcgguaacgga

SEQ ID NO: 3450460 - RNA, 15 nt, Pseudomonas aeruginosa PA01
cgcgguacagccggu

SEQ ID NO: 3450461 - RNA, 22 nt, Pseudomonas aeruginosa PA01
cgcgguacccggcagggccagc

SEQ ID NO: 3450462 - RNA, 14 nt, Pseudomonas aeruginosa PA01
cgcgguagacgcag

SEQ ID NO: 3450463 - RNA, 16 nt, Pseudomonas aeruginosa PA01
cgcgguagcugcgcag

SEQ ID NO: 3450464 - RNA, 18 nt, Pseudomonas aeruginosa PA01
cgcgguagcugcgcaggg

SEQ ID NO: 3450465 - RNA, 19 nt, Pseudomonas aeruginosa PA01
cgcgguagcugcgcagggc

SEQ ID NO: 3450466 - RNA, 20 nt, Pseudomonas aeruginosa PA01
cgcgguagcugcgcagggcg

SEQ ID NO: 3450467 - RNA, 14 nt, Pseudomonas aeruginosa PA01
cgcgguaggccagc

SEQ ID NO: 3450468 - RNA, 19 nt, Pseudomonas aeruginosa PA01
cgcgguagggaucgucgcc

SEQ ID NO: 3450469 - RNA, 21 nt, Pseudomonas aeruginosa PA01
cgcgguagggaucgucgccaa

SEQ ID NO: 3450470 - RNA, 16 nt, Pseudomonas aeruginosa PA01
cgcgguauucuccagc

SEQ ID NO: 3450471 - RNA, 18 nt, Pseudomonas aeruginosa PA01
cgcgguauucuccagcag

SEQ ID NO: 3450472 - RNA, 21 nt, Pseudomonas aeruginosa PA01
cgcggucaccagggucacgcc

SEQ ID NO: 3450473 - RNA, 23 nt, Pseudomonas aeruginosa PA01
cgcggucaccagggucacgccgc

SEQ ID NO: 3450474 - RNA, 13 nt, Pseudomonas aeruginosa PA01
cgcggucacccau

SEQ ID NO: 3450475 - RNA, 22 nt, Pseudomonas aeruginosa PA01
cgcggucacccauucgaugccg

SEQ ID NO: 3450476 - RNA, 14 nt, Pseudomonas aeruginosa PA01
cgcggucacucggc

SEQ ID NO: 3450477 - RNA, 16 nt, Pseudomonas aeruginosa PA01
cgcggucacucggccu

SEQ ID NO: 3450478 - RNA, 18 nt, Pseudomonas aeruginosa PA01
cgcggucacucggccucg

SEQ ID NO: 3450479 - RNA, 17 nt, Pseudomonas aeruginosa PA01
cgcggucauccgcccug

SEQ ID NO: 3450480 - RNA, 22 nt, Pseudomonas aeruginosa PA01
cgcggucauccgcccugcgucg

SEQ ID NO: 3450481 - RNA, 14 nt, Pseudomonas aeruginosa PA01
cgcggucaucgccg

SEQ ID NO: 3450482 - RNA, 15 nt, Pseudomonas aeruginosa PA01
cgcgguccaucccuu

SEQ ID NO: 3450483 - RNA, 21 nt, Pseudomonas aeruginosa PA01
cgcggucccuggaucugcggg

SEQ ID NO: 3450484 - RNA, 14 nt, Pseudomonas aeruginosa PA01
cgcggucgagcagc

SEQ ID NO: 3450485 - RNA, 18 nt, Pseudomonas aeruginosa PA01
cgcggucgagcagcgccg

SEQ ID NO: 3450486 - RNA, 19 nt, Pseudomonas aeruginosa PA01
cgcggucgagcagcgccgc

SEQ ID NO: 3450487 - RNA, 20 nt, Pseudomonas aeruginosa PA01
cgcggucgagcagcgccgcg

SEQ ID NO: 3450488 - RNA, 19 nt, Pseudomonas aeruginosa PA01
cgcggucgagcucggccag

SEQ ID NO: 3450489 - RNA, 22 nt, Pseudomonas aeruginosa PA01
cgcggucgggcagauguccagg

SEQ ID NO: 3450490 - RNA, 19 nt, Pseudomonas aeruginosa PA01
cgcggucggguccgggccc

SEQ ID NO: 3450491 - RNA, 17 nt, Pseudomonas aeruginosa PA01
cgcggucggugagcacg

SEQ ID NO: 3450492 - RNA, 20 nt, Pseudomonas aeruginosa PA01
cgcggucggugagcacgccg

SEQ ID NO: 3450493 - RNA, 22 nt, Pseudomonas aeruginosa PA01
cgcggucggugagcacgccgcg

SEQ ID NO: 3450494 - RNA, 21 nt, Pseudomonas aeruginosa PA01
cgcggucucgcguucaucguc

SEQ ID NO: 3450495 - RNA, 23 nt, Pseudomonas aeruginosa PA01
cgcggucucgcguucaucgucgg

SEQ ID NO: 3450496 - RNA, 16 nt, Pseudomonas aeruginosa PA01
cgcggucucuucgucg

SEQ ID NO: 3450497 - RNA, 21 nt, Pseudomonas aeruginosa PA01
cgcggucucuucgucggucau

SEQ ID NO: 3450498 - RNA, 18 nt, Pseudomonas aeruginosa PA01
cgcggucuucaucaccuu

SEQ ID NO: 3450499 - RNA, 21 nt, Pseudomonas aeruginosa PA01
cgcggucuucccguaaggcca

SEQ ID NO: 3450500 - RNA, 23 nt, Pseudomonas aeruginosa PA01
cgcggucuucccguaaggccagg

SEQ ID NO: 3450501 - RNA, 17 nt, Pseudomonas aeruginosa PA01
cgcggucuuccgccgac

SEQ ID NO: 3450502 - RNA, 20 nt, Pseudomonas aeruginosa PA01
cgcggucuuccgccgacugc

SEQ ID NO: 3450503 - RNA, 13 nt, Pseudomonas aeruginosa PA01
cgcggucuucgcg

SEQ ID NO: 3450504 - RNA, 14 nt, Pseudomonas aeruginosa PA01
cgcggugagggcga

SEQ ID NO: 3450505 - RNA, 23 nt, Pseudomonas aeruginosa PA01
cgcggugcaguucgccguucagc

SEQ ID NO: 3450506 - RNA, 21 nt, Pseudomonas aeruginosa PA01
cgcggugccauucggugcgcu

SEQ ID NO: 3450507 - RNA, 12 nt, Pseudomonas aeruginosa PA01
cgcggugccgcc

SEQ ID NO: 3450508 - RNA, 17 nt, Pseudomonas aeruginosa PA01
cgcggugcgcgccauca

SEQ ID NO: 3450509 - RNA, 19 nt, Pseudomonas aeruginosa PA01
cgcggugcgguuguucgcc

SEQ ID NO: 3450510 - RNA, 12 nt, Pseudomonas aeruginosa PA01
cgcgguggaggc

SEQ ID NO: 3450511 - RNA, 16 nt, Pseudomonas aeruginosa PA01
cgcgguggaggcggcg

SEQ ID NO: 3450512 - RNA, 18 nt, Pseudomonas aeruginosa PA01
cgcgguggaggcggcggu

SEQ ID NO: 3450513 - RNA, 20 nt, Pseudomonas aeruginosa PA01
cgcgguggaggcggcgguca

SEQ ID NO: 3450514 - RNA, 13 nt, Pseudomonas aeruginosa PA01
cgcggugggccuu

SEQ ID NO: 3450515 - RNA, 19 nt, Pseudomonas aeruginosa PA01
cgcggugggcuccagcggg

SEQ ID NO: 3450516 - RNA, 22 nt, Pseudomonas aeruginosa PA01
cgcggugucggugcccucgcgg

SEQ ID NO: 3450517 - RNA, 21 nt, Pseudomonas aeruginosa PA01
cgcggugugcuuguccaccac

SEQ ID NO: 3450518 - RNA, 14 nt, Pseudomonas aeruginosa PA01
cgcgguuauccgcc

SEQ ID NO: 3450519 - RNA, 16 nt, Pseudomonas aeruginosa PA01
cgcgguuauccgccga

SEQ ID NO: 3450520 - RNA, 21 nt, Pseudomonas aeruginosa PA01
cgcgguuauccgccgccgggc

SEQ ID NO: 3450521 - RNA, 18 nt, Pseudomonas aeruginosa PA01
cgcgguuauccgccgccu

SEQ ID NO: 3450522 - RNA, 16 nt, Pseudomonas aeruginosa PA01
cgcgguuauccgccgg

SEQ ID NO: 3450523 - RNA, 17 nt, Pseudomonas aeruginosa PA01
cgcgguuauccgccgga

SEQ ID NO: 3450524 - RNA, 21 nt, Pseudomonas aeruginosa PA01
cgcgguuccagcucgucgagc

SEQ ID NO: 3450525 - RNA, 19 nt, Pseudomonas aeruginosa PA01
cgcgguugccgcugcggcg

SEQ ID NO: 3450526 - RNA, 13 nt, Pseudomonas aeruginosa PA01
cgcgguugcgcug

SEQ ID NO: 3450527 - RNA, 14 nt, Pseudomonas aeruginosa PA01
cgcgguuucgcagc

SEQ ID NO: 3450528 - RNA, 15 nt, Pseudomonas aeruginosa PA01
cgcgguuucgcagcg

SEQ ID NO: 3450529 - RNA, 16 nt, Pseudomonas aeruginosa PA01
cgcgguuucgcagcgc

SEQ ID NO: 3450530 - RNA, 19 nt, Pseudomonas aeruginosa PA01
cgcgguuucgcagcgcucc

SEQ ID NO: 3450531 - RNA, 13 nt, Pseudomonas aeruginosa PA01
cgcguaagcggcc

SEQ ID NO: 3450532 - RNA, 16 nt, Pseudomonas aeruginosa PA01
cgcguaauaggcgaag

SEQ ID NO: 3450533 - RNA, 22 nt, Pseudomonas aeruginosa PA01
cgcguaauaggcgaagcggcuc

SEQ ID NO: 3450534 - RNA, 15 nt, Pseudomonas aeruginosa PA01
cgcguacaucccgcc

SEQ ID NO: 3450535 - RNA, 16 nt, Pseudomonas aeruginosa PA01
cgcguaccaguagcga

SEQ ID NO: 3450536 - RNA, 14 nt, Pseudomonas aeruginosa PA01
cgcguacgacuucg

SEQ ID NO: 3450537 - RNA, 21 nt, Pseudomonas aeruginosa PA01
cgcguacggucuugcgcuugc

SEQ ID NO: 3450538 - RNA, 23 nt, Pseudomonas aeruginosa PA01
cgcucaggcugugcaggaaggcg

SEQ ID NO: 3450539 - RNA, 20 nt, Pseudomonas aeruginosa PA01
cgcucagggaauggaugcgc

SEQ ID NO: 3450540 - RNA, 22 nt, Pseudomonas aeruginosa PA01
cgcucagggaauggaugcgcgg

SEQ ID NO: 3450541 - RNA, 15 nt, Pseudomonas aeruginosa PA01
cgcucagggacaccc

SEQ ID NO: 3450542 - RNA, 16 nt, Pseudomonas aeruginosa PA01
cgcucaggguggcguu

SEQ ID NO: 3450543 - RNA, 17 nt, Pseudomonas aeruginosa PA01
cgcucaggucggucgaa

SEQ ID NO: 3450544 - RNA, 23 nt, Pseudomonas aeruginosa PA01
cgcucauccgcugguagcccagg

SEQ ID NO: 3450545 - RNA, 15 nt, Pseudomonas aeruginosa PA01
cgcucaucugcacca

SEQ ID NO: 3450546 - RNA, 23 nt, Pseudomonas aeruginosa PA01
cgcucaugagauccgccagcaga

SEQ ID NO: 3450547 - RNA, 13 nt, Pseudomonas aeruginosa PA01
cgcucauggcgcc

SEQ ID NO: 3450548 - RNA, 23 nt, Pseudomonas aeruginosa PA01
cgcucaugugggcuaccgcaucg

SEQ ID NO: 3450549 - RNA, 18 nt, Pseudomonas aeruginosa PA01
cgcuccaacagcagguag

SEQ ID NO: 3450550 - RNA, 19 nt, Pseudomonas aeruginosa PA01
cgcuccaacagcagguaga

SEQ ID NO: 3450551 - RNA, 18 nt, Pseudomonas aeruginosa PA01
cgcuccaacgcaggcgca

SEQ ID NO: 3450552 - RNA, 14 nt, Pseudomonas aeruginosa PA01
cgcuccacagcugc

SEQ ID NO: 3450553 - RNA, 15 nt, Pseudomonas aeruginosa PA01
cgcuccacagcugcc

SEQ ID NO: 3450554 - RNA, 18 nt, Pseudomonas aeruginosa PA01
cgcuccacagcugccagc

SEQ ID NO: 3450555 - RNA, 22 nt, Pseudomonas aeruginosa PA01
cgcuccaccagggccucggggc

SEQ ID NO: 3450556 - RNA, 14 nt, Pseudomonas aeruginosa PA01
cgcuccacccaggc

SEQ ID NO: 3450557 - RNA, 15 nt, Pseudomonas aeruginosa PA01
cgcuccacccaggcg

SEQ ID NO: 3450558 - RNA, 16 nt, Pseudomonas aeruginosa PA01
cgcuccacccaggcgc

SEQ ID NO: 3450559 - RNA, 17 nt, Pseudomonas aeruginosa PA01
cgcuccacccaggcgcc

SEQ ID NO: 3450560 - RNA, 19 nt, Pseudomonas aeruginosa PA01
cgcuccacccaggcgccga

SEQ ID NO: 3450561 - RNA, 20 nt, Pseudomonas aeruginosa PA01
cgcuccacccaggcgccgau

SEQ ID NO: 3450562 - RNA, 18 nt, Pseudomonas aeruginosa PA01
cgcuccaccgcccccggc

SEQ ID NO: 3450563 - RNA, 20 nt, Pseudomonas aeruginosa PA01
cgcuccaccgcccccggcgc

SEQ ID NO: 3450564 - RNA, 14 nt, Pseudomonas aeruginosa PA01
cgcuccagccggca

SEQ ID NO: 3450565 - RNA, 11 nt, Pseudomonas aeruginosa PA01
cgcuccagcgc

SEQ ID NO: 3450566 - RNA, 12 nt, Pseudomonas aeruginosa PA01
cgcuccagcgcc

SEQ ID NO: 3450567 - RNA, 21 nt, Pseudomonas aeruginosa PA01
cgcuccagcgccucgaccaga

SEQ ID NO: 3450568 - RNA, 16 nt, Pseudomonas aeruginosa PA01
cgcuccagcggcagcu

SEQ ID NO: 3450569 - RNA, 23 nt, Pseudomonas aeruginosa PA01
cgcuccagcggcagcucggcgac

SEQ ID NO: 3450570 - RNA, 18 nt, Pseudomonas aeruginosa PA01
cgcuccagcuccuccagc

SEQ ID NO: 3450571 - RNA, 17 nt, Pseudomonas aeruginosa PA01
cgcuccaggaucgccuc

SEQ ID NO: 3450572 - RNA, 13 nt, Pseudomonas aeruginosa PA01
cgcuccaggcccg

SEQ ID NO: 3450573 - RNA, 15 nt, Pseudomonas aeruginosa PA01
cgcuccaggcccggc

SEQ ID NO: 3450574 - RNA, 16 nt, Pseudomonas aeruginosa PA01
cgcuccaggcgguagu

SEQ ID NO: 3450575 - RNA, 13 nt, Pseudomonas aeruginosa PA01
cgcuccagggcgc

SEQ ID NO: 3450576 - RNA, 14 nt, Pseudomonas aeruginosa PA01
cgcuccagggcgcu

SEQ ID NO: 3450577 - RNA, 22 nt, Pseudomonas aeruginosa PA01
cgcuccaggugcacggccaggc

SEQ ID NO: 3450578 - RNA, 15 nt, Pseudomonas aeruginosa PA01
cgcuccagucggggc

SEQ ID NO: 3450579 - RNA, 20 nt, Pseudomonas aeruginosa PA01
cgcuccauccagucggcgcu

SEQ ID NO: 3450580 - RNA, 20 nt, Pseudomonas aeruginosa PA01
cgcucccaacagucgucgcg

SEQ ID NO: 3450581 - RNA, 23 nt, Pseudomonas aeruginosa PA01
cgcucccaccgcuuucagcgccg

SEQ ID NO: 3450582 - RNA, 12 nt, Pseudomonas aeruginosa PA01
cgcucccaggcu

SEQ ID NO: 3450583 - RNA, 15 nt, Pseudomonas aeruginosa PA01
cgcucccaggcucac

SEQ ID NO: 3450584 - RNA, 18 nt, Pseudomonas aeruginosa PA01
cgcucccaggcucacgca

SEQ ID NO: 3450585 - RNA, 23 nt, Pseudomonas aeruginosa PA01
cgcucccauucgcugucgucggc

SEQ ID NO: 3450586 - RNA, 13 nt, Pseudomonas aeruginosa PA01
cgcuccccugccg

SEQ ID NO: 3450587 - RNA, 13 nt, Pseudomonas aeruginosa PA01
cgcucccgcggcc

SEQ ID NO: 3450588 - RNA, 18 nt, Pseudomonas aeruginosa PA01
cgcuccgacuccugcaac

SEQ ID NO: 3450589 - RNA, 15 nt, Pseudomonas aeruginosa PA01
cgcuccgagcaggcc

SEQ ID NO: 3450590 - RNA, 21 nt, Pseudomonas aeruginosa PA01
cgcuccgcaucuucugcgcgu

SEQ ID NO: 3450591 - RNA, 13 nt, Pseudomonas aeruginosa PA01
cgcuccgccaggc

SEQ ID NO: 3450592 - RNA, 14 nt, Pseudomonas aeruginosa PA01
cgcuccgccaggcc

SEQ ID NO: 3450593 - RNA, 20 nt, Pseudomonas aeruginosa PA01
cgcuccgccaggccgcgcag

SEQ ID NO: 3450594 - RNA, 23 nt, Pseudomonas aeruginosa PA01
cgcuccgccaggccgcgcagucc

SEQ ID NO: 3450595 - RNA, 17 nt, Pseudomonas aeruginosa PA01
cgcuccgccgaacgcca

SEQ ID NO: 3450596 - RNA, 18 nt, Pseudomonas aeruginosa PA01
cgcuccgcgccacgcucu

SEQ ID NO: 3450597 - RNA, 15 nt, Pseudomonas aeruginosa PA01
cgcuccgcggccggc

SEQ ID NO: 3450598 - RNA, 17 nt, Pseudomonas aeruginosa PA01
cgcuccggaacgccugc

SEQ ID NO: 3450599 - RNA, 13 nt, Pseudomonas aeruginosa PA01
cgcuccggcucuc

SEQ ID NO: 3450600 - RNA, 15 nt, Pseudomonas aeruginosa PA01
cgcuccggcucuccc

SEQ ID NO: 3450601 - RNA, 18 nt, Pseudomonas aeruginosa PA01
cgcuccggcugcgcggag

SEQ ID NO: 3450602 - RNA, 16 nt, Pseudomonas aeruginosa PA01
cgcuccgggcccgugc

SEQ ID NO: 3450603 - RNA, 23 nt, Pseudomonas aeruginosa PA01
cgcuccgggcccgugcggcacgc

SEQ ID NO: 3450604 - RNA, 19 nt, Pseudomonas aeruginosa PA01
cgcuccgggcuccaccagu

SEQ ID NO: 3450605 - RNA, 13 nt, Pseudomonas aeruginosa PA01
cgcuccggugcca

SEQ ID NO: 3450606 - RNA, 15 nt, Pseudomonas aeruginosa PA01
cgcuccggugccagg

SEQ ID NO: 3450607 - RNA, 16 nt, Pseudomonas aeruginosa PA01
cgcuccgucgcuucgc

SEQ ID NO: 3450608 - RNA, 18 nt, Pseudomonas aeruginosa PA01
cgcuccgucgcuucgccc

SEQ ID NO: 3450609 - RNA, 19 nt, Pseudomonas aeruginosa PA01
cgcuccucagaggcgacca

SEQ ID NO: 3450610 - RNA, 21 nt, Pseudomonas aeruginosa PA01
cgcuccucagaggcgaccagc

SEQ ID NO: 3450611 - RNA, 15 nt, Pseudomonas aeruginosa PA01
cgcuccuccagcgcc

SEQ ID NO: 3450612 - RNA, 17 nt, Pseudomonas aeruginosa PA01
cgcuccuccagcgccgc

SEQ ID NO: 3450613 - RNA, 14 nt, Pseudomonas aeruginosa PA01
cgcuccuccucgcu

SEQ ID NO: 3450614 - RNA, 15 nt, Pseudomonas aeruginosa PA01
cgcuccucgauccgc

SEQ ID NO: 3450615 - RNA, 15 nt, Pseudomonas aeruginosa PA01
cgcuccucgcgcugc

SEQ ID NO: 3450616 - RNA, 21 nt, Pseudomonas aeruginosa PA01
cgcuccucgcgcugcccggcg

SEQ ID NO: 3450617 - RNA, 16 nt, Pseudomonas aeruginosa PA01
cgcuccugcgccggcu

SEQ ID NO: 3450618 - RNA, 17 nt, Pseudomonas aeruginosa PA01
cgcuccugcgccggcuc

SEQ ID NO: 3450619 - RNA, 15 nt, Pseudomonas aeruginosa PA01
cgcuccuggcaggcu

SEQ ID NO: 3450620 - RNA, 18 nt, Pseudomonas aeruginosa PA01
cgcuccuggcaggcucac

SEQ ID NO: 3450621 - RNA, 19 nt, Pseudomonas aeruginosa PA01
cgcuccuggugcggcacca

SEQ ID NO: 3450622 - RNA, 18 nt, Pseudomonas aeruginosa PA01
cgcuccuguugcuggccg

SEQ ID NO: 3450623 - RNA, 18 nt, Pseudomonas aeruginosa PA01
cgcuccuucuccggggcc

SEQ ID NO: 3450624 - RNA, 16 nt, Pseudomonas aeruginosa PA01
cgcuccuugagcagcu

SEQ ID NO: 3450625 - RNA, 17 nt, Pseudomonas aeruginosa PA01
cgcuccuugcgccaggc

SEQ ID NO: 3450626 - RNA, 22 nt, Pseudomonas aeruginosa PA01
cgcuccuuggcuggccagcccu

SEQ ID NO: 3450627 - RNA, 21 nt, Pseudomonas aeruginosa PA01
cgcuccuuguagaacggcggc

SEQ ID NO: 3450628 - RNA, 13 nt, Pseudomonas aeruginosa PA01
cgcuccuuuggcg

SEQ ID NO: 3450629 - RNA, 21 nt, Pseudomonas aeruginosa PA01
cgcuccuuuggcgucgaugcg

SEQ ID NO: 3450630 - RNA, 19 nt, Pseudomonas aeruginosa PA01
cgcucgacauacuccgccg

SEQ ID NO: 3450631 - RNA, 20 nt, Pseudomonas aeruginosa PA01
cgcucgacauacuccgccgc

SEQ ID NO: 3450632 - RNA, 21 nt, Pseudomonas aeruginosa PA01
cgcucgacauacuccgccgcu

SEQ ID NO: 3450633 - RNA, 22 nt, Pseudomonas aeruginosa PA01
cgcucgaccuugccgagcgcga

SEQ ID NO: 3450634 - RNA, 22 nt, Pseudomonas aeruginosa PA01
cgcucgacgaucaggugcagga

SEQ ID NO: 3450635 - RNA, 13 nt, Pseudomonas aeruginosa PA01
cgcucgagccggc

SEQ ID NO: 3450636 - RNA, 14 nt, Pseudomonas aeruginosa PA01
cgcucgagccggcu

SEQ ID NO: 3450637 - RNA, 15 nt, Pseudomonas aeruginosa PA01
cgcucgagccggcug

SEQ ID NO: 3450638 - RNA, 16 nt, Pseudomonas aeruginosa PA01
cgcucgagccggcuga

SEQ ID NO: 3450639 - RNA, 15 nt, Pseudomonas aeruginosa PA01
cgcucgagcuugagg

SEQ ID NO: 3450640 - RNA, 21 nt, Pseudomonas aeruginosa PA01
cgcucgagcuugaggucggcc

SEQ ID NO: 3450641 - RNA, 17 nt, Pseudomonas aeruginosa PA01
cgcucucgaacaccggc

SEQ ID NO: 3450642 - RNA, 17 nt, Pseudomonas aeruginosa PA01
cgcucucgaacagcagc

SEQ ID NO: 3450643 - RNA, 21 nt, Pseudomonas aeruginosa PA01
cgcucucgaacagcagcaagc

SEQ ID NO: 3450644 - RNA, 21 nt, Pseudomonas aeruginosa PA01
cgcucucgccgccuucggcag

SEQ ID NO: 3450645 - RNA, 12 nt, Pseudomonas aeruginosa PA01
cgcucucgguga

SEQ ID NO: 3450646 - RNA, 17 nt, Pseudomonas aeruginosa PA01
cgcucucggugaccacc

SEQ ID NO: 3450647 - RNA, 22 nt, Pseudomonas aeruginosa PA01
cgcucugcaccgucauggugcg

SEQ ID NO: 3450648 - RNA, 19 nt, Pseudomonas aeruginosa PA01
cgcucugccagaaggccug

SEQ ID NO: 3450649 - RNA, 22 nt, Pseudomonas aeruginosa PA01
cgcucugccagaaggccugcgc

SEQ ID NO: 3450650 - RNA, 23 nt, Pseudomonas aeruginosa PA01
cgcucugccagaaggccugcgcu

SEQ ID NO: 3450651 - RNA, 14 nt, Pseudomonas aeruginosa PA01
cgcucugcccgacc

SEQ ID NO: 3450652 - RNA, 20 nt, Pseudomonas aeruginosa PA01
cgcucugcugaauucccgcu

SEQ ID NO: 3450653 - RNA, 12 nt, Pseudomonas aeruginosa PA01
cgcucugcuggc

SEQ ID NO: 3450654 - RNA, 17 nt, Pseudomonas aeruginosa PA01
cgcucugcuggccaccc

SEQ ID NO: 3450655 - RNA, 19 nt, Pseudomonas aeruginosa PA01
cgcucugcuggccacccuu

SEQ ID NO: 3450656 - RNA, 21 nt, Pseudomonas aeruginosa PA01
cgcucugcuggccacccuugc

SEQ ID NO: 3450657 - RNA, 14 nt, Pseudomonas aeruginosa PA01
cgcucugcuggccg

SEQ ID NO: 3450658 - RNA, 16 nt, Pseudomonas aeruginosa PA01
cgcucugcuggccgcc

SEQ ID NO: 3450659 - RNA, 19 nt, Pseudomonas aeruginosa PA01
cgcucugcuggccgcccuu

SEQ ID NO: 3450660 - RNA, 22 nt, Pseudomonas aeruginosa PA01
cgcucugcuggccgcccuugcg

SEQ ID NO: 3450661 - RNA, 17 nt, Pseudomonas aeruginosa PA01
cgcucuggcccagcuug

SEQ ID NO: 3450662 - RNA, 13 nt, Pseudomonas aeruginosa PA01
cgcucuggccgcg

SEQ ID NO: 3450663 - RNA, 15 nt, Pseudomonas aeruginosa PA01
cgcucuggccgcgcu

SEQ ID NO: 3450664 - RNA, 18 nt, Pseudomonas aeruginosa PA01
cgcucuggccgcgcucca

SEQ ID NO: 3450665 - RNA, 16 nt, Pseudomonas aeruginosa PA01
cgcucuggcugcuggc

SEQ ID NO: 3450666 - RNA, 20 nt, Pseudomonas aeruginosa PA01
cgcucuguagggucgcagca

SEQ ID NO: 3450667 - RNA, 22 nt, Pseudomonas aeruginosa PA01
cgcucuguagggucgcagcagg

SEQ ID NO: 3450668 - RNA, 23 nt, Pseudomonas aeruginosa PA01
cgcucuguagggucgcagcaggc

SEQ ID NO: 3450669 - RNA, 18 nt, Pseudomonas aeruginosa PA01
cgcucuguuucgggucgc

SEQ ID NO: 3450670 - RNA, 19 nt, Pseudomonas aeruginosa PA01
cgcucuguuucgggucgcc

SEQ ID NO: 3450671 - RNA, 22 nt, Pseudomonas aeruginosa PA01
cgcucuucacuuccagcugcca

SEQ ID NO: 3450672 - RNA, 14 nt, Pseudomonas aeruginosa PA01
cgcucuucagcacg

SEQ ID NO: 3450673 - RNA, 17 nt, Pseudomonas aeruginosa PA01
cgcucuucagcacgccc

SEQ ID NO: 3450674 - RNA, 17 nt, Pseudomonas aeruginosa PA01
cgcucuucgccgcggcg

SEQ ID NO: 3450675 - RNA, 23 nt, Pseudomonas aeruginosa PA01
cgcucuucgccgcggcguaggcg

SEQ ID NO: 3450676 - RNA, 19 nt, Pseudomonas aeruginosa PA01
cgcucuucugguaggccag

SEQ ID NO: 3450677 - RNA, 20 nt, Pseudomonas aeruginosa PA01
cgcucuugauacccaccggc

SEQ ID NO: 3450678 - RNA, 16 nt, Pseudomonas aeruginosa PA01
cgcugaaacgcgcguc

SEQ ID NO: 3450679 - RNA, 17 nt, Pseudomonas aeruginosa PA01
cgcugaaacgcgcgucc

SEQ ID NO: 3450680 - RNA, 20 nt, Pseudomonas aeruginosa PA01
cgcugaaauagcgcgucauc

SEQ ID NO: 3450681 - RNA, 19 nt, Pseudomonas aeruginosa PA01
cgcugaaauccaccagcac

SEQ ID NO: 3450682 - RNA, 12 nt, Pseudomonas aeruginosa PA01
cgcugaaaucgg

SEQ ID NO: 3450683 - RNA, 21 nt, Pseudomonas aeruginosa PA01
cgcugaacaagcccugguggu

SEQ ID NO: 3450684 - RNA, 21 nt, Pseudomonas aeruginosa PA01
cgcugaaccgcgucaugcucu

SEQ ID NO: 3450685 - RNA, 22 nt, Pseudomonas aeruginosa PA01
cgcugaaccgcgucaugcucuc

SEQ ID NO: 3450686 - RNA, 18 nt, Pseudomonas aeruginosa PA01
cgcugaagaucgccacga

SEQ ID NO: 3450687 - RNA, 17 nt, Pseudomonas aeruginosa PA01
cgcugaagcggccgaga

SEQ ID NO: 3450688 - RNA, 18 nt, Pseudomonas aeruginosa PA01
cgcugaaggucgccgcgc

SEQ ID NO: 3450689 - RNA, 19 nt, Pseudomonas aeruginosa PA01
cgcugaaggucgccgcgcu

SEQ ID NO: 3450690 - RNA, 17 nt, Pseudomonas aeruginosa PA01
cgcugaaguccuggccg

SEQ ID NO: 3450691 - RNA, 19 nt, Pseudomonas aeruginosa PA01
cgcugaaguccuggccgag

SEQ ID NO: 3450692 - RNA, 20 nt, Pseudomonas aeruginosa PA01
cgcugaaguccuggccgagc

SEQ ID NO: 3450693 - RNA, 22 nt, Pseudomonas aeruginosa PA01
cgcugaauaccaccgggccguc

SEQ ID NO: 3450694 - RNA, 13 nt, Pseudomonas aeruginosa PA01
cgcugaccacccg

SEQ ID NO: 3450695 - RNA, 15 nt, Pseudomonas aeruginosa PA01
cgcugaccacccggu

SEQ ID NO: 3450696 - RNA, 19 nt, Pseudomonas aeruginosa PA01
cgcugaccacccggugcag

SEQ ID NO: 3450697 - RNA, 15 nt, Pseudomonas aeruginosa PA01
cgcugaccagcccgg

SEQ ID NO: 3450698 - RNA, 18 nt, Pseudomonas aeruginosa PA01
cgcugaccagcccggcgg

SEQ ID NO: 3450699 - RNA, 19 nt, Pseudomonas aeruginosa PA01
cgcugaccagcccggcggc

SEQ ID NO: 3450700 - RNA, 22 nt, Pseudomonas aeruginosa PA01
cgcugaccaggucguggaaggc

SEQ ID NO: 3450701 - RNA, 23 nt, Pseudomonas aeruginosa PA01
cgcugaccaggucguggaaggcu

SEQ ID NO: 3450702 - RNA, 18 nt, Pseudomonas aeruginosa PA01
cgcugacccagcgcacgc

SEQ ID NO: 3450703 - RNA, 24 nt, Pseudomonas aeruginosa PA01
cgcugacccaggcuucggcgcgcu

SEQ ID NO: 3450704 - RNA, 17 nt, Pseudomonas aeruginosa PA01
cgcugaccgcgaauggc

SEQ ID NO: 3450705 - RNA, 18 nt, Pseudomonas aeruginosa PA01
cgcugaccgcgaauggca

SEQ ID NO: 3450706 - RNA, 15 nt, Pseudomonas aeruginosa PA01
cgcugaccggccgca

SEQ ID NO: 3450707 - RNA, 16 nt, Pseudomonas aeruginosa PA01
cgcugaccggccgcag

SEQ ID NO: 3450708 - RNA, 19 nt, Pseudomonas aeruginosa PA01
cgcugaccggccgcagcag

SEQ ID NO: 3450709 - RNA, 19 nt, Pseudomonas aeruginosa PA01
cgcugaccgggcggaucgc

SEQ ID NO: 3450710 - RNA, 15 nt, Pseudomonas aeruginosa PA01
cgcugaccucgagcu

SEQ ID NO: 3450711 - RNA, 16 nt, Pseudomonas aeruginosa PA01
cgcugaccuggaagcg

SEQ ID NO: 3450712 - RNA, 22 nt, Pseudomonas aeruginosa PA01
cgcugacgaaacggugacgggc

SEQ ID NO: 3450713 - RNA, 18 nt, Pseudomonas aeruginosa PA01
cgcugacgaggacgccgc

SEQ ID NO: 3450714 - RNA, 20 nt, Pseudomonas aeruginosa PA01
cgcugacgaggacgccgccg

SEQ ID NO: 3450715 - RNA, 20 nt, Pseudomonas aeruginosa PA01
cgcugacgccauucaggcgg

SEQ ID NO: 3450716 - RNA, 13 nt, Pseudomonas aeruginosa PA01
cgcugacgccggc

SEQ ID NO: 3450717 - RNA, 19 nt, Pseudomonas aeruginosa PA01
cgcugacggcaaggaccug

SEQ ID NO: 3450718 - RNA, 14 nt, Pseudomonas aeruginosa PA01
cgcugagcaccggg

SEQ ID NO: 3450719 - RNA, 15 nt, Pseudomonas aeruginosa PA01
cgcugagcaccggga

SEQ ID NO: 3450720 - RNA, 19 nt, Pseudomonas aeruginosa PA01
cgcugagcaggaacucgau

SEQ ID NO: 3450721 - RNA, 20 nt, Pseudomonas aeruginosa PA01
cgcugagcaggaacucgauc

SEQ ID NO: 3450722 - RNA, 20 nt, Pseudomonas aeruginosa PA01
cgcugagcaguugcgggcgc

SEQ ID NO: 3450723 - RNA, 18 nt, Pseudomonas aeruginosa PA01
cgcugagcaucugggucu

SEQ ID NO: 3450724 - RNA, 23 nt, Pseudomonas aeruginosa PA01
cgcugagcaucugggucuucagc

SEQ ID NO: 3450725 - RNA, 16 nt, Pseudomonas aeruginosa PA01
cgcugagcgccucgau

SEQ ID NO: 3450726 - RNA, 19 nt, Pseudomonas aeruginosa PA01
cgcugagcgccucgaucgc

SEQ ID NO: 3450727 - RNA, 20 nt, Pseudomonas aeruginosa PA01
cgcugagcgccucgaucgcc

SEQ ID NO: 3450728 - RNA, 18 nt, Pseudomonas aeruginosa PA01
cgcugagcggcugguggc

SEQ ID NO: 3450729 - RNA, 14 nt, Pseudomonas aeruginosa PA01
cgcugaggaagagc

SEQ ID NO: 3450730 - RNA, 19 nt, Pseudomonas aeruginosa PA01
cgcugaggaagagcagcgc

SEQ ID NO: 3450731 - RNA, 20 nt, Pseudomonas aeruginosa PA01
cgcugaggaagagcagcgcg

SEQ ID NO: 3450732 - RNA, 21 nt, Pseudomonas aeruginosa PA01
cgcugaggaagagcagcgcgg

SEQ ID NO: 3450733 - RNA, 23 nt, Pseudomonas aeruginosa PA01
cgcugaggaagagcagcgcggcg

SEQ ID NO: 3450734 - RNA, 19 nt, Pseudomonas aeruginosa PA01
cgcugaggacugccagggu

SEQ ID NO: 3450735 - RNA, 22 nt, Pseudomonas aeruginosa PA01
cgcugaggaucacgauggccgg

SEQ ID NO: 3450736 - RNA, 17 nt, Pseudomonas aeruginosa PA01
cgcugaggaucagccag

SEQ ID NO: 3450737 - RNA, 21 nt, Pseudomonas aeruginosa PA01
cgcugaggaucagccagccgg

SEQ ID NO: 3450738 - RNA, 23 nt, Pseudomonas aeruginosa PA01
cgcugaggaucagccagccggcg

SEQ ID NO: 3450739 - RNA, 20 nt, Pseudomonas aeruginosa PA01
cgcugaggauguagccggcu

SEQ ID NO: 3450740 - RNA, 23 nt, Pseudomonas aeruginosa PA01
cgcugaggauguagccggcuucc

SEQ ID NO: 3450741 - RNA, 15 nt, Pseudomonas aeruginosa PA01
cgcugaggccgcccu

SEQ ID NO: 3450742 - RNA, 15 nt, Pseudomonas aeruginosa PA01
cgcugcgccaggccg

SEQ ID NO: 3450743 - RNA, 23 nt, Pseudomonas aeruginosa PA01
cgcugcgccaggcuuuccgccga

SEQ ID NO: 3450744 - RNA, 13 nt, Pseudomonas aeruginosa PA01
cgcugcgcccgcu

SEQ ID NO: 3450745 - RNA, 13 nt, Pseudomonas aeruginosa PA01
cgcugcgccgccg

SEQ ID NO: 3450746 - RNA, 17 nt, Pseudomonas aeruginosa PA01
cgcugcgccgccgucuu

SEQ ID NO: 3450747 - RNA, 23 nt, Pseudomonas aeruginosa PA01
cgcugcgccguuucgacgaugcu

SEQ ID NO: 3450748 - RNA, 12 nt, Pseudomonas aeruginosa PA01
cgcugcgcgcag

SEQ ID NO: 3450749 - RNA, 16 nt, Pseudomonas aeruginosa PA01
cgcugcgcgcaguuca

SEQ ID NO: 3450750 - RNA, 15 nt, Pseudomonas aeruginosa PA01
cgcugcgcgccaucu

SEQ ID NO: 3450751 - RNA, 21 nt, Pseudomonas aeruginosa PA01
cgcugcgcgccaucuccucgc

SEQ ID NO: 3450752 - RNA, 15 nt, Pseudomonas aeruginosa PA01
cgcugcgcggccugc

SEQ ID NO: 3450753 - RNA, 24 nt, Pseudomonas aeruginosa PA01
cgcugcgcggccugcgccggacca

SEQ ID NO: 3450754 - RNA, 23 nt, Pseudomonas aeruginosa PA01
cgcugcgcgggucguacaccgcg

SEQ ID NO: 3450755 - RNA, 16 nt, Pseudomonas aeruginosa PA01
cgcugcgcguacaucc

SEQ ID NO: 3450756 - RNA, 23 nt, Pseudomonas aeruginosa PA01
cgcugcggaucaacuccgccagg

SEQ ID NO: 3450757 - RNA, 15 nt, Pseudomonas aeruginosa PA01
cgcugcggccggcgc

SEQ ID NO: 3450758 - RNA, 20 nt, Pseudomonas aeruginosa PA01
cgcugcgggcguagcgcggc

SEQ ID NO: 3450759 - RNA, 14 nt, Pseudomonas aeruginosa PA01
cgcugcgggucauu

SEQ ID NO: 3450760 - RNA, 18 nt, Pseudomonas aeruginosa PA01
cgcugcgggucauuggcg

SEQ ID NO: 3450761 - RNA, 19 nt, Pseudomonas aeruginosa PA01
cgcugcgggucauuggcga

SEQ ID NO: 3450762 - RNA, 20 nt, Pseudomonas aeruginosa PA01
cgcugcgggucauuggcgaa

SEQ ID NO: 3450763 - RNA, 19 nt, Pseudomonas aeruginosa PA01
cgcugcggguucagucggc

SEQ ID NO: 3450764 - RNA, 23 nt, Pseudomonas aeruginosa PA01
cgcugcggguucagucggccagg

SEQ ID NO: 3450765 - RNA, 19 nt, Pseudomonas aeruginosa PA01
cgcugcgguaccagcgcac

SEQ ID NO: 3450766 - RNA, 23 nt, Pseudomonas aeruginosa PA01
cgcugcguaguugagccccaggu

SEQ ID NO: 3450767 - RNA, 17 nt, Pseudomonas aeruginosa PA01
cgcugcgugccagggcu

SEQ ID NO: 3450768 - RNA, 16 nt, Pseudomonas aeruginosa PA01
cgcugcgugcgccgcu

SEQ ID NO: 3450769 - RNA, 19 nt, Pseudomonas aeruginosa PA01
cgcugcgugcgccgcucgc

SEQ ID NO: 3450770 - RNA, 20 nt, Pseudomonas aeruginosa PA01
cgcugcgugcgccgcucgcg

SEQ ID NO: 3450771 - RNA, 17 nt, Pseudomonas aeruginosa PA01
cgcugcgugcguugcgc

SEQ ID NO: 3450772 - RNA, 19 nt, Pseudomonas aeruginosa PA01
cgcugcguggguagccgcc

SEQ ID NO: 3450773 - RNA, 20 nt, Pseudomonas aeruginosa PA01
cgcugcguggguagccgccc

SEQ ID NO: 3450774 - RNA, 15 nt, Pseudomonas aeruginosa PA01
cgcugcguuccuguu

SEQ ID NO: 3450775 - RNA, 22 nt, Pseudomonas aeruginosa PA01
cgcugcuaggcuggaagccgcg

SEQ ID NO: 3450776 - RNA, 14 nt, Pseudomonas aeruginosa PA01
cgcugcucaccagg

SEQ ID NO: 3450777 - RNA, 15 nt, Pseudomonas aeruginosa PA01
cgcugcucagggcuc

SEQ ID NO: 3450778 - RNA, 21 nt, Pseudomonas aeruginosa PA01
cgcugcuccuuucggaacagc

SEQ ID NO: 3450779 - RNA, 19 nt, Pseudomonas aeruginosa PA01
cgcugcucgaccaccucgg

SEQ ID NO: 3450780 - RNA, 21 nt, Pseudomonas aeruginosa PA01
cgcugcucgaccaccucggcg

SEQ ID NO: 3450781 - RNA, 22 nt, Pseudomonas aeruginosa PA01
cgcugcucgaccaccucggcgu

SEQ ID NO: 3450782 - RNA, 17 nt, Pseudomonas aeruginosa PA01
cgcugcucgacggcacc

SEQ ID NO: 3450783 - RNA, 18 nt, Pseudomonas aeruginosa PA01
cgcugcucgacggcacca

SEQ ID NO: 3450784 - RNA, 23 nt, Pseudomonas aeruginosa PA01
cgcugcucgacggcaccagcgcg

SEQ ID NO: 3450785 - RNA, 13 nt, Pseudomonas aeruginosa PA01
cgcugcucgcagc

SEQ ID NO: 3450786 - RNA, 14 nt, Pseudomonas aeruginosa PA01
cgcugcucgcagcc

SEQ ID NO: 3450787 - RNA, 20 nt, Pseudomonas aeruginosa PA01
cgcugcugaaaaacgccugg

SEQ ID NO: 3450788 - RNA, 13 nt, Pseudomonas aeruginosa PA01
cgcugcugccggc

SEQ ID NO: 3450789 - RNA, 17 nt, Pseudomonas aeruginosa PA01
cgcugcuggcgccgcug

SEQ ID NO: 3450790 - RNA, 20 nt, Pseudomonas aeruginosa PA01
cgcugcugguagugcuggcg

SEQ ID NO: 3450791 - RNA, 23 nt, Pseudomonas aeruginosa PA01
cgcugcugguggacgucgucggc

SEQ ID NO: 3450792 - RNA, 17 nt, Pseudomonas aeruginosa PA01
cgcugcuguacagcuca

SEQ ID NO: 3450793 - RNA, 18 nt, Pseudomonas aeruginosa PA01
cgcugcuucuugucgagg

SEQ ID NO: 3450794 - RNA, 23 nt, Pseudomonas aeruginosa PA01
cgcugcuugaacaccucuucgcc

SEQ ID NO: 3450795 - RNA, 18 nt, Pseudomonas aeruginosa PA01
cgcugcuugcgcaccucc

SEQ ID NO: 3450796 - RNA, 17 nt, Pseudomonas aeruginosa PA01
cgcuggaaccggccggc

SEQ ID NO: 3450797 - RNA, 18 nt, Pseudomonas aeruginosa PA01
cgcuggaaccggccggca

SEQ ID NO: 3450798 - RNA, 20 nt, Pseudomonas aeruginosa PA01
cgcuggacaggcgcaggggc

SEQ ID NO: 3450799 - RNA, 12 nt, Pseudomonas aeruginosa PA01
cgcuggaccagg

SEQ ID NO: 3450800 - RNA, 20 nt, Pseudomonas aeruginosa PA01
cgcuggaccaggcggccggu

SEQ ID NO: 3450801 - RNA, 19 nt, Pseudomonas aeruginosa PA01
cgcuggaccaguucagcgc

SEQ ID NO: 3450802 - RNA, 22 nt, Pseudomonas aeruginosa PA01
cgcuggaccaguucagcgcgcu

SEQ ID NO: 3450803 - RNA, 14 nt, Pseudomonas aeruginosa PA01
cgcuggaccauggc

SEQ ID NO: 3450804 - RNA, 17 nt, Pseudomonas aeruginosa PA01
cgcuggaccauggccgg

SEQ ID NO: 3450805 - RNA, 22 nt, Pseudomonas aeruginosa PA01
cgcuggaccauggccggcgugc

SEQ ID NO: 3450806 - RNA, 13 nt, Pseudomonas aeruginosa PA01
cgcuggacccgca

SEQ ID NO: 3450807 - RNA, 24 nt, Pseudomonas aeruginosa PA01
cgcuggacccgcaccuggaccggg

SEQ ID NO: 3450808 - RNA, 16 nt, Pseudomonas aeruginosa PA01
cgcuggaccuggccgg

SEQ ID NO: 3450809 - RNA, 17 nt, Pseudomonas aeruginosa PA01
cgcuggaccuggccggc

SEQ ID NO: 3450810 - RNA, 20 nt, Pseudomonas aeruginosa PA01
cgcuggaguaucgcccuggc

SEQ ID NO: 3450811 - RNA, 14 nt, Pseudomonas aeruginosa PA01
cgcuggaugccgac

SEQ ID NO: 3450812 - RNA, 19 nt, Pseudomonas aeruginosa PA01
cgcuggaugccgaccacgu

SEQ ID NO: 3450813 - RNA, 16 nt, Pseudomonas aeruginosa PA01
cgcuggauuucgccga

SEQ ID NO: 3450814 - RNA, 18 nt, Pseudomonas aeruginosa PA01
cgcuggauuucgccgagu

SEQ ID NO: 3450815 - RNA, 21 nt, Pseudomonas aeruginosa PA01
cgcuggauuucgccgaguggc

SEQ ID NO: 3450816 - RNA, 15 nt, Pseudomonas aeruginosa PA01
cgcuggcaccggcca

SEQ ID NO: 3450817 - RNA, 16 nt, Pseudomonas aeruginosa PA01
cgcuggcaccggccag

SEQ ID NO: 3450818 - RNA, 17 nt, Pseudomonas aeruginosa PA01
cgcuggcaccggccagg

SEQ ID NO: 3450819 - RNA, 18 nt, Pseudomonas aeruginosa PA01
cgcuggcaccggccaggc

SEQ ID NO: 3450820 - RNA, 20 nt, Pseudomonas aeruginosa PA01
cgcuggcaccggccaggcgc

SEQ ID NO: 3450821 - RNA, 12 nt, Pseudomonas aeruginosa PA01
cgcuggccagcg

SEQ ID NO: 3450822 - RNA, 15 nt, Pseudomonas aeruginosa PA01
cgcuggcccaacagc

SEQ ID NO: 3450823 - RNA, 22 nt, Pseudomonas aeruginosa PA01
cgcuggccgagcugccgcaccg

SEQ ID NO: 3450824 - RNA, 13 nt, Pseudomonas aeruginosa PA01
cgcuggccgcgcg

SEQ ID NO: 3450825 - RNA, 15 nt, Pseudomonas aeruginosa PA01
cgcuggccgcgcgac

SEQ ID NO: 3450826 - RNA, 18 nt, Pseudomonas aeruginosa PA01
cgcuggccgcgcgaccgc

SEQ ID NO: 3450827 - RNA, 12 nt, Pseudomonas aeruginosa PA01
cgcuggccggca

SEQ ID NO: 3450828 - RNA, 17 nt, Pseudomonas aeruginosa PA01
cgcuggccugcagcagg

SEQ ID NO: 3450829 - RNA, 14 nt, Pseudomonas aeruginosa PA01
cgcuggccugcagg

SEQ ID NO: 3450830 - RNA, 13 nt, Pseudomonas aeruginosa PA01
cgcuggccugccg

SEQ ID NO: 3450831 - RNA, 15 nt, Pseudomonas aeruginosa PA01
cgcuggccugccgau

SEQ ID NO: 3450832 - RNA, 19 nt, Pseudomonas aeruginosa PA01
cgcuggccuggccacccuu

SEQ ID NO: 3450833 - RNA, 20 nt, Pseudomonas aeruginosa PA01
cgcuggccugggguagccgg

SEQ ID NO: 3450834 - RNA, 21 nt, Pseudomonas aeruginosa PA01
cgcuggccugggguagccggc

SEQ ID NO: 3450835 - RNA, 23 nt, Pseudomonas aeruginosa PA01
cgcuggccugggguagccggccg

SEQ ID NO: 3450836 - RNA, 12 nt, Pseudomonas aeruginosa PA01
cgcuggcgaacg

SEQ ID NO: 3450837 - RNA, 20 nt, Pseudomonas aeruginosa PA01
cgcuggcgaacggcuggucg

SEQ ID NO: 3450838 - RNA, 20 nt, Pseudomonas aeruginosa PA01
cgcuggcgaagaaccacugg

SEQ ID NO: 3450839 - RNA, 21 nt, Pseudomonas aeruginosa PA01
cgcuggcgaagaaccacugga

SEQ ID NO: 3450840 - RNA, 20 nt, Pseudomonas aeruginosa PA01
cgcuggcgaauauccucguc

SEQ ID NO: 3450841 - RNA, 22 nt, Pseudomonas aeruginosa PA01
cgcuggcgaauauccucgucga

SEQ ID NO: 3450842 - RNA, 13 nt, Pseudomonas aeruginosa PA01
cgcuggcgacgcu

SEQ ID NO: 3450843 - RNA, 17 nt, Pseudomonas aeruginosa PA01
cgcuggcgaggacgccg

SEQ ID NO: 3450844 - RNA, 20 nt, Pseudomonas aeruginosa PA01
cgcuucauccugcgcgccuc

SEQ ID NO: 3450845 - RNA, 21 nt, Pseudomonas aeruginosa PA01
cgcuuccagcaccucccccag

SEQ ID NO: 3450846 - RNA, 21 nt, Pseudomonas aeruginosa PA01
cgcuuccaggguagcgccgcg

SEQ ID NO: 3450847 - RNA, 17 nt, Pseudomonas aeruginosa PA01
cgcuuccgcaucggccg

SEQ ID NO: 3450848 - RNA, 22 nt, Pseudomonas aeruginosa PA01
cgcuuccgcaucggccgacaga

SEQ ID NO: 3450849 - RNA, 14 nt, Pseudomonas aeruginosa PA01
cgcuuccgccaggc

SEQ ID NO: 3450850 - RNA, 15 nt, Pseudomonas aeruginosa PA01
cgcuuccgccaggcg

SEQ ID NO: 3450851 - RNA, 17 nt, Pseudomonas aeruginosa PA01
cgcuuccgccaggcgca

SEQ ID NO: 3450852 - RNA, 20 nt, Pseudomonas aeruginosa PA01
cgcuuccgccaggcgcagcc

SEQ ID NO: 3450853 - RNA, 20 nt, Pseudomonas aeruginosa PA01
cgcuuccgccggcgccgccu

SEQ ID NO: 3450854 - RNA, 21 nt, Pseudomonas aeruginosa PA01
cgcuuccgcgcggcgcccugc

SEQ ID NO: 3450855 - RNA, 13 nt, Pseudomonas aeruginosa PA01
cgcuuccggcagc

SEQ ID NO: 3450856 - RNA, 19 nt, Pseudomonas aeruginosa PA01
cgcuuccggcagccagccg

SEQ ID NO: 3450857 - RNA, 22 nt, Pseudomonas aeruginosa PA01
cgcuuccggcagccagccgccg

SEQ ID NO: 3450858 - RNA, 13 nt, Pseudomonas aeruginosa PA01
cgcuuccggcccg

SEQ ID NO: 3450859 - RNA, 15 nt, Pseudomonas aeruginosa PA01
cgcuuccggcccggc

SEQ ID NO: 3450860 - RNA, 20 nt, Pseudomonas aeruginosa PA01
cgcuuccggcccggccaggu

SEQ ID NO: 3450861 - RNA, 13 nt, Pseudomonas aeruginosa PA01
cgcuuccggcgcc

SEQ ID NO: 3450862 - RNA, 14 nt, Pseudomonas aeruginosa PA01
cgcuuccggcgcca

SEQ ID NO: 3450863 - RNA, 17 nt, Pseudomonas aeruginosa PA01
cgcuuccucggcacuca

SEQ ID NO: 3450864 - RNA, 23 nt, Pseudomonas aeruginosa PA01
cgcuuccucggcacucagccagc

SEQ ID NO: 3450865 - RNA, 14 nt, Pseudomonas aeruginosa PA01
cgcuuccugggcuu

SEQ ID NO: 3450866 - RNA, 18 nt, Pseudomonas aeruginosa PA01
cgcuuccugggcuucguc

SEQ ID NO: 3450867 - RNA, 14 nt, Pseudomonas aeruginosa PA01
cgcuuccuugcccu

SEQ ID NO: 3450868 - RNA, 16 nt, Pseudomonas aeruginosa PA01
cgcuucgaagcucucg

SEQ ID NO: 3450869 - RNA, 18 nt, Pseudomonas aeruginosa PA01
cgcuucgaagcucucgcc

SEQ ID NO: 3450870 - RNA, 14 nt, Pseudomonas aeruginosa PA01
cgcuucgagcaccc

SEQ ID NO: 3450871 - RNA, 16 nt, Pseudomonas aeruginosa PA01
cgcuucgagcaccccg

SEQ ID NO: 3450872 - RNA, 15 nt, Pseudomonas aeruginosa PA01
cgcuucgcccgccgc

SEQ ID NO: 3450873 - RNA, 17 nt, Pseudomonas aeruginosa PA01
cgcuucgcccgccgccu

SEQ ID NO: 3450874 - RNA, 17 nt, Pseudomonas aeruginosa PA01
cgcuucgccgcccucgc

SEQ ID NO: 3450875 - RNA, 20 nt, Pseudomonas aeruginosa PA01
cgcuucgcgcagcucggcca

SEQ ID NO: 3450876 - RNA, 12 nt, Pseudomonas aeruginosa PA01
cgcuucggccac

SEQ ID NO: 3450877 - RNA, 16 nt, Pseudomonas aeruginosa PA01
cgcuucggccaccagc

SEQ ID NO: 3450878 - RNA, 14 nt, Pseudomonas aeruginosa PA01
cgcuucggcccgcu

SEQ ID NO: 3450879 - RNA, 12 nt, Pseudomonas aeruginosa PA01
cgcuucggcgga

SEQ ID NO: 3450880 - RNA, 15 nt, Pseudomonas aeruginosa PA01
cgcuucggcggcuuc

SEQ ID NO: 3450881 - RNA, 12 nt, Pseudomonas aeruginosa PA01
cgcuucggcggg

SEQ ID NO: 3450882 - RNA, 13 nt, Pseudomonas aeruginosa PA01
cgcuucggcgggg

SEQ ID NO: 3450883 - RNA, 16 nt, Pseudomonas aeruginosa PA01
cgcuucggcugcugcu

SEQ ID NO: 3450884 - RNA, 23 nt, Pseudomonas aeruginosa PA01
cgcuucgggagucaacgccuggc

SEQ ID NO: 3450885 - RNA, 16 nt, Pseudomonas aeruginosa PA01
cgcuucgucccaugac

SEQ ID NO: 3450886 - RNA, 15 nt, Pseudomonas aeruginosa PA01
cgcuucgucggucgc

SEQ ID NO: 3450887 - RNA, 18 nt, Pseudomonas aeruginosa PA01
cgcuucgucggucgcgac

SEQ ID NO: 3450888 - RNA, 23 nt, Pseudomonas aeruginosa PA01
cgcuucguugcuccugcggcugg

SEQ ID NO: 3450889 - RNA, 15 nt, Pseudomonas aeruginosa PA01
cgcuucuccucggcc

SEQ ID NO: 3450890 - RNA, 19 nt, Pseudomonas aeruginosa PA01
cgcuucuccucggccgaca

SEQ ID NO: 3450891 - RNA, 20 nt, Pseudomonas aeruginosa PA01
cgcuucucgacguaggcggc

SEQ ID NO: 3450892 - RNA, 15 nt, Pseudomonas aeruginosa PA01
cgcuucucggcagcg

SEQ ID NO: 3450893 - RNA, 15 nt, Pseudomonas aeruginosa PA01
cgcuucugcaggccg

SEQ ID NO: 3450894 - RNA, 19 nt, Pseudomonas aeruginosa PA01
cgcuucugcgagccgcgcg

SEQ ID NO: 3450895 - RNA, 20 nt, Pseudomonas aeruginosa PA01
cgcuucugcgagccgcgcgu

SEQ ID NO: 3450896 - RNA, 15 nt, Pseudomonas aeruginosa PA01
cgcuucugcgccucc

SEQ ID NO: 3450897 - RNA, 20 nt, Pseudomonas aeruginosa PA01
cgcuucugcgccuccucggc

SEQ ID NO: 3450898 - RNA, 16 nt, Pseudomonas aeruginosa PA01
cgcuucugcuggccgc

SEQ ID NO: 3450899 - RNA, 20 nt, Pseudomonas aeruginosa PA01
cgcuucugcuggccgcgcag

SEQ ID NO: 3450900 - RNA, 16 nt, Pseudomonas aeruginosa PA01
cgcuucuucccgccca

SEQ ID NO: 3450901 - RNA, 17 nt, Pseudomonas aeruginosa PA01
cgcuucuucccgcccau

SEQ ID NO: 3450902 - RNA, 14 nt, Pseudomonas aeruginosa PA01
cgcuugaacgcgcg

SEQ ID NO: 3450903 - RNA, 17 nt, Pseudomonas aeruginosa PA01
cgcuugaacgcgcgccu

SEQ ID NO: 3450904 - RNA, 14 nt, Pseudomonas aeruginosa PA01
cgcuugaagccggc

SEQ ID NO: 3450905 - RNA, 18 nt, Pseudomonas aeruginosa PA01
cgcuugaagccggcguag

SEQ ID NO: 3450906 - RNA, 17 nt, Pseudomonas aeruginosa PA01
cgcuugagcagccaggc

SEQ ID NO: 3450907 - RNA, 12 nt, Pseudomonas aeruginosa PA01
cgcuugagcccc

SEQ ID NO: 3450908 - RNA, 14 nt, Pseudomonas aeruginosa PA01
cgcuugagccccgg

SEQ ID NO: 3450909 - RNA, 16 nt, Pseudomonas aeruginosa PA01
cgcuugagcuggcgcu

SEQ ID NO: 3450910 - RNA, 18 nt, Pseudomonas aeruginosa PA01
cgcuugagcuggcgcugg

SEQ ID NO: 3450911 - RNA, 17 nt, Pseudomonas aeruginosa PA01
cgcuugaggucgugcag

SEQ ID NO: 3450912 - RNA, 19 nt, Pseudomonas aeruginosa PA01
cgcuugaggucgugcagca

SEQ ID NO: 3450913 - RNA, 22 nt, Pseudomonas aeruginosa PA01
cgcuugaggucgugcagcacau

SEQ ID NO: 3450914 - RNA, 20 nt, Pseudomonas aeruginosa PA01
cgcuugaguugccagacgau

SEQ ID NO: 3450915 - RNA, 14 nt, Pseudomonas aeruginosa PA01
cgcuugccagccgc

SEQ ID NO: 3450916 - RNA, 13 nt, Pseudomonas aeruginosa PA01
cgcuugcccaggu

SEQ ID NO: 3450917 - RNA, 19 nt, Pseudomonas aeruginosa PA01
cgcuugcccucgcgcccgg

SEQ ID NO: 3450918 - RNA, 11 nt, Pseudomonas aeruginosa PA01
cgcuugccgcg

SEQ ID NO: 3450919 - RNA, 12 nt, Pseudomonas aeruginosa PA01
cgcuugccgcgc

SEQ ID NO: 3450920 - RNA, 13 nt, Pseudomonas aeruginosa PA01
cgcuugccggccg

SEQ ID NO: 3450921 - RNA, 14 nt, Pseudomonas aeruginosa PA01
cgcuugccggccgc

SEQ ID NO: 3450922 - RNA, 16 nt, Pseudomonas aeruginosa PA01
cgcuugccggccgcca

SEQ ID NO: 3450923 - RNA, 21 nt, Pseudomonas aeruginosa PA01
cgcuugccggccgccagcagg

SEQ ID NO: 3450924 - RNA, 20 nt, Pseudomonas aeruginosa PA01
cgcuugccgucgcggaagcc

SEQ ID NO: 3450925 - RNA, 14 nt, Pseudomonas aeruginosa PA01
cgcuugcgccgccu

SEQ ID NO: 3450926 - RNA, 15 nt, Pseudomonas aeruginosa PA01
cgcuugcgccgccuc

SEQ ID NO: 3450927 - RNA, 17 nt, Pseudomonas aeruginosa PA01
cgcuugcgggcgcgccu

SEQ ID NO: 3450928 - RNA, 20 nt, Pseudomonas aeruginosa PA01
cgcuugcgguuauccgccgc

SEQ ID NO: 3450929 - RNA, 20 nt, Pseudomonas aeruginosa PA01
cgcuugcgguuauccgccgu

SEQ ID NO: 3450930 - RNA, 15 nt, Pseudomonas aeruginosa PA01
cgcuugcguuccucc

SEQ ID NO: 3450931 - RNA, 17 nt, Pseudomonas aeruginosa PA01
cgcuugcugccauggcg

SEQ ID NO: 3450932 - RNA, 15 nt, Pseudomonas aeruginosa PA01
cgcuugcuggcgcga

SEQ ID NO: 3450933 - RNA, 17 nt, Pseudomonas aeruginosa PA01
cgcuuggacagcucgcg

SEQ ID NO: 3450934 - RNA, 16 nt, Pseudomonas aeruginosa PA01
cgcuuggccauggcgc

SEQ ID NO: 3450935 - RNA, 19 nt, Pseudomonas aeruginosa PA01
cgcuuggcgaucacggcgc

SEQ ID NO: 3450936 - RNA, 23 nt, Pseudomonas aeruginosa PA01
cgcuuggcgaucacggcgccccg

SEQ ID NO: 3450937 - RNA, 16 nt, Pseudomonas aeruginosa PA01
cgcuuguagcagccgc

SEQ ID NO: 3450938 - RNA, 18 nt, Pseudomonas aeruginosa PA01
cgcuuguagcagccgcag

SEQ ID NO: 3450939 - RNA, 14 nt, Pseudomonas aeruginosa PA01
cgcuuguagcccag

SEQ ID NO: 3450940 - RNA, 18 nt, Pseudomonas aeruginosa PA01
cgcuuguagcccaggggc

SEQ ID NO: 3450941 - RNA, 16 nt, Pseudomonas aeruginosa PA01
cgcuuguccgagaccg

SEQ ID NO: 3450942 - RNA, 20 nt, Pseudomonas aeruginosa PA01
cgcuuguccgagaccggcag

SEQ ID NO: 3450943 - RNA, 14 nt, Pseudomonas aeruginosa PA01
cgcuuguccuccag

SEQ ID NO: 3450944 - RNA, 18 nt, Pseudomonas aeruginosa PA01
cgcuuguccuccagcugc

SEQ ID NO: 3450945 - RNA, 19 nt, Pseudomonas aeruginosa PA01
cgcuuguccuccagcugcg

SEQ ID NO: 3450946 - RNA, 21 nt, Pseudomonas aeruginosa PA01
cgcuuguccuccagcugcgcc

SEQ ID NO: 3450947 - RNA, 14 nt, Pseudomonas aeruginosa PA01
cggaaggccacgcc

SEQ ID NO: 3450948 - RNA, 13 nt, Pseudomonas aeruginosa PA01
cggaaggcggcgu

SEQ ID NO: 3450949 - RNA, 19 nt, Pseudomonas aeruginosa PA01
cggaaggcggcgucgucgc

SEQ ID NO: 3450950 - RNA, 20 nt, Pseudomonas aeruginosa PA01
cggaaggcuuccugguggaa

SEQ ID NO: 3450951 - RNA, 22 nt, Pseudomonas aeruginosa PA01
cggaaggcuuccugguggaaca

SEQ ID NO: 3450952 - RNA, 14 nt, Pseudomonas aeruginosa PA01
cggaagucggcggg

SEQ ID NO: 3450953 - RNA, 21 nt, Pseudomonas aeruginosa PA01
cggaagucggcggguccgcgu

SEQ ID NO: 3450954 - RNA, 15 nt, Pseudomonas aeruginosa PA01
cggaaguggcagcgc

SEQ ID NO: 3450955 - RNA, 13 nt, Pseudomonas aeruginosa PA01
cggaaguucaccu

SEQ ID NO: 3450956 - RNA, 20 nt, Pseudomonas aeruginosa PA01
cggaauccuucgcggcggcg

SEQ ID NO: 3450957 - RNA, 15 nt, Pseudomonas aeruginosa PA01
cggaaucggcgaucg

SEQ ID NO: 3450958 - RNA, 13 nt, Pseudomonas aeruginosa PA01
cggaaugucaggg

SEQ ID NO: 3450959 - RNA, 15 nt, Pseudomonas aeruginosa PA01
cggacaacaggccgg

SEQ ID NO: 3450960 - RNA, 16 nt, Pseudomonas aeruginosa PA01
cggacaacaggccggg

SEQ ID NO: 3450961 - RNA, 18 nt, Pseudomonas aeruginosa PA01
cggacaacaggccgggcg

SEQ ID NO: 3450962 - RNA, 14 nt, Pseudomonas aeruginosa PA01
cggacaaccaccau

SEQ ID NO: 3450963 - RNA, 16 nt, Pseudomonas aeruginosa PA01
cggacaaccaccaugc

SEQ ID NO: 3450964 - RNA, 22 nt, Pseudomonas aeruginosa PA01
cggacaaccaccaugcggcuac

SEQ ID NO: 3450965 - RNA, 23 nt, Pseudomonas aeruginosa PA01
cggacaaccgccguagccgucgu

SEQ ID NO: 3450966 - RNA, 14 nt, Pseudomonas aeruginosa PA01
cggacaagggccag

SEQ ID NO: 3450967 - RNA, 16 nt, Pseudomonas aeruginosa PA01
cggacacgcaggcgcc

SEQ ID NO: 3450968 - RNA, 14 nt, Pseudomonas aeruginosa PA01
cggacagcccgcgc

SEQ ID NO: 3450969 - RNA, 23 nt, Pseudomonas aeruginosa PA01
cggacagcuucugguuguaagcg

SEQ ID NO: 3450970 - RNA, 21 nt, Pseudomonas aeruginosa PA01
cggacaggaaaaagcccgcgu

SEQ ID NO: 3450971 - RNA, 18 nt, Pseudomonas aeruginosa PA01
cggacaggcauuccgggc

SEQ ID NO: 3450972 - RNA, 15 nt, Pseudomonas aeruginosa PA01
cggacaggccacccg

SEQ ID NO: 3450973 - RNA, 17 nt, Pseudomonas aeruginosa PA01
cggacaggccacccgcc

SEQ ID NO: 3450974 - RNA, 20 nt, Pseudomonas aeruginosa PA01
cggacaggccacccgccucg

SEQ ID NO: 3450975 - RNA, 21 nt, Pseudomonas aeruginosa PA01
cggacaggccacccgccucgu

SEQ ID NO: 3450976 - RNA, 22 nt, Pseudomonas aeruginosa PA01
cggacauguugcagggucgccg

SEQ ID NO: 3450977 - RNA, 23 nt, Pseudomonas aeruginosa PA01
cggacauguugcagggucgccgg

SEQ ID NO: 3450978 - RNA, 16 nt, Pseudomonas aeruginosa PA01
cggaccagaucggcgc

SEQ ID NO: 3450979 - RNA, 21 nt, Pseudomonas aeruginosa PA01
cggaccagaucggcgcgcagg

SEQ ID NO: 3450980 - RNA, 13 nt, Pseudomonas aeruginosa PA01
cggaccagcuccg

SEQ ID NO: 3450981 - RNA, 19 nt, Pseudomonas aeruginosa PA01
cggaccagcuccgaaggga

SEQ ID NO: 3450982 - RNA, 16 nt, Pseudomonas aeruginosa PA01
cggaccagggcgccgg

SEQ ID NO: 3450983 - RNA, 18 nt, Pseudomonas aeruginosa PA01
cggaccagggcgccgggc

SEQ ID NO: 3450984 - RNA, 17 nt, Pseudomonas aeruginosa PA01
cggacccaguugggcca

SEQ ID NO: 3450985 - RNA, 21 nt, Pseudomonas aeruginosa PA01
cggacccaguugggccaggag

SEQ ID NO: 3450986 - RNA, 23 nt, Pseudomonas aeruginosa PA01
cggaccccauguaccucuggcug

SEQ ID NO: 3450987 - RNA, 18 nt, Pseudomonas aeruginosa PA01
cggaccccggccuccagg

SEQ ID NO: 3450988 - RNA, 14 nt, Pseudomonas aeruginosa PA01
cggacccgcgccgg

SEQ ID NO: 3450989 - RNA, 16 nt, Pseudomonas aeruginosa PA01
cggacccgcucggccu

SEQ ID NO: 3450990 - RNA, 12 nt, Pseudomonas aeruginosa PA01
cggacccugccg

SEQ ID NO: 3450991 - RNA, 22 nt, Pseudomonas aeruginosa PA01
cggaccgaaggcaacagcccgc

SEQ ID NO: 3450992 - RNA, 23 nt, Pseudomonas aeruginosa PA01
cggaccgaaggcaacagcccgcg

SEQ ID NO: 3450993 - RNA, 21 nt, Pseudomonas aeruginosa PA01
cggaccgaucucguucgggua

SEQ ID NO: 3450994 - RNA, 12 nt, Pseudomonas aeruginosa PA01
cggaccgcaacc

SEQ ID NO: 3450995 - RNA, 17 nt, Pseudomonas aeruginosa PA01
cggaccgcagaaccaga

SEQ ID NO: 3450996 - RNA, 15 nt, Pseudomonas aeruginosa PA01
cggaccgccucgacc

SEQ ID NO: 3450997 - RNA, 17 nt, Pseudomonas aeruginosa PA01
cggaccgcgacaacccu

SEQ ID NO: 3450998 - RNA, 15 nt, Pseudomonas aeruginosa PA01
cggaccgggcgccuc

SEQ ID NO: 3450999 - RNA, 19 nt, Pseudomonas aeruginosa PA01
cggaccgggcgccucgucg

SEQ ID NO: 3451000 - RNA, 18 nt, Pseudomonas aeruginosa PA01
cggaccgggcggcaggcg

SEQ ID NO: 3451001 - RNA, 14 nt, Pseudomonas aeruginosa PA01
cggaccgggcggcg

SEQ ID NO: 3451002 - RNA, 16 nt, Pseudomonas aeruginosa PA01
cggaccggugccccgc

SEQ ID NO: 3451003 - RNA, 13 nt, Pseudomonas aeruginosa PA01
cggaccgucgggc

SEQ ID NO: 3451004 - RNA, 16 nt, Pseudomonas aeruginosa PA01
cggaccguggugacgg

SEQ ID NO: 3451005 - RNA, 24 nt, Pseudomonas aeruginosa PA01
cggaccuccagccggccauccagc

SEQ ID NO: 3451006 - RNA, 18 nt, Pseudomonas aeruginosa PA01
cggaccuccgccaggucg

SEQ ID NO: 3451007 - RNA, 16 nt, Pseudomonas aeruginosa PA01
cggaccucgggcagcu

SEQ ID NO: 3451008 - RNA, 15 nt, Pseudomonas aeruginosa PA01
cggaccucucucgcu

SEQ ID NO: 3451009 - RNA, 18 nt, Pseudomonas aeruginosa PA01
cggaccugagaucagcgc

SEQ ID NO: 3451010 - RNA, 21 nt, Pseudomonas aeruginosa PA01
cggaccugagaucagcgcccg

SEQ ID NO: 3451011 - RNA, 22 nt, Pseudomonas aeruginosa PA01
cggaccugucccgauuccgcgc

SEQ ID NO: 3451012 - RNA, 16 nt, Pseudomonas aeruginosa PA01
cggaccuucgacggca

SEQ ID NO: 3451013 - RNA, 16 nt, Pseudomonas aeruginosa PA01
cggaccuugucgccgg

SEQ ID NO: 3451014 - RNA, 16 nt, Pseudomonas aeruginosa PA01
cggacgaaccccggau

SEQ ID NO: 3451015 - RNA, 21 nt, Pseudomonas aeruginosa PA01
cggacgacgaagugaccgcgc

SEQ ID NO: 3451016 - RNA, 22 nt, Pseudomonas aeruginosa PA01
cggacgaggauggucaggccgg

SEQ ID NO: 3451017 - RNA, 15 nt, Pseudomonas aeruginosa PA01
cggacgauggucgcc

SEQ ID NO: 3451018 - RNA, 19 nt, Pseudomonas aeruginosa PA01
cggacgauggucgccgcga

SEQ ID NO: 3451019 - RNA, 16 nt, Pseudomonas aeruginosa PA01
cggacgcaccagcagg

SEQ ID NO: 3451020 - RNA, 17 nt, Pseudomonas aeruginosa PA01
cggacgcaccagcaggc

SEQ ID NO: 3451021 - RNA, 18 nt, Pseudomonas aeruginosa PA01
cggacgcaccagcaggcc

SEQ ID NO: 3451022 - RNA, 21 nt, Pseudomonas aeruginosa PA01
cggacgcaccagcaggccgau

SEQ ID NO: 3451023 - RNA, 13 nt, Pseudomonas aeruginosa PA01
cggacgcaggccg

SEQ ID NO: 3451024 - RNA, 15 nt, Pseudomonas aeruginosa PA01
cggacgcaggccgac

SEQ ID NO: 3451025 - RNA, 16 nt, Pseudomonas aeruginosa PA01
cggacgcaggccgacc

SEQ ID NO: 3451026 - RNA, 18 nt, Pseudomonas aeruginosa PA01
cggacgcaggccgaccuc

SEQ ID NO: 3451027 - RNA, 22 nt, Pseudomonas aeruginosa PA01
cggacgcaggccgaccucggcg

SEQ ID NO: 3451028 - RNA, 12 nt, Pseudomonas aeruginosa PA01
cggacgccgaac

SEQ ID NO: 3451029 - RNA, 14 nt, Pseudomonas aeruginosa PA01
cggacgccgaagcg

SEQ ID NO: 3451030 - RNA, 17 nt, Pseudomonas aeruginosa PA01
cggacgccgaagcgggc

SEQ ID NO: 3451031 - RNA, 15 nt, Pseudomonas aeruginosa PA01
cggacgcgacgccuu

SEQ ID NO: 3451032 - RNA, 18 nt, Pseudomonas aeruginosa PA01
cggacgcgacugcugcug

SEQ ID NO: 3451033 - RNA, 21 nt, Pseudomonas aeruginosa PA01
cggacgcgccgcgguuuccgu

SEQ ID NO: 3451034 - RNA, 20 nt, Pseudomonas aeruginosa PA01
cggacgcggcuggcgcagga

SEQ ID NO: 3451035 - RNA, 13 nt, Pseudomonas aeruginosa PA01
cggacgcuggcga

SEQ ID NO: 3451036 - RNA, 14 nt, Pseudomonas aeruginosa PA01
cggacgcuggcgau

SEQ ID NO: 3451037 - RNA, 16 nt, Pseudomonas aeruginosa PA01
cggacgcuggcgauca

SEQ ID NO: 3451038 - RNA, 19 nt, Pseudomonas aeruginosa PA01
cggacgcuggcgaucaugc

SEQ ID NO: 3451039 - RNA, 20 nt, Pseudomonas aeruginosa PA01
cggacgcuuguccuucggcc

SEQ ID NO: 3451040 - RNA, 22 nt, Pseudomonas aeruginosa PA01
cggacgcuuguccuucggccag

SEQ ID NO: 3451041 - RNA, 15 nt, Pseudomonas aeruginosa PA01
cggacggccugcgcc

SEQ ID NO: 3451042 - RNA, 13 nt, Pseudomonas aeruginosa PA01
cggacggcggcgu

SEQ ID NO: 3451043 - RNA, 12 nt, Pseudomonas aeruginosa PA01
cggacggcucgc

SEQ ID NO: 3451044 - RNA, 18 nt, Pseudomonas aeruginosa PA01
cggacggcucgcgcagcg

SEQ ID NO: 3451045 - RNA, 21 nt, Pseudomonas aeruginosa PA01
cggacggcucgcgcagcggcg

SEQ ID NO: 3451046 - RNA, 15 nt, Pseudomonas aeruginosa PA01
cggacgggccgcgcc

SEQ ID NO: 3451047 - RNA, 18 nt, Pseudomonas aeruginosa PA01
cggacgggccgcgccgca

SEQ ID NO: 3451048 - RNA, 19 nt, Pseudomonas aeruginosa PA01
cggacgggugcgcgccacc

SEQ ID NO: 3451049 - RNA, 18 nt, Pseudomonas aeruginosa PA01
cggacguuccaccuggcg

SEQ ID NO: 3451050 - RNA, 21 nt, Pseudomonas aeruginosa PA01
cggauacaccagguuggccag

SEQ ID NO: 3451051 - RNA, 22 nt, Pseudomonas aeruginosa PA01
cggauacaccagguuggccagu

SEQ ID NO: 3451052 - RNA, 19 nt, Pseudomonas aeruginosa PA01
cggauacaugcugcucagu

SEQ ID NO: 3451053 - RNA, 14 nt, Pseudomonas aeruginosa PA01
cggauaccacccgc

SEQ ID NO: 3451054 - RNA, 18 nt, Pseudomonas aeruginosa PA01
cggauaccacccgcagcc

SEQ ID NO: 3451055 - RNA, 22 nt, Pseudomonas aeruginosa PA01
cggauagacgccguccaccagc

SEQ ID NO: 3451056 - RNA, 17 nt, Pseudomonas aeruginosa PA01
cggauagaucaggccgg

SEQ ID NO: 3451057 - RNA, 16 nt, Pseudomonas aeruginosa PA01
cggauagccgcaagcg

SEQ ID NO: 3451058 - RNA, 17 nt, Pseudomonas aeruginosa PA01
cggauagccgugcagca

SEQ ID NO: 3451059 - RNA, 20 nt, Pseudomonas aeruginosa PA01
cggauagcgcgcaggcgcua

SEQ ID NO: 3451060 - RNA, 18 nt, Pseudomonas aeruginosa PA01
cggauauccccccacccg

SEQ ID NO: 3451061 - RNA, 23 nt, Pseudomonas aeruginosa PA01
cggauauccccguauccuccgcg

SEQ ID NO: 3451062 - RNA, 15 nt, Pseudomonas aeruginosa PA01
cggauaucgcgccgc

SEQ ID NO: 3451063 - RNA, 15 nt, Pseudomonas aeruginosa PA01
cggauaucgcguggu

SEQ ID NO: 3451064 - RNA, 14 nt, Pseudomonas aeruginosa PA01
cggauaugcgccgc

SEQ ID NO: 3451065 - RNA, 15 nt, Pseudomonas aeruginosa PA01
cggaucaacgccggu

SEQ ID NO: 3451066 - RNA, 16 nt, Pseudomonas aeruginosa PA01
cggaucaacgccgguc

SEQ ID NO: 3451067 - RNA, 20 nt, Pseudomonas aeruginosa PA01
cggaucaacuccgccaggcg

SEQ ID NO: 3451068 - RNA, 20 nt, Pseudomonas aeruginosa PA01
cggaucacaggcucuucucg

SEQ ID NO: 3451069 - RNA, 12 nt, Pseudomonas aeruginosa PA01
cggaucaccggc

SEQ ID NO: 3451070 - RNA, 11 nt, Pseudomonas aeruginosa PA01
cggaucaccug

SEQ ID NO: 3451071 - RNA, 15 nt, Pseudomonas aeruginosa PA01
cggaucaccuggccg

SEQ ID NO: 3451072 - RNA, 13 nt, Pseudomonas aeruginosa PA01
cggaucagcccgc

SEQ ID NO: 3451073 - RNA, 13 nt, Pseudomonas aeruginosa PA01
cggaucagcucga

SEQ ID NO: 3451074 - RNA, 18 nt, Pseudomonas aeruginosa PA01
cggaucagcucgaucagc

SEQ ID NO: 3451075 - RNA, 21 nt, Pseudomonas aeruginosa PA01
cggaucaggcgggcuccgccg

SEQ ID NO: 3451076 - RNA, 12 nt, Pseudomonas aeruginosa PA01
cggaucagucag

SEQ ID NO: 3451077 - RNA, 21 nt, Pseudomonas aeruginosa PA01
cggaucagucaggaucggcgc

SEQ ID NO: 3451078 - RNA, 18 nt, Pseudomonas aeruginosa PA01
cggaucaugguauggaga

SEQ ID NO: 3451079 - RNA, 17 nt, Pseudomonas aeruginosa PA01
cggauccacgccuggcc

SEQ ID NO: 3451080 - RNA, 15 nt, Pseudomonas aeruginosa PA01
cggauccccucccgc

SEQ ID NO: 3451081 - RNA, 17 nt, Pseudomonas aeruginosa PA01
cggauccccucccgcgc

SEQ ID NO: 3451082 - RNA, 19 nt, Pseudomonas aeruginosa PA01
cggaucgaaguagucggcg

SEQ ID NO: 3451083 - RNA, 20 nt, Pseudomonas aeruginosa PA01
cggaucgaaguagucggcgu

SEQ ID NO: 3451084 - RNA, 14 nt, Pseudomonas aeruginosa PA01
cggaucgacgccuu

SEQ ID NO: 3451085 - RNA, 20 nt, Pseudomonas aeruginosa PA01
cggaucgagcagcggcgcca

SEQ ID NO: 3451086 - RNA, 16 nt, Pseudomonas aeruginosa PA01
cggaucgaucagcagc

SEQ ID NO: 3451087 - RNA, 17 nt, Pseudomonas aeruginosa PA01
cggaucgaucagcagca

SEQ ID NO: 3451088 - RNA, 18 nt, Pseudomonas aeruginosa PA01
cggaucgaucagcagcac

SEQ ID NO: 3451089 - RNA, 21 nt, Pseudomonas aeruginosa PA01
cggaucgaucagcagcaccgc

SEQ ID NO: 3451090 - RNA, 15 nt, Pseudomonas aeruginosa PA01
cggaucgaucagcga

SEQ ID NO: 3451091 - RNA, 17 nt, Pseudomonas aeruginosa PA01
cggaucgaucagcgagc

SEQ ID NO: 3451092 - RNA, 18 nt, Pseudomonas aeruginosa PA01
cggaucgaucgaucagcc

SEQ ID NO: 3451093 - RNA, 16 nt, Pseudomonas aeruginosa PA01
cggaucgaugcccggc

SEQ ID NO: 3451094 - RNA, 18 nt, Pseudomonas aeruginosa PA01
cggaucgaugcccggcug

SEQ ID NO: 3451095 - RNA, 13 nt, Pseudomonas aeruginosa PA01
cggaucgcccggc

SEQ ID NO: 3451096 - RNA, 14 nt, Pseudomonas aeruginosa PA01
cggaucgcccuggc

SEQ ID NO: 3451097 - RNA, 19 nt, Pseudomonas aeruginosa PA01
cggaucgcccuggcgccag

SEQ ID NO: 3451098 - RNA, 13 nt, Pseudomonas aeruginosa PA01
cggaucgccgccu

SEQ ID NO: 3451099 - RNA, 14 nt, Pseudomonas aeruginosa PA01
cggaucgccgccuu

SEQ ID NO: 3451100 - RNA, 15 nt, Pseudomonas aeruginosa PA01
cggaucgcgccgucg

SEQ ID NO: 3451101 - RNA, 19 nt, Pseudomonas aeruginosa PA01
cggaucgcgccgucgcugg

SEQ ID NO: 3451102 - RNA, 15 nt, Pseudomonas aeruginosa PA01
cggaucgcgcugggc

SEQ ID NO: 3451103 - RNA, 18 nt, Pseudomonas aeruginosa PA01
cggaucgcgcugggcgca

SEQ ID NO: 3451104 - RNA, 17 nt, Pseudomonas aeruginosa PA01
cggaucgcgucgcaggc

SEQ ID NO: 3451105 - RNA, 14 nt, Pseudomonas aeruginosa PA01
cggaucggcccggc

SEQ ID NO: 3451106 - RNA, 14 nt, Pseudomonas aeruginosa PA01
cggaucguccgggc

SEQ ID NO: 3451107 - RNA, 13 nt, Pseudomonas aeruginosa PA01
cggaucgucgcgg

SEQ ID NO: 3451108 - RNA, 19 nt, Pseudomonas aeruginosa PA01
cggaucgucgcggcgcgag

SEQ ID NO: 3451109 - RNA, 20 nt, Pseudomonas aeruginosa PA01
cggaucuaaggggcggcucg

SEQ ID NO: 3451110 - RNA, 15 nt, Pseudomonas aeruginosa PA01
cggaucucggugucg

SEQ ID NO: 3451111 - RNA, 15 nt, Pseudomonas aeruginosa PA01
cggaucucgucgccg

SEQ ID NO: 3451112 - RNA, 20 nt, Pseudomonas aeruginosa PA01
cggaucugcuccugcaggcc

SEQ ID NO: 3451113 - RNA, 13 nt, Pseudomonas aeruginosa PA01
cggaucugcucga

SEQ ID NO: 3451114 - RNA, 16 nt, Pseudomonas aeruginosa PA01
cggaucugcucgacgu

SEQ ID NO: 3451115 - RNA, 20 nt, Pseudomonas aeruginosa PA01
cggaucuggaauucgccgcg

SEQ ID NO: 3451116 - RNA, 22 nt, Pseudomonas aeruginosa PA01
cggaucuggaauucgccgcgcg

SEQ ID NO: 3451117 - RNA, 21 nt, Pseudomonas aeruginosa PA01
cggaucuggcccuuuuccucg

SEQ ID NO: 3451118 - RNA, 23 nt, Pseudomonas aeruginosa PA01
cggaugaaagcaaaaaaagccca

SEQ ID NO: 3451119 - RNA, 12 nt, Pseudomonas aeruginosa PA01
cggaugaccuuc

SEQ ID NO: 3451120 - RNA, 19 nt, Pseudomonas aeruginosa PA01
cggaugacgcaaacgccau

SEQ ID NO: 3451121 - RNA, 14 nt, Pseudomonas aeruginosa PA01
cggaugcacgugca

SEQ ID NO: 3451122 - RNA, 17 nt, Pseudomonas aeruginosa PA01
cggaugcacgugcagcu

SEQ ID NO: 3451123 - RNA, 19 nt, Pseudomonas aeruginosa PA01
cggaugcagauccagcggc

SEQ ID NO: 3451124 - RNA, 20 nt, Pseudomonas aeruginosa PA01
cggaugcagauccagcggca

SEQ ID NO: 3451125 - RNA, 13 nt, Pseudomonas aeruginosa PA01
cggaugcagcgcu

SEQ ID NO: 3451126 - RNA, 16 nt, Pseudomonas aeruginosa PA01
cggaugcagucccgcc

SEQ ID NO: 3451127 - RNA, 17 nt, Pseudomonas aeruginosa PA01
cggaugcagucccgcca

SEQ ID NO: 3451128 - RNA, 20 nt, Pseudomonas aeruginosa PA01
cggaugcaguugagucgcgc

SEQ ID NO: 3451129 - RNA, 13 nt, Pseudomonas aeruginosa PA01
cggaugcccuggu

SEQ ID NO: 3451130 - RNA, 15 nt, Pseudomonas aeruginosa PA01
cggaugcccuggucg

SEQ ID NO: 3451131 - RNA, 19 nt, Pseudomonas aeruginosa PA01
cggaugcccuggucggcgg

SEQ ID NO: 3451132 - RNA, 19 nt, Pseudomonas aeruginosa PA01
cggaugccgcacaggcugg

SEQ ID NO: 3451133 - RNA, 21 nt, Pseudomonas aeruginosa PA01
cggaugccgcacaggcuggcc

SEQ ID NO: 3451134 - RNA, 15 nt, Pseudomonas aeruginosa PA01
cggaugccgcgagcc

SEQ ID NO: 3451135 - RNA, 16 nt, Pseudomonas aeruginosa PA01
cggaugccgcgagcca

SEQ ID NO: 3451136 - RNA, 17 nt, Pseudomonas aeruginosa PA01
cggaugccggcgcuguc

SEQ ID NO: 3451137 - RNA, 14 nt, Pseudomonas aeruginosa PA01
cggaugccgggcga

SEQ ID NO: 3451138 - RNA, 21 nt, Pseudomonas aeruginosa PA01
cggaugccgggcgagucgauc

SEQ ID NO: 3451139 - RNA, 21 nt, Pseudomonas aeruginosa PA01
cggaugcgcgaauaccgcgcg

SEQ ID NO: 3451140 - RNA, 23 nt, Pseudomonas aeruginosa PA01
cggaugcguugcucgcaccaggc

SEQ ID NO: 3451141 - RNA, 19 nt, Pseudomonas aeruginosa PA01
cggaugcugacauccacca

SEQ ID NO: 3451142 - RNA, 15 nt, Pseudomonas aeruginosa PA01
cggauggccgccguu

SEQ ID NO: 3451143 - RNA, 16 nt, Pseudomonas aeruginosa PA01
cggauggcgaucgagc

SEQ ID NO: 3451144 - RNA, 17 nt, Pseudomonas aeruginosa PA01
cggauggcgaucgagcu

SEQ ID NO: 3451145 - RNA, 15 nt, Pseudomonas aeruginosa PA01
cggauggcgcggggc

SEQ ID NO: 3451146 - RNA, 21 nt, Pseudomonas aeruginosa PA01
cggauggcgcggggccccggc

SEQ ID NO: 3451147 - RNA, 13 nt, Pseudomonas aeruginosa PA01
cggauggcugacc

SEQ ID NO: 3451148 - RNA, 20 nt, Pseudomonas aeruginosa PA01
cggauggcugacccgcugcu

SEQ ID NO: 3451149 - RNA, 20 nt, Pseudomonas aeruginosa PA01
cggaugggcgacgacgaacg

SEQ ID NO: 3451150 - RNA, 14 nt, Pseudomonas aeruginosa PA01
cggaugggcgagcu

SEQ ID NO: 3451151 - RNA, 17 nt, Pseudomonas aeruginosa PA01
cggauguaguccagcgc

SEQ ID NO: 3451152 - RNA, 18 nt, Pseudomonas aeruginosa PA01
cggauguaguccagcgcc

SEQ ID NO: 3451153 - RNA, 14 nt, Pseudomonas aeruginosa PA01
cggcacgaccacau

SEQ ID NO: 3451154 - RNA, 20 nt, Pseudomonas aeruginosa PA01
cggcacgaccacaucggcca

SEQ ID NO: 3451155 - RNA, 22 nt, Pseudomonas aeruginosa PA01
cggcacgaccacaucggccagu

SEQ ID NO: 3451156 - RNA, 19 nt, Pseudomonas aeruginosa PA01
cggcacgaccuucuccgac

SEQ ID NO: 3451157 - RNA, 15 nt, Pseudomonas aeruginosa PA01
cggcacgaugucgac

SEQ ID NO: 3451158 - RNA, 15 nt, Pseudomonas aeruginosa PA01
cggcacgcagcagcu

SEQ ID NO: 3451159 - RNA, 15 nt, Pseudomonas aeruginosa PA01
cggcacgcguggcga

SEQ ID NO: 3451160 - RNA, 13 nt, Pseudomonas aeruginosa PA01
cggcacgcuccag

SEQ ID NO: 3451161 - RNA, 15 nt, Pseudomonas aeruginosa PA01
cggcacgcuccagau

SEQ ID NO: 3451162 - RNA, 17 nt, Pseudomonas aeruginosa PA01
cggcacgcuccagaucg

SEQ ID NO: 3451163 - RNA, 18 nt, Pseudomonas aeruginosa PA01
cggcacgcuccagaucgc

SEQ ID NO: 3451164 - RNA, 19 nt, Pseudomonas aeruginosa PA01
cggcacgcuccagaucgcc

SEQ ID NO: 3451165 - RNA, 16 nt, Pseudomonas aeruginosa PA01
cggcacgcuccagggc

SEQ ID NO: 3451166 - RNA, 18 nt, Pseudomonas aeruginosa PA01
cggcacgcuccagggcgg

SEQ ID NO: 3451167 - RNA, 16 nt, Pseudomonas aeruginosa PA01
cggcacgcucuggccg

SEQ ID NO: 3451168 - RNA, 16 nt, Pseudomonas aeruginosa PA01
cggcacgcugccgccg

SEQ ID NO: 3451169 - RNA, 15 nt, Pseudomonas aeruginosa PA01
cggcacgcugcuugc

SEQ ID NO: 3451170 - RNA, 18 nt, Pseudomonas aeruginosa PA01
cggcacgcugcuugcgca

SEQ ID NO: 3451171 - RNA, 22 nt, Pseudomonas aeruginosa PA01
cggcacgcugcuugcgcaccuc

SEQ ID NO: 3451172 - RNA, 13 nt, Pseudomonas aeruginosa PA01
cggcacggcaucg

SEQ ID NO: 3451173 - RNA, 23 nt, Pseudomonas aeruginosa PA01
cggcacggucauggccagcucga

SEQ ID NO: 3451174 - RNA, 18 nt, Pseudomonas aeruginosa PA01
cggcacgguggaccaacg

SEQ ID NO: 3451175 - RNA, 16 nt, Pseudomonas aeruginosa PA01
cggcacucagccagcg

SEQ ID NO: 3451176 - RNA, 18 nt, Pseudomonas aeruginosa PA01
cggcacucagccagcggc

SEQ ID NO: 3451177 - RNA, 19 nt, Pseudomonas aeruginosa PA01
cggcacucagccagcggcg

SEQ ID NO: 3451178 - RNA, 20 nt, Pseudomonas aeruginosa PA01
cggcacucagccagcggcgc

SEQ ID NO: 3451179 - RNA, 15 nt, Pseudomonas aeruginosa PA01
cggcacuccggcaua

SEQ ID NO: 3451180 - RNA, 15 nt, Pseudomonas aeruginosa PA01
cggcacucgccgggc

SEQ ID NO: 3451181 - RNA, 16 nt, Pseudomonas aeruginosa PA01
cggcacucgccgggcg

SEQ ID NO: 3451182 - RNA, 17 nt, Pseudomonas aeruginosa PA01
cggcacucggcgaccac

SEQ ID NO: 3451183 - RNA, 19 nt, Pseudomonas aeruginosa PA01
cggcacucggcgaccaccc

SEQ ID NO: 3451184 - RNA, 24 nt, Pseudomonas aeruginosa PA01
cggcacucggcgaccacccggcgg

SEQ ID NO: 3451185 - RNA, 15 nt, Pseudomonas aeruginosa PA01
cggcacuucccgccc

SEQ ID NO: 3451186 - RNA, 22 nt, Pseudomonas aeruginosa PA01
cggcacuuccuuggugaucacc

SEQ ID NO: 3451187 - RNA, 15 nt, Pseudomonas aeruginosa PA01
cggcagaagcuuucc

SEQ ID NO: 3451188 - RNA, 21 nt, Pseudomonas aeruginosa PA01
cggcagaguuucucggucgcc

SEQ ID NO: 3451189 - RNA, 12 nt, Pseudomonas aeruginosa PA01
cggcagauccgc

SEQ ID NO: 3451190 - RNA, 14 nt, Pseudomonas aeruginosa PA01
cggcagauccgccg

SEQ ID NO: 3451191 - RNA, 16 nt, Pseudomonas aeruginosa PA01
cggcagauccgccgug

SEQ ID NO: 3451192 - RNA, 19 nt, Pseudomonas aeruginosa PA01
cggcagauccgccgugagg

SEQ ID NO: 3451193 - RNA, 17 nt, Pseudomonas aeruginosa PA01
cggcagcaccaggccau

SEQ ID NO: 3451194 - RNA, 12 nt, Pseudomonas aeruginosa PA01
cggcagcacccg

SEQ ID NO: 3451195 - RNA, 13 nt, Pseudomonas aeruginosa PA01
cggcagcacccgc

SEQ ID NO: 3451196 - RNA, 14 nt, Pseudomonas aeruginosa PA01
cggcagcacccgca

SEQ ID NO: 3451197 - RNA, 19 nt, Pseudomonas aeruginosa PA01
cggcagcacccgcaccagc

SEQ ID NO: 3451198 - RNA, 22 nt, Pseudomonas aeruginosa PA01
cggcagcacgaugaggcguggg

SEQ ID NO: 3451199 - RNA, 22 nt, Pseudomonas aeruginosa PA01
cggcagcacgcugacgccggca

SEQ ID NO: 3451200 - RNA, 16 nt, Pseudomonas aeruginosa PA01
cggcagcacggcgaua

SEQ ID NO: 3451201 - RNA, 15 nt, Pseudomonas aeruginosa PA01
cggcagcagccaacc

SEQ ID NO: 3451202 - RNA, 12 nt, Pseudomonas aeruginosa PA01
cggcagcagcgc

SEQ ID NO: 3451203 - RNA, 14 nt, Pseudomonas aeruginosa PA01
cggcagcagcgcca

SEQ ID NO: 3451204 - RNA, 16 nt, Pseudomonas aeruginosa PA01
cggcagcagcgccagg

SEQ ID NO: 3451205 - RNA, 18 nt, Pseudomonas aeruginosa PA01
cggcagcagcggaucggc

SEQ ID NO: 3451206 - RNA, 16 nt, Pseudomonas aeruginosa PA01
cggcagcagcuugccg

SEQ ID NO: 3451207 - RNA, 20 nt, Pseudomonas aeruginosa PA01
cggcagcagcuugccggcau

SEQ ID NO: 3451208 - RNA, 21 nt, Pseudomonas aeruginosa PA01
cggcagcagcuugccggcaua

SEQ ID NO: 3451209 - RNA, 11 nt, Pseudomonas aeruginosa PA01
cggcagcaggc

SEQ ID NO: 3451210 - RNA, 13 nt, Pseudomonas aeruginosa PA01
cggcagcaggccg

SEQ ID NO: 3451211 - RNA, 16 nt, Pseudomonas aeruginosa PA01
cggcagcaggccgccg

SEQ ID NO: 3451212 - RNA, 17 nt, Pseudomonas aeruginosa PA01
cggcagcaggccgccgc

SEQ ID NO: 3451213 - RNA, 19 nt, Pseudomonas aeruginosa PA01
cggcagcaggccgccgcgu

SEQ ID NO: 3451214 - RNA, 22 nt, Pseudomonas aeruginosa PA01
cggcagcaggcuguacagcagg

SEQ ID NO: 3451215 - RNA, 15 nt, Pseudomonas aeruginosa PA01
cggcagcagggucag

SEQ ID NO: 3451216 - RNA, 19 nt, Pseudomonas aeruginosa PA01
cggcagcagggucagcagc

SEQ ID NO: 3451217 - RNA, 22 nt, Pseudomonas aeruginosa PA01
cggcagcagggucagcagcgcc

SEQ ID NO: 3451218 - RNA, 23 nt, Pseudomonas aeruginosa PA01
cggcagcagggucagcagcgcca

SEQ ID NO: 3451219 - RNA, 13 nt, Pseudomonas aeruginosa PA01
cggcagcaucagc

SEQ ID NO: 3451220 - RNA, 15 nt, Pseudomonas aeruginosa PA01
cggcagcaucagccg

SEQ ID NO: 3451221 - RNA, 17 nt, Pseudomonas aeruginosa PA01
cggcagcaucagccgcg

SEQ ID NO: 3451222 - RNA, 18 nt, Pseudomonas aeruginosa PA01
cggcagcaucucggugcg

SEQ ID NO: 3451223 - RNA, 19 nt, Pseudomonas aeruginosa PA01
cggcagcaucucggugcgc

SEQ ID NO: 3451224 - RNA, 21 nt, Pseudomonas aeruginosa PA01
cggcagcaucucggugcgccc

SEQ ID NO: 3451225 - RNA, 15 nt, Pseudomonas aeruginosa PA01
cggcagccaccaggu

SEQ ID NO: 3451226 - RNA, 19 nt, Pseudomonas aeruginosa PA01
cggcagccacucggccagg

SEQ ID NO: 3451227 - RNA, 14 nt, Pseudomonas aeruginosa PA01
cggcagccagccgc

SEQ ID NO: 3451228 - RNA, 15 nt, Pseudomonas aeruginosa PA01
cggcagccagccgcc

SEQ ID NO: 3451229 - RNA, 16 nt, Pseudomonas aeruginosa PA01
cggcagccagccgccg

SEQ ID NO: 3451230 - RNA, 17 nt, Pseudomonas aeruginosa PA01
cggcagccagccgccga

SEQ ID NO: 3451231 - RNA, 22 nt, Pseudomonas aeruginosa PA01
cggcagccagccgccgaagggc

SEQ ID NO: 3451232 - RNA, 23 nt, Pseudomonas aeruginosa PA01
cggcagccaucgcauagccggcg

SEQ ID NO: 3451233 - RNA, 12 nt, Pseudomonas aeruginosa PA01
cggcagccgcgu

SEQ ID NO: 3451234 - RNA, 13 nt, Pseudomonas aeruginosa PA01
cggcagccguccg

SEQ ID NO: 3451235 - RNA, 14 nt, Pseudomonas aeruginosa PA01
cggcagccguccgc

SEQ ID NO: 3451236 - RNA, 17 nt, Pseudomonas aeruginosa PA01
cggcagcgaccaccacc

SEQ ID NO: 3451237 - RNA, 13 nt, Pseudomonas aeruginosa PA01
cggcagcgagcgg

SEQ ID NO: 3451238 - RNA, 15 nt, Pseudomonas aeruginosa PA01
cggcagcgagcgggu

SEQ ID NO: 3451239 - RNA, 17 nt, Pseudomonas aeruginosa PA01
cggcagcgccagguagu

SEQ ID NO: 3451240 - RNA, 18 nt, Pseudomonas aeruginosa PA01
cggcagcgccaucaggcc

SEQ ID NO: 3451241 - RNA, 20 nt, Pseudomonas aeruginosa PA01
cggcagcgccaucaggcccu

SEQ ID NO: 3451242 - RNA, 15 nt, Pseudomonas aeruginosa PA01
cggcagcgccgaggu

SEQ ID NO: 3451243 - RNA, 16 nt, Pseudomonas aeruginosa PA01
cggcagcgccgagguc

SEQ ID NO: 3451244 - RNA, 15 nt, Pseudomonas aeruginosa PA01
cggcagcgccgccag

SEQ ID NO: 3451245 - RNA, 17 nt, Pseudomonas aeruginosa PA01
cggcagcgccgccagca

SEQ ID NO: 3451246 - RNA, 13 nt, Pseudomonas aeruginosa PA01
cggcagcgccgcg

SEQ ID NO: 3451247 - RNA, 18 nt, Pseudomonas aeruginosa PA01
cggcagcgccgcgcggca

SEQ ID NO: 3451248 - RNA, 23 nt, Pseudomonas aeruginosa PA01
cggcagcgccgcgcggcaacacc

SEQ ID NO: 3451249 - RNA, 14 nt, Pseudomonas aeruginosa PA01
cggcagcgccgggc

SEQ ID NO: 3451250 - RNA, 16 nt, Pseudomonas aeruginosa PA01
cggcagcgccgggcau

SEQ ID NO: 3451251 - RNA, 20 nt, Pseudomonas aeruginosa PA01
cggcagcgccgggcauucgc

SEQ ID NO: 3451252 - RNA, 13 nt, Pseudomonas aeruginosa PA01
cggcagcgccucg

SEQ ID NO: 3451253 - RNA, 16 nt, Pseudomonas aeruginosa PA01
cggcagcgccucggcg

SEQ ID NO: 3451254 - RNA, 21 nt, Pseudomonas aeruginosa PA01
cggcagcgccuuuucggcacu

SEQ ID NO: 3451255 - RNA, 19 nt, Pseudomonas aeruginosa PA01
cggcagcgcguagaccacc

SEQ ID NO: 3451256 - RNA, 15 nt, Pseudomonas aeruginosa PA01
cggcaggguagccac

SEQ ID NO: 3451257 - RNA, 16 nt, Pseudomonas aeruginosa PA01
cggcaggguagccacg

SEQ ID NO: 3451258 - RNA, 15 nt, Pseudomonas aeruginosa PA01
cggcagggucacgcc

SEQ ID NO: 3451259 - RNA, 20 nt, Pseudomonas aeruginosa PA01
cggcagggucacgccgguga

SEQ ID NO: 3451260 - RNA, 15 nt, Pseudomonas aeruginosa PA01
cggcagggucagccg

SEQ ID NO: 3451261 - RNA, 14 nt, Pseudomonas aeruginosa PA01
cggcaggguggcgc

SEQ ID NO: 3451262 - RNA, 15 nt, Pseudomonas aeruginosa PA01
cggcaggguggcgca

SEQ ID NO: 3451263 - RNA, 16 nt, Pseudomonas aeruginosa PA01
cggcagguagaccucg

SEQ ID NO: 3451264 - RNA, 17 nt, Pseudomonas aeruginosa PA01
cggcagguagaccucga

SEQ ID NO: 3451265 - RNA, 12 nt, Pseudomonas aeruginosa PA01
cggcagguagug

SEQ ID NO: 3451266 - RNA, 15 nt, Pseudomonas aeruginosa PA01
cggcagguaguggcc

SEQ ID NO: 3451267 - RNA, 18 nt, Pseudomonas aeruginosa PA01
cggcaggucgggcaacgg

SEQ ID NO: 3451268 - RNA, 22 nt, Pseudomonas aeruginosa PA01
cggcaggucguugacgaucugc

SEQ ID NO: 3451269 - RNA, 11 nt, Pseudomonas aeruginosa PA01
cggcagguggc

SEQ ID NO: 3451270 - RNA, 16 nt, Pseudomonas aeruginosa PA01
cggcagguggccggaa

SEQ ID NO: 3451271 - RNA, 20 nt, Pseudomonas aeruginosa PA01
cggcagguggcgggucggcg

SEQ ID NO: 3451272 - RNA, 21 nt, Pseudomonas aeruginosa PA01
cggcagguggcgggucggcgg

SEQ ID NO: 3451273 - RNA, 16 nt, Pseudomonas aeruginosa PA01
cggcagguggcuggcc

SEQ ID NO: 3451274 - RNA, 20 nt, Pseudomonas aeruginosa PA01
cggcaggugguaagcgagca

SEQ ID NO: 3451275 - RNA, 13 nt, Pseudomonas aeruginosa PA01
cggcagguggucg

SEQ ID NO: 3451276 - RNA, 19 nt, Pseudomonas aeruginosa PA01
cggcagguggucguugcgc

SEQ ID NO: 3451277 - RNA, 15 nt, Pseudomonas aeruginosa PA01
cggcagguucagcag

SEQ ID NO: 3451278 - RNA, 16 nt, Pseudomonas aeruginosa PA01
cggcagguucagcagg

SEQ ID NO: 3451279 - RNA, 17 nt, Pseudomonas aeruginosa PA01
cggcagguucagcaggu

SEQ ID NO: 3451280 - RNA, 21 nt, Pseudomonas aeruginosa PA01
cggcagguugaugugcaguuc

SEQ ID NO: 3451281 - RNA, 16 nt, Pseudomonas aeruginosa PA01
cggcagguuguucgcc

SEQ ID NO: 3451282 - RNA, 20 nt, Pseudomonas aeruginosa PA01
cggcagguuguucgccgcag

SEQ ID NO: 3451283 - RNA, 15 nt, Pseudomonas aeruginosa PA01
cggcaguacgcucug

SEQ ID NO: 3451284 - RNA, 15 nt, Pseudomonas aeruginosa PA01
cggcaguccucgccg

SEQ ID NO: 3451285 - RNA, 20 nt, Pseudomonas aeruginosa PA01
cggcaguccucgccguuggc

SEQ ID NO: 3451286 - RNA, 22 nt, Pseudomonas aeruginosa PA01
cggcaguccucgccguuggcga

SEQ ID NO: 3451287 - RNA, 19 nt, Pseudomonas aeruginosa PA01
cggcagucgguagaaaucc

SEQ ID NO: 3451288 - RNA, 15 nt, Pseudomonas aeruginosa PA01
cggcagugcucgauc

SEQ ID NO: 3451289 - RNA, 17 nt, Pseudomonas aeruginosa PA01
cggcagugcucgaucag

SEQ ID NO: 3451290 - RNA, 19 nt, Pseudomonas aeruginosa PA01
cggcagugcucgaucaggc

SEQ ID NO: 3451291 - RNA, 23 nt, Pseudomonas aeruginosa PA01
cggcaguggugauccgcacccgc

SEQ ID NO: 3451292 - RNA, 20 nt, Pseudomonas aeruginosa PA01
cggcagugugccgcccugcu

SEQ ID NO: 3451293 - RNA, 15 nt, Pseudomonas aeruginosa PA01
cggcauagaugccgg

SEQ ID NO: 3451294 - RNA, 15 nt, Pseudomonas aeruginosa PA01
cggcauagcgcagcc

SEQ ID NO: 3451295 - RNA, 16 nt, Pseudomonas aeruginosa PA01
cggcauagcgcagccg

SEQ ID NO: 3451296 - RNA, 17 nt, Pseudomonas aeruginosa PA01
cggcauaggcccggcgu

SEQ ID NO: 3451297 - RNA, 19 nt, Pseudomonas aeruginosa PA01
cggcauaggcccggcgugc

SEQ ID NO: 3451298 - RNA, 17 nt, Pseudomonas aeruginosa PA01
cggcauaggcgccagcc

SEQ ID NO: 3451299 - RNA, 17 nt, Pseudomonas aeruginosa PA01
cggcaucaccggcggga

SEQ ID NO: 3451300 - RNA, 19 nt, Pseudomonas aeruginosa PA01
cggcaucaguagcgggcau

SEQ ID NO: 3451301 - RNA, 13 nt, Pseudomonas aeruginosa PA01
cggcauccagcau

SEQ ID NO: 3451302 - RNA, 14 nt, Pseudomonas aeruginosa PA01
cggcauccagcauc

SEQ ID NO: 3451303 - RNA, 16 nt, Pseudomonas aeruginosa PA01
cggcauccagcauccg

SEQ ID NO: 3451304 - RNA, 23 nt, Pseudomonas aeruginosa PA01
cggcauccaguuccugcaccacg

SEQ ID NO: 3451305 - RNA, 14 nt, Pseudomonas aeruginosa PA01
cggcaucccgcccg

SEQ ID NO: 3451306 - RNA, 15 nt, Pseudomonas aeruginosa PA01
cggcaucccgcccgg

SEQ ID NO: 3451307 - RNA, 14 nt, Pseudomonas aeruginosa PA01
cggcauccgccgcu

SEQ ID NO: 3451308 - RNA, 19 nt, Pseudomonas aeruginosa PA01
cggcauccgccgcugggga

SEQ ID NO: 3451309 - RNA, 22 nt, Pseudomonas aeruginosa PA01
cggcauccucgccccgccggga

SEQ ID NO: 3451310 - RNA, 13 nt, Pseudomonas aeruginosa PA01
cggcauccuggcg

SEQ ID NO: 3451311 - RNA, 19 nt, Pseudomonas aeruginosa PA01
cggcaucgaccagggccgg

SEQ ID NO: 3451312 - RNA, 14 nt, Pseudomonas aeruginosa PA01
cggcaucgauccgc

SEQ ID NO: 3451313 - RNA, 16 nt, Pseudomonas aeruginosa PA01
cggcaucgccauggcg

SEQ ID NO: 3451314 - RNA, 16 nt, Pseudomonas aeruginosa PA01
cggcaucgccggggcu

SEQ ID NO: 3451315 - RNA, 18 nt, Pseudomonas aeruginosa PA01
cggcaucgcguagggcgu

SEQ ID NO: 3451316 - RNA, 16 nt, Pseudomonas aeruginosa PA01
cggcaucgcucugcug

SEQ ID NO: 3451317 - RNA, 15 nt, Pseudomonas aeruginosa PA01
cggcaucggccuggu

SEQ ID NO: 3451318 - RNA, 16 nt, Pseudomonas aeruginosa PA01
cggcaucggcgccgcg

SEQ ID NO: 3451319 - RNA, 17 nt, Pseudomonas aeruginosa PA01
cggcaucggcgccgcgc

SEQ ID NO: 3451320 - RNA, 18 nt, Pseudomonas aeruginosa PA01
cggcaucggcgccgcgca

SEQ ID NO: 3451321 - RNA, 20 nt, Pseudomonas aeruginosa PA01
cggcaucggcgccgcgcacc

SEQ ID NO: 3451322 - RNA, 18 nt, Pseudomonas aeruginosa PA01
cggcaucgucgaagcuga

SEQ ID NO: 3451323 - RNA, 19 nt, Pseudomonas aeruginosa PA01
cggcaucuucaaucgcgcg

SEQ ID NO: 3451324 - RNA, 19 nt, Pseudomonas aeruginosa PA01
cggcaucuuguguaccacc

SEQ ID NO: 3451325 - RNA, 16 nt, Pseudomonas aeruginosa PA01
cggcaugcccugccgg

SEQ ID NO: 3451326 - RNA, 17 nt, Pseudomonas aeruginosa PA01
cggcaugcccugccggc

SEQ ID NO: 3451327 - RNA, 19 nt, Pseudomonas aeruginosa PA01
cggcaugcccugccggcgc

SEQ ID NO: 3451328 - RNA, 20 nt, Pseudomonas aeruginosa PA01
cggcaugcccugccggcgca

SEQ ID NO: 3451329 - RNA, 14 nt, Pseudomonas aeruginosa PA01
cggcaugccguugg

SEQ ID NO: 3451330 - RNA, 17 nt, Pseudomonas aeruginosa PA01
cggcaugcucagccgcg

SEQ ID NO: 3451331 - RNA, 18 nt, Pseudomonas aeruginosa PA01
cggcaugcucagccgcgc

SEQ ID NO: 3451332 - RNA, 19 nt, Pseudomonas aeruginosa PA01
cggcaugcucagccgcgcc

SEQ ID NO: 3451333 - RNA, 24 nt, Pseudomonas aeruginosa PA01
cggcaugcucagccgcgccggggc

SEQ ID NO: 3451334 - RNA, 14 nt, Pseudomonas aeruginosa PA01
cggcauggaucaac

SEQ ID NO: 3451335 - RNA, 15 nt, Pseudomonas aeruginosa PA01
cggcauggccacgcu

SEQ ID NO: 3451336 - RNA, 14 nt, Pseudomonas aeruginosa PA01
cggcauggccgacc

SEQ ID NO: 3451337 - RNA, 20 nt, Pseudomonas aeruginosa PA01
cggcauggccgaccgccagg

SEQ ID NO: 3451338 - RNA, 24 nt, Pseudomonas aeruginosa PA01
cggcauggccgaccgccaggccga

SEQ ID NO: 3451339 - RNA, 17 nt, Pseudomonas aeruginosa PA01
cggcaugggcauccugc

SEQ ID NO: 3451340 - RNA, 18 nt, Pseudomonas aeruginosa PA01
cggcaugggcauccugcc

SEQ ID NO: 3451341 - RNA, 20 nt, Pseudomonas aeruginosa PA01
cggcaugguccguucggcgc

SEQ ID NO: 3451342 - RNA, 16 nt, Pseudomonas aeruginosa PA01
cggcauuccgggcgaa

SEQ ID NO: 3451343 - RNA, 20 nt, Pseudomonas aeruginosa PA01
cggcauuccgggcgaaagcg

SEQ ID NO: 3451344 - RNA, 14 nt, Pseudomonas aeruginosa PA01
cggcauuccugguc

SEQ ID NO: 3451345 - RNA, 15 nt, Pseudomonas aeruginosa PA01
cggcauuccuggucc

SEQ ID NO: 3451346 - RNA, 18 nt, Pseudomonas aeruginosa PA01
cggcauucgacccgccga

SEQ ID NO: 3451347 - RNA, 20 nt, Pseudomonas aeruginosa PA01
cggcauucgacccgccgacc

SEQ ID NO: 3451348 - RNA, 21 nt, Pseudomonas aeruginosa PA01
cggcauucgacccgccgacca

SEQ ID NO: 3451349 - RNA, 16 nt, Pseudomonas aeruginosa PA01
cggcauugagggcgag

SEQ ID NO: 3451350 - RNA, 20 nt, Pseudomonas aeruginosa PA01
cggcauuggagaugaucagc

SEQ ID NO: 3451351 - RNA, 17 nt, Pseudomonas aeruginosa PA01
cggcauuggcacccugg

SEQ ID NO: 3451352 - RNA, 16 nt, Pseudomonas aeruginosa PA01
cggccaacccgcuucg

SEQ ID NO: 3451353 - RNA, 16 nt, Pseudomonas aeruginosa PA01
cggccaaccucucccc

SEQ ID NO: 3451354 - RNA, 21 nt, Pseudomonas aeruginosa PA01
cggccaaccucuccccagacc

SEQ ID NO: 3451355 - RNA, 22 nt, Pseudomonas aeruginosa PA01
cggccaaccucuccccagaccc

SEQ ID NO: 3451356 - RNA, 18 nt, Pseudomonas aeruginosa PA01
cggccaacugggccuuga

SEQ ID NO: 3451357 - RNA, 18 nt, Pseudomonas aeruginosa PA01
cggccaaugcccggaccu

SEQ ID NO: 3451358 - RNA, 13 nt, Pseudomonas aeruginosa PA01
cggccaccaccac

SEQ ID NO: 3451359 - RNA, 17 nt, Pseudomonas aeruginosa PA01
cggccaggcggccgacg

SEQ ID NO: 3451360 - RNA, 18 nt, Pseudomonas aeruginosa PA01
cggccaggcgguccagcc

SEQ ID NO: 3451361 - RNA, 21 nt, Pseudomonas aeruginosa PA01
cggccaggcgguccagccaga

SEQ ID NO: 3451362 - RNA, 16 nt, Pseudomonas aeruginosa PA01
cggccagggagcgcga

SEQ ID NO: 3451363 - RNA, 17 nt, Pseudomonas aeruginosa PA01
cggccagggagcgcgac

SEQ ID NO: 3451364 - RNA, 18 nt, Pseudomonas aeruginosa PA01
cggccagggagucgcugg

SEQ ID NO: 3451365 - RNA, 19 nt, Pseudomonas aeruginosa PA01
cggccagggagucgcuggc

SEQ ID NO: 3451366 - RNA, 23 nt, Pseudomonas aeruginosa PA01
cggccagggcaugggucagcgcc

SEQ ID NO: 3451367 - RNA, 14 nt, Pseudomonas aeruginosa PA01
cggccagggccgcu

SEQ ID NO: 3451368 - RNA, 22 nt, Pseudomonas aeruginosa PA01
cggccagggccgcucgagggcg

SEQ ID NO: 3451369 - RNA, 20 nt, Pseudomonas aeruginosa PA01
cggccagggcgaggccgcuc

SEQ ID NO: 3451370 - RNA, 14 nt, Pseudomonas aeruginosa PA01
cggccagggcgcgg

SEQ ID NO: 3451371 - RNA, 16 nt, Pseudomonas aeruginosa PA01
cggccagggcgcggua

SEQ ID NO: 3451372 - RNA, 17 nt, Pseudomonas aeruginosa PA01
cggccagggcgcgguag

SEQ ID NO: 3451373 - RNA, 17 nt, Pseudomonas aeruginosa PA01
cggccaggggagcgccg

SEQ ID NO: 3451374 - RNA, 18 nt, Pseudomonas aeruginosa PA01
cggccaggggagcgccgg

SEQ ID NO: 3451375 - RNA, 19 nt, Pseudomonas aeruginosa PA01
cggccaggggagcgccggc

SEQ ID NO: 3451376 - RNA, 16 nt, Pseudomonas aeruginosa PA01
cggccagggucgccag

SEQ ID NO: 3451377 - RNA, 17 nt, Pseudomonas aeruginosa PA01
cggccagggucgccagc

SEQ ID NO: 3451378 - RNA, 20 nt, Pseudomonas aeruginosa PA01
cggccagguaccggccaggc

SEQ ID NO: 3451379 - RNA, 21 nt, Pseudomonas aeruginosa PA01
cggccagguaccggccaggcg

SEQ ID NO: 3451380 - RNA, 16 nt, Pseudomonas aeruginosa PA01
cggccagguacuggcg

SEQ ID NO: 3451381 - RNA, 22 nt, Pseudomonas aeruginosa PA01
cggccagguacuuggccacgcc

SEQ ID NO: 3451382 - RNA, 20 nt, Pseudomonas aeruginosa PA01
cggccagguagcggaccccg

SEQ ID NO: 3451383 - RNA, 16 nt, Pseudomonas aeruginosa PA01
cggccagguagcggcg

SEQ ID NO: 3451384 - RNA, 22 nt, Pseudomonas aeruginosa PA01
cggccagguagcggcguucgcc

SEQ ID NO: 3451385 - RNA, 17 nt, Pseudomonas aeruginosa PA01
cggccagguaggcgacg

SEQ ID NO: 3451386 - RNA, 21 nt, Pseudomonas aeruginosa PA01
cggccagguauucgcgcucgg

SEQ ID NO: 3451387 - RNA, 15 nt, Pseudomonas aeruginosa PA01
cggccaggucgaggu

SEQ ID NO: 3451388 - RNA, 15 nt, Pseudomonas aeruginosa PA01
cggccaggucgcgac

SEQ ID NO: 3451389 - RNA, 21 nt, Pseudomonas aeruginosa PA01
cggccaggucgcgggugaagc

SEQ ID NO: 3451390 - RNA, 21 nt, Pseudomonas aeruginosa PA01
cggccaggucguugcgccggc

SEQ ID NO: 3451391 - RNA, 23 nt, Pseudomonas aeruginosa PA01
cggccaguccggucagcagcagg

SEQ ID NO: 3451392 - RNA, 20 nt, Pseudomonas aeruginosa PA01
cggccaguuccuucacggca

SEQ ID NO: 3451393 - RNA, 23 nt, Pseudomonas aeruginosa PA01
cggccaguuccuucacggcaucc

SEQ ID NO: 3451394 - RNA, 18 nt, Pseudomonas aeruginosa PA01
cggccaguucgcggcgca

SEQ ID NO: 3451395 - RNA, 20 nt, Pseudomonas aeruginosa PA01
cggccaguucggggucggcc

SEQ ID NO: 3451396 - RNA, 17 nt, Pseudomonas aeruginosa PA01
cggccaguucgucgagc

SEQ ID NO: 3451397 - RNA, 23 nt, Pseudomonas aeruginosa PA01
cggccaguuggugcacgcgccgg

SEQ ID NO: 3451398 - RNA, 16 nt, Pseudomonas aeruginosa PA01
cggccauaauggccgc

SEQ ID NO: 3451399 - RNA, 17 nt, Pseudomonas aeruginosa PA01
cggccauaccuccagcc

SEQ ID NO: 3451400 - RNA, 15 nt, Pseudomonas aeruginosa PA01
cggccaucagcacca

SEQ ID NO: 3451401 - RNA, 17 nt, Pseudomonas aeruginosa PA01
cggccaucagcaccagg

SEQ ID NO: 3451402 - RNA, 18 nt, Pseudomonas aeruginosa PA01
cggccaucagcaccagga

SEQ ID NO: 3451403 - RNA, 23 nt, Pseudomonas aeruginosa PA01
cggccaucagcaccaggaagccc

SEQ ID NO: 3451404 - RNA, 14 nt, Pseudomonas aeruginosa PA01
cggccaucagcacg

SEQ ID NO: 3451405 - RNA, 15 nt, Pseudomonas aeruginosa PA01
cggccaucagcacgu

SEQ ID NO: 3451406 - RNA, 16 nt, Pseudomonas aeruginosa PA01
cggccaucagcacguc

SEQ ID NO: 3451407 - RNA, 13 nt, Pseudomonas aeruginosa PA01
cggccaucagcgc

SEQ ID NO: 3451408 - RNA, 16 nt, Pseudomonas aeruginosa PA01
cggccaucagcgccag

SEQ ID NO: 3451409 - RNA, 17 nt, Pseudomonas aeruginosa PA01
cggccaucagcgccagg

SEQ ID NO: 3451410 - RNA, 20 nt, Pseudomonas aeruginosa PA01
cggccaucagcgccagggca

SEQ ID NO: 3451411 - RNA, 12 nt, Pseudomonas aeruginosa PA01
cggccaucaggc

SEQ ID NO: 3451412 - RNA, 13 nt, Pseudomonas aeruginosa PA01
cggccaucaggcg

SEQ ID NO: 3451413 - RNA, 15 nt, Pseudomonas aeruginosa PA01
cggccaucaggcgcu

SEQ ID NO: 3451414 - RNA, 16 nt, Pseudomonas aeruginosa PA01
cggccaucaggcgcug

SEQ ID NO: 3451415 - RNA, 15 nt, Pseudomonas aeruginosa PA01
cggccauccagccag

SEQ ID NO: 3451416 - RNA, 18 nt, Pseudomonas aeruginosa PA01
cggccauccagccaggcg

SEQ ID NO: 3451417 - RNA, 17 nt, Pseudomonas aeruginosa PA01
cggccauccuggccggu

SEQ ID NO: 3451418 - RNA, 16 nt, Pseudomonas aeruginosa PA01
cggccaucgagcgcuc

SEQ ID NO: 3451419 - RNA, 17 nt, Pseudomonas aeruginosa PA01
cggccaucgagcgcucc

SEQ ID NO: 3451420 - RNA, 12 nt, Pseudomonas aeruginosa PA01
cggccaucgccg

SEQ ID NO: 3451421 - RNA, 13 nt, Pseudomonas aeruginosa PA01
cggccaucgccgu

SEQ ID NO: 3451422 - RNA, 14 nt, Pseudomonas aeruginosa PA01
cggccaucggcgaa

SEQ ID NO: 3451423 - RNA, 17 nt, Pseudomonas aeruginosa PA01
cggccaucuggcugccg

SEQ ID NO: 3451424 - RNA, 16 nt, Pseudomonas aeruginosa PA01
cggccaugagccgggg

SEQ ID NO: 3451425 - RNA, 17 nt, Pseudomonas aeruginosa PA01
cggccaugagccggggu

SEQ ID NO: 3451426 - RNA, 15 nt, Pseudomonas aeruginosa PA01
cggccaugcaggcca

SEQ ID NO: 3451427 - RNA, 16 nt, Pseudomonas aeruginosa PA01
cggccaugcaggccag

SEQ ID NO: 3451428 - RNA, 17 nt, Pseudomonas aeruginosa PA01
cggccaugcaggccagg

SEQ ID NO: 3451429 - RNA, 15 nt, Pseudomonas aeruginosa PA01
cggccaugccgccga

SEQ ID NO: 3451430 - RNA, 13 nt, Pseudomonas aeruginosa PA01
cggccaugccggc

SEQ ID NO: 3451431 - RNA, 15 nt, Pseudomonas aeruginosa PA01
cggccaugccggcca

SEQ ID NO: 3451432 - RNA, 17 nt, Pseudomonas aeruginosa PA01
cggccaugccggccagg

SEQ ID NO: 3451433 - RNA, 16 nt, Pseudomonas aeruginosa PA01
cggccaugcuggcgcu

SEQ ID NO: 3451434 - RNA, 13 nt, Pseudomonas aeruginosa PA01
cggccauggccga

SEQ ID NO: 3451435 - RNA, 23 nt, Pseudomonas aeruginosa PA01
cggccauggcgggucacgccgaa

SEQ ID NO: 3451436 - RNA, 20 nt, Pseudomonas aeruginosa PA01
cggccauggucucgcugacc

SEQ ID NO: 3451437 - RNA, 22 nt, Pseudomonas aeruginosa PA01
cggccauggucucgcugaccca

SEQ ID NO: 3451438 - RNA, 15 nt, Pseudomonas aeruginosa PA01
cggccauuacgccga

SEQ ID NO: 3451439 - RNA, 16 nt, Pseudomonas aeruginosa PA01
cggccauuacgccgag

SEQ ID NO: 3451440 - RNA, 18 nt, Pseudomonas aeruginosa PA01
cggccauuacgccgagca

SEQ ID NO: 3451441 - RNA, 16 nt, Pseudomonas aeruginosa PA01
cggccauuccuuccag

SEQ ID NO: 3451442 - RNA, 18 nt, Pseudomonas aeruginosa PA01
cggccauuccuuccaggg

SEQ ID NO: 3451443 - RNA, 20 nt, Pseudomonas aeruginosa PA01
cggccauucgcugucgagca

SEQ ID NO: 3451444 - RNA, 22 nt, Pseudomonas aeruginosa PA01
cggccauucgcugucgagcagg

SEQ ID NO: 3451445 - RNA, 23 nt, Pseudomonas aeruginosa PA01
cggccauucgcugucgagcaggg

SEQ ID NO: 3451446 - RNA, 16 nt, Pseudomonas aeruginosa PA01
cggccauucggccugg

SEQ ID NO: 3451447 - RNA, 17 nt, Pseudomonas aeruginosa PA01
cggccauucggccuggc

SEQ ID NO: 3451448 - RNA, 17 nt, Pseudomonas aeruginosa PA01
cggccauugcccggugg

SEQ ID NO: 3451449 - RNA, 22 nt, Pseudomonas aeruginosa PA01
cggccauugcccgguggccucc

SEQ ID NO: 3451450 - RNA, 15 nt, Pseudomonas aeruginosa PA01
cggccauugccgcca

SEQ ID NO: 3451451 - RNA, 17 nt, Pseudomonas aeruginosa PA01
cggccauugccgcgggc

SEQ ID NO: 3451452 - RNA, 16 nt, Pseudomonas aeruginosa PA01
cggccauugucggccu

SEQ ID NO: 3451453 - RNA, 17 nt, Pseudomonas aeruginosa PA01
cggccauuugcgugcug

SEQ ID NO: 3451454 - RNA, 10 nt, Pseudomonas aeruginosa PA01
cggcccacca

SEQ ID NO: 3451455 - RNA, 13 nt, Pseudomonas aeruginosa PA01
cggcccaccagag

SEQ ID NO: 3451456 - RNA, 11 nt, Pseudomonas aeruginosa PA01
cggcccacgcu

SEQ ID NO: 3451457 - RNA, 23 nt, Pseudomonas aeruginosa PA01
cggcccacgcucagugcgccggg

SEQ ID NO: 3451458 - RNA, 15 nt, Pseudomonas aeruginosa PA01
cggcccacggcgaga

SEQ ID NO: 3451459 - RNA, 14 nt, Pseudomonas aeruginosa PA01
cggcccagcagcgc

SEQ ID NO: 3451460 - RNA, 17 nt, Pseudomonas aeruginosa PA01
cggcccagcagcgcuca

SEQ ID NO: 3451461 - RNA, 19 nt, Pseudomonas aeruginosa PA01
cggcccagccgcggcgcca

SEQ ID NO: 3451462 - RNA, 18 nt, Pseudomonas aeruginosa PA01
cggccgaacucuggcggc

SEQ ID NO: 3451463 - RNA, 19 nt, Pseudomonas aeruginosa PA01
cggccgaacucuggcggcg

SEQ ID NO: 3451464 - RNA, 20 nt, Pseudomonas aeruginosa PA01
cggccgaacucuggcggcgu

SEQ ID NO: 3451465 - RNA, 17 nt, Pseudomonas aeruginosa PA01
cggccgaauccuccagc

SEQ ID NO: 3451466 - RNA, 18 nt, Pseudomonas aeruginosa PA01
cggccgaauccuccagcc

SEQ ID NO: 3451467 - RNA, 19 nt, Pseudomonas aeruginosa PA01
cggccgaauccuccagccg

SEQ ID NO: 3451468 - RNA, 21 nt, Pseudomonas aeruginosa PA01
cggccgaauccuccagccggc

SEQ ID NO: 3451469 - RNA, 22 nt, Pseudomonas aeruginosa PA01
cggccgaauccuccagccggcg

SEQ ID NO: 3451470 - RNA, 23 nt, Pseudomonas aeruginosa PA01
cggccgaauccuccagccggcga

SEQ ID NO: 3451471 - RNA, 18 nt, Pseudomonas aeruginosa PA01
cggccgacagagcggccg

SEQ ID NO: 3451472 - RNA, 19 nt, Pseudomonas aeruginosa PA01
cggccgacagagcggccgg

SEQ ID NO: 3451473 - RNA, 20 nt, Pseudomonas aeruginosa PA01
cggccgacagagcggccggc

SEQ ID NO: 3451474 - RNA, 14 nt, Pseudomonas aeruginosa PA01
cggccgacaggcug

SEQ ID NO: 3451475 - RNA, 19 nt, Pseudomonas aeruginosa PA01
cggccgacaggcuggugcc

SEQ ID NO: 3451476 - RNA, 13 nt, Pseudomonas aeruginosa PA01
cggccgaccaggc

SEQ ID NO: 3451477 - RNA, 14 nt, Pseudomonas aeruginosa PA01
cggccgaccaggcc

SEQ ID NO: 3451478 - RNA, 18 nt, Pseudomonas aeruginosa PA01
cggccgaccaggccguag

SEQ ID NO: 3451479 - RNA, 22 nt, Pseudomonas aeruginosa PA01
cggccgacgguaguaccucgaa

SEQ ID NO: 3451480 - RNA, 18 nt, Pseudomonas aeruginosa PA01
cggccgacgugcacccgc

SEQ ID NO: 3451481 - RNA, 19 nt, Pseudomonas aeruginosa PA01
cggccgagauccugcagca

SEQ ID NO: 3451482 - RNA, 20 nt, Pseudomonas aeruginosa PA01
cggccgagauccugcagcag

SEQ ID NO: 3451483 - RNA, 17 nt, Pseudomonas aeruginosa PA01
cggccgagcaccacgcg

SEQ ID NO: 3451484 - RNA, 18 nt, Pseudomonas aeruginosa PA01
cggccgagcaggcgcgcc

SEQ ID NO: 3451485 - RNA, 19 nt, Pseudomonas aeruginosa PA01
cggccgagcaggcgcgcca

SEQ ID NO: 3451486 - RNA, 23 nt, Pseudomonas aeruginosa PA01
cggccgagcaggcgcgccaggcc

SEQ ID NO: 3451487 - RNA, 20 nt, Pseudomonas aeruginosa PA01
cggccgaggaaggcgcuggc

SEQ ID NO: 3451488 - RNA, 15 nt, Pseudomonas aeruginosa PA01
cggccgaggcuuccu

SEQ ID NO: 3451489 - RNA, 14 nt, Pseudomonas aeruginosa PA01
cggccgagggcagc

SEQ ID NO: 3451490 - RNA, 23 nt, Pseudomonas aeruginosa PA01
cggccgagggcagccucagcgac

SEQ ID NO: 3451491 - RNA, 14 nt, Pseudomonas aeruginosa PA01
cggccgagggcgag

SEQ ID NO: 3451492 - RNA, 14 nt, Pseudomonas aeruginosa PA01
cggccgaguucgcg

SEQ ID NO: 3451493 - RNA, 23 nt, Pseudomonas aeruginosa PA01
cggccgaguucgcgcaggcgcug

SEQ ID NO: 3451494 - RNA, 19 nt, Pseudomonas aeruginosa PA01
cggccgaucaccuucaccg

SEQ ID NO: 3451495 - RNA, 21 nt, Pseudomonas aeruginosa PA01
cggccgaucaccuucaccggc

SEQ ID NO: 3451496 - RNA, 22 nt, Pseudomonas aeruginosa PA01
cggccgaucaccuucaccggca

SEQ ID NO: 3451497 - RNA, 13 nt, Pseudomonas aeruginosa PA01
cggccgaucuuca

SEQ ID NO: 3451498 - RNA, 18 nt, Pseudomonas aeruginosa PA01
cggccgaucuucagcagc

SEQ ID NO: 3451499 - RNA, 22 nt, Pseudomonas aeruginosa PA01
cggccgaucuucagcagcaggc

SEQ ID NO: 3451500 - RNA, 18 nt, Pseudomonas aeruginosa PA01
cggccgaugaucuccgcg

SEQ ID NO: 3451501 - RNA, 19 nt, Pseudomonas aeruginosa PA01
cggccgaugaucuccgcgc

SEQ ID NO: 3451502 - RNA, 20 nt, Pseudomonas aeruginosa PA01
cggccgaugaucuccgcgcc

SEQ ID NO: 3451503 - RNA, 18 nt, Pseudomonas aeruginosa PA01
cggccgaugcuaucgcgu

SEQ ID NO: 3451504 - RNA, 21 nt, Pseudomonas aeruginosa PA01
cggccgaugcuaucgcguggc

SEQ ID NO: 3451505 - RNA, 21 nt, Pseudomonas aeruginosa PA01
cggccgauggaaaucggccac

SEQ ID NO: 3451506 - RNA, 14 nt, Pseudomonas aeruginosa PA01
cggccgcaaccagc

SEQ ID NO: 3451507 - RNA, 16 nt, Pseudomonas aeruginosa PA01
cggccgcaaccagccc

SEQ ID NO: 3451508 - RNA, 18 nt, Pseudomonas aeruginosa PA01
cggccgcaaccagcccug

SEQ ID NO: 3451509 - RNA, 20 nt, Pseudomonas aeruginosa PA01
cggccgcaaccagcccuggc

SEQ ID NO: 3451510 - RNA, 21 nt, Pseudomonas aeruginosa PA01
cggccgcaaccagcccuggcg

SEQ ID NO: 3451511 - RNA, 13 nt, Pseudomonas aeruginosa PA01
cggccgcaccagg

SEQ ID NO: 3451512 - RNA, 14 nt, Pseudomonas aeruginosa PA01
cggccgcaccagga

SEQ ID NO: 3451513 - RNA, 13 nt, Pseudomonas aeruginosa PA01
cggccgcaggcag

SEQ ID NO: 3451514 - RNA, 13 nt, Pseudomonas aeruginosa PA01
cggccgccagcag

SEQ ID NO: 3451515 - RNA, 14 nt, Pseudomonas aeruginosa PA01
cggccgccagcagg

SEQ ID NO: 3451516 - RNA, 20 nt, Pseudomonas aeruginosa PA01
cggccgccagcagguagacg

SEQ ID NO: 3451517 - RNA, 13 nt, Pseudomonas aeruginosa PA01
cggccgccaggcg

SEQ ID NO: 3451518 - RNA, 15 nt, Pseudomonas aeruginosa PA01
cggccgccaggcgcg

SEQ ID NO: 3451519 - RNA, 13 nt, Pseudomonas aeruginosa PA01
cggccgccaggcu

SEQ ID NO: 3451520 - RNA, 18 nt, Pseudomonas aeruginosa PA01
cggccgccaggcuggguu

SEQ ID NO: 3451521 - RNA, 12 nt, Pseudomonas aeruginosa PA01
cggccgccaggg

SEQ ID NO: 3451522 - RNA, 14 nt, Pseudomonas aeruginosa PA01
cggccgccagggcg

SEQ ID NO: 3451523 - RNA, 18 nt, Pseudomonas aeruginosa PA01
cggccgccagggcgucgg

SEQ ID NO: 3451524 - RNA, 15 nt, Pseudomonas aeruginosa PA01
cggccgccaucgccc

SEQ ID NO: 3451525 - RNA, 16 nt, Pseudomonas aeruginosa PA01
cggccgccaucgcccg

SEQ ID NO: 3451526 - RNA, 16 nt, Pseudomonas aeruginosa PA01
cggccgcccgagccgc

SEQ ID NO: 3451527 - RNA, 13 nt, Pseudomonas aeruginosa PA01
cggccgccgccga

SEQ ID NO: 3451528 - RNA, 15 nt, Pseudomonas aeruginosa PA01
cggccgccgccgaca

SEQ ID NO: 3451529 - RNA, 12 nt, Pseudomonas aeruginosa PA01
cggccgccgcgc

SEQ ID NO: 3451530 - RNA, 16 nt, Pseudomonas aeruginosa PA01
cggccgccgcgcagca

SEQ ID NO: 3451531 - RNA, 19 nt, Pseudomonas aeruginosa PA01
cggccgccgcgcagcacca

SEQ ID NO: 3451532 - RNA, 13 nt, Pseudomonas aeruginosa PA01
cggccgccggcgc

SEQ ID NO: 3451533 - RNA, 14 nt, Pseudomonas aeruginosa PA01
cggccgccggcgcc

SEQ ID NO: 3451534 - RNA, 20 nt, Pseudomonas aeruginosa PA01
cggccgccggcgcccugcuc

SEQ ID NO: 3451535 - RNA, 13 nt, Pseudomonas aeruginosa PA01
cggccgccucggc

SEQ ID NO: 3451536 - RNA, 14 nt, Pseudomonas aeruginosa PA01
cggccgccucggcg

SEQ ID NO: 3451537 - RNA, 16 nt, Pseudomonas aeruginosa PA01
cggccgccucggucca

SEQ ID NO: 3451538 - RNA, 13 nt, Pseudomonas aeruginosa PA01
cggccgccugccu

SEQ ID NO: 3451539 - RNA, 15 nt, Pseudomonas aeruginosa PA01
cggccgccugccuuc

SEQ ID NO: 3451540 - RNA, 14 nt, Pseudomonas aeruginosa PA01
cggccgccuggcgu

SEQ ID NO: 3451541 - RNA, 18 nt, Pseudomonas aeruginosa PA01
cggccgccuggcgugccg

SEQ ID NO: 3451542 - RNA, 23 nt, Pseudomonas aeruginosa PA01
cggccgccuggcgugccgccagg

SEQ ID NO: 3451543 - RNA, 16 nt, Pseudomonas aeruginosa PA01
cggccgccuuccucgg

SEQ ID NO: 3451544 - RNA, 21 nt, Pseudomonas aeruginosa PA01
cggccgccuuccucggccgcc

SEQ ID NO: 3451545 - RNA, 22 nt, Pseudomonas aeruginosa PA01
cggccgccuuccucggccgcca

SEQ ID NO: 3451546 - RNA, 23 nt, Pseudomonas aeruginosa PA01
cggccgccuuccucggccgccag

SEQ ID NO: 3451547 - RNA, 19 nt, Pseudomonas aeruginosa PA01
cggccgccuugaccugcug

SEQ ID NO: 3451548 - RNA, 21 nt, Pseudomonas aeruginosa PA01
cggccgccuugaccugcuggg

SEQ ID NO: 3451549 - RNA, 22 nt, Pseudomonas aeruginosa PA01
cggccgcgagcgcggccggcca

SEQ ID NO: 3451550 - RNA, 15 nt, Pseudomonas aeruginosa PA01
cggccgcgaggacaa

SEQ ID NO: 3451551 - RNA, 12 nt, Pseudomonas aeruginosa PA01
cggccgcgccag

SEQ ID NO: 3451552 - RNA, 14 nt, Pseudomonas aeruginosa PA01
cggccgcgccagcc

SEQ ID NO: 3451553 - RNA, 15 nt, Pseudomonas aeruginosa PA01
cggccgcgccagcca

SEQ ID NO: 3451554 - RNA, 14 nt, Pseudomonas aeruginosa PA01
cggccgcgccggcu

SEQ ID NO: 3451555 - RNA, 15 nt, Pseudomonas aeruginosa PA01
cggccgcgccggcuc

SEQ ID NO: 3451556 - RNA, 18 nt, Pseudomonas aeruginosa PA01
cggccgcgccuucagcgc

SEQ ID NO: 3451557 - RNA, 23 nt, Pseudomonas aeruginosa PA01
cggccgcgccuucagcgccagca

SEQ ID NO: 3451558 - RNA, 17 nt, Pseudomonas aeruginosa PA01
cggccgcgccuugcuca

SEQ ID NO: 3451559 - RNA, 22 nt, Pseudomonas aeruginosa PA01
cggccgcgccuugcucaggucg

SEQ ID NO: 3451560 - RNA, 23 nt, Pseudomonas aeruginosa PA01
cggccgcgccuugcucaggucgu

SEQ ID NO: 3451561 - RNA, 14 nt, Pseudomonas aeruginosa PA01
cggccgcggcuggc

SEQ ID NO: 3451562 - RNA, 17 nt, Pseudomonas aeruginosa PA01
cggccgcgucgcccagg

SEQ ID NO: 3451563 - RNA, 17 nt, Pseudomonas aeruginosa PA01
cggccgcucggccuuga

SEQ ID NO: 3451564 - RNA, 22 nt, Pseudomonas aeruginosa PA01
cggccucgcgcaacugcggggc

SEQ ID NO: 3451565 - RNA, 16 nt, Pseudomonas aeruginosa PA01
cggccucgcggcgcuc

SEQ ID NO: 3451566 - RNA, 17 nt, Pseudomonas aeruginosa PA01
cggccucgcgugcgcug

SEQ ID NO: 3451567 - RNA, 15 nt, Pseudomonas aeruginosa PA01
cggccucgcugccgc

SEQ ID NO: 3451568 - RNA, 19 nt, Pseudomonas aeruginosa PA01
cggccucgcugccgccgca

SEQ ID NO: 3451569 - RNA, 23 nt, Pseudomonas aeruginosa PA01
cggccucgcugccgccgcagagc

SEQ ID NO: 3451570 - RNA, 14 nt, Pseudomonas aeruginosa PA01
cggccucgcuggcg

SEQ ID NO: 3451571 - RNA, 12 nt, Pseudomonas aeruginosa PA01
cggccucggccu

SEQ ID NO: 3451572 - RNA, 16 nt, Pseudomonas aeruginosa PA01
cggccucggccucguc

SEQ ID NO: 3451573 - RNA, 18 nt, Pseudomonas aeruginosa PA01
cggccucggccucgucga

SEQ ID NO: 3451574 - RNA, 11 nt, Pseudomonas aeruginosa PA01
cggccucggcg

SEQ ID NO: 3451575 - RNA, 12 nt, Pseudomonas aeruginosa PA01
cggccucggcgg

SEQ ID NO: 3451576 - RNA, 14 nt, Pseudomonas aeruginosa PA01
cggccucggcggcg

SEQ ID NO: 3451577 - RNA, 16 nt, Pseudomonas aeruginosa PA01
cggccucggcggcgcg

SEQ ID NO: 3451578 - RNA, 15 nt, Pseudomonas aeruginosa PA01
cggccucggcgucgc

SEQ ID NO: 3451579 - RNA, 17 nt, Pseudomonas aeruginosa PA01
cggccucggcgucgcgc

SEQ ID NO: 3451580 - RNA, 15 nt, Pseudomonas aeruginosa PA01
cggccucggucaggu

SEQ ID NO: 3451581 - RNA, 17 nt, Pseudomonas aeruginosa PA01
cggccucggucagguau

SEQ ID NO: 3451582 - RNA, 20 nt, Pseudomonas aeruginosa PA01
cggccucggucagguauucg

SEQ ID NO: 3451583 - RNA, 22 nt, Pseudomonas aeruginosa PA01
cggccucggucagguauucgcc

SEQ ID NO: 3451584 - RNA, 18 nt, Pseudomonas aeruginosa PA01
cggccucgguugagacga

SEQ ID NO: 3451585 - RNA, 21 nt, Pseudomonas aeruginosa PA01
cggccucguaggcggcgcguu

SEQ ID NO: 3451586 - RNA, 14 nt, Pseudomonas aeruginosa PA01
cggccucgucgagc

SEQ ID NO: 3451587 - RNA, 20 nt, Pseudomonas aeruginosa PA01
cggccucgucgagcaucugc

SEQ ID NO: 3451588 - RNA, 22 nt, Pseudomonas aeruginosa PA01
cggccucgucgagcaucugccg

SEQ ID NO: 3451589 - RNA, 23 nt, Pseudomonas aeruginosa PA01
cggccucgucgagcaucugccgg

SEQ ID NO: 3451590 - RNA, 19 nt, Pseudomonas aeruginosa PA01
cggccucuccgagacgcug

SEQ ID NO: 3451591 - RNA, 18 nt, Pseudomonas aeruginosa PA01
cggccucuucgucggcga

SEQ ID NO: 3451592 - RNA, 15 nt, Pseudomonas aeruginosa PA01
cggccugagccggcc

SEQ ID NO: 3451593 - RNA, 20 nt, Pseudomonas aeruginosa PA01
cggccugagcugccgcuucg

SEQ ID NO: 3451594 - RNA, 19 nt, Pseudomonas aeruginosa PA01
cggccugaucaucugggcc

SEQ ID NO: 3451595 - RNA, 21 nt, Pseudomonas aeruginosa PA01
cggccugaucaucugggccau

SEQ ID NO: 3451596 - RNA, 23 nt, Pseudomonas aeruginosa PA01
cggccugaucaucugggccaucg

SEQ ID NO: 3451597 - RNA, 20 nt, Pseudomonas aeruginosa PA01
cggccugcaacacccaggcc

SEQ ID NO: 3451598 - RNA, 21 nt, Pseudomonas aeruginosa PA01
cggccugcaacacccaggccu

SEQ ID NO: 3451599 - RNA, 24 nt, Pseudomonas aeruginosa PA01
cggccugcaacacccaggccuggg

SEQ ID NO: 3451600 - RNA, 16 nt, Pseudomonas aeruginosa PA01
cggccugcaacgccgc

SEQ ID NO: 3451601 - RNA, 17 nt, Pseudomonas aeruginosa PA01
cggccugcaacgccgcc

SEQ ID NO: 3451602 - RNA, 21 nt, Pseudomonas aeruginosa PA01
cggccugcaccagccaguccg

SEQ ID NO: 3451603 - RNA, 19 nt, Pseudomonas aeruginosa PA01
cggccugcaccugcucggg

SEQ ID NO: 3451604 - RNA, 23 nt, Pseudomonas aeruginosa PA01
cggccugcaccugcucggggccg

SEQ ID NO: 3451605 - RNA, 14 nt, Pseudomonas aeruginosa PA01
cggccugcagccug

SEQ ID NO: 3451606 - RNA, 17 nt, Pseudomonas aeruginosa PA01
cggccugcagccuggcg

SEQ ID NO: 3451607 - RNA, 14 nt, Pseudomonas aeruginosa PA01
cggccugcagcgac

SEQ ID NO: 3451608 - RNA, 16 nt, Pseudomonas aeruginosa PA01
cggccugcagcgacuc

SEQ ID NO: 3451609 - RNA, 24 nt, Pseudomonas aeruginosa PA01
cggccugcagcgacuccagccagg

SEQ ID NO: 3451610 - RNA, 18 nt, Pseudomonas aeruginosa PA01
cggccugccccgccggcg

SEQ ID NO: 3451611 - RNA, 18 nt, Pseudomonas aeruginosa PA01
cggccugccguugcacga

SEQ ID NO: 3451612 - RNA, 13 nt, Pseudomonas aeruginosa PA01
cggccugcgccgg

SEQ ID NO: 3451613 - RNA, 19 nt, Pseudomonas aeruginosa PA01
cggccugcgccggaccaga

SEQ ID NO: 3451614 - RNA, 19 nt, Pseudomonas aeruginosa PA01
cggccugcggguucggcga

SEQ ID NO: 3451615 - RNA, 15 nt, Pseudomonas aeruginosa PA01
cggccugcgguucgc

SEQ ID NO: 3451616 - RNA, 20 nt, Pseudomonas aeruginosa PA01
cggccugcgguucgccuucc

SEQ ID NO: 3451617 - RNA, 18 nt, Pseudomonas aeruginosa PA01
cggccugcgucgcaucca

SEQ ID NO: 3451618 - RNA, 19 nt, Pseudomonas aeruginosa PA01
cggccugcgucgcauccac

SEQ ID NO: 3451619 - RNA, 22 nt, Pseudomonas aeruginosa PA01
cggccugcgucgcauccaccag

SEQ ID NO: 3451620 - RNA, 21 nt, Pseudomonas aeruginosa PA01
cggccugcucgaacggcggau

SEQ ID NO: 3451621 - RNA, 13 nt, Pseudomonas aeruginosa PA01
cggccugcucgcg

SEQ ID NO: 3451622 - RNA, 14 nt, Pseudomonas aeruginosa PA01
cggccugcucgcgc

SEQ ID NO: 3451623 - RNA, 15 nt, Pseudomonas aeruginosa PA01
cggccugcucgcgca

SEQ ID NO: 3451624 - RNA, 17 nt, Pseudomonas aeruginosa PA01
cggccugcucgcgcagc

SEQ ID NO: 3451625 - RNA, 23 nt, Pseudomonas aeruginosa PA01
cggccugcucgcgcagccaggcg

SEQ ID NO: 3451626 - RNA, 23 nt, Pseudomonas aeruginosa PA01
cggccugcucggcucgcgguucg

SEQ ID NO: 3451627 - RNA, 14 nt, Pseudomonas aeruginosa PA01
cggccugcugcgcc

SEQ ID NO: 3451628 - RNA, 15 nt, Pseudomonas aeruginosa PA01
cggccugcugcgccg

SEQ ID NO: 3451629 - RNA, 17 nt, Pseudomonas aeruginosa PA01
cggccugcugcgccggc

SEQ ID NO: 3451630 - RNA, 18 nt, Pseudomonas aeruginosa PA01
cggccugcugcgccggca

SEQ ID NO: 3451631 - RNA, 14 nt, Pseudomonas aeruginosa PA01
cggccugcugcucg

SEQ ID NO: 3451632 - RNA, 16 nt, Pseudomonas aeruginosa PA01
cggccugcugcucgac

SEQ ID NO: 3451633 - RNA, 15 nt, Pseudomonas aeruginosa PA01
cggccuggaaccgcu

SEQ ID NO: 3451634 - RNA, 16 nt, Pseudomonas aeruginosa PA01
cggccuggaaccgcuc

SEQ ID NO: 3451635 - RNA, 14 nt, Pseudomonas aeruginosa PA01
cggccuggaucgcc

SEQ ID NO: 3451636 - RNA, 14 nt, Pseudomonas aeruginosa PA01
cggccuggcgcagc

SEQ ID NO: 3451637 - RNA, 21 nt, Pseudomonas aeruginosa PA01
cggccuggcgcagcggcagcg

SEQ ID NO: 3451638 - RNA, 22 nt, Pseudomonas aeruginosa PA01
cggccuggcgcagcggcagcgc

SEQ ID NO: 3451639 - RNA, 12 nt, Pseudomonas aeruginosa PA01
cggccuggcgcc

SEQ ID NO: 3451640 - RNA, 17 nt, Pseudomonas aeruginosa PA01
cggccuggcgccggggu

SEQ ID NO: 3451641 - RNA, 18 nt, Pseudomonas aeruginosa PA01
cggccuggcgcgcgcgcc

SEQ ID NO: 3451642 - RNA, 13 nt, Pseudomonas aeruginosa PA01
cggccuggcgucc

SEQ ID NO: 3451643 - RNA, 16 nt, Pseudomonas aeruginosa PA01
cggccuggcgucccgg

SEQ ID NO: 3451644 - RNA, 15 nt, Pseudomonas aeruginosa PA01
cggccuggcugccga

SEQ ID NO: 3451645 - RNA, 18 nt, Pseudomonas aeruginosa PA01
cggccuggcugccgagca

SEQ ID NO: 3451646 - RNA, 13 nt, Pseudomonas aeruginosa PA01
cggccuggcuggc

SEQ ID NO: 3451647 - RNA, 15 nt, Pseudomonas aeruginosa PA01
cggccuggcuggccu

SEQ ID NO: 3451648 - RNA, 16 nt, Pseudomonas aeruginosa PA01
cggccuggcuggccuu

SEQ ID NO: 3451649 - RNA, 15 nt, Pseudomonas aeruginosa PA01
cggccugggccgaag

SEQ ID NO: 3451650 - RNA, 20 nt, Pseudomonas aeruginosa PA01
cggccugggccgaaggccag

SEQ ID NO: 3451651 - RNA, 15 nt, Pseudomonas aeruginosa PA01
cggccugggccgggu

SEQ ID NO: 3451652 - RNA, 16 nt, Pseudomonas aeruginosa PA01
cggccugggccggguu

SEQ ID NO: 3451653 - RNA, 20 nt, Pseudomonas aeruginosa PA01
cggccugggcgcaggccgag

SEQ ID NO: 3451654 - RNA, 20 nt, Pseudomonas aeruginosa PA01
cggccuggggcucggcuucc

SEQ ID NO: 3451655 - RNA, 19 nt, Pseudomonas aeruginosa PA01
cggccuggguacgcaccgg

SEQ ID NO: 3451656 - RNA, 23 nt, Pseudomonas aeruginosa PA01
cggccuggguacgcaccggcuuc

SEQ ID NO: 3451657 - RNA, 14 nt, Pseudomonas aeruginosa PA01
cggccugguagucg

SEQ ID NO: 3451658 - RNA, 20 nt, Pseudomonas aeruginosa PA01
cggccugguccggcacuucc

SEQ ID NO: 3451659 - RNA, 12 nt, Pseudomonas aeruginosa PA01
cggccuggucgu

SEQ ID NO: 3451660 - RNA, 14 nt, Pseudomonas aeruginosa PA01
cggccuggucgucg

SEQ ID NO: 3451661 - RNA, 16 nt, Pseudomonas aeruginosa PA01
cggccuggugacccgg

SEQ ID NO: 3451662 - RNA, 20 nt, Pseudomonas aeruginosa PA01
cggccuggugacccggacag

SEQ ID NO: 3451663 - RNA, 23 nt, Pseudomonas aeruginosa PA01
cggccuggugacccggacagccu

SEQ ID NO: 3451664 - RNA, 18 nt, Pseudomonas aeruginosa PA01
cggccuggugcaccuggc

SEQ ID NO: 3451665 - RNA, 16 nt, Pseudomonas aeruginosa PA01
cggccugguuguaggc

SEQ ID NO: 3451666 - RNA, 20 nt, Pseudomonas aeruginosa PA01
cggcgacaccccgaaguagc

SEQ ID NO: 3451667 - RNA, 17 nt, Pseudomonas aeruginosa PA01
cggcgacaccgccagca

SEQ ID NO: 3451668 - RNA, 14 nt, Pseudomonas aeruginosa PA01
cggcgacagcacca

SEQ ID NO: 3451669 - RNA, 17 nt, Pseudomonas aeruginosa PA01
cggcgacagcaccacgc

SEQ ID NO: 3451670 - RNA, 22 nt, Pseudomonas aeruginosa PA01
cggcgacagcaccacgccgcug

SEQ ID NO: 3451671 - RNA, 12 nt, Pseudomonas aeruginosa PA01
cggcgacagccg

SEQ ID NO: 3451672 - RNA, 15 nt, Pseudomonas aeruginosa PA01
cggcgacauagccgg

SEQ ID NO: 3451673 - RNA, 16 nt, Pseudomonas aeruginosa PA01
cggcgacauagccggc

SEQ ID NO: 3451674 - RNA, 17 nt, Pseudomonas aeruginosa PA01
cggcgacauagccggcg

SEQ ID NO: 3451675 - RNA, 18 nt, Pseudomonas aeruginosa PA01
cggcgacauagccggcga

SEQ ID NO: 3451676 - RNA, 20 nt, Pseudomonas aeruginosa PA01
cggcgacauagccggcgaac

SEQ ID NO: 3451677 - RNA, 17 nt, Pseudomonas aeruginosa PA01
cggcgaccaccacgucg

SEQ ID NO: 3451678 - RNA, 22 nt, Pseudomonas aeruginosa PA01
cggcgaccaccacgucgaugcc

SEQ ID NO: 3451679 - RNA, 15 nt, Pseudomonas aeruginosa PA01
cggcgaccacccggc

SEQ ID NO: 3451680 - RNA, 17 nt, Pseudomonas aeruginosa PA01
cggcgaccacccggcgg

SEQ ID NO: 3451681 - RNA, 12 nt, Pseudomonas aeruginosa PA01
cggcgaccaccg

SEQ ID NO: 3451682 - RNA, 15 nt, Pseudomonas aeruginosa PA01
cggcgaccaccgccg

SEQ ID NO: 3451683 - RNA, 16 nt, Pseudomonas aeruginosa PA01
cggcgaccaccgccgg

SEQ ID NO: 3451684 - RNA, 14 nt, Pseudomonas aeruginosa PA01
cggcgaccaccgcg

SEQ ID NO: 3451685 - RNA, 15 nt, Pseudomonas aeruginosa PA01
cggcgaccaccgcga

SEQ ID NO: 3451686 - RNA, 18 nt, Pseudomonas aeruginosa PA01
cggcgaccagcccgcgcg

SEQ ID NO: 3451687 - RNA, 19 nt, Pseudomonas aeruginosa PA01
cggcgaccagcccgcgcga

SEQ ID NO: 3451688 - RNA, 12 nt, Pseudomonas aeruginosa PA01
cggcgaccagcg

SEQ ID NO: 3451689 - RNA, 14 nt, Pseudomonas aeruginosa PA01
cggcgaccagcgcg

SEQ ID NO: 3451690 - RNA, 14 nt, Pseudomonas aeruginosa PA01
cggcgaccagcguc

SEQ ID NO: 3451691 - RNA, 19 nt, Pseudomonas aeruginosa PA01
cggcgaccagcgucgcgcg

SEQ ID NO: 3451692 - RNA, 15 nt, Pseudomonas aeruginosa PA01
cggcgaccagcucga

SEQ ID NO: 3451693 - RNA, 15 nt, Pseudomonas aeruginosa PA01
cggcgaccauccagc

SEQ ID NO: 3451694 - RNA, 16 nt, Pseudomonas aeruginosa PA01
cggcgaccauccagcc

SEQ ID NO: 3451695 - RNA, 22 nt, Pseudomonas aeruginosa PA01
cggcgaccauccagccugcgcu

SEQ ID NO: 3451696 - RNA, 17 nt, Pseudomonas aeruginosa PA01
cggcgaccauguucacc

SEQ ID NO: 3451697 - RNA, 20 nt, Pseudomonas aeruginosa PA01
cggcgaccauguucaccagc

SEQ ID NO: 3451698 - RNA, 23 nt, Pseudomonas aeruginosa PA01
cggcgaccauguucaccagcgcu

SEQ ID NO: 3451699 - RNA, 13 nt, Pseudomonas aeruginosa PA01
cggcgacccagac

SEQ ID NO: 3451700 - RNA, 15 nt, Pseudomonas aeruginosa PA01
cggcgacccagaccu

SEQ ID NO: 3451701 - RNA, 21 nt, Pseudomonas aeruginosa PA01
cggcgacccagaccugccgcc

SEQ ID NO: 3451702 - RNA, 15 nt, Pseudomonas aeruginosa PA01
cggcgaccccgauca

SEQ ID NO: 3451703 - RNA, 19 nt, Pseudomonas aeruginosa PA01
cggcgaccccgaucaccgg

SEQ ID NO: 3451704 - RNA, 13 nt, Pseudomonas aeruginosa PA01
cggcgacccgaag

SEQ ID NO: 3451705 - RNA, 12 nt, Pseudomonas aeruginosa PA01
cggcgacccgca

SEQ ID NO: 3451706 - RNA, 19 nt, Pseudomonas aeruginosa PA01
cggcgacccgccguucgcc

SEQ ID NO: 3451707 - RNA, 14 nt, Pseudomonas aeruginosa PA01
cggcgacccugggg

SEQ ID NO: 3451708 - RNA, 16 nt, Pseudomonas aeruginosa PA01
cggcgacccugggguc

SEQ ID NO: 3451709 - RNA, 21 nt, Pseudomonas aeruginosa PA01
cggcgacccuggggucgccgu

SEQ ID NO: 3451710 - RNA, 19 nt, Pseudomonas aeruginosa PA01
cggcgaccgaacagcgcgc

SEQ ID NO: 3451711 - RNA, 21 nt, Pseudomonas aeruginosa PA01
cggcgaccgaacagcgcgcca

SEQ ID NO: 3451712 - RNA, 13 nt, Pseudomonas aeruginosa PA01
cggcgaccgcauc

SEQ ID NO: 3451713 - RNA, 14 nt, Pseudomonas aeruginosa PA01
cggcgaccgcgcgc

SEQ ID NO: 3451714 - RNA, 15 nt, Pseudomonas aeruginosa PA01
cggcgaccgcgcgca

SEQ ID NO: 3451715 - RNA, 19 nt, Pseudomonas aeruginosa PA01
cggcgaccgcgcgcauggu

SEQ ID NO: 3451716 - RNA, 16 nt, Pseudomonas aeruginosa PA01
cggcgaccgcuggacc

SEQ ID NO: 3451717 - RNA, 15 nt, Pseudomonas aeruginosa PA01
cggcgaccggccuca

SEQ ID NO: 3451718 - RNA, 15 nt, Pseudomonas aeruginosa PA01
cggcgaccugcggca

SEQ ID NO: 3451719 - RNA, 15 nt, Pseudomonas aeruginosa PA01
cggcgaccugcggug

SEQ ID NO: 3451720 - RNA, 22 nt, Pseudomonas aeruginosa PA01
cggcgaccuugacgaagccggc

SEQ ID NO: 3451721 - RNA, 22 nt, Pseudomonas aeruginosa PA01
cggcgaccuuguccaggcgcug

SEQ ID NO: 3451722 - RNA, 15 nt, Pseudomonas aeruginosa PA01
cggcgaccuuguccu

SEQ ID NO: 3451723 - RNA, 20 nt, Pseudomonas aeruginosa PA01
cggcgacgaaagacgcugcg

SEQ ID NO: 3451724 - RNA, 13 nt, Pseudomonas aeruginosa PA01
cggcgacgaagcc

SEQ ID NO: 3451725 - RNA, 15 nt, Pseudomonas aeruginosa PA01
cggcgacgaaggucg

SEQ ID NO: 3451726 - RNA, 21 nt, Pseudomonas aeruginosa PA01
cggcgacgaaggucggcggca

SEQ ID NO: 3451727 - RNA, 22 nt, Pseudomonas aeruginosa PA01
cggcgacgaaggucggcggcag

SEQ ID NO: 3451728 - RNA, 23 nt, Pseudomonas aeruginosa PA01
cggcgacgaaggucggcggcagc

SEQ ID NO: 3451729 - RNA, 19 nt, Pseudomonas aeruginosa PA01
cggcgacgacgaagaguaa

SEQ ID NO: 3451730 - RNA, 14 nt, Pseudomonas aeruginosa PA01
cggcgacgacgauc

SEQ ID NO: 3451731 - RNA, 16 nt, Pseudomonas aeruginosa PA01
cggcgacgacgauccc

SEQ ID NO: 3451732 - RNA, 14 nt, Pseudomonas aeruginosa PA01
cggcgacgaucacc

SEQ ID NO: 3451733 - RNA, 22 nt, Pseudomonas aeruginosa PA01
cggcgacgaucacccccagcga

SEQ ID NO: 3451734 - RNA, 14 nt, Pseudomonas aeruginosa PA01
cggcgacgaucagc

SEQ ID NO: 3451735 - RNA, 15 nt, Pseudomonas aeruginosa PA01
cggcgacgaugccgc

SEQ ID NO: 3451736 - RNA, 16 nt, Pseudomonas aeruginosa PA01
cggcgacgaugccgcc

SEQ ID NO: 3451737 - RNA, 19 nt, Pseudomonas aeruginosa PA01
cggcgacgaugccgccgcc

SEQ ID NO: 3451738 - RNA, 18 nt, Pseudomonas aeruginosa PA01
cggcgacgcaggacgucg

SEQ ID NO: 3451739 - RNA, 14 nt, Pseudomonas aeruginosa PA01
cggcgacgccaccc

SEQ ID NO: 3451740 - RNA, 16 nt, Pseudomonas aeruginosa PA01
cggcgacgccacccgc

SEQ ID NO: 3451741 - RNA, 17 nt, Pseudomonas aeruginosa PA01
cggcgacgccacccgca

SEQ ID NO: 3451742 - RNA, 18 nt, Pseudomonas aeruginosa PA01
cggcgacgccacccgcau

SEQ ID NO: 3451743 - RNA, 16 nt, Pseudomonas aeruginosa PA01
cggcgacgcggauacc

SEQ ID NO: 3451744 - RNA, 22 nt, Pseudomonas aeruginosa PA01
cggcgacgcugaugaugccgcg

SEQ ID NO: 3451745 - RNA, 15 nt, Pseudomonas aeruginosa PA01
cggcgacgggaagcg

SEQ ID NO: 3451746 - RNA, 23 nt, Pseudomonas aeruginosa PA01
cggcgacgggaagcgaaccaggc

SEQ ID NO: 3451747 - RNA, 16 nt, Pseudomonas aeruginosa PA01
cggcgacggugccggu

SEQ ID NO: 3451748 - RNA, 19 nt, Pseudomonas aeruginosa PA01
cggcgacuucgcauuccac

SEQ ID NO: 3451749 - RNA, 17 nt, Pseudomonas aeruginosa PA01
cggcgagaaaggcugcu

SEQ ID NO: 3451750 - RNA, 21 nt, Pseudomonas aeruginosa PA01
cggcgagaaaggcugcuucgg

SEQ ID NO: 3451751 - RNA, 22 nt, Pseudomonas aeruginosa PA01
cggcgagaaagucgaucagcgc

SEQ ID NO: 3451752 - RNA, 21 nt, Pseudomonas aeruginosa PA01
cggcgagaacucguccggucg

SEQ ID NO: 3451753 - RNA, 21 nt, Pseudomonas aeruginosa PA01
cggcgagacuaccgaucggcu

SEQ ID NO: 3451754 - RNA, 22 nt, Pseudomonas aeruginosa PA01
cggcgagacuaccgaucggcug

SEQ ID NO: 3451755 - RNA, 17 nt, Pseudomonas aeruginosa PA01
cggcgagagcgccgacc

SEQ ID NO: 3451756 - RNA, 20 nt, Pseudomonas aeruginosa PA01
cggcgagagcgccgaccagc

SEQ ID NO: 3451757 - RNA, 20 nt, Pseudomonas aeruginosa PA01
cggcgagagcguccggcagg

SEQ ID NO: 3451758 - RNA, 20 nt, Pseudomonas aeruginosa PA01
cggcgagaggucggcgcgcc

SEQ ID NO: 3451759 - RNA, 19 nt, Pseudomonas aeruginosa PA01
cggcgagaucuucaggccg

SEQ ID NO: 3451760 - RNA, 20 nt, Pseudomonas aeruginosa PA01
cggcgagaucuucaggccga

SEQ ID NO: 3451761 - RNA, 19 nt, Pseudomonas aeruginosa PA01
cggcgagauugcgcugagc

SEQ ID NO: 3451762 - RNA, 22 nt, Pseudomonas aeruginosa PA01
cggcgagauugcgcugagcgga

SEQ ID NO: 3451763 - RNA, 17 nt, Pseudomonas aeruginosa PA01
cggcgagcaacgcaggu

SEQ ID NO: 3451764 - RNA, 18 nt, Pseudomonas aeruginosa PA01
cggcgagcaacgcagguc

SEQ ID NO: 3451765 - RNA, 23 nt, Pseudomonas aeruginosa PA01
cggcgagcaaugaaaaaggcgau

SEQ ID NO: 3451766 - RNA, 18 nt, Pseudomonas aeruginosa PA01
cggcgagcacggcgaaca

SEQ ID NO: 3451767 - RNA, 14 nt, Pseudomonas aeruginosa PA01
cggcgagcagcggc

SEQ ID NO: 3451768 - RNA, 16 nt, Pseudomonas aeruginosa PA01
cggcgaugaccagcuc

SEQ ID NO: 3451769 - RNA, 20 nt, Pseudomonas aeruginosa PA01
cggcgaugaccagcucggcg

SEQ ID NO: 3451770 - RNA, 22 nt, Pseudomonas aeruginosa PA01
cggcgaugaccagcucggcggg

SEQ ID NO: 3451771 - RNA, 22 nt, Pseudomonas aeruginosa PA01
cggcgaugaccaggguggcggc

SEQ ID NO: 3451772 - RNA, 17 nt, Pseudomonas aeruginosa PA01
cggcgaugauggucaac

SEQ ID NO: 3451773 - RNA, 18 nt, Pseudomonas aeruginosa PA01
cggcgaugauggucaaca

SEQ ID NO: 3451774 - RNA, 15 nt, Pseudomonas aeruginosa PA01
cggcgaugcccaggc

SEQ ID NO: 3451775 - RNA, 21 nt, Pseudomonas aeruginosa PA01
cggcgaugcccaggccgccga

SEQ ID NO: 3451776 - RNA, 16 nt, Pseudomonas aeruginosa PA01
cggcgaugccgcccag

SEQ ID NO: 3451777 - RNA, 17 nt, Pseudomonas aeruginosa PA01
cggcgaugccgcccagc

SEQ ID NO: 3451778 - RNA, 20 nt, Pseudomonas aeruginosa PA01
cggcgaugccgcccagcacc

SEQ ID NO: 3451779 - RNA, 22 nt, Pseudomonas aeruginosa PA01
cggcgaugccgcccagcaccga

SEQ ID NO: 3451780 - RNA, 15 nt, Pseudomonas aeruginosa PA01
cggcgaugccgccgg

SEQ ID NO: 3451781 - RNA, 17 nt, Pseudomonas aeruginosa PA01
cggcgaugccgccgggc

SEQ ID NO: 3451782 - RNA, 14 nt, Pseudomonas aeruginosa PA01
cggcgaugccgcgc

SEQ ID NO: 3451783 - RNA, 16 nt, Pseudomonas aeruginosa PA01
cggcgaugccgcgcca

SEQ ID NO: 3451784 - RNA, 17 nt, Pseudomonas aeruginosa PA01
cggcgaugccgcgccag

SEQ ID NO: 3451785 - RNA, 20 nt, Pseudomonas aeruginosa PA01
cggcgaugccgcgccaggcg

SEQ ID NO: 3451786 - RNA, 22 nt, Pseudomonas aeruginosa PA01
cggcgaugcgcaugcgcagcgc

SEQ ID NO: 3451787 - RNA, 21 nt, Pseudomonas aeruginosa PA01
cggcgaugcguuugucgaccu

SEQ ID NO: 3451788 - RNA, 23 nt, Pseudomonas aeruginosa PA01
cggcgaugcguuugucgaccugc

SEQ ID NO: 3451789 - RNA, 14 nt, Pseudomonas aeruginosa PA01
cggcgaugcucagc

SEQ ID NO: 3451790 - RNA, 16 nt, Pseudomonas aeruginosa PA01
cggcgaugcucagcgc

SEQ ID NO: 3451791 - RNA, 18 nt, Pseudomonas aeruginosa PA01
cggcgaugcucagcgccg

SEQ ID NO: 3451792 - RNA, 12 nt, Pseudomonas aeruginosa PA01
cggcgaugcugc

SEQ ID NO: 3451793 - RNA, 14 nt, Pseudomonas aeruginosa PA01
cggcgaugcugcug

SEQ ID NO: 3451794 - RNA, 16 nt, Pseudomonas aeruginosa PA01
cggcgauggacucgau

SEQ ID NO: 3451795 - RNA, 19 nt, Pseudomonas aeruginosa PA01
cggcgauggacucgaucac

SEQ ID NO: 3451796 - RNA, 15 nt, Pseudomonas aeruginosa PA01
cggcgauggcccaga

SEQ ID NO: 3451797 - RNA, 19 nt, Pseudomonas aeruginosa PA01
cggcgauggcccagaugau

SEQ ID NO: 3451798 - RNA, 15 nt, Pseudomonas aeruginosa PA01
cggcgauggccgcca

SEQ ID NO: 3451799 - RNA, 16 nt, Pseudomonas aeruginosa PA01
cggcgauggccgccag

SEQ ID NO: 3451800 - RNA, 18 nt, Pseudomonas aeruginosa PA01
cggcgauggccgccagca

SEQ ID NO: 3451801 - RNA, 19 nt, Pseudomonas aeruginosa PA01
cggcgauggccgccagcag

SEQ ID NO: 3451802 - RNA, 22 nt, Pseudomonas aeruginosa PA01
cggcgauggccgccagcaggcc

SEQ ID NO: 3451803 - RNA, 15 nt, Pseudomonas aeruginosa PA01
cggcgauggccgccu

SEQ ID NO: 3451804 - RNA, 19 nt, Pseudomonas aeruginosa PA01
cggcgauggccgccugcag

SEQ ID NO: 3451805 - RNA, 17 nt, Pseudomonas aeruginosa PA01
cggcgauggcgcgcggg

SEQ ID NO: 3451806 - RNA, 18 nt, Pseudomonas aeruginosa PA01
cggcgauggcgcgcgggc

SEQ ID NO: 3451807 - RNA, 20 nt, Pseudomonas aeruginosa PA01
cggcgauggcgcgcgggccu

SEQ ID NO: 3451808 - RNA, 22 nt, Pseudomonas aeruginosa PA01
cggcgauggcguagaggcucgg

SEQ ID NO: 3451809 - RNA, 18 nt, Pseudomonas aeruginosa PA01
cggcgauggcguccaccg

SEQ ID NO: 3451810 - RNA, 18 nt, Pseudomonas aeruginosa PA01
cggcgauguugcgcaggg

SEQ ID NO: 3451811 - RNA, 22 nt, Pseudomonas aeruginosa PA01
cggcgauguugcgcagggugcc

SEQ ID NO: 3451812 - RNA, 18 nt, Pseudomonas aeruginosa PA01
cggcgauuccacgggccu

SEQ ID NO: 3451813 - RNA, 13 nt, Pseudomonas aeruginosa PA01
cggcgauucgcgg

SEQ ID NO: 3451814 - RNA, 18 nt, Pseudomonas aeruginosa PA01
cggcgauucgcggcgaca

SEQ ID NO: 3451815 - RNA, 20 nt, Pseudomonas aeruginosa PA01
cggcgauucgcggcgacagc

SEQ ID NO: 3451816 - RNA, 21 nt, Pseudomonas aeruginosa PA01
cggcgauucgcggcgacagca

SEQ ID NO: 3451817 - RNA, 20 nt, Pseudomonas aeruginosa PA01
cggcgauucguucgagcagc

SEQ ID NO: 3451818 - RNA, 20 nt, Pseudomonas aeruginosa PA01
cggcgcaagggcgccgccga

SEQ ID NO: 3451819 - RNA, 17 nt, Pseudomonas aeruginosa PA01
cggcgcaaucagggcug

SEQ ID NO: 3451820 - RNA, 18 nt, Pseudomonas aeruginosa PA01
cggcgcaaucagggcugg

SEQ ID NO: 3451821 - RNA, 18 nt, Pseudomonas aeruginosa PA01
cggcgcacauuacccccu

SEQ ID NO: 3451822 - RNA, 14 nt, Pseudomonas aeruginosa PA01
cggcgcaccgacgc

SEQ ID NO: 3451823 - RNA, 22 nt, Pseudomonas aeruginosa PA01
cggcgcaccgacgccgccugcg

SEQ ID NO: 3451824 - RNA, 23 nt, Pseudomonas aeruginosa PA01
cggcgcaccgacgccgccugcgc

SEQ ID NO: 3451825 - RNA, 15 nt, Pseudomonas aeruginosa PA01
cggcgcacgccggcc

SEQ ID NO: 3451826 - RNA, 18 nt, Pseudomonas aeruginosa PA01
cggcgcacugagggucag

SEQ ID NO: 3451827 - RNA, 22 nt, Pseudomonas aeruginosa PA01
cggcgcacugagggucagccgc

SEQ ID NO: 3451828 - RNA, 23 nt, Pseudomonas aeruginosa PA01
cggcgcagaacugccgggccagc

SEQ ID NO: 3451829 - RNA, 14 nt, Pseudomonas aeruginosa PA01
cggcgcagcaacug

SEQ ID NO: 3451830 - RNA, 19 nt, Pseudomonas aeruginosa PA01
cggcgcagcaacuguccga

SEQ ID NO: 3451831 - RNA, 14 nt, Pseudomonas aeruginosa PA01
cggcgcagcagggc

SEQ ID NO: 3451832 - RNA, 21 nt, Pseudomonas aeruginosa PA01
cggcgcagcagggcgucggcg

SEQ ID NO: 3451833 - RNA, 22 nt, Pseudomonas aeruginosa PA01
cggcgcagcagggcgucggcgu

SEQ ID NO: 3451834 - RNA, 13 nt, Pseudomonas aeruginosa PA01
cggcgcagccaga

SEQ ID NO: 3451835 - RNA, 16 nt, Pseudomonas aeruginosa PA01
cggcgcagcccagccg

SEQ ID NO: 3451836 - RNA, 18 nt, Pseudomonas aeruginosa PA01
cggcgcagcccagccgcu

SEQ ID NO: 3451837 - RNA, 12 nt, Pseudomonas aeruginosa PA01
cggcgcagccgc

SEQ ID NO: 3451838 - RNA, 19 nt, Pseudomonas aeruginosa PA01
cggcgcagccgcaaggcca

SEQ ID NO: 3451839 - RNA, 16 nt, Pseudomonas aeruginosa PA01
cggcgcagccucgcgc

SEQ ID NO: 3451840 - RNA, 12 nt, Pseudomonas aeruginosa PA01
cggcgcagcgga

SEQ ID NO: 3451841 - RNA, 14 nt, Pseudomonas aeruginosa PA01
cggcgcagcggagg

SEQ ID NO: 3451842 - RNA, 14 nt, Pseudomonas aeruginosa PA01
cggcgcagcggcga

SEQ ID NO: 3451843 - RNA, 19 nt, Pseudomonas aeruginosa PA01
cggcgcagcuucuccaccg

SEQ ID NO: 3451844 - RNA, 13 nt, Pseudomonas aeruginosa PA01
cggcgcaggcaug

SEQ ID NO: 3451845 - RNA, 14 nt, Pseudomonas aeruginosa PA01
cggcgcaggcgaug

SEQ ID NO: 3451846 - RNA, 12 nt, Pseudomonas aeruginosa PA01
cggcgcaggcgg

SEQ ID NO: 3451847 - RNA, 15 nt, Pseudomonas aeruginosa PA01
cggcgcaggcugucg

SEQ ID NO: 3451848 - RNA, 14 nt, Pseudomonas aeruginosa PA01
cggcgcaggcuugg

SEQ ID NO: 3451849 - RNA, 19 nt, Pseudomonas aeruginosa PA01
cggcgcagucgucaagcgc

SEQ ID NO: 3451850 - RNA, 17 nt, Pseudomonas aeruginosa PA01
cggcgcaguucgucgag

SEQ ID NO: 3451851 - RNA, 16 nt, Pseudomonas aeruginosa PA01
cggcgcauagccaccg

SEQ ID NO: 3451852 - RNA, 17 nt, Pseudomonas aeruginosa PA01
cggcgcauagccaccgc

SEQ ID NO: 3451853 - RNA, 19 nt, Pseudomonas aeruginosa PA01
cggcgcauagccaccgccg

SEQ ID NO: 3451854 - RNA, 22 nt, Pseudomonas aeruginosa PA01
cggcgcauagccaccgccgaca

SEQ ID NO: 3451855 - RNA, 23 nt, Pseudomonas aeruginosa PA01
cggcgcauagccaccgccgacau

SEQ ID NO: 3451856 - RNA, 16 nt, Pseudomonas aeruginosa PA01
cggcgcaucagcgccg

SEQ ID NO: 3451857 - RNA, 14 nt, Pseudomonas aeruginosa PA01
cggcgcaucggcgg

SEQ ID NO: 3451858 - RNA, 18 nt, Pseudomonas aeruginosa PA01
cggcgcaucgucgaaacg

SEQ ID NO: 3451859 - RNA, 22 nt, Pseudomonas aeruginosa PA01
cggcgcaucgucgaaacgcugg

SEQ ID NO: 3451860 - RNA, 16 nt, Pseudomonas aeruginosa PA01
cggcgcaugccgcagg

SEQ ID NO: 3451861 - RNA, 15 nt, Pseudomonas aeruginosa PA01
cggcgcaugcgccgg

SEQ ID NO: 3451862 - RNA, 18 nt, Pseudomonas aeruginosa PA01
cggcgccaacucggccug

SEQ ID NO: 3451863 - RNA, 14 nt, Pseudomonas aeruginosa PA01
cggcgccaacugcu

SEQ ID NO: 3451864 - RNA, 17 nt, Pseudomonas aeruginosa PA01
cggcgccaacugcuugc

SEQ ID NO: 3451865 - RNA, 20 nt, Pseudomonas aeruginosa PA01
cggcgccaacugcuugccga

SEQ ID NO: 3451866 - RNA, 11 nt, Pseudomonas aeruginosa PA01
cggcgccaccc

SEQ ID NO: 3451867 - RNA, 13 nt, Pseudomonas aeruginosa PA01
cggcgccaccccg

SEQ ID NO: 3451868 - RNA, 15 nt, Pseudomonas aeruginosa PA01
cggcgccaccccgcc

SEQ ID NO: 3451869 - RNA, 16 nt, Pseudomonas aeruginosa PA01
cggcgccaccccgccg

SEQ ID NO: 3451870 - RNA, 21 nt, Pseudomonas aeruginosa PA01
cggcgccuucagcgccgccag

SEQ ID NO: 3451871 - RNA, 16 nt, Pseudomonas aeruginosa PA01
cggcgccuucaucgcc

SEQ ID NO: 3451872 - RNA, 23 nt, Pseudomonas aeruginosa PA01
cggcgccuucaucgccaccuucc

SEQ ID NO: 3451873 - RNA, 20 nt, Pseudomonas aeruginosa PA01
cggcgccuuccugcuucagg

SEQ ID NO: 3451874 - RNA, 14 nt, Pseudomonas aeruginosa PA01
cggcgccuucgccg

SEQ ID NO: 3451875 - RNA, 21 nt, Pseudomonas aeruginosa PA01
cggcgccuugcgguccagcga

SEQ ID NO: 3451876 - RNA, 17 nt, Pseudomonas aeruginosa PA01
cggcgcgaaccagcagc

SEQ ID NO: 3451877 - RNA, 13 nt, Pseudomonas aeruginosa PA01
cggcgcgaagucg

SEQ ID NO: 3451878 - RNA, 19 nt, Pseudomonas aeruginosa PA01
cggcgcgaagucgcagucg

SEQ ID NO: 3451879 - RNA, 17 nt, Pseudomonas aeruginosa PA01
cggcgcgaccgucggcc

SEQ ID NO: 3451880 - RNA, 24 nt, Pseudomonas aeruginosa PA01
cggcgcgacgcuacguuccagggc

SEQ ID NO: 3451881 - RNA, 15 nt, Pseudomonas aeruginosa PA01
cggcgcgacgcucca

SEQ ID NO: 3451882 - RNA, 17 nt, Pseudomonas aeruginosa PA01
cggcgcgacgcuccagg

SEQ ID NO: 3451883 - RNA, 19 nt, Pseudomonas aeruginosa PA01
cggcgcgacggcccacggc

SEQ ID NO: 3451884 - RNA, 20 nt, Pseudomonas aeruginosa PA01
cggcgcgacggcccacggcg

SEQ ID NO: 3451885 - RNA, 18 nt, Pseudomonas aeruginosa PA01
cggcgcgagaugaagcgc

SEQ ID NO: 3451886 - RNA, 21 nt, Pseudomonas aeruginosa PA01
cggcgcgagaugaagcgccgc

SEQ ID NO: 3451887 - RNA, 22 nt, Pseudomonas aeruginosa PA01
cggcgcgagaugaagcgccgca

SEQ ID NO: 3451888 - RNA, 18 nt, Pseudomonas aeruginosa PA01
cggcgcgaggcggaagaa

SEQ ID NO: 3451889 - RNA, 18 nt, Pseudomonas aeruginosa PA01
cggcgcgauauccgccag

SEQ ID NO: 3451890 - RNA, 19 nt, Pseudomonas aeruginosa PA01
cggcgcgauauccgccagg

SEQ ID NO: 3451891 - RNA, 12 nt, Pseudomonas aeruginosa PA01
cggcgcgauccu

SEQ ID NO: 3451892 - RNA, 12 nt, Pseudomonas aeruginosa PA01
cggcgcgaugcc

SEQ ID NO: 3451893 - RNA, 14 nt, Pseudomonas aeruginosa PA01
cggcgcgcagggcc

SEQ ID NO: 3451894 - RNA, 15 nt, Pseudomonas aeruginosa PA01
cggcgcgcagggcca

SEQ ID NO: 3451895 - RNA, 18 nt, Pseudomonas aeruginosa PA01
cggcgcgcagggccagca

SEQ ID NO: 3451896 - RNA, 21 nt, Pseudomonas aeruginosa PA01
cggcgcgcagggugagcaugg

SEQ ID NO: 3451897 - RNA, 23 nt, Pseudomonas aeruginosa PA01
cggcgcgcaucuggugcgcgucc

SEQ ID NO: 3451898 - RNA, 23 nt, Pseudomonas aeruginosa PA01
cggcgcgccagaagcggccgacc

SEQ ID NO: 3451899 - RNA, 15 nt, Pseudomonas aeruginosa PA01
cggcgcgccauggcg

SEQ ID NO: 3451900 - RNA, 21 nt, Pseudomonas aeruginosa PA01
cggcgcgccauggcgguuccu

SEQ ID NO: 3451901 - RNA, 21 nt, Pseudomonas aeruginosa PA01
cggcgcgcccaggcccagcgc

SEQ ID NO: 3451902 - RNA, 14 nt, Pseudomonas aeruginosa PA01
cggcgcgcccggcg

SEQ ID NO: 3451903 - RNA, 16 nt, Pseudomonas aeruginosa PA01
cggcgcgcccggcgca

SEQ ID NO: 3451904 - RNA, 16 nt, Pseudomonas aeruginosa PA01
cggcgcgccgaaggcg

SEQ ID NO: 3451905 - RNA, 15 nt, Pseudomonas aeruginosa PA01
cggcgcgccggacag

SEQ ID NO: 3451906 - RNA, 13 nt, Pseudomonas aeruginosa PA01
cggcgcgccggug

SEQ ID NO: 3451907 - RNA, 15 nt, Pseudomonas aeruginosa PA01
cggcgcgccggugau

SEQ ID NO: 3451908 - RNA, 11 nt, Pseudomonas aeruginosa PA01
cggcgcgccuu

SEQ ID NO: 3451909 - RNA, 17 nt, Pseudomonas aeruginosa PA01
cggcgcgccuucagcgc

SEQ ID NO: 3451910 - RNA, 19 nt, Pseudomonas aeruginosa PA01
cggcgcgccuucagcgccu

SEQ ID NO: 3451911 - RNA, 14 nt, Pseudomonas aeruginosa PA01
cggcgcgcgccccc

SEQ ID NO: 3451912 - RNA, 15 nt, Pseudomonas aeruginosa PA01
cggcgcgcgcccccu

SEQ ID NO: 3451913 - RNA, 14 nt, Pseudomonas aeruginosa PA01
cggcgcgcggcagc

SEQ ID NO: 3451914 - RNA, 15 nt, Pseudomonas aeruginosa PA01
cggcgcgcggcagca

SEQ ID NO: 3451915 - RNA, 17 nt, Pseudomonas aeruginosa PA01
cggcgcgcggcagcacc

SEQ ID NO: 3451916 - RNA, 18 nt, Pseudomonas aeruginosa PA01
cggcgcgcggcagcacca

SEQ ID NO: 3451917 - RNA, 14 nt, Pseudomonas aeruginosa PA01
cggcgcgcggcggg

SEQ ID NO: 3451918 - RNA, 13 nt, Pseudomonas aeruginosa PA01
cggcgcgcggggu

SEQ ID NO: 3451919 - RNA, 15 nt, Pseudomonas aeruginosa PA01
cggcgcgcggggucu

SEQ ID NO: 3451920 - RNA, 21 nt, Pseudomonas aeruginosa PA01
cggcgcgcgucguccagggcg

SEQ ID NO: 3451921 - RNA, 17 nt, Pseudomonas aeruginosa PA01
cggcgcgcuccggcgcg

SEQ ID NO: 3451922 - RNA, 11 nt, Pseudomonas aeruginosa PA01
cggcgcgcuga

SEQ ID NO: 3451923 - RNA, 14 nt, Pseudomonas aeruginosa PA01
cggcgcgcugcggg

SEQ ID NO: 3451924 - RNA, 19 nt, Pseudomonas aeruginosa PA01
cggcgcgcugcgggucauu

SEQ ID NO: 3451925 - RNA, 22 nt, Pseudomonas aeruginosa PA01
cggcgcgcugcgugcgccgcuc

SEQ ID NO: 3451926 - RNA, 16 nt, Pseudomonas aeruginosa PA01
cggcgcggaagcgccu

SEQ ID NO: 3451927 - RNA, 22 nt, Pseudomonas aeruginosa PA01
cggcgcggaagcgccugcggug

SEQ ID NO: 3451928 - RNA, 14 nt, Pseudomonas aeruginosa PA01
cggcgcggaccgca

SEQ ID NO: 3451929 - RNA, 19 nt, Pseudomonas aeruginosa PA01
cggcgcggacggccugcgc

SEQ ID NO: 3451930 - RNA, 22 nt, Pseudomonas aeruginosa PA01
cggcgcggacggccugcgcccu

SEQ ID NO: 3451931 - RNA, 23 nt, Pseudomonas aeruginosa PA01
cggcgcggagauccccuccucca

SEQ ID NO: 3451932 - RNA, 19 nt, Pseudomonas aeruginosa PA01
cggcgcggcagugcucgau

SEQ ID NO: 3451933 - RNA, 17 nt, Pseudomonas aeruginosa PA01
cggcgcggccagcuucu

SEQ ID NO: 3451934 - RNA, 23 nt, Pseudomonas aeruginosa PA01
cggcgcggccagcuucuccagca

SEQ ID NO: 3451935 - RNA, 16 nt, Pseudomonas aeruginosa PA01
cggcgcggcccguccg

SEQ ID NO: 3451936 - RNA, 24 nt, Pseudomonas aeruginosa PA01
cggcgcggcccguccgcgccacgg

SEQ ID NO: 3451937 - RNA, 14 nt, Pseudomonas aeruginosa PA01
cggcgcggccggcg

SEQ ID NO: 3451938 - RNA, 15 nt, Pseudomonas aeruginosa PA01
cggcgcggccggcgc

SEQ ID NO: 3451939 - RNA, 19 nt, Pseudomonas aeruginosa PA01
cggcgcggccggcgccgcg

SEQ ID NO: 3451940 - RNA, 16 nt, Pseudomonas aeruginosa PA01
cggcgcggccugcagc

SEQ ID NO: 3451941 - RNA, 12 nt, Pseudomonas aeruginosa PA01
cggcgcggcgca

SEQ ID NO: 3451942 - RNA, 13 nt, Pseudomonas aeruginosa PA01
cggcgcggcgcgu

SEQ ID NO: 3451943 - RNA, 17 nt, Pseudomonas aeruginosa PA01
cggcgcggcgcguuccg

SEQ ID NO: 3451944 - RNA, 15 nt, Pseudomonas aeruginosa PA01
cggcgcggcgcucca

SEQ ID NO: 3451945 - RNA, 17 nt, Pseudomonas aeruginosa PA01
cggcgcggcgcuccagg

SEQ ID NO: 3451946 - RNA, 20 nt, Pseudomonas aeruginosa PA01
cggcgcggcgcuccaggcgg

SEQ ID NO: 3451947 - RNA, 21 nt, Pseudomonas aeruginosa PA01
cggcgcggcgcuccaggcggg

SEQ ID NO: 3451948 - RNA, 18 nt, Pseudomonas aeruginosa PA01
cggcgcggcggccgccuc

SEQ ID NO: 3451949 - RNA, 12 nt, Pseudomonas aeruginosa PA01
cggcgcggcgua

SEQ ID NO: 3451950 - RNA, 16 nt, Pseudomonas aeruginosa PA01
cggcgcggcguggcgg

SEQ ID NO: 3451951 - RNA, 21 nt, Pseudomonas aeruginosa PA01
cggcgcggcguggcggaagaa

SEQ ID NO: 3451952 - RNA, 14 nt, Pseudomonas aeruginosa PA01
cggcgcggcguuca

SEQ ID NO: 3451953 - RNA, 20 nt, Pseudomonas aeruginosa PA01
cggcgcggcuacccucuccc

SEQ ID NO: 3451954 - RNA, 22 nt, Pseudomonas aeruginosa PA01
cggcgcggcuacccucucccca

SEQ ID NO: 3451955 - RNA, 16 nt, Pseudomonas aeruginosa PA01
cggcgcgggcgccgau

SEQ ID NO: 3451956 - RNA, 17 nt, Pseudomonas aeruginosa PA01
cggcgcgggcgccgaug

SEQ ID NO: 3451957 - RNA, 16 nt, Pseudomonas aeruginosa PA01
cggcgcgggcgcgcgc

SEQ ID NO: 3451958 - RNA, 20 nt, Pseudomonas aeruginosa PA01
cggcgcgggcgcgcgccacc

SEQ ID NO: 3451959 - RNA, 22 nt, Pseudomonas aeruginosa PA01
cggcgcgggcgcgcgccaccgc

SEQ ID NO: 3451960 - RNA, 20 nt, Pseudomonas aeruginosa PA01
cggcgcgggucugcucgcgc

SEQ ID NO: 3451961 - RNA, 19 nt, Pseudomonas aeruginosa PA01
cggcgcggugagggcgacg

SEQ ID NO: 3451962 - RNA, 21 nt, Pseudomonas aeruginosa PA01
cggcgcggugccgugggucgc

SEQ ID NO: 3451963 - RNA, 17 nt, Pseudomonas aeruginosa PA01
cggcgcgguuucgcagc

SEQ ID NO: 3451964 - RNA, 18 nt, Pseudomonas aeruginosa PA01
cggcgcgguuucgcagcg

SEQ ID NO: 3451965 - RNA, 19 nt, Pseudomonas aeruginosa PA01
cggcgcgguuucgcagcgc

SEQ ID NO: 3451966 - RNA, 20 nt, Pseudomonas aeruginosa PA01
cggcgcgguuucgcagcgcu

SEQ ID NO: 3451967 - RNA, 23 nt, Pseudomonas aeruginosa PA01
cggcgcguaggcgaacacgucgg

SEQ ID NO: 3451968 - RNA, 15 nt, Pseudomonas aeruginosa PA01
cggcgcguccaccug

SEQ ID NO: 3451969 - RNA, 18 nt, Pseudomonas aeruginosa PA01
cggcgcguccaccuggcg

SEQ ID NO: 3451970 - RNA, 17 nt, Pseudomonas aeruginosa PA01
cggcgcgucccugggcg

SEQ ID NO: 3451971 - RNA, 18 nt, Pseudomonas aeruginosa PA01
cggcgcgucccugggcgc

SEQ ID NO: 3451972 - RNA, 21 nt, Pseudomonas aeruginosa PA01
cggcggaggccuacuucucga

SEQ ID NO: 3451973 - RNA, 21 nt, Pseudomonas aeruginosa PA01
cggcggagucguagcgcaugc

SEQ ID NO: 3451974 - RNA, 23 nt, Pseudomonas aeruginosa PA01
cggcggagucguagcgcaugccg

SEQ ID NO: 3451975 - RNA, 18 nt, Pseudomonas aeruginosa PA01
cggcggauaaacggcaug

SEQ ID NO: 3451976 - RNA, 23 nt, Pseudomonas aeruginosa PA01
cggcggauaaacggcaugcacgc

SEQ ID NO: 3451977 - RNA, 21 nt, Pseudomonas aeruginosa PA01
cggcggauaaccgcguugcgg

SEQ ID NO: 3451978 - RNA, 13 nt, Pseudomonas aeruginosa PA01
cggcggauaacgc

SEQ ID NO: 3451979 - RNA, 15 nt, Pseudomonas aeruginosa PA01
cggcggauaacgccg

SEQ ID NO: 3451980 - RNA, 17 nt, Pseudomonas aeruginosa PA01
cggcggauaacgccgau

SEQ ID NO: 3451981 - RNA, 17 nt, Pseudomonas aeruginosa PA01
cggcggauaacgccugc

SEQ ID NO: 3451982 - RNA, 22 nt, Pseudomonas aeruginosa PA01
cggcggauaacgcuacccucag

SEQ ID NO: 3451983 - RNA, 21 nt, Pseudomonas aeruginosa PA01
cggcggauaacgcuucgcagc

SEQ ID NO: 3451984 - RNA, 22 nt, Pseudomonas aeruginosa PA01
cggcggauaacgcuucgcagca

SEQ ID NO: 3451985 - RNA, 23 nt, Pseudomonas aeruginosa PA01
cggcggauaacgcuucgcagcau

SEQ ID NO: 3451986 - RNA, 14 nt, Pseudomonas aeruginosa PA01
cggcggauacaggc

SEQ ID NO: 3451987 - RNA, 16 nt, Pseudomonas aeruginosa PA01
cggcggauacaggcgc

SEQ ID NO: 3451988 - RNA, 17 nt, Pseudomonas aeruginosa PA01
cggcggauacaggcgca

SEQ ID NO: 3451989 - RNA, 18 nt, Pseudomonas aeruginosa PA01
cggcggauacaggcgcag

SEQ ID NO: 3451990 - RNA, 19 nt, Pseudomonas aeruginosa PA01
cggcggauacaggcgcagc

SEQ ID NO: 3451991 - RNA, 14 nt, Pseudomonas aeruginosa PA01
cggcggaucagccc

SEQ ID NO: 3451992 - RNA, 16 nt, Pseudomonas aeruginosa PA01
cggcggaucagcccgc

SEQ ID NO: 3451993 - RNA, 16 nt, Pseudomonas aeruginosa PA01
cggcggaucgaucagc

SEQ ID NO: 3451994 - RNA, 17 nt, Pseudomonas aeruginosa PA01
cggcggaucgaucagca

SEQ ID NO: 3451995 - RNA, 19 nt, Pseudomonas aeruginosa PA01
cggcggaucgaucagcagc

SEQ ID NO: 3451996 - RNA, 14 nt, Pseudomonas aeruginosa PA01
cggcggaucgaucg

SEQ ID NO: 3451997 - RNA, 22 nt, Pseudomonas aeruginosa PA01
cggcggaucgaucgaucagccg

SEQ ID NO: 3451998 - RNA, 23 nt, Pseudomonas aeruginosa PA01
cggcggaugacguucccguccgg

SEQ ID NO: 3451999 - RNA, 14 nt, Pseudomonas aeruginosa PA01
cggcggaugccggc

SEQ ID NO: 3452000 - RNA, 16 nt, Pseudomonas aeruginosa PA01
cggcggaugccggcgc

SEQ ID NO: 3452001 - RNA, 19 nt, Pseudomonas aeruginosa PA01
cggcggauuacuccgccgg

SEQ ID NO: 3452002 - RNA, 19 nt, Pseudomonas aeruginosa PA01
cggcggauugacgauggcc

SEQ ID NO: 3452003 - RNA, 22 nt, Pseudomonas aeruginosa PA01
cggcggauugacgauggccagc

SEQ ID NO: 3452004 - RNA, 23 nt, Pseudomonas aeruginosa PA01
cggcggauugacgauggccagcc

SEQ ID NO: 3452005 - RNA, 16 nt, Pseudomonas aeruginosa PA01
cggcggauugccagca

SEQ ID NO: 3452006 - RNA, 18 nt, Pseudomonas aeruginosa PA01
cggcggauugccagcagu

SEQ ID NO: 3452007 - RNA, 20 nt, Pseudomonas aeruginosa PA01
cggcggcaccacgugcagca

SEQ ID NO: 3452008 - RNA, 14 nt, Pseudomonas aeruginosa PA01
cggcggcacgacca

SEQ ID NO: 3452009 - RNA, 17 nt, Pseudomonas aeruginosa PA01
cggcggcagcugcggcg

SEQ ID NO: 3452010 - RNA, 18 nt, Pseudomonas aeruginosa PA01
cggcggcagcugcggcgg

SEQ ID NO: 3452011 - RNA, 23 nt, Pseudomonas aeruginosa PA01
cggcggcaggccagcuuccaggc

SEQ ID NO: 3452012 - RNA, 13 nt, Pseudomonas aeruginosa PA01
cggcggcaggccg

SEQ ID NO: 3452013 - RNA, 15 nt, Pseudomonas aeruginosa PA01
cggcggcaggccgau

SEQ ID NO: 3452014 - RNA, 14 nt, Pseudomonas aeruginosa PA01
cggcggcaggcgca

SEQ ID NO: 3452015 - RNA, 20 nt, Pseudomonas aeruginosa PA01
cggcggcaggcugcgccgcu

SEQ ID NO: 3452016 - RNA, 15 nt, Pseudomonas aeruginosa PA01
cggcggcaggucgga

SEQ ID NO: 3452017 - RNA, 20 nt, Pseudomonas aeruginosa PA01
cggcggcaggucggacaggc

SEQ ID NO: 3452018 - RNA, 24 nt, Pseudomonas aeruginosa PA01
cggcggcaugggcauccugccgcc

SEQ ID NO: 3452019 - RNA, 14 nt, Pseudomonas aeruginosa PA01
cggcggccagcagc

SEQ ID NO: 3452020 - RNA, 21 nt, Pseudomonas aeruginosa PA01
cggcggccagcagcacggcga

SEQ ID NO: 3452021 - RNA, 22 nt, Pseudomonas aeruginosa PA01
cggcggccagcagcacggcgac

SEQ ID NO: 3452022 - RNA, 14 nt, Pseudomonas aeruginosa PA01
cggcggccagcgga

SEQ ID NO: 3452023 - RNA, 23 nt, Pseudomonas aeruginosa PA01
cggcggccagcggaugcuggcgg

SEQ ID NO: 3452024 - RNA, 14 nt, Pseudomonas aeruginosa PA01
cggcggccaggcgc

SEQ ID NO: 3452025 - RNA, 16 nt, Pseudomonas aeruginosa PA01
cggcggccaggcgcuc

SEQ ID NO: 3452026 - RNA, 15 nt, Pseudomonas aeruginosa PA01
cggcggccaggcggc

SEQ ID NO: 3452027 - RNA, 16 nt, Pseudomonas aeruginosa PA01
cggcggccaggcggcu

SEQ ID NO: 3452028 - RNA, 12 nt, Pseudomonas aeruginosa PA01
cggcggccaggg

SEQ ID NO: 3452029 - RNA, 15 nt, Pseudomonas aeruginosa PA01
cggcggccauugccg

SEQ ID NO: 3452030 - RNA, 14 nt, Pseudomonas aeruginosa PA01
cggcggccgcaugc

SEQ ID NO: 3452031 - RNA, 18 nt, Pseudomonas aeruginosa PA01
cggcggccgcaugccggg

SEQ ID NO: 3452032 - RNA, 17 nt, Pseudomonas aeruginosa PA01
cggcggccgccaucgcc

SEQ ID NO: 3452033 - RNA, 18 nt, Pseudomonas aeruginosa PA01
cggcggccgccaucgccc

SEQ ID NO: 3452034 - RNA, 21 nt, Pseudomonas aeruginosa PA01
cggcggccgccaucgcccggu

SEQ ID NO: 3452035 - RNA, 23 nt, Pseudomonas aeruginosa PA01
cggcggccgccaucgcccgguug

SEQ ID NO: 3452036 - RNA, 12 nt, Pseudomonas aeruginosa PA01
cggcggccgccu

SEQ ID NO: 3452037 - RNA, 17 nt, Pseudomonas aeruginosa PA01
cggcggccgccucggcg

SEQ ID NO: 3452038 - RNA, 21 nt, Pseudomonas aeruginosa PA01
cggcggccgccucggcguaga

SEQ ID NO: 3452039 - RNA, 13 nt, Pseudomonas aeruginosa PA01
cggcggccgccuu

SEQ ID NO: 3452040 - RNA, 14 nt, Pseudomonas aeruginosa PA01
cggcggccggcgca

SEQ ID NO: 3452041 - RNA, 14 nt, Pseudomonas aeruginosa PA01
cggcggccgggucg

SEQ ID NO: 3452042 - RNA, 13 nt, Pseudomonas aeruginosa PA01
cggcggccgucgc

SEQ ID NO: 3452043 - RNA, 14 nt, Pseudomonas aeruginosa PA01
cggcggccucgagg

SEQ ID NO: 3452044 - RNA, 20 nt, Pseudomonas aeruginosa PA01
cggcggccucgaggucggcc

SEQ ID NO: 3452045 - RNA, 14 nt, Pseudomonas aeruginosa PA01
cggcggccucgcgg

SEQ ID NO: 3452046 - RNA, 14 nt, Pseudomonas aeruginosa PA01
cggcggccucggcc

SEQ ID NO: 3452047 - RNA, 16 nt, Pseudomonas aeruginosa PA01
cggcggccugagccgg

SEQ ID NO: 3452048 - RNA, 23 nt, Pseudomonas aeruginosa PA01
cggcggccugccccgccggcgcu

SEQ ID NO: 3452049 - RNA, 13 nt, Pseudomonas aeruginosa PA01
cggcggccugcuc

SEQ ID NO: 3452050 - RNA, 14 nt, Pseudomonas aeruginosa PA01
cggcggccugcucg

SEQ ID NO: 3452051 - RNA, 19 nt, Pseudomonas aeruginosa PA01
cggcggccugcucgcgcag

SEQ ID NO: 3452052 - RNA, 20 nt, Pseudomonas aeruginosa PA01
cggcggccugcucgcgcagc

SEQ ID NO: 3452053 - RNA, 23 nt, Pseudomonas aeruginosa PA01
cggcggccuuuucggcggccagg

SEQ ID NO: 3452054 - RNA, 23 nt, Pseudomonas aeruginosa PA01
cggcggcgaacaguuguuccggg

SEQ ID NO: 3452055 - RNA, 20 nt, Pseudomonas aeruginosa PA01
cggcggcgaauacguggggg

SEQ ID NO: 3452056 - RNA, 14 nt, Pseudomonas aeruginosa PA01
cggcggcgacccag

SEQ ID NO: 3452057 - RNA, 15 nt, Pseudomonas aeruginosa PA01
cggcggcgacccaga

SEQ ID NO: 3452058 - RNA, 16 nt, Pseudomonas aeruginosa PA01
cggcggcgacccagac

SEQ ID NO: 3452059 - RNA, 17 nt, Pseudomonas aeruginosa PA01
cggcggcgacccagacc

SEQ ID NO: 3452060 - RNA, 22 nt, Pseudomonas aeruginosa PA01
cggcggcgacccagaccugccg

SEQ ID NO: 3452061 - RNA, 17 nt, Pseudomonas aeruginosa PA01
cggcggcgaccccgauc

SEQ ID NO: 3452062 - RNA, 19 nt, Pseudomonas aeruginosa PA01
cggcggcgaccccgaucac

SEQ ID NO: 3452063 - RNA, 18 nt, Pseudomonas aeruginosa PA01
cggcggcgacgcuggcgg

SEQ ID NO: 3452064 - RNA, 22 nt, Pseudomonas aeruginosa PA01
cggcggcgagcauuccucagcg

SEQ ID NO: 3452065 - RNA, 14 nt, Pseudomonas aeruginosa PA01
cggcggcgagcgcc

SEQ ID NO: 3452066 - RNA, 16 nt, Pseudomonas aeruginosa PA01
cggcggcgagcgccgc

SEQ ID NO: 3452067 - RNA, 20 nt, Pseudomonas aeruginosa PA01
cggcggcgagcgccgcggcg

SEQ ID NO: 3452068 - RNA, 12 nt, Pseudomonas aeruginosa PA01
cggcggcgaucu

SEQ ID NO: 3452069 - RNA, 20 nt, Pseudomonas aeruginosa PA01
cggcggcgaucuucuccgcc

SEQ ID NO: 3452070 - RNA, 22 nt, Pseudomonas aeruginosa PA01
cggcggcgaucuucuccgccgc

SEQ ID NO: 3452071 - RNA, 18 nt, Pseudomonas aeruginosa PA01
cggcggcgaugaucggca

SEQ ID NO: 3452072 - RNA, 20 nt, Pseudomonas aeruginosa PA01
cggcggcgaugaucggcagc

SEQ ID NO: 3452073 - RNA, 13 nt, Pseudomonas aeruginosa PA01
cggcggcgccagg

SEQ ID NO: 3452074 - RNA, 15 nt, Pseudomonas aeruginosa PA01
cggcgguccgccgcg

SEQ ID NO: 3452075 - RNA, 19 nt, Pseudomonas aeruginosa PA01
cggcgguccgccgcgggac

SEQ ID NO: 3452076 - RNA, 14 nt, Pseudomonas aeruginosa PA01
cggcggucgcgauc

SEQ ID NO: 3452077 - RNA, 19 nt, Pseudomonas aeruginosa PA01
cggcggucgcgaucugcug

SEQ ID NO: 3452078 - RNA, 16 nt, Pseudomonas aeruginosa PA01
cggcggucucgaacgc

SEQ ID NO: 3452079 - RNA, 18 nt, Pseudomonas aeruginosa PA01
cggcggucucgaacgcca

SEQ ID NO: 3452080 - RNA, 21 nt, Pseudomonas aeruginosa PA01
cggcggucucgaacgccaggc

SEQ ID NO: 3452081 - RNA, 22 nt, Pseudomonas aeruginosa PA01
cggcggucucgaacgccaggca

SEQ ID NO: 3452082 - RNA, 22 nt, Pseudomonas aeruginosa PA01
cggcggucuugaucacguccag

SEQ ID NO: 3452083 - RNA, 14 nt, Pseudomonas aeruginosa PA01
cggcggugagggcg

SEQ ID NO: 3452084 - RNA, 17 nt, Pseudomonas aeruginosa PA01
cggcggugagggcgacg

SEQ ID NO: 3452085 - RNA, 12 nt, Pseudomonas aeruginosa PA01
cggcggugcaga

SEQ ID NO: 3452086 - RNA, 21 nt, Pseudomonas aeruginosa PA01
cggcggugccauggaucacca

SEQ ID NO: 3452087 - RNA, 15 nt, Pseudomonas aeruginosa PA01
cggcggugcgccggc

SEQ ID NO: 3452088 - RNA, 17 nt, Pseudomonas aeruginosa PA01
cggcggugcgccggcgg

SEQ ID NO: 3452089 - RNA, 15 nt, Pseudomonas aeruginosa PA01
cggcgguggacgucg

SEQ ID NO: 3452090 - RNA, 15 nt, Pseudomonas aeruginosa PA01
cggcgguggggccgc

SEQ ID NO: 3452091 - RNA, 21 nt, Pseudomonas aeruginosa PA01
cggcgguggggccgccgaugc

SEQ ID NO: 3452092 - RNA, 22 nt, Pseudomonas aeruginosa PA01
cggcgguggggccgccgaugcc

SEQ ID NO: 3452093 - RNA, 23 nt, Pseudomonas aeruginosa PA01
cggcgguggggccgccgaugccg

SEQ ID NO: 3452094 - RNA, 14 nt, Pseudomonas aeruginosa PA01
cggcgguguagucg

SEQ ID NO: 3452095 - RNA, 16 nt, Pseudomonas aeruginosa PA01
cggcgguucgccgagc

SEQ ID NO: 3452096 - RNA, 21 nt, Pseudomonas aeruginosa PA01
cggcgguucgccgagcgccgc

SEQ ID NO: 3452097 - RNA, 24 nt, Pseudomonas aeruginosa PA01
cggcgguucgccgagcgccgccag

SEQ ID NO: 3452098 - RNA, 19 nt, Pseudomonas aeruginosa PA01
cggcgguuggagcgagcga

SEQ ID NO: 3452099 - RNA, 16 nt, Pseudomonas aeruginosa PA01
cggcgguuuccaguuc

SEQ ID NO: 3452100 - RNA, 18 nt, Pseudomonas aeruginosa PA01
cggcgguuucgccgaggc

SEQ ID NO: 3452101 - RNA, 19 nt, Pseudomonas aeruginosa PA01
cggcgguuucgucgaagcc

SEQ ID NO: 3452102 - RNA, 19 nt, Pseudomonas aeruginosa PA01
cggcguaaucgaaggucag

SEQ ID NO: 3452103 - RNA, 22 nt, Pseudomonas aeruginosa PA01
cggcguaaucgcgccaggccgc

SEQ ID NO: 3452104 - RNA, 15 nt, Pseudomonas aeruginosa PA01
cggcguaccagccgc

SEQ ID NO: 3452105 - RNA, 17 nt, Pseudomonas aeruginosa PA01
cggcguaccagccgcgg

SEQ ID NO: 3452106 - RNA, 15 nt, Pseudomonas aeruginosa PA01
cggcguaccaggaug

SEQ ID NO: 3452107 - RNA, 23 nt, Pseudomonas aeruginosa PA01
cggcguacgaaccccgggccgcg

SEQ ID NO: 3452108 - RNA, 15 nt, Pseudomonas aeruginosa PA01
cggcguacuucggcg

SEQ ID NO: 3452109 - RNA, 19 nt, Pseudomonas aeruginosa PA01
cggcguacuucggcgcggu

SEQ ID NO: 3452110 - RNA, 15 nt, Pseudomonas aeruginosa PA01
cggcguagccggcca

SEQ ID NO: 3452111 - RNA, 15 nt, Pseudomonas aeruginosa PA01
cggcguagcgcuggg

SEQ ID NO: 3452112 - RNA, 16 nt, Pseudomonas aeruginosa PA01
cggcguagcgcugggc

SEQ ID NO: 3452113 - RNA, 14 nt, Pseudomonas aeruginosa PA01
cggcguaggagucg

SEQ ID NO: 3452114 - RNA, 14 nt, Pseudomonas aeruginosa PA01
cggcguaggccagu

SEQ ID NO: 3452115 - RNA, 18 nt, Pseudomonas aeruginosa PA01
cggcguaggccucggagu

SEQ ID NO: 3452116 - RNA, 14 nt, Pseudomonas aeruginosa PA01
cggcguaggcgcgc

SEQ ID NO: 3452117 - RNA, 15 nt, Pseudomonas aeruginosa PA01
cggcguagugcuggu

SEQ ID NO: 3452118 - RNA, 21 nt, Pseudomonas aeruginosa PA01
cggcguauccaagagagcgcc

SEQ ID NO: 3452119 - RNA, 17 nt, Pseudomonas aeruginosa PA01
cggcguauccucggcca

SEQ ID NO: 3452120 - RNA, 18 nt, Pseudomonas aeruginosa PA01
cggcguaugcgccuccag

SEQ ID NO: 3452121 - RNA, 19 nt, Pseudomonas aeruginosa PA01
cggcguaugcgccuccagg

SEQ ID NO: 3452122 - RNA, 14 nt, Pseudomonas aeruginosa PA01
cggcguauucgccg

SEQ ID NO: 3452123 - RNA, 15 nt, Pseudomonas aeruginosa PA01
cggcguauucgccga

SEQ ID NO: 3452124 - RNA, 17 nt, Pseudomonas aeruginosa PA01
cggcguauucgccgaag

SEQ ID NO: 3452125 - RNA, 22 nt, Pseudomonas aeruginosa PA01
cggcgucacgccgaucccggcg

SEQ ID NO: 3452126 - RNA, 23 nt, Pseudomonas aeruginosa PA01
cggcgucacgccgaucccggcgg

SEQ ID NO: 3452127 - RNA, 24 nt, Pseudomonas aeruginosa PA01
cggcguccacuccggcagcacccg

SEQ ID NO: 3452128 - RNA, 14 nt, Pseudomonas aeruginosa PA01
cggcguccauggcg

SEQ ID NO: 3452129 - RNA, 17 nt, Pseudomonas aeruginosa PA01
cggcguccauggcggcg

SEQ ID NO: 3452130 - RNA, 14 nt, Pseudomonas aeruginosa PA01
cggcguccccuucc

SEQ ID NO: 3452131 - RNA, 21 nt, Pseudomonas aeruginosa PA01
cggcguccccuuccuccucgc

SEQ ID NO: 3452132 - RNA, 22 nt, Pseudomonas aeruginosa PA01
cggcguccccuuccuccucgcc

SEQ ID NO: 3452133 - RNA, 23 nt, Pseudomonas aeruginosa PA01
cggcguccccuuccuccucgccg

SEQ ID NO: 3452134 - RNA, 16 nt, Pseudomonas aeruginosa PA01
cggcgucccggcgccg

SEQ ID NO: 3452135 - RNA, 19 nt, Pseudomonas aeruginosa PA01
cggcgucccggcgccgccc

SEQ ID NO: 3452136 - RNA, 20 nt, Pseudomonas aeruginosa PA01
cggcgucccggcgccgcccu

SEQ ID NO: 3452137 - RNA, 17 nt, Pseudomonas aeruginosa PA01
cggcguccgcggccugc

SEQ ID NO: 3452138 - RNA, 19 nt, Pseudomonas aeruginosa PA01
cggcguccgggugccccag

SEQ ID NO: 3452139 - RNA, 21 nt, Pseudomonas aeruginosa PA01
cggcguccgggugccccaggc

SEQ ID NO: 3452140 - RNA, 22 nt, Pseudomonas aeruginosa PA01
cggcguccgggugccccaggcg

SEQ ID NO: 3452141 - RNA, 13 nt, Pseudomonas aeruginosa PA01
cggcguccuccuc

SEQ ID NO: 3452142 - RNA, 20 nt, Pseudomonas aeruginosa PA01
cggcguccuccuccaguucc

SEQ ID NO: 3452143 - RNA, 13 nt, Pseudomonas aeruginosa PA01
cggcguccucgcg

SEQ ID NO: 3452144 - RNA, 14 nt, Pseudomonas aeruginosa PA01
cggcguccucgcga

SEQ ID NO: 3452145 - RNA, 14 nt, Pseudomonas aeruginosa PA01
cggcguccucggag

SEQ ID NO: 3452146 - RNA, 21 nt, Pseudomonas aeruginosa PA01
cggcguccugcucccuggcgg

SEQ ID NO: 3452147 - RNA, 22 nt, Pseudomonas aeruginosa PA01
cggcguccugcucccuggcgga

SEQ ID NO: 3452148 - RNA, 13 nt, Pseudomonas aeruginosa PA01
cggcguccuugcc

SEQ ID NO: 3452149 - RNA, 14 nt, Pseudomonas aeruginosa PA01
cggcguccuugccg

SEQ ID NO: 3452150 - RNA, 18 nt, Pseudomonas aeruginosa PA01
cggcguccuugccgagga

SEQ ID NO: 3452151 - RNA, 17 nt, Pseudomonas aeruginosa PA01
cggcguccuugggaucg

SEQ ID NO: 3452152 - RNA, 20 nt, Pseudomonas aeruginosa PA01
cggcgucgaggugcggcugc

SEQ ID NO: 3452153 - RNA, 13 nt, Pseudomonas aeruginosa PA01
cggcgucgcgcuu

SEQ ID NO: 3452154 - RNA, 18 nt, Pseudomonas aeruginosa PA01
cggcgucgcgcuugccuu

SEQ ID NO: 3452155 - RNA, 14 nt, Pseudomonas aeruginosa PA01
cggcgucggcaugg

SEQ ID NO: 3452156 - RNA, 16 nt, Pseudomonas aeruginosa PA01
cggcgucggcauggcu

SEQ ID NO: 3452157 - RNA, 22 nt, Pseudomonas aeruginosa PA01
cggcgucggcgaagccugcggc

SEQ ID NO: 3452158 - RNA, 13 nt, Pseudomonas aeruginosa PA01
cggcgucggcgag

SEQ ID NO: 3452159 - RNA, 12 nt, Pseudomonas aeruginosa PA01
cggcgucggcgc

SEQ ID NO: 3452160 - RNA, 16 nt, Pseudomonas aeruginosa PA01
cggcgucggcgcgggc

SEQ ID NO: 3452161 - RNA, 17 nt, Pseudomonas aeruginosa PA01
cggcgucggcugcgcug

SEQ ID NO: 3452162 - RNA, 18 nt, Pseudomonas aeruginosa PA01
cggcgucggcugcgcugg

SEQ ID NO: 3452163 - RNA, 14 nt, Pseudomonas aeruginosa PA01
cggcgucggcuggu

SEQ ID NO: 3452164 - RNA, 18 nt, Pseudomonas aeruginosa PA01
cggcgucggcuggucgaa

SEQ ID NO: 3452165 - RNA, 15 nt, Pseudomonas aeruginosa PA01
cggcgucgggcaggg

SEQ ID NO: 3452166 - RNA, 16 nt, Pseudomonas aeruginosa PA01
cggcgucgggcagggc

SEQ ID NO: 3452167 - RNA, 13 nt, Pseudomonas aeruginosa PA01
cggcgucgggcga

SEQ ID NO: 3452168 - RNA, 21 nt, Pseudomonas aeruginosa PA01
cggcgucguccugcgcggcga

SEQ ID NO: 3452169 - RNA, 14 nt, Pseudomonas aeruginosa PA01
cggcgucgucgauc

SEQ ID NO: 3452170 - RNA, 17 nt, Pseudomonas aeruginosa PA01
cggcgucucauggaaca

SEQ ID NO: 3452171 - RNA, 19 nt, Pseudomonas aeruginosa PA01
cggcgucucauggaacagc

SEQ ID NO: 3452172 - RNA, 22 nt, Pseudomonas aeruginosa PA01
cggcgucucauggaacagcagc

SEQ ID NO: 3452173 - RNA, 23 nt, Pseudomonas aeruginosa PA01
cggcgucucauggaacagcagcc

SEQ ID NO: 3452174 - RNA, 22 nt, Pseudomonas aeruginosa PA01
cggcgucucggagugaggccga

SEQ ID NO: 3452175 - RNA, 19 nt, Pseudomonas aeruginosa PA01
cggcgucuggggugaggcc

SEQ ID NO: 3452176 - RNA, 21 nt, Pseudomonas aeruginosa PA01
cggcgucuggggugaggccga

SEQ ID NO: 3452177 - RNA, 23 nt, Pseudomonas aeruginosa PA01
cggcgucuggggugaggccgagc

SEQ ID NO: 3452178 - RNA, 18 nt, Pseudomonas aeruginosa PA01
cggcgucuuccggcucgc

SEQ ID NO: 3452179 - RNA, 16 nt, Pseudomonas aeruginosa PA01
cggcgucuucggcggc

SEQ ID NO: 3452180 - RNA, 17 nt, Pseudomonas aeruginosa PA01
cggcgucuucggcggcg

SEQ ID NO: 3452181 - RNA, 18 nt, Pseudomonas aeruginosa PA01
cggcgucuucggcggcgc

SEQ ID NO: 3452182 - RNA, 19 nt, Pseudomonas aeruginosa PA01
cggcgucuugucgaagccc

SEQ ID NO: 3452183 - RNA, 15 nt, Pseudomonas aeruginosa PA01
cggcgugaagccgcc

SEQ ID NO: 3452184 - RNA, 19 nt, Pseudomonas aeruginosa PA01
cggcgugaagccgccgccc

SEQ ID NO: 3452185 - RNA, 20 nt, Pseudomonas aeruginosa PA01
cggcgugaagccgccgccca

SEQ ID NO: 3452186 - RNA, 16 nt, Pseudomonas aeruginosa PA01
cggcgugagcagggcc

SEQ ID NO: 3452187 - RNA, 20 nt, Pseudomonas aeruginosa PA01
cggcgugagggucgcgccga

SEQ ID NO: 3452188 - RNA, 23 nt, Pseudomonas aeruginosa PA01
cggcgugagggucgcgccgacga

SEQ ID NO: 3452189 - RNA, 20 nt, Pseudomonas aeruginosa PA01
cggcgugauccgcagguagc

SEQ ID NO: 3452190 - RNA, 15 nt, Pseudomonas aeruginosa PA01
cggcgugcaggccga

SEQ ID NO: 3452191 - RNA, 18 nt, Pseudomonas aeruginosa PA01
cggcgugcaggccgauca

SEQ ID NO: 3452192 - RNA, 21 nt, Pseudomonas aeruginosa PA01
cggcgugcagguagcagccgu

SEQ ID NO: 3452193 - RNA, 17 nt, Pseudomonas aeruginosa PA01
cggcgugcauggccggg

SEQ ID NO: 3452194 - RNA, 18 nt, Pseudomonas aeruginosa PA01
cggcgugcccuuuuccuc

SEQ ID NO: 3452195 - RNA, 12 nt, Pseudomonas aeruginosa PA01
cggcgugccgca

SEQ ID NO: 3452196 - RNA, 16 nt, Pseudomonas aeruginosa PA01
cggcgugccgcaggcc

SEQ ID NO: 3452197 - RNA, 19 nt, Pseudomonas aeruginosa PA01
cggcgugccgcaggccgcg

SEQ ID NO: 3452198 - RNA, 14 nt, Pseudomonas aeruginosa PA01
cggcgugccgggca

SEQ ID NO: 3452199 - RNA, 14 nt, Pseudomonas aeruginosa PA01
cggcgugccgggcc

SEQ ID NO: 3452200 - RNA, 19 nt, Pseudomonas aeruginosa PA01
cggcgugccgggccggcca

SEQ ID NO: 3452201 - RNA, 19 nt, Pseudomonas aeruginosa PA01
cggcgugcugggucuccuc

SEQ ID NO: 3452202 - RNA, 13 nt, Pseudomonas aeruginosa PA01
cggcguggaaggc

SEQ ID NO: 3452203 - RNA, 15 nt, Pseudomonas aeruginosa PA01
cggcguggaaggcca

SEQ ID NO: 3452204 - RNA, 16 nt, Pseudomonas aeruginosa PA01
cggcguggacccacgc

SEQ ID NO: 3452205 - RNA, 16 nt, Pseudomonas aeruginosa PA01
cggcguggccggcgac

SEQ ID NO: 3452206 - RNA, 17 nt, Pseudomonas aeruginosa PA01
cggcguggccggcgacc

SEQ ID NO: 3452207 - RNA, 22 nt, Pseudomonas aeruginosa PA01
cggcguggcgaucaggcagcgc

SEQ ID NO: 3452208 - RNA, 23 nt, Pseudomonas aeruginosa PA01
cggcguggcgaucaggcagcgcg

SEQ ID NO: 3452209 - RNA, 13 nt, Pseudomonas aeruginosa PA01
cggcguggcggau

SEQ ID NO: 3452210 - RNA, 14 nt, Pseudomonas aeruginosa PA01
cggcguggcucgau

SEQ ID NO: 3452211 - RNA, 18 nt, Pseudomonas aeruginosa PA01
cggcguggcucgaucagc

SEQ ID NO: 3452212 - RNA, 20 nt, Pseudomonas aeruginosa PA01
cggcguggcucgaucagccg

SEQ ID NO: 3452213 - RNA, 15 nt, Pseudomonas aeruginosa PA01
cggcgugggcggucg

SEQ ID NO: 3452214 - RNA, 19 nt, Pseudomonas aeruginosa PA01
cggcgugggcggucggcga

SEQ ID NO: 3452215 - RNA, 17 nt, Pseudomonas aeruginosa PA01
cggcguggucgaugccc

SEQ ID NO: 3452216 - RNA, 20 nt, Pseudomonas aeruginosa PA01
cggcguggucgaugcccacc

SEQ ID NO: 3452217 - RNA, 19 nt, Pseudomonas aeruginosa PA01
cggcguggucuccgugcug

SEQ ID NO: 3452218 - RNA, 18 nt, Pseudomonas aeruginosa PA01
cggcguguucaggugcug

SEQ ID NO: 3452219 - RNA, 14 nt, Pseudomonas aeruginosa PA01
cggcguuauccgcc

SEQ ID NO: 3452220 - RNA, 23 nt, Pseudomonas aeruginosa PA01
cggcguuauccgcccugcgcagc

SEQ ID NO: 3452221 - RNA, 16 nt, Pseudomonas aeruginosa PA01
cggcguuauccgccga

SEQ ID NO: 3452222 - RNA, 18 nt, Pseudomonas aeruginosa PA01
cggcguuauccgccgaua

SEQ ID NO: 3452223 - RNA, 19 nt, Pseudomonas aeruginosa PA01
cggcguuauccgccgcuca

SEQ ID NO: 3452224 - RNA, 16 nt, Pseudomonas aeruginosa PA01
cggcguucaccgcgca

SEQ ID NO: 3452225 - RNA, 15 nt, Pseudomonas aeruginosa PA01
cggcguucgacgccu

SEQ ID NO: 3452226 - RNA, 13 nt, Pseudomonas aeruginosa PA01
cggcguucgcccu

SEQ ID NO: 3452227 - RNA, 14 nt, Pseudomonas aeruginosa PA01
cggcguucgcccug

SEQ ID NO: 3452228 - RNA, 14 nt, Pseudomonas aeruginosa PA01
cggcguucgccgag

SEQ ID NO: 3452229 - RNA, 17 nt, Pseudomonas aeruginosa PA01
cggcguucgccgagcaa

SEQ ID NO: 3452230 - RNA, 21 nt, Pseudomonas aeruginosa PA01
cggcguucgccgagcaagccu

SEQ ID NO: 3452231 - RNA, 16 nt, Pseudomonas aeruginosa PA01
cggcguucgccgcggg

SEQ ID NO: 3452232 - RNA, 17 nt, Pseudomonas aeruginosa PA01
cggcguucgccgcgggc

SEQ ID NO: 3452233 - RNA, 16 nt, Pseudomonas aeruginosa PA01
cggcguucgccggguu

SEQ ID NO: 3452234 - RNA, 17 nt, Pseudomonas aeruginosa PA01
cggcguugaacugcccg

SEQ ID NO: 3452235 - RNA, 24 nt, Pseudomonas aeruginosa PA01
cggcguugaacugcccgcaggggc

SEQ ID NO: 3452236 - RNA, 23 nt, Pseudomonas aeruginosa PA01
cggcguuggaauaguggaucgcc

SEQ ID NO: 3452237 - RNA, 17 nt, Pseudomonas aeruginosa PA01
cggcguuggcacgacgc

SEQ ID NO: 3452238 - RNA, 15 nt, Pseudomonas aeruginosa PA01
cggcguuggccgagg

SEQ ID NO: 3452239 - RNA, 19 nt, Pseudomonas aeruginosa PA01
cggcguuggccgaggaggc

SEQ ID NO: 3452240 - RNA, 20 nt, Pseudomonas aeruginosa PA01
cggcguuggccgaggaggcc

SEQ ID NO: 3452241 - RNA, 21 nt, Pseudomonas aeruginosa PA01
cggcguuguagaucugcaccg

SEQ ID NO: 3452242 - RNA, 16 nt, Pseudomonas aeruginosa PA01
cggcguuguccaggcu

SEQ ID NO: 3452243 - RNA, 17 nt, Pseudomonas aeruginosa PA01
cggcguuguccaggcug

SEQ ID NO: 3452244 - RNA, 14 nt, Pseudomonas aeruginosa PA01
cggcguugucggcc

SEQ ID NO: 3452245 - RNA, 15 nt, Pseudomonas aeruginosa PA01
cggcguugucggcca

SEQ ID NO: 3452246 - RNA, 16 nt, Pseudomonas aeruginosa PA01
cggcguugucggccag

SEQ ID NO: 3452247 - RNA, 18 nt, Pseudomonas aeruginosa PA01
cggcguugucggccagca

SEQ ID NO: 3452248 - RNA, 21 nt, Pseudomonas aeruginosa PA01
cggcguugucggccagcagca

SEQ ID NO: 3452249 - RNA, 16 nt, Pseudomonas aeruginosa PA01
cggcguuuacgcgcca

SEQ ID NO: 3452250 - RNA, 18 nt, Pseudomonas aeruginosa PA01
cggcguuuacgcgccaag

SEQ ID NO: 3452251 - RNA, 23 nt, Pseudomonas aeruginosa PA01
cggcguuuacgcgccaagguucc

SEQ ID NO: 3452252 - RNA, 16 nt, Pseudomonas aeruginosa PA01
cggcguuuagcgcccg

SEQ ID NO: 3452253 - RNA, 17 nt, Pseudomonas aeruginosa PA01
cggcguuuagcgcccga

SEQ ID NO: 3452254 - RNA, 15 nt, Pseudomonas aeruginosa PA01
cggcguuucgccggg

SEQ ID NO: 3452255 - RNA, 16 nt, Pseudomonas aeruginosa PA01
cggcguuucgccgggc

SEQ ID NO: 3452256 - RNA, 17 nt, Pseudomonas aeruginosa PA01
cggcguuucgccgggcc

SEQ ID NO: 3452257 - RNA, 23 nt, Pseudomonas aeruginosa PA01
cggcguuuuucauugggcagcca

SEQ ID NO: 3452258 - RNA, 20 nt, Pseudomonas aeruginosa PA01
cggcguuuuuuuauccucgc

SEQ ID NO: 3452259 - RNA, 14 nt, Pseudomonas aeruginosa PA01
cggcuaaccgccuu

SEQ ID NO: 3452260 - RNA, 18 nt, Pseudomonas aeruginosa PA01
cggcuaaccgccuucgcg

SEQ ID NO: 3452261 - RNA, 15 nt, Pseudomonas aeruginosa PA01
cggcuaaccgcgaag

SEQ ID NO: 3452262 - RNA, 23 nt, Pseudomonas aeruginosa PA01
cggcuacaggccguagcgcucga

SEQ ID NO: 3452263 - RNA, 14 nt, Pseudomonas aeruginosa PA01
cggcuaccagcgcu

SEQ ID NO: 3452264 - RNA, 17 nt, Pseudomonas aeruginosa PA01
cggcuaccagcgcuucg

SEQ ID NO: 3452265 - RNA, 20 nt, Pseudomonas aeruginosa PA01
cggcuaccagcgcuucggcg

SEQ ID NO: 3452266 - RNA, 22 nt, Pseudomonas aeruginosa PA01
cggcuaccagcgcuucggcggc

SEQ ID NO: 3452267 - RNA, 15 nt, Pseudomonas aeruginosa PA01
cggcuaccccacgcg

SEQ ID NO: 3452268 - RNA, 18 nt, Pseudomonas aeruginosa PA01
cggcuaccccacgcgacc

SEQ ID NO: 3452269 - RNA, 12 nt, Pseudomonas aeruginosa PA01
cggcuacccucu

SEQ ID NO: 3452270 - RNA, 14 nt, Pseudomonas aeruginosa PA01
cggcuacccucucc

SEQ ID NO: 3452271 - RNA, 13 nt, Pseudomonas aeruginosa PA01
cggcuacucgccc

SEQ ID NO: 3452272 - RNA, 16 nt, Pseudomonas aeruginosa PA01
cggcuacucgcccgac

SEQ ID NO: 3452273 - RNA, 17 nt, Pseudomonas aeruginosa PA01
cggcuacucgcccgacc

SEQ ID NO: 3452274 - RNA, 13 nt, Pseudomonas aeruginosa PA01
cggcuacucgugg

SEQ ID NO: 3452275 - RNA, 22 nt, Pseudomonas aeruginosa PA01
cggcucaacugcuuaccuugcc

SEQ ID NO: 3452276 - RNA, 23 nt, Pseudomonas aeruginosa PA01
cggcucaacugguuggccgccug

SEQ ID NO: 3452277 - RNA, 16 nt, Pseudomonas aeruginosa PA01
cggcucaccgagaacc

SEQ ID NO: 3452278 - RNA, 19 nt, Pseudomonas aeruginosa PA01
cggcugcauguccgccagu

SEQ ID NO: 3452279 - RNA, 23 nt, Pseudomonas aeruginosa PA01
cggcugcauguccgccaguuccg

SEQ ID NO: 3452280 - RNA, 14 nt, Pseudomonas aeruginosa PA01
cggcugcccaacug

SEQ ID NO: 3452281 - RNA, 19 nt, Pseudomonas aeruginosa PA01
cggcugcccaagggccugg

SEQ ID NO: 3452282 - RNA, 21 nt, Pseudomonas aeruginosa PA01
cggcugcccaagggccugggc

SEQ ID NO: 3452283 - RNA, 23 nt, Pseudomonas aeruginosa PA01
cggcugcccaagggccugggcgc

SEQ ID NO: 3452284 - RNA, 17 nt, Pseudomonas aeruginosa PA01
cggcugccgaggcugau

SEQ ID NO: 3452285 - RNA, 14 nt, Pseudomonas aeruginosa PA01
cggcugccgccagc

SEQ ID NO: 3452286 - RNA, 11 nt, Pseudomonas aeruginosa PA01
cggcugccggu

SEQ ID NO: 3452287 - RNA, 19 nt, Pseudomonas aeruginosa PA01
cggcugccgguacgcacca

SEQ ID NO: 3452288 - RNA, 20 nt, Pseudomonas aeruginosa PA01
cggcugccgguacgcaccag

SEQ ID NO: 3452289 - RNA, 22 nt, Pseudomonas aeruginosa PA01
cggcugccgguacgcaccagcg

SEQ ID NO: 3452290 - RNA, 16 nt, Pseudomonas aeruginosa PA01
cggcugcgcgccgggu

SEQ ID NO: 3452291 - RNA, 16 nt, Pseudomonas aeruginosa PA01
cggcugcgucguuggc

SEQ ID NO: 3452292 - RNA, 21 nt, Pseudomonas aeruginosa PA01
cggcugcgucguuggccggcu

SEQ ID NO: 3452293 - RNA, 14 nt, Pseudomonas aeruginosa PA01
cggcugcuccgggc

SEQ ID NO: 3452294 - RNA, 17 nt, Pseudomonas aeruginosa PA01
cggcugcugcgccuggc

SEQ ID NO: 3452295 - RNA, 19 nt, Pseudomonas aeruginosa PA01
cggcugcugcgccuggccg

SEQ ID NO: 3452296 - RNA, 22 nt, Pseudomonas aeruginosa PA01
cggcugcugcugcggcuucgcg

SEQ ID NO: 3452297 - RNA, 23 nt, Pseudomonas aeruginosa PA01
cggcugcugucguuccggcucag

SEQ ID NO: 3452298 - RNA, 14 nt, Pseudomonas aeruginosa PA01
cggcugcuugccgc

SEQ ID NO: 3452299 - RNA, 15 nt, Pseudomonas aeruginosa PA01
cggcugcuugccgcu

SEQ ID NO: 3452300 - RNA, 14 nt, Pseudomonas aeruginosa PA01
cggcugcuugccgg

SEQ ID NO: 3452301 - RNA, 19 nt, Pseudomonas aeruginosa PA01
cggcugcuugccggugcca

SEQ ID NO: 3452302 - RNA, 20 nt, Pseudomonas aeruginosa PA01
cggcugcuugccggugccau

SEQ ID NO: 3452303 - RNA, 23 nt, Pseudomonas aeruginosa PA01
cggcuggaagucgcccugcccgg

SEQ ID NO: 3452304 - RNA, 17 nt, Pseudomonas aeruginosa PA01
cggcuggacgugcagga

SEQ ID NO: 3452305 - RNA, 15 nt, Pseudomonas aeruginosa PA01
cggcuggcagggcgc

SEQ ID NO: 3452306 - RNA, 12 nt, Pseudomonas aeruginosa PA01
cggcuggcaggu

SEQ ID NO: 3452307 - RNA, 23 nt, Pseudomonas aeruginosa PA01
cggcuggccauccauaucggcca

SEQ ID NO: 3452308 - RNA, 22 nt, Pseudomonas aeruginosa PA01
cggcuggccauccgcccugcgg

SEQ ID NO: 3452309 - RNA, 14 nt, Pseudomonas aeruginosa PA01
cggcuggcccucgg

SEQ ID NO: 3452310 - RNA, 16 nt, Pseudomonas aeruginosa PA01
cggcuggcccucggcg

SEQ ID NO: 3452311 - RNA, 18 nt, Pseudomonas aeruginosa PA01
cggcuggccgagggcgcg

SEQ ID NO: 3452312 - RNA, 19 nt, Pseudomonas aeruginosa PA01
cggcuggccgagggcgcgc

SEQ ID NO: 3452313 - RNA, 13 nt, Pseudomonas aeruginosa PA01
cggcuggccgccu

SEQ ID NO: 3452314 - RNA, 20 nt, Pseudomonas aeruginosa PA01
cggcuggccgccucgcgccg

SEQ ID NO: 3452315 - RNA, 22 nt, Pseudomonas aeruginosa PA01
cggcuggccgccucgcgccgcg

SEQ ID NO: 3452316 - RNA, 23 nt, Pseudomonas aeruginosa PA01
cggcuggccgccucgcgccgcgc

SEQ ID NO: 3452317 - RNA, 15 nt, Pseudomonas aeruginosa PA01
cggcuggccgccugg

SEQ ID NO: 3452318 - RNA, 21 nt, Pseudomonas aeruginosa PA01
cggcuggccgccuggccggcc

SEQ ID NO: 3452319 - RNA, 13 nt, Pseudomonas aeruginosa PA01
cggcuggccgucg

SEQ ID NO: 3452320 - RNA, 14 nt, Pseudomonas aeruginosa PA01
cggcuggccgucga

SEQ ID NO: 3452321 - RNA, 18 nt, Pseudomonas aeruginosa PA01
cggcuggccgucgacccg

SEQ ID NO: 3452322 - RNA, 17 nt, Pseudomonas aeruginosa PA01
cggcuggcgcaggaccg

SEQ ID NO: 3452323 - RNA, 19 nt, Pseudomonas aeruginosa PA01
cggcuggcgcaggaccgcc

SEQ ID NO: 3452324 - RNA, 13 nt, Pseudomonas aeruginosa PA01
cggcuggcgccgg

SEQ ID NO: 3452325 - RNA, 20 nt, Pseudomonas aeruginosa PA01
cggcuggcgccggugcauga

SEQ ID NO: 3452326 - RNA, 15 nt, Pseudomonas aeruginosa PA01
cggcuggcgcgaucg

SEQ ID NO: 3452327 - RNA, 14 nt, Pseudomonas aeruginosa PA01
cggcuggcgcgcgc

SEQ ID NO: 3452328 - RNA, 16 nt, Pseudomonas aeruginosa PA01
cggcuggcgcuugccg

SEQ ID NO: 3452329 - RNA, 19 nt, Pseudomonas aeruginosa PA01
cggcuggcgcuugccgcgc

SEQ ID NO: 3452330 - RNA, 21 nt, Pseudomonas aeruginosa PA01
cggcuggcgcuugccgcgccc

SEQ ID NO: 3452331 - RNA, 23 nt, Pseudomonas aeruginosa PA01
cggcuggcgcuugccgcgcccgg

SEQ ID NO: 3452332 - RNA, 20 nt, Pseudomonas aeruginosa PA01
cggcuggcggcucggcugcu

SEQ ID NO: 3452333 - RNA, 22 nt, Pseudomonas aeruginosa PA01
cggcuggcgggcgaccggaugc

SEQ ID NO: 3452334 - RNA, 19 nt, Pseudomonas aeruginosa PA01
cggcuggcguaccucgcca

SEQ ID NO: 3452335 - RNA, 15 nt, Pseudomonas aeruginosa PA01
cggcuggcugaagcc

SEQ ID NO: 3452336 - RNA, 14 nt, Pseudomonas aeruginosa PA01
cggcugggccagga

SEQ ID NO: 3452337 - RNA, 18 nt, Pseudomonas aeruginosa PA01
cggcugggccaggaucag

SEQ ID NO: 3452338 - RNA, 15 nt, Pseudomonas aeruginosa PA01
cggcugggcugcggg

SEQ ID NO: 3452339 - RNA, 21 nt, Pseudomonas aeruginosa PA01
cggcuggucagaaccaccggu

SEQ ID NO: 3452340 - RNA, 14 nt, Pseudomonas aeruginosa PA01
cggcuggucgaagc

SEQ ID NO: 3452341 - RNA, 15 nt, Pseudomonas aeruginosa PA01
cggcuggucggcuuc

SEQ ID NO: 3452342 - RNA, 16 nt, Pseudomonas aeruginosa PA01
cggcuggucggcuucc

SEQ ID NO: 3452343 - RNA, 20 nt, Pseudomonas aeruginosa PA01
cggcuggucggcuuccgccg

SEQ ID NO: 3452344 - RNA, 23 nt, Pseudomonas aeruginosa PA01
cggcuggucggcuuccgccgcca

SEQ ID NO: 3452345 - RNA, 24 nt, Pseudomonas aeruginosa PA01
cggcuggucggcuuccgccgccag

SEQ ID NO: 3452346 - RNA, 19 nt, Pseudomonas aeruginosa PA01
cggcugguggccguugagc

SEQ ID NO: 3452347 - RNA, 21 nt, Pseudomonas aeruginosa PA01
cggcugguucugguccaccag

SEQ ID NO: 3452348 - RNA, 23 nt, Pseudomonas aeruginosa PA01
cggcugguucugguccaccagcc

SEQ ID NO: 3452349 - RNA, 18 nt, Pseudomonas aeruginosa PA01
cggcugguugccagcagc

SEQ ID NO: 3452350 - RNA, 20 nt, Pseudomonas aeruginosa PA01
cggcugguugccagcagcgc

SEQ ID NO: 3452351 - RNA, 21 nt, Pseudomonas aeruginosa PA01
cggcugguugccagcagcgcu

SEQ ID NO: 3452352 - RNA, 22 nt, Pseudomonas aeruginosa PA01
cggcuguagcggaucaggccca

SEQ ID NO: 3452353 - RNA, 13 nt, Pseudomonas aeruginosa PA01
cggcugugcaggg

SEQ ID NO: 3452354 - RNA, 20 nt, Pseudomonas aeruginosa PA01
cggcugugcucgacgggcgc

SEQ ID NO: 3452355 - RNA, 16 nt, Pseudomonas aeruginosa PA01
cggcugugcucgagga

SEQ ID NO: 3452356 - RNA, 17 nt, Pseudomonas aeruginosa PA01
cggcugugcucgaggaa

SEQ ID NO: 3452357 - RNA, 16 nt, Pseudomonas aeruginosa PA01
cggcuguugccggaau

SEQ ID NO: 3452358 - RNA, 17 nt, Pseudomonas aeruginosa PA01
cggcuguugccggaauc

SEQ ID NO: 3452359 - RNA, 22 nt, Pseudomonas aeruginosa PA01
cggcuguugucgaacagguagu

SEQ ID NO: 3452360 - RNA, 19 nt, Pseudomonas aeruginosa PA01
cggcuguuucaggccggcg

SEQ ID NO: 3452361 - RNA, 17 nt, Pseudomonas aeruginosa PA01
cggcuucaacgcgacgg

SEQ ID NO: 3452362 - RNA, 17 nt, Pseudomonas aeruginosa PA01
cggcuucagagcuggac

SEQ ID NO: 3452363 - RNA, 18 nt, Pseudomonas aeruginosa PA01
cggcuucagagcuggacg

SEQ ID NO: 3452364 - RNA, 14 nt, Pseudomonas aeruginosa PA01
cggcuucagccaga

SEQ ID NO: 3452365 - RNA, 16 nt, Pseudomonas aeruginosa PA01
cggcuucagcgccagg

SEQ ID NO: 3452366 - RNA, 21 nt, Pseudomonas aeruginosa PA01
cggcuuccaccagacgcagca

SEQ ID NO: 3452367 - RNA, 22 nt, Pseudomonas aeruginosa PA01
cggcuuccaccagacgcagcau

SEQ ID NO: 3452368 - RNA, 22 nt, Pseudomonas aeruginosa PA01
cggcuuccagguacggcccgcg

SEQ ID NO: 3452369 - RNA, 13 nt, Pseudomonas aeruginosa PA01
cggcuuccgccgc

SEQ ID NO: 3452370 - RNA, 14 nt, Pseudomonas aeruginosa PA01
cggcuuccgccgcc

SEQ ID NO: 3452371 - RNA, 17 nt, Pseudomonas aeruginosa PA01
cggcuuccgccgccagg

SEQ ID NO: 3452372 - RNA, 14 nt, Pseudomonas aeruginosa PA01
cggcuuccuccauc

SEQ ID NO: 3452373 - RNA, 14 nt, Pseudomonas aeruginosa PA01
cggcuuccugggcg

SEQ ID NO: 3452374 - RNA, 18 nt, Pseudomonas aeruginosa PA01
cggcuuccugggcgaagu

SEQ ID NO: 3452375 - RNA, 21 nt, Pseudomonas aeruginosa PA01
cggcuucgaccacgacccggg

SEQ ID NO: 3452376 - RNA, 16 nt, Pseudomonas aeruginosa PA01
cggcuucgcagauguc

SEQ ID NO: 3452377 - RNA, 21 nt, Pseudomonas aeruginosa PA01
cggcuucgcagaugucgguca

SEQ ID NO: 3452378 - RNA, 16 nt, Pseudomonas aeruginosa PA01
cggcuucgcccauggc

SEQ ID NO: 3452379 - RNA, 21 nt, Pseudomonas aeruginosa PA01
cggcuucgcccauggcacgca

SEQ ID NO: 3452380 - RNA, 21 nt, Pseudomonas aeruginosa PA01
cgggccagcaggcgcucggcg

SEQ ID NO: 3452381 - RNA, 23 nt, Pseudomonas aeruginosa PA01
cgggccagcaggcgcucggcgac

SEQ ID NO: 3452382 - RNA, 22 nt, Pseudomonas aeruginosa PA01
cgggccagcaggguggccaggg

SEQ ID NO: 3452383 - RNA, 13 nt, Pseudomonas aeruginosa PA01
cgggccagcucca

SEQ ID NO: 3452384 - RNA, 16 nt, Pseudomonas aeruginosa PA01
cgggccagcuccagca

SEQ ID NO: 3452385 - RNA, 17 nt, Pseudomonas aeruginosa PA01
cgggccagcuccagcac

SEQ ID NO: 3452386 - RNA, 18 nt, Pseudomonas aeruginosa PA01
cgggccagcuccagcacc

SEQ ID NO: 3452387 - RNA, 13 nt, Pseudomonas aeruginosa PA01
cgggccagcuccg

SEQ ID NO: 3452388 - RNA, 15 nt, Pseudomonas aeruginosa PA01
cgggccagcuccgcc

SEQ ID NO: 3452389 - RNA, 19 nt, Pseudomonas aeruginosa PA01
cgggccagcuccgccugac

SEQ ID NO: 3452390 - RNA, 14 nt, Pseudomonas aeruginosa PA01
cgggccaggccgag

SEQ ID NO: 3452391 - RNA, 19 nt, Pseudomonas aeruginosa PA01
cgggccaggccgagcgugc

SEQ ID NO: 3452392 - RNA, 14 nt, Pseudomonas aeruginosa PA01
cgggccaucagguc

SEQ ID NO: 3452393 - RNA, 16 nt, Pseudomonas aeruginosa PA01
cgggccaucgcggaaa

SEQ ID NO: 3452394 - RNA, 21 nt, Pseudomonas aeruginosa PA01
cgggccaugagcagggcggau

SEQ ID NO: 3452395 - RNA, 15 nt, Pseudomonas aeruginosa PA01
cgggccaugcgcucg

SEQ ID NO: 3452396 - RNA, 13 nt, Pseudomonas aeruginosa PA01
cgggcccaagccg

SEQ ID NO: 3452397 - RNA, 18 nt, Pseudomonas aeruginosa PA01
cgggcccaagccgagcgg

SEQ ID NO: 3452398 - RNA, 19 nt, Pseudomonas aeruginosa PA01
cgggcccaagccgagcggc

SEQ ID NO: 3452399 - RNA, 23 nt, Pseudomonas aeruginosa PA01
cgggcccaagccgagcggcaagg

SEQ ID NO: 3452400 - RNA, 14 nt, Pseudomonas aeruginosa PA01
cgggcccagcggua

SEQ ID NO: 3452401 - RNA, 18 nt, Pseudomonas aeruginosa PA01
cgggcccaguucgcguag

SEQ ID NO: 3452402 - RNA, 13 nt, Pseudomonas aeruginosa PA01
cgggcccauggcg

SEQ ID NO: 3452403 - RNA, 15 nt, Pseudomonas aeruginosa PA01
cgggcccgugcggca

SEQ ID NO: 3452404 - RNA, 18 nt, Pseudomonas aeruginosa PA01
cgggcccgugcggcacgc

SEQ ID NO: 3452405 - RNA, 13 nt, Pseudomonas aeruginosa PA01
cgggcccucccaa

SEQ ID NO: 3452406 - RNA, 14 nt, Pseudomonas aeruginosa PA01
cgggcccugccaga

SEQ ID NO: 3452407 - RNA, 16 nt, Pseudomonas aeruginosa PA01
cgggcccugccagagg

SEQ ID NO: 3452408 - RNA, 20 nt, Pseudomonas aeruginosa PA01
cgggcccugggccccggccg

SEQ ID NO: 3452409 - RNA, 14 nt, Pseudomonas aeruginosa PA01
cgggccgaccugcc

SEQ ID NO: 3452410 - RNA, 18 nt, Pseudomonas aeruginosa PA01
cgggccgaccugcccgcu

SEQ ID NO: 3452411 - RNA, 22 nt, Pseudomonas aeruginosa PA01
cgggccgaccugcccgcuguug

SEQ ID NO: 3452412 - RNA, 14 nt, Pseudomonas aeruginosa PA01
cgggccgacggccc

SEQ ID NO: 3452413 - RNA, 17 nt, Pseudomonas aeruginosa PA01
cgggccgacggcccucc

SEQ ID NO: 3452414 - RNA, 15 nt, Pseudomonas aeruginosa PA01
cgggccgagggugau

SEQ ID NO: 3452415 - RNA, 19 nt, Pseudomonas aeruginosa PA01
cgggccgaggucgcgggcc

SEQ ID NO: 3452416 - RNA, 22 nt, Pseudomonas aeruginosa PA01
cgggccgaggucgcgggccagg

SEQ ID NO: 3452417 - RNA, 18 nt, Pseudomonas aeruginosa PA01
cgggccgaucaccaccug

SEQ ID NO: 3452418 - RNA, 17 nt, Pseudomonas aeruginosa PA01
cgggccgaucgagcggc

SEQ ID NO: 3452419 - RNA, 18 nt, Pseudomonas aeruginosa PA01
cgggccgaucgagcggcc

SEQ ID NO: 3452420 - RNA, 19 nt, Pseudomonas aeruginosa PA01
cgggccgaucgagcggccc

SEQ ID NO: 3452421 - RNA, 19 nt, Pseudomonas aeruginosa PA01
cgggccgaucuucgccgac

SEQ ID NO: 3452422 - RNA, 20 nt, Pseudomonas aeruginosa PA01
cgggccgaucuucgccgaca

SEQ ID NO: 3452423 - RNA, 16 nt, Pseudomonas aeruginosa PA01
cgggccgaugcgcgac

SEQ ID NO: 3452424 - RNA, 13 nt, Pseudomonas aeruginosa PA01
cgggccgcagggg

SEQ ID NO: 3452425 - RNA, 17 nt, Pseudomonas aeruginosa PA01
cgggccgcaucgcgggc

SEQ ID NO: 3452426 - RNA, 23 nt, Pseudomonas aeruginosa PA01
cgggccgcaucgcgggcgugcuc

SEQ ID NO: 3452427 - RNA, 13 nt, Pseudomonas aeruginosa PA01
cgggccgccggcg

SEQ ID NO: 3452428 - RNA, 16 nt, Pseudomonas aeruginosa PA01
cgggccgccggcgacg

SEQ ID NO: 3452429 - RNA, 19 nt, Pseudomonas aeruginosa PA01
cgggccgccggcgacgagg

SEQ ID NO: 3452430 - RNA, 22 nt, Pseudomonas aeruginosa PA01
cgggccgccggcgacgagguag

SEQ ID NO: 3452431 - RNA, 13 nt, Pseudomonas aeruginosa PA01
cgggccgccuggu

SEQ ID NO: 3452432 - RNA, 15 nt, Pseudomonas aeruginosa PA01
cgggccgccuggucg

SEQ ID NO: 3452433 - RNA, 12 nt, Pseudomonas aeruginosa PA01
cgggccgcgcac

SEQ ID NO: 3452434 - RNA, 13 nt, Pseudomonas aeruginosa PA01
cgggccgcgccgc

SEQ ID NO: 3452435 - RNA, 22 nt, Pseudomonas aeruginosa PA01
cgggccgcgccuuucgcucagg

SEQ ID NO: 3452436 - RNA, 18 nt, Pseudomonas aeruginosa PA01
cgggccgcgcucggucca

SEQ ID NO: 3452437 - RNA, 13 nt, Pseudomonas aeruginosa PA01
cgggccgcggcga

SEQ ID NO: 3452438 - RNA, 13 nt, Pseudomonas aeruginosa PA01
cgggccgcucagg

SEQ ID NO: 3452439 - RNA, 17 nt, Pseudomonas aeruginosa PA01
cgggccgcucgcgcggc

SEQ ID NO: 3452440 - RNA, 18 nt, Pseudomonas aeruginosa PA01
cgggccgcucgcgcggca

SEQ ID NO: 3452441 - RNA, 20 nt, Pseudomonas aeruginosa PA01
cgggccgcucgcgcggcacc

SEQ ID NO: 3452442 - RNA, 15 nt, Pseudomonas aeruginosa PA01
cgggccggagcaggc

SEQ ID NO: 3452443 - RNA, 15 nt, Pseudomonas aeruginosa PA01
cgggccggcguccag

SEQ ID NO: 3452444 - RNA, 19 nt, Pseudomonas aeruginosa PA01
cgggccggcguccaggagg

SEQ ID NO: 3452445 - RNA, 20 nt, Pseudomonas aeruginosa PA01
cgggccggcguccaggaggg

SEQ ID NO: 3452446 - RNA, 14 nt, Pseudomonas aeruginosa PA01
cgggccggggaucg

SEQ ID NO: 3452447 - RNA, 16 nt, Pseudomonas aeruginosa PA01
cgggccggggaucggc

SEQ ID NO: 3452448 - RNA, 22 nt, Pseudomonas aeruginosa PA01
cgggccgggggcggcgccuggu

SEQ ID NO: 3452449 - RNA, 13 nt, Pseudomonas aeruginosa PA01
cgggccgucgggc

SEQ ID NO: 3452450 - RNA, 21 nt, Pseudomonas aeruginosa PA01
cgggccgucgggcauggcgau

SEQ ID NO: 3452451 - RNA, 15 nt, Pseudomonas aeruginosa PA01
cgggccguuggcuuc

SEQ ID NO: 3452452 - RNA, 21 nt, Pseudomonas aeruginosa PA01
cgggccguuuuuuaugccgag

SEQ ID NO: 3452453 - RNA, 15 nt, Pseudomonas aeruginosa PA01
cgggccuccuggcgg

SEQ ID NO: 3452454 - RNA, 17 nt, Pseudomonas aeruginosa PA01
cgggccuccuggcggcg

SEQ ID NO: 3452455 - RNA, 20 nt, Pseudomonas aeruginosa PA01
cgggccuccuggcggcgugg

SEQ ID NO: 3452456 - RNA, 13 nt, Pseudomonas aeruginosa PA01
cgggccucggcgg

SEQ ID NO: 3452457 - RNA, 14 nt, Pseudomonas aeruginosa PA01
cgggccucggcggg

SEQ ID NO: 3452458 - RNA, 22 nt, Pseudomonas aeruginosa PA01
cgggccucucgacguaccgccu

SEQ ID NO: 3452459 - RNA, 15 nt, Pseudomonas aeruginosa PA01
cgggccugggcaucg

SEQ ID NO: 3452460 - RNA, 23 nt, Pseudomonas aeruginosa PA01
cgggccuguugagugggaugacg

SEQ ID NO: 3452461 - RNA, 14 nt, Pseudomonas aeruginosa PA01
cgggccuucaggcu

SEQ ID NO: 3452462 - RNA, 16 nt, Pseudomonas aeruginosa PA01
cgggccuucaggcugc

SEQ ID NO: 3452463 - RNA, 23 nt, Pseudomonas aeruginosa PA01
cgggccuucgccuucggcgugca

SEQ ID NO: 3452464 - RNA, 18 nt, Pseudomonas aeruginosa PA01
cgggccuugaccaccgcc

SEQ ID NO: 3452465 - RNA, 15 nt, Pseudomonas aeruginosa PA01
cgggcgaaacggcag

SEQ ID NO: 3452466 - RNA, 18 nt, Pseudomonas aeruginosa PA01
cgggcgaaacggcaggcc

SEQ ID NO: 3452467 - RNA, 20 nt, Pseudomonas aeruginosa PA01
cgggcgaaacggcaggccag

SEQ ID NO: 3452468 - RNA, 21 nt, Pseudomonas aeruginosa PA01
cgggcgaaacggcaggccagc

SEQ ID NO: 3452469 - RNA, 17 nt, Pseudomonas aeruginosa PA01
cgggcgaacccgaaucc

SEQ ID NO: 3452470 - RNA, 16 nt, Pseudomonas aeruginosa PA01
cgggcgaacggcagcg

SEQ ID NO: 3452471 - RNA, 15 nt, Pseudomonas aeruginosa PA01
cgggcgaagcgcagc

SEQ ID NO: 3452472 - RNA, 19 nt, Pseudomonas aeruginosa PA01
cgggcgaagcgcagcuccg

SEQ ID NO: 3452473 - RNA, 20 nt, Pseudomonas aeruginosa PA01
cgggcgaaguagaagcgcgc

SEQ ID NO: 3452474 - RNA, 16 nt, Pseudomonas aeruginosa PA01
cgggcgacccaggccg

SEQ ID NO: 3452475 - RNA, 21 nt, Pseudomonas aeruginosa PA01
cgggcgacccaggccgacagc

SEQ ID NO: 3452476 - RNA, 20 nt, Pseudomonas aeruginosa PA01
cgggcgaccggaugcuccag

SEQ ID NO: 3452477 - RNA, 12 nt, Pseudomonas aeruginosa PA01
cgggcgaccugc

SEQ ID NO: 3452478 - RNA, 15 nt, Pseudomonas aeruginosa PA01
cgggcgaccugcucg

SEQ ID NO: 3452479 - RNA, 17 nt, Pseudomonas aeruginosa PA01
cgggcgacgaagcccuc

SEQ ID NO: 3452480 - RNA, 21 nt, Pseudomonas aeruginosa PA01
cgggcgacgcguccggugacg

SEQ ID NO: 3452481 - RNA, 20 nt, Pseudomonas aeruginosa PA01
cgggcgagaaucgccgaggc

SEQ ID NO: 3452482 - RNA, 23 nt, Pseudomonas aeruginosa PA01
cgggcgagcagggaggagggcga

SEQ ID NO: 3452483 - RNA, 14 nt, Pseudomonas aeruginosa PA01
cgggcgagcgcaga

SEQ ID NO: 3452484 - RNA, 22 nt, Pseudomonas aeruginosa PA01
cgggcgagcgcagacgggugcu

SEQ ID NO: 3452485 - RNA, 13 nt, Pseudomonas aeruginosa PA01
cgggcgagcugca

SEQ ID NO: 3452486 - RNA, 15 nt, Pseudomonas aeruginosa PA01
cgggcgaggcuaacg

SEQ ID NO: 3452487 - RNA, 15 nt, Pseudomonas aeruginosa PA01
cgggcgagggcggcg

SEQ ID NO: 3452488 - RNA, 16 nt, Pseudomonas aeruginosa PA01
cgggcgagggcggcgc

SEQ ID NO: 3452489 - RNA, 22 nt, Pseudomonas aeruginosa PA01
cgggcgaggucgccacgcaguu

SEQ ID NO: 3452490 - RNA, 23 nt, Pseudomonas aeruginosa PA01
cgggcgaugaggcuguccagcag

SEQ ID NO: 3452491 - RNA, 16 nt, Pseudomonas aeruginosa PA01
cgggcgaugcggucau

SEQ ID NO: 3452492 - RNA, 14 nt, Pseudomonas aeruginosa PA01
cgggcgccaccgau

SEQ ID NO: 3452493 - RNA, 22 nt, Pseudomonas aeruginosa PA01
cgggcgccaccgauagcggcgc

SEQ ID NO: 3452494 - RNA, 13 nt, Pseudomonas aeruginosa PA01
cgggcgccaccgc

SEQ ID NO: 3452495 - RNA, 14 nt, Pseudomonas aeruginosa PA01
cgggcgccaccgcg

SEQ ID NO: 3452496 - RNA, 15 nt, Pseudomonas aeruginosa PA01
cgggcgccaccgcgu

SEQ ID NO: 3452497 - RNA, 13 nt, Pseudomonas aeruginosa PA01
cgggcgccaucgc

SEQ ID NO: 3452498 - RNA, 15 nt, Pseudomonas aeruginosa PA01
cgggcgcccgccaag

SEQ ID NO: 3452499 - RNA, 17 nt, Pseudomonas aeruginosa PA01
cgggcgcccgccaaggc

SEQ ID NO: 3452500 - RNA, 12 nt, Pseudomonas aeruginosa PA01
cgggcgcccggc

SEQ ID NO: 3452501 - RNA, 14 nt, Pseudomonas aeruginosa PA01
cgggcgcccggccg

SEQ ID NO: 3452502 - RNA, 14 nt, Pseudomonas aeruginosa PA01
cgggcgccgaugcc

SEQ ID NO: 3452503 - RNA, 15 nt, Pseudomonas aeruginosa PA01
cgggcgccgaugccg

SEQ ID NO: 3452504 - RNA, 22 nt, Pseudomonas aeruginosa PA01
cgggcgccgaugccggccggca

SEQ ID NO: 3452505 - RNA, 14 nt, Pseudomonas aeruginosa PA01
cgggcgccgccgcu

SEQ ID NO: 3452506 - RNA, 16 nt, Pseudomonas aeruginosa PA01
cgggcgccgccgcugg

SEQ ID NO: 3452507 - RNA, 17 nt, Pseudomonas aeruginosa PA01
cgggcgccgccgcuggc

SEQ ID NO: 3452508 - RNA, 19 nt, Pseudomonas aeruginosa PA01
cgggcgccgccgcuggcga

SEQ ID NO: 3452509 - RNA, 13 nt, Pseudomonas aeruginosa PA01
cgggcgccgcgcc

SEQ ID NO: 3452510 - RNA, 19 nt, Pseudomonas aeruginosa PA01
cgggcgccggaccagccgg

SEQ ID NO: 3452511 - RNA, 22 nt, Pseudomonas aeruginosa PA01
cgggcgccguggaucgcccggc

SEQ ID NO: 3452512 - RNA, 12 nt, Pseudomonas aeruginosa PA01
cgggcgcgcagc

SEQ ID NO: 3452513 - RNA, 16 nt, Pseudomonas aeruginosa PA01
cgggcgcgcgccaccg

SEQ ID NO: 3452514 - RNA, 16 nt, Pseudomonas aeruginosa PA01
cgggcgcgcuggucgu

SEQ ID NO: 3452515 - RNA, 13 nt, Pseudomonas aeruginosa PA01
cgggcgcgggcgu

SEQ ID NO: 3452516 - RNA, 16 nt, Pseudomonas aeruginosa PA01
cgggcgcgggcguugu

SEQ ID NO: 3452517 - RNA, 19 nt, Pseudomonas aeruginosa PA01
cgggcgcuaugcgccguua

SEQ ID NO: 3452518 - RNA, 18 nt, Pseudomonas aeruginosa PA01
cgggcgcucuggccgcgc

SEQ ID NO: 3452519 - RNA, 13 nt, Pseudomonas aeruginosa PA01
cgggcgcuuccgg

SEQ ID NO: 3452520 - RNA, 20 nt, Pseudomonas aeruginosa PA01
cgggcgcuugaagccggcgu

SEQ ID NO: 3452521 - RNA, 19 nt, Pseudomonas aeruginosa PA01
cgggcggacgcugggcugg

SEQ ID NO: 3452522 - RNA, 14 nt, Pseudomonas aeruginosa PA01
cgggcggaggcgag

SEQ ID NO: 3452523 - RNA, 16 nt, Pseudomonas aeruginosa PA01
cgggcggaggcgaggu

SEQ ID NO: 3452524 - RNA, 17 nt, Pseudomonas aeruginosa PA01
cgggcggaucagcucga

SEQ ID NO: 3452525 - RNA, 20 nt, Pseudomonas aeruginosa PA01
cgggcggaucagcucgauca

SEQ ID NO: 3452526 - RNA, 23 nt, Pseudomonas aeruginosa PA01
cgggcggaucagcucgaucagcc

SEQ ID NO: 3452527 - RNA, 15 nt, Pseudomonas aeruginosa PA01
cgggcggaucgagca

SEQ ID NO: 3452528 - RNA, 16 nt, Pseudomonas aeruginosa PA01
cgggcggaucgagcag

SEQ ID NO: 3452529 - RNA, 21 nt, Pseudomonas aeruginosa PA01
cgggcggaucgagcagcggcg

SEQ ID NO: 3452530 - RNA, 22 nt, Pseudomonas aeruginosa PA01
cgggcggaucgagcagcggcgc

SEQ ID NO: 3452531 - RNA, 24 nt, Pseudomonas aeruginosa PA01
cgggcggaucgagcagcggcgcca

SEQ ID NO: 3452532 - RNA, 18 nt, Pseudomonas aeruginosa PA01
cgggcggaucgccaacca

SEQ ID NO: 3452533 - RNA, 22 nt, Pseudomonas aeruginosa PA01
cgggcggaucgccaaccaguag

SEQ ID NO: 3452534 - RNA, 17 nt, Pseudomonas aeruginosa PA01
cgggcggaugaccuguc

SEQ ID NO: 3452535 - RNA, 20 nt, Pseudomonas aeruginosa PA01
cgggcggaugaccuguccag

SEQ ID NO: 3452536 - RNA, 22 nt, Pseudomonas aeruginosa PA01
cgggcggaugaccuguccaguc

SEQ ID NO: 3452537 - RNA, 24 nt, Pseudomonas aeruginosa PA01
cgggcggaugaccuguccagucac

SEQ ID NO: 3452538 - RNA, 13 nt, Pseudomonas aeruginosa PA01
cgggcggcaggcg

SEQ ID NO: 3452539 - RNA, 15 nt, Pseudomonas aeruginosa PA01
cgggcggcaggcgcc

SEQ ID NO: 3452540 - RNA, 17 nt, Pseudomonas aeruginosa PA01
cgggcggcaggcgccgg

SEQ ID NO: 3452541 - RNA, 14 nt, Pseudomonas aeruginosa PA01
cgggcggccgacgu

SEQ ID NO: 3452542 - RNA, 11 nt, Pseudomonas aeruginosa PA01
cgggcggccuc

SEQ ID NO: 3452543 - RNA, 14 nt, Pseudomonas aeruginosa PA01
cgggcggcgcggcg

SEQ ID NO: 3452544 - RNA, 12 nt, Pseudomonas aeruginosa PA01
cgggcggcggcg

SEQ ID NO: 3452545 - RNA, 20 nt, Pseudomonas aeruginosa PA01
cgggcggcgucgaaaugcuc

SEQ ID NO: 3452546 - RNA, 23 nt, Pseudomonas aeruginosa PA01
cgggcggcuguagcggaucaggc

SEQ ID NO: 3452547 - RNA, 21 nt, Pseudomonas aeruginosa PA01
cgggcgggaucaggucgccag

SEQ ID NO: 3452548 - RNA, 22 nt, Pseudomonas aeruginosa PA01
cgggcgggaucaggucgccagc

SEQ ID NO: 3452549 - RNA, 18 nt, Pseudomonas aeruginosa PA01
cgggcgggaucuccgcgc

SEQ ID NO: 3452550 - RNA, 17 nt, Pseudomonas aeruginosa PA01
cgggcggguaaagcgcc

SEQ ID NO: 3452551 - RNA, 22 nt, Pseudomonas aeruginosa PA01
cgggcggguaaagcgcccgcgc

SEQ ID NO: 3452552 - RNA, 16 nt, Pseudomonas aeruginosa PA01
cgggcgggucuggcgg

SEQ ID NO: 3452553 - RNA, 16 nt, Pseudomonas aeruginosa PA01
cgggcgggugcgcgaa

SEQ ID NO: 3452554 - RNA, 12 nt, Pseudomonas aeruginosa PA01
cgggcgguagcg

SEQ ID NO: 3452555 - RNA, 23 nt, Pseudomonas aeruginosa PA01
cgggcgguagcgggccagcagcu

SEQ ID NO: 3452556 - RNA, 15 nt, Pseudomonas aeruginosa PA01
cgggcggucgaggcc

SEQ ID NO: 3452557 - RNA, 16 nt, Pseudomonas aeruginosa PA01
cgggcggucgaggccc

SEQ ID NO: 3452558 - RNA, 13 nt, Pseudomonas aeruginosa PA01
cgggcggucgucg

SEQ ID NO: 3452559 - RNA, 14 nt, Pseudomonas aeruginosa PA01
cgggcggucgucgc

SEQ ID NO: 3452560 - RNA, 17 nt, Pseudomonas aeruginosa PA01
cgggcggucgucgccau

SEQ ID NO: 3452561 - RNA, 14 nt, Pseudomonas aeruginosa PA01
cgggcguagcgcgg

SEQ ID NO: 3452562 - RNA, 22 nt, Pseudomonas aeruginosa PA01
cgggcguagcgcggcagcgcca

SEQ ID NO: 3452563 - RNA, 15 nt, Pseudomonas aeruginosa PA01
cgggcguccggcgag

SEQ ID NO: 3452564 - RNA, 22 nt, Pseudomonas aeruginosa PA01
cgggcguccguaaugcaacccg

SEQ ID NO: 3452565 - RNA, 23 nt, Pseudomonas aeruginosa PA01
cgggcguccguaaugcaacccgc

SEQ ID NO: 3452566 - RNA, 13 nt, Pseudomonas aeruginosa PA01
cgggcgucggcgu

SEQ ID NO: 3452567 - RNA, 14 nt, Pseudomonas aeruginosa PA01
cgggcgucuccugc

SEQ ID NO: 3452568 - RNA, 15 nt, Pseudomonas aeruginosa PA01
cgggcgucuccugcc

SEQ ID NO: 3452569 - RNA, 16 nt, Pseudomonas aeruginosa PA01
cgggcgucuccugccg

SEQ ID NO: 3452570 - RNA, 21 nt, Pseudomonas aeruginosa PA01
cgggcgugaguaucaucgcga

SEQ ID NO: 3452571 - RNA, 18 nt, Pseudomonas aeruginosa PA01
cgggcgugcuccagcacc

SEQ ID NO: 3452572 - RNA, 14 nt, Pseudomonas aeruginosa PA01
cgggcguugccggc

SEQ ID NO: 3452573 - RNA, 17 nt, Pseudomonas aeruginosa PA01
cgggcguugcgcgccuc

SEQ ID NO: 3452574 - RNA, 21 nt, Pseudomonas aeruginosa PA01
cgggcguugcgcgccucgccc

SEQ ID NO: 3452575 - RNA, 17 nt, Pseudomonas aeruginosa PA01
cgggcguuggcuccggg

SEQ ID NO: 3452576 - RNA, 19 nt, Pseudomonas aeruginosa PA01
cgggcguuggcuccgggcc

SEQ ID NO: 3452577 - RNA, 23 nt, Pseudomonas aeruginosa PA01
cgggcguugguacagcucgcgca

SEQ ID NO: 3452578 - RNA, 16 nt, Pseudomonas aeruginosa PA01
cgggcguuguccacgg

SEQ ID NO: 3452579 - RNA, 22 nt, Pseudomonas aeruginosa PA01
cgggcuagguuuccccguggcg

SEQ ID NO: 3452580 - RNA, 18 nt, Pseudomonas aeruginosa PA01
cgggcuauucccgccgcu

SEQ ID NO: 3452581 - RNA, 19 nt, Pseudomonas aeruginosa PA01
cgggcuauucccgccgcuc

SEQ ID NO: 3452582 - RNA, 24 nt, Pseudomonas aeruginosa PA01
cgggcucacauuaauugcgagcga

SEQ ID NO: 3452583 - RNA, 18 nt, Pseudomonas aeruginosa PA01
cgggcucacucccgucca

SEQ ID NO: 3452584 - RNA, 22 nt, Pseudomonas aeruginosa PA01
cgggcucacucccguccagcgc

SEQ ID NO: 3452585 - RNA, 14 nt, Pseudomonas aeruginosa PA01
cgggcucagcgcgc

SEQ ID NO: 3452586 - RNA, 14 nt, Pseudomonas aeruginosa PA01
cggggccugcugcg

SEQ ID NO: 3452587 - RNA, 16 nt, Pseudomonas aeruginosa PA01
cggggccugcugcggg

SEQ ID NO: 3452588 - RNA, 17 nt, Pseudomonas aeruginosa PA01
cggggccugcugcgggc

SEQ ID NO: 3452589 - RNA, 20 nt, Pseudomonas aeruginosa PA01
cggggccugcugcgggcgcu

SEQ ID NO: 3452590 - RNA, 16 nt, Pseudomonas aeruginosa PA01
cggggccuucaggcgc

SEQ ID NO: 3452591 - RNA, 19 nt, Pseudomonas aeruginosa PA01
cggggccuucaggcgcucc

SEQ ID NO: 3452592 - RNA, 15 nt, Pseudomonas aeruginosa PA01
cggggcgaccagcau

SEQ ID NO: 3452593 - RNA, 16 nt, Pseudomonas aeruginosa PA01
cggggcgaggucggcc

SEQ ID NO: 3452594 - RNA, 18 nt, Pseudomonas aeruginosa PA01
cggggcgaggucggccug

SEQ ID NO: 3452595 - RNA, 22 nt, Pseudomonas aeruginosa PA01
cggggcgaggucggccugcggg

SEQ ID NO: 3452596 - RNA, 22 nt, Pseudomonas aeruginosa PA01
cggggcgaucuugaucgccagc

SEQ ID NO: 3452597 - RNA, 14 nt, Pseudomonas aeruginosa PA01
cggggcgcaccgcc

SEQ ID NO: 3452598 - RNA, 15 nt, Pseudomonas aeruginosa PA01
cggggcgcaccgccu

SEQ ID NO: 3452599 - RNA, 17 nt, Pseudomonas aeruginosa PA01
cggggcgcaccgccucg

SEQ ID NO: 3452600 - RNA, 18 nt, Pseudomonas aeruginosa PA01
cggggcgcaccgccucga

SEQ ID NO: 3452601 - RNA, 20 nt, Pseudomonas aeruginosa PA01
cggggcgcaccgccucgacc

SEQ ID NO: 3452602 - RNA, 16 nt, Pseudomonas aeruginosa PA01
cggggcgcagcaggau

SEQ ID NO: 3452603 - RNA, 18 nt, Pseudomonas aeruginosa PA01
cggggcgccgcgcggcgc

SEQ ID NO: 3452604 - RNA, 20 nt, Pseudomonas aeruginosa PA01
cggggcgccgcgcggcgccc

SEQ ID NO: 3452605 - RNA, 18 nt, Pseudomonas aeruginosa PA01
cggggcgccuccagcggg

SEQ ID NO: 3452606 - RNA, 21 nt, Pseudomonas aeruginosa PA01
cggggcgccuccagcgggccu

SEQ ID NO: 3452607 - RNA, 12 nt, Pseudomonas aeruginosa PA01
cggggcgcgccc

SEQ ID NO: 3452608 - RNA, 20 nt, Pseudomonas aeruginosa PA01
cggggcgcgcccgccagguc

SEQ ID NO: 3452609 - RNA, 16 nt, Pseudomonas aeruginosa PA01
cggggcgcgcugcgaa

SEQ ID NO: 3452610 - RNA, 14 nt, Pseudomonas aeruginosa PA01
cggggcgcgggcga

SEQ ID NO: 3452611 - RNA, 14 nt, Pseudomonas aeruginosa PA01
cggggcgcucaggg

SEQ ID NO: 3452612 - RNA, 14 nt, Pseudomonas aeruginosa PA01
cggggcgcucgccc

SEQ ID NO: 3452613 - RNA, 15 nt, Pseudomonas aeruginosa PA01
cggggcgcucgcccu

SEQ ID NO: 3452614 - RNA, 19 nt, Pseudomonas aeruginosa PA01
cggggcggauucaggcgcg

SEQ ID NO: 3452615 - RNA, 20 nt, Pseudomonas aeruginosa PA01
cggggcggauucaggcgcgc

SEQ ID NO: 3452616 - RNA, 20 nt, Pseudomonas aeruginosa PA01
cggggcggccaaccucuccc

SEQ ID NO: 3452617 - RNA, 22 nt, Pseudomonas aeruginosa PA01
cggggcggccaaccucucccca

SEQ ID NO: 3452618 - RNA, 23 nt, Pseudomonas aeruginosa PA01
cggggcguagggggccgggucga

SEQ ID NO: 3452619 - RNA, 20 nt, Pseudomonas aeruginosa PA01
cggggcgugcaggccgccga

SEQ ID NO: 3452620 - RNA, 21 nt, Pseudomonas aeruginosa PA01
cggggcguuuuucauggcggc

SEQ ID NO: 3452621 - RNA, 15 nt, Pseudomonas aeruginosa PA01
cggggcuccccugga

SEQ ID NO: 3452622 - RNA, 15 nt, Pseudomonas aeruginosa PA01
cggggcucugccggu

SEQ ID NO: 3452623 - RNA, 13 nt, Pseudomonas aeruginosa PA01
cggggcugcggcc

SEQ ID NO: 3452624 - RNA, 17 nt, Pseudomonas aeruginosa PA01
cggggcugcggccucgu

SEQ ID NO: 3452625 - RNA, 13 nt, Pseudomonas aeruginosa PA01
cggggcugcuccu

SEQ ID NO: 3452626 - RNA, 16 nt, Pseudomonas aeruginosa PA01
cggggcugcuccuccc

SEQ ID NO: 3452627 - RNA, 15 nt, Pseudomonas aeruginosa PA01
cggggcuugcgcccc

SEQ ID NO: 3452628 - RNA, 16 nt, Pseudomonas aeruginosa PA01
cggggcuugcgccccc

SEQ ID NO: 3452629 - RNA, 23 nt, Pseudomonas aeruginosa PA01
cggggcuuuccgucucaggcgcc

SEQ ID NO: 3452630 - RNA, 19 nt, Pseudomonas aeruginosa PA01
cggggcuuuuuccaacgcg

SEQ ID NO: 3452631 - RNA, 21 nt, Pseudomonas aeruginosa PA01
cggggcuuuuuuaugcgcagc

SEQ ID NO: 3452632 - RNA, 21 nt, Pseudomonas aeruginosa PA01
cgggggaagaacccagacagc

SEQ ID NO: 3452633 - RNA, 17 nt, Pseudomonas aeruginosa PA01
cgggggcggcgccuggu

SEQ ID NO: 3452634 - RNA, 16 nt, Pseudomonas aeruginosa PA01
cgggggcuccagggga

SEQ ID NO: 3452635 - RNA, 15 nt, Pseudomonas aeruginosa PA01
cgggggcucggucga

SEQ ID NO: 3452636 - RNA, 17 nt, Pseudomonas aeruginosa PA01
cgggggcucggucgagc

SEQ ID NO: 3452637 - RNA, 20 nt, Pseudomonas aeruginosa PA01
cgggggucggaugcagcgcu

SEQ ID NO: 3452638 - RNA, 18 nt, Pseudomonas aeruginosa PA01
cgggggucucguagcagc

SEQ ID NO: 3452639 - RNA, 22 nt, Pseudomonas aeruginosa PA01
cgggguagggguggccaggcgc

SEQ ID NO: 3452640 - RNA, 15 nt, Pseudomonas aeruginosa PA01
cgggguauccgggca

SEQ ID NO: 3452641 - RNA, 16 nt, Pseudomonas aeruginosa PA01
cgggguauccgggcac

SEQ ID NO: 3452642 - RNA, 20 nt, Pseudomonas aeruginosa PA01
cgggguauccgggcacuugu

SEQ ID NO: 3452643 - RNA, 16 nt, Pseudomonas aeruginosa PA01
cgggguauggccuucg

SEQ ID NO: 3452644 - RNA, 14 nt, Pseudomonas aeruginosa PA01
cggggucagcgccu

SEQ ID NO: 3452645 - RNA, 21 nt, Pseudomonas aeruginosa PA01
cggggucaguuccaggucggc

SEQ ID NO: 3452646 - RNA, 23 nt, Pseudomonas aeruginosa PA01
cggggucaguuccaggucggcgg

SEQ ID NO: 3452647 - RNA, 17 nt, Pseudomonas aeruginosa PA01
cgggguccgccggucac

SEQ ID NO: 3452648 - RNA, 14 nt, Pseudomonas aeruginosa PA01
cggggucgcgccgg

SEQ ID NO: 3452649 - RNA, 15 nt, Pseudomonas aeruginosa PA01
cggggucgcgccggu

SEQ ID NO: 3452650 - RNA, 13 nt, Pseudomonas aeruginosa PA01
cggggucggccug

SEQ ID NO: 3452651 - RNA, 16 nt, Pseudomonas aeruginosa PA01
cggggucggccugcgg

SEQ ID NO: 3452652 - RNA, 14 nt, Pseudomonas aeruginosa PA01
cggggucgggcagc

SEQ ID NO: 3452653 - RNA, 18 nt, Pseudomonas aeruginosa PA01
cggggucgggcagcuucu

SEQ ID NO: 3452654 - RNA, 16 nt, Pseudomonas aeruginosa PA01
cggggucuggccggcg

SEQ ID NO: 3452655 - RNA, 17 nt, Pseudomonas aeruginosa PA01
cggggucuggccggcga

SEQ ID NO: 3452656 - RNA, 18 nt, Pseudomonas aeruginosa PA01
cggggucuggccggcgau

SEQ ID NO: 3452657 - RNA, 20 nt, Pseudomonas aeruginosa PA01
cggggucuggccggcgauca

SEQ ID NO: 3452658 - RNA, 22 nt, Pseudomonas aeruginosa PA01
cggggucuggccggcgaucaga

SEQ ID NO: 3452659 - RNA, 15 nt, Pseudomonas aeruginosa PA01
cggggugaagcucuu

SEQ ID NO: 3452660 - RNA, 23 nt, Pseudomonas aeruginosa PA01
cggggugagcaguucgucgauga

SEQ ID NO: 3452661 - RNA, 19 nt, Pseudomonas aeruginosa PA01
cggggugauccagcuggcg

SEQ ID NO: 3452662 - RNA, 18 nt, Pseudomonas aeruginosa PA01
cggggugauuuacaggac

SEQ ID NO: 3452663 - RNA, 12 nt, Pseudomonas aeruginosa PA01
cggggugcaggg

SEQ ID NO: 3452664 - RNA, 15 nt, Pseudomonas aeruginosa PA01
cggggugcaggggcg

SEQ ID NO: 3452665 - RNA, 22 nt, Pseudomonas aeruginosa PA01
cggggugccgccagucggccug

SEQ ID NO: 3452666 - RNA, 14 nt, Pseudomonas aeruginosa PA01
cggggugcgcggcg

SEQ ID NO: 3452667 - RNA, 20 nt, Pseudomonas aeruginosa PA01
cgggguggaguaccaggcca

SEQ ID NO: 3452668 - RNA, 15 nt, Pseudomonas aeruginosa PA01
cgggguggccgugca

SEQ ID NO: 3452669 - RNA, 21 nt, Pseudomonas aeruginosa PA01
cgggguucgacgcgccacgca

SEQ ID NO: 3452670 - RNA, 23 nt, Pseudomonas aeruginosa PA01
cgggguucgacgcgccacgcagg

SEQ ID NO: 3452671 - RNA, 20 nt, Pseudomonas aeruginosa PA01
cgggguucuugucgaccagc

SEQ ID NO: 3452672 - RNA, 21 nt, Pseudomonas aeruginosa PA01
cgggguucuugucgaccagcg

SEQ ID NO: 3452673 - RNA, 22 nt, Pseudomonas aeruginosa PA01
cgggguucuugucgaccagcgg

SEQ ID NO: 3452674 - RNA, 19 nt, Pseudomonas aeruginosa PA01
cgggguuuccucgaagcgc

SEQ ID NO: 3452675 - RNA, 21 nt, Pseudomonas aeruginosa PA01
cgggguuucuuuuuauccggc

SEQ ID NO: 3452676 - RNA, 16 nt, Pseudomonas aeruginosa PA01
cggguaaagcgcccgc

SEQ ID NO: 3452677 - RNA, 17 nt, Pseudomonas aeruginosa PA01
cggguaaagcgcccgcg

SEQ ID NO: 3452678 - RNA, 20 nt, Pseudomonas aeruginosa PA01
cggguaacgguagcggcagg

SEQ ID NO: 3452679 - RNA, 21 nt, Pseudomonas aeruginosa PA01
cggguaacgguagcggcagga

SEQ ID NO: 3452680 - RNA, 15 nt, Pseudomonas aeruginosa PA01
cggguaauccaucgc

SEQ ID NO: 3452681 - RNA, 22 nt, Pseudomonas aeruginosa PA01
cggguacagcgccacggccagc

SEQ ID NO: 3452682 - RNA, 20 nt, Pseudomonas aeruginosa PA01
cggguaccugcucgcggguc

SEQ ID NO: 3452683 - RNA, 13 nt, Pseudomonas aeruginosa PA01
cggguacgcgggc

SEQ ID NO: 3452684 - RNA, 23 nt, Pseudomonas aeruginosa PA01
cggguacuggcgcugcgcggcgu

SEQ ID NO: 3452685 - RNA, 12 nt, Pseudomonas aeruginosa PA01
cggguagagcgc

SEQ ID NO: 3452686 - RNA, 14 nt, Pseudomonas aeruginosa PA01
cggguagagcgcgg

SEQ ID NO: 3452687 - RNA, 16 nt, Pseudomonas aeruginosa PA01
cggguagagcgcggcg

SEQ ID NO: 3452688 - RNA, 18 nt, Pseudomonas aeruginosa PA01
cgggugccggugcgggug

SEQ ID NO: 3452689 - RNA, 17 nt, Pseudomonas aeruginosa PA01
cgggugccuuccgcgcc

SEQ ID NO: 3452690 - RNA, 19 nt, Pseudomonas aeruginosa PA01
cgggugccuuccgcgccca

SEQ ID NO: 3452691 - RNA, 22 nt, Pseudomonas aeruginosa PA01
cgggugccuuccgcgcccaggc

SEQ ID NO: 3452692 - RNA, 13 nt, Pseudomonas aeruginosa PA01
cgggugcgcaggc

SEQ ID NO: 3452693 - RNA, 13 nt, Pseudomonas aeruginosa PA01
cgggugcgcgcca

SEQ ID NO: 3452694 - RNA, 19 nt, Pseudomonas aeruginosa PA01
cgggugcgcgccaccuggu

SEQ ID NO: 3452695 - RNA, 15 nt, Pseudomonas aeruginosa PA01
cgggugcggcuggcg

SEQ ID NO: 3452696 - RNA, 17 nt, Pseudomonas aeruginosa PA01
cgggugcguccauccag

SEQ ID NO: 3452697 - RNA, 17 nt, Pseudomonas aeruginosa PA01
cgggugcuaugcgccgg

SEQ ID NO: 3452698 - RNA, 18 nt, Pseudomonas aeruginosa PA01
cgggugcuaugcgccggg

SEQ ID NO: 3452699 - RNA, 13 nt, Pseudomonas aeruginosa PA01
cgggugcugaaga

SEQ ID NO: 3452700 - RNA, 17 nt, Pseudomonas aeruginosa PA01
cggguggaacgaggcga

SEQ ID NO: 3452701 - RNA, 22 nt, Pseudomonas aeruginosa PA01
cggguggagaggcgugcuggcu

SEQ ID NO: 3452702 - RNA, 19 nt, Pseudomonas aeruginosa PA01
cggguggcaacugccgccc

SEQ ID NO: 3452703 - RNA, 22 nt, Pseudomonas aeruginosa PA01
cggguggcaacugccgcccgcu

SEQ ID NO: 3452704 - RNA, 14 nt, Pseudomonas aeruginosa PA01
cggguggcaugggc

SEQ ID NO: 3452705 - RNA, 16 nt, Pseudomonas aeruginosa PA01
cggguggcaugggcca

SEQ ID NO: 3452706 - RNA, 17 nt, Pseudomonas aeruginosa PA01
cggguggcaugggccag

SEQ ID NO: 3452707 - RNA, 13 nt, Pseudomonas aeruginosa PA01
cggguggcgcugu

SEQ ID NO: 3452708 - RNA, 15 nt, Pseudomonas aeruginosa PA01
cggguggcgucgauc

SEQ ID NO: 3452709 - RNA, 19 nt, Pseudomonas aeruginosa PA01
cggguggcgucgaucaggc

SEQ ID NO: 3452710 - RNA, 20 nt, Pseudomonas aeruginosa PA01
cgggugggacauggagaccu

SEQ ID NO: 3452711 - RNA, 14 nt, Pseudomonas aeruginosa PA01
cggguggucgccgc

SEQ ID NO: 3452712 - RNA, 20 nt, Pseudomonas aeruginosa PA01
cggguggucgccgcccacgc

SEQ ID NO: 3452713 - RNA, 22 nt, Pseudomonas aeruginosa PA01
cggguggucgccgcccacgccu

SEQ ID NO: 3452714 - RNA, 16 nt, Pseudomonas aeruginosa PA01
cggguggucuugcgca

SEQ ID NO: 3452715 - RNA, 18 nt, Pseudomonas aeruginosa PA01
cggguguccucgaucauc

SEQ ID NO: 3452716 - RNA, 14 nt, Pseudomonas aeruginosa PA01
cgggugugcgagaa

SEQ ID NO: 3452717 - RNA, 23 nt, Pseudomonas aeruginosa PA01
cggguguuguucuucauccaguc

SEQ ID NO: 3452718 - RNA, 17 nt, Pseudomonas aeruginosa PA01
cggguguuucggccgcu

SEQ ID NO: 3452719 - RNA, 13 nt, Pseudomonas aeruginosa PA01
cggguucagcccg

SEQ ID NO: 3452720 - RNA, 15 nt, Pseudomonas aeruginosa PA01
cggguucagcccgcc

SEQ ID NO: 3452721 - RNA, 16 nt, Pseudomonas aeruginosa PA01
cggguucagcccgccg

SEQ ID NO: 3452722 - RNA, 20 nt, Pseudomonas aeruginosa PA01
cggguucagcccgccgugcg

SEQ ID NO: 3452723 - RNA, 21 nt, Pseudomonas aeruginosa PA01
cggguucagcccgccgugcgc

SEQ ID NO: 3452724 - RNA, 23 nt, Pseudomonas aeruginosa PA01
cggguucagcccgccgugcgcuc

SEQ ID NO: 3452725 - RNA, 16 nt, Pseudomonas aeruginosa PA01
cggguucagucggcca

SEQ ID NO: 3452726 - RNA, 20 nt, Pseudomonas aeruginosa PA01
cggguucagucggccaggcg

SEQ ID NO: 3452727 - RNA, 23 nt, Pseudomonas aeruginosa PA01
cggguucagucggccaggcgcca

SEQ ID NO: 3452728 - RNA, 22 nt, Pseudomonas aeruginosa PA01
cggguucccaguugcugggcga

SEQ ID NO: 3452729 - RNA, 23 nt, Pseudomonas aeruginosa PA01
cggguucccugcgccucgaccug

SEQ ID NO: 3452730 - RNA, 15 nt, Pseudomonas aeruginosa PA01
cggguucgagucccg

SEQ ID NO: 3452731 - RNA, 22 nt, Pseudomonas aeruginosa PA01
cggguucgagucccguccgcug

SEQ ID NO: 3452732 - RNA, 16 nt, Pseudomonas aeruginosa PA01
cggguucgugccaggc

SEQ ID NO: 3452733 - RNA, 17 nt, Pseudomonas aeruginosa PA01
cggguucgugccaggcg

SEQ ID NO: 3452734 - RNA, 15 nt, Pseudomonas aeruginosa PA01
cggguucuugccgcu

SEQ ID NO: 3452735 - RNA, 19 nt, Pseudomonas aeruginosa PA01
cggguucuugccgcuguug

SEQ ID NO: 3452736 - RNA, 16 nt, Pseudomonas aeruginosa PA01
cggguugaaggcgcgg

SEQ ID NO: 3452737 - RNA, 20 nt, Pseudomonas aeruginosa PA01
cggguugacccagagccgcu

SEQ ID NO: 3452738 - RNA, 23 nt, Pseudomonas aeruginosa PA01
cggguugaccccgaggucggcga

SEQ ID NO: 3452739 - RNA, 20 nt, Pseudomonas aeruginosa PA01
cggguugaccgccagacagg

SEQ ID NO: 3452740 - RNA, 14 nt, Pseudomonas aeruginosa PA01
cggguugagcaccc

SEQ ID NO: 3452741 - RNA, 16 nt, Pseudomonas aeruginosa PA01
cggguugagcaccccg

SEQ ID NO: 3452742 - RNA, 21 nt, Pseudomonas aeruginosa PA01
cggguugagguagagcacgcc

SEQ ID NO: 3452743 - RNA, 18 nt, Pseudomonas aeruginosa PA01
cggguugaugccgaggcu

SEQ ID NO: 3452744 - RNA, 17 nt, Pseudomonas aeruginosa PA01
cggguugauggugcggu

SEQ ID NO: 3452745 - RNA, 16 nt, Pseudomonas aeruginosa PA01
cggguugcccggcucc

SEQ ID NO: 3452746 - RNA, 17 nt, Pseudomonas aeruginosa PA01
cggguugcccggcucca

SEQ ID NO: 3452747 - RNA, 19 nt, Pseudomonas aeruginosa PA01
cggguugcccucgcagccg

SEQ ID NO: 3452748 - RNA, 14 nt, Pseudomonas aeruginosa PA01
cggguugccgcugg

SEQ ID NO: 3452749 - RNA, 16 nt, Pseudomonas aeruginosa PA01
cggguugccgcuggcc

SEQ ID NO: 3452750 - RNA, 14 nt, Pseudomonas aeruginosa PA01
cggguuggcgcagg

SEQ ID NO: 3452751 - RNA, 16 nt, Pseudomonas aeruginosa PA01
cggguuggcgcaggcc

SEQ ID NO: 3452752 - RNA, 18 nt, Pseudomonas aeruginosa PA01
cggguuggcgcaggccgg

SEQ ID NO: 3452753 - RNA, 19 nt, Pseudomonas aeruginosa PA01
cggguuggcuuccagccag

SEQ ID NO: 3452754 - RNA, 14 nt, Pseudomonas aeruginosa PA01
cggguuggucggca

SEQ ID NO: 3452755 - RNA, 16 nt, Pseudomonas aeruginosa PA01
cggguugguggccgcg

SEQ ID NO: 3452756 - RNA, 14 nt, Pseudomonas aeruginosa PA01
cggguuguccaggc

SEQ ID NO: 3452757 - RNA, 16 nt, Pseudomonas aeruginosa PA01
cggguuguccaggcga

SEQ ID NO: 3452758 - RNA, 16 nt, Pseudomonas aeruginosa PA01
cggguugucguugcgc

SEQ ID NO: 3452759 - RNA, 23 nt, Pseudomonas aeruginosa PA01
cggguugucguugcgcagcuucu

SEQ ID NO: 3452760 - RNA, 15 nt, Pseudomonas aeruginosa PA01
cggguuuccgugcgc

SEQ ID NO: 3452761 - RNA, 22 nt, Pseudomonas aeruginosa PA01
cggguuuccgugcgcugcgcgu

SEQ ID NO: 3452762 - RNA, 19 nt, Pseudomonas aeruginosa PA01
cggguuuccgugugcagca

SEQ ID NO: 3452763 - RNA, 22 nt, Pseudomonas aeruginosa PA01
cggguuuccgugugcagcaggg

SEQ ID NO: 3452764 - RNA, 15 nt, Pseudomonas aeruginosa PA01
cggguuuccugcccg

SEQ ID NO: 3452765 - RNA, 16 nt, Pseudomonas aeruginosa PA01
cggguuuccugcccga

SEQ ID NO: 3452766 - RNA, 20 nt, Pseudomonas aeruginosa PA01
cggguuucgcugcugccgcg

SEQ ID NO: 3452767 - RNA, 21 nt, Pseudomonas aeruginosa PA01
cggguuuggcgcccgccuugu

SEQ ID NO: 3452768 - RNA, 13 nt, Pseudomonas aeruginosa PA01
cgguacagccccc

SEQ ID NO: 3452769 - RNA, 18 nt, Pseudomonas aeruginosa PA01
cgguacagcgccuggucg

SEQ ID NO: 3452770 - RNA, 18 nt, Pseudomonas aeruginosa PA01
cgguacagcucguccuug

SEQ ID NO: 3452771 - RNA, 19 nt, Pseudomonas aeruginosa PA01
cgguacagcuguccgcgcc

SEQ ID NO: 3452772 - RNA, 16 nt, Pseudomonas aeruginosa PA01
cgguacaguucaggcu

SEQ ID NO: 3452773 - RNA, 19 nt, Pseudomonas aeruginosa PA01
cgguacaguucaggcuggg

SEQ ID NO: 3452774 - RNA, 17 nt, Pseudomonas aeruginosa PA01
cgguacauggccuucuc

SEQ ID NO: 3452775 - RNA, 20 nt, Pseudomonas aeruginosa PA01
cgguaccacgggcaguucca

SEQ ID NO: 3452776 - RNA, 13 nt, Pseudomonas aeruginosa PA01
cgguaccagcagc

SEQ ID NO: 3452777 - RNA, 15 nt, Pseudomonas aeruginosa PA01
cgguaccagcagcgc

SEQ ID NO: 3452778 - RNA, 20 nt, Pseudomonas aeruginosa PA01
cgguaccagcgcaccagggu

SEQ ID NO: 3452779 - RNA, 15 nt, Pseudomonas aeruginosa PA01
cgguaccagggaagc

SEQ ID NO: 3452780 - RNA, 21 nt, Pseudomonas aeruginosa PA01
cgguacccagcuugcuggcgu

SEQ ID NO: 3452781 - RNA, 14 nt, Pseudomonas aeruginosa PA01
cgguacccgccggc

SEQ ID NO: 3452782 - RNA, 16 nt, Pseudomonas aeruginosa PA01
cgguacccgccggcca

SEQ ID NO: 3452783 - RNA, 19 nt, Pseudomonas aeruginosa PA01
cgguacccgccggccaugc

SEQ ID NO: 3452784 - RNA, 17 nt, Pseudomonas aeruginosa PA01
cgguacccguacgcugc

SEQ ID NO: 3452785 - RNA, 17 nt, Pseudomonas aeruginosa PA01
cgguaccgggccaggca

SEQ ID NO: 3452786 - RNA, 20 nt, Pseudomonas aeruginosa PA01
cgguaccucgugggugccgg

SEQ ID NO: 3452787 - RNA, 14 nt, Pseudomonas aeruginosa PA01
cgguacgccgcgcu

SEQ ID NO: 3452788 - RNA, 13 nt, Pseudomonas aeruginosa PA01
cgguacggucgag

SEQ ID NO: 3452789 - RNA, 19 nt, Pseudomonas aeruginosa PA01
cgguacggucgaggcggag

SEQ ID NO: 3452790 - RNA, 12 nt, Pseudomonas aeruginosa PA01
cggucagguacg

SEQ ID NO: 3452791 - RNA, 18 nt, Pseudomonas aeruginosa PA01
cggucagguaggcaucga

SEQ ID NO: 3452792 - RNA, 21 nt, Pseudomonas aeruginosa PA01
cggucagguauucgccggcca

SEQ ID NO: 3452793 - RNA, 14 nt, Pseudomonas aeruginosa PA01
cggucauccgccgg

SEQ ID NO: 3452794 - RNA, 16 nt, Pseudomonas aeruginosa PA01
cggucauccgccggcg

SEQ ID NO: 3452795 - RNA, 19 nt, Pseudomonas aeruginosa PA01
cggucauccgccggcgcgu

SEQ ID NO: 3452796 - RNA, 14 nt, Pseudomonas aeruginosa PA01
cggucaucgccggc

SEQ ID NO: 3452797 - RNA, 15 nt, Pseudomonas aeruginosa PA01
cggucaucgccggcg

SEQ ID NO: 3452798 - RNA, 19 nt, Pseudomonas aeruginosa PA01
cggucaucgccggcgccga

SEQ ID NO: 3452799 - RNA, 14 nt, Pseudomonas aeruginosa PA01
cggucaucgcgccg

SEQ ID NO: 3452800 - RNA, 15 nt, Pseudomonas aeruginosa PA01
cggucaucgcgccgc

SEQ ID NO: 3452801 - RNA, 16 nt, Pseudomonas aeruginosa PA01
cggucaucgcgccgcc

SEQ ID NO: 3452802 - RNA, 17 nt, Pseudomonas aeruginosa PA01
cggucaucgcgccgccg

SEQ ID NO: 3452803 - RNA, 18 nt, Pseudomonas aeruginosa PA01
cggucaucgcgccgccga

SEQ ID NO: 3452804 - RNA, 23 nt, Pseudomonas aeruginosa PA01
cggucaucgcgccgccgaagccg

SEQ ID NO: 3452805 - RNA, 17 nt, Pseudomonas aeruginosa PA01
cggucaugcgcccuacg

SEQ ID NO: 3452806 - RNA, 15 nt, Pseudomonas aeruginosa PA01
cggucauggccagcu

SEQ ID NO: 3452807 - RNA, 18 nt, Pseudomonas aeruginosa PA01
cggucauggccagcucga

SEQ ID NO: 3452808 - RNA, 20 nt, Pseudomonas aeruginosa PA01
cggucauggccagcucgacc

SEQ ID NO: 3452809 - RNA, 15 nt, Pseudomonas aeruginosa PA01
cggucauggugccga

SEQ ID NO: 3452810 - RNA, 17 nt, Pseudomonas aeruginosa PA01
cggucauggugccgagc

SEQ ID NO: 3452811 - RNA, 18 nt, Pseudomonas aeruginosa PA01
cggucauggugccgagca

SEQ ID NO: 3452812 - RNA, 20 nt, Pseudomonas aeruginosa PA01
cggucauggugccgagcagg

SEQ ID NO: 3452813 - RNA, 18 nt, Pseudomonas aeruginosa PA01
cggucauguccggggcga

SEQ ID NO: 3452814 - RNA, 13 nt, Pseudomonas aeruginosa PA01
cgguccaccaggg

SEQ ID NO: 3452815 - RNA, 13 nt, Pseudomonas aeruginosa PA01
cgguccagccaga

SEQ ID NO: 3452816 - RNA, 23 nt, Pseudomonas aeruginosa PA01
cgguccagccagacguccggcag

SEQ ID NO: 3452817 - RNA, 21 nt, Pseudomonas aeruginosa PA01
cgguccagcgagcgggcgagg

SEQ ID NO: 3452818 - RNA, 17 nt, Pseudomonas aeruginosa PA01
cgguccagcuccuugcg

SEQ ID NO: 3452819 - RNA, 18 nt, Pseudomonas aeruginosa PA01
cgguccaggaucauccgc

SEQ ID NO: 3452820 - RNA, 18 nt, Pseudomonas aeruginosa PA01
cgguccaggggccgaugc

SEQ ID NO: 3452821 - RNA, 18 nt, Pseudomonas aeruginosa PA01
cgguccaggucaugcccu

SEQ ID NO: 3452822 - RNA, 19 nt, Pseudomonas aeruginosa PA01
cgguccaggucaugcccug

SEQ ID NO: 3452823 - RNA, 22 nt, Pseudomonas aeruginosa PA01
cgguccaggucaugcccuggcc

SEQ ID NO: 3452824 - RNA, 22 nt, Pseudomonas aeruginosa PA01
cggucccagaccagcagcggca

SEQ ID NO: 3452825 - RNA, 19 nt, Pseudomonas aeruginosa PA01
cggucccagguagcgcugc

SEQ ID NO: 3452826 - RNA, 20 nt, Pseudomonas aeruginosa PA01
cggucccagguagcgcugcg

SEQ ID NO: 3452827 - RNA, 16 nt, Pseudomonas aeruginosa PA01
cggucccaucagcagu

SEQ ID NO: 3452828 - RNA, 17 nt, Pseudomonas aeruginosa PA01
cggucccaucagcaguc

SEQ ID NO: 3452829 - RNA, 20 nt, Pseudomonas aeruginosa PA01
cgguccccaguagcaucccc

SEQ ID NO: 3452830 - RNA, 18 nt, Pseudomonas aeruginosa PA01
cgguccccuccagguagg

SEQ ID NO: 3452831 - RNA, 21 nt, Pseudomonas aeruginosa PA01
cggucccgggaaaccaccagg

SEQ ID NO: 3452832 - RNA, 18 nt, Pseudomonas aeruginosa PA01
cgguccgacaaucagcgg

SEQ ID NO: 3452833 - RNA, 14 nt, Pseudomonas aeruginosa PA01
cgguccgccgcggg

SEQ ID NO: 3452834 - RNA, 22 nt, Pseudomonas aeruginosa PA01
cgguccgcgccacgcaguggga

SEQ ID NO: 3452835 - RNA, 20 nt, Pseudomonas aeruginosa PA01
cgguccgcgguagcugcgca

SEQ ID NO: 3452836 - RNA, 23 nt, Pseudomonas aeruginosa PA01
cgguccggugaaccugaccaucg

SEQ ID NO: 3452837 - RNA, 15 nt, Pseudomonas aeruginosa PA01
cgguccguccagcgc

SEQ ID NO: 3452838 - RNA, 17 nt, Pseudomonas aeruginosa PA01
cgguccguccagcgcgc

SEQ ID NO: 3452839 - RNA, 23 nt, Pseudomonas aeruginosa PA01
cgguccucgcccgucacuucacg

SEQ ID NO: 3452840 - RNA, 19 nt, Pseudomonas aeruginosa PA01
cgguccucgggcaccagca

SEQ ID NO: 3452841 - RNA, 13 nt, Pseudomonas aeruginosa PA01
cgguccuuguccg

SEQ ID NO: 3452842 - RNA, 17 nt, Pseudomonas aeruginosa PA01
cggucgaaccccuuccc

SEQ ID NO: 3452843 - RNA, 18 nt, Pseudomonas aeruginosa PA01
cggucgaaccccuucccc

SEQ ID NO: 3452844 - RNA, 20 nt, Pseudomonas aeruginosa PA01
cggucgaacugaccaccagg

SEQ ID NO: 3452845 - RNA, 17 nt, Pseudomonas aeruginosa PA01
cggucgacggcgugcag

SEQ ID NO: 3452846 - RNA, 17 nt, Pseudomonas aeruginosa PA01
cggucgagacccgcaac

SEQ ID NO: 3452847 - RNA, 21 nt, Pseudomonas aeruginosa PA01
cggucgagacgccaucaacgg

SEQ ID NO: 3452848 - RNA, 14 nt, Pseudomonas aeruginosa PA01
cggucgagcagcgc

SEQ ID NO: 3452849 - RNA, 15 nt, Pseudomonas aeruginosa PA01
cggucgagcagcgcc

SEQ ID NO: 3452850 - RNA, 16 nt, Pseudomonas aeruginosa PA01
cggucgagcagcgccg

SEQ ID NO: 3452851 - RNA, 17 nt, Pseudomonas aeruginosa PA01
cggucgagcagcgccgc

SEQ ID NO: 3452852 - RNA, 18 nt, Pseudomonas aeruginosa PA01
cggucgagcagcgccgcg

SEQ ID NO: 3452853 - RNA, 18 nt, Pseudomonas aeruginosa PA01
cggucgagccccacgucg

SEQ ID NO: 3452854 - RNA, 16 nt, Pseudomonas aeruginosa PA01
cggucgagcucggcca

SEQ ID NO: 3452855 - RNA, 12 nt, Pseudomonas aeruginosa PA01
cggucgaggccc

SEQ ID NO: 3452856 - RNA, 13 nt, Pseudomonas aeruginosa PA01
cggucgaggcccu

SEQ ID NO: 3452857 - RNA, 14 nt, Pseudomonas aeruginosa PA01
cggucgaggcccuc

SEQ ID NO: 3452858 - RNA, 18 nt, Pseudomonas aeruginosa PA01
cggucgaggcccucggcg

SEQ ID NO: 3452859 - RNA, 20 nt, Pseudomonas aeruginosa PA01
cggucgaggcccucggcggc

SEQ ID NO: 3452860 - RNA, 21 nt, Pseudomonas aeruginosa PA01
cggucgaggcccucggcggcg

SEQ ID NO: 3452861 - RNA, 18 nt, Pseudomonas aeruginosa PA01
cggucgagguugcgcggc

SEQ ID NO: 3452862 - RNA, 21 nt, Pseudomonas aeruginosa PA01
cggucgagguugcgcggcagg

SEQ ID NO: 3452863 - RNA, 15 nt, Pseudomonas aeruginosa PA01
cggucgauccgaccu

SEQ ID NO: 3452864 - RNA, 18 nt, Pseudomonas aeruginosa PA01
cggucgaucguugccagc

SEQ ID NO: 3452865 - RNA, 20 nt, Pseudomonas aeruginosa PA01
cggucgauguccugggccac

SEQ ID NO: 3452866 - RNA, 14 nt, Pseudomonas aeruginosa PA01
cggucgcaauggcg

SEQ ID NO: 3452867 - RNA, 17 nt, Pseudomonas aeruginosa PA01
cggucgcaccgccagca

SEQ ID NO: 3452868 - RNA, 15 nt, Pseudomonas aeruginosa PA01
cggucgcccucggcc

SEQ ID NO: 3452869 - RNA, 19 nt, Pseudomonas aeruginosa PA01
cggucgcccucggccaggc

SEQ ID NO: 3452870 - RNA, 12 nt, Pseudomonas aeruginosa PA01
cggucgccgcca

SEQ ID NO: 3452871 - RNA, 14 nt, Pseudomonas aeruginosa PA01
cggucgccgccagc

SEQ ID NO: 3452872 - RNA, 16 nt, Pseudomonas aeruginosa PA01
cggucgccgccagcau

SEQ ID NO: 3452873 - RNA, 12 nt, Pseudomonas aeruginosa PA01
cggucgccgccg

SEQ ID NO: 3452874 - RNA, 14 nt, Pseudomonas aeruginosa PA01
cggucgccggcgcg

SEQ ID NO: 3452875 - RNA, 17 nt, Pseudomonas aeruginosa PA01
cggucgccggcgcgcac

SEQ ID NO: 3452876 - RNA, 16 nt, Pseudomonas aeruginosa PA01
cggucgcgaucugcug

SEQ ID NO: 3452877 - RNA, 15 nt, Pseudomonas aeruginosa PA01
cggucgcgcagcacc

SEQ ID NO: 3452878 - RNA, 18 nt, Pseudomonas aeruginosa PA01
cggucgcgccccgccagg

SEQ ID NO: 3452879 - RNA, 21 nt, Pseudomonas aeruginosa PA01
cggucgcgccccgccaggagc

SEQ ID NO: 3452880 - RNA, 21 nt, Pseudomonas aeruginosa PA01
cggucgcgcgggugcggcugg

SEQ ID NO: 3452881 - RNA, 23 nt, Pseudomonas aeruginosa PA01
cggucgcgcgggugcggcuggcg

SEQ ID NO: 3452882 - RNA, 19 nt, Pseudomonas aeruginosa PA01
cggucgcgcucaggcgcag

SEQ ID NO: 3452883 - RNA, 20 nt, Pseudomonas aeruginosa PA01
cggucgcgcuggaccuggcc

SEQ ID NO: 3452884 - RNA, 21 nt, Pseudomonas aeruginosa PA01
cggucgcgcuggaccuggccg

SEQ ID NO: 3452885 - RNA, 21 nt, Pseudomonas aeruginosa PA01
cggucgcggggaauuuccggc

SEQ ID NO: 3452886 - RNA, 20 nt, Pseudomonas aeruginosa PA01
cggucgcugaccagcccggc

SEQ ID NO: 3452887 - RNA, 21 nt, Pseudomonas aeruginosa PA01
cggucgcuuuuuccgcugccg

SEQ ID NO: 3452888 - RNA, 16 nt, Pseudomonas aeruginosa PA01
cggucggacuccgccc

SEQ ID NO: 3452889 - RNA, 13 nt, Pseudomonas aeruginosa PA01
cggucggccagga

SEQ ID NO: 3452890 - RNA, 15 nt, Pseudomonas aeruginosa PA01
cggucggccaggacg

SEQ ID NO: 3452891 - RNA, 16 nt, Pseudomonas aeruginosa PA01
cggucggccaggacgc

SEQ ID NO: 3452892 - RNA, 11 nt, Pseudomonas aeruginosa PA01
cggugaucgcc

SEQ ID NO: 3452893 - RNA, 15 nt, Pseudomonas aeruginosa PA01
cggugaucgccgcga

SEQ ID NO: 3452894 - RNA, 22 nt, Pseudomonas aeruginosa PA01
cggugaucuggaaauucagcgc

SEQ ID NO: 3452895 - RNA, 19 nt, Pseudomonas aeruginosa PA01
cggugaugguaucgccguc

SEQ ID NO: 3452896 - RNA, 21 nt, Pseudomonas aeruginosa PA01
cggugaugguaucgccguccu

SEQ ID NO: 3452897 - RNA, 22 nt, Pseudomonas aeruginosa PA01
cggugauguaggacgccucguc

SEQ ID NO: 3452898 - RNA, 15 nt, Pseudomonas aeruginosa PA01
cggugaugucggcgc

SEQ ID NO: 3452899 - RNA, 19 nt, Pseudomonas aeruginosa PA01
cggugaugucggcgcuguc

SEQ ID NO: 3452900 - RNA, 18 nt, Pseudomonas aeruginosa PA01
cggugcaccaggcgaugc

SEQ ID NO: 3452901 - RNA, 19 nt, Pseudomonas aeruginosa PA01
cggugcaccaggcgaugcg

SEQ ID NO: 3452902 - RNA, 15 nt, Pseudomonas aeruginosa PA01
cggugcagccaccca

SEQ ID NO: 3452903 - RNA, 16 nt, Pseudomonas aeruginosa PA01
cggugcagccacccag

SEQ ID NO: 3452904 - RNA, 17 nt, Pseudomonas aeruginosa PA01
cggugcagcggaagccc

SEQ ID NO: 3452905 - RNA, 18 nt, Pseudomonas aeruginosa PA01
cggugcaugaaggcgcug

SEQ ID NO: 3452906 - RNA, 14 nt, Pseudomonas aeruginosa PA01
cggugcaugcgcac

SEQ ID NO: 3452907 - RNA, 14 nt, Pseudomonas aeruginosa PA01
cggugccagggcgg

SEQ ID NO: 3452908 - RNA, 18 nt, Pseudomonas aeruginosa PA01
cggugccauacagcgccc

SEQ ID NO: 3452909 - RNA, 20 nt, Pseudomonas aeruginosa PA01
cggugccauggaucaccagg

SEQ ID NO: 3452910 - RNA, 22 nt, Pseudomonas aeruginosa PA01
cggugccauggaucaccagggu

SEQ ID NO: 3452911 - RNA, 13 nt, Pseudomonas aeruginosa PA01
cggugccgcccgg

SEQ ID NO: 3452912 - RNA, 14 nt, Pseudomonas aeruginosa PA01
cggugccgcccggc

SEQ ID NO: 3452913 - RNA, 18 nt, Pseudomonas aeruginosa PA01
cggugccgcccggcgcca

SEQ ID NO: 3452914 - RNA, 19 nt, Pseudomonas aeruginosa PA01
cggugccgcccggcgccac

SEQ ID NO: 3452915 - RNA, 21 nt, Pseudomonas aeruginosa PA01
cggugccgcccggcgccaccg

SEQ ID NO: 3452916 - RNA, 12 nt, Pseudomonas aeruginosa PA01
cggugccgccgg

SEQ ID NO: 3452917 - RNA, 13 nt, Pseudomonas aeruginosa PA01
cggugccgccggc

SEQ ID NO: 3452918 - RNA, 23 nt, Pseudomonas aeruginosa PA01
cggugccgccggccaccagcagc

SEQ ID NO: 3452919 - RNA, 19 nt, Pseudomonas aeruginosa PA01
cggugccgccggcgccgcc

SEQ ID NO: 3452920 - RNA, 20 nt, Pseudomonas aeruginosa PA01
cggugccgccggcgccgccg

SEQ ID NO: 3452921 - RNA, 11 nt, Pseudomonas aeruginosa PA01
cggugccgcgc

SEQ ID NO: 3452922 - RNA, 12 nt, Pseudomonas aeruginosa PA01
cggugccgcgca

SEQ ID NO: 3452923 - RNA, 13 nt, Pseudomonas aeruginosa PA01
cggugccggcggc

SEQ ID NO: 3452924 - RNA, 22 nt, Pseudomonas aeruginosa PA01
cggugccggcggcggacgcagg

SEQ ID NO: 3452925 - RNA, 13 nt, Pseudomonas aeruginosa PA01
cggugccgggaag

SEQ ID NO: 3452926 - RNA, 15 nt, Pseudomonas aeruginosa PA01
cggugccgggaagcg

SEQ ID NO: 3452927 - RNA, 22 nt, Pseudomonas aeruginosa PA01
cggugccgucaugcacuucgac

SEQ ID NO: 3452928 - RNA, 17 nt, Pseudomonas aeruginosa PA01
cggugccuucccagccg

SEQ ID NO: 3452929 - RNA, 19 nt, Pseudomonas aeruginosa PA01
cggugccuucccagccgag

SEQ ID NO: 3452930 - RNA, 21 nt, Pseudomonas aeruginosa PA01
cggugccuucccagccgaggc

SEQ ID NO: 3452931 - RNA, 15 nt, Pseudomonas aeruginosa PA01
cggugccuucggcgg

SEQ ID NO: 3452932 - RNA, 16 nt, Pseudomonas aeruginosa PA01
cggugccuucggcggc

SEQ ID NO: 3452933 - RNA, 17 nt, Pseudomonas aeruginosa PA01
cggugccuucggcggcg

SEQ ID NO: 3452934 - RNA, 18 nt, Pseudomonas aeruginosa PA01
cggugccuucggcggcgc

SEQ ID NO: 3452935 - RNA, 16 nt, Pseudomonas aeruginosa PA01
cggugcgccccaggug

SEQ ID NO: 3452936 - RNA, 21 nt, Pseudomonas aeruginosa PA01
cggugcgccccaggugcagcg

SEQ ID NO: 3452937 - RNA, 13 nt, Pseudomonas aeruginosa PA01
cggugcgccggcg

SEQ ID NO: 3452938 - RNA, 17 nt, Pseudomonas aeruginosa PA01
cggugcgccggcgggau

SEQ ID NO: 3452939 - RNA, 16 nt, Pseudomonas aeruginosa PA01
cggugcgccuccagga

SEQ ID NO: 3452940 - RNA, 17 nt, Pseudomonas aeruginosa PA01
cggugcggauggcaaug

SEQ ID NO: 3452941 - RNA, 17 nt, Pseudomonas aeruginosa PA01
cggugcggccgaggaac

SEQ ID NO: 3452942 - RNA, 19 nt, Pseudomonas aeruginosa PA01
cggugcggguggucgccgc

SEQ ID NO: 3452943 - RNA, 21 nt, Pseudomonas aeruginosa PA01
cggugcggguggucgccgccc

SEQ ID NO: 3452944 - RNA, 22 nt, Pseudomonas aeruginosa PA01
cggugcggguggucgccgccca

SEQ ID NO: 3452945 - RNA, 15 nt, Pseudomonas aeruginosa PA01
cggugcggucguuga

SEQ ID NO: 3452946 - RNA, 17 nt, Pseudomonas aeruginosa PA01
cggugcggucguugauc

SEQ ID NO: 3452947 - RNA, 23 nt, Pseudomonas aeruginosa PA01
cggugcgguuggagcggaucacg

SEQ ID NO: 3452948 - RNA, 16 nt, Pseudomonas aeruginosa PA01
cggugcguagcgacag

SEQ ID NO: 3452949 - RNA, 20 nt, Pseudomonas aeruginosa PA01
cggugcguucgcgggcgccg

SEQ ID NO: 3452950 - RNA, 23 nt, Pseudomonas aeruginosa PA01
cggugcuagcggguggcaacugc

SEQ ID NO: 3452951 - RNA, 11 nt, Pseudomonas aeruginosa PA01
cggugcucagg

SEQ ID NO: 3452952 - RNA, 21 nt, Pseudomonas aeruginosa PA01
cggugcucaggcggccgaacu

SEQ ID NO: 3452953 - RNA, 14 nt, Pseudomonas aeruginosa PA01
cggugcuggcgagc

SEQ ID NO: 3452954 - RNA, 20 nt, Pseudomonas aeruginosa PA01
cggugcuggugcggccgaug

SEQ ID NO: 3452955 - RNA, 16 nt, Pseudomonas aeruginosa PA01
cggugcuuugcauggc

SEQ ID NO: 3452956 - RNA, 19 nt, Pseudomonas aeruginosa PA01
cgguggaauaccgcugcgc

SEQ ID NO: 3452957 - RNA, 20 nt, Pseudomonas aeruginosa PA01
cgguggaauaccgcugcgcg

SEQ ID NO: 3452958 - RNA, 19 nt, Pseudomonas aeruginosa PA01
cgguggaccaacgggcugc

SEQ ID NO: 3452959 - RNA, 17 nt, Pseudomonas aeruginosa PA01
cgguggacugguugacc

SEQ ID NO: 3452960 - RNA, 14 nt, Pseudomonas aeruginosa PA01
cgguggagcacguc

SEQ ID NO: 3452961 - RNA, 18 nt, Pseudomonas aeruginosa PA01
cgguggagcacgucgagc

SEQ ID NO: 3452962 - RNA, 20 nt, Pseudomonas aeruginosa PA01
cgguggagcacgucgagcag

SEQ ID NO: 3452963 - RNA, 21 nt, Pseudomonas aeruginosa PA01
cgguggagcagaacuugcgca

SEQ ID NO: 3452964 - RNA, 14 nt, Pseudomonas aeruginosa PA01
cgguggaggcggcg

SEQ ID NO: 3452965 - RNA, 15 nt, Pseudomonas aeruginosa PA01
cgguggaggcgucgg

SEQ ID NO: 3452966 - RNA, 17 nt, Pseudomonas aeruginosa PA01
cgguggaggcgucggcc

SEQ ID NO: 3452967 - RNA, 18 nt, Pseudomonas aeruginosa PA01
cgguggaugccgguggcg

SEQ ID NO: 3452968 - RNA, 20 nt, Pseudomonas aeruginosa PA01
cgguggaugccgguggcgcc

SEQ ID NO: 3452969 - RNA, 19 nt, Pseudomonas aeruginosa PA01
cgguggcaugguguccggc

SEQ ID NO: 3452970 - RNA, 23 nt, Pseudomonas aeruginosa PA01
cgguggcaugguguccggcggcg

SEQ ID NO: 3452971 - RNA, 16 nt, Pseudomonas aeruginosa PA01
cgguggccacgucgcc

SEQ ID NO: 3452972 - RNA, 14 nt, Pseudomonas aeruginosa PA01
cgguggccaggacg

SEQ ID NO: 3452973 - RNA, 22 nt, Pseudomonas aeruginosa PA01
cgguggccaggacgcuggcgau

SEQ ID NO: 3452974 - RNA, 14 nt, Pseudomonas aeruginosa PA01
cgguggccaggcuc

SEQ ID NO: 3452975 - RNA, 17 nt, Pseudomonas aeruginosa PA01
cgguggccgugggccgc

SEQ ID NO: 3452976 - RNA, 20 nt, Pseudomonas aeruginosa PA01
cgguggccgugggccgccga

SEQ ID NO: 3452977 - RNA, 15 nt, Pseudomonas aeruginosa PA01
cgguggccuccugca

SEQ ID NO: 3452978 - RNA, 14 nt, Pseudomonas aeruginosa PA01
cgguggcgaccagg

SEQ ID NO: 3452979 - RNA, 18 nt, Pseudomonas aeruginosa PA01
cgguggcgaccaggacag

SEQ ID NO: 3452980 - RNA, 21 nt, Pseudomonas aeruginosa PA01
cgguggcgaccaggacagcac

SEQ ID NO: 3452981 - RNA, 19 nt, Pseudomonas aeruginosa PA01
cgguggcgacgcgcaggcc

SEQ ID NO: 3452982 - RNA, 20 nt, Pseudomonas aeruginosa PA01
cgguggcgacgcgcaggccg

SEQ ID NO: 3452983 - RNA, 21 nt, Pseudomonas aeruginosa PA01
cgguggcgacgcgcaggccgg

SEQ ID NO: 3452984 - RNA, 17 nt, Pseudomonas aeruginosa PA01
cgguggcgcccagccag

SEQ ID NO: 3452985 - RNA, 18 nt, Pseudomonas aeruginosa PA01
cgguggcgcccagccaga

SEQ ID NO: 3452986 - RNA, 13 nt, Pseudomonas aeruginosa PA01
cgguggcggacug

SEQ ID NO: 3452987 - RNA, 22 nt, Pseudomonas aeruginosa PA01
cgguggcggacugguaggacag

SEQ ID NO: 3452988 - RNA, 17 nt, Pseudomonas aeruginosa PA01
cgguggcguuauccgcc

SEQ ID NO: 3452989 - RNA, 19 nt, Pseudomonas aeruginosa PA01
cgguggcguuauccgcccc

SEQ ID NO: 3452990 - RNA, 18 nt, Pseudomonas aeruginosa PA01
cgguggcguuauucgccc

SEQ ID NO: 3452991 - RNA, 21 nt, Pseudomonas aeruginosa PA01
cggugggaagagcaucucgcc

SEQ ID NO: 3452992 - RNA, 22 nt, Pseudomonas aeruginosa PA01
cggugggaagagcaucucgccg

SEQ ID NO: 3452993 - RNA, 18 nt, Pseudomonas aeruginosa PA01
cggugggacugagccgcu

SEQ ID NO: 3452994 - RNA, 17 nt, Pseudomonas aeruginosa PA01
cgguuggccucggcccg

SEQ ID NO: 3452995 - RNA, 15 nt, Pseudomonas aeruginosa PA01
cgguuggcgccccag

SEQ ID NO: 3452996 - RNA, 16 nt, Pseudomonas aeruginosa PA01
cgguuggcggaugacg

SEQ ID NO: 3452997 - RNA, 19 nt, Pseudomonas aeruginosa PA01
cgguuggcuacccgcaggg

SEQ ID NO: 3452998 - RNA, 22 nt, Pseudomonas aeruginosa PA01
cgguuggcuacccgcagggcuc

SEQ ID NO: 3452999 - RNA, 20 nt, Pseudomonas aeruginosa PA01
cgguuggggaggugcggcgg

SEQ ID NO: 3453000 - RNA, 22 nt, Pseudomonas aeruginosa PA01
cgguuggggaggugcggcggug

SEQ ID NO: 3453001 - RNA, 14 nt, Pseudomonas aeruginosa PA01
cgguugugcgcccg

SEQ ID NO: 3453002 - RNA, 21 nt, Pseudomonas aeruginosa PA01
cgguugugcgcccguucgauc

SEQ ID NO: 3453003 - RNA, 16 nt, Pseudomonas aeruginosa PA01
cgguuucaggccuugc

SEQ ID NO: 3453004 - RNA, 17 nt, Pseudomonas aeruginosa PA01
cgguuucaggccuugcu

SEQ ID NO: 3453005 - RNA, 18 nt, Pseudomonas aeruginosa PA01
cgguuucccucgagcacc

SEQ ID NO: 3453006 - RNA, 14 nt, Pseudomonas aeruginosa PA01
cgguuuccgcagcg

SEQ ID NO: 3453007 - RNA, 15 nt, Pseudomonas aeruginosa PA01
cgguuucgcagcgcu

SEQ ID NO: 3453008 - RNA, 16 nt, Pseudomonas aeruginosa PA01
cgguuucgcagcgcuc

SEQ ID NO: 3453009 - RNA, 14 nt, Pseudomonas aeruginosa PA01
cgguuuuccugccc

SEQ ID NO: 3453010 - RNA, 16 nt, Pseudomonas aeruginosa PA01
cgguuuuccugccccg

SEQ ID NO: 3453011 - RNA, 18 nt, Pseudomonas aeruginosa PA01
cgguuuuuuuaugccugc

SEQ ID NO: 3453012 - RNA, 16 nt, Pseudomonas aeruginosa PA01
cguaaagcaagcccgu

SEQ ID NO: 3453013 - RNA, 22 nt, Pseudomonas aeruginosa PA01
cguaacggcuugucggguaggg

SEQ ID NO: 3453014 - RNA, 18 nt, Pseudomonas aeruginosa PA01
cguaagucagguccuugu

SEQ ID NO: 3453015 - RNA, 19 nt, Pseudomonas aeruginosa PA01
cguaagucagguccuuguu

SEQ ID NO: 3453016 - RNA, 18 nt, Pseudomonas aeruginosa PA01
cguaaucgcgccaggccg

SEQ ID NO: 3453017 - RNA, 19 nt, Pseudomonas aeruginosa PA01
cguaaucgcgccaggccgc

SEQ ID NO: 3453018 - RNA, 17 nt, Pseudomonas aeruginosa PA01
cguaaugcaacccgccg

SEQ ID NO: 3453019 - RNA, 21 nt, Pseudomonas aeruginosa PA01
cguacaccgcgcggcacagcg

SEQ ID NO: 3453020 - RNA, 16 nt, Pseudomonas aeruginosa PA01
cguacagcccccgccg

SEQ ID NO: 3453021 - RNA, 19 nt, Pseudomonas aeruginosa PA01
cguacagcccccgccggcc

SEQ ID NO: 3453022 - RNA, 20 nt, Pseudomonas aeruginosa PA01
cguacagcccccgccggccg

SEQ ID NO: 3453023 - RNA, 15 nt, Pseudomonas aeruginosa PA01
cguacaggccccagg

SEQ ID NO: 3453024 - RNA, 18 nt, Pseudomonas aeruginosa PA01
cguacaggccccaggcga

SEQ ID NO: 3453025 - RNA, 17 nt, Pseudomonas aeruginosa PA01
cguacaggucggcgccg

SEQ ID NO: 3453026 - RNA, 22 nt, Pseudomonas aeruginosa PA01
cguaccaagcgagacgccgccc

SEQ ID NO: 3453027 - RNA, 14 nt, Pseudomonas aeruginosa PA01
cguaccacguccag

SEQ ID NO: 3453028 - RNA, 15 nt, Pseudomonas aeruginosa PA01
cguaccagccgcggu

SEQ ID NO: 3453029 - RNA, 12 nt, Pseudomonas aeruginosa PA01
cguaccagcgcg

SEQ ID NO: 3453030 - RNA, 14 nt, Pseudomonas aeruginosa PA01
cguaccagcgcgca

SEQ ID NO: 3453031 - RNA, 15 nt, Pseudomonas aeruginosa PA01
cguaccagcgcgcag

SEQ ID NO: 3453032 - RNA, 16 nt, Pseudomonas aeruginosa PA01
cguaccagcgcgcagc

SEQ ID NO: 3453033 - RNA, 16 nt, Pseudomonas aeruginosa PA01
cguaccaggaugcccu

SEQ ID NO: 3453034 - RNA, 17 nt, Pseudomonas aeruginosa PA01
cguacccgcccuacgca

SEQ ID NO: 3453035 - RNA, 21 nt, Pseudomonas aeruginosa PA01
cguaccggcuacaggccguag

SEQ ID NO: 3453036 - RNA, 23 nt, Pseudomonas aeruginosa PA01
cguaccggcuacaggccguagcg

SEQ ID NO: 3453037 - RNA, 13 nt, Pseudomonas aeruginosa PA01
cguaccguuggcg

SEQ ID NO: 3453038 - RNA, 14 nt, Pseudomonas aeruginosa PA01
cguaccucgccagg

SEQ ID NO: 3453039 - RNA, 16 nt, Pseudomonas aeruginosa PA01
cguaccuucgagcagg

SEQ ID NO: 3453040 - RNA, 18 nt, Pseudomonas aeruginosa PA01
cguaccuucgagcaggag

SEQ ID NO: 3453041 - RNA, 14 nt, Pseudomonas aeruginosa PA01
cguacgcccagcag

SEQ ID NO: 3453042 - RNA, 15 nt, Pseudomonas aeruginosa PA01
cguacgcccagcagc

SEQ ID NO: 3453043 - RNA, 14 nt, Pseudomonas aeruginosa PA01
cguacgcccgcagc

SEQ ID NO: 3453044 - RNA, 15 nt, Pseudomonas aeruginosa PA01
cguacgcccgcagcc

SEQ ID NO: 3453045 - RNA, 22 nt, Pseudomonas aeruginosa PA01
cguacgcccgcagccacggcac

SEQ ID NO: 3453046 - RNA, 12 nt, Pseudomonas aeruginosa PA01
cguacgcugcca

SEQ ID NO: 3453047 - RNA, 22 nt, Pseudomonas aeruginosa PA01
cguacgcuucagcgguucggca

SEQ ID NO: 3453048 - RNA, 14 nt, Pseudomonas aeruginosa PA01
cguacggcgccucg

SEQ ID NO: 3453049 - RNA, 15 nt, Pseudomonas aeruginosa PA01
cguacguccagggca

SEQ ID NO: 3453050 - RNA, 21 nt, Pseudomonas aeruginosa PA01
cguacguccagggcaccacgg

SEQ ID NO: 3453051 - RNA, 14 nt, Pseudomonas aeruginosa PA01
cguacuccagcaac

SEQ ID NO: 3453052 - RNA, 15 nt, Pseudomonas aeruginosa PA01
cguacuccagcaacg

SEQ ID NO: 3453053 - RNA, 17 nt, Pseudomonas aeruginosa PA01
cguacuggcgccaggcc

SEQ ID NO: 3453054 - RNA, 19 nt, Pseudomonas aeruginosa PA01
cguacuggcgccaggccgc

SEQ ID NO: 3453055 - RNA, 16 nt, Pseudomonas aeruginosa PA01
cguacuucagcgucac

SEQ ID NO: 3453056 - RNA, 22 nt, Pseudomonas aeruginosa PA01
cguacuugaaggugcccagggc

SEQ ID NO: 3453057 - RNA, 16 nt, Pseudomonas aeruginosa PA01
cguacuugccagggca

SEQ ID NO: 3453058 - RNA, 15 nt, Pseudomonas aeruginosa PA01
cguacuuggcccggc

SEQ ID NO: 3453059 - RNA, 15 nt, Pseudomonas aeruginosa PA01
cguacuugggcauca

SEQ ID NO: 3453060 - RNA, 17 nt, Pseudomonas aeruginosa PA01
cguacuugggcaucagc

SEQ ID NO: 3453061 - RNA, 16 nt, Pseudomonas aeruginosa PA01
cguagaaacgcgccuc

SEQ ID NO: 3453062 - RNA, 19 nt, Pseudomonas aeruginosa PA01
cguagaacaccacccggcc

SEQ ID NO: 3453063 - RNA, 15 nt, Pseudomonas aeruginosa PA01
cguagaacagcacgu

SEQ ID NO: 3453064 - RNA, 16 nt, Pseudomonas aeruginosa PA01
cguagaacgccaggau

SEQ ID NO: 3453065 - RNA, 13 nt, Pseudomonas aeruginosa PA01
cguagaccaccag

SEQ ID NO: 3453066 - RNA, 14 nt, Pseudomonas aeruginosa PA01
cguagaccaccagc

SEQ ID NO: 3453067 - RNA, 16 nt, Pseudomonas aeruginosa PA01
cguagaccaccagcag

SEQ ID NO: 3453068 - RNA, 17 nt, Pseudomonas aeruginosa PA01
cguagaccaccagcagc

SEQ ID NO: 3453069 - RNA, 18 nt, Pseudomonas aeruginosa PA01
cguagaccaccagcagca

SEQ ID NO: 3453070 - RNA, 19 nt, Pseudomonas aeruginosa PA01
cguagaccaccucgacggc

SEQ ID NO: 3453071 - RNA, 23 nt, Pseudomonas aeruginosa PA01
cguagaccaucgccggcgagccg

SEQ ID NO: 3453072 - RNA, 16 nt, Pseudomonas aeruginosa PA01
cguagaccuugcggcc

SEQ ID NO: 3453073 - RNA, 22 nt, Pseudomonas aeruginosa PA01
cguagacguagucggcagucgc

SEQ ID NO: 3453074 - RNA, 23 nt, Pseudomonas aeruginosa PA01
cguagacugugguguagcgcagg

SEQ ID NO: 3453075 - RNA, 18 nt, Pseudomonas aeruginosa PA01
cguagagauauucccgcg

SEQ ID NO: 3453076 - RNA, 17 nt, Pseudomonas aeruginosa PA01
cguagagcgugcggccg

SEQ ID NO: 3453077 - RNA, 16 nt, Pseudomonas aeruginosa PA01
cguagagcuugcugaa

SEQ ID NO: 3453078 - RNA, 21 nt, Pseudomonas aeruginosa PA01
cguagaggaucucgccacuga

SEQ ID NO: 3453079 - RNA, 15 nt, Pseudomonas aeruginosa PA01
cguagaggcucggcg

SEQ ID NO: 3453080 - RNA, 20 nt, Pseudomonas aeruginosa PA01
cguagaggcuguagcgcucc

SEQ ID NO: 3453081 - RNA, 13 nt, Pseudomonas aeruginosa PA01
cguagaggggcuc

SEQ ID NO: 3453082 - RNA, 20 nt, Pseudomonas aeruginosa PA01
cguagaguucgcugcgcgcc

SEQ ID NO: 3453083 - RNA, 23 nt, Pseudomonas aeruginosa PA01
cguagcagcggaaaugcucgccg

SEQ ID NO: 3453084 - RNA, 23 nt, Pseudomonas aeruginosa PA01
cguagcagguccgcgccucgcgc

SEQ ID NO: 3453085 - RNA, 12 nt, Pseudomonas aeruginosa PA01
cguagcccaggc

SEQ ID NO: 3453086 - RNA, 13 nt, Pseudomonas aeruginosa PA01
cguagcccauggu

SEQ ID NO: 3453087 - RNA, 19 nt, Pseudomonas aeruginosa PA01
cguagcccauggucagcgg

SEQ ID NO: 3453088 - RNA, 13 nt, Pseudomonas aeruginosa PA01
cguagcccccgcc

SEQ ID NO: 3453089 - RNA, 18 nt, Pseudomonas aeruginosa PA01
cguagcccccgccgcuga

SEQ ID NO: 3453090 - RNA, 19 nt, Pseudomonas aeruginosa PA01
cguagcccuucuccgccag

SEQ ID NO: 3453091 - RNA, 21 nt, Pseudomonas aeruginosa PA01
cguagcccuucuccgccagcc

SEQ ID NO: 3453092 - RNA, 13 nt, Pseudomonas aeruginosa PA01
cguagccgcgcgc

SEQ ID NO: 3453093 - RNA, 21 nt, Pseudomonas aeruginosa PA01
cguagccgcgcgccagcaacg

SEQ ID NO: 3453094 - RNA, 17 nt, Pseudomonas aeruginosa PA01
cguagccgucgaacagc

SEQ ID NO: 3453095 - RNA, 20 nt, Pseudomonas aeruginosa PA01
cguagccgucgaacagcagc

SEQ ID NO: 3453096 - RNA, 17 nt, Pseudomonas aeruginosa PA01
cguagccgucguagcgc

SEQ ID NO: 3453097 - RNA, 19 nt, Pseudomonas aeruginosa PA01
cgucacuguuuuccauggc

SEQ ID NO: 3453098 - RNA, 19 nt, Pseudomonas aeruginosa PA01
cgucacuucacgacaggcg

SEQ ID NO: 3453099 - RNA, 13 nt, Pseudomonas aeruginosa PA01
cgucacuugaagu

SEQ ID NO: 3453100 - RNA, 20 nt, Pseudomonas aeruginosa PA01
cgucagcaggucucaccgcc

SEQ ID NO: 3453101 - RNA, 23 nt, Pseudomonas aeruginosa PA01
cgucagcaggucucaccgcccug

SEQ ID NO: 3453102 - RNA, 12 nt, Pseudomonas aeruginosa PA01
cgucagccaggc

SEQ ID NO: 3453103 - RNA, 14 nt, Pseudomonas aeruginosa PA01
cgucagccaggcug

SEQ ID NO: 3453104 - RNA, 18 nt, Pseudomonas aeruginosa PA01
cgucagccaggcuggcug

SEQ ID NO: 3453105 - RNA, 12 nt, Pseudomonas aeruginosa PA01
cgucagccgcgg

SEQ ID NO: 3453106 - RNA, 22 nt, Pseudomonas aeruginosa PA01
cgucagcgagcuaucgccuccc

SEQ ID NO: 3453107 - RNA, 20 nt, Pseudomonas aeruginosa PA01
cgucaggcaccucguccagc

SEQ ID NO: 3453108 - RNA, 14 nt, Pseudomonas aeruginosa PA01
cgucaggccuugcg

SEQ ID NO: 3453109 - RNA, 22 nt, Pseudomonas aeruginosa PA01
cgucaggccuugcgcggcgccg

SEQ ID NO: 3453110 - RNA, 21 nt, Pseudomonas aeruginosa PA01
cgucaggggcucggcgagcga

SEQ ID NO: 3453111 - RNA, 23 nt, Pseudomonas aeruginosa PA01
cgucaguuccacgcggaccuugu

SEQ ID NO: 3453112 - RNA, 17 nt, Pseudomonas aeruginosa PA01
cgucaguuccgcaucgg

SEQ ID NO: 3453113 - RNA, 17 nt, Pseudomonas aeruginosa PA01
cgucauaggccuuggcg

SEQ ID NO: 3453114 - RNA, 19 nt, Pseudomonas aeruginosa PA01
cgucaucaggcucaggccg

SEQ ID NO: 3453115 - RNA, 13 nt, Pseudomonas aeruginosa PA01
cgucaucgagcag

SEQ ID NO: 3453116 - RNA, 14 nt, Pseudomonas aeruginosa PA01
cgucaucgagcagu

SEQ ID NO: 3453117 - RNA, 24 nt, Pseudomonas aeruginosa PA01
cgucaucguccagcucggccauca

SEQ ID NO: 3453118 - RNA, 14 nt, Pseudomonas aeruginosa PA01
cgucaugaccagag

SEQ ID NO: 3453119 - RNA, 18 nt, Pseudomonas aeruginosa PA01
cgucaugaccagagccgc

SEQ ID NO: 3453120 - RNA, 19 nt, Pseudomonas aeruginosa PA01
cgucaugcacuucgaccag

SEQ ID NO: 3453121 - RNA, 14 nt, Pseudomonas aeruginosa PA01
cgucaugccgccgu

SEQ ID NO: 3453122 - RNA, 16 nt, Pseudomonas aeruginosa PA01
cgucaugccgccgucg

SEQ ID NO: 3453123 - RNA, 16 nt, Pseudomonas aeruginosa PA01
cgucauggcgcacgcc

SEQ ID NO: 3453124 - RNA, 19 nt, Pseudomonas aeruginosa PA01
cgucauguuguucgcgcac

SEQ ID NO: 3453125 - RNA, 14 nt, Pseudomonas aeruginosa PA01
cguccaccagccag

SEQ ID NO: 3453126 - RNA, 15 nt, Pseudomonas aeruginosa PA01
cguccaccagccagc

SEQ ID NO: 3453127 - RNA, 15 nt, Pseudomonas aeruginosa PA01
cguccaccagcgccc

SEQ ID NO: 3453128 - RNA, 24 nt, Pseudomonas aeruginosa PA01
cguccaccauaaagcccacacgca

SEQ ID NO: 3453129 - RNA, 21 nt, Pseudomonas aeruginosa PA01
cguccaccgaguggcgcagcg

SEQ ID NO: 3453130 - RNA, 22 nt, Pseudomonas aeruginosa PA01
cguccaccgaguggcgcagcgc

SEQ ID NO: 3453131 - RNA, 15 nt, Pseudomonas aeruginosa PA01
cguccaccgcuucgc

SEQ ID NO: 3453132 - RNA, 14 nt, Pseudomonas aeruginosa PA01
cguccaccuccacc

SEQ ID NO: 3453133 - RNA, 13 nt, Pseudomonas aeruginosa PA01
cguccaccuggcg

SEQ ID NO: 3453134 - RNA, 14 nt, Pseudomonas aeruginosa PA01
cguccaccuggcgg

SEQ ID NO: 3453135 - RNA, 14 nt, Pseudomonas aeruginosa PA01
cguccacggcgcgu

SEQ ID NO: 3453136 - RNA, 18 nt, Pseudomonas aeruginosa PA01
cguccacggcgcgucggc

SEQ ID NO: 3453137 - RNA, 20 nt, Pseudomonas aeruginosa PA01
cguccacguugagcaucacc

SEQ ID NO: 3453138 - RNA, 19 nt, Pseudomonas aeruginosa PA01
cguccacuccggcagcacc

SEQ ID NO: 3453139 - RNA, 21 nt, Pseudomonas aeruginosa PA01
cguccacuccggcagcacccg

SEQ ID NO: 3453140 - RNA, 16 nt, Pseudomonas aeruginosa PA01
cguccacugcguccug

SEQ ID NO: 3453141 - RNA, 19 nt, Pseudomonas aeruginosa PA01
cguccagaugaaacugccc

SEQ ID NO: 3453142 - RNA, 21 nt, Pseudomonas aeruginosa PA01
cguccagaugcuugcacaccu

SEQ ID NO: 3453143 - RNA, 17 nt, Pseudomonas aeruginosa PA01
cguccagcaggacgucg

SEQ ID NO: 3453144 - RNA, 13 nt, Pseudomonas aeruginosa PA01
cguccagccgccg

SEQ ID NO: 3453145 - RNA, 14 nt, Pseudomonas aeruginosa PA01
cguccagccgccgc

SEQ ID NO: 3453146 - RNA, 16 nt, Pseudomonas aeruginosa PA01
cguccagccggcgcuu

SEQ ID NO: 3453147 - RNA, 17 nt, Pseudomonas aeruginosa PA01
cguccagccggcgcuuc

SEQ ID NO: 3453148 - RNA, 16 nt, Pseudomonas aeruginosa PA01
cguccagcgagaacuu

SEQ ID NO: 3453149 - RNA, 14 nt, Pseudomonas aeruginosa PA01
cguccagcgaggcg

SEQ ID NO: 3453150 - RNA, 21 nt, Pseudomonas aeruginosa PA01
cguccagcgccacuuccaggu

SEQ ID NO: 3453151 - RNA, 12 nt, Pseudomonas aeruginosa PA01
cguccagcgccg

SEQ ID NO: 3453152 - RNA, 23 nt, Pseudomonas aeruginosa PA01
cguccagcgccgagacgaucagc

SEQ ID NO: 3453153 - RNA, 14 nt, Pseudomonas aeruginosa PA01
cguccagcgcgccc

SEQ ID NO: 3453154 - RNA, 20 nt, Pseudomonas aeruginosa PA01
cguccagcgcgcccggcgcc

SEQ ID NO: 3453155 - RNA, 19 nt, Pseudomonas aeruginosa PA01
cguccagcgcgccgcgcag

SEQ ID NO: 3453156 - RNA, 22 nt, Pseudomonas aeruginosa PA01
cguccagcgcuugaacgcgcgc

SEQ ID NO: 3453157 - RNA, 23 nt, Pseudomonas aeruginosa PA01
cguccagcgcuugaacgcgcgcc

SEQ ID NO: 3453158 - RNA, 17 nt, Pseudomonas aeruginosa PA01
cguccagcgggcccaug

SEQ ID NO: 3453159 - RNA, 19 nt, Pseudomonas aeruginosa PA01
cguccagcgggcccauggc

SEQ ID NO: 3453160 - RNA, 20 nt, Pseudomonas aeruginosa PA01
cguccagcgggcccauggcg

SEQ ID NO: 3453161 - RNA, 14 nt, Pseudomonas aeruginosa PA01
cguccagcuccacc

SEQ ID NO: 3453162 - RNA, 18 nt, Pseudomonas aeruginosa PA01
cguccagcuccaccaggc

SEQ ID NO: 3453163 - RNA, 22 nt, Pseudomonas aeruginosa PA01
cguccagcucggccaucagcgc

SEQ ID NO: 3453164 - RNA, 22 nt, Pseudomonas aeruginosa PA01
cguccagcuugagguaggccag

SEQ ID NO: 3453165 - RNA, 14 nt, Pseudomonas aeruginosa PA01
cguccaggcaagcg

SEQ ID NO: 3453166 - RNA, 14 nt, Pseudomonas aeruginosa PA01
cguccaggccgccu

SEQ ID NO: 3453167 - RNA, 15 nt, Pseudomonas aeruginosa PA01
cguccaggccgccua

SEQ ID NO: 3453168 - RNA, 16 nt, Pseudomonas aeruginosa PA01
cguccaggcgcgaacg

SEQ ID NO: 3453169 - RNA, 22 nt, Pseudomonas aeruginosa PA01
cguccaggcugccgccuucgcg

SEQ ID NO: 3453170 - RNA, 18 nt, Pseudomonas aeruginosa PA01
cguccagggcuucgacau

SEQ ID NO: 3453171 - RNA, 20 nt, Pseudomonas aeruginosa PA01
cguccagggugcugaccuuc

SEQ ID NO: 3453172 - RNA, 16 nt, Pseudomonas aeruginosa PA01
cguccaggugcggcug

SEQ ID NO: 3453173 - RNA, 18 nt, Pseudomonas aeruginosa PA01
cguccaguagcgccuggu

SEQ ID NO: 3453174 - RNA, 20 nt, Pseudomonas aeruginosa PA01
cguccaguagcgccugguuc

SEQ ID NO: 3453175 - RNA, 18 nt, Pseudomonas aeruginosa PA01
cguccagugcggcagucg

SEQ ID NO: 3453176 - RNA, 22 nt, Pseudomonas aeruginosa PA01
cguccaguuccagggucagcug

SEQ ID NO: 3453177 - RNA, 23 nt, Pseudomonas aeruginosa PA01
cguccaguuccagggucagcugg

SEQ ID NO: 3453178 - RNA, 24 nt, Pseudomonas aeruginosa PA01
cguccauccccgccucgaccagcg

SEQ ID NO: 3453179 - RNA, 22 nt, Pseudomonas aeruginosa PA01
cguccaucccugcuucgaccag

SEQ ID NO: 3453180 - RNA, 15 nt, Pseudomonas aeruginosa PA01
cguccaucgccaggc

SEQ ID NO: 3453181 - RNA, 16 nt, Pseudomonas aeruginosa PA01
cguccaucgccaggcc

SEQ ID NO: 3453182 - RNA, 15 nt, Pseudomonas aeruginosa PA01
cguccaucgccgcgg

SEQ ID NO: 3453183 - RNA, 17 nt, Pseudomonas aeruginosa PA01
cguccaucgccgcggcg

SEQ ID NO: 3453184 - RNA, 17 nt, Pseudomonas aeruginosa PA01
cguccaucuguaccacc

SEQ ID NO: 3453185 - RNA, 22 nt, Pseudomonas aeruginosa PA01
cguccaugccguacaggucggc

SEQ ID NO: 3453186 - RNA, 15 nt, Pseudomonas aeruginosa PA01
cguccauggcggcga

SEQ ID NO: 3453187 - RNA, 16 nt, Pseudomonas aeruginosa PA01
cguccauuuucagcgg

SEQ ID NO: 3453188 - RNA, 14 nt, Pseudomonas aeruginosa PA01
cgucccacaggccg

SEQ ID NO: 3453189 - RNA, 15 nt, Pseudomonas aeruginosa PA01
cgucccacaggccgg

SEQ ID NO: 3453190 - RNA, 16 nt, Pseudomonas aeruginosa PA01
cgucccacaggccggc

SEQ ID NO: 3453191 - RNA, 15 nt, Pseudomonas aeruginosa PA01
cgucccagucggcgu

SEQ ID NO: 3453192 - RNA, 18 nt, Pseudomonas aeruginosa PA01
cgucccagucggcguccg

SEQ ID NO: 3453193 - RNA, 19 nt, Pseudomonas aeruginosa PA01
cgucccagucggcguccgc

SEQ ID NO: 3453194 - RNA, 13 nt, Pseudomonas aeruginosa PA01
cgucccaucgggu

SEQ ID NO: 3453195 - RNA, 20 nt, Pseudomonas aeruginosa PA01
cgucccaugaccgucagcca

SEQ ID NO: 3453196 - RNA, 22 nt, Pseudomonas aeruginosa PA01
cgucccaugaccgucagccagg

SEQ ID NO: 3453197 - RNA, 17 nt, Pseudomonas aeruginosa PA01
cgucccauuccucggcg

SEQ ID NO: 3453198 - RNA, 22 nt, Pseudomonas aeruginosa PA01
cguccccaugcccggccuggcg

SEQ ID NO: 3453199 - RNA, 13 nt, Pseudomonas aeruginosa PA01
cguccuucggcgc

SEQ ID NO: 3453200 - RNA, 22 nt, Pseudomonas aeruginosa PA01
cguccuucuuguauaccagcgg

SEQ ID NO: 3453201 - RNA, 23 nt, Pseudomonas aeruginosa PA01
cguccuucuuguauaccagcggc

SEQ ID NO: 3453202 - RNA, 21 nt, Pseudomonas aeruginosa PA01
cguccuugaguagcuggcgca

SEQ ID NO: 3453203 - RNA, 20 nt, Pseudomonas aeruginosa PA01
cguccuugaguucccagacc

SEQ ID NO: 3453204 - RNA, 19 nt, Pseudomonas aeruginosa PA01
cguccuugguguagccgac

SEQ ID NO: 3453205 - RNA, 18 nt, Pseudomonas aeruginosa PA01
cgucgaaacgggcgcucu

SEQ ID NO: 3453206 - RNA, 20 nt, Pseudomonas aeruginosa PA01
cgucgaacaccggcgccgcc

SEQ ID NO: 3453207 - RNA, 14 nt, Pseudomonas aeruginosa PA01
cgucgaacagcagc

SEQ ID NO: 3453208 - RNA, 16 nt, Pseudomonas aeruginosa PA01
cgucgaacagcagcuc

SEQ ID NO: 3453209 - RNA, 15 nt, Pseudomonas aeruginosa PA01
cgucgaacagcgagu

SEQ ID NO: 3453210 - RNA, 21 nt, Pseudomonas aeruginosa PA01
cgucgaacagguggcuuucca

SEQ ID NO: 3453211 - RNA, 19 nt, Pseudomonas aeruginosa PA01
cgucgaaccagggacgccc

SEQ ID NO: 3453212 - RNA, 13 nt, Pseudomonas aeruginosa PA01
cgucgaacgacuc

SEQ ID NO: 3453213 - RNA, 11 nt, Pseudomonas aeruginosa PA01
cgucgaagcca

SEQ ID NO: 3453214 - RNA, 20 nt, Pseudomonas aeruginosa PA01
cgucgaagccaggcaccgga

SEQ ID NO: 3453215 - RNA, 13 nt, Pseudomonas aeruginosa PA01
cgucgaagcccag

SEQ ID NO: 3453216 - RNA, 14 nt, Pseudomonas aeruginosa PA01
cgucgaagcccagg

SEQ ID NO: 3453217 - RNA, 22 nt, Pseudomonas aeruginosa PA01
cgucgaagccggauucgcgcag

SEQ ID NO: 3453218 - RNA, 15 nt, Pseudomonas aeruginosa PA01
cgucgaagcgcagca

SEQ ID NO: 3453219 - RNA, 16 nt, Pseudomonas aeruginosa PA01
cgucgaagcgcagcag

SEQ ID NO: 3453220 - RNA, 17 nt, Pseudomonas aeruginosa PA01
cgucgaagcgcagcagg

SEQ ID NO: 3453221 - RNA, 23 nt, Pseudomonas aeruginosa PA01
cgucgaagcgcaguacccggccg

SEQ ID NO: 3453222 - RNA, 15 nt, Pseudomonas aeruginosa PA01
cgucgaagcucggcg

SEQ ID NO: 3453223 - RNA, 17 nt, Pseudomonas aeruginosa PA01
cgucgaagcucggcgcg

SEQ ID NO: 3453224 - RNA, 18 nt, Pseudomonas aeruginosa PA01
cgucgaagcugucggccc

SEQ ID NO: 3453225 - RNA, 20 nt, Pseudomonas aeruginosa PA01
cgucgaagcugucggcccgc

SEQ ID NO: 3453226 - RNA, 22 nt, Pseudomonas aeruginosa PA01
cgucgaagcugucggcccgcgc

SEQ ID NO: 3453227 - RNA, 17 nt, Pseudomonas aeruginosa PA01
cgucgaagcugucguag

SEQ ID NO: 3453228 - RNA, 18 nt, Pseudomonas aeruginosa PA01
cgucgaaggccucgucgc

SEQ ID NO: 3453229 - RNA, 13 nt, Pseudomonas aeruginosa PA01
cgucgaaggcggc

SEQ ID NO: 3453230 - RNA, 19 nt, Pseudomonas aeruginosa PA01
cgucgaaggcggcgcggcg

SEQ ID NO: 3453231 - RNA, 16 nt, Pseudomonas aeruginosa PA01
cgucgaagggcacgcc

SEQ ID NO: 3453232 - RNA, 17 nt, Pseudomonas aeruginosa PA01
cgucgaagggcacgccg

SEQ ID NO: 3453233 - RNA, 18 nt, Pseudomonas aeruginosa PA01
cgucgaaugcggcgugga

SEQ ID NO: 3453234 - RNA, 17 nt, Pseudomonas aeruginosa PA01
cgucgaauuggacagca

SEQ ID NO: 3453235 - RNA, 19 nt, Pseudomonas aeruginosa PA01
cgucgaauuggacagcagg

SEQ ID NO: 3453236 - RNA, 20 nt, Pseudomonas aeruginosa PA01
cgucgacacugauauccgcu

SEQ ID NO: 3453237 - RNA, 15 nt, Pseudomonas aeruginosa PA01
cgucgaccaccgcgu

SEQ ID NO: 3453238 - RNA, 18 nt, Pseudomonas aeruginosa PA01
cgucgaccaucaccagcg

SEQ ID NO: 3453239 - RNA, 15 nt, Pseudomonas aeruginosa PA01
cgucgaccauggugu

SEQ ID NO: 3453240 - RNA, 23 nt, Pseudomonas aeruginosa PA01
cgucgaccaugguguuggcggcc

SEQ ID NO: 3453241 - RNA, 18 nt, Pseudomonas aeruginosa PA01
cgucgacccgccucaccc

SEQ ID NO: 3453242 - RNA, 13 nt, Pseudomonas aeruginosa PA01
cgucgaccgccug

SEQ ID NO: 3453243 - RNA, 15 nt, Pseudomonas aeruginosa PA01
cgucgaccgccugcc

SEQ ID NO: 3453244 - RNA, 20 nt, Pseudomonas aeruginosa PA01
cgucgaccgccugccagacc

SEQ ID NO: 3453245 - RNA, 19 nt, Pseudomonas aeruginosa PA01
cgucgaccugcggggcgga

SEQ ID NO: 3453246 - RNA, 23 nt, Pseudomonas aeruginosa PA01
cgucgaccugcggguuggucggc

SEQ ID NO: 3453247 - RNA, 14 nt, Pseudomonas aeruginosa PA01
cgucgacgcagcgc

SEQ ID NO: 3453248 - RNA, 13 nt, Pseudomonas aeruginosa PA01
cgucgacgcccug

SEQ ID NO: 3453249 - RNA, 18 nt, Pseudomonas aeruginosa PA01
cgucgacgcccugggcga

SEQ ID NO: 3453250 - RNA, 13 nt, Pseudomonas aeruginosa PA01
cgucgacgccgag

SEQ ID NO: 3453251 - RNA, 14 nt, Pseudomonas aeruginosa PA01
cgucgacgccgagc

SEQ ID NO: 3453252 - RNA, 14 nt, Pseudomonas aeruginosa PA01
cgucgagaugcugc

SEQ ID NO: 3453253 - RNA, 21 nt, Pseudomonas aeruginosa PA01
cgucgagaugcugcgggcgcc

SEQ ID NO: 3453254 - RNA, 19 nt, Pseudomonas aeruginosa PA01
cgucgagcaccagcagguc

SEQ ID NO: 3453255 - RNA, 15 nt, Pseudomonas aeruginosa PA01
cgucgagcaccaggc

SEQ ID NO: 3453256 - RNA, 14 nt, Pseudomonas aeruginosa PA01
cgucgagcacgccg

SEQ ID NO: 3453257 - RNA, 13 nt, Pseudomonas aeruginosa PA01
cgucgagcagcgc

SEQ ID NO: 3453258 - RNA, 14 nt, Pseudomonas aeruginosa PA01
cgucgagcagcgcg

SEQ ID NO: 3453259 - RNA, 23 nt, Pseudomonas aeruginosa PA01
cgucgagcaucugccgggcgcgc

SEQ ID NO: 3453260 - RNA, 14 nt, Pseudomonas aeruginosa PA01
cgucgagcaugccg

SEQ ID NO: 3453261 - RNA, 16 nt, Pseudomonas aeruginosa PA01
cgucgagccagcccag

SEQ ID NO: 3453262 - RNA, 16 nt, Pseudomonas aeruginosa PA01
cgucgagcgcagcgac

SEQ ID NO: 3453263 - RNA, 16 nt, Pseudomonas aeruginosa PA01
cgucgagcgggcgguc

SEQ ID NO: 3453264 - RNA, 23 nt, Pseudomonas aeruginosa PA01
cgucgagcguuucgcggaaggcg

SEQ ID NO: 3453265 - RNA, 16 nt, Pseudomonas aeruginosa PA01
cgucgagcugcucggc

SEQ ID NO: 3453266 - RNA, 18 nt, Pseudomonas aeruginosa PA01
cgucgagcugcucggcgg

SEQ ID NO: 3453267 - RNA, 19 nt, Pseudomonas aeruginosa PA01
cgucgagcugcucggcggu

SEQ ID NO: 3453268 - RNA, 17 nt, Pseudomonas aeruginosa PA01
cgucgagcuggcgcagg

SEQ ID NO: 3453269 - RNA, 17 nt, Pseudomonas aeruginosa PA01
cgucgaggaaggccagg

SEQ ID NO: 3453270 - RNA, 17 nt, Pseudomonas aeruginosa PA01
cgucgaggaucuucucc

SEQ ID NO: 3453271 - RNA, 22 nt, Pseudomonas aeruginosa PA01
cgucgaggauguacagggucuu

SEQ ID NO: 3453272 - RNA, 19 nt, Pseudomonas aeruginosa PA01
cgucgagggcaaaggcgcg

SEQ ID NO: 3453273 - RNA, 20 nt, Pseudomonas aeruginosa PA01
cgucgagggcaaaggcgcgc

SEQ ID NO: 3453274 - RNA, 21 nt, Pseudomonas aeruginosa PA01
cgucgagggcaaaggcgcgca

SEQ ID NO: 3453275 - RNA, 15 nt, Pseudomonas aeruginosa PA01
cgucgagggccuugu

SEQ ID NO: 3453276 - RNA, 17 nt, Pseudomonas aeruginosa PA01
cgucgagggccuugucg

SEQ ID NO: 3453277 - RNA, 21 nt, Pseudomonas aeruginosa PA01
cgucgagguagaacaggcugc

SEQ ID NO: 3453278 - RNA, 23 nt, Pseudomonas aeruginosa PA01
cgucgagguagaacaggcugccg

SEQ ID NO: 3453279 - RNA, 14 nt, Pseudomonas aeruginosa PA01
cgucgagguagucg

SEQ ID NO: 3453280 - RNA, 14 nt, Pseudomonas aeruginosa PA01
cgucgaggucgacg

SEQ ID NO: 3453281 - RNA, 16 nt, Pseudomonas aeruginosa PA01
cgucgaggucgacggc

SEQ ID NO: 3453282 - RNA, 19 nt, Pseudomonas aeruginosa PA01
cgucgaggucgacggcggc

SEQ ID NO: 3453283 - RNA, 22 nt, Pseudomonas aeruginosa PA01
cgucgaggucgacggcggccgc

SEQ ID NO: 3453284 - RNA, 23 nt, Pseudomonas aeruginosa PA01
cgucgaggugcggcugccggugc

SEQ ID NO: 3453285 - RNA, 15 nt, Pseudomonas aeruginosa PA01
cgucgaguaccgcug

SEQ ID NO: 3453286 - RNA, 22 nt, Pseudomonas aeruginosa PA01
cgucgaguaccgcugcggccgg

SEQ ID NO: 3453287 - RNA, 17 nt, Pseudomonas aeruginosa PA01
cgucgauauccagcggc

SEQ ID NO: 3453288 - RNA, 18 nt, Pseudomonas aeruginosa PA01
cgucgauauccagcggca

SEQ ID NO: 3453289 - RNA, 20 nt, Pseudomonas aeruginosa PA01
cgucgauauccagcggcagc

SEQ ID NO: 3453290 - RNA, 21 nt, Pseudomonas aeruginosa PA01
cgucgauauccagcggcagcc

SEQ ID NO: 3453291 - RNA, 22 nt, Pseudomonas aeruginosa PA01
cgucgaucaccuugcccucgcg

SEQ ID NO: 3453292 - RNA, 12 nt, Pseudomonas aeruginosa PA01
cgucgaucaggu

SEQ ID NO: 3453293 - RNA, 16 nt, Pseudomonas aeruginosa PA01
cgucgaucagguccug

SEQ ID NO: 3453294 - RNA, 15 nt, Pseudomonas aeruginosa PA01
cgucgaucaucugcu

SEQ ID NO: 3453295 - RNA, 20 nt, Pseudomonas aeruginosa PA01
cgucgaucaucugcugcagc

SEQ ID NO: 3453296 - RNA, 22 nt, Pseudomonas aeruginosa PA01
cgucgaucucgagcaugucggc

SEQ ID NO: 3453297 - RNA, 21 nt, Pseudomonas aeruginosa PA01
cgucgaucucgccgaaggugc

SEQ ID NO: 3453298 - RNA, 16 nt, Pseudomonas aeruginosa PA01
cgucgaucugcucguc

SEQ ID NO: 3453299 - RNA, 23 nt, Pseudomonas aeruginosa PA01
cgucgaucugcucguccaggccg

SEQ ID NO: 3453300 - RNA, 19 nt, Pseudomonas aeruginosa PA01
cgucgaucuugaggaagug

SEQ ID NO: 3453301 - RNA, 16 nt, Pseudomonas aeruginosa PA01
cgucgcucauccgcga

SEQ ID NO: 3453302 - RNA, 19 nt, Pseudomonas aeruginosa PA01
cgucgcucauccgcgaggc

SEQ ID NO: 3453303 - RNA, 13 nt, Pseudomonas aeruginosa PA01
cgucgcugccgcc

SEQ ID NO: 3453304 - RNA, 14 nt, Pseudomonas aeruginosa PA01
cgucgcugccgccg

SEQ ID NO: 3453305 - RNA, 15 nt, Pseudomonas aeruginosa PA01
cgucgcugccgccgc

SEQ ID NO: 3453306 - RNA, 17 nt, Pseudomonas aeruginosa PA01
cgucgcugccgccgcgc

SEQ ID NO: 3453307 - RNA, 16 nt, Pseudomonas aeruginosa PA01
cgucgcugcgcaacug

SEQ ID NO: 3453308 - RNA, 17 nt, Pseudomonas aeruginosa PA01
cgucgcuggagcugcgc

SEQ ID NO: 3453309 - RNA, 14 nt, Pseudomonas aeruginosa PA01
cgucgcuggcgaug

SEQ ID NO: 3453310 - RNA, 17 nt, Pseudomonas aeruginosa PA01
cgucgcuguagcggcuc

SEQ ID NO: 3453311 - RNA, 20 nt, Pseudomonas aeruginosa PA01
cgucgcuguagcggcucgcc

SEQ ID NO: 3453312 - RNA, 23 nt, Pseudomonas aeruginosa PA01
cgucgcuguagcggcucgccgaa

SEQ ID NO: 3453313 - RNA, 17 nt, Pseudomonas aeruginosa PA01
cgucgcuuccggcgcca

SEQ ID NO: 3453314 - RNA, 18 nt, Pseudomonas aeruginosa PA01
cgucgcuuccggcgccaa

SEQ ID NO: 3453315 - RNA, 20 nt, Pseudomonas aeruginosa PA01
cgucgcuuccggcgccaacc

SEQ ID NO: 3453316 - RNA, 14 nt, Pseudomonas aeruginosa PA01
cgucgcuucgcccg

SEQ ID NO: 3453317 - RNA, 18 nt, Pseudomonas aeruginosa PA01
cgucgcuucgcccgccgc

SEQ ID NO: 3453318 - RNA, 19 nt, Pseudomonas aeruginosa PA01
cgucgcuucgcccgccgcc

SEQ ID NO: 3453319 - RNA, 19 nt, Pseudomonas aeruginosa PA01
cgucggaagcgucagccgc

SEQ ID NO: 3453320 - RNA, 21 nt, Pseudomonas aeruginosa PA01
cgucggacuugaugaccgucc

SEQ ID NO: 3453321 - RNA, 15 nt, Pseudomonas aeruginosa PA01
cgucggacuugcggc

SEQ ID NO: 3453322 - RNA, 20 nt, Pseudomonas aeruginosa PA01
cgucggagauagccuccucc

SEQ ID NO: 3453323 - RNA, 19 nt, Pseudomonas aeruginosa PA01
cgucggauggccguccagg

SEQ ID NO: 3453324 - RNA, 20 nt, Pseudomonas aeruginosa PA01
cgucggauggccguccaggc

SEQ ID NO: 3453325 - RNA, 16 nt, Pseudomonas aeruginosa PA01
cgucggcaagcaggcc

SEQ ID NO: 3453326 - RNA, 17 nt, Pseudomonas aeruginosa PA01
cgucggcaagcaggccg

SEQ ID NO: 3453327 - RNA, 18 nt, Pseudomonas aeruginosa PA01
cgucggcaagcaggccgc

SEQ ID NO: 3453328 - RNA, 13 nt, Pseudomonas aeruginosa PA01
cgucggcacgccg

SEQ ID NO: 3453329 - RNA, 14 nt, Pseudomonas aeruginosa PA01
cgucggcacgccga

SEQ ID NO: 3453330 - RNA, 18 nt, Pseudomonas aeruginosa PA01
cgucggcacgccgaaguc

SEQ ID NO: 3453331 - RNA, 21 nt, Pseudomonas aeruginosa PA01
cgucggcaguggugauccgca

SEQ ID NO: 3453332 - RNA, 13 nt, Pseudomonas aeruginosa PA01
cgucggcauggcu

SEQ ID NO: 3453333 - RNA, 18 nt, Pseudomonas aeruginosa PA01
cgucggcauggcuguagg

SEQ ID NO: 3453334 - RNA, 20 nt, Pseudomonas aeruginosa PA01
cgucggcccuccccuggccc

SEQ ID NO: 3453335 - RNA, 20 nt, Pseudomonas aeruginosa PA01
cgucggcccuugugaaaggg

SEQ ID NO: 3453336 - RNA, 11 nt, Pseudomonas aeruginosa PA01
cgucggccggg

SEQ ID NO: 3453337 - RNA, 19 nt, Pseudomonas aeruginosa PA01
cgucggccggggucaggcc

SEQ ID NO: 3453338 - RNA, 13 nt, Pseudomonas aeruginosa PA01
cgucggccucgcc

SEQ ID NO: 3453339 - RNA, 21 nt, Pseudomonas aeruginosa PA01
cgucggccugcucgaacggcg

SEQ ID NO: 3453340 - RNA, 16 nt, Pseudomonas aeruginosa PA01
cgucggccuggcgcag

SEQ ID NO: 3453341 - RNA, 17 nt, Pseudomonas aeruginosa PA01
cgucggccuggcgcagc

SEQ ID NO: 3453342 - RNA, 12 nt, Pseudomonas aeruginosa PA01
cgucggccuuga

SEQ ID NO: 3453343 - RNA, 20 nt, Pseudomonas aeruginosa PA01
cgucggcgaacccggcgcgg

SEQ ID NO: 3453344 - RNA, 22 nt, Pseudomonas aeruginosa PA01
cgucggcgaacccggcgcggcg

SEQ ID NO: 3453345 - RNA, 18 nt, Pseudomonas aeruginosa PA01
cgucggcgaagccugcgg

SEQ ID NO: 3453346 - RNA, 20 nt, Pseudomonas aeruginosa PA01
cgucggcgaagccugcggcg

SEQ ID NO: 3453347 - RNA, 13 nt, Pseudomonas aeruginosa PA01
cgucggcgacgcu

SEQ ID NO: 3453348 - RNA, 16 nt, Pseudomonas aeruginosa PA01
cgucggcgagcaggcg

SEQ ID NO: 3453349 - RNA, 14 nt, Pseudomonas aeruginosa PA01
cgucggcgaucacg

SEQ ID NO: 3453350 - RNA, 13 nt, Pseudomonas aeruginosa PA01
cgucggcgaucgc

SEQ ID NO: 3453351 - RNA, 15 nt, Pseudomonas aeruginosa PA01
cgucggcgaucgcca

SEQ ID NO: 3453352 - RNA, 16 nt, Pseudomonas aeruginosa PA01
cgucggcgaucgccag

SEQ ID NO: 3453353 - RNA, 17 nt, Pseudomonas aeruginosa PA01
cgucggcgaucgccagu

SEQ ID NO: 3453354 - RNA, 12 nt, Pseudomonas aeruginosa PA01
cgucggcgcccu

SEQ ID NO: 3453355 - RNA, 15 nt, Pseudomonas aeruginosa PA01
cgucggcgccuuccu

SEQ ID NO: 3453356 - RNA, 19 nt, Pseudomonas aeruginosa PA01
cgucggcgcggccggcgcc

SEQ ID NO: 3453357 - RNA, 15 nt, Pseudomonas aeruginosa PA01
cgucggcgcgggcgc

SEQ ID NO: 3453358 - RNA, 18 nt, Pseudomonas aeruginosa PA01
cgucggcgcgggcgccga

SEQ ID NO: 3453359 - RNA, 19 nt, Pseudomonas aeruginosa PA01
cgucggcgcgggcgccgau

SEQ ID NO: 3453360 - RNA, 21 nt, Pseudomonas aeruginosa PA01
cgucggcgcgggcgccgaugc

SEQ ID NO: 3453361 - RNA, 16 nt, Pseudomonas aeruginosa PA01
cgucggcgcggggcgu

SEQ ID NO: 3453362 - RNA, 19 nt, Pseudomonas aeruginosa PA01
cgucggcggcacccucuuc

SEQ ID NO: 3453363 - RNA, 13 nt, Pseudomonas aeruginosa PA01
cgucggcggcgga

SEQ ID NO: 3453364 - RNA, 18 nt, Pseudomonas aeruginosa PA01
cgucggcgggaagggucu

SEQ ID NO: 3453365 - RNA, 14 nt, Pseudomonas aeruginosa PA01
cgucggcggggcgc

SEQ ID NO: 3453366 - RNA, 14 nt, Pseudomonas aeruginosa PA01
cgucggcggucagc

SEQ ID NO: 3453367 - RNA, 20 nt, Pseudomonas aeruginosa PA01
cgucggcggucagcuugccc

SEQ ID NO: 3453368 - RNA, 21 nt, Pseudomonas aeruginosa PA01
cgucggcguccauggcggcga

SEQ ID NO: 3453369 - RNA, 17 nt, Pseudomonas aeruginosa PA01
cgucggcgucgaggugc

SEQ ID NO: 3453370 - RNA, 15 nt, Pseudomonas aeruginosa PA01
cgucggcgucggcug

SEQ ID NO: 3453371 - RNA, 23 nt, Pseudomonas aeruginosa PA01
cgucggcgugcugggucuccucc

SEQ ID NO: 3453372 - RNA, 21 nt, Pseudomonas aeruginosa PA01
cgucggcgugguugccugcug

SEQ ID NO: 3453373 - RNA, 16 nt, Pseudomonas aeruginosa PA01
cgucggcguugcugau

SEQ ID NO: 3453374 - RNA, 13 nt, Pseudomonas aeruginosa PA01
cgucggcuccgcu

SEQ ID NO: 3453375 - RNA, 15 nt, Pseudomonas aeruginosa PA01
cgucggcuccgcuca

SEQ ID NO: 3453376 - RNA, 13 nt, Pseudomonas aeruginosa PA01
cgucggcugcgcu

SEQ ID NO: 3453377 - RNA, 20 nt, Pseudomonas aeruginosa PA01
cgucggcugcgcugggcgcc

SEQ ID NO: 3453378 - RNA, 19 nt, Pseudomonas aeruginosa PA01
cgucgggacgcaugcgcgg

SEQ ID NO: 3453379 - RNA, 23 nt, Pseudomonas aeruginosa PA01
cgucgggaucgagcaacagcagg

SEQ ID NO: 3453380 - RNA, 24 nt, Pseudomonas aeruginosa PA01
cgucgggcagaguggcgcggcuga

SEQ ID NO: 3453381 - RNA, 20 nt, Pseudomonas aeruginosa PA01
cgucgggcaguacucaugac

SEQ ID NO: 3453382 - RNA, 20 nt, Pseudomonas aeruginosa PA01
cgucgggcaguuccgccaga

SEQ ID NO: 3453383 - RNA, 20 nt, Pseudomonas aeruginosa PA01
cgucgggcgaaacggcaggc

SEQ ID NO: 3453384 - RNA, 21 nt, Pseudomonas aeruginosa PA01
cgucgggcgaaacggcaggcc

SEQ ID NO: 3453385 - RNA, 22 nt, Pseudomonas aeruginosa PA01
cgucgggcgaaacggcaggcca

SEQ ID NO: 3453386 - RNA, 23 nt, Pseudomonas aeruginosa PA01
cgucgggcgaaacggcaggccag

SEQ ID NO: 3453387 - RNA, 13 nt, Pseudomonas aeruginosa PA01
cgucgggggcgcg

SEQ ID NO: 3453388 - RNA, 14 nt, Pseudomonas aeruginosa PA01
cgucgggggcgcgu

SEQ ID NO: 3453389 - RNA, 17 nt, Pseudomonas aeruginosa PA01
cgucggggugccgccag

SEQ ID NO: 3453390 - RNA, 18 nt, Pseudomonas aeruginosa PA01
cgucggggugccgccagu

SEQ ID NO: 3453391 - RNA, 21 nt, Pseudomonas aeruginosa PA01
cgucggucauguccggggcga

SEQ ID NO: 3453392 - RNA, 13 nt, Pseudomonas aeruginosa PA01
cgucggucggcca

SEQ ID NO: 3453393 - RNA, 19 nt, Pseudomonas aeruginosa PA01
cgucggucggccaggacgc

SEQ ID NO: 3453394 - RNA, 21 nt, Pseudomonas aeruginosa PA01
cgucggugaucgagacgccgu

SEQ ID NO: 3453395 - RNA, 16 nt, Pseudomonas aeruginosa PA01
cgucgguucagcgcgg

SEQ ID NO: 3453396 - RNA, 22 nt, Pseudomonas aeruginosa PA01
cgucgguucagcgcggagcguc

SEQ ID NO: 3453397 - RNA, 14 nt, Pseudomonas aeruginosa PA01
cgucguacucggcg

SEQ ID NO: 3453398 - RNA, 17 nt, Pseudomonas aeruginosa PA01
cgucguacucggcgggg

SEQ ID NO: 3453399 - RNA, 17 nt, Pseudomonas aeruginosa PA01
cgucguacuucagcguc

SEQ ID NO: 3453400 - RNA, 21 nt, Pseudomonas aeruginosa PA01
cgucguagccaggcaccaccu

SEQ ID NO: 3453401 - RNA, 21 nt, Pseudomonas aeruginosa PA01
cgucguagcccuucuccgcca

SEQ ID NO: 3453402 - RNA, 14 nt, Pseudomonas aeruginosa PA01
cgucguagcgcagc

SEQ ID NO: 3453403 - RNA, 22 nt, Pseudomonas aeruginosa PA01
cgugaccauaggcuugcgccga

SEQ ID NO: 3453404 - RNA, 13 nt, Pseudomonas aeruginosa PA01
cgugacccgcgcu

SEQ ID NO: 3453405 - RNA, 19 nt, Pseudomonas aeruginosa PA01
cgugacccgcgcuuccagg

SEQ ID NO: 3453406 - RNA, 14 nt, Pseudomonas aeruginosa PA01
cgugacgucggcgg

SEQ ID NO: 3453407 - RNA, 17 nt, Pseudomonas aeruginosa PA01
cgugagcagggccgagc

SEQ ID NO: 3453408 - RNA, 21 nt, Pseudomonas aeruginosa PA01
cgugagcuuguccagggcgcc

SEQ ID NO: 3453409 - RNA, 14 nt, Pseudomonas aeruginosa PA01
cgugaggcgcgcgc

SEQ ID NO: 3453410 - RNA, 19 nt, Pseudomonas aeruginosa PA01
cgugaggcgcgcgccgaac

SEQ ID NO: 3453411 - RNA, 20 nt, Pseudomonas aeruginosa PA01
cgugaggcgcgcgccgaacu

SEQ ID NO: 3453412 - RNA, 15 nt, Pseudomonas aeruginosa PA01
cgugagggucgcgcc

SEQ ID NO: 3453413 - RNA, 18 nt, Pseudomonas aeruginosa PA01
cgugagggucgcgccgac

SEQ ID NO: 3453414 - RNA, 17 nt, Pseudomonas aeruginosa PA01
cgugauacagcucgcug

SEQ ID NO: 3453415 - RNA, 13 nt, Pseudomonas aeruginosa PA01
cgugaucccgcgc

SEQ ID NO: 3453416 - RNA, 18 nt, Pseudomonas aeruginosa PA01
cgugaucccgcgcgggcc

SEQ ID NO: 3453417 - RNA, 21 nt, Pseudomonas aeruginosa PA01
cgugaucccgcgcgggccgag

SEQ ID NO: 3453418 - RNA, 12 nt, Pseudomonas aeruginosa PA01
cgugaugcccag

SEQ ID NO: 3453419 - RNA, 17 nt, Pseudomonas aeruginosa PA01
cgugaugcccagcggcg

SEQ ID NO: 3453420 - RNA, 20 nt, Pseudomonas aeruginosa PA01
cgugaugcccagcggcgcca

SEQ ID NO: 3453421 - RNA, 22 nt, Pseudomonas aeruginosa PA01
cgugaugcccagcggcgccagc

SEQ ID NO: 3453422 - RNA, 18 nt, Pseudomonas aeruginosa PA01
cgugcaccagcaggcgac

SEQ ID NO: 3453423 - RNA, 14 nt, Pseudomonas aeruginosa PA01
cgugcaccgaggcg

SEQ ID NO: 3453424 - RNA, 15 nt, Pseudomonas aeruginosa PA01
cgugcaccgaggcgc

SEQ ID NO: 3453425 - RNA, 19 nt, Pseudomonas aeruginosa PA01
cgugcaccgaggcgcgccg

SEQ ID NO: 3453426 - RNA, 23 nt, Pseudomonas aeruginosa PA01
cgugcaccgaggcgcgccgacag

SEQ ID NO: 3453427 - RNA, 19 nt, Pseudomonas aeruginosa PA01
cgugcagcaagccgcagcg

SEQ ID NO: 3453428 - RNA, 21 nt, Pseudomonas aeruginosa PA01
cgugcagcaagccgcagcgcc

SEQ ID NO: 3453429 - RNA, 21 nt, Pseudomonas aeruginosa PA01
cgugcagcagcgccuucaccg

SEQ ID NO: 3453430 - RNA, 19 nt, Pseudomonas aeruginosa PA01
cgugcagcccggucacgcc

SEQ ID NO: 3453431 - RNA, 17 nt, Pseudomonas aeruginosa PA01
cgugcagcggcagcguc

SEQ ID NO: 3453432 - RNA, 14 nt, Pseudomonas aeruginosa PA01
cgugcagcucggca

SEQ ID NO: 3453433 - RNA, 16 nt, Pseudomonas aeruginosa PA01
cgugcagcucggcacg

SEQ ID NO: 3453434 - RNA, 20 nt, Pseudomonas aeruginosa PA01
cgugcagcucggcacgcagc

SEQ ID NO: 3453435 - RNA, 22 nt, Pseudomonas aeruginosa PA01
cgugcagcucggcacgcagcag

SEQ ID NO: 3453436 - RNA, 14 nt, Pseudomonas aeruginosa PA01
cgugcagcuuggcg

SEQ ID NO: 3453437 - RNA, 16 nt, Pseudomonas aeruginosa PA01
cgugcaggaucaccug

SEQ ID NO: 3453438 - RNA, 20 nt, Pseudomonas aeruginosa PA01
cgugcaggaucaccugcuuc

SEQ ID NO: 3453439 - RNA, 13 nt, Pseudomonas aeruginosa PA01
cgugcaggccgau

SEQ ID NO: 3453440 - RNA, 14 nt, Pseudomonas aeruginosa PA01
cgugcaggccgauc

SEQ ID NO: 3453441 - RNA, 15 nt, Pseudomonas aeruginosa PA01
cgugcaggccgccga

SEQ ID NO: 3453442 - RNA, 19 nt, Pseudomonas aeruginosa PA01
cgugcaggcgcccuggccg

SEQ ID NO: 3453443 - RNA, 22 nt, Pseudomonas aeruginosa PA01
cgugcaggguauuuuccagcag

SEQ ID NO: 3453444 - RNA, 23 nt, Pseudomonas aeruginosa PA01
cgugcaggguauuuuccagcagg

SEQ ID NO: 3453445 - RNA, 14 nt, Pseudomonas aeruginosa PA01
cgugcagggucagg

SEQ ID NO: 3453446 - RNA, 23 nt, Pseudomonas aeruginosa PA01
cgugcagguagcagccguccagc

SEQ ID NO: 3453447 - RNA, 13 nt, Pseudomonas aeruginosa PA01
cgugcagguagcc

SEQ ID NO: 3453448 - RNA, 17 nt, Pseudomonas aeruginosa PA01
cgugcagguagccgcgc

SEQ ID NO: 3453449 - RNA, 20 nt, Pseudomonas aeruginosa PA01
cgugcagguagccgcgccgg

SEQ ID NO: 3453450 - RNA, 23 nt, Pseudomonas aeruginosa PA01
cgugcagguguucggcggcgugc

SEQ ID NO: 3453451 - RNA, 19 nt, Pseudomonas aeruginosa PA01
cgugcaguacuuggccagc

SEQ ID NO: 3453452 - RNA, 21 nt, Pseudomonas aeruginosa PA01
cgugcaguacuuggccagcag

SEQ ID NO: 3453453 - RNA, 22 nt, Pseudomonas aeruginosa PA01
cgugcaguacuuggccagcagc

SEQ ID NO: 3453454 - RNA, 23 nt, Pseudomonas aeruginosa PA01
cgugcaguacuuggccagcagca

SEQ ID NO: 3453455 - RNA, 19 nt, Pseudomonas aeruginosa PA01
cgugcaucaccggcagcag

SEQ ID NO: 3453456 - RNA, 20 nt, Pseudomonas aeruginosa PA01
cgugcaucaccggcagcagc

SEQ ID NO: 3453457 - RNA, 21 nt, Pseudomonas aeruginosa PA01
cgugcaucaccggcagcagcg

SEQ ID NO: 3453458 - RNA, 17 nt, Pseudomonas aeruginosa PA01
cgugcaucaccuugucg

SEQ ID NO: 3453459 - RNA, 19 nt, Pseudomonas aeruginosa PA01
cgugcaucaccuugucgca

SEQ ID NO: 3453460 - RNA, 22 nt, Pseudomonas aeruginosa PA01
cgugcaugccgacgagcagcuc

SEQ ID NO: 3453461 - RNA, 14 nt, Pseudomonas aeruginosa PA01
cgugcauggccggg

SEQ ID NO: 3453462 - RNA, 14 nt, Pseudomonas aeruginosa PA01
cgugcauuuccugg

SEQ ID NO: 3453463 - RNA, 17 nt, Pseudomonas aeruginosa PA01
cgugcauuuccuggacg

SEQ ID NO: 3453464 - RNA, 15 nt, Pseudomonas aeruginosa PA01
cgugccaggcggcag

SEQ ID NO: 3453465 - RNA, 16 nt, Pseudomonas aeruginosa PA01
cgugccaggcggcagc

SEQ ID NO: 3453466 - RNA, 24 nt, Pseudomonas aeruginosa PA01
cgugccagggcuucccaggccagc

SEQ ID NO: 3453467 - RNA, 17 nt, Pseudomonas aeruginosa PA01
cgugccaucaggccgcg

SEQ ID NO: 3453468 - RNA, 14 nt, Pseudomonas aeruginosa PA01
cgugccccaggccg

SEQ ID NO: 3453469 - RNA, 16 nt, Pseudomonas aeruginosa PA01
cgugccccaggccgaa

SEQ ID NO: 3453470 - RNA, 17 nt, Pseudomonas aeruginosa PA01
cgugccccguggcgggc

SEQ ID NO: 3453471 - RNA, 19 nt, Pseudomonas aeruginosa PA01
cgugccccguggcgggcca

SEQ ID NO: 3453472 - RNA, 22 nt, Pseudomonas aeruginosa PA01
cgugccccguggcgggccagca

SEQ ID NO: 3453473 - RNA, 17 nt, Pseudomonas aeruginosa PA01
cgugcccgccggcgcgc

SEQ ID NO: 3453474 - RNA, 22 nt, Pseudomonas aeruginosa PA01
cgugcccgccggcgcgcccagg

SEQ ID NO: 3453475 - RNA, 20 nt, Pseudomonas aeruginosa PA01
cgugcccuuuuccuccaggg

SEQ ID NO: 3453476 - RNA, 14 nt, Pseudomonas aeruginosa PA01
cgugccgccaggcc

SEQ ID NO: 3453477 - RNA, 15 nt, Pseudomonas aeruginosa PA01
cgugccgccaggccu

SEQ ID NO: 3453478 - RNA, 17 nt, Pseudomonas aeruginosa PA01
cgugccgccaggccuuc

SEQ ID NO: 3453479 - RNA, 16 nt, Pseudomonas aeruginosa PA01
cgugccgccaucgccu

SEQ ID NO: 3453480 - RNA, 18 nt, Pseudomonas aeruginosa PA01
cgugccgccaucgccucg

SEQ ID NO: 3453481 - RNA, 21 nt, Pseudomonas aeruginosa PA01
cgugccgccaucgccucgccg

SEQ ID NO: 3453482 - RNA, 23 nt, Pseudomonas aeruginosa PA01
cgugccgccaucgccucgccggc

SEQ ID NO: 3453483 - RNA, 14 nt, Pseudomonas aeruginosa PA01
cgugccgccggacc

SEQ ID NO: 3453484 - RNA, 20 nt, Pseudomonas aeruginosa PA01
cgugccgccggaccgucgcg

SEQ ID NO: 3453485 - RNA, 14 nt, Pseudomonas aeruginosa PA01
cgugccgccggggc

SEQ ID NO: 3453486 - RNA, 20 nt, Pseudomonas aeruginosa PA01
cgugccgccugggcggucgg

SEQ ID NO: 3453487 - RNA, 13 nt, Pseudomonas aeruginosa PA01
cgugccgcuggcc

SEQ ID NO: 3453488 - RNA, 14 nt, Pseudomonas aeruginosa PA01
cgugccgcuggccg

SEQ ID NO: 3453489 - RNA, 15 nt, Pseudomonas aeruginosa PA01
cgugccgcuggccga

SEQ ID NO: 3453490 - RNA, 16 nt, Pseudomonas aeruginosa PA01
cgugccgcuggccgac

SEQ ID NO: 3453491 - RNA, 17 nt, Pseudomonas aeruginosa PA01
cgugccgcuggccgacc

SEQ ID NO: 3453492 - RNA, 12 nt, Pseudomonas aeruginosa PA01
cgugccgggcag

SEQ ID NO: 3453493 - RNA, 14 nt, Pseudomonas aeruginosa PA01
cgugccgggccggc

SEQ ID NO: 3453494 - RNA, 16 nt, Pseudomonas aeruginosa PA01
cgugccgggccggcca

SEQ ID NO: 3453495 - RNA, 23 nt, Pseudomonas aeruginosa PA01
cgugccggguauccagcacccgc

SEQ ID NO: 3453496 - RNA, 17 nt, Pseudomonas aeruginosa PA01
cgugccggucgcgcagc

SEQ ID NO: 3453497 - RNA, 22 nt, Pseudomonas aeruginosa PA01
cgugccguggaccaacagccgg

SEQ ID NO: 3453498 - RNA, 19 nt, Pseudomonas aeruginosa PA01
cgugccguggcucggcggc

SEQ ID NO: 3453499 - RNA, 22 nt, Pseudomonas aeruginosa PA01
cgugccguggcucggcggcagg

SEQ ID NO: 3453500 - RNA, 14 nt, Pseudomonas aeruginosa PA01
cgugccuccagccu

SEQ ID NO: 3453501 - RNA, 12 nt, Pseudomonas aeruginosa PA01
cgugccucggcg

SEQ ID NO: 3453502 - RNA, 14 nt, Pseudomonas aeruginosa PA01
cgugccucggcgga

SEQ ID NO: 3453503 - RNA, 18 nt, Pseudomonas aeruginosa PA01
cgugcgaacacaccgacc

SEQ ID NO: 3453504 - RNA, 17 nt, Pseudomonas aeruginosa PA01
cgugcgagggcggcggc

SEQ ID NO: 3453505 - RNA, 16 nt, Pseudomonas aeruginosa PA01
cguggcgccggcgcgc

SEQ ID NO: 3453506 - RNA, 20 nt, Pseudomonas aeruginosa PA01
cguggcgcggacgggccgcg

SEQ ID NO: 3453507 - RNA, 15 nt, Pseudomonas aeruginosa PA01
cguggcgcuugagca

SEQ ID NO: 3453508 - RNA, 19 nt, Pseudomonas aeruginosa PA01
cguggcgcuugagcagcca

SEQ ID NO: 3453509 - RNA, 22 nt, Pseudomonas aeruginosa PA01
cguggcgcuugagcagccaggc

SEQ ID NO: 3453510 - RNA, 19 nt, Pseudomonas aeruginosa PA01
cguggcggaagaaucgcag

SEQ ID NO: 3453511 - RNA, 17 nt, Pseudomonas aeruginosa PA01
cguggcggaaggucagg

SEQ ID NO: 3453512 - RNA, 22 nt, Pseudomonas aeruginosa PA01
cguggcggacaacccggcgcug

SEQ ID NO: 3453513 - RNA, 12 nt, Pseudomonas aeruginosa PA01
cguggcggccgc

SEQ ID NO: 3453514 - RNA, 15 nt, Pseudomonas aeruginosa PA01
cguggcggccgccgc

SEQ ID NO: 3453515 - RNA, 16 nt, Pseudomonas aeruginosa PA01
cguggcggccgccggc

SEQ ID NO: 3453516 - RNA, 13 nt, Pseudomonas aeruginosa PA01
cguggcggcgcgc

SEQ ID NO: 3453517 - RNA, 14 nt, Pseudomonas aeruginosa PA01
cguggcgggccagc

SEQ ID NO: 3453518 - RNA, 16 nt, Pseudomonas aeruginosa PA01
cguggcgggccagcag

SEQ ID NO: 3453519 - RNA, 23 nt, Pseudomonas aeruginosa PA01
cguggcgggccagcaggcgcucg

SEQ ID NO: 3453520 - RNA, 14 nt, Pseudomonas aeruginosa PA01
cguggcgucggcgc

SEQ ID NO: 3453521 - RNA, 15 nt, Pseudomonas aeruginosa PA01
cguggcgucggcgcu

SEQ ID NO: 3453522 - RNA, 19 nt, Pseudomonas aeruginosa PA01
cguggcgugcucggcgauc

SEQ ID NO: 3453523 - RNA, 15 nt, Pseudomonas aeruginosa PA01
cguggcucgaucagc

SEQ ID NO: 3453524 - RNA, 21 nt, Pseudomonas aeruginosa PA01
cguggcucgaucagccggcgc

SEQ ID NO: 3453525 - RNA, 13 nt, Pseudomonas aeruginosa PA01
cguggcucggcgg

SEQ ID NO: 3453526 - RNA, 14 nt, Pseudomonas aeruginosa PA01
cguggcugccggag

SEQ ID NO: 3453527 - RNA, 13 nt, Pseudomonas aeruginosa PA01
cguggcuggcgcc

SEQ ID NO: 3453528 - RNA, 15 nt, Pseudomonas aeruginosa PA01
cguggcuggcgccgc

SEQ ID NO: 3453529 - RNA, 16 nt, Pseudomonas aeruginosa PA01
cguggcuggcgccgcg

SEQ ID NO: 3453530 - RNA, 21 nt, Pseudomonas aeruginosa PA01
cguggcuggggccggccuggg

SEQ ID NO: 3453531 - RNA, 17 nt, Pseudomonas aeruginosa PA01
cguggcugugcuggcca

SEQ ID NO: 3453532 - RNA, 15 nt, Pseudomonas aeruginosa PA01
cguggcuucguccag

SEQ ID NO: 3453533 - RNA, 16 nt, Pseudomonas aeruginosa PA01
cguggcuucguccagc

SEQ ID NO: 3453534 - RNA, 20 nt, Pseudomonas aeruginosa PA01
cguggcuucguccagcgagg

SEQ ID NO: 3453535 - RNA, 14 nt, Pseudomonas aeruginosa PA01
cguggcuuggcccu

SEQ ID NO: 3453536 - RNA, 16 nt, Pseudomonas aeruginosa PA01
cguggcuuggcccugc

SEQ ID NO: 3453537 - RNA, 16 nt, Pseudomonas aeruginosa PA01
cgugggaucgccacgc

SEQ ID NO: 3453538 - RNA, 17 nt, Pseudomonas aeruginosa PA01
cgugggaucgccacgcc

SEQ ID NO: 3453539 - RNA, 13 nt, Pseudomonas aeruginosa PA01
cgugggcaacagg

SEQ ID NO: 3453540 - RNA, 16 nt, Pseudomonas aeruginosa PA01
cgugggcaacaggccg

SEQ ID NO: 3453541 - RNA, 17 nt, Pseudomonas aeruginosa PA01
cgugggcaacaggccga

SEQ ID NO: 3453542 - RNA, 18 nt, Pseudomonas aeruginosa PA01
cgugggcaacaggccgau

SEQ ID NO: 3453543 - RNA, 15 nt, Pseudomonas aeruginosa PA01
cgugggccaccauca

SEQ ID NO: 3453544 - RNA, 16 nt, Pseudomonas aeruginosa PA01
cgugggccaccaucag

SEQ ID NO: 3453545 - RNA, 14 nt, Pseudomonas aeruginosa PA01
cgugggccagcagg

SEQ ID NO: 3453546 - RNA, 17 nt, Pseudomonas aeruginosa PA01
cgugggccagcccagaa

SEQ ID NO: 3453547 - RNA, 20 nt, Pseudomonas aeruginosa PA01
cgugggccagcccagaacag

SEQ ID NO: 3453548 - RNA, 13 nt, Pseudomonas aeruginosa PA01
cgugggccgccga

SEQ ID NO: 3453549 - RNA, 15 nt, Pseudomonas aeruginosa PA01
cgugggccgccgaac

SEQ ID NO: 3453550 - RNA, 13 nt, Pseudomonas aeruginosa PA01
cgugggccggcgc

SEQ ID NO: 3453551 - RNA, 15 nt, Pseudomonas aeruginosa PA01
cgugggccggcgcgc

SEQ ID NO: 3453552 - RNA, 17 nt, Pseudomonas aeruginosa PA01
cgugggccggcgcgccg

SEQ ID NO: 3453553 - RNA, 12 nt, Pseudomonas aeruginosa PA01
cgugggccugcu

SEQ ID NO: 3453554 - RNA, 19 nt, Pseudomonas aeruginosa PA01
cgugggccugcuccucggc

SEQ ID NO: 3453555 - RNA, 14 nt, Pseudomonas aeruginosa PA01
cgugggcgccgccg

SEQ ID NO: 3453556 - RNA, 18 nt, Pseudomonas aeruginosa PA01
cgugggcgccgccgguga

SEQ ID NO: 3453557 - RNA, 13 nt, Pseudomonas aeruginosa PA01
cgugggcgccggc

SEQ ID NO: 3453558 - RNA, 15 nt, Pseudomonas aeruginosa PA01
cgugggcggccggcc

SEQ ID NO: 3453559 - RNA, 16 nt, Pseudomonas aeruginosa PA01
cgugggcggucggcga

SEQ ID NO: 3453560 - RNA, 23 nt, Pseudomonas aeruginosa PA01
cgugggcguaguagggacggugc

SEQ ID NO: 3453561 - RNA, 21 nt, Pseudomonas aeruginosa PA01
cgugggcuucgccgccgcgcg

SEQ ID NO: 3453562 - RNA, 19 nt, Pseudomonas aeruginosa PA01
cguggggaagacggccagg

SEQ ID NO: 3453563 - RNA, 15 nt, Pseudomonas aeruginosa PA01
cgugggggggaaggg

SEQ ID NO: 3453564 - RNA, 17 nt, Pseudomonas aeruginosa PA01
cgugggguauuccaggc

SEQ ID NO: 3453565 - RNA, 18 nt, Pseudomonas aeruginosa PA01
cguggguccacgccgggc

SEQ ID NO: 3453566 - RNA, 21 nt, Pseudomonas aeruginosa PA01
cgugggugccgggggcggcga

SEQ ID NO: 3453567 - RNA, 16 nt, Pseudomonas aeruginosa PA01
cgugguagucgagccg

SEQ ID NO: 3453568 - RNA, 14 nt, Pseudomonas aeruginosa PA01
cguggucauggcgc

SEQ ID NO: 3453569 - RNA, 17 nt, Pseudomonas aeruginosa PA01
cguggucauggcgcaga

SEQ ID NO: 3453570 - RNA, 20 nt, Pseudomonas aeruginosa PA01
cguggucauggcgcagacga

SEQ ID NO: 3453571 - RNA, 14 nt, Pseudomonas aeruginosa PA01
cgugguccgccagc

SEQ ID NO: 3453572 - RNA, 17 nt, Pseudomonas aeruginosa PA01
cgugguccgccagcagg

SEQ ID NO: 3453573 - RNA, 19 nt, Pseudomonas aeruginosa PA01
cgugguccgccagcaggcg

SEQ ID NO: 3453574 - RNA, 13 nt, Pseudomonas aeruginosa PA01
cguggucgccgcu

SEQ ID NO: 3453575 - RNA, 23 nt, Pseudomonas aeruginosa PA01
cguggucgccgcucauccgcugg

SEQ ID NO: 3453576 - RNA, 16 nt, Pseudomonas aeruginosa PA01
cguggucgccguccac

SEQ ID NO: 3453577 - RNA, 14 nt, Pseudomonas aeruginosa PA01
cguggucgcgcagg

SEQ ID NO: 3453578 - RNA, 14 nt, Pseudomonas aeruginosa PA01
cguggucggcggcc

SEQ ID NO: 3453579 - RNA, 17 nt, Pseudomonas aeruginosa PA01
cguggucggcggccucg

SEQ ID NO: 3453580 - RNA, 17 nt, Pseudomonas aeruginosa PA01
cguggucuccgugcugg

SEQ ID NO: 3453581 - RNA, 18 nt, Pseudomonas aeruginosa PA01
cguggucuccgugcuggc

SEQ ID NO: 3453582 - RNA, 19 nt, Pseudomonas aeruginosa PA01
cguggucuccgugcuggcc

SEQ ID NO: 3453583 - RNA, 16 nt, Pseudomonas aeruginosa PA01
cguggucuuccucggu

SEQ ID NO: 3453584 - RNA, 16 nt, Pseudomonas aeruginosa PA01
cguggugacgguccgc

SEQ ID NO: 3453585 - RNA, 18 nt, Pseudomonas aeruginosa PA01
cguggugacgguccgcgc

SEQ ID NO: 3453586 - RNA, 23 nt, Pseudomonas aeruginosa PA01
cguggugauguccccccuacgaa

SEQ ID NO: 3453587 - RNA, 14 nt, Pseudomonas aeruginosa PA01
cguggugcuaucga

SEQ ID NO: 3453588 - RNA, 13 nt, Pseudomonas aeruginosa PA01
cgugguggccgug

SEQ ID NO: 3453589 - RNA, 18 nt, Pseudomonas aeruginosa PA01
cgugguucucggucgggc

SEQ ID NO: 3453590 - RNA, 14 nt, Pseudomonas aeruginosa PA01
cgugguugaggcgc

SEQ ID NO: 3453591 - RNA, 15 nt, Pseudomonas aeruginosa PA01
cgugguugaggcgcu

SEQ ID NO: 3453592 - RNA, 17 nt, Pseudomonas aeruginosa PA01
cgugguugaggcgcucg

SEQ ID NO: 3453593 - RNA, 15 nt, Pseudomonas aeruginosa PA01
cguguaccacgcccg

SEQ ID NO: 3453594 - RNA, 14 nt, Pseudomonas aeruginosa PA01
cguguaggguucgc

SEQ ID NO: 3453595 - RNA, 16 nt, Pseudomonas aeruginosa PA01
cgugucgaagccuucg

SEQ ID NO: 3453596 - RNA, 21 nt, Pseudomonas aeruginosa PA01
cgugucgacucagcgggcgcg

SEQ ID NO: 3453597 - RNA, 22 nt, Pseudomonas aeruginosa PA01
cgugucgaggaaggccagcagg

SEQ ID NO: 3453598 - RNA, 19 nt, Pseudomonas aeruginosa PA01
cgugucgagggcgaacagc

SEQ ID NO: 3453599 - RNA, 21 nt, Pseudomonas aeruginosa PA01
cgugucgagggcugggcagcg

SEQ ID NO: 3453600 - RNA, 16 nt, Pseudomonas aeruginosa PA01
cgugucgccuuccggc

SEQ ID NO: 3453601 - RNA, 13 nt, Pseudomonas aeruginosa PA01
cgugucggcggcg

SEQ ID NO: 3453602 - RNA, 13 nt, Pseudomonas aeruginosa PA01
cgugugcagcagg

SEQ ID NO: 3453603 - RNA, 20 nt, Pseudomonas aeruginosa PA01
cgugugccugagcuggcugu

SEQ ID NO: 3453604 - RNA, 15 nt, Pseudomonas aeruginosa PA01
cguguucgaccgggu

SEQ ID NO: 3453605 - RNA, 23 nt, Pseudomonas aeruginosa PA01
cguguucgcggcucuggcgcagg

SEQ ID NO: 3453606 - RNA, 13 nt, Pseudomonas aeruginosa PA01
cguguucggcggc

SEQ ID NO: 3453607 - RNA, 18 nt, Pseudomonas aeruginosa PA01
cguguugaucgccgcgcc

SEQ ID NO: 3453608 - RNA, 22 nt, Pseudomonas aeruginosa PA01
cguguugaucgccgcgccgccg

SEQ ID NO: 3453609 - RNA, 21 nt, Pseudomonas aeruginosa PA01
cguucggcuguuucaggccgg

SEQ ID NO: 3453610 - RNA, 20 nt, Pseudomonas aeruginosa PA01
cguucggggcccuccaggcg

SEQ ID NO: 3453611 - RNA, 23 nt, Pseudomonas aeruginosa PA01
cguucggucaggcugaucggcgc

SEQ ID NO: 3453612 - RNA, 17 nt, Pseudomonas aeruginosa PA01
cguucgucgccgacugc

SEQ ID NO: 3453613 - RNA, 15 nt, Pseudomonas aeruginosa PA01
cguucgucguggcca

SEQ ID NO: 3453614 - RNA, 17 nt, Pseudomonas aeruginosa PA01
cguucucauugcgccgc

SEQ ID NO: 3453615 - RNA, 19 nt, Pseudomonas aeruginosa PA01
cguucuccaggucgaacag

SEQ ID NO: 3453616 - RNA, 14 nt, Pseudomonas aeruginosa PA01
cguucucccugagc

SEQ ID NO: 3453617 - RNA, 19 nt, Pseudomonas aeruginosa PA01
cguucucgaagagcuggcg

SEQ ID NO: 3453618 - RNA, 22 nt, Pseudomonas aeruginosa PA01
cguucucgaagagcuggcggcc

SEQ ID NO: 3453619 - RNA, 23 nt, Pseudomonas aeruginosa PA01
cguucucgaucaucgccagcggc

SEQ ID NO: 3453620 - RNA, 14 nt, Pseudomonas aeruginosa PA01
cguucucggccagg

SEQ ID NO: 3453621 - RNA, 16 nt, Pseudomonas aeruginosa PA01
cguucucggccaggua

SEQ ID NO: 3453622 - RNA, 18 nt, Pseudomonas aeruginosa PA01
cguucucggccagguacu

SEQ ID NO: 3453623 - RNA, 17 nt, Pseudomonas aeruginosa PA01
cguucugcugcuugcgc

SEQ ID NO: 3453624 - RNA, 23 nt, Pseudomonas aeruginosa PA01
cguucuguucgucccgagcaccg

SEQ ID NO: 3453625 - RNA, 20 nt, Pseudomonas aeruginosa PA01
cguucuucacccgcagcggc

SEQ ID NO: 3453626 - RNA, 13 nt, Pseudomonas aeruginosa PA01
cguucuuccugag

SEQ ID NO: 3453627 - RNA, 21 nt, Pseudomonas aeruginosa PA01
cguucuugaccuucugcaccg

SEQ ID NO: 3453628 - RNA, 18 nt, Pseudomonas aeruginosa PA01
cguucuugaucaccgcgg

SEQ ID NO: 3453629 - RNA, 16 nt, Pseudomonas aeruginosa PA01
cguugaaacgcucggc

SEQ ID NO: 3453630 - RNA, 18 nt, Pseudomonas aeruginosa PA01
cguugaaacgcucggcgu

SEQ ID NO: 3453631 - RNA, 17 nt, Pseudomonas aeruginosa PA01
cguugaaagucugcacc

SEQ ID NO: 3453632 - RNA, 16 nt, Pseudomonas aeruginosa PA01
cguugaacacaucgac

SEQ ID NO: 3453633 - RNA, 14 nt, Pseudomonas aeruginosa PA01
cguugaccagcgcg

SEQ ID NO: 3453634 - RNA, 23 nt, Pseudomonas aeruginosa PA01
cguugaccgugaugcccagcggc

SEQ ID NO: 3453635 - RNA, 17 nt, Pseudomonas aeruginosa PA01
cguugacgaucgccccg

SEQ ID NO: 3453636 - RNA, 22 nt, Pseudomonas aeruginosa PA01
cguugacgaucugcgagcgcac

SEQ ID NO: 3453637 - RNA, 17 nt, Pseudomonas aeruginosa PA01
cguugagcaucaccgcg

SEQ ID NO: 3453638 - RNA, 17 nt, Pseudomonas aeruginosa PA01
cguugaucacgaacagc

SEQ ID NO: 3453639 - RNA, 13 nt, Pseudomonas aeruginosa PA01
cguugauccgcgu

SEQ ID NO: 3453640 - RNA, 18 nt, Pseudomonas aeruginosa PA01
cguugaucggcaacgagc

SEQ ID NO: 3453641 - RNA, 18 nt, Pseudomonas aeruginosa PA01
cguugaugucgaccacga

SEQ ID NO: 3453642 - RNA, 17 nt, Pseudomonas aeruginosa PA01
cguugcaauugcaggcc

SEQ ID NO: 3453643 - RNA, 21 nt, Pseudomonas aeruginosa PA01
cguugcaauugcaggcccggc

SEQ ID NO: 3453644 - RNA, 22 nt, Pseudomonas aeruginosa PA01
cguugcaauugcaggcccggcc

SEQ ID NO: 3453645 - RNA, 15 nt, Pseudomonas aeruginosa PA01
cguugcacagcgccc

SEQ ID NO: 3453646 - RNA, 20 nt, Pseudomonas aeruginosa PA01
cguugcacagcgcccagaca

SEQ ID NO: 3453647 - RNA, 14 nt, Pseudomonas aeruginosa PA01
cguugcacgcaggc

SEQ ID NO: 3453648 - RNA, 21 nt, Pseudomonas aeruginosa PA01
cguugcacgcaggccgcugcc

SEQ ID NO: 3453649 - RNA, 13 nt, Pseudomonas aeruginosa PA01
cguugcagcgccu

SEQ ID NO: 3453650 - RNA, 15 nt, Pseudomonas aeruginosa PA01
cguugcagcgccugu

SEQ ID NO: 3453651 - RNA, 23 nt, Pseudomonas aeruginosa PA01
cguugcagcgccuguuccagggc

SEQ ID NO: 3453652 - RNA, 18 nt, Pseudomonas aeruginosa PA01
cguugcagcgucuguacc

SEQ ID NO: 3453653 - RNA, 22 nt, Pseudomonas aeruginosa PA01
cguugcaggcacggaagcgcug

SEQ ID NO: 3453654 - RNA, 14 nt, Pseudomonas aeruginosa PA01
cguugcaggcccag

SEQ ID NO: 3453655 - RNA, 13 nt, Pseudomonas aeruginosa PA01
cguugcaggucga

SEQ ID NO: 3453656 - RNA, 15 nt, Pseudomonas aeruginosa PA01
cguugcaguccaggc

SEQ ID NO: 3453657 - RNA, 16 nt, Pseudomonas aeruginosa PA01
cguugcagugcgccgc

SEQ ID NO: 3453658 - RNA, 19 nt, Pseudomonas aeruginosa PA01
cguugcauguccucggcgc

SEQ ID NO: 3453659 - RNA, 20 nt, Pseudomonas aeruginosa PA01
cguugcauguccucggcgcc

SEQ ID NO: 3453660 - RNA, 16 nt, Pseudomonas aeruginosa PA01
cguugccagccggccu

SEQ ID NO: 3453661 - RNA, 18 nt, Pseudomonas aeruginosa PA01
cguugccauagccgacga

SEQ ID NO: 3453662 - RNA, 20 nt, Pseudomonas aeruginosa PA01
cguugccauagccgacgaag

SEQ ID NO: 3453663 - RNA, 17 nt, Pseudomonas aeruginosa PA01
cguugccauccagcgcc

SEQ ID NO: 3453664 - RNA, 11 nt, Pseudomonas aeruginosa PA01
cguugcccagc

SEQ ID NO: 3453665 - RNA, 15 nt, Pseudomonas aeruginosa PA01
cguugcccagcccca

SEQ ID NO: 3453666 - RNA, 23 nt, Pseudomonas aeruginosa PA01
cguugcccagccccaccgccagg

SEQ ID NO: 3453667 - RNA, 22 nt, Pseudomonas aeruginosa PA01
cguugcccuuguacagcuucag

SEQ ID NO: 3453668 - RNA, 21 nt, Pseudomonas aeruginosa PA01
cguugccgcgcgggccggcga

SEQ ID NO: 3453669 - RNA, 23 nt, Pseudomonas aeruginosa PA01
cguugccgcgcgggccggcgaug

SEQ ID NO: 3453670 - RNA, 14 nt, Pseudomonas aeruginosa PA01
cguugccggacuuc

SEQ ID NO: 3453671 - RNA, 16 nt, Pseudomonas aeruginosa PA01
cguugccggacuuccu

SEQ ID NO: 3453672 - RNA, 17 nt, Pseudomonas aeruginosa PA01
cguugccggcauugcac

SEQ ID NO: 3453673 - RNA, 20 nt, Pseudomonas aeruginosa PA01
cguugccggcauugcacuuc

SEQ ID NO: 3453674 - RNA, 22 nt, Pseudomonas aeruginosa PA01
cguugccggcauugcacuucca

SEQ ID NO: 3453675 - RNA, 13 nt, Pseudomonas aeruginosa PA01
cguugccgucgag

SEQ ID NO: 3453676 - RNA, 14 nt, Pseudomonas aeruginosa PA01
cguugccgucgagc

SEQ ID NO: 3453677 - RNA, 16 nt, Pseudomonas aeruginosa PA01
cguugccgucgagcac

SEQ ID NO: 3453678 - RNA, 20 nt, Pseudomonas aeruginosa PA01
cguugccgucgagcaccagc

SEQ ID NO: 3453679 - RNA, 18 nt, Pseudomonas aeruginosa PA01
cguugccuucgccgucga

SEQ ID NO: 3453680 - RNA, 22 nt, Pseudomonas aeruginosa PA01
cguugcgagggcucgggcgcgg

SEQ ID NO: 3453681 - RNA, 22 nt, Pseudomonas aeruginosa PA01
cguugcgaugggugccgcgcag

SEQ ID NO: 3453682 - RNA, 12 nt, Pseudomonas aeruginosa PA01
cguugcgcaggg

SEQ ID NO: 3453683 - RNA, 20 nt, Pseudomonas aeruginosa PA01
cguugcgcaggggcgcggcg

SEQ ID NO: 3453684 - RNA, 20 nt, Pseudomonas aeruginosa PA01
cguugcgcauuugcacgucg

SEQ ID NO: 3453685 - RNA, 19 nt, Pseudomonas aeruginosa PA01
cguugcgccagaccagccc

SEQ ID NO: 3453686 - RNA, 22 nt, Pseudomonas aeruginosa PA01
cguugcgccagaccagccccag

SEQ ID NO: 3453687 - RNA, 23 nt, Pseudomonas aeruginosa PA01
cguugcgccccgggucgcugcuc

SEQ ID NO: 3453688 - RNA, 13 nt, Pseudomonas aeruginosa PA01
cguugcgccgcag

SEQ ID NO: 3453689 - RNA, 14 nt, Pseudomonas aeruginosa PA01
cguugcgccgcagc

SEQ ID NO: 3453690 - RNA, 17 nt, Pseudomonas aeruginosa PA01
cguugcgccgcagcggc

SEQ ID NO: 3453691 - RNA, 13 nt, Pseudomonas aeruginosa PA01
cguugcgccgcuc

SEQ ID NO: 3453692 - RNA, 18 nt, Pseudomonas aeruginosa PA01
cguugcgccgcuccuggc

SEQ ID NO: 3453693 - RNA, 22 nt, Pseudomonas aeruginosa PA01
cguugcgccgcuccuggcaggc

SEQ ID NO: 3453694 - RNA, 23 nt, Pseudomonas aeruginosa PA01
cguugcgccgcuccuggcaggcu

SEQ ID NO: 3453695 - RNA, 20 nt, Pseudomonas aeruginosa PA01
cguugcgccggcccagcagg

SEQ ID NO: 3453696 - RNA, 21 nt, Pseudomonas aeruginosa PA01
cguugcgccggcccagcaggc

SEQ ID NO: 3453697 - RNA, 17 nt, Pseudomonas aeruginosa PA01
cguugcgccucgccgcc

SEQ ID NO: 3453698 - RNA, 19 nt, Pseudomonas aeruginosa PA01
cguugcgccucgccgcccg

SEQ ID NO: 3453699 - RNA, 16 nt, Pseudomonas aeruginosa PA01
cguugcgcgcauagca

SEQ ID NO: 3453700 - RNA, 20 nt, Pseudomonas aeruginosa PA01
cguugcgcgcauagcaggcc

SEQ ID NO: 3453701 - RNA, 14 nt, Pseudomonas aeruginosa PA01
cguugcgcgccagc

SEQ ID NO: 3453702 - RNA, 15 nt, Pseudomonas aeruginosa PA01
cguugcgcgccagcg

SEQ ID NO: 3453703 - RNA, 16 nt, Pseudomonas aeruginosa PA01
cguugcgcgccagcgc

SEQ ID NO: 3453704 - RNA, 13 nt, Pseudomonas aeruginosa PA01
cguugcgcggcag

SEQ ID NO: 3453705 - RNA, 20 nt, Pseudomonas aeruginosa PA01
cguugcgcuaucggcccggg

SEQ ID NO: 3453706 - RNA, 19 nt, Pseudomonas aeruginosa PA01
cguugcggaaagcgacgcc

SEQ ID NO: 3453707 - RNA, 18 nt, Pseudomonas aeruginosa PA01
cguugcggcccuucauca

SEQ ID NO: 3453708 - RNA, 16 nt, Pseudomonas aeruginosa PA01
cguugcgguagugccc

SEQ ID NO: 3453709 - RNA, 14 nt, Pseudomonas aeruginosa PA01
cguugcucacgccg

SEQ ID NO: 3453710 - RNA, 15 nt, Pseudomonas aeruginosa PA01
cguugcuccugcggc

SEQ ID NO: 3453711 - RNA, 13 nt, Pseudomonas aeruginosa PA01
cuacaggaccuuc

SEQ ID NO: 3453712 - RNA, 15 nt, Pseudomonas aeruginosa PA01
cuacaucgucugcgc

SEQ ID NO: 3453713 - RNA, 19 nt, Pseudomonas aeruginosa PA01
cuacaucgucugcgcggcg

SEQ ID NO: 3453714 - RNA, 13 nt, Pseudomonas aeruginosa PA01
cuaccagaccgca

SEQ ID NO: 3453715 - RNA, 13 nt, Pseudomonas aeruginosa PA01
cuaccagcaauuc

SEQ ID NO: 3453716 - RNA, 18 nt, Pseudomonas aeruginosa PA01
cuaccaggaagcucggca

SEQ ID NO: 3453717 - RNA, 20 nt, Pseudomonas aeruginosa PA01
cuaccagguucugccagagc

SEQ ID NO: 3453718 - RNA, 22 nt, Pseudomonas aeruginosa PA01
cuaccagguucugccagagcgc

SEQ ID NO: 3453719 - RNA, 19 nt, Pseudomonas aeruginosa PA01
cuaccaguaguucuccacc

SEQ ID NO: 3453720 - RNA, 22 nt, Pseudomonas aeruginosa PA01
cuaccaguaguucuccaccgcc

SEQ ID NO: 3453721 - RNA, 21 nt, Pseudomonas aeruginosa PA01
cuacccagguggucgaccagg

SEQ ID NO: 3453722 - RNA, 21 nt, Pseudomonas aeruginosa PA01
cuaccccaggggucggcaucg

SEQ ID NO: 3453723 - RNA, 19 nt, Pseudomonas aeruginosa PA01
cuacccgacaggcagcgcc

SEQ ID NO: 3453724 - RNA, 13 nt, Pseudomonas aeruginosa PA01
cuacccgcgcuuc

SEQ ID NO: 3453725 - RNA, 14 nt, Pseudomonas aeruginosa PA01
cuacccgcgcuucu

SEQ ID NO: 3453726 - RNA, 22 nt, Pseudomonas aeruginosa PA01
cuacccucaggggugcagcccu

SEQ ID NO: 3453727 - RNA, 13 nt, Pseudomonas aeruginosa PA01
cuacccucucccc

SEQ ID NO: 3453728 - RNA, 15 nt, Pseudomonas aeruginosa PA01
cuaccgccgagggcg

SEQ ID NO: 3453729 - RNA, 16 nt, Pseudomonas aeruginosa PA01
cuaccgcgcauggcgg

SEQ ID NO: 3453730 - RNA, 20 nt, Pseudomonas aeruginosa PA01
cuaccgcugggacggcggcu

SEQ ID NO: 3453731 - RNA, 20 nt, Pseudomonas aeruginosa PA01
cuaccggcagggucacgccg

SEQ ID NO: 3453732 - RNA, 12 nt, Pseudomonas aeruginosa PA01
cuaccggcgccg

SEQ ID NO: 3453733 - RNA, 23 nt, Pseudomonas aeruginosa PA01
cuaccgucacgcggacccaguug

SEQ ID NO: 3453734 - RNA, 15 nt, Pseudomonas aeruginosa PA01
cuaccgucggccugc

SEQ ID NO: 3453735 - RNA, 14 nt, Pseudomonas aeruginosa PA01
cuaccugcgugcgc

SEQ ID NO: 3453736 - RNA, 19 nt, Pseudomonas aeruginosa PA01
cuaccugcgugcgccguag

SEQ ID NO: 3453737 - RNA, 12 nt, Pseudomonas aeruginosa PA01
cuaccuggcgcu

SEQ ID NO: 3453738 - RNA, 15 nt, Pseudomonas aeruginosa PA01
cuaccugucccggac

SEQ ID NO: 3453739 - RNA, 17 nt, Pseudomonas aeruginosa PA01
cuaccugucccggacga

SEQ ID NO: 3453740 - RNA, 13 nt, Pseudomonas aeruginosa PA01
cuaccuucgauca

SEQ ID NO: 3453741 - RNA, 23 nt, Pseudomonas aeruginosa PA01
cuacgaaggcgugccgcuggccg

SEQ ID NO: 3453742 - RNA, 16 nt, Pseudomonas aeruginosa PA01
cuacgcaacccgcccg

SEQ ID NO: 3453743 - RNA, 17 nt, Pseudomonas aeruginosa PA01
cuacgcaacccgcccgg

SEQ ID NO: 3453744 - RNA, 20 nt, Pseudomonas aeruginosa PA01
cuacgccauacugggcggcg

SEQ ID NO: 3453745 - RNA, 17 nt, Pseudomonas aeruginosa PA01
cuacgccuugcggcgcc

SEQ ID NO: 3453746 - RNA, 18 nt, Pseudomonas aeruginosa PA01
cuacgcgaccggucaggc

SEQ ID NO: 3453747 - RNA, 18 nt, Pseudomonas aeruginosa PA01
cuacgcggcgggagguca

SEQ ID NO: 3453748 - RNA, 13 nt, Pseudomonas aeruginosa PA01
cuacgcucgccga

SEQ ID NO: 3453749 - RNA, 21 nt, Pseudomonas aeruginosa PA01
cuacgcucggggugcgcggcg

SEQ ID NO: 3453750 - RNA, 20 nt, Pseudomonas aeruginosa PA01
cuacggggacaugucgaggg

SEQ ID NO: 3453751 - RNA, 19 nt, Pseudomonas aeruginosa PA01
cuacggggcgugucgaggg

SEQ ID NO: 3453752 - RNA, 13 nt, Pseudomonas aeruginosa PA01
cuacguuccaggg

SEQ ID NO: 3453753 - RNA, 16 nt, Pseudomonas aeruginosa PA01
cuacguuccagggccu

SEQ ID NO: 3453754 - RNA, 20 nt, Pseudomonas aeruginosa PA01
cuacguuccagggccuggua

SEQ ID NO: 3453755 - RNA, 12 nt, Pseudomonas aeruginosa PA01
cuacuaccgcca

SEQ ID NO: 3453756 - RNA, 14 nt, Pseudomonas aeruginosa PA01
cuacuaccgccagc

SEQ ID NO: 3453757 - RNA, 18 nt, Pseudomonas aeruginosa PA01
cuacuccaggggucggca

SEQ ID NO: 3453758 - RNA, 15 nt, Pseudomonas aeruginosa PA01
cuacucgacgcugcc

SEQ ID NO: 3453759 - RNA, 21 nt, Pseudomonas aeruginosa PA01
cuacucgacgcugcccagccc

SEQ ID NO: 3453760 - RNA, 23 nt, Pseudomonas aeruginosa PA01
cuacucgacgcugcccagcccgc

SEQ ID NO: 3453761 - RNA, 13 nt, Pseudomonas aeruginosa PA01
cuacugcgcgggc

SEQ ID NO: 3453762 - RNA, 19 nt, Pseudomonas aeruginosa PA01
cuacugcgcgggcaugcac

SEQ ID NO: 3453763 - RNA, 22 nt, Pseudomonas aeruginosa PA01
cuacugggcguggcggccgccg

SEQ ID NO: 3453764 - RNA, 17 nt, Pseudomonas aeruginosa PA01
cuacuucccugccggcg

SEQ ID NO: 3453765 - RNA, 18 nt, Pseudomonas aeruginosa PA01
cuacuucgccggguggaa

SEQ ID NO: 3453766 - RNA, 15 nt, Pseudomonas aeruginosa PA01
cuagacccugggcca

SEQ ID NO: 3453767 - RNA, 14 nt, Pseudomonas aeruginosa PA01
cuagcccucgaccu

SEQ ID NO: 3453768 - RNA, 15 nt, Pseudomonas aeruginosa PA01
cuagcccucgaccug

SEQ ID NO: 3453769 - RNA, 18 nt, Pseudomonas aeruginosa PA01
cuagcccucgaccuggcu

SEQ ID NO: 3453770 - RNA, 14 nt, Pseudomonas aeruginosa PA01
cuagcccugcugcu

SEQ ID NO: 3453771 - RNA, 15 nt, Pseudomonas aeruginosa PA01
cuagcccugcugcuc

SEQ ID NO: 3453772 - RNA, 17 nt, Pseudomonas aeruginosa PA01
cuagcccugcugcucgc

SEQ ID NO: 3453773 - RNA, 12 nt, Pseudomonas aeruginosa PA01
cuagcgaaggcu

SEQ ID NO: 3453774 - RNA, 13 nt, Pseudomonas aeruginosa PA01
cuagcgcauggcg

SEQ ID NO: 3453775 - RNA, 23 nt, Pseudomonas aeruginosa PA01
cuagcgcauggcgaccugguggc

SEQ ID NO: 3453776 - RNA, 17 nt, Pseudomonas aeruginosa PA01
cuagcgccccggccgcg

SEQ ID NO: 3453777 - RNA, 22 nt, Pseudomonas aeruginosa PA01
cuagcggguggcaacugccgcc

SEQ ID NO: 3453778 - RNA, 22 nt, Pseudomonas aeruginosa PA01
cuaggccaugaucuggcugucg

SEQ ID NO: 3453779 - RNA, 19 nt, Pseudomonas aeruginosa PA01
cuaggcuggaagccgcgcu

SEQ ID NO: 3453780 - RNA, 20 nt, Pseudomonas aeruginosa PA01
cuaggcuggaagccgcgcuc

SEQ ID NO: 3453781 - RNA, 12 nt, Pseudomonas aeruginosa PA01
cuagucuuccug

SEQ ID NO: 3453782 - RNA, 21 nt, Pseudomonas aeruginosa PA01
cuaucaggugagggcgaccca

SEQ ID NO: 3453783 - RNA, 16 nt, Pseudomonas aeruginosa PA01
cuaucccgugccgggc

SEQ ID NO: 3453784 - RNA, 17 nt, Pseudomonas aeruginosa PA01
cuauccuccaggccgcc

SEQ ID NO: 3453785 - RNA, 21 nt, Pseudomonas aeruginosa PA01
cuaucgaucacugccuggcag

SEQ ID NO: 3453786 - RNA, 21 nt, Pseudomonas aeruginosa PA01
cuaucgccaacgccaccgcgc

SEQ ID NO: 3453787 - RNA, 19 nt, Pseudomonas aeruginosa PA01
cuaucgccgccgcagccgu

SEQ ID NO: 3453788 - RNA, 16 nt, Pseudomonas aeruginosa PA01
cuaucgcuggcgcagc

SEQ ID NO: 3453789 - RNA, 16 nt, Pseudomonas aeruginosa PA01
cuaucgcuuucagcaa

SEQ ID NO: 3453790 - RNA, 19 nt, Pseudomonas aeruginosa PA01
cuaucgggcagggcagccg

SEQ ID NO: 3453791 - RNA, 22 nt, Pseudomonas aeruginosa PA01
cuaucgggcagggcagccgccg

SEQ ID NO: 3453792 - RNA, 23 nt, Pseudomonas aeruginosa PA01
cuaucgggcagggcagccgccgc

SEQ ID NO: 3453793 - RNA, 12 nt, Pseudomonas aeruginosa PA01
cuaucgggccga

SEQ ID NO: 3453794 - RNA, 16 nt, Pseudomonas aeruginosa PA01
cuaucgggccgaucga

SEQ ID NO: 3453795 - RNA, 21 nt, Pseudomonas aeruginosa PA01
cuaugcgccguuacgccgggu

SEQ ID NO: 3453796 - RNA, 14 nt, Pseudomonas aeruginosa PA01
cuaugggacgaccu

SEQ ID NO: 3453797 - RNA, 21 nt, Pseudomonas aeruginosa PA01
cuauggguggcccuuucaaug

SEQ ID NO: 3453798 - RNA, 22 nt, Pseudomonas aeruginosa PA01
cuauguauucggcgguccaggg

SEQ ID NO: 3453799 - RNA, 15 nt, Pseudomonas aeruginosa PA01
cuauucccgccgcuc

SEQ ID NO: 3453800 - RNA, 18 nt, Pseudomonas aeruginosa PA01
cuauuccgccaccagcca

SEQ ID NO: 3453801 - RNA, 18 nt, Pseudomonas aeruginosa PA01
cuauuccggggacgcugu

SEQ ID NO: 3453802 - RNA, 20 nt, Pseudomonas aeruginosa PA01
cuauuccggggacgcugucc

SEQ ID NO: 3453803 - RNA, 21 nt, Pseudomonas aeruginosa PA01
cuauuccggggacgcuguccc

SEQ ID NO: 3453804 - RNA, 18 nt, Pseudomonas aeruginosa PA01
cuauuccuugcgccaugc

SEQ ID NO: 3453805 - RNA, 17 nt, Pseudomonas aeruginosa PA01
cucaaaagggugucggg

SEQ ID NO: 3453806 - RNA, 15 nt, Pseudomonas aeruginosa PA01
cucaaccggcguccc

SEQ ID NO: 3453807 - RNA, 14 nt, Pseudomonas aeruginosa PA01
cucaacgaccgccc

SEQ ID NO: 3453808 - RNA, 13 nt, Pseudomonas aeruginosa PA01
cucaacggcgugc

SEQ ID NO: 3453809 - RNA, 14 nt, Pseudomonas aeruginosa PA01
cucaacggcgugcc

SEQ ID NO: 3453810 - RNA, 15 nt, Pseudomonas aeruginosa PA01
cucaacggcgugccg

SEQ ID NO: 3453811 - RNA, 15 nt, Pseudomonas aeruginosa PA01
cucaacgggaccguc

SEQ ID NO: 3453812 - RNA, 19 nt, Pseudomonas aeruginosa PA01
cucaacugguuggccgccu

SEQ ID NO: 3453813 - RNA, 15 nt, Pseudomonas aeruginosa PA01
cucaagcaagcgauc

SEQ ID NO: 3453814 - RNA, 15 nt, Pseudomonas aeruginosa PA01
cucagggccgcgccg

SEQ ID NO: 3453815 - RNA, 23 nt, Pseudomonas aeruginosa PA01
cucagggccgcgccgagccggcu

SEQ ID NO: 3453816 - RNA, 12 nt, Pseudomonas aeruginosa PA01
cucagggcucca

SEQ ID NO: 3453817 - RNA, 16 nt, Pseudomonas aeruginosa PA01
cucaggggugcagccc

SEQ ID NO: 3453818 - RNA, 17 nt, Pseudomonas aeruginosa PA01
cucaggguggucgauga

SEQ ID NO: 3453819 - RNA, 14 nt, Pseudomonas aeruginosa PA01
cucaggucggcgcc

SEQ ID NO: 3453820 - RNA, 16 nt, Pseudomonas aeruginosa PA01
cucaggucgucgagga

SEQ ID NO: 3453821 - RNA, 14 nt, Pseudomonas aeruginosa PA01
cucaggugauggcg

SEQ ID NO: 3453822 - RNA, 17 nt, Pseudomonas aeruginosa PA01
cucagucgguagagcaa

SEQ ID NO: 3453823 - RNA, 20 nt, Pseudomonas aeruginosa PA01
cucagucgguagagcaaaug

SEQ ID NO: 3453824 - RNA, 18 nt, Pseudomonas aeruginosa PA01
cucagucgguagagcagu

SEQ ID NO: 3453825 - RNA, 20 nt, Pseudomonas aeruginosa PA01
cucagucgguagagcaguug

SEQ ID NO: 3453826 - RNA, 15 nt, Pseudomonas aeruginosa PA01
cucagugcgccgggu

SEQ ID NO: 3453827 - RNA, 13 nt, Pseudomonas aeruginosa PA01
cucagugcgggca

SEQ ID NO: 3453828 - RNA, 19 nt, Pseudomonas aeruginosa PA01
cucaguugcugaucaggcc

SEQ ID NO: 3453829 - RNA, 15 nt, Pseudomonas aeruginosa PA01
cucauagcucagcug

SEQ ID NO: 3453830 - RNA, 13 nt, Pseudomonas aeruginosa PA01
cucauaggucagg

SEQ ID NO: 3453831 - RNA, 15 nt, Pseudomonas aeruginosa PA01
cucauaggucaggua

SEQ ID NO: 3453832 - RNA, 19 nt, Pseudomonas aeruginosa PA01
cucauaggucagguacagg

SEQ ID NO: 3453833 - RNA, 12 nt, Pseudomonas aeruginosa PA01
cucaucaggcug

SEQ ID NO: 3453834 - RNA, 13 nt, Pseudomonas aeruginosa PA01
cucaucaggcugc

SEQ ID NO: 3453835 - RNA, 15 nt, Pseudomonas aeruginosa PA01
cucaucaggcugccg

SEQ ID NO: 3453836 - RNA, 14 nt, Pseudomonas aeruginosa PA01
cucaucccugugcg

SEQ ID NO: 3453837 - RNA, 12 nt, Pseudomonas aeruginosa PA01
cucauccgcgag

SEQ ID NO: 3453838 - RNA, 15 nt, Pseudomonas aeruginosa PA01
cucauccucgccgcu

SEQ ID NO: 3453839 - RNA, 12 nt, Pseudomonas aeruginosa PA01
cucaucgcccau

SEQ ID NO: 3453840 - RNA, 16 nt, Pseudomonas aeruginosa PA01
cucaucggcgacaccc

SEQ ID NO: 3453841 - RNA, 18 nt, Pseudomonas aeruginosa PA01
cucaugaccgccgcucau

SEQ ID NO: 3453842 - RNA, 18 nt, Pseudomonas aeruginosa PA01
cucaugagauccgccagc

SEQ ID NO: 3453843 - RNA, 22 nt, Pseudomonas aeruginosa PA01
cucaugagauccgccagcagac

SEQ ID NO: 3453844 - RNA, 13 nt, Pseudomonas aeruginosa PA01
cucaugcaggccg

SEQ ID NO: 3453845 - RNA, 19 nt, Pseudomonas aeruginosa PA01
cucaugcccagcuuggcca

SEQ ID NO: 3453846 - RNA, 18 nt, Pseudomonas aeruginosa PA01
cucaugcgcguguugcgc

SEQ ID NO: 3453847 - RNA, 22 nt, Pseudomonas aeruginosa PA01
cucaugcgcguguugcgccgca

SEQ ID NO: 3453848 - RNA, 19 nt, Pseudomonas aeruginosa PA01
cucauggaacagcagccag

SEQ ID NO: 3453849 - RNA, 19 nt, Pseudomonas aeruginosa PA01
cucauggagcaacagcguc

SEQ ID NO: 3453850 - RNA, 13 nt, Pseudomonas aeruginosa PA01
cucauggccgcag

SEQ ID NO: 3453851 - RNA, 22 nt, Pseudomonas aeruginosa PA01
cucauggccgcagcggcuguug

SEQ ID NO: 3453852 - RNA, 14 nt, Pseudomonas aeruginosa PA01
cucauggcgccgcc

SEQ ID NO: 3453853 - RNA, 15 nt, Pseudomonas aeruginosa PA01
cucauggcgccgcca

SEQ ID NO: 3453854 - RNA, 22 nt, Pseudomonas aeruginosa PA01
cucauggcuguagcucugcugg

SEQ ID NO: 3453855 - RNA, 13 nt, Pseudomonas aeruginosa PA01
cucauguugcggg

SEQ ID NO: 3453856 - RNA, 15 nt, Pseudomonas aeruginosa PA01
cucauguugcgggcu

SEQ ID NO: 3453857 - RNA, 18 nt, Pseudomonas aeruginosa PA01
cucauucaucucgccguc

SEQ ID NO: 3453858 - RNA, 18 nt, Pseudomonas aeruginosa PA01
cucauugcgccgccggcu

SEQ ID NO: 3453859 - RNA, 19 nt, Pseudomonas aeruginosa PA01
cucauugcgccgccggcuc

SEQ ID NO: 3453860 - RNA, 20 nt, Pseudomonas aeruginosa PA01
cuccaaagccuggagcaggg

SEQ ID NO: 3453861 - RNA, 21 nt, Pseudomonas aeruginosa PA01
cuccaaagccuggagcagggc

SEQ ID NO: 3453862 - RNA, 14 nt, Pseudomonas aeruginosa PA01
cuccaacuggcggc

SEQ ID NO: 3453863 - RNA, 18 nt, Pseudomonas aeruginosa PA01
cuccaacuggcggcuggg

SEQ ID NO: 3453864 - RNA, 22 nt, Pseudomonas aeruginosa PA01
cuccaacuggcggcugggcugc

SEQ ID NO: 3453865 - RNA, 18 nt, Pseudomonas aeruginosa PA01
cuccacacccggucgcgc

SEQ ID NO: 3453866 - RNA, 14 nt, Pseudomonas aeruginosa PA01
cuccaccagcgccg

SEQ ID NO: 3453867 - RNA, 18 nt, Pseudomonas aeruginosa PA01
cuccaccagcgccggcgg

SEQ ID NO: 3453868 - RNA, 16 nt, Pseudomonas aeruginosa PA01
cuccacccaggcgccg

SEQ ID NO: 3453869 - RNA, 19 nt, Pseudomonas aeruginosa PA01
cuccacccaggcgccgauc

SEQ ID NO: 3453870 - RNA, 18 nt, Pseudomonas aeruginosa PA01
cuccacccccgcaaccgc

SEQ ID NO: 3453871 - RNA, 22 nt, Pseudomonas aeruginosa PA01
cuccacccccgcaaccgcugcc

SEQ ID NO: 3453872 - RNA, 17 nt, Pseudomonas aeruginosa PA01
cuccacccguucgccgg

SEQ ID NO: 3453873 - RNA, 18 nt, Pseudomonas aeruginosa PA01
cuccacccguucgccggc

SEQ ID NO: 3453874 - RNA, 16 nt, Pseudomonas aeruginosa PA01
cuccaccgauggcgcg

SEQ ID NO: 3453875 - RNA, 18 nt, Pseudomonas aeruginosa PA01
cuccaccgauggcgcgcu

SEQ ID NO: 3453876 - RNA, 14 nt, Pseudomonas aeruginosa PA01
cuccaccgccaccu

SEQ ID NO: 3453877 - RNA, 13 nt, Pseudomonas aeruginosa PA01
cuccaccgccccc

SEQ ID NO: 3453878 - RNA, 16 nt, Pseudomonas aeruginosa PA01
cuccaccgcgcuccgc

SEQ ID NO: 3453879 - RNA, 16 nt, Pseudomonas aeruginosa PA01
cuccaccgcuccggcg

SEQ ID NO: 3453880 - RNA, 18 nt, Pseudomonas aeruginosa PA01
cuccacugcuuggccagg

SEQ ID NO: 3453881 - RNA, 22 nt, Pseudomonas aeruginosa PA01
cuccacugcuuggccaggcgcu

SEQ ID NO: 3453882 - RNA, 13 nt, Pseudomonas aeruginosa PA01
cuccacuuccacu

SEQ ID NO: 3453883 - RNA, 18 nt, Pseudomonas aeruginosa PA01
cuccagaaucucccgcag

SEQ ID NO: 3453884 - RNA, 22 nt, Pseudomonas aeruginosa PA01
cuccagaaucucccgcaggcgc

SEQ ID NO: 3453885 - RNA, 19 nt, Pseudomonas aeruginosa PA01
cuccagaccuccagguagg

SEQ ID NO: 3453886 - RNA, 15 nt, Pseudomonas aeruginosa PA01
cuccagacucuccag

SEQ ID NO: 3453887 - RNA, 19 nt, Pseudomonas aeruginosa PA01
cuccagagccaugggccgg

SEQ ID NO: 3453888 - RNA, 20 nt, Pseudomonas aeruginosa PA01
cuccagagccaugggccggc

SEQ ID NO: 3453889 - RNA, 17 nt, Pseudomonas aeruginosa PA01
cuccagaguccaugcuc

SEQ ID NO: 3453890 - RNA, 16 nt, Pseudomonas aeruginosa PA01
cuccagagugcgcagc

SEQ ID NO: 3453891 - RNA, 21 nt, Pseudomonas aeruginosa PA01
cuccagagugcgcagcagcgu

SEQ ID NO: 3453892 - RNA, 22 nt, Pseudomonas aeruginosa PA01
cuccagagugcgcagcagcguc

SEQ ID NO: 3453893 - RNA, 20 nt, Pseudomonas aeruginosa PA01
cuccagauagugcggccagg

SEQ ID NO: 3453894 - RNA, 22 nt, Pseudomonas aeruginosa PA01
cuccagaucgcauuguugcggu

SEQ ID NO: 3453895 - RNA, 17 nt, Pseudomonas aeruginosa PA01
cuccagcaacgccgccc

SEQ ID NO: 3453896 - RNA, 19 nt, Pseudomonas aeruginosa PA01
cuccagcaacgccgccccc

SEQ ID NO: 3453897 - RNA, 19 nt, Pseudomonas aeruginosa PA01
cuccagcaacggcaucgcu

SEQ ID NO: 3453898 - RNA, 12 nt, Pseudomonas aeruginosa PA01
cuccagcaagcc

SEQ ID NO: 3453899 - RNA, 13 nt, Pseudomonas aeruginosa PA01
cuccagcaagccg

SEQ ID NO: 3453900 - RNA, 14 nt, Pseudomonas aeruginosa PA01
cuccagcaagccgu

SEQ ID NO: 3453901 - RNA, 15 nt, Pseudomonas aeruginosa PA01
cuccagcaaggcguc

SEQ ID NO: 3453902 - RNA, 17 nt, Pseudomonas aeruginosa PA01
cuccagcaccagcacgc

SEQ ID NO: 3453903 - RNA, 20 nt, Pseudomonas aeruginosa PA01
cuccagcaccagcacgcccu

SEQ ID NO: 3453904 - RNA, 15 nt, Pseudomonas aeruginosa PA01
cuccagcacccaggu

SEQ ID NO: 3453905 - RNA, 18 nt, Pseudomonas aeruginosa PA01
cuccagcacccagguaga

SEQ ID NO: 3453906 - RNA, 16 nt, Pseudomonas aeruginosa PA01
cuccagcaccgccugg

SEQ ID NO: 3453907 - RNA, 17 nt, Pseudomonas aeruginosa PA01
cuccagcaccggcggcg

SEQ ID NO: 3453908 - RNA, 18 nt, Pseudomonas aeruginosa PA01
cuccagcaccggcggcgc

SEQ ID NO: 3453909 - RNA, 22 nt, Pseudomonas aeruginosa PA01
cuccagcaccggcggcgccagg

SEQ ID NO: 3453910 - RNA, 19 nt, Pseudomonas aeruginosa PA01
cuccagcaccguggcgcca

SEQ ID NO: 3453911 - RNA, 13 nt, Pseudomonas aeruginosa PA01
cuccagcagcgca

SEQ ID NO: 3453912 - RNA, 18 nt, Pseudomonas aeruginosa PA01
cuccagcagcgcacgcuu

SEQ ID NO: 3453913 - RNA, 16 nt, Pseudomonas aeruginosa PA01
cuccagcaggaccugg

SEQ ID NO: 3453914 - RNA, 19 nt, Pseudomonas aeruginosa PA01
cuccagcaggaccuggccg

SEQ ID NO: 3453915 - RNA, 17 nt, Pseudomonas aeruginosa PA01
cuccagcagggccagcg

SEQ ID NO: 3453916 - RNA, 23 nt, Pseudomonas aeruginosa PA01
cuccagcagggccagcgccuggc

SEQ ID NO: 3453917 - RNA, 21 nt, Pseudomonas aeruginosa PA01
cucccaggcaacggagcuggu

SEQ ID NO: 3453918 - RNA, 17 nt, Pseudomonas aeruginosa PA01
cucccaggcgucgccga

SEQ ID NO: 3453919 - RNA, 23 nt, Pseudomonas aeruginosa PA01
cuccccaccaacucagucgaggu

SEQ ID NO: 3453920 - RNA, 18 nt, Pseudomonas aeruginosa PA01
cuccccacucggccagca

SEQ ID NO: 3453921 - RNA, 17 nt, Pseudomonas aeruginosa PA01
cuccccagacccucucc

SEQ ID NO: 3453922 - RNA, 15 nt, Pseudomonas aeruginosa PA01
cuccccagcaggcag

SEQ ID NO: 3453923 - RNA, 19 nt, Pseudomonas aeruginosa PA01
cuccccagcaggcaggcau

SEQ ID NO: 3453924 - RNA, 13 nt, Pseudomonas aeruginosa PA01
cucccccgcgccg

SEQ ID NO: 3453925 - RNA, 15 nt, Pseudomonas aeruginosa PA01
cucccccgcgccgcc

SEQ ID NO: 3453926 - RNA, 12 nt, Pseudomonas aeruginosa PA01
cuccccgccgcc

SEQ ID NO: 3453927 - RNA, 14 nt, Pseudomonas aeruginosa PA01
cuccccgccgccag

SEQ ID NO: 3453928 - RNA, 18 nt, Pseudomonas aeruginosa PA01
cuccccgcucccgcggcc

SEQ ID NO: 3453929 - RNA, 19 nt, Pseudomonas aeruginosa PA01
cuccccggcccgcgccgcc

SEQ ID NO: 3453930 - RNA, 23 nt, Pseudomonas aeruginosa PA01
cuccccggcccgcgccgccucga

SEQ ID NO: 3453931 - RNA, 18 nt, Pseudomonas aeruginosa PA01
cuccccucaggcgccgcu

SEQ ID NO: 3453932 - RNA, 13 nt, Pseudomonas aeruginosa PA01
cuccccucgcccu

SEQ ID NO: 3453933 - RNA, 17 nt, Pseudomonas aeruginosa PA01
cuccccuggaaugccgg

SEQ ID NO: 3453934 - RNA, 17 nt, Pseudomonas aeruginosa PA01
cuccccuggagcccccg

SEQ ID NO: 3453935 - RNA, 22 nt, Pseudomonas aeruginosa PA01
cuccccuggcccugcaucgcga

SEQ ID NO: 3453936 - RNA, 21 nt, Pseudomonas aeruginosa PA01
cuccccuguggucaggcgcca

SEQ ID NO: 3453937 - RNA, 22 nt, Pseudomonas aeruginosa PA01
cucccgaggcgaucgccgcggc

SEQ ID NO: 3453938 - RNA, 20 nt, Pseudomonas aeruginosa PA01
cucccgcaaccugccagaaa

SEQ ID NO: 3453939 - RNA, 22 nt, Pseudomonas aeruginosa PA01
cucccgcaggcgcuucagcgcc

SEQ ID NO: 3453940 - RNA, 15 nt, Pseudomonas aeruginosa PA01
cucccgccccuccag

SEQ ID NO: 3453941 - RNA, 16 nt, Pseudomonas aeruginosa PA01
cucccgccccuccagu

SEQ ID NO: 3453942 - RNA, 21 nt, Pseudomonas aeruginosa PA01
cucccgcgauucgccgggcuc

SEQ ID NO: 3453943 - RNA, 14 nt, Pseudomonas aeruginosa PA01
cucccgcgccagcg

SEQ ID NO: 3453944 - RNA, 16 nt, Pseudomonas aeruginosa PA01
cucccgcgccagcgcc

SEQ ID NO: 3453945 - RNA, 17 nt, Pseudomonas aeruginosa PA01
cucccgcgccagcgccg

SEQ ID NO: 3453946 - RNA, 20 nt, Pseudomonas aeruginosa PA01
cucccgcgccagcucgaaca

SEQ ID NO: 3453947 - RNA, 22 nt, Pseudomonas aeruginosa PA01
cucccgcgcgcugugcacgguc

SEQ ID NO: 3453948 - RNA, 15 nt, Pseudomonas aeruginosa PA01
cucccgcggcccaag

SEQ ID NO: 3453949 - RNA, 13 nt, Pseudomonas aeruginosa PA01
cucccggccuggu

SEQ ID NO: 3453950 - RNA, 21 nt, Pseudomonas aeruginosa PA01
cucccggccuggugacccgga

SEQ ID NO: 3453951 - RNA, 15 nt, Pseudomonas aeruginosa PA01
cucccggcucgccga

SEQ ID NO: 3453952 - RNA, 15 nt, Pseudomonas aeruginosa PA01
cucccggcuggucag

SEQ ID NO: 3453953 - RNA, 22 nt, Pseudomonas aeruginosa PA01
cucccggcuugcugacgaugaa

SEQ ID NO: 3453954 - RNA, 17 nt, Pseudomonas aeruginosa PA01
cucccgggccagcuccg

SEQ ID NO: 3453955 - RNA, 18 nt, Pseudomonas aeruginosa PA01
cucccgggccagcuccgc

SEQ ID NO: 3453956 - RNA, 15 nt, Pseudomonas aeruginosa PA01
cucccguaccagcgc

SEQ ID NO: 3453957 - RNA, 16 nt, Pseudomonas aeruginosa PA01
cucccguaccagcgcg

SEQ ID NO: 3453958 - RNA, 17 nt, Pseudomonas aeruginosa PA01
cucccguaccagcgcga

SEQ ID NO: 3453959 - RNA, 15 nt, Pseudomonas aeruginosa PA01
cucccguccagcgcu

SEQ ID NO: 3453960 - RNA, 17 nt, Pseudomonas aeruginosa PA01
cucccguccagcgcuug

SEQ ID NO: 3453961 - RNA, 17 nt, Pseudomonas aeruginosa PA01
cucccuaucuccgccgg

SEQ ID NO: 3453962 - RNA, 18 nt, Pseudomonas aeruginosa PA01
cucccuaucuccgccggg

SEQ ID NO: 3453963 - RNA, 14 nt, Pseudomonas aeruginosa PA01
cucccucgccgacc

SEQ ID NO: 3453964 - RNA, 17 nt, Pseudomonas aeruginosa PA01
cucccugaagggagagg

SEQ ID NO: 3453965 - RNA, 21 nt, Pseudomonas aeruginosa PA01
cucccugaagggagagggaac

SEQ ID NO: 3453966 - RNA, 23 nt, Pseudomonas aeruginosa PA01
cucccugaagggagagggaacca

SEQ ID NO: 3453967 - RNA, 15 nt, Pseudomonas aeruginosa PA01
cucccugagccuguc

SEQ ID NO: 3453968 - RNA, 14 nt, Pseudomonas aeruginosa PA01
cucccugcccgcuc

SEQ ID NO: 3453969 - RNA, 17 nt, Pseudomonas aeruginosa PA01
cucccugccgcccuucg

SEQ ID NO: 3453970 - RNA, 14 nt, Pseudomonas aeruginosa PA01
cucccugcucgcgc

SEQ ID NO: 3453971 - RNA, 19 nt, Pseudomonas aeruginosa PA01
cucccuggcggauaucgcg

SEQ ID NO: 3453972 - RNA, 23 nt, Pseudomonas aeruginosa PA01
cucccuggcggauaucgcgccgc

SEQ ID NO: 3453973 - RNA, 14 nt, Pseudomonas aeruginosa PA01
cuccgaccagguag

SEQ ID NO: 3453974 - RNA, 19 nt, Pseudomonas aeruginosa PA01
cuccgacgaucucaucgcc

SEQ ID NO: 3453975 - RNA, 22 nt, Pseudomonas aeruginosa PA01
cuccgacgcgucguccgaggcg

SEQ ID NO: 3453976 - RNA, 15 nt, Pseudomonas aeruginosa PA01
cuccgacuccugcaa

SEQ ID NO: 3453977 - RNA, 17 nt, Pseudomonas aeruginosa PA01
cuccgacuccugcaaca

SEQ ID NO: 3453978 - RNA, 21 nt, Pseudomonas aeruginosa PA01
cuccgacuggugggcacgagu

SEQ ID NO: 3453979 - RNA, 15 nt, Pseudomonas aeruginosa PA01
cuccgagacgcugca

SEQ ID NO: 3453980 - RNA, 20 nt, Pseudomonas aeruginosa PA01
cuccgagacgcugcaccgcg

SEQ ID NO: 3453981 - RNA, 21 nt, Pseudomonas aeruginosa PA01
cuccgagggaggaggcgccgg

SEQ ID NO: 3453982 - RNA, 22 nt, Pseudomonas aeruginosa PA01
cuccgagggaggaggcgccggg

SEQ ID NO: 3453983 - RNA, 16 nt, Pseudomonas aeruginosa PA01
cuccgagggccgcgcc

SEQ ID NO: 3453984 - RNA, 22 nt, Pseudomonas aeruginosa PA01
cuccgagggccgcgccgaccca

SEQ ID NO: 3453985 - RNA, 19 nt, Pseudomonas aeruginosa PA01
cuccgaguccugcugcgac

SEQ ID NO: 3453986 - RNA, 17 nt, Pseudomonas aeruginosa PA01
cuccgaugaagcaggcg

SEQ ID NO: 3453987 - RNA, 20 nt, Pseudomonas aeruginosa PA01
cuccgaugaagcaggcggag

SEQ ID NO: 3453988 - RNA, 21 nt, Pseudomonas aeruginosa PA01
cuccgauggcgcuggaacagc

SEQ ID NO: 3453989 - RNA, 14 nt, Pseudomonas aeruginosa PA01
cuccgauuccugcg

SEQ ID NO: 3453990 - RNA, 19 nt, Pseudomonas aeruginosa PA01
cuccgccacccgcuccggc

SEQ ID NO: 3453991 - RNA, 21 nt, Pseudomonas aeruginosa PA01
cuccgccacccguuccuugcg

SEQ ID NO: 3453992 - RNA, 16 nt, Pseudomonas aeruginosa PA01
cuccgccagcaccacc

SEQ ID NO: 3453993 - RNA, 18 nt, Pseudomonas aeruginosa PA01
cuccgccagcaccacccg

SEQ ID NO: 3453994 - RNA, 19 nt, Pseudomonas aeruginosa PA01
cuccgccagcaccacccgg

SEQ ID NO: 3453995 - RNA, 20 nt, Pseudomonas aeruginosa PA01
cuccgccagcaccacccggc

SEQ ID NO: 3453996 - RNA, 22 nt, Pseudomonas aeruginosa PA01
cuccgccagcaccacccggccg

SEQ ID NO: 3453997 - RNA, 12 nt, Pseudomonas aeruginosa PA01
cuccgccagcca

SEQ ID NO: 3453998 - RNA, 19 nt, Pseudomonas aeruginosa PA01
cuccgccagccagccgcgc

SEQ ID NO: 3453999 - RNA, 17 nt, Pseudomonas aeruginosa PA01
cuccgccagccccaggc

SEQ ID NO: 3454000 - RNA, 16 nt, Pseudomonas aeruginosa PA01
cuccgccagcguuucg

SEQ ID NO: 3454001 - RNA, 21 nt, Pseudomonas aeruginosa PA01
cuccgccagcuuguccgccgg

SEQ ID NO: 3454002 - RNA, 13 nt, Pseudomonas aeruginosa PA01
cuccgccaggacc

SEQ ID NO: 3454003 - RNA, 19 nt, Pseudomonas aeruginosa PA01
cuccgccaggaccuccugc

SEQ ID NO: 3454004 - RNA, 14 nt, Pseudomonas aeruginosa PA01
cuccgccaggccgc

SEQ ID NO: 3454005 - RNA, 18 nt, Pseudomonas aeruginosa PA01
cuccgccaggccgcgcag

SEQ ID NO: 3454006 - RNA, 14 nt, Pseudomonas aeruginosa PA01
cuccgccaggcgcu

SEQ ID NO: 3454007 - RNA, 19 nt, Pseudomonas aeruginosa PA01
cuccgccaggcgcuccagg

SEQ ID NO: 3454008 - RNA, 13 nt, Pseudomonas aeruginosa PA01
cuccgccaggcgg

SEQ ID NO: 3454009 - RNA, 17 nt, Pseudomonas aeruginosa PA01
cuccgccaggcggccga

SEQ ID NO: 3454010 - RNA, 22 nt, Pseudomonas aeruginosa PA01
cuccgccaggucgauccccaac

SEQ ID NO: 3454011 - RNA, 23 nt, Pseudomonas aeruginosa PA01
cuccgccaggucgauccccaacc

SEQ ID NO: 3454012 - RNA, 19 nt, Pseudomonas aeruginosa PA01
cuccgcccaguucuucgcc

SEQ ID NO: 3454013 - RNA, 22 nt, Pseudomonas aeruginosa PA01
cuccgcccaguucuucgccgcc

SEQ ID NO: 3454014 - RNA, 23 nt, Pseudomonas aeruginosa PA01
cuccgccgaacgccaccagggcc

SEQ ID NO: 3454015 - RNA, 20 nt, Pseudomonas aeruginosa PA01
cuccgccgcgccucgucgcg

SEQ ID NO: 3454016 - RNA, 19 nt, Pseudomonas aeruginosa PA01
cuccgccgcgugcgcgccc

SEQ ID NO: 3454017 - RNA, 20 nt, Pseudomonas aeruginosa PA01
cuccgccgcgugcgcgcccu

SEQ ID NO: 3454018 - RNA, 21 nt, Pseudomonas aeruginosa PA01
cuccgccgcgugcgcgcccuc

SEQ ID NO: 3454019 - RNA, 23 nt, Pseudomonas aeruginosa PA01
cuccuccucgcucugcgccgcgg

SEQ ID NO: 3454020 - RNA, 13 nt, Pseudomonas aeruginosa PA01
cuccuccucggcg

SEQ ID NO: 3454021 - RNA, 16 nt, Pseudomonas aeruginosa PA01
cuccucgacggcggga

SEQ ID NO: 3454022 - RNA, 19 nt, Pseudomonas aeruginosa PA01
cuccucgauaaacggcgcu

SEQ ID NO: 3454023 - RNA, 16 nt, Pseudomonas aeruginosa PA01
cuccucgauccgcucc

SEQ ID NO: 3454024 - RNA, 18 nt, Pseudomonas aeruginosa PA01
cuccucgauccgcugggc

SEQ ID NO: 3454025 - RNA, 12 nt, Pseudomonas aeruginosa PA01
cuccucgccgcc

SEQ ID NO: 3454026 - RNA, 14 nt, Pseudomonas aeruginosa PA01
cuccucgccgccga

SEQ ID NO: 3454027 - RNA, 21 nt, Pseudomonas aeruginosa PA01
cuccucgccgccgaccgggcg

SEQ ID NO: 3454028 - RNA, 12 nt, Pseudomonas aeruginosa PA01
cuccucgccgcu

SEQ ID NO: 3454029 - RNA, 18 nt, Pseudomonas aeruginosa PA01
cuccucgccguacagcag

SEQ ID NO: 3454030 - RNA, 14 nt, Pseudomonas aeruginosa PA01
cuccucgcgcugcc

SEQ ID NO: 3454031 - RNA, 14 nt, Pseudomonas aeruginosa PA01
cuccucgcuccaga

SEQ ID NO: 3454032 - RNA, 15 nt, Pseudomonas aeruginosa PA01
cuccucggcagcgcu

SEQ ID NO: 3454033 - RNA, 20 nt, Pseudomonas aeruginosa PA01
cuccucggcagcgcuggcga

SEQ ID NO: 3454034 - RNA, 20 nt, Pseudomonas aeruginosa PA01
cuccucggccgacaggcugg

SEQ ID NO: 3454035 - RNA, 16 nt, Pseudomonas aeruginosa PA01
cuccucggccugggcg

SEQ ID NO: 3454036 - RNA, 12 nt, Pseudomonas aeruginosa PA01
cuccucggccuu

SEQ ID NO: 3454037 - RNA, 16 nt, Pseudomonas aeruginosa PA01
cuccucggcggcuucc

SEQ ID NO: 3454038 - RNA, 17 nt, Pseudomonas aeruginosa PA01
cuccucggcguggcuac

SEQ ID NO: 3454039 - RNA, 16 nt, Pseudomonas aeruginosa PA01
cuccucguaggcgucc

SEQ ID NO: 3454040 - RNA, 18 nt, Pseudomonas aeruginosa PA01
cuccucguaggcguccug

SEQ ID NO: 3454041 - RNA, 22 nt, Pseudomonas aeruginosa PA01
cuccucguaggcguccuggcga

SEQ ID NO: 3454042 - RNA, 18 nt, Pseudomonas aeruginosa PA01
cuccucgucguacuggcg

SEQ ID NO: 3454043 - RNA, 13 nt, Pseudomonas aeruginosa PA01
cuccucgucuucc

SEQ ID NO: 3454044 - RNA, 15 nt, Pseudomonas aeruginosa PA01
cuccucuaccaggcg

SEQ ID NO: 3454045 - RNA, 16 nt, Pseudomonas aeruginosa PA01
cuccucuaccaggcgg

SEQ ID NO: 3454046 - RNA, 19 nt, Pseudomonas aeruginosa PA01
cuccucugccugcgcccuc

SEQ ID NO: 3454047 - RNA, 17 nt, Pseudomonas aeruginosa PA01
cuccugaaggaccagcu

SEQ ID NO: 3454048 - RNA, 17 nt, Pseudomonas aeruginosa PA01
cuccugauagggggcug

SEQ ID NO: 3454049 - RNA, 20 nt, Pseudomonas aeruginosa PA01
cuccugcaacgccuggugca

SEQ ID NO: 3454050 - RNA, 17 nt, Pseudomonas aeruginosa PA01
cuccugcacauagugga

SEQ ID NO: 3454051 - RNA, 14 nt, Pseudomonas aeruginosa PA01
cuccugcgccggcu

SEQ ID NO: 3454052 - RNA, 14 nt, Pseudomonas aeruginosa PA01
cuccugcggucggg

SEQ ID NO: 3454053 - RNA, 17 nt, Pseudomonas aeruginosa PA01
cuccugcucgauccagc

SEQ ID NO: 3454054 - RNA, 20 nt, Pseudomonas aeruginosa PA01
cuccuggaaagaccggcgcc

SEQ ID NO: 3454055 - RNA, 23 nt, Pseudomonas aeruginosa PA01
cuccuggaagaacaggcgcuuca

SEQ ID NO: 3454056 - RNA, 16 nt, Pseudomonas aeruginosa PA01
cuccuggaggacgcgg

SEQ ID NO: 3454057 - RNA, 18 nt, Pseudomonas aeruginosa PA01
cuccuggaugcuccgcgc

SEQ ID NO: 3454058 - RNA, 21 nt, Pseudomonas aeruginosa PA01
cuccuggaugcuccgcgccuc

SEQ ID NO: 3454059 - RNA, 20 nt, Pseudomonas aeruginosa PA01
cuccuggcauggcuuuccag

SEQ ID NO: 3454060 - RNA, 14 nt, Pseudomonas aeruginosa PA01
cuccuggcgcgucg

SEQ ID NO: 3454061 - RNA, 19 nt, Pseudomonas aeruginosa PA01
cuccugggccgacgcuucc

SEQ ID NO: 3454062 - RNA, 21 nt, Pseudomonas aeruginosa PA01
cuccugggccugucgggggcu

SEQ ID NO: 3454063 - RNA, 20 nt, Pseudomonas aeruginosa PA01
cuccuggggaaucugcgcca

SEQ ID NO: 3454064 - RNA, 23 nt, Pseudomonas aeruginosa PA01
cuccuggggaaucugcgccaggu

SEQ ID NO: 3454065 - RNA, 19 nt, Pseudomonas aeruginosa PA01
cuccugggucgacugcugg

SEQ ID NO: 3454066 - RNA, 22 nt, Pseudomonas aeruginosa PA01
cuccugguagaacuccuugccg

SEQ ID NO: 3454067 - RNA, 20 nt, Pseudomonas aeruginosa PA01
cuccuguucgcgcgccucgc

SEQ ID NO: 3454068 - RNA, 16 nt, Pseudomonas aeruginosa PA01
cuccuguucgucgcgu

SEQ ID NO: 3454069 - RNA, 14 nt, Pseudomonas aeruginosa PA01
cuccuguugcuggc

SEQ ID NO: 3454070 - RNA, 15 nt, Pseudomonas aeruginosa PA01
cuccuguugcuggcc

SEQ ID NO: 3454071 - RNA, 15 nt, Pseudomonas aeruginosa PA01
cuccuucaucuuggc

SEQ ID NO: 3454072 - RNA, 17 nt, Pseudomonas aeruginosa PA01
cuccuucgagccuggcc

SEQ ID NO: 3454073 - RNA, 21 nt, Pseudomonas aeruginosa PA01
cuccuucgagccuggccaggc

SEQ ID NO: 3454074 - RNA, 22 nt, Pseudomonas aeruginosa PA01
cuccuucgagccuggccaggcg

SEQ ID NO: 3454075 - RNA, 12 nt, Pseudomonas aeruginosa PA01
cuccuugaaggc

SEQ ID NO: 3454076 - RNA, 19 nt, Pseudomonas aeruginosa PA01
cuccuugaaggcuuccugg

SEQ ID NO: 3454077 - RNA, 18 nt, Pseudomonas aeruginosa PA01
cuccuugcgccaggcccg

SEQ ID NO: 3454078 - RNA, 17 nt, Pseudomonas aeruginosa PA01
cuccuugcgccguugcc

SEQ ID NO: 3454079 - RNA, 20 nt, Pseudomonas aeruginosa PA01
cuccuugcucucgcgcacgc

SEQ ID NO: 3454080 - RNA, 22 nt, Pseudomonas aeruginosa PA01
cuccuuggcuggccagcccugg

SEQ ID NO: 3454081 - RNA, 13 nt, Pseudomonas aeruginosa PA01
cuccuuucccagc

SEQ ID NO: 3454082 - RNA, 14 nt, Pseudomonas aeruginosa PA01
cuccuuucccagcg

SEQ ID NO: 3454083 - RNA, 17 nt, Pseudomonas aeruginosa PA01
cucgaaaaugucggugc

SEQ ID NO: 3454084 - RNA, 14 nt, Pseudomonas aeruginosa PA01
cucgaaagccgccg

SEQ ID NO: 3454085 - RNA, 17 nt, Pseudomonas aeruginosa PA01
cucgaaagccgccgccg

SEQ ID NO: 3454086 - RNA, 19 nt, Pseudomonas aeruginosa PA01
cucgaaagccgccgccgcg

SEQ ID NO: 3454087 - RNA, 17 nt, Pseudomonas aeruginosa PA01
cucgaacaacuggacga

SEQ ID NO: 3454088 - RNA, 15 nt, Pseudomonas aeruginosa PA01
cucgaacaccaggcg

SEQ ID NO: 3454089 - RNA, 17 nt, Pseudomonas aeruginosa PA01
cucgaacaccggcgagc

SEQ ID NO: 3454090 - RNA, 15 nt, Pseudomonas aeruginosa PA01
cucgaacagcagcaa

SEQ ID NO: 3454091 - RNA, 19 nt, Pseudomonas aeruginosa PA01
cucgaacauggccaccgaa

SEQ ID NO: 3454092 - RNA, 15 nt, Pseudomonas aeruginosa PA01
cucgaaccccuggcg

SEQ ID NO: 3454093 - RNA, 17 nt, Pseudomonas aeruginosa PA01
cucgaaccccuggcgcu

SEQ ID NO: 3454094 - RNA, 20 nt, Pseudomonas aeruginosa PA01
cucgaaccccuggcgcucga

SEQ ID NO: 3454095 - RNA, 16 nt, Pseudomonas aeruginosa PA01
cucgaacgccaggcag

SEQ ID NO: 3454096 - RNA, 14 nt, Pseudomonas aeruginosa PA01
cucgaacgccgccc

SEQ ID NO: 3454097 - RNA, 20 nt, Pseudomonas aeruginosa PA01
cucgaacggcggaucgauca

SEQ ID NO: 3454098 - RNA, 18 nt, Pseudomonas aeruginosa PA01
cucgaagaacuccaucuc

SEQ ID NO: 3454099 - RNA, 23 nt, Pseudomonas aeruginosa PA01
cucgaagaacuccaucucgcggc

SEQ ID NO: 3454100 - RNA, 21 nt, Pseudomonas aeruginosa PA01
cucgaagcagagggcguccug

SEQ ID NO: 3454101 - RNA, 16 nt, Pseudomonas aeruginosa PA01
cucgaagcccagcgcc

SEQ ID NO: 3454102 - RNA, 17 nt, Pseudomonas aeruginosa PA01
cucgaagcccagcgccu

SEQ ID NO: 3454103 - RNA, 16 nt, Pseudomonas aeruginosa PA01
cucgaagcccugcaaa

SEQ ID NO: 3454104 - RNA, 14 nt, Pseudomonas aeruginosa PA01
cucgaagccgaggc

SEQ ID NO: 3454105 - RNA, 17 nt, Pseudomonas aeruginosa PA01
cucgaagcgcgccugcu

SEQ ID NO: 3454106 - RNA, 14 nt, Pseudomonas aeruginosa PA01
cucgaagcgcuugc

SEQ ID NO: 3454107 - RNA, 13 nt, Pseudomonas aeruginosa PA01
cucgaaggccagc

SEQ ID NO: 3454108 - RNA, 17 nt, Pseudomonas aeruginosa PA01
cucgaaggccagcucgu

SEQ ID NO: 3454109 - RNA, 19 nt, Pseudomonas aeruginosa PA01
cucgaaggccagcucgucg

SEQ ID NO: 3454110 - RNA, 12 nt, Pseudomonas aeruginosa PA01
cucgaaggucgc

SEQ ID NO: 3454111 - RNA, 15 nt, Pseudomonas aeruginosa PA01
cucgacagcgucgua

SEQ ID NO: 3454112 - RNA, 16 nt, Pseudomonas aeruginosa PA01
cucgacauacuccgcc

SEQ ID NO: 3454113 - RNA, 19 nt, Pseudomonas aeruginosa PA01
cucgacauacuccgccgcu

SEQ ID NO: 3454114 - RNA, 20 nt, Pseudomonas aeruginosa PA01
cucgacaucgucucgcgaca

SEQ ID NO: 3454115 - RNA, 18 nt, Pseudomonas aeruginosa PA01
cucgacauggaucaccgc

SEQ ID NO: 3454116 - RNA, 19 nt, Pseudomonas aeruginosa PA01
cucgacauggaucaccgcc

SEQ ID NO: 3454117 - RNA, 18 nt, Pseudomonas aeruginosa PA01
cucgacauugcugccgag

SEQ ID NO: 3454118 - RNA, 13 nt, Pseudomonas aeruginosa PA01
cucgaccaccucg

SEQ ID NO: 3454119 - RNA, 16 nt, Pseudomonas aeruginosa PA01
cucgaccaccucggcg

SEQ ID NO: 3454120 - RNA, 23 nt, Pseudomonas aeruginosa PA01
cucgaccagaucggcauggccga

SEQ ID NO: 3454121 - RNA, 15 nt, Pseudomonas aeruginosa PA01
cucgaccagcgccgc

SEQ ID NO: 3454122 - RNA, 22 nt, Pseudomonas aeruginosa PA01
cucgauggcagccuuggccacg

SEQ ID NO: 3454123 - RNA, 18 nt, Pseudomonas aeruginosa PA01
cucgauggccuugaggua

SEQ ID NO: 3454124 - RNA, 12 nt, Pseudomonas aeruginosa PA01
cucgauggcgaa

SEQ ID NO: 3454125 - RNA, 15 nt, Pseudomonas aeruginosa PA01
cucgauggcgaagcg

SEQ ID NO: 3454126 - RNA, 19 nt, Pseudomonas aeruginosa PA01
cucgauggcgaagcgcuug

SEQ ID NO: 3454127 - RNA, 12 nt, Pseudomonas aeruginosa PA01
cucgauggcgau

SEQ ID NO: 3454128 - RNA, 15 nt, Pseudomonas aeruginosa PA01
cucgauggcggcauu

SEQ ID NO: 3454129 - RNA, 23 nt, Pseudomonas aeruginosa PA01
cucgauggcggcauugagggcga

SEQ ID NO: 3454130 - RNA, 16 nt, Pseudomonas aeruginosa PA01
cucgauggcggccugg

SEQ ID NO: 3454131 - RNA, 16 nt, Pseudomonas aeruginosa PA01
cucgauggcggcggcg

SEQ ID NO: 3454132 - RNA, 20 nt, Pseudomonas aeruginosa PA01
cucgauggugaacgccaggc

SEQ ID NO: 3454133 - RNA, 23 nt, Pseudomonas aeruginosa PA01
cucgauggugaacgccaggcagu

SEQ ID NO: 3454134 - RNA, 23 nt, Pseudomonas aeruginosa PA01
cucgauggugacguugcgccgca

SEQ ID NO: 3454135 - RNA, 21 nt, Pseudomonas aeruginosa PA01
cucgauggugaucacgucggc

SEQ ID NO: 3454136 - RNA, 19 nt, Pseudomonas aeruginosa PA01
cucgauguaggccucggcc

SEQ ID NO: 3454137 - RNA, 21 nt, Pseudomonas aeruginosa PA01
cucgauguaggccucggccug

SEQ ID NO: 3454138 - RNA, 17 nt, Pseudomonas aeruginosa PA01
cucgauguccgggaugc

SEQ ID NO: 3454139 - RNA, 18 nt, Pseudomonas aeruginosa PA01
cucgauguccgggaugcc

SEQ ID NO: 3454140 - RNA, 23 nt, Pseudomonas aeruginosa PA01
cucgauguccgggaugccggugc

SEQ ID NO: 3454141 - RNA, 16 nt, Pseudomonas aeruginosa PA01
cucgcaaucagcgcga

SEQ ID NO: 3454142 - RNA, 22 nt, Pseudomonas aeruginosa PA01
cucgcaauugaucauccaggac

SEQ ID NO: 3454143 - RNA, 14 nt, Pseudomonas aeruginosa PA01
cucgcaccaggcca

SEQ ID NO: 3454144 - RNA, 19 nt, Pseudomonas aeruginosa PA01
cucgcaccaggccaggugg

SEQ ID NO: 3454145 - RNA, 14 nt, Pseudomonas aeruginosa PA01
cucgcagagcgcca

SEQ ID NO: 3454146 - RNA, 17 nt, Pseudomonas aeruginosa PA01
cucgcagagcgccagcc

SEQ ID NO: 3454147 - RNA, 18 nt, Pseudomonas aeruginosa PA01
cucgcagagcgccagcca

SEQ ID NO: 3454148 - RNA, 14 nt, Pseudomonas aeruginosa PA01
cucgcagccgcgcu

SEQ ID NO: 3454149 - RNA, 16 nt, Pseudomonas aeruginosa PA01
cucgcagccgcgcucg

SEQ ID NO: 3454150 - RNA, 20 nt, Pseudomonas aeruginosa PA01
cucgcagccgcgcucggcca

SEQ ID NO: 3454151 - RNA, 17 nt, Pseudomonas aeruginosa PA01
cucgcagccggcggcga

SEQ ID NO: 3454152 - RNA, 13 nt, Pseudomonas aeruginosa PA01
cucgcagccggug

SEQ ID NO: 3454153 - RNA, 23 nt, Pseudomonas aeruginosa PA01
cucgcagccgguggucuucagca

SEQ ID NO: 3454154 - RNA, 18 nt, Pseudomonas aeruginosa PA01
cucgcaguacagcucggc

SEQ ID NO: 3454155 - RNA, 23 nt, Pseudomonas aeruginosa PA01
cucgccaagcuggcgaucgaccu

SEQ ID NO: 3454156 - RNA, 18 nt, Pseudomonas aeruginosa PA01
cucgccaccccgcuccgc

SEQ ID NO: 3454157 - RNA, 19 nt, Pseudomonas aeruginosa PA01
cucgccaccccgcuccgcu

SEQ ID NO: 3454158 - RNA, 18 nt, Pseudomonas aeruginosa PA01
cucgccaccuguagcagg

SEQ ID NO: 3454159 - RNA, 19 nt, Pseudomonas aeruginosa PA01
cucgccacgcuucugcgcc

SEQ ID NO: 3454160 - RNA, 21 nt, Pseudomonas aeruginosa PA01
cucgccacgcuucugcgccuc

SEQ ID NO: 3454161 - RNA, 17 nt, Pseudomonas aeruginosa PA01
cucgccagcccggcagg

SEQ ID NO: 3454162 - RNA, 22 nt, Pseudomonas aeruginosa PA01
cucgccagcgcgcgccgacagg

SEQ ID NO: 3454163 - RNA, 15 nt, Pseudomonas aeruginosa PA01
cucgccaucggccug

SEQ ID NO: 3454164 - RNA, 16 nt, Pseudomonas aeruginosa PA01
cucgccaucggccugg

SEQ ID NO: 3454165 - RNA, 14 nt, Pseudomonas aeruginosa PA01
cucgcccagcaggc

SEQ ID NO: 3454166 - RNA, 21 nt, Pseudomonas aeruginosa PA01
cucgcccagcaggcgcgcccu

SEQ ID NO: 3454167 - RNA, 13 nt, Pseudomonas aeruginosa PA01
cucgcccagggcg

SEQ ID NO: 3454168 - RNA, 20 nt, Pseudomonas aeruginosa PA01
cucgcccagggcguggucgg

SEQ ID NO: 3454169 - RNA, 14 nt, Pseudomonas aeruginosa PA01
cucgcccaguaccg

SEQ ID NO: 3454170 - RNA, 17 nt, Pseudomonas aeruginosa PA01
cucgcccaguaccgcca

SEQ ID NO: 3454171 - RNA, 14 nt, Pseudomonas aeruginosa PA01
cucgcccaucgcca

SEQ ID NO: 3454172 - RNA, 15 nt, Pseudomonas aeruginosa PA01
cucgcccaucugcgc

SEQ ID NO: 3454173 - RNA, 17 nt, Pseudomonas aeruginosa PA01
cucgcccaugcgcggcg

SEQ ID NO: 3454174 - RNA, 13 nt, Pseudomonas aeruginosa PA01
cucgccccgccgg

SEQ ID NO: 3454175 - RNA, 17 nt, Pseudomonas aeruginosa PA01
cucgccccggcggcgau

SEQ ID NO: 3454176 - RNA, 18 nt, Pseudomonas aeruginosa PA01
cucgccccggcggcgauc

SEQ ID NO: 3454177 - RNA, 19 nt, Pseudomonas aeruginosa PA01
cucgccccggcggcgaucu

SEQ ID NO: 3454178 - RNA, 19 nt, Pseudomonas aeruginosa PA01
cucgcccgaccccacgccg

SEQ ID NO: 3454179 - RNA, 22 nt, Pseudomonas aeruginosa PA01
cucgcccgaccccacgccggcc

SEQ ID NO: 3454180 - RNA, 12 nt, Pseudomonas aeruginosa PA01
cucgcccgccuc

SEQ ID NO: 3454181 - RNA, 23 nt, Pseudomonas aeruginosa PA01
cucgcccgucacuucacgacagg

SEQ ID NO: 3454182 - RNA, 14 nt, Pseudomonas aeruginosa PA01
cucgcccucauggc

SEQ ID NO: 3454183 - RNA, 19 nt, Pseudomonas aeruginosa PA01
cucgcccucgaagcccugc

SEQ ID NO: 3454184 - RNA, 21 nt, Pseudomonas aeruginosa PA01
cucgcccugcuuggccagcgc

SEQ ID NO: 3454185 - RNA, 22 nt, Pseudomonas aeruginosa PA01
cucgcccuugaccagucccggc

SEQ ID NO: 3454186 - RNA, 16 nt, Pseudomonas aeruginosa PA01
cucgcccuugcgccgc

SEQ ID NO: 3454187 - RNA, 21 nt, Pseudomonas aeruginosa PA01
cucgcccuugggaccgggcau

SEQ ID NO: 3454188 - RNA, 17 nt, Pseudomonas aeruginosa PA01
cucgccgaacaggaucu

SEQ ID NO: 3454189 - RNA, 20 nt, Pseudomonas aeruginosa PA01
cucgccgaaggugcaggccg

SEQ ID NO: 3454190 - RNA, 13 nt, Pseudomonas aeruginosa PA01
cucgccgacggcu

SEQ ID NO: 3454191 - RNA, 16 nt, Pseudomonas aeruginosa PA01
cucgccgacggcuucg

SEQ ID NO: 3454192 - RNA, 17 nt, Pseudomonas aeruginosa PA01
cucgccgacuuccaggc

SEQ ID NO: 3454193 - RNA, 17 nt, Pseudomonas aeruginosa PA01
cucgccgaucuccuccg

SEQ ID NO: 3454194 - RNA, 18 nt, Pseudomonas aeruginosa PA01
cucgccgaucuccuccgc

SEQ ID NO: 3454195 - RNA, 21 nt, Pseudomonas aeruginosa PA01
cucgccgaugucguagccgcg

SEQ ID NO: 3454196 - RNA, 12 nt, Pseudomonas aeruginosa PA01
cucgccgccagc

SEQ ID NO: 3454197 - RNA, 13 nt, Pseudomonas aeruginosa PA01
cucgccgccagca

SEQ ID NO: 3454198 - RNA, 11 nt, Pseudomonas aeruginosa PA01
cucgccgccga

SEQ ID NO: 3454199 - RNA, 23 nt, Pseudomonas aeruginosa PA01
cucgccgccgacacccgcgccgc

SEQ ID NO: 3454200 - RNA, 13 nt, Pseudomonas aeruginosa PA01
cucgccgccgacc

SEQ ID NO: 3454201 - RNA, 18 nt, Pseudomonas aeruginosa PA01
cucgccgccgaccgggcg

SEQ ID NO: 3454202 - RNA, 16 nt, Pseudomonas aeruginosa PA01
cucgccgccgagcagg

SEQ ID NO: 3454203 - RNA, 12 nt, Pseudomonas aeruginosa PA01
cucgccgccggc

SEQ ID NO: 3454204 - RNA, 13 nt, Pseudomonas aeruginosa PA01
cucgccgccggcg

SEQ ID NO: 3454205 - RNA, 14 nt, Pseudomonas aeruginosa PA01
cucgccgccgggcg

SEQ ID NO: 3454206 - RNA, 17 nt, Pseudomonas aeruginosa PA01
cucgccgccgggcgcgc

SEQ ID NO: 3454207 - RNA, 13 nt, Pseudomonas aeruginosa PA01
cucgccgccgucc

SEQ ID NO: 3454208 - RNA, 18 nt, Pseudomonas aeruginosa PA01
cucgccgcgcacgucgag

SEQ ID NO: 3454209 - RNA, 16 nt, Pseudomonas aeruginosa PA01
cucgccgcgcucgcgc

SEQ ID NO: 3454210 - RNA, 13 nt, Pseudomonas aeruginosa PA01
cucgccgcgcugc

SEQ ID NO: 3454211 - RNA, 14 nt, Pseudomonas aeruginosa PA01
cucgccgcgcugca

SEQ ID NO: 3454212 - RNA, 17 nt, Pseudomonas aeruginosa PA01
cucgccgcgcugcauga

SEQ ID NO: 3454213 - RNA, 17 nt, Pseudomonas aeruginosa PA01
cucgccgcuccgcgcca

SEQ ID NO: 3454214 - RNA, 18 nt, Pseudomonas aeruginosa PA01
cucgccgcuccgcgccac

SEQ ID NO: 3454215 - RNA, 20 nt, Pseudomonas aeruginosa PA01
cucgccgcugaaguccuggc

SEQ ID NO: 3454216 - RNA, 22 nt, Pseudomonas aeruginosa PA01
cucgccgcugaaguccuggccg

SEQ ID NO: 3454217 - RNA, 23 nt, Pseudomonas aeruginosa PA01
cucgccgcugaaguccuggccga

SEQ ID NO: 3454218 - RNA, 15 nt, Pseudomonas aeruginosa PA01
cucgccgcugcuggc

SEQ ID NO: 3454219 - RNA, 15 nt, Pseudomonas aeruginosa PA01
cucgccgcuggcgcu

SEQ ID NO: 3454220 - RNA, 16 nt, Pseudomonas aeruginosa PA01
cucgccgcuggcgcug

SEQ ID NO: 3454221 - RNA, 22 nt, Pseudomonas aeruginosa PA01
cucgccgcuggcgcugaccgcu

SEQ ID NO: 3454222 - RNA, 22 nt, Pseudomonas aeruginosa PA01
cucgccggcgaucuccgccagg

SEQ ID NO: 3454223 - RNA, 15 nt, Pseudomonas aeruginosa PA01
cucgccggcguccuc

SEQ ID NO: 3454224 - RNA, 15 nt, Pseudomonas aeruginosa PA01
cucggcgaccuugcg

SEQ ID NO: 3454225 - RNA, 13 nt, Pseudomonas aeruginosa PA01
cucggcgacgagg

SEQ ID NO: 3454226 - RNA, 13 nt, Pseudomonas aeruginosa PA01
cucggcgacuucg

SEQ ID NO: 3454227 - RNA, 14 nt, Pseudomonas aeruginosa PA01
cucggcgacuucgc

SEQ ID NO: 3454228 - RNA, 20 nt, Pseudomonas aeruginosa PA01
cucggcgacuucgcauucca

SEQ ID NO: 3454229 - RNA, 13 nt, Pseudomonas aeruginosa PA01
cucggcgagccgc

SEQ ID NO: 3454230 - RNA, 16 nt, Pseudomonas aeruginosa PA01
cucggcgagccgccgg

SEQ ID NO: 3454231 - RNA, 17 nt, Pseudomonas aeruginosa PA01
cucggcgaggaacagca

SEQ ID NO: 3454232 - RNA, 22 nt, Pseudomonas aeruginosa PA01
cucggcgaggaacagcaccagc

SEQ ID NO: 3454233 - RNA, 17 nt, Pseudomonas aeruginosa PA01
cucggcgaggccggcga

SEQ ID NO: 3454234 - RNA, 22 nt, Pseudomonas aeruginosa PA01
cucggcgaggccggcgaucagc

SEQ ID NO: 3454235 - RNA, 19 nt, Pseudomonas aeruginosa PA01
cucggcgaguucgcgcagg

SEQ ID NO: 3454236 - RNA, 18 nt, Pseudomonas aeruginosa PA01
cucggcgaucacccggcg

SEQ ID NO: 3454237 - RNA, 16 nt, Pseudomonas aeruginosa PA01
cucggcgauccgcgcu

SEQ ID NO: 3454238 - RNA, 19 nt, Pseudomonas aeruginosa PA01
cucggcgauccgcgcuucc

SEQ ID NO: 3454239 - RNA, 20 nt, Pseudomonas aeruginosa PA01
cucggcgaucgccaggugga

SEQ ID NO: 3454240 - RNA, 16 nt, Pseudomonas aeruginosa PA01
cucggcgaucucgccc

SEQ ID NO: 3454241 - RNA, 18 nt, Pseudomonas aeruginosa PA01
cucggcgaucucgcccag

SEQ ID NO: 3454242 - RNA, 17 nt, Pseudomonas aeruginosa PA01
cucggcgaugccgccgg

SEQ ID NO: 3454243 - RNA, 19 nt, Pseudomonas aeruginosa PA01
cucggcgaugccgccgggc

SEQ ID NO: 3454244 - RNA, 15 nt, Pseudomonas aeruginosa PA01
cucggcgauggcgcg

SEQ ID NO: 3454245 - RNA, 21 nt, Pseudomonas aeruginosa PA01
cucggcgauggcgcgcgggcc

SEQ ID NO: 3454246 - RNA, 20 nt, Pseudomonas aeruginosa PA01
cucggcgauggcguagaggc

SEQ ID NO: 3454247 - RNA, 18 nt, Pseudomonas aeruginosa PA01
cucggcgauguugcgcag

SEQ ID NO: 3454248 - RNA, 22 nt, Pseudomonas aeruginosa PA01
cucggcgauguugcgcagggug

SEQ ID NO: 3454249 - RNA, 17 nt, Pseudomonas aeruginosa PA01
cucggcgauucgcggcg

SEQ ID NO: 3454250 - RNA, 19 nt, Pseudomonas aeruginosa PA01
cucggcgauucgcggcgac

SEQ ID NO: 3454251 - RNA, 20 nt, Pseudomonas aeruginosa PA01
cucggcgauucgcggcgaca

SEQ ID NO: 3454252 - RNA, 15 nt, Pseudomonas aeruginosa PA01
cucggcgcaggcaug

SEQ ID NO: 3454253 - RNA, 14 nt, Pseudomonas aeruginosa PA01
cucggcgcccaggg

SEQ ID NO: 3454254 - RNA, 15 nt, Pseudomonas aeruginosa PA01
cucggcgcccgccug

SEQ ID NO: 3454255 - RNA, 16 nt, Pseudomonas aeruginosa PA01
cucggcgcccuggccg

SEQ ID NO: 3454256 - RNA, 13 nt, Pseudomonas aeruginosa PA01
cucggcgccgagc

SEQ ID NO: 3454257 - RNA, 22 nt, Pseudomonas aeruginosa PA01
cucggcgccgagcauuccgaca

SEQ ID NO: 3454258 - RNA, 13 nt, Pseudomonas aeruginosa PA01
cucggcgccgauc

SEQ ID NO: 3454259 - RNA, 17 nt, Pseudomonas aeruginosa PA01
cucggcgccgucgauca

SEQ ID NO: 3454260 - RNA, 21 nt, Pseudomonas aeruginosa PA01
cucggcgccguuguucaggcg

SEQ ID NO: 3454261 - RNA, 12 nt, Pseudomonas aeruginosa PA01
cucggcgcgauc

SEQ ID NO: 3454262 - RNA, 21 nt, Pseudomonas aeruginosa PA01
cucggcgcgaugaugccgccg

SEQ ID NO: 3454263 - RNA, 16 nt, Pseudomonas aeruginosa PA01
cucggcgcgcgccccc

SEQ ID NO: 3454264 - RNA, 22 nt, Pseudomonas aeruginosa PA01
cucggcgcgcgcccccuggccg

SEQ ID NO: 3454265 - RNA, 23 nt, Pseudomonas aeruginosa PA01
cucggcgcgcgcccccuggccgu

SEQ ID NO: 3454266 - RNA, 17 nt, Pseudomonas aeruginosa PA01
cucggcgcucggcucca

SEQ ID NO: 3454267 - RNA, 20 nt, Pseudomonas aeruginosa PA01
cucggcgcuuucgcucuggu

SEQ ID NO: 3454268 - RNA, 14 nt, Pseudomonas aeruginosa PA01
cucggcggacagcc

SEQ ID NO: 3454269 - RNA, 15 nt, Pseudomonas aeruginosa PA01
cucggcggacagccc

SEQ ID NO: 3454270 - RNA, 13 nt, Pseudomonas aeruginosa PA01
cucggcggccagg

SEQ ID NO: 3454271 - RNA, 14 nt, Pseudomonas aeruginosa PA01
cucggcggccaggc

SEQ ID NO: 3454272 - RNA, 19 nt, Pseudomonas aeruginosa PA01
cucggcggccauugccgcg

SEQ ID NO: 3454273 - RNA, 18 nt, Pseudomonas aeruginosa PA01
cucggcggcgagcgccgc

SEQ ID NO: 3454274 - RNA, 22 nt, Pseudomonas aeruginosa PA01
cucggcggcgagcgccgcggcg

SEQ ID NO: 3454275 - RNA, 22 nt, Pseudomonas aeruginosa PA01
cucggcggcgcgaaccagcagc

SEQ ID NO: 3454276 - RNA, 14 nt, Pseudomonas aeruginosa PA01
cucggcggcggccu

SEQ ID NO: 3454277 - RNA, 18 nt, Pseudomonas aeruginosa PA01
cucggcggcggucgcgau

SEQ ID NO: 3454278 - RNA, 16 nt, Pseudomonas aeruginosa PA01
cucggcgggacggcgc

SEQ ID NO: 3454279 - RNA, 19 nt, Pseudomonas aeruginosa PA01
cucggcgggagagggcggc

SEQ ID NO: 3454280 - RNA, 17 nt, Pseudomonas aeruginosa PA01
cucggcgggcugccgcg

SEQ ID NO: 3454281 - RNA, 18 nt, Pseudomonas aeruginosa PA01
cucggcgggcugccgcgg

SEQ ID NO: 3454282 - RNA, 20 nt, Pseudomonas aeruginosa PA01
cucggcggggcgcagcagga

SEQ ID NO: 3454283 - RNA, 14 nt, Pseudomonas aeruginosa PA01
cucggcggucaggc

SEQ ID NO: 3454284 - RNA, 17 nt, Pseudomonas aeruginosa PA01
cucggcggucaggccaa

SEQ ID NO: 3454285 - RNA, 18 nt, Pseudomonas aeruginosa PA01
cucggcgguggggaagcg

SEQ ID NO: 3454286 - RNA, 16 nt, Pseudomonas aeruginosa PA01
cucggcguagccggcc

SEQ ID NO: 3454287 - RNA, 19 nt, Pseudomonas aeruginosa PA01
cucggcguagccggccagg

SEQ ID NO: 3454288 - RNA, 22 nt, Pseudomonas aeruginosa PA01
cucggcguagccggccagggcg

SEQ ID NO: 3454289 - RNA, 17 nt, Pseudomonas aeruginosa PA01
cucggcguagccggcga

SEQ ID NO: 3454290 - RNA, 19 nt, Pseudomonas aeruginosa PA01
cucggcguagccggcgauc

SEQ ID NO: 3454291 - RNA, 20 nt, Pseudomonas aeruginosa PA01
cucggcguagccggcgaucc

SEQ ID NO: 3454292 - RNA, 18 nt, Pseudomonas aeruginosa PA01
cucggcguagugcuggua

SEQ ID NO: 3454293 - RNA, 16 nt, Pseudomonas aeruginosa PA01
cucggcguccagcagg

SEQ ID NO: 3454294 - RNA, 17 nt, Pseudomonas aeruginosa PA01
cucggcguccagcaggu

SEQ ID NO: 3454295 - RNA, 16 nt, Pseudomonas aeruginosa PA01
cucggcgucgucgauc

SEQ ID NO: 3454296 - RNA, 18 nt, Pseudomonas aeruginosa PA01
cucggcgugccgggccgg

SEQ ID NO: 3454297 - RNA, 19 nt, Pseudomonas aeruginosa PA01
cucggcgugccgggccggc

SEQ ID NO: 3454298 - RNA, 20 nt, Pseudomonas aeruginosa PA01
cucggcguucaccgcgcaaa

SEQ ID NO: 3454299 - RNA, 20 nt, Pseudomonas aeruginosa PA01
cucggcuaaccgccuucgcg

SEQ ID NO: 3454300 - RNA, 14 nt, Pseudomonas aeruginosa PA01
cucggcuccagcca

SEQ ID NO: 3454301 - RNA, 18 nt, Pseudomonas aeruginosa PA01
cucggcuccagccaggcc

SEQ ID NO: 3454302 - RNA, 20 nt, Pseudomonas aeruginosa PA01
cucggcuccagccaggcccg

SEQ ID NO: 3454303 - RNA, 21 nt, Pseudomonas aeruginosa PA01
cucggcuccaggaccggcagg

SEQ ID NO: 3454304 - RNA, 17 nt, Pseudomonas aeruginosa PA01
cucggcugcaacgccgc

SEQ ID NO: 3454305 - RNA, 19 nt, Pseudomonas aeruginosa PA01
cucggcugcaacgccgcgg

SEQ ID NO: 3454306 - RNA, 14 nt, Pseudomonas aeruginosa PA01
cucggcugcuugcc

SEQ ID NO: 3454307 - RNA, 16 nt, Pseudomonas aeruginosa PA01
cucggcugcuugccgg

SEQ ID NO: 3454308 - RNA, 19 nt, Pseudomonas aeruginosa PA01
cucggcugcuugccggugc

SEQ ID NO: 3454309 - RNA, 17 nt, Pseudomonas aeruginosa PA01
cucggcuuccaucaccg

SEQ ID NO: 3454310 - RNA, 20 nt, Pseudomonas aeruginosa PA01
cucggcuuccaucaccgcgu

SEQ ID NO: 3454311 - RNA, 24 nt, Pseudomonas aeruginosa PA01
cucggcuucgcguugcaggcgacg

SEQ ID NO: 3454312 - RNA, 20 nt, Pseudomonas aeruginosa PA01
cucggcuucguccugcugcu

SEQ ID NO: 3454313 - RNA, 18 nt, Pseudomonas aeruginosa PA01
cucggcuugacuggcagu

SEQ ID NO: 3454314 - RNA, 17 nt, Pseudomonas aeruginosa PA01
cucgggaugcaguucgu

SEQ ID NO: 3454315 - RNA, 22 nt, Pseudomonas aeruginosa PA01
cucgggccaugagcagggcgga

SEQ ID NO: 3454316 - RNA, 13 nt, Pseudomonas aeruginosa PA01
cucgggccgcagg

SEQ ID NO: 3454317 - RNA, 14 nt, Pseudomonas aeruginosa PA01
cucgggccgcaggg

SEQ ID NO: 3454318 - RNA, 23 nt, Pseudomonas aeruginosa PA01
cucgggcggaucgagcagcggcg

SEQ ID NO: 3454319 - RNA, 23 nt, Pseudomonas aeruginosa PA01
cucgggcgggaucuccgcgccac

SEQ ID NO: 3454320 - RNA, 15 nt, Pseudomonas aeruginosa PA01
cucgggcgucuccug

SEQ ID NO: 3454321 - RNA, 14 nt, Pseudomonas aeruginosa PA01
cucgggcugccgca

SEQ ID NO: 3454322 - RNA, 18 nt, Pseudomonas aeruginosa PA01
cucgggcugccgcagauc

SEQ ID NO: 3454323 - RNA, 13 nt, Pseudomonas aeruginosa PA01
cucggggaagcgc

SEQ ID NO: 3454324 - RNA, 19 nt, Pseudomonas aeruginosa PA01
cucggggauguccgccgcc

SEQ ID NO: 3454325 - RNA, 20 nt, Pseudomonas aeruginosa PA01
cucggggauguccgccgccc

SEQ ID NO: 3454326 - RNA, 22 nt, Pseudomonas aeruginosa PA01
cucgucggcggggcgcaccgcc

SEQ ID NO: 3454327 - RNA, 17 nt, Pseudomonas aeruginosa PA01
cucgucguacuggcgga

SEQ ID NO: 3454328 - RNA, 17 nt, Pseudomonas aeruginosa PA01
cucgucguccagcggcu

SEQ ID NO: 3454329 - RNA, 18 nt, Pseudomonas aeruginosa PA01
cucgucguccagcggcuc

SEQ ID NO: 3454330 - RNA, 22 nt, Pseudomonas aeruginosa PA01
cucgucgucggagauagccucc

SEQ ID NO: 3454331 - RNA, 20 nt, Pseudomonas aeruginosa PA01
cucgugcaacggcacgaccu

SEQ ID NO: 3454332 - RNA, 18 nt, Pseudomonas aeruginosa PA01
cucgugcagcaagccgca

SEQ ID NO: 3454333 - RNA, 24 nt, Pseudomonas aeruginosa PA01
cucgugcagguagccgcgccggcc

SEQ ID NO: 3454334 - RNA, 21 nt, Pseudomonas aeruginosa PA01
cucgugcuuggugucggccgc

SEQ ID NO: 3454335 - RNA, 16 nt, Pseudomonas aeruginosa PA01
cucguggaacagcgcg

SEQ ID NO: 3454336 - RNA, 16 nt, Pseudomonas aeruginosa PA01
cucguggacccgugcg

SEQ ID NO: 3454337 - RNA, 13 nt, Pseudomonas aeruginosa PA01
cucguggcgcgau

SEQ ID NO: 3454338 - RNA, 14 nt, Pseudomonas aeruginosa PA01
cucguggcgcgccg

SEQ ID NO: 3454339 - RNA, 14 nt, Pseudomonas aeruginosa PA01
cucguggcuggcgc

SEQ ID NO: 3454340 - RNA, 13 nt, Pseudomonas aeruginosa PA01
cucgugggccagc

SEQ ID NO: 3454341 - RNA, 15 nt, Pseudomonas aeruginosa PA01
cucguguuccggcag

SEQ ID NO: 3454342 - RNA, 22 nt, Pseudomonas aeruginosa PA01
cucguuccacgggucgcagccg

SEQ ID NO: 3454343 - RNA, 22 nt, Pseudomonas aeruginosa PA01
cucguuccgcggagucgccggu

SEQ ID NO: 3454344 - RNA, 12 nt, Pseudomonas aeruginosa PA01
cucguucgccca

SEQ ID NO: 3454345 - RNA, 13 nt, Pseudomonas aeruginosa PA01
cucguucgcccag

SEQ ID NO: 3454346 - RNA, 14 nt, Pseudomonas aeruginosa PA01
cucguucgggcgcu

SEQ ID NO: 3454347 - RNA, 14 nt, Pseudomonas aeruginosa PA01
cucguucgucgccg

SEQ ID NO: 3454348 - RNA, 22 nt, Pseudomonas aeruginosa PA01
cucguugaccaguacgucacga

SEQ ID NO: 3454349 - RNA, 23 nt, Pseudomonas aeruginosa PA01
cucguugaguucgaagcgccagg

SEQ ID NO: 3454350 - RNA, 17 nt, Pseudomonas aeruginosa PA01
cucguugcacagcgccc

SEQ ID NO: 3454351 - RNA, 14 nt, Pseudomonas aeruginosa PA01
cucguugcgccgcu

SEQ ID NO: 3454352 - RNA, 15 nt, Pseudomonas aeruginosa PA01
cucguugcgccgcuc

SEQ ID NO: 3454353 - RNA, 16 nt, Pseudomonas aeruginosa PA01
cucguuggccaccugc

SEQ ID NO: 3454354 - RNA, 18 nt, Pseudomonas aeruginosa PA01
cucguuggcggccagcau

SEQ ID NO: 3454355 - RNA, 13 nt, Pseudomonas aeruginosa PA01
cucuaccaggcgg

SEQ ID NO: 3454356 - RNA, 23 nt, Pseudomonas aeruginosa PA01
cucuaccaggcgguuggcccgcg

SEQ ID NO: 3454357 - RNA, 18 nt, Pseudomonas aeruginosa PA01
cucuaccgagaucaccuu

SEQ ID NO: 3454358 - RNA, 16 nt, Pseudomonas aeruginosa PA01
cucuacuaccgccagc

SEQ ID NO: 3454359 - RNA, 22 nt, Pseudomonas aeruginosa PA01
cucuaucacacuguccagggcg

SEQ ID NO: 3454360 - RNA, 19 nt, Pseudomonas aeruginosa PA01
cucuaugcaauggggcgcu

SEQ ID NO: 3454361 - RNA, 23 nt, Pseudomonas aeruginosa PA01
cucuaugcgcgggguaggggugg

SEQ ID NO: 3454362 - RNA, 17 nt, Pseudomonas aeruginosa PA01
cucucaggagcgccgcg

SEQ ID NO: 3454363 - RNA, 19 nt, Pseudomonas aeruginosa PA01
cucucaggagcgccgcgca

SEQ ID NO: 3454364 - RNA, 21 nt, Pseudomonas aeruginosa PA01
cucuccaggucggucggcggc

SEQ ID NO: 3454365 - RNA, 19 nt, Pseudomonas aeruginosa PA01
cucuccccaaccuucuccc

SEQ ID NO: 3454366 - RNA, 21 nt, Pseudomonas aeruginosa PA01
cucuccccaaccuucucccuu

SEQ ID NO: 3454367 - RNA, 13 nt, Pseudomonas aeruginosa PA01
cucuccccagacc

SEQ ID NO: 3454368 - RNA, 20 nt, Pseudomonas aeruginosa PA01
cucuccccagacccucuccc

SEQ ID NO: 3454369 - RNA, 15 nt, Pseudomonas aeruginosa PA01
cucucccgaggcgau

SEQ ID NO: 3454370 - RNA, 23 nt, Pseudomonas aeruginosa PA01
cucucccgaggcgaucgccgcgg

SEQ ID NO: 3454371 - RNA, 22 nt, Pseudomonas aeruginosa PA01
cucuccgagacgcugcaccgcg

SEQ ID NO: 3454372 - RNA, 14 nt, Pseudomonas aeruginosa PA01
cucuccgcgccgcg

SEQ ID NO: 3454373 - RNA, 20 nt, Pseudomonas aeruginosa PA01
cucuccgucaaugcggccug

SEQ ID NO: 3454374 - RNA, 21 nt, Pseudomonas aeruginosa PA01
cucuccgucaaugcggccugc

SEQ ID NO: 3454375 - RNA, 21 nt, Pseudomonas aeruginosa PA01
cucucgaacaccaggcgccag

SEQ ID NO: 3454376 - RNA, 14 nt, Pseudomonas aeruginosa PA01
cucucgaacagcag

SEQ ID NO: 3454377 - RNA, 16 nt, Pseudomonas aeruginosa PA01
cucucgaacagcagca

SEQ ID NO: 3454378 - RNA, 19 nt, Pseudomonas aeruginosa PA01
cucucgacguaccgccugc

SEQ ID NO: 3454379 - RNA, 22 nt, Pseudomonas aeruginosa PA01
cucucgacuugaacagggucuu

SEQ ID NO: 3454380 - RNA, 14 nt, Pseudomonas aeruginosa PA01
cucucgccgccuuc

SEQ ID NO: 3454381 - RNA, 13 nt, Pseudomonas aeruginosa PA01
cucucgccgcgcu

SEQ ID NO: 3454382 - RNA, 18 nt, Pseudomonas aeruginosa PA01
cucucgccgcgcucgcgc

SEQ ID NO: 3454383 - RNA, 11 nt, Pseudomonas aeruginosa PA01
cucucgccggc

SEQ ID NO: 3454384 - RNA, 16 nt, Pseudomonas aeruginosa PA01
cucucgccucggcggg

SEQ ID NO: 3454385 - RNA, 13 nt, Pseudomonas aeruginosa PA01
cucucgcgcagca

SEQ ID NO: 3454386 - RNA, 18 nt, Pseudomonas aeruginosa PA01
cucucgcgcagcaggauc

SEQ ID NO: 3454387 - RNA, 23 nt, Pseudomonas aeruginosa PA01
cucucgcugcgcgggucguccuc

SEQ ID NO: 3454388 - RNA, 16 nt, Pseudomonas aeruginosa PA01
cucucggugaccacca

SEQ ID NO: 3454389 - RNA, 21 nt, Pseudomonas aeruginosa PA01
cucucggugaccaccaggcgg

SEQ ID NO: 3454390 - RNA, 13 nt, Pseudomonas aeruginosa PA01
cucucgucagggg

SEQ ID NO: 3454391 - RNA, 15 nt, Pseudomonas aeruginosa PA01
cucucucgccucggc

SEQ ID NO: 3454392 - RNA, 18 nt, Pseudomonas aeruginosa PA01
cucugcaccgucauggug

SEQ ID NO: 3454393 - RNA, 13 nt, Pseudomonas aeruginosa PA01
cucugcaucucgg

SEQ ID NO: 3454394 - RNA, 17 nt, Pseudomonas aeruginosa PA01
cucugcauggcaccguc

SEQ ID NO: 3454395 - RNA, 19 nt, Pseudomonas aeruginosa PA01
cucugcauggcaccgucaa

SEQ ID NO: 3454396 - RNA, 19 nt, Pseudomonas aeruginosa PA01
cucugccgauccuugucga

SEQ ID NO: 3454397 - RNA, 20 nt, Pseudomonas aeruginosa PA01
cucugccggugugccgucag

SEQ ID NO: 3454398 - RNA, 16 nt, Pseudomonas aeruginosa PA01
cucugccugcgcccuc

SEQ ID NO: 3454399 - RNA, 22 nt, Pseudomonas aeruginosa PA01
cucugcgaucagggccucgcca

SEQ ID NO: 3454400 - RNA, 13 nt, Pseudomonas aeruginosa PA01
cucugcuccagca

SEQ ID NO: 3454401 - RNA, 22 nt, Pseudomonas aeruginosa PA01
cucugcugaauucccgcuccag

SEQ ID NO: 3454402 - RNA, 16 nt, Pseudomonas aeruginosa PA01
cucugcuggccacccu

SEQ ID NO: 3454403 - RNA, 15 nt, Pseudomonas aeruginosa PA01
cucugcuggccgccc

SEQ ID NO: 3454404 - RNA, 16 nt, Pseudomonas aeruginosa PA01
cucugcuggccgcccu

SEQ ID NO: 3454405 - RNA, 13 nt, Pseudomonas aeruginosa PA01
cucugcuggcugu

SEQ ID NO: 3454406 - RNA, 20 nt, Pseudomonas aeruginosa PA01
cucugcuucugucccugggc

SEQ ID NO: 3454407 - RNA, 22 nt, Pseudomonas aeruginosa PA01
cucugcuucugucccugggcca

SEQ ID NO: 3454408 - RNA, 12 nt, Pseudomonas aeruginosa PA01
cucuggcccagc

SEQ ID NO: 3454409 - RNA, 15 nt, Pseudomonas aeruginosa PA01
cucuggccguucucc

SEQ ID NO: 3454410 - RNA, 16 nt, Pseudomonas aeruginosa PA01
cucuggcgcauagcgg

SEQ ID NO: 3454411 - RNA, 15 nt, Pseudomonas aeruginosa PA01
cucuggcugaagacc

SEQ ID NO: 3454412 - RNA, 17 nt, Pseudomonas aeruginosa PA01
cucugggcauggcuggc

SEQ ID NO: 3454413 - RNA, 20 nt, Pseudomonas aeruginosa PA01
cucugguagccgcaguccag

SEQ ID NO: 3454414 - RNA, 14 nt, Pseudomonas aeruginosa PA01
cucugguagcugcg

SEQ ID NO: 3454415 - RNA, 17 nt, Pseudomonas aeruginosa PA01
cucuggucaugacgggc

SEQ ID NO: 3454416 - RNA, 14 nt, Pseudomonas aeruginosa PA01
cucugguuggccga

SEQ ID NO: 3454417 - RNA, 22 nt, Pseudomonas aeruginosa PA01
cucuguagggucgcagcaggcc

SEQ ID NO: 3454418 - RNA, 13 nt, Pseudomonas aeruginosa PA01
cucugucuccugu

SEQ ID NO: 3454419 - RNA, 23 nt, Pseudomonas aeruginosa PA01
cucugugcgguauagcucauggc

SEQ ID NO: 3454420 - RNA, 21 nt, Pseudomonas aeruginosa PA01
cucuguuucgggucgcccuug

SEQ ID NO: 3454421 - RNA, 22 nt, Pseudomonas aeruginosa PA01
cucuucacauggugggcgccgc

SEQ ID NO: 3454422 - RNA, 19 nt, Pseudomonas aeruginosa PA01
cucuucaggcugucggcca

SEQ ID NO: 3454423 - RNA, 20 nt, Pseudomonas aeruginosa PA01
cucuuccagcaugcucgggc

SEQ ID NO: 3454424 - RNA, 14 nt, Pseudomonas aeruginosa PA01
cucuucgccgcggc

SEQ ID NO: 3454425 - RNA, 15 nt, Pseudomonas aeruginosa PA01
cucuucggcggccag

SEQ ID NO: 3454426 - RNA, 16 nt, Pseudomonas aeruginosa PA01
cucuucggcggccagc

SEQ ID NO: 3454427 - RNA, 20 nt, Pseudomonas aeruginosa PA01
cucuucuuacagcuugcugg

SEQ ID NO: 3454428 - RNA, 20 nt, Pseudomonas aeruginosa PA01
cugagccggccggaggggau

SEQ ID NO: 3454429 - RNA, 18 nt, Pseudomonas aeruginosa PA01
cugagccucuaaggaaaa

SEQ ID NO: 3454430 - RNA, 20 nt, Pseudomonas aeruginosa PA01
cugagccucuaaggaaaaac

SEQ ID NO: 3454431 - RNA, 21 nt, Pseudomonas aeruginosa PA01
cugagccucuaaggaaaaacc

SEQ ID NO: 3454432 - RNA, 17 nt, Pseudomonas aeruginosa PA01
cugagcgccaggcgcaa

SEQ ID NO: 3454433 - RNA, 17 nt, Pseudomonas aeruginosa PA01
cugagcgccucgaucgc

SEQ ID NO: 3454434 - RNA, 21 nt, Pseudomonas aeruginosa PA01
cugagcggcggcacgaccaca

SEQ ID NO: 3454435 - RNA, 15 nt, Pseudomonas aeruginosa PA01
cugagcuggcccagu

SEQ ID NO: 3454436 - RNA, 19 nt, Pseudomonas aeruginosa PA01
cugagcuguuucagcccac

SEQ ID NO: 3454437 - RNA, 20 nt, Pseudomonas aeruginosa PA01
cugaggaagagcagcgcggc

SEQ ID NO: 3454438 - RNA, 15 nt, Pseudomonas aeruginosa PA01
cugaggacugccagg

SEQ ID NO: 3454439 - RNA, 22 nt, Pseudomonas aeruginosa PA01
cugaggaucacgauggccggca

SEQ ID NO: 3454440 - RNA, 13 nt, Pseudomonas aeruginosa PA01
cugaggaucagcc

SEQ ID NO: 3454441 - RNA, 14 nt, Pseudomonas aeruginosa PA01
cugaggaucagcca

SEQ ID NO: 3454442 - RNA, 15 nt, Pseudomonas aeruginosa PA01
cugaggaucagccag

SEQ ID NO: 3454443 - RNA, 16 nt, Pseudomonas aeruginosa PA01
cugaggaucagccagc

SEQ ID NO: 3454444 - RNA, 13 nt, Pseudomonas aeruginosa PA01
cugaggccgacga

SEQ ID NO: 3454445 - RNA, 17 nt, Pseudomonas aeruginosa PA01
cugaggccgacgaacag

SEQ ID NO: 3454446 - RNA, 19 nt, Pseudomonas aeruginosa PA01
cugaggccgacgaacagcc

SEQ ID NO: 3454447 - RNA, 21 nt, Pseudomonas aeruginosa PA01
cugaggccgacgaacagccag

SEQ ID NO: 3454448 - RNA, 16 nt, Pseudomonas aeruginosa PA01
cugaggccguagccga

SEQ ID NO: 3454449 - RNA, 19 nt, Pseudomonas aeruginosa PA01
cugaggcucagcgcgccga

SEQ ID NO: 3454450 - RNA, 20 nt, Pseudomonas aeruginosa PA01
cugaggcucccagguggaaa

SEQ ID NO: 3454451 - RNA, 16 nt, Pseudomonas aeruginosa PA01
cugaggcucgccgggu

SEQ ID NO: 3454452 - RNA, 13 nt, Pseudomonas aeruginosa PA01
cugaggcuggcga

SEQ ID NO: 3454453 - RNA, 12 nt, Pseudomonas aeruginosa PA01
cugaggggugag

SEQ ID NO: 3454454 - RNA, 22 nt, Pseudomonas aeruginosa PA01
cugaggguggaacccauggcgc

SEQ ID NO: 3454455 - RNA, 17 nt, Pseudomonas aeruginosa PA01
cugagguucaugccgcg

SEQ ID NO: 3454456 - RNA, 18 nt, Pseudomonas aeruginosa PA01
cugaguuucacgucgagc

SEQ ID NO: 3454457 - RNA, 15 nt, Pseudomonas aeruginosa PA01
cugaguuugcccagc

SEQ ID NO: 3454458 - RNA, 20 nt, Pseudomonas aeruginosa PA01
cugaguuugcccagcgccgc

SEQ ID NO: 3454459 - RNA, 15 nt, Pseudomonas aeruginosa PA01
cugauaagcucggcu

SEQ ID NO: 3454460 - RNA, 19 nt, Pseudomonas aeruginosa PA01
cugauauucgacgguaugu

SEQ ID NO: 3454461 - RNA, 15 nt, Pseudomonas aeruginosa PA01
cugaucagcccgcug

SEQ ID NO: 3454462 - RNA, 14 nt, Pseudomonas aeruginosa PA01
cugaucagccgggc

SEQ ID NO: 3454463 - RNA, 15 nt, Pseudomonas aeruginosa PA01
cugaucagccgggcg

SEQ ID NO: 3454464 - RNA, 23 nt, Pseudomonas aeruginosa PA01
cugaucagcuucuucagcagcgg

SEQ ID NO: 3454465 - RNA, 13 nt, Pseudomonas aeruginosa PA01
cugaucaggccga

SEQ ID NO: 3454466 - RNA, 21 nt, Pseudomonas aeruginosa PA01
cugaucaguaccggcagcgcc

SEQ ID NO: 3454467 - RNA, 22 nt, Pseudomonas aeruginosa PA01
cugaucaguaccggcagcgccg

SEQ ID NO: 3454468 - RNA, 12 nt, Pseudomonas aeruginosa PA01
cugaucaucugg

SEQ ID NO: 3454469 - RNA, 18 nt, Pseudomonas aeruginosa PA01
cugaucgaagcccaucga

SEQ ID NO: 3454470 - RNA, 22 nt, Pseudomonas aeruginosa PA01
cugaucgaagcccaucgacugc

SEQ ID NO: 3454471 - RNA, 14 nt, Pseudomonas aeruginosa PA01
cugaucggccgcca

SEQ ID NO: 3454472 - RNA, 15 nt, Pseudomonas aeruginosa PA01
cugaucggccgccag

SEQ ID NO: 3454473 - RNA, 16 nt, Pseudomonas aeruginosa PA01
cugaucggccgccagu

SEQ ID NO: 3454474 - RNA, 19 nt, Pseudomonas aeruginosa PA01
cugaucggccgccagugca

SEQ ID NO: 3454475 - RNA, 17 nt, Pseudomonas aeruginosa PA01
cugaucggcgcgccggc

SEQ ID NO: 3454476 - RNA, 18 nt, Pseudomonas aeruginosa PA01
cugaucucgguaucgcuu

SEQ ID NO: 3454477 - RNA, 14 nt, Pseudomonas aeruginosa PA01
cugaucuucugucc

SEQ ID NO: 3454478 - RNA, 16 nt, Pseudomonas aeruginosa PA01
cugaugaaucgccucc

SEQ ID NO: 3454479 - RNA, 22 nt, Pseudomonas aeruginosa PA01
cugaugaaucgccucccuggcg

SEQ ID NO: 3454480 - RNA, 18 nt, Pseudomonas aeruginosa PA01
cugaugaugccgcggcga

SEQ ID NO: 3454481 - RNA, 20 nt, Pseudomonas aeruginosa PA01
cugaugccgcgguaggucag

SEQ ID NO: 3454482 - RNA, 15 nt, Pseudomonas aeruginosa PA01
cugaugccggcgaac

SEQ ID NO: 3454483 - RNA, 18 nt, Pseudomonas aeruginosa PA01
cugaugccguucucccgc

SEQ ID NO: 3454484 - RNA, 22 nt, Pseudomonas aeruginosa PA01
cugaugccguucucccgcgcgc

SEQ ID NO: 3454485 - RNA, 20 nt, Pseudomonas aeruginosa PA01
cugaugugccgcacggugcg

SEQ ID NO: 3454486 - RNA, 21 nt, Pseudomonas aeruginosa PA01
cugcaaacgggcaucgucgaa

SEQ ID NO: 3454487 - RNA, 15 nt, Pseudomonas aeruginosa PA01
cugcaaagcggcgac

SEQ ID NO: 3454488 - RNA, 18 nt, Pseudomonas aeruginosa PA01
cugcaacacccaggccug

SEQ ID NO: 3454489 - RNA, 21 nt, Pseudomonas aeruginosa PA01
cugcaacacguagcgcagguc

SEQ ID NO: 3454490 - RNA, 14 nt, Pseudomonas aeruginosa PA01
cugcaacagaaguu

SEQ ID NO: 3454491 - RNA, 20 nt, Pseudomonas aeruginosa PA01
cugcaacagaaguugcuggc

SEQ ID NO: 3454492 - RNA, 22 nt, Pseudomonas aeruginosa PA01
cugcaacagaaguugcuggcga

SEQ ID NO: 3454493 - RNA, 14 nt, Pseudomonas aeruginosa PA01
cugcaacaggaccc

SEQ ID NO: 3454494 - RNA, 18 nt, Pseudomonas aeruginosa PA01
cugcaacaggacccagcc

SEQ ID NO: 3454495 - RNA, 23 nt, Pseudomonas aeruginosa PA01
cugcaacagggcauuggccauca

SEQ ID NO: 3454496 - RNA, 24 nt, Pseudomonas aeruginosa PA01
cugcaacaguggguaggccaggca

SEQ ID NO: 3454497 - RNA, 20 nt, Pseudomonas aeruginosa PA01
cugcaacauggcgucggcga

SEQ ID NO: 3454498 - RNA, 23 nt, Pseudomonas aeruginosa PA01
cugcaaccgauauggcuggcgca

SEQ ID NO: 3454499 - RNA, 13 nt, Pseudomonas aeruginosa PA01
cugcaacgccagc

SEQ ID NO: 3454500 - RNA, 17 nt, Pseudomonas aeruginosa PA01
cugcaacgcccgcgagc

SEQ ID NO: 3454501 - RNA, 13 nt, Pseudomonas aeruginosa PA01
cugcaacgccgcg

SEQ ID NO: 3454502 - RNA, 21 nt, Pseudomonas aeruginosa PA01
cugcaacgccggcccgugccc

SEQ ID NO: 3454503 - RNA, 22 nt, Pseudomonas aeruginosa PA01
cugcaacgccuggugcaggucg

SEQ ID NO: 3454504 - RNA, 20 nt, Pseudomonas aeruginosa PA01
cugcaacguccucgcgccgc

SEQ ID NO: 3454505 - RNA, 16 nt, Pseudomonas aeruginosa PA01
cugcaacucggcgccg

SEQ ID NO: 3454506 - RNA, 20 nt, Pseudomonas aeruginosa PA01
cugcaacucggcgucgcgcu

SEQ ID NO: 3454507 - RNA, 23 nt, Pseudomonas aeruginosa PA01
cugcaacucggcgucgcgcuugc

SEQ ID NO: 3454508 - RNA, 22 nt, Pseudomonas aeruginosa PA01
cugcaacucgucguccagcggc

SEQ ID NO: 3454509 - RNA, 14 nt, Pseudomonas aeruginosa PA01
cugcaacugcucga

SEQ ID NO: 3454510 - RNA, 13 nt, Pseudomonas aeruginosa PA01
cugcaacuggaag

SEQ ID NO: 3454511 - RNA, 23 nt, Pseudomonas aeruginosa PA01
cugcaacuggaaggccgcgccga

SEQ ID NO: 3454512 - RNA, 16 nt, Pseudomonas aeruginosa PA01
cugcaacuggccgaga

SEQ ID NO: 3454513 - RNA, 14 nt, Pseudomonas aeruginosa PA01
cugcaacuuccacu

SEQ ID NO: 3454514 - RNA, 20 nt, Pseudomonas aeruginosa PA01
cugcaacuuccacucgccga

SEQ ID NO: 3454515 - RNA, 14 nt, Pseudomonas aeruginosa PA01
cugcaaggcgguga

SEQ ID NO: 3454516 - RNA, 19 nt, Pseudomonas aeruginosa PA01
cugcaaggcggugaccagc

SEQ ID NO: 3454517 - RNA, 20 nt, Pseudomonas aeruginosa PA01
cugcaaggcggugaccagcg

SEQ ID NO: 3454518 - RNA, 21 nt, Pseudomonas aeruginosa PA01
cugcaaggcuucggcggucag

SEQ ID NO: 3454519 - RNA, 21 nt, Pseudomonas aeruginosa PA01
cugcaaucgcugccggucagg

SEQ ID NO: 3454520 - RNA, 22 nt, Pseudomonas aeruginosa PA01
cugcaaucgcugccggucaggc

SEQ ID NO: 3454521 - RNA, 17 nt, Pseudomonas aeruginosa PA01
cugcaauggggcggccg

SEQ ID NO: 3454522 - RNA, 19 nt, Pseudomonas aeruginosa PA01
cugcaauggggcggccggc

SEQ ID NO: 3454523 - RNA, 20 nt, Pseudomonas aeruginosa PA01
cugcaauggggcggccggcg

SEQ ID NO: 3454524 - RNA, 20 nt, Pseudomonas aeruginosa PA01
cugcaauuccaccggcuggc

SEQ ID NO: 3454525 - RNA, 14 nt, Pseudomonas aeruginosa PA01
cugcaauucgucgg

SEQ ID NO: 3454526 - RNA, 19 nt, Pseudomonas aeruginosa PA01
cugcaauucgucggccugc

SEQ ID NO: 3454527 - RNA, 22 nt, Pseudomonas aeruginosa PA01
cugcaauucgucggccugcucg

SEQ ID NO: 3454528 - RNA, 23 nt, Pseudomonas aeruginosa PA01
cugcaauucgucggccugcucga

SEQ ID NO: 3454529 - RNA, 13 nt, Pseudomonas aeruginosa PA01
cugcacagggacg

SEQ ID NO: 3454530 - RNA, 14 nt, Pseudomonas aeruginosa PA01
cugccaaacgccgu

SEQ ID NO: 3454531 - RNA, 15 nt, Pseudomonas aeruginosa PA01
cugccaaccgcgcuc

SEQ ID NO: 3454532 - RNA, 17 nt, Pseudomonas aeruginosa PA01
cugccaaccgcgcucgg

SEQ ID NO: 3454533 - RNA, 24 nt, Pseudomonas aeruginosa PA01
cugccaaccgcgcucggcggucag

SEQ ID NO: 3454534 - RNA, 16 nt, Pseudomonas aeruginosa PA01
cugccaacuggcgucc

SEQ ID NO: 3454535 - RNA, 13 nt, Pseudomonas aeruginosa PA01
cugccacccggcg

SEQ ID NO: 3454536 - RNA, 16 nt, Pseudomonas aeruginosa PA01
cugccacccggcgccc

SEQ ID NO: 3454537 - RNA, 21 nt, Pseudomonas aeruginosa PA01
cugccaccgagggcaggaacc

SEQ ID NO: 3454538 - RNA, 18 nt, Pseudomonas aeruginosa PA01
cugccacucggugcagau

SEQ ID NO: 3454539 - RNA, 14 nt, Pseudomonas aeruginosa PA01
cugccagaaggccu

SEQ ID NO: 3454540 - RNA, 16 nt, Pseudomonas aeruginosa PA01
cugccagaaggccugc

SEQ ID NO: 3454541 - RNA, 19 nt, Pseudomonas aeruginosa PA01
cugccagaaggccugcgcu

SEQ ID NO: 3454542 - RNA, 22 nt, Pseudomonas aeruginosa PA01
cugccagaaggccugcgcuucc

SEQ ID NO: 3454543 - RNA, 20 nt, Pseudomonas aeruginosa PA01
cugccagaccgagauuggcc

SEQ ID NO: 3454544 - RNA, 23 nt, Pseudomonas aeruginosa PA01
cugccagaccgagauuggccgcc

SEQ ID NO: 3454545 - RNA, 16 nt, Pseudomonas aeruginosa PA01
cugccagaccguggcg

SEQ ID NO: 3454546 - RNA, 15 nt, Pseudomonas aeruginosa PA01
cugccagagcgcugc

SEQ ID NO: 3454547 - RNA, 12 nt, Pseudomonas aeruginosa PA01
cugccagcaggc

SEQ ID NO: 3454548 - RNA, 15 nt, Pseudomonas aeruginosa PA01
cugccagcaggccga

SEQ ID NO: 3454549 - RNA, 17 nt, Pseudomonas aeruginosa PA01
cugccagcaggccgagc

SEQ ID NO: 3454550 - RNA, 18 nt, Pseudomonas aeruginosa PA01
cugccagcaggccgagcc

SEQ ID NO: 3454551 - RNA, 13 nt, Pseudomonas aeruginosa PA01
cugccagccccgc

SEQ ID NO: 3454552 - RNA, 12 nt, Pseudomonas aeruginosa PA01
cugccagcgccg

SEQ ID NO: 3454553 - RNA, 13 nt, Pseudomonas aeruginosa PA01
cugccagcgccgc

SEQ ID NO: 3454554 - RNA, 14 nt, Pseudomonas aeruginosa PA01
cugccagcgccgcc

SEQ ID NO: 3454555 - RNA, 17 nt, Pseudomonas aeruginosa PA01
cugccagcgccgccgcg

SEQ ID NO: 3454556 - RNA, 18 nt, Pseudomonas aeruginosa PA01
cugccagcgccgccgcgu

SEQ ID NO: 3454557 - RNA, 17 nt, Pseudomonas aeruginosa PA01
cugccagcgcgucggca

SEQ ID NO: 3454558 - RNA, 22 nt, Pseudomonas aeruginosa PA01
cugccagcgcgucggcacgccg

SEQ ID NO: 3454559 - RNA, 23 nt, Pseudomonas aeruginosa PA01
cugccagcgcgucggcacgccga

SEQ ID NO: 3454560 - RNA, 17 nt, Pseudomonas aeruginosa PA01
cugccagcgggcgccgc

SEQ ID NO: 3454561 - RNA, 19 nt, Pseudomonas aeruginosa PA01
cugccagcgggcgccgccg

SEQ ID NO: 3454562 - RNA, 17 nt, Pseudomonas aeruginosa PA01
cugccagcucuggccgu

SEQ ID NO: 3454563 - RNA, 12 nt, Pseudomonas aeruginosa PA01
cugccagcucuu

SEQ ID NO: 3454564 - RNA, 15 nt, Pseudomonas aeruginosa PA01
cugccagcucuugcc

SEQ ID NO: 3454565 - RNA, 14 nt, Pseudomonas aeruginosa PA01
cugccaggagcacg

SEQ ID NO: 3454566 - RNA, 15 nt, Pseudomonas aeruginosa PA01
cugccaggagcacgc

SEQ ID NO: 3454567 - RNA, 17 nt, Pseudomonas aeruginosa PA01
cugccaggagcacgccg

SEQ ID NO: 3454568 - RNA, 18 nt, Pseudomonas aeruginosa PA01
cugccaggagcacgccgu

SEQ ID NO: 3454569 - RNA, 20 nt, Pseudomonas aeruginosa PA01
cugccaggagcacgccgugc

SEQ ID NO: 3454570 - RNA, 20 nt, Pseudomonas aeruginosa PA01
cugccaggggcuagucgcgc

SEQ ID NO: 3454571 - RNA, 21 nt, Pseudomonas aeruginosa PA01
cugccaggggcuagucgcgca

SEQ ID NO: 3454572 - RNA, 23 nt, Pseudomonas aeruginosa PA01
cugccagguuggcaacugcgucc

SEQ ID NO: 3454573 - RNA, 21 nt, Pseudomonas aeruginosa PA01
cugccaguauuuggcgucgua

SEQ ID NO: 3454574 - RNA, 15 nt, Pseudomonas aeruginosa PA01
cugccaguggcggcg

SEQ ID NO: 3454575 - RNA, 16 nt, Pseudomonas aeruginosa PA01
cugccauccgcgccga

SEQ ID NO: 3454576 - RNA, 14 nt, Pseudomonas aeruginosa PA01
cugccauggcggcg

SEQ ID NO: 3454577 - RNA, 16 nt, Pseudomonas aeruginosa PA01
cugccauggcggcgga

SEQ ID NO: 3454578 - RNA, 19 nt, Pseudomonas aeruginosa PA01
cugcccaagggccugggcg

SEQ ID NO: 3454579 - RNA, 20 nt, Pseudomonas aeruginosa PA01
cugcccaagggccugggcgc

SEQ ID NO: 3454580 - RNA, 11 nt, Pseudomonas aeruginosa PA01
cugcccaccac

SEQ ID NO: 3454581 - RNA, 15 nt, Pseudomonas aeruginosa PA01
cugcccaccaccagg

SEQ ID NO: 3454582 - RNA, 13 nt, Pseudomonas aeruginosa PA01
cugcccagauccc

SEQ ID NO: 3454583 - RNA, 12 nt, Pseudomonas aeruginosa PA01
cugcccagcccg

SEQ ID NO: 3454584 - RNA, 14 nt, Pseudomonas aeruginosa PA01
cugcccagcccgcc

SEQ ID NO: 3454585 - RNA, 15 nt, Pseudomonas aeruginosa PA01
cugcccagcccgccu

SEQ ID NO: 3454586 - RNA, 21 nt, Pseudomonas aeruginosa PA01
cugcccagcccgccuuccagc

SEQ ID NO: 3454587 - RNA, 22 nt, Pseudomonas aeruginosa PA01
cugcccagcccgccuuccagcu

SEQ ID NO: 3454588 - RNA, 14 nt, Pseudomonas aeruginosa PA01
cugcccagcgccgc

SEQ ID NO: 3454589 - RNA, 17 nt, Pseudomonas aeruginosa PA01
cugcccagcgccgccag

SEQ ID NO: 3454590 - RNA, 18 nt, Pseudomonas aeruginosa PA01
cugcccagcgccgccagc

SEQ ID NO: 3454591 - RNA, 19 nt, Pseudomonas aeruginosa PA01
cugcccagcgccgccagca

SEQ ID NO: 3454592 - RNA, 14 nt, Pseudomonas aeruginosa PA01
cugcccaggcugag

SEQ ID NO: 3454593 - RNA, 17 nt, Pseudomonas aeruginosa PA01
cugcccagggcccagag

SEQ ID NO: 3454594 - RNA, 19 nt, Pseudomonas aeruginosa PA01
cugcccagggcccagagca

SEQ ID NO: 3454595 - RNA, 14 nt, Pseudomonas aeruginosa PA01
cugcccagguagcc

SEQ ID NO: 3454596 - RNA, 19 nt, Pseudomonas aeruginosa PA01
cugcccagguagccggcga

SEQ ID NO: 3454597 - RNA, 19 nt, Pseudomonas aeruginosa PA01
cugcccagugggccaccgg

SEQ ID NO: 3454598 - RNA, 20 nt, Pseudomonas aeruginosa PA01
cugcccagugggccaccggc

SEQ ID NO: 3454599 - RNA, 14 nt, Pseudomonas aeruginosa PA01
cugcccaguugcgc

SEQ ID NO: 3454600 - RNA, 19 nt, Pseudomonas aeruginosa PA01
cugcccaguugcgcggcga

SEQ ID NO: 3454601 - RNA, 21 nt, Pseudomonas aeruginosa PA01
cugcccaguugcgcggcgagu

SEQ ID NO: 3454602 - RNA, 15 nt, Pseudomonas aeruginosa PA01
cugcccaucgccucc

SEQ ID NO: 3454603 - RNA, 16 nt, Pseudomonas aeruginosa PA01
cugcccaucgccucca

SEQ ID NO: 3454604 - RNA, 17 nt, Pseudomonas aeruginosa PA01
cugcccaucgccuccac

SEQ ID NO: 3454605 - RNA, 16 nt, Pseudomonas aeruginosa PA01
cugccccacaggcccu

SEQ ID NO: 3454606 - RNA, 20 nt, Pseudomonas aeruginosa PA01
cugccccacaggcccugcag

SEQ ID NO: 3454607 - RNA, 22 nt, Pseudomonas aeruginosa PA01
cugccccacuuccggcccggcc

SEQ ID NO: 3454608 - RNA, 23 nt, Pseudomonas aeruginosa PA01
cugccccacuuccggcccggcca

SEQ ID NO: 3454609 - RNA, 13 nt, Pseudomonas aeruginosa PA01
cugccccagcauc

SEQ ID NO: 3454610 - RNA, 19 nt, Pseudomonas aeruginosa PA01
cugccccagcaucgccggc

SEQ ID NO: 3454611 - RNA, 20 nt, Pseudomonas aeruginosa PA01
cugccccagcaucgccggca

SEQ ID NO: 3454612 - RNA, 22 nt, Pseudomonas aeruginosa PA01
cugccccagcaucgccggcagc

SEQ ID NO: 3454613 - RNA, 14 nt, Pseudomonas aeruginosa PA01
cugccccgccggcg

SEQ ID NO: 3454614 - RNA, 12 nt, Pseudomonas aeruginosa PA01
cugccccggcuu

SEQ ID NO: 3454615 - RNA, 12 nt, Pseudomonas aeruginosa PA01
cugccccgggcg

SEQ ID NO: 3454616 - RNA, 13 nt, Pseudomonas aeruginosa PA01
cugccccgggcgc

SEQ ID NO: 3454617 - RNA, 16 nt, Pseudomonas aeruginosa PA01
cugccccgggcgccgg

SEQ ID NO: 3454618 - RNA, 17 nt, Pseudomonas aeruginosa PA01
cugccccgggcgccggg

SEQ ID NO: 3454619 - RNA, 19 nt, Pseudomonas aeruginosa PA01
cugccccgggcgccggguc

SEQ ID NO: 3454620 - RNA, 22 nt, Pseudomonas aeruginosa PA01
cugccccguagccaugcccggc

SEQ ID NO: 3454621 - RNA, 15 nt, Pseudomonas aeruginosa PA01
cugccccucacacca

SEQ ID NO: 3454622 - RNA, 17 nt, Pseudomonas aeruginosa PA01
cugccccucguggcgcg

SEQ ID NO: 3454623 - RNA, 23 nt, Pseudomonas aeruginosa PA01
cugccccuugagccaguccugga

SEQ ID NO: 3454624 - RNA, 23 nt, Pseudomonas aeruginosa PA01
cugcccgaccgguuccagcggcc

SEQ ID NO: 3454625 - RNA, 12 nt, Pseudomonas aeruginosa PA01
cugcccgccggc

SEQ ID NO: 3454626 - RNA, 14 nt, Pseudomonas aeruginosa PA01
cugcccgccggcgc

SEQ ID NO: 3454627 - RNA, 15 nt, Pseudomonas aeruginosa PA01
cugcccgccggcgcc

SEQ ID NO: 3454628 - RNA, 16 nt, Pseudomonas aeruginosa PA01
cugcccgccggcgccc

SEQ ID NO: 3454629 - RNA, 22 nt, Pseudomonas aeruginosa PA01
cugcccgccggcgcccugggcg

SEQ ID NO: 3454630 - RNA, 15 nt, Pseudomonas aeruginosa PA01
cugcccgcgccucgc

SEQ ID NO: 3454631 - RNA, 15 nt, Pseudomonas aeruginosa PA01
cugcccgcucggggc

SEQ ID NO: 3454632 - RNA, 18 nt, Pseudomonas aeruginosa PA01
cugcccgcucggggcauc

SEQ ID NO: 3454633 - RNA, 18 nt, Pseudomonas aeruginosa PA01
cugccgguaggucaccag

SEQ ID NO: 3454634 - RNA, 20 nt, Pseudomonas aeruginosa PA01
cugccgguaggucaccaggu

SEQ ID NO: 3454635 - RNA, 13 nt, Pseudomonas aeruginosa PA01
cugccggucaggc

SEQ ID NO: 3454636 - RNA, 15 nt, Pseudomonas aeruginosa PA01
cugccggucaggcug

SEQ ID NO: 3454637 - RNA, 18 nt, Pseudomonas aeruginosa PA01
cugccggucaggcuggug

SEQ ID NO: 3454638 - RNA, 21 nt, Pseudomonas aeruginosa PA01
cugccggucggaacgaccacg

SEQ ID NO: 3454639 - RNA, 13 nt, Pseudomonas aeruginosa PA01
cugccggugcucg

SEQ ID NO: 3454640 - RNA, 23 nt, Pseudomonas aeruginosa PA01
cugccggugugccgucaggcacc

SEQ ID NO: 3454641 - RNA, 17 nt, Pseudomonas aeruginosa PA01
cugccguacagcccccg

SEQ ID NO: 3454642 - RNA, 22 nt, Pseudomonas aeruginosa PA01
cugccguagcgcuucaucaggc

SEQ ID NO: 3454643 - RNA, 20 nt, Pseudomonas aeruginosa PA01
cugccguagugguugcgcac

SEQ ID NO: 3454644 - RNA, 23 nt, Pseudomonas aeruginosa PA01
cugccguagugguugcgcacgcu

SEQ ID NO: 3454645 - RNA, 16 nt, Pseudomonas aeruginosa PA01
cugccguauccgcggc

SEQ ID NO: 3454646 - RNA, 19 nt, Pseudomonas aeruginosa PA01
cugccguauccgcggcagg

SEQ ID NO: 3454647 - RNA, 15 nt, Pseudomonas aeruginosa PA01
cugccguccaggcgc

SEQ ID NO: 3454648 - RNA, 17 nt, Pseudomonas aeruginosa PA01
cugccguccaggcgcga

SEQ ID NO: 3454649 - RNA, 20 nt, Pseudomonas aeruginosa PA01
cugccgucgaagucguugaa

SEQ ID NO: 3454650 - RNA, 14 nt, Pseudomonas aeruginosa PA01
cugccguucgcccg

SEQ ID NO: 3454651 - RNA, 20 nt, Pseudomonas aeruginosa PA01
cugccguucgcccgcggcgg

SEQ ID NO: 3454652 - RNA, 18 nt, Pseudomonas aeruginosa PA01
cugccguucgucaccggc

SEQ ID NO: 3454653 - RNA, 22 nt, Pseudomonas aeruginosa PA01
cugccguucgucaccggcgcca

SEQ ID NO: 3454654 - RNA, 18 nt, Pseudomonas aeruginosa PA01
cugccguugcaggcccag

SEQ ID NO: 3454655 - RNA, 13 nt, Pseudomonas aeruginosa PA01
cugccguugcggc

SEQ ID NO: 3454656 - RNA, 15 nt, Pseudomonas aeruginosa PA01
cugccguugcggccc

SEQ ID NO: 3454657 - RNA, 22 nt, Pseudomonas aeruginosa PA01
cugccguuuuacucgucgccaa

SEQ ID NO: 3454658 - RNA, 13 nt, Pseudomonas aeruginosa PA01
cugccucgacgcu

SEQ ID NO: 3454659 - RNA, 14 nt, Pseudomonas aeruginosa PA01
cugccucgccgagg

SEQ ID NO: 3454660 - RNA, 15 nt, Pseudomonas aeruginosa PA01
cugccucgccgaggc

SEQ ID NO: 3454661 - RNA, 19 nt, Pseudomonas aeruginosa PA01
cugccucgguuuccggcca

SEQ ID NO: 3454662 - RNA, 21 nt, Pseudomonas aeruginosa PA01
cugccucgguuuccggccagg

SEQ ID NO: 3454663 - RNA, 22 nt, Pseudomonas aeruginosa PA01
cugccucgguuuccggccaggc

SEQ ID NO: 3454664 - RNA, 16 nt, Pseudomonas aeruginosa PA01
cugccugcaccgggcc

SEQ ID NO: 3454665 - RNA, 12 nt, Pseudomonas aeruginosa PA01
cugccuggcagg

SEQ ID NO: 3454666 - RNA, 16 nt, Pseudomonas aeruginosa PA01
cugccuggcagguccg

SEQ ID NO: 3454667 - RNA, 22 nt, Pseudomonas aeruginosa PA01
cugccuggggacggcaggcccc

SEQ ID NO: 3454668 - RNA, 16 nt, Pseudomonas aeruginosa PA01
cugccuguccgcugcg

SEQ ID NO: 3454669 - RNA, 15 nt, Pseudomonas aeruginosa PA01
cugccugucgcagcg

SEQ ID NO: 3454670 - RNA, 22 nt, Pseudomonas aeruginosa PA01
cugccuuacaagcagagggucg

SEQ ID NO: 3454671 - RNA, 14 nt, Pseudomonas aeruginosa PA01
cugccuuccagcag

SEQ ID NO: 3454672 - RNA, 15 nt, Pseudomonas aeruginosa PA01
cugccuuccagcagg

SEQ ID NO: 3454673 - RNA, 16 nt, Pseudomonas aeruginosa PA01
cugccuuccagcaggu

SEQ ID NO: 3454674 - RNA, 18 nt, Pseudomonas aeruginosa PA01
cugccuuccagcaggucg

SEQ ID NO: 3454675 - RNA, 18 nt, Pseudomonas aeruginosa PA01
cugccuucgaagccggca

SEQ ID NO: 3454676 - RNA, 19 nt, Pseudomonas aeruginosa PA01
cugccuucgaagccggcac

SEQ ID NO: 3454677 - RNA, 20 nt, Pseudomonas aeruginosa PA01
cugccuucgacguagaccug

SEQ ID NO: 3454678 - RNA, 18 nt, Pseudomonas aeruginosa PA01
cugcgaauagacgccgcu

SEQ ID NO: 3454679 - RNA, 18 nt, Pseudomonas aeruginosa PA01
cugcgaaucgucgccgga

SEQ ID NO: 3454680 - RNA, 14 nt, Pseudomonas aeruginosa PA01
cugcgaccgugagg

SEQ ID NO: 3454681 - RNA, 15 nt, Pseudomonas aeruginosa PA01
cugcgaccgugaggc

SEQ ID NO: 3454682 - RNA, 18 nt, Pseudomonas aeruginosa PA01
cugcgaccgugaggcgca

SEQ ID NO: 3454683 - RNA, 12 nt, Pseudomonas aeruginosa PA01
cugcgaccuggc

SEQ ID NO: 3454684 - RNA, 13 nt, Pseudomonas aeruginosa PA01
cugcgaccuggcg

SEQ ID NO: 3454685 - RNA, 17 nt, Pseudomonas aeruginosa PA01
cugcgaccuggcgccga

SEQ ID NO: 3454686 - RNA, 22 nt, Pseudomonas aeruginosa PA01
cugcgacgagccggacggcggc

SEQ ID NO: 3454687 - RNA, 20 nt, Pseudomonas aeruginosa PA01
cugcgacugacgguggaggc

SEQ ID NO: 3454688 - RNA, 14 nt, Pseudomonas aeruginosa PA01
cugcgacuggaugc

SEQ ID NO: 3454689 - RNA, 15 nt, Pseudomonas aeruginosa PA01
cugcgacuggaugca

SEQ ID NO: 3454690 - RNA, 16 nt, Pseudomonas aeruginosa PA01
cugcgagaacaggcgg

SEQ ID NO: 3454691 - RNA, 17 nt, Pseudomonas aeruginosa PA01
cugcgagacgggcgacg

SEQ ID NO: 3454692 - RNA, 15 nt, Pseudomonas aeruginosa PA01
cugcgagcaccaugc

SEQ ID NO: 3454693 - RNA, 18 nt, Pseudomonas aeruginosa PA01
cugcgagcaccaugccga

SEQ ID NO: 3454694 - RNA, 16 nt, Pseudomonas aeruginosa PA01
cugcgagcagguccug

SEQ ID NO: 3454695 - RNA, 13 nt, Pseudomonas aeruginosa PA01
cugcgagccgacu

SEQ ID NO: 3454696 - RNA, 14 nt, Pseudomonas aeruginosa PA01
cugcgagcgcacaa

SEQ ID NO: 3454697 - RNA, 21 nt, Pseudomonas aeruginosa PA01
cugcgagcgcacaacgccuuc

SEQ ID NO: 3454698 - RNA, 13 nt, Pseudomonas aeruginosa PA01
cugcgaggcggug

SEQ ID NO: 3454699 - RNA, 18 nt, Pseudomonas aeruginosa PA01
cugcgaggcggugcagcg

SEQ ID NO: 3454700 - RNA, 22 nt, Pseudomonas aeruginosa PA01
cugcgagggauguuccaggccc

SEQ ID NO: 3454701 - RNA, 23 nt, Pseudomonas aeruginosa PA01
cugcgaguugaucggcguggcgg

SEQ ID NO: 3454702 - RNA, 14 nt, Pseudomonas aeruginosa PA01
cugcgauggaacga

SEQ ID NO: 3454703 - RNA, 18 nt, Pseudomonas aeruginosa PA01
cugcgauggaacgagcgc

SEQ ID NO: 3454704 - RNA, 20 nt, Pseudomonas aeruginosa PA01
cugcgauggaacgagcgcga

SEQ ID NO: 3454705 - RNA, 19 nt, Pseudomonas aeruginosa PA01
cugcgcaacugccggucgg

SEQ ID NO: 3454706 - RNA, 19 nt, Pseudomonas aeruginosa PA01
cugcgcaaggaacuggaag

SEQ ID NO: 3454707 - RNA, 13 nt, Pseudomonas aeruginosa PA01
cugcgcaccaugc

SEQ ID NO: 3454708 - RNA, 22 nt, Pseudomonas aeruginosa PA01
cugcgcaccaugcccgcugggc

SEQ ID NO: 3454709 - RNA, 17 nt, Pseudomonas aeruginosa PA01
cugcgcagaugcggggc

SEQ ID NO: 3454710 - RNA, 14 nt, Pseudomonas aeruginosa PA01
cugcgcaggccgag

SEQ ID NO: 3454711 - RNA, 23 nt, Pseudomonas aeruginosa PA01
cugcgcaggcugguaugcagcaa

SEQ ID NO: 3454712 - RNA, 18 nt, Pseudomonas aeruginosa PA01
cugcgcagggcgccgucg

SEQ ID NO: 3454713 - RNA, 21 nt, Pseudomonas aeruginosa PA01
cugcgcagggcuuccuuggcg

SEQ ID NO: 3454714 - RNA, 18 nt, Pseudomonas aeruginosa PA01
cugcgcaucgccugggcc

SEQ ID NO: 3454715 - RNA, 19 nt, Pseudomonas aeruginosa PA01
cugcgcaucgccugggccg

SEQ ID NO: 3454716 - RNA, 22 nt, Pseudomonas aeruginosa PA01
cugcgccagcaucgcaucggcg

SEQ ID NO: 3454717 - RNA, 14 nt, Pseudomonas aeruginosa PA01
cugcgccaggccgu

SEQ ID NO: 3454718 - RNA, 12 nt, Pseudomonas aeruginosa PA01
cugcgccaggcg

SEQ ID NO: 3454719 - RNA, 13 nt, Pseudomonas aeruginosa PA01
cugcgccaggcuu

SEQ ID NO: 3454720 - RNA, 13 nt, Pseudomonas aeruginosa PA01
cugcgccaggugu

SEQ ID NO: 3454721 - RNA, 20 nt, Pseudomonas aeruginosa PA01
cugcgccaugccguucaggc

SEQ ID NO: 3454722 - RNA, 22 nt, Pseudomonas aeruginosa PA01
cugcgccaugccguucaggccg

SEQ ID NO: 3454723 - RNA, 23 nt, Pseudomonas aeruginosa PA01
cugcgccauucacuuccccuccc

SEQ ID NO: 3454724 - RNA, 21 nt, Pseudomonas aeruginosa PA01
cugcgcccagggacgcgccgg

SEQ ID NO: 3454725 - RNA, 19 nt, Pseudomonas aeruginosa PA01
cugcgcccccagcgcccgc

SEQ ID NO: 3454726 - RNA, 20 nt, Pseudomonas aeruginosa PA01
cugcgcccccagcgcccgca

SEQ ID NO: 3454727 - RNA, 14 nt, Pseudomonas aeruginosa PA01
cugcgccccggucu

SEQ ID NO: 3454728 - RNA, 22 nt, Pseudomonas aeruginosa PA01
cugcgccccggucucgcgcagc

SEQ ID NO: 3454729 - RNA, 20 nt, Pseudomonas aeruginosa PA01
cugcgcccucaagucuccag

SEQ ID NO: 3454730 - RNA, 22 nt, Pseudomonas aeruginosa PA01
cugcgcccucaagucuccagcg

SEQ ID NO: 3454731 - RNA, 13 nt, Pseudomonas aeruginosa PA01
cugcgccgcagcg

SEQ ID NO: 3454732 - RNA, 16 nt, Pseudomonas aeruginosa PA01
cugcgccgcagcggcc

SEQ ID NO: 3454733 - RNA, 18 nt, Pseudomonas aeruginosa PA01
cugcgccgcagcggccag

SEQ ID NO: 3454734 - RNA, 13 nt, Pseudomonas aeruginosa PA01
cugcgccgccguc

SEQ ID NO: 3454735 - RNA, 13 nt, Pseudomonas aeruginosa PA01
cugcggcucgccg

SEQ ID NO: 3454736 - RNA, 14 nt, Pseudomonas aeruginosa PA01
cugcggcucgccga

SEQ ID NO: 3454737 - RNA, 16 nt, Pseudomonas aeruginosa PA01
cugcggcugcagggcc

SEQ ID NO: 3454738 - RNA, 13 nt, Pseudomonas aeruginosa PA01
cugcggcuggcga

SEQ ID NO: 3454739 - RNA, 18 nt, Pseudomonas aeruginosa PA01
cugcggcuucgcgugcca

SEQ ID NO: 3454740 - RNA, 19 nt, Pseudomonas aeruginosa PA01
cugcggcuugcccugcucg

SEQ ID NO: 3454741 - RNA, 18 nt, Pseudomonas aeruginosa PA01
cugcgggaacuuggcgcg

SEQ ID NO: 3454742 - RNA, 22 nt, Pseudomonas aeruginosa PA01
cugcgggaacuuggcgcgcagg

SEQ ID NO: 3454743 - RNA, 20 nt, Pseudomonas aeruginosa PA01
cugcgggaugcccgucaggc

SEQ ID NO: 3454744 - RNA, 17 nt, Pseudomonas aeruginosa PA01
cugcgggccguagggcg

SEQ ID NO: 3454745 - RNA, 19 nt, Pseudomonas aeruginosa PA01
cugcgggcgauguugaaca

SEQ ID NO: 3454746 - RNA, 14 nt, Pseudomonas aeruginosa PA01
cugcgggcgccgcc

SEQ ID NO: 3454747 - RNA, 23 nt, Pseudomonas aeruginosa PA01
cugcgggcgccgccgcuggcgag

SEQ ID NO: 3454748 - RNA, 19 nt, Pseudomonas aeruginosa PA01
cugcgggcguagcgcggca

SEQ ID NO: 3454749 - RNA, 14 nt, Pseudomonas aeruginosa PA01
cugcggggccugcu

SEQ ID NO: 3454750 - RNA, 15 nt, Pseudomonas aeruginosa PA01
cugcggggccugcug

SEQ ID NO: 3454751 - RNA, 15 nt, Pseudomonas aeruginosa PA01
cugcggggcgcucag

SEQ ID NO: 3454752 - RNA, 14 nt, Pseudomonas aeruginosa PA01
cugcggggugagca

SEQ ID NO: 3454753 - RNA, 16 nt, Pseudomonas aeruginosa PA01
cugcggggugagcagu

SEQ ID NO: 3454754 - RNA, 17 nt, Pseudomonas aeruginosa PA01
cugcgggucauagucgg

SEQ ID NO: 3454755 - RNA, 16 nt, Pseudomonas aeruginosa PA01
cugcggguucagucgg

SEQ ID NO: 3454756 - RNA, 20 nt, Pseudomonas aeruginosa PA01
cugcggguucggcgagaggu

SEQ ID NO: 3454757 - RNA, 23 nt, Pseudomonas aeruginosa PA01
cugcggguucggcgagaggucgg

SEQ ID NO: 3454758 - RNA, 17 nt, Pseudomonas aeruginosa PA01
cugcggguuggucggca

SEQ ID NO: 3454759 - RNA, 16 nt, Pseudomonas aeruginosa PA01
cugcgguaccagcgca

SEQ ID NO: 3454760 - RNA, 18 nt, Pseudomonas aeruginosa PA01
cugcgguaccagcgcacc

SEQ ID NO: 3454761 - RNA, 22 nt, Pseudomonas aeruginosa PA01
cugcgguaccagcgcaccaggg

SEQ ID NO: 3454762 - RNA, 13 nt, Pseudomonas aeruginosa PA01
cugcggucgggug

SEQ ID NO: 3454763 - RNA, 16 nt, Pseudomonas aeruginosa PA01
cugcggucgggugaag

SEQ ID NO: 3454764 - RNA, 16 nt, Pseudomonas aeruginosa PA01
cugcggugucccuucu

SEQ ID NO: 3454765 - RNA, 19 nt, Pseudomonas aeruginosa PA01
cugcggugucccuucuuuu

SEQ ID NO: 3454766 - RNA, 17 nt, Pseudomonas aeruginosa PA01
cugcgguuuuccugccc

SEQ ID NO: 3454767 - RNA, 18 nt, Pseudomonas aeruginosa PA01
cugcguaguugagcccca

SEQ ID NO: 3454768 - RNA, 19 nt, Pseudomonas aeruginosa PA01
cugcguaguugagccccag

SEQ ID NO: 3454769 - RNA, 23 nt, Pseudomonas aeruginosa PA01
cugcguaguugagccccagguag

SEQ ID NO: 3454770 - RNA, 14 nt, Pseudomonas aeruginosa PA01
cugcgucagcgagg

SEQ ID NO: 3454771 - RNA, 21 nt, Pseudomonas aeruginosa PA01
cugcgucagcgaggcgggcgc

SEQ ID NO: 3454772 - RNA, 23 nt, Pseudomonas aeruginosa PA01
cugcgucgcagagacgcagcgcu

SEQ ID NO: 3454773 - RNA, 19 nt, Pseudomonas aeruginosa PA01
cugcgucgcauccaccagc

SEQ ID NO: 3454774 - RNA, 18 nt, Pseudomonas aeruginosa PA01
cugcgucguuggccggcu

SEQ ID NO: 3454775 - RNA, 19 nt, Pseudomonas aeruginosa PA01
cugcgucguuggccggcug

SEQ ID NO: 3454776 - RNA, 14 nt, Pseudomonas aeruginosa PA01
cugcgugagcuggg

SEQ ID NO: 3454777 - RNA, 13 nt, Pseudomonas aeruginosa PA01
cugcgugccagca

SEQ ID NO: 3454778 - RNA, 15 nt, Pseudomonas aeruginosa PA01
cugcgugccagcacc

SEQ ID NO: 3454779 - RNA, 17 nt, Pseudomonas aeruginosa PA01
cugcgugccagcaccuu

SEQ ID NO: 3454780 - RNA, 13 nt, Pseudomonas aeruginosa PA01
cugcgugccaggg

SEQ ID NO: 3454781 - RNA, 13 nt, Pseudomonas aeruginosa PA01
cugcgugcgccgc

SEQ ID NO: 3454782 - RNA, 17 nt, Pseudomonas aeruginosa PA01
cugcguggaaccgcggc

SEQ ID NO: 3454783 - RNA, 21 nt, Pseudomonas aeruginosa PA01
cugcguggaaccgcggcgccc

SEQ ID NO: 3454784 - RNA, 21 nt, Pseudomonas aeruginosa PA01
cugcguggcgaacgcccggcu

SEQ ID NO: 3454785 - RNA, 20 nt, Pseudomonas aeruginosa PA01
cugcguggguagccauggcg

SEQ ID NO: 3454786 - RNA, 21 nt, Pseudomonas aeruginosa PA01
cugcguggguagccauggcgg

SEQ ID NO: 3454787 - RNA, 15 nt, Pseudomonas aeruginosa PA01
cugcguggguagccg

SEQ ID NO: 3454788 - RNA, 15 nt, Pseudomonas aeruginosa PA01
cugcguucugcugcu

SEQ ID NO: 3454789 - RNA, 16 nt, Pseudomonas aeruginosa PA01
cugcguucugcugcuu

SEQ ID NO: 3454790 - RNA, 21 nt, Pseudomonas aeruginosa PA01
cugcuaggcuggaagccgcgc

SEQ ID NO: 3454791 - RNA, 22 nt, Pseudomonas aeruginosa PA01
cugcucacggccgaacagacgc

SEQ ID NO: 3454792 - RNA, 21 nt, Pseudomonas aeruginosa PA01
cugcucagcguccucagccuc

SEQ ID NO: 3454793 - RNA, 14 nt, Pseudomonas aeruginosa PA01
cugcucagggccgc

SEQ ID NO: 3454794 - RNA, 17 nt, Pseudomonas aeruginosa PA01
cugcucagggccgcgcc

SEQ ID NO: 3454795 - RNA, 17 nt, Pseudomonas aeruginosa PA01
cugcucauucggccagc

SEQ ID NO: 3454796 - RNA, 20 nt, Pseudomonas aeruginosa PA01
cugcucauucggccagcgcg

SEQ ID NO: 3454797 - RNA, 13 nt, Pseudomonas aeruginosa PA01
cugcuccagcaau

SEQ ID NO: 3454798 - RNA, 23 nt, Pseudomonas aeruginosa PA01
cugcuccagcaaugccagcgcca

SEQ ID NO: 3454799 - RNA, 12 nt, Pseudomonas aeruginosa PA01
cugcuccagcag

SEQ ID NO: 3454800 - RNA, 16 nt, Pseudomonas aeruginosa PA01
cugcuccagcagggcc

SEQ ID NO: 3454801 - RNA, 22 nt, Pseudomonas aeruginosa PA01
cugcuccagcagggccagcgcc

SEQ ID NO: 3454802 - RNA, 23 nt, Pseudomonas aeruginosa PA01
cugcuccagcagggccagcgccu

SEQ ID NO: 3454803 - RNA, 14 nt, Pseudomonas aeruginosa PA01
cugcuccagcccgg

SEQ ID NO: 3454804 - RNA, 15 nt, Pseudomonas aeruginosa PA01
cugcuccagcccggc

SEQ ID NO: 3454805 - RNA, 15 nt, Pseudomonas aeruginosa PA01
cugcuccagcggagc

SEQ ID NO: 3454806 - RNA, 22 nt, Pseudomonas aeruginosa PA01
cugcuccagcggagcgaccgga

SEQ ID NO: 3454807 - RNA, 18 nt, Pseudomonas aeruginosa PA01
cugcuccaucaguugcgc

SEQ ID NO: 3454808 - RNA, 14 nt, Pseudomonas aeruginosa PA01
cugcucccaugagc

SEQ ID NO: 3454809 - RNA, 14 nt, Pseudomonas aeruginosa PA01
cugcucccuggcgg

SEQ ID NO: 3454810 - RNA, 16 nt, Pseudomonas aeruginosa PA01
cugcucccuggcggau

SEQ ID NO: 3454811 - RNA, 15 nt, Pseudomonas aeruginosa PA01
cugcuccuccaggcu

SEQ ID NO: 3454812 - RNA, 20 nt, Pseudomonas aeruginosa PA01
cugcuccuccccguccuggc

SEQ ID NO: 3454813 - RNA, 21 nt, Pseudomonas aeruginosa PA01
cugcuccuccccguccuggcg

SEQ ID NO: 3454814 - RNA, 22 nt, Pseudomonas aeruginosa PA01
cugcuccuccccguccuggcgg

SEQ ID NO: 3454815 - RNA, 13 nt, Pseudomonas aeruginosa PA01
cugcuccucgccg

SEQ ID NO: 3454816 - RNA, 23 nt, Pseudomonas aeruginosa PA01
cugcuccucgccguacagcaggc

SEQ ID NO: 3454817 - RNA, 15 nt, Pseudomonas aeruginosa PA01
cugcuccucggcagc

SEQ ID NO: 3454818 - RNA, 20 nt, Pseudomonas aeruginosa PA01
cugcuccugaaggaccagcu

SEQ ID NO: 3454819 - RNA, 14 nt, Pseudomonas aeruginosa PA01
cugcuccugcaggc

SEQ ID NO: 3454820 - RNA, 22 nt, Pseudomonas aeruginosa PA01
cugcuccugcaggcccugccag

SEQ ID NO: 3454821 - RNA, 23 nt, Pseudomonas aeruginosa PA01
cugcuccuuucggaacagcgccu

SEQ ID NO: 3454822 - RNA, 17 nt, Pseudomonas aeruginosa PA01
cugcucgaaagccucca

SEQ ID NO: 3454823 - RNA, 19 nt, Pseudomonas aeruginosa PA01
cugcucgaaagccuccagc

SEQ ID NO: 3454824 - RNA, 20 nt, Pseudomonas aeruginosa PA01
cugcucgaaagccuccagca

SEQ ID NO: 3454825 - RNA, 23 nt, Pseudomonas aeruginosa PA01
cugcucgaaagccuccagcagcu

SEQ ID NO: 3454826 - RNA, 21 nt, Pseudomonas aeruginosa PA01
cugcucgaacaucagcagcgc

SEQ ID NO: 3454827 - RNA, 23 nt, Pseudomonas aeruginosa PA01
cugcucgaacaucagcagcgcca

SEQ ID NO: 3454828 - RNA, 17 nt, Pseudomonas aeruginosa PA01
cugcucgaacggcggau

SEQ ID NO: 3454829 - RNA, 16 nt, Pseudomonas aeruginosa PA01
cugcucgaacugcucc

SEQ ID NO: 3454830 - RNA, 14 nt, Pseudomonas aeruginosa PA01
cugcucgacgaucu

SEQ ID NO: 3454831 - RNA, 18 nt, Pseudomonas aeruginosa PA01
cugcucgacggcaccagc

SEQ ID NO: 3454832 - RNA, 16 nt, Pseudomonas aeruginosa PA01
cugcucgaggauggca

SEQ ID NO: 3454833 - RNA, 20 nt, Pseudomonas aeruginosa PA01
cugcucgaggauggcacggg

SEQ ID NO: 3454834 - RNA, 17 nt, Pseudomonas aeruginosa PA01
cugcucgauccagccgg

SEQ ID NO: 3454835 - RNA, 17 nt, Pseudomonas aeruginosa PA01
cugcucgauggccuuga

SEQ ID NO: 3454836 - RNA, 16 nt, Pseudomonas aeruginosa PA01
cugcucgauggcggcc

SEQ ID NO: 3454837 - RNA, 17 nt, Pseudomonas aeruginosa PA01
cugcuguguccggcgga

SEQ ID NO: 3454838 - RNA, 15 nt, Pseudomonas aeruginosa PA01
cugcuguugccaggg

SEQ ID NO: 3454839 - RNA, 19 nt, Pseudomonas aeruginosa PA01
cugcuuaccuugccggugc

SEQ ID NO: 3454840 - RNA, 14 nt, Pseudomonas aeruginosa PA01
cugcuucagcccgg

SEQ ID NO: 3454841 - RNA, 15 nt, Pseudomonas aeruginosa PA01
cugcuucagcccggc

SEQ ID NO: 3454842 - RNA, 16 nt, Pseudomonas aeruginosa PA01
cugcuucagcccggca

SEQ ID NO: 3454843 - RNA, 23 nt, Pseudomonas aeruginosa PA01
cugcuucaggaguuucaucucgg

SEQ ID NO: 3454844 - RNA, 14 nt, Pseudomonas aeruginosa PA01
cugcuucaggcgcg

SEQ ID NO: 3454845 - RNA, 18 nt, Pseudomonas aeruginosa PA01
cugcuucaggcgcgcggc

SEQ ID NO: 3454846 - RNA, 19 nt, Pseudomonas aeruginosa PA01
cugcuucaggcgcgcggcc

SEQ ID NO: 3454847 - RNA, 22 nt, Pseudomonas aeruginosa PA01
cugcuucaggcgcgcggccagc

SEQ ID NO: 3454848 - RNA, 22 nt, Pseudomonas aeruginosa PA01
cugcuucagguagugcaacacc

SEQ ID NO: 3454849 - RNA, 16 nt, Pseudomonas aeruginosa PA01
cugcuucgaccagggc

SEQ ID NO: 3454850 - RNA, 17 nt, Pseudomonas aeruginosa PA01
cugcuucgaccagggca

SEQ ID NO: 3454851 - RNA, 20 nt, Pseudomonas aeruginosa PA01
cugcuugccgagcugggcgu

SEQ ID NO: 3454852 - RNA, 17 nt, Pseudomonas aeruginosa PA01
cugcuugccgcucaggc

SEQ ID NO: 3454853 - RNA, 22 nt, Pseudomonas aeruginosa PA01
cugcuugcgccguggcaccagg

SEQ ID NO: 3454854 - RNA, 14 nt, Pseudomonas aeruginosa PA01
cugcuugcgcgccg

SEQ ID NO: 3454855 - RNA, 19 nt, Pseudomonas aeruginosa PA01
cugcuugcgcgccgccgcc

SEQ ID NO: 3454856 - RNA, 15 nt, Pseudomonas aeruginosa PA01
cugcuugcgcgcggc

SEQ ID NO: 3454857 - RNA, 16 nt, Pseudomonas aeruginosa PA01
cugcuuggccagcgcg

SEQ ID NO: 3454858 - RNA, 20 nt, Pseudomonas aeruginosa PA01
cugcuuggccagcgcggugc

SEQ ID NO: 3454859 - RNA, 23 nt, Pseudomonas aeruginosa PA01
cugcuuggccaggucgcgcaggg

SEQ ID NO: 3454860 - RNA, 21 nt, Pseudomonas aeruginosa PA01
cugcuugggcgccucgccgcg

SEQ ID NO: 3454861 - RNA, 20 nt, Pseudomonas aeruginosa PA01
cugcuugucgauggucagga

SEQ ID NO: 3454862 - RNA, 21 nt, Pseudomonas aeruginosa PA01
cugcuuucccugcugcggcaa

SEQ ID NO: 3454863 - RNA, 17 nt, Pseudomonas aeruginosa PA01
cuggaaaggccucggcg

SEQ ID NO: 3454864 - RNA, 20 nt, Pseudomonas aeruginosa PA01
cuggaaaggccucggcgaug

SEQ ID NO: 3454865 - RNA, 23 nt, Pseudomonas aeruginosa PA01
cuggaaaucggcguccuggucga

SEQ ID NO: 3454866 - RNA, 20 nt, Pseudomonas aeruginosa PA01
cuggaaauggcggucgccga

SEQ ID NO: 3454867 - RNA, 18 nt, Pseudomonas aeruginosa PA01
cuggaaaugguucaugaa

SEQ ID NO: 3454868 - RNA, 15 nt, Pseudomonas aeruginosa PA01
cuggaacaccaggcc

SEQ ID NO: 3454869 - RNA, 17 nt, Pseudomonas aeruginosa PA01
cuggaacaccaggccgc

SEQ ID NO: 3454870 - RNA, 15 nt, Pseudomonas aeruginosa PA01
cuggaacagcgcguc

SEQ ID NO: 3454871 - RNA, 15 nt, Pseudomonas aeruginosa PA01
cuggaaccggccggc

SEQ ID NO: 3454872 - RNA, 14 nt, Pseudomonas aeruginosa PA01
cuggaacggccagg

SEQ ID NO: 3454873 - RNA, 15 nt, Pseudomonas aeruginosa PA01
cuggaacggccaggu

SEQ ID NO: 3454874 - RNA, 19 nt, Pseudomonas aeruginosa PA01
cuggaacuagcccucgacc

SEQ ID NO: 3454875 - RNA, 20 nt, Pseudomonas aeruginosa PA01
cuggaacuagcccucgaccu

SEQ ID NO: 3454876 - RNA, 20 nt, Pseudomonas aeruginosa PA01
cuggaagaaggcgaucaucg

SEQ ID NO: 3454877 - RNA, 21 nt, Pseudomonas aeruginosa PA01
cuggaagaaggcgaucaucgc

SEQ ID NO: 3454878 - RNA, 16 nt, Pseudomonas aeruginosa PA01
cuggaagccugccaga

SEQ ID NO: 3454879 - RNA, 13 nt, Pseudomonas aeruginosa PA01
cuggaagcggguu

SEQ ID NO: 3454880 - RNA, 16 nt, Pseudomonas aeruginosa PA01
cuggaaggcgcugggc

SEQ ID NO: 3454881 - RNA, 20 nt, Pseudomonas aeruginosa PA01
cuggaaggcgcugggcggcu

SEQ ID NO: 3454882 - RNA, 15 nt, Pseudomonas aeruginosa PA01
cuggaagucgcccug

SEQ ID NO: 3454883 - RNA, 17 nt, Pseudomonas aeruginosa PA01
cuggaagucguccagca

SEQ ID NO: 3454884 - RNA, 19 nt, Pseudomonas aeruginosa PA01
cuggaagucguccagcagg

SEQ ID NO: 3454885 - RNA, 16 nt, Pseudomonas aeruginosa PA01
cuggaauaccccgcgg

SEQ ID NO: 3454886 - RNA, 20 nt, Pseudomonas aeruginosa PA01
cuggaaugccggccggggcc

SEQ ID NO: 3454887 - RNA, 20 nt, Pseudomonas aeruginosa PA01
cuggaauucgccgcgcgcca

SEQ ID NO: 3454888 - RNA, 15 nt, Pseudomonas aeruginosa PA01
cuggacaggcgcagg

SEQ ID NO: 3454889 - RNA, 20 nt, Pseudomonas aeruginosa PA01
cuggaccaccguggcgccgg

SEQ ID NO: 3454890 - RNA, 22 nt, Pseudomonas aeruginosa PA01
cuggaccaggcggccggugccu

SEQ ID NO: 3454891 - RNA, 14 nt, Pseudomonas aeruginosa PA01
cuggaccauggccg

SEQ ID NO: 3454892 - RNA, 14 nt, Pseudomonas aeruginosa PA01
cuggaccccgcccu

SEQ ID NO: 3454893 - RNA, 14 nt, Pseudomonas aeruginosa PA01
cuggacccgcaccu

SEQ ID NO: 3454894 - RNA, 12 nt, Pseudomonas aeruginosa PA01
cuggacccgggc

SEQ ID NO: 3454895 - RNA, 18 nt, Pseudomonas aeruginosa PA01
cuggacccgggccuccug

SEQ ID NO: 3454896 - RNA, 20 nt, Pseudomonas aeruginosa PA01
cuggacccgggccuccuggc

SEQ ID NO: 3454897 - RNA, 21 nt, Pseudomonas aeruginosa PA01
cuggacccgggccuccuggcg

SEQ ID NO: 3454898 - RNA, 22 nt, Pseudomonas aeruginosa PA01
cuggacccgggccuccuggcgg

SEQ ID NO: 3454899 - RNA, 19 nt, Pseudomonas aeruginosa PA01
cuggacccguugccgaccg

SEQ ID NO: 3454900 - RNA, 13 nt, Pseudomonas aeruginosa PA01
cuggaccuccgcc

SEQ ID NO: 3454901 - RNA, 14 nt, Pseudomonas aeruginosa PA01
cuggaccuccgcca

SEQ ID NO: 3454902 - RNA, 16 nt, Pseudomonas aeruginosa PA01
cuggaccuccgccagg

SEQ ID NO: 3454903 - RNA, 17 nt, Pseudomonas aeruginosa PA01
cuggaccuccuggcgcg

SEQ ID NO: 3454904 - RNA, 18 nt, Pseudomonas aeruginosa PA01
cuggaccuccuggcgcgu

SEQ ID NO: 3454905 - RNA, 12 nt, Pseudomonas aeruginosa PA01
cuggaccuggcc

SEQ ID NO: 3454906 - RNA, 16 nt, Pseudomonas aeruginosa PA01
cuggacgaaccgauca

SEQ ID NO: 3454907 - RNA, 13 nt, Pseudomonas aeruginosa PA01
cuggacgaaggcc

SEQ ID NO: 3454908 - RNA, 14 nt, Pseudomonas aeruginosa PA01
cuggacgaaggccu

SEQ ID NO: 3454909 - RNA, 14 nt, Pseudomonas aeruginosa PA01
cuggacgacgcugg

SEQ ID NO: 3454910 - RNA, 16 nt, Pseudomonas aeruginosa PA01
cuggacgacgcuggcc

SEQ ID NO: 3454911 - RNA, 19 nt, Pseudomonas aeruginosa PA01
cuggacgacgcuggccugc

SEQ ID NO: 3454912 - RNA, 20 nt, Pseudomonas aeruginosa PA01
cuggacgacgcuggccugcc

SEQ ID NO: 3454913 - RNA, 21 nt, Pseudomonas aeruginosa PA01
cuggacgacgcuggccugccg

SEQ ID NO: 3454914 - RNA, 18 nt, Pseudomonas aeruginosa PA01
cuggacggcggacugcuc

SEQ ID NO: 3454915 - RNA, 19 nt, Pseudomonas aeruginosa PA01
cuggacggcggacugcucg

SEQ ID NO: 3454916 - RNA, 22 nt, Pseudomonas aeruginosa PA01
cuggacggcggacugcucgccg

SEQ ID NO: 3454917 - RNA, 23 nt, Pseudomonas aeruginosa PA01
cuggacggcggacugcucgccgc

SEQ ID NO: 3454918 - RNA, 16 nt, Pseudomonas aeruginosa PA01
cuggacuucccggcgu

SEQ ID NO: 3454919 - RNA, 17 nt, Pseudomonas aeruginosa PA01
cuggagaaacucgcggg

SEQ ID NO: 3454920 - RNA, 20 nt, Pseudomonas aeruginosa PA01
cuggagaaauccggcuggcg

SEQ ID NO: 3454921 - RNA, 15 nt, Pseudomonas aeruginosa PA01
cuggagaaugaaaaa

SEQ ID NO: 3454922 - RNA, 19 nt, Pseudomonas aeruginosa PA01
cuggagaaugaaaaaggga

SEQ ID NO: 3454923 - RNA, 14 nt, Pseudomonas aeruginosa PA01
cuggagcagaaccg

SEQ ID NO: 3454924 - RNA, 20 nt, Pseudomonas aeruginosa PA01
cuggagcagaaccgccagca

SEQ ID NO: 3454925 - RNA, 20 nt, Pseudomonas aeruginosa PA01
cuggagcagggcgcaaccug

SEQ ID NO: 3454926 - RNA, 12 nt, Pseudomonas aeruginosa PA01
cuggagcgccuc

SEQ ID NO: 3454927 - RNA, 14 nt, Pseudomonas aeruginosa PA01
cuggagcugcgcgc

SEQ ID NO: 3454928 - RNA, 23 nt, Pseudomonas aeruginosa PA01
cuggagcuugccggcgacgccgu

SEQ ID NO: 3454929 - RNA, 13 nt, Pseudomonas aeruginosa PA01
cuggaguagcuga

SEQ ID NO: 3454930 - RNA, 20 nt, Pseudomonas aeruginosa PA01
cuggaguaucgcccuggccu

SEQ ID NO: 3454931 - RNA, 16 nt, Pseudomonas aeruginosa PA01
cuggauaagccgcgcc

SEQ ID NO: 3454932 - RNA, 21 nt, Pseudomonas aeruginosa PA01
cuggauaagccgcgccaucgg

SEQ ID NO: 3454933 - RNA, 19 nt, Pseudomonas aeruginosa PA01
cuggauacgcuuggccagg

SEQ ID NO: 3454934 - RNA, 18 nt, Pseudomonas aeruginosa PA01
cuggauacgggcgccagg

SEQ ID NO: 3454935 - RNA, 14 nt, Pseudomonas aeruginosa PA01
cuggauaucaccuc

SEQ ID NO: 3454936 - RNA, 13 nt, Pseudomonas aeruginosa PA01
cuggauaucuggg

SEQ ID NO: 3454937 - RNA, 14 nt, Pseudomonas aeruginosa PA01
cuggauaucugggc

SEQ ID NO: 3454938 - RNA, 16 nt, Pseudomonas aeruginosa PA01
cuggauaucugggcca

SEQ ID NO: 3454939 - RNA, 19 nt, Pseudomonas aeruginosa PA01
cuggcccaguugcccggcc

SEQ ID NO: 3454940 - RNA, 22 nt, Pseudomonas aeruginosa PA01
cuggcccggcgcacugcguggg

SEQ ID NO: 3454941 - RNA, 17 nt, Pseudomonas aeruginosa PA01
cuggcccucucucgccu

SEQ ID NO: 3454942 - RNA, 22 nt, Pseudomonas aeruginosa PA01
cuggcccucucucgccucggcg

SEQ ID NO: 3454943 - RNA, 23 nt, Pseudomonas aeruginosa PA01
cuggcccucucucgccucggcgg

SEQ ID NO: 3454944 - RNA, 14 nt, Pseudomonas aeruginosa PA01
cuggcccugcaaca

SEQ ID NO: 3454945 - RNA, 18 nt, Pseudomonas aeruginosa PA01
cuggcccugcaacaggac

SEQ ID NO: 3454946 - RNA, 18 nt, Pseudomonas aeruginosa PA01
cuggcccugcaucgcgac

SEQ ID NO: 3454947 - RNA, 15 nt, Pseudomonas aeruginosa PA01
cuggcccuggaccuc

SEQ ID NO: 3454948 - RNA, 12 nt, Pseudomonas aeruginosa PA01
cuggcccuggcg

SEQ ID NO: 3454949 - RNA, 14 nt, Pseudomonas aeruginosa PA01
cuggcccuggcgca

SEQ ID NO: 3454950 - RNA, 15 nt, Pseudomonas aeruginosa PA01
cuggcccuggcgcag

SEQ ID NO: 3454951 - RNA, 17 nt, Pseudomonas aeruginosa PA01
cuggcccuggcgcaggc

SEQ ID NO: 3454952 - RNA, 19 nt, Pseudomonas aeruginosa PA01
cuggcccuggcgcaggcgg

SEQ ID NO: 3454953 - RNA, 22 nt, Pseudomonas aeruginosa PA01
cuggccgaaauugaccagguac

SEQ ID NO: 3454954 - RNA, 24 nt, Pseudomonas aeruginosa PA01
cuggccgaaauugaccagguacgg

SEQ ID NO: 3454955 - RNA, 21 nt, Pseudomonas aeruginosa PA01
cuggccgaaguuguagaugau

SEQ ID NO: 3454956 - RNA, 19 nt, Pseudomonas aeruginosa PA01
cuggccgaauaggcgaucu

SEQ ID NO: 3454957 - RNA, 12 nt, Pseudomonas aeruginosa PA01
cuggccgaccag

SEQ ID NO: 3454958 - RNA, 21 nt, Pseudomonas aeruginosa PA01
cuggccgacccgcagcggcgc

SEQ ID NO: 3454959 - RNA, 15 nt, Pseudomonas aeruginosa PA01
cuggccgacgcugag

SEQ ID NO: 3454960 - RNA, 16 nt, Pseudomonas aeruginosa PA01
cuggccgagaucgguc

SEQ ID NO: 3454961 - RNA, 18 nt, Pseudomonas aeruginosa PA01
cuggccgagaucggucac

SEQ ID NO: 3454962 - RNA, 17 nt, Pseudomonas aeruginosa PA01
cuggccgagcgacuccg

SEQ ID NO: 3454963 - RNA, 23 nt, Pseudomonas aeruginosa PA01
cuggccgagcgacuccgggaaca

SEQ ID NO: 3454964 - RNA, 19 nt, Pseudomonas aeruginosa PA01
cuggccgagcgccgccugg

SEQ ID NO: 3454965 - RNA, 17 nt, Pseudomonas aeruginosa PA01
cuggccgagcugccgca

SEQ ID NO: 3454966 - RNA, 21 nt, Pseudomonas aeruginosa PA01
cuggccgagcugccgcaccgc

SEQ ID NO: 3454967 - RNA, 17 nt, Pseudomonas aeruginosa PA01
cuggccgagggcgcgca

SEQ ID NO: 3454968 - RNA, 16 nt, Pseudomonas aeruginosa PA01
cuggccgaucagcuug

SEQ ID NO: 3454969 - RNA, 20 nt, Pseudomonas aeruginosa PA01
cuggccgaucagcuuggccu

SEQ ID NO: 3454970 - RNA, 23 nt, Pseudomonas aeruginosa PA01
cuggccgaucagcuuggccuuga

SEQ ID NO: 3454971 - RNA, 23 nt, Pseudomonas aeruginosa PA01
cuggccgccaaaguucaguagcg

SEQ ID NO: 3454972 - RNA, 23 nt, Pseudomonas aeruginosa PA01
cuggccgcccuugcggcccgccu

SEQ ID NO: 3454973 - RNA, 19 nt, Pseudomonas aeruginosa PA01
cuggccgccucgcgccgcg

SEQ ID NO: 3454974 - RNA, 20 nt, Pseudomonas aeruginosa PA01
cuggccgccucgcgccgcgc

SEQ ID NO: 3454975 - RNA, 13 nt, Pseudomonas aeruginosa PA01
cuggccgccuggc

SEQ ID NO: 3454976 - RNA, 14 nt, Pseudomonas aeruginosa PA01
cuggccgccuggcc

SEQ ID NO: 3454977 - RNA, 15 nt, Pseudomonas aeruginosa PA01
cuggccgccuggccg

SEQ ID NO: 3454978 - RNA, 16 nt, Pseudomonas aeruginosa PA01
cuggccgccuggccgg

SEQ ID NO: 3454979 - RNA, 14 nt, Pseudomonas aeruginosa PA01
cuggccgcgcagga

SEQ ID NO: 3454980 - RNA, 16 nt, Pseudomonas aeruginosa PA01
cuggccgcgcaggaag

SEQ ID NO: 3454981 - RNA, 16 nt, Pseudomonas aeruginosa PA01
cuggccgcgcaggacg

SEQ ID NO: 3454982 - RNA, 20 nt, Pseudomonas aeruginosa PA01
cuggccgcgcgaccgcggcg

SEQ ID NO: 3454983 - RNA, 20 nt, Pseudomonas aeruginosa PA01
cuggccgcgcggcuugccgg

SEQ ID NO: 3454984 - RNA, 19 nt, Pseudomonas aeruginosa PA01
cuggccgcgcuccaacagg

SEQ ID NO: 3454985 - RNA, 21 nt, Pseudomonas aeruginosa PA01
cuggccgcggugggcuccagc

SEQ ID NO: 3454986 - RNA, 20 nt, Pseudomonas aeruginosa PA01
cuggccgcguucgccgaggc

SEQ ID NO: 3454987 - RNA, 21 nt, Pseudomonas aeruginosa PA01
cuggccgcugccgcucuggcu

SEQ ID NO: 3454988 - RNA, 12 nt, Pseudomonas aeruginosa PA01
cuggccgcugug

SEQ ID NO: 3454989 - RNA, 16 nt, Pseudomonas aeruginosa PA01
cuggccgcuguggaag

SEQ ID NO: 3454990 - RNA, 19 nt, Pseudomonas aeruginosa PA01
cuggccggcaacgaacuuc

SEQ ID NO: 3454991 - RNA, 18 nt, Pseudomonas aeruginosa PA01
cuggccggcacccugacc

SEQ ID NO: 3454992 - RNA, 17 nt, Pseudomonas aeruginosa PA01
cuggccggccagccagg

SEQ ID NO: 3454993 - RNA, 18 nt, Pseudomonas aeruginosa PA01
cuggccggccagccaggc

SEQ ID NO: 3454994 - RNA, 16 nt, Pseudomonas aeruginosa PA01
cuggccggcgaccuug

SEQ ID NO: 3454995 - RNA, 17 nt, Pseudomonas aeruginosa PA01
cuggccggcgaccuugu

SEQ ID NO: 3454996 - RNA, 20 nt, Pseudomonas aeruginosa PA01
cuggccggcgaccuugucca

SEQ ID NO: 3454997 - RNA, 13 nt, Pseudomonas aeruginosa PA01
cuggccggcgauc

SEQ ID NO: 3454998 - RNA, 17 nt, Pseudomonas aeruginosa PA01
cuggccggcgauggccg

SEQ ID NO: 3454999 - RNA, 19 nt, Pseudomonas aeruginosa PA01
cuggccggcgauggccgcc

SEQ ID NO: 3455000 - RNA, 18 nt, Pseudomonas aeruginosa PA01
cuggccgggggucgcggc

SEQ ID NO: 3455001 - RNA, 20 nt, Pseudomonas aeruginosa PA01
cuggccgggggucgcggcga

SEQ ID NO: 3455002 - RNA, 16 nt, Pseudomonas aeruginosa PA01
cuggccggucguucgc

SEQ ID NO: 3455003 - RNA, 21 nt, Pseudomonas aeruginosa PA01
cuggccggucguucgcccuuc

SEQ ID NO: 3455004 - RNA, 16 nt, Pseudomonas aeruginosa PA01
cuggccggugccgccc

SEQ ID NO: 3455005 - RNA, 19 nt, Pseudomonas aeruginosa PA01
cuggccggugccgcccugg

SEQ ID NO: 3455006 - RNA, 21 nt, Pseudomonas aeruginosa PA01
cuggccggugccgcccugggg

SEQ ID NO: 3455007 - RNA, 20 nt, Pseudomonas aeruginosa PA01
cuggccgucccugaccagca

SEQ ID NO: 3455008 - RNA, 22 nt, Pseudomonas aeruginosa PA01
cuggccgucccugaccagcagg

SEQ ID NO: 3455009 - RNA, 21 nt, Pseudomonas aeruginosa PA01
cuggccguccugcuugaccuu

SEQ ID NO: 3455010 - RNA, 12 nt, Pseudomonas aeruginosa PA01
cuggccgucgag

SEQ ID NO: 3455011 - RNA, 19 nt, Pseudomonas aeruginosa PA01
cuggccgucgaggucggcg

SEQ ID NO: 3455012 - RNA, 16 nt, Pseudomonas aeruginosa PA01
cuggccgucggccugc

SEQ ID NO: 3455013 - RNA, 18 nt, Pseudomonas aeruginosa PA01
cuggccgucggccugcuu

SEQ ID NO: 3455014 - RNA, 20 nt, Pseudomonas aeruginosa PA01
cuggccgucuuccagggcgg

SEQ ID NO: 3455015 - RNA, 17 nt, Pseudomonas aeruginosa PA01
cuggccgugcucgauga

SEQ ID NO: 3455016 - RNA, 17 nt, Pseudomonas aeruginosa PA01
cuggccguucuccaggu

SEQ ID NO: 3455017 - RNA, 19 nt, Pseudomonas aeruginosa PA01
cuggccguucuccaggucg

SEQ ID NO: 3455018 - RNA, 17 nt, Pseudomonas aeruginosa PA01
cuggccguugaccagcg

SEQ ID NO: 3455019 - RNA, 19 nt, Pseudomonas aeruginosa PA01
cuggccguugcgcaggcgg

SEQ ID NO: 3455020 - RNA, 21 nt, Pseudomonas aeruginosa PA01
cuggccucggcgaucgccagg

SEQ ID NO: 3455021 - RNA, 13 nt, Pseudomonas aeruginosa PA01
cuggccucggcgu

SEQ ID NO: 3455022 - RNA, 15 nt, Pseudomonas aeruginosa PA01
cuggccugcagcagg

SEQ ID NO: 3455023 - RNA, 16 nt, Pseudomonas aeruginosa PA01
cuggccugcagguccg

SEQ ID NO: 3455024 - RNA, 18 nt, Pseudomonas aeruginosa PA01
cuggccuggaacuggucg

SEQ ID NO: 3455025 - RNA, 16 nt, Pseudomonas aeruginosa PA01
cuggccugggacggcg

SEQ ID NO: 3455026 - RNA, 14 nt, Pseudomonas aeruginosa PA01
cuggccugggguag

SEQ ID NO: 3455027 - RNA, 22 nt, Pseudomonas aeruginosa PA01
cuggccugggguagccggccga

SEQ ID NO: 3455028 - RNA, 18 nt, Pseudomonas aeruginosa PA01
cuggccuuggccacgacc

SEQ ID NO: 3455029 - RNA, 16 nt, Pseudomonas aeruginosa PA01
cuggccuuggccaugc

SEQ ID NO: 3455030 - RNA, 22 nt, Pseudomonas aeruginosa PA01
cuggccuuguacagggcgcgga

SEQ ID NO: 3455031 - RNA, 19 nt, Pseudomonas aeruginosa PA01
cuggcgaaccaguccagca

SEQ ID NO: 3455032 - RNA, 16 nt, Pseudomonas aeruginosa PA01
cuggcgaacgauggug

SEQ ID NO: 3455033 - RNA, 16 nt, Pseudomonas aeruginosa PA01
cuggcgaagaaccacu

SEQ ID NO: 3455034 - RNA, 23 nt, Pseudomonas aeruginosa PA01
cuggcgaauauccucgucgaucc

SEQ ID NO: 3455035 - RNA, 18 nt, Pseudomonas aeruginosa PA01
cuggcgaaugccuucgac

SEQ ID NO: 3455036 - RNA, 21 nt, Pseudomonas aeruginosa PA01
cuggcgaauuuccugcuggcg

SEQ ID NO: 3455037 - RNA, 23 nt, Pseudomonas aeruginosa PA01
cuggcgaauuuccugcuggcgag

SEQ ID NO: 3455038 - RNA, 15 nt, Pseudomonas aeruginosa PA01
cuggcgacaggcgau

SEQ ID NO: 3455039 - RNA, 21 nt, Pseudomonas aeruginosa PA01
cuggcgaccggguccugcaga

SEQ ID NO: 3455040 - RNA, 23 nt, Pseudomonas aeruginosa PA01
cuggcgacgcuuuccgaaaccag

SEQ ID NO: 3455041 - RNA, 19 nt, Pseudomonas aeruginosa PA01
cuggcgcugucgcccgggc

SEQ ID NO: 3455042 - RNA, 17 nt, Pseudomonas aeruginosa PA01
cuggcgcuugccgcgcc

SEQ ID NO: 3455043 - RNA, 16 nt, Pseudomonas aeruginosa PA01
cuggcggaacagcucg

SEQ ID NO: 3455044 - RNA, 15 nt, Pseudomonas aeruginosa PA01
cuggcggaccgccuc

SEQ ID NO: 3455045 - RNA, 20 nt, Pseudomonas aeruginosa PA01
cuggcggauaucgcgccgcg

SEQ ID NO: 3455046 - RNA, 19 nt, Pseudomonas aeruginosa PA01
cuggcggaucaccggcugg

SEQ ID NO: 3455047 - RNA, 22 nt, Pseudomonas aeruginosa PA01
cuggcggaucaccggcuggccc

SEQ ID NO: 3455048 - RNA, 23 nt, Pseudomonas aeruginosa PA01
cuggcggaucaccggcuggcccu

SEQ ID NO: 3455049 - RNA, 21 nt, Pseudomonas aeruginosa PA01
cuggcggauguaguccagcgc

SEQ ID NO: 3455050 - RNA, 23 nt, Pseudomonas aeruginosa PA01
cuggcggauguaguccagcgccg

SEQ ID NO: 3455051 - RNA, 17 nt, Pseudomonas aeruginosa PA01
cuggcggcacuccagga

SEQ ID NO: 3455052 - RNA, 16 nt, Pseudomonas aeruginosa PA01
cuggcggcaucggcgc

SEQ ID NO: 3455053 - RNA, 18 nt, Pseudomonas aeruginosa PA01
cuggcggcaucggcgccg

SEQ ID NO: 3455054 - RNA, 12 nt, Pseudomonas aeruginosa PA01
cuggcggccagg

SEQ ID NO: 3455055 - RNA, 20 nt, Pseudomonas aeruginosa PA01
cuggcggcccugguugcgga

SEQ ID NO: 3455056 - RNA, 12 nt, Pseudomonas aeruginosa PA01
cuggcggccgag

SEQ ID NO: 3455057 - RNA, 23 nt, Pseudomonas aeruginosa PA01
cuggcggccgaguucgcgcaggc

SEQ ID NO: 3455058 - RNA, 18 nt, Pseudomonas aeruginosa PA01
cuggcggcgcucacccac

SEQ ID NO: 3455059 - RNA, 19 nt, Pseudomonas aeruginosa PA01
cuggcggcguggcaccgcu

SEQ ID NO: 3455060 - RNA, 15 nt, Pseudomonas aeruginosa PA01
cuggcggcucggcug

SEQ ID NO: 3455061 - RNA, 15 nt, Pseudomonas aeruginosa PA01
cuggcggggucgcgc

SEQ ID NO: 3455062 - RNA, 17 nt, Pseudomonas aeruginosa PA01
cuggcgguagcccggca

SEQ ID NO: 3455063 - RNA, 14 nt, Pseudomonas aeruginosa PA01
cuggcggucgccgc

SEQ ID NO: 3455064 - RNA, 17 nt, Pseudomonas aeruginosa PA01
cuggcggucgccgccgg

SEQ ID NO: 3455065 - RNA, 18 nt, Pseudomonas aeruginosa PA01
cuggcggucgccgccggc

SEQ ID NO: 3455066 - RNA, 20 nt, Pseudomonas aeruginosa PA01
cuggcggucgccgccggcga

SEQ ID NO: 3455067 - RNA, 21 nt, Pseudomonas aeruginosa PA01
cuggcguagcguugcgcgagc

SEQ ID NO: 3455068 - RNA, 24 nt, Pseudomonas aeruginosa PA01
cuggcguagcguugcgcgagcacc

SEQ ID NO: 3455069 - RNA, 15 nt, Pseudomonas aeruginosa PA01
cuggcguagggcgaa

SEQ ID NO: 3455070 - RNA, 23 nt, Pseudomonas aeruginosa PA01
cuggcguaguagugccccuugau

SEQ ID NO: 3455071 - RNA, 16 nt, Pseudomonas aeruginosa PA01
cuggcguccccaugcc

SEQ ID NO: 3455072 - RNA, 18 nt, Pseudomonas aeruginosa PA01
cuggcguccccaugcccg

SEQ ID NO: 3455073 - RNA, 22 nt, Pseudomonas aeruginosa PA01
cuggcguccccaugcccggccu

SEQ ID NO: 3455074 - RNA, 18 nt, Pseudomonas aeruginosa PA01
cuggcgucgaaugcggcg

SEQ ID NO: 3455075 - RNA, 16 nt, Pseudomonas aeruginosa PA01
cuggcgucgaccgccu

SEQ ID NO: 3455076 - RNA, 19 nt, Pseudomonas aeruginosa PA01
cuggcgucgaccgccugcc

SEQ ID NO: 3455077 - RNA, 21 nt, Pseudomonas aeruginosa PA01
cuggcgucgaccgccugccag

SEQ ID NO: 3455078 - RNA, 19 nt, Pseudomonas aeruginosa PA01
cuggcgucgcacugcugcu

SEQ ID NO: 3455079 - RNA, 17 nt, Pseudomonas aeruginosa PA01
cuggcgucgccuuccac

SEQ ID NO: 3455080 - RNA, 20 nt, Pseudomonas aeruginosa PA01
cuggcgucgccuuccaccac

SEQ ID NO: 3455081 - RNA, 22 nt, Pseudomonas aeruginosa PA01
cuggcgucgccuuccaccacca

SEQ ID NO: 3455082 - RNA, 14 nt, Pseudomonas aeruginosa PA01
cuggcgugccgcca

SEQ ID NO: 3455083 - RNA, 16 nt, Pseudomonas aeruginosa PA01
cuggcgugccgccagg

SEQ ID NO: 3455084 - RNA, 17 nt, Pseudomonas aeruginosa PA01
cuggcgugccgccaggc

SEQ ID NO: 3455085 - RNA, 18 nt, Pseudomonas aeruginosa PA01
cuggcgugccgccaggcc

SEQ ID NO: 3455086 - RNA, 16 nt, Pseudomonas aeruginosa PA01
cuggcguggccggcga

SEQ ID NO: 3455087 - RNA, 23 nt, Pseudomonas aeruginosa PA01
cuggcguuauucgcccuacccga

SEQ ID NO: 3455088 - RNA, 18 nt, Pseudomonas aeruginosa PA01
cuggcguucucggccagg

SEQ ID NO: 3455089 - RNA, 19 nt, Pseudomonas aeruginosa PA01
cuggcguucucggccaggu

SEQ ID NO: 3455090 - RNA, 23 nt, Pseudomonas aeruginosa PA01
cuggcguuguugccgccgaagcc

SEQ ID NO: 3455091 - RNA, 17 nt, Pseudomonas aeruginosa PA01
cuggcuauucgcccagu

SEQ ID NO: 3455092 - RNA, 21 nt, Pseudomonas aeruginosa PA01
cuggcucgaucggcagggcgc

SEQ ID NO: 3455093 - RNA, 14 nt, Pseudomonas aeruginosa PA01
cuggcucugggcca

SEQ ID NO: 3455094 - RNA, 18 nt, Pseudomonas aeruginosa PA01
cuggcucuguuccucggc

SEQ ID NO: 3455095 - RNA, 22 nt, Pseudomonas aeruginosa PA01
cuggcucuguuccucggcggcg

SEQ ID NO: 3455096 - RNA, 23 nt, Pseudomonas aeruginosa PA01
cuggcucuguuccucggcggcgg

SEQ ID NO: 3455097 - RNA, 19 nt, Pseudomonas aeruginosa PA01
cuggcucuugccgcgagcu

SEQ ID NO: 3455098 - RNA, 12 nt, Pseudomonas aeruginosa PA01
cuggcugaagac

SEQ ID NO: 3455099 - RNA, 17 nt, Pseudomonas aeruginosa PA01
cuggcugaagacccugc

SEQ ID NO: 3455100 - RNA, 18 nt, Pseudomonas aeruginosa PA01
cuggcugaagacccugca

SEQ ID NO: 3455101 - RNA, 16 nt, Pseudomonas aeruginosa PA01
cuggcugaagccgggc

SEQ ID NO: 3455102 - RNA, 16 nt, Pseudomonas aeruginosa PA01
cuggcugaucaguucg

SEQ ID NO: 3455103 - RNA, 13 nt, Pseudomonas aeruginosa PA01
cuggcugcccagg

SEQ ID NO: 3455104 - RNA, 22 nt, Pseudomonas aeruginosa PA01
cuggcugcccaguugcgcggcg

SEQ ID NO: 3455105 - RNA, 17 nt, Pseudomonas aeruginosa PA01
cuggcugcccucgacga

SEQ ID NO: 3455106 - RNA, 12 nt, Pseudomonas aeruginosa PA01
cuggcugcgcgc

SEQ ID NO: 3455107 - RNA, 13 nt, Pseudomonas aeruginosa PA01
cuggcugcgcgcc

SEQ ID NO: 3455108 - RNA, 17 nt, Pseudomonas aeruginosa PA01
cuggcugcgcgccacca

SEQ ID NO: 3455109 - RNA, 13 nt, Pseudomonas aeruginosa PA01
cuggcugcuggcg

SEQ ID NO: 3455110 - RNA, 18 nt, Pseudomonas aeruginosa PA01
cuggcuggaguagcugaa

SEQ ID NO: 3455111 - RNA, 15 nt, Pseudomonas aeruginosa PA01
cuggcuggccagcag

SEQ ID NO: 3455112 - RNA, 17 nt, Pseudomonas aeruginosa PA01
cuggcuggccagcaggc

SEQ ID NO: 3455113 - RNA, 18 nt, Pseudomonas aeruginosa PA01
cuggcugguaacgggcga

SEQ ID NO: 3455114 - RNA, 21 nt, Pseudomonas aeruginosa PA01
cuggcuguaggugcccggcgg

SEQ ID NO: 3455115 - RNA, 17 nt, Pseudomonas aeruginosa PA01
cuggcugucgagcgaag

SEQ ID NO: 3455116 - RNA, 18 nt, Pseudomonas aeruginosa PA01
cuggcugucguagaacuu

SEQ ID NO: 3455117 - RNA, 13 nt, Pseudomonas aeruginosa PA01
cuggcuuuccagg

SEQ ID NO: 3455118 - RNA, 14 nt, Pseudomonas aeruginosa PA01
cuggcuuuccaggg

SEQ ID NO: 3455119 - RNA, 23 nt, Pseudomonas aeruginosa PA01
cuggcuuuccagggccuggcgca

SEQ ID NO: 3455120 - RNA, 17 nt, Pseudomonas aeruginosa PA01
cugggaaagaccgaaca

SEQ ID NO: 3455121 - RNA, 20 nt, Pseudomonas aeruginosa PA01
cugggaacccuugcgcaggu

SEQ ID NO: 3455122 - RNA, 20 nt, Pseudomonas aeruginosa PA01
cugggaauggcgaugccgag

SEQ ID NO: 3455123 - RNA, 21 nt, Pseudomonas aeruginosa PA01
cugggaauggcgaugccgagg

SEQ ID NO: 3455124 - RNA, 22 nt, Pseudomonas aeruginosa PA01
cugggaauggcggauagccgca

SEQ ID NO: 3455125 - RNA, 17 nt, Pseudomonas aeruginosa PA01
cugggaauugcgcacgc

SEQ ID NO: 3455126 - RNA, 19 nt, Pseudomonas aeruginosa PA01
cugggacggcagccugggg

SEQ ID NO: 3455127 - RNA, 13 nt, Pseudomonas aeruginosa PA01
cugggacggcggc

SEQ ID NO: 3455128 - RNA, 16 nt, Pseudomonas aeruginosa PA01
cugggacggcggcugg

SEQ ID NO: 3455129 - RNA, 16 nt, Pseudomonas aeruginosa PA01
cugggacggcugccca

SEQ ID NO: 3455130 - RNA, 22 nt, Pseudomonas aeruginosa PA01
cugggagaacuuuucccagcgg

SEQ ID NO: 3455131 - RNA, 14 nt, Pseudomonas aeruginosa PA01
cugggagccgccgg

SEQ ID NO: 3455132 - RNA, 15 nt, Pseudomonas aeruginosa PA01
cugggaguuccgcgc

SEQ ID NO: 3455133 - RNA, 19 nt, Pseudomonas aeruginosa PA01
cugggcaagcugcacggcg

SEQ ID NO: 3455134 - RNA, 20 nt, Pseudomonas aeruginosa PA01
cugggcaccaguggcgccgc

SEQ ID NO: 3455135 - RNA, 21 nt, Pseudomonas aeruginosa PA01
cugggcaccaguggcgccgcc

SEQ ID NO: 3455136 - RNA, 22 nt, Pseudomonas aeruginosa PA01
cugggcaccaguggcgccgcca

SEQ ID NO: 3455137 - RNA, 14 nt, Pseudomonas aeruginosa PA01
cugggcacgaugcu

SEQ ID NO: 3455138 - RNA, 14 nt, Pseudomonas aeruginosa PA01
cugggcagcgccgc

SEQ ID NO: 3455139 - RNA, 12 nt, Pseudomonas aeruginosa PA01
cugggcaggcug

SEQ ID NO: 3455140 - RNA, 15 nt, Pseudomonas aeruginosa PA01
cugggcauggcuggc

SEQ ID NO: 3455141 - RNA, 14 nt, Pseudomonas aeruginosa PA01
cugggccaccuggc

SEQ ID NO: 3455142 - RNA, 17 nt, Pseudomonas aeruginosa PA01
cugggccaccuggcucu

SEQ ID NO: 3455143 - RNA, 19 nt, Pseudomonas aeruginosa PA01
cugguaauggugaucaccu

SEQ ID NO: 3455144 - RNA, 11 nt, Pseudomonas aeruginosa PA01
cugguacagca

SEQ ID NO: 3455145 - RNA, 19 nt, Pseudomonas aeruginosa PA01
cugguacagcacccaggcg

SEQ ID NO: 3455146 - RNA, 15 nt, Pseudomonas aeruginosa PA01
cugguaccugccggc

SEQ ID NO: 3455147 - RNA, 20 nt, Pseudomonas aeruginosa PA01
cugguaccugccggcacgcu

SEQ ID NO: 3455148 - RNA, 15 nt, Pseudomonas aeruginosa PA01
cugguacgcccccuc

SEQ ID NO: 3455149 - RNA, 14 nt, Pseudomonas aeruginosa PA01
cugguacucguccu

SEQ ID NO: 3455150 - RNA, 17 nt, Pseudomonas aeruginosa PA01
cugguagaaacgcuuga

SEQ ID NO: 3455151 - RNA, 23 nt, Pseudomonas aeruginosa PA01
cugguagaacuccuugccguggc

SEQ ID NO: 3455152 - RNA, 21 nt, Pseudomonas aeruginosa PA01
cugguagaccaccgugcgcac

SEQ ID NO: 3455153 - RNA, 14 nt, Pseudomonas aeruginosa PA01
cugguagcccaggc

SEQ ID NO: 3455154 - RNA, 20 nt, Pseudomonas aeruginosa PA01
cugguagccgaagucggcgu

SEQ ID NO: 3455155 - RNA, 22 nt, Pseudomonas aeruginosa PA01
cugguagccgcaguccagggcg

SEQ ID NO: 3455156 - RNA, 14 nt, Pseudomonas aeruginosa PA01
cugguagcuaccgu

SEQ ID NO: 3455157 - RNA, 19 nt, Pseudomonas aeruginosa PA01
cugguagcuaccgucggcc

SEQ ID NO: 3455158 - RNA, 22 nt, Pseudomonas aeruginosa PA01
cugguagcuaccgucggccugc

SEQ ID NO: 3455159 - RNA, 23 nt, Pseudomonas aeruginosa PA01
cugguagcuaccgucggccugca

SEQ ID NO: 3455160 - RNA, 16 nt, Pseudomonas aeruginosa PA01
cugguagcugcggccg

SEQ ID NO: 3455161 - RNA, 19 nt, Pseudomonas aeruginosa PA01
cugguagcugcggccgagc

SEQ ID NO: 3455162 - RNA, 17 nt, Pseudomonas aeruginosa PA01
cugguaggacagggcca

SEQ ID NO: 3455163 - RNA, 20 nt, Pseudomonas aeruginosa PA01
cugguaggacagggccaggc

SEQ ID NO: 3455164 - RNA, 20 nt, Pseudomonas aeruginosa PA01
cugguaggagccgucgccgg

SEQ ID NO: 3455165 - RNA, 20 nt, Pseudomonas aeruginosa PA01
cugguaggccucgaugaucg

SEQ ID NO: 3455166 - RNA, 14 nt, Pseudomonas aeruginosa PA01
cugguaggcggcga

SEQ ID NO: 3455167 - RNA, 17 nt, Pseudomonas aeruginosa PA01
cugguaggcgucgucga

SEQ ID NO: 3455168 - RNA, 20 nt, Pseudomonas aeruginosa PA01
cugguaggugcgcuggcgcc

SEQ ID NO: 3455169 - RNA, 21 nt, Pseudomonas aeruginosa PA01
cugguaggugcgcuggcgcca

SEQ ID NO: 3455170 - RNA, 17 nt, Pseudomonas aeruginosa PA01
cugguaguaggcgcucu

SEQ ID NO: 3455171 - RNA, 17 nt, Pseudomonas aeruginosa PA01
cugguaguccagcaggu

SEQ ID NO: 3455172 - RNA, 12 nt, Pseudomonas aeruginosa PA01
cugguagucgcc

SEQ ID NO: 3455173 - RNA, 16 nt, Pseudomonas aeruginosa PA01
cugguagucgccgguc

SEQ ID NO: 3455174 - RNA, 23 nt, Pseudomonas aeruginosa PA01
cugguagucgcgguugcugugca

SEQ ID NO: 3455175 - RNA, 15 nt, Pseudomonas aeruginosa PA01
cugguagugcuggcg

SEQ ID NO: 3455176 - RNA, 16 nt, Pseudomonas aeruginosa PA01
cuggucaauaccaccc

SEQ ID NO: 3455177 - RNA, 17 nt, Pseudomonas aeruginosa PA01
cuggucaauaccacccu

SEQ ID NO: 3455178 - RNA, 15 nt, Pseudomonas aeruginosa PA01
cuggucaggcugauc

SEQ ID NO: 3455179 - RNA, 19 nt, Pseudomonas aeruginosa PA01
cuggucaguucggcccagc

SEQ ID NO: 3455180 - RNA, 16 nt, Pseudomonas aeruginosa PA01
cuggucauccuggccc

SEQ ID NO: 3455181 - RNA, 22 nt, Pseudomonas aeruginosa PA01
cugguccaaccgggcaucgccg

SEQ ID NO: 3455182 - RNA, 23 nt, Pseudomonas aeruginosa PA01
cugguccaaccgggcaucgccga

SEQ ID NO: 3455183 - RNA, 14 nt, Pseudomonas aeruginosa PA01
cugguccaccagcc

SEQ ID NO: 3455184 - RNA, 19 nt, Pseudomonas aeruginosa PA01
cugguccagcuggcgcagc

SEQ ID NO: 3455185 - RNA, 19 nt, Pseudomonas aeruginosa PA01
cugguccggcacuuccuug

SEQ ID NO: 3455186 - RNA, 17 nt, Pseudomonas aeruginosa PA01
cugguccgucucgucga

SEQ ID NO: 3455187 - RNA, 19 nt, Pseudomonas aeruginosa PA01
cugguccugcggcggcagg

SEQ ID NO: 3455188 - RNA, 14 nt, Pseudomonas aeruginosa PA01
cuggucgaaagccu

SEQ ID NO: 3455189 - RNA, 20 nt, Pseudomonas aeruginosa PA01
cuggucgaaagccugccggg

SEQ ID NO: 3455190 - RNA, 19 nt, Pseudomonas aeruginosa PA01
cuggucgacauagcgcagc

SEQ ID NO: 3455191 - RNA, 20 nt, Pseudomonas aeruginosa PA01
cuggucgacauagcgcagca

SEQ ID NO: 3455192 - RNA, 23 nt, Pseudomonas aeruginosa PA01
cuggucgacauagcgcagcaccg

SEQ ID NO: 3455193 - RNA, 23 nt, Pseudomonas aeruginosa PA01
cuggucgagcuuguuggccagca

SEQ ID NO: 3455194 - RNA, 15 nt, Pseudomonas aeruginosa PA01
cuggucgauccgcgc

SEQ ID NO: 3455195 - RNA, 16 nt, Pseudomonas aeruginosa PA01
cuggucgauccgcgcc

SEQ ID NO: 3455196 - RNA, 18 nt, Pseudomonas aeruginosa PA01
cuggucgauccgcgccug

SEQ ID NO: 3455197 - RNA, 20 nt, Pseudomonas aeruginosa PA01
cuggucgauccgcgccugcu

SEQ ID NO: 3455198 - RNA, 16 nt, Pseudomonas aeruginosa PA01
cuggucgaucucgucg

SEQ ID NO: 3455199 - RNA, 18 nt, Pseudomonas aeruginosa PA01
cuggucgaucucgucgaa

SEQ ID NO: 3455200 - RNA, 14 nt, Pseudomonas aeruginosa PA01
cuggucgcagccgc

SEQ ID NO: 3455201 - RNA, 15 nt, Pseudomonas aeruginosa PA01
cuggucgcagccgcg

SEQ ID NO: 3455202 - RNA, 13 nt, Pseudomonas aeruginosa PA01
cuggucgccgaag

SEQ ID NO: 3455203 - RNA, 16 nt, Pseudomonas aeruginosa PA01
cuggucgccgcagguc

SEQ ID NO: 3455204 - RNA, 16 nt, Pseudomonas aeruginosa PA01
cuggucgcgcgcggcc

SEQ ID NO: 3455205 - RNA, 20 nt, Pseudomonas aeruginosa PA01
cuggucgcgcgcggccagcu

SEQ ID NO: 3455206 - RNA, 18 nt, Pseudomonas aeruginosa PA01
cuggucgcggcugcgcgc

SEQ ID NO: 3455207 - RNA, 20 nt, Pseudomonas aeruginosa PA01
cuggucgcggcugcgcgccg

SEQ ID NO: 3455208 - RNA, 22 nt, Pseudomonas aeruginosa PA01
cuggucgcggcugcgcgccggg

SEQ ID NO: 3455209 - RNA, 13 nt, Pseudomonas aeruginosa PA01
cuggucgcggggc

SEQ ID NO: 3455210 - RNA, 19 nt, Pseudomonas aeruginosa PA01
cuggucgcguuccagcucc

SEQ ID NO: 3455211 - RNA, 18 nt, Pseudomonas aeruginosa PA01
cuggucgcuccagcccca

SEQ ID NO: 3455212 - RNA, 17 nt, Pseudomonas aeruginosa PA01
cuggucgcugaggccgc

SEQ ID NO: 3455213 - RNA, 15 nt, Pseudomonas aeruginosa PA01
cuggucggcgcggcg

SEQ ID NO: 3455214 - RNA, 17 nt, Pseudomonas aeruginosa PA01
cuggucggcgcggcgcu

SEQ ID NO: 3455215 - RNA, 21 nt, Pseudomonas aeruginosa PA01
cuggucggcggucucgaacgc

SEQ ID NO: 3455216 - RNA, 20 nt, Pseudomonas aeruginosa PA01
cuggucggcuuccgccgcca

SEQ ID NO: 3455217 - RNA, 16 nt, Pseudomonas aeruginosa PA01
cuggucggggccggcg

SEQ ID NO: 3455218 - RNA, 14 nt, Pseudomonas aeruginosa PA01
cuggucggggcgca

SEQ ID NO: 3455219 - RNA, 23 nt, Pseudomonas aeruginosa PA01
cuggucggggcgcaaggccagcg

SEQ ID NO: 3455220 - RNA, 16 nt, Pseudomonas aeruginosa PA01
cuggucguaggcgcgg

SEQ ID NO: 3455221 - RNA, 13 nt, Pseudomonas aeruginosa PA01
cuggucguucagu

SEQ ID NO: 3455222 - RNA, 19 nt, Pseudomonas aeruginosa PA01
cuggucguucagugccagc

SEQ ID NO: 3455223 - RNA, 22 nt, Pseudomonas aeruginosa PA01
cuggucguucagugccagcaga

SEQ ID NO: 3455224 - RNA, 15 nt, Pseudomonas aeruginosa PA01
cuggucguugcgcgc

SEQ ID NO: 3455225 - RNA, 16 nt, Pseudomonas aeruginosa PA01
cuggucguugcgcgca

SEQ ID NO: 3455226 - RNA, 22 nt, Pseudomonas aeruginosa PA01
cuggucguugcgcgcauagcag

SEQ ID NO: 3455227 - RNA, 18 nt, Pseudomonas aeruginosa PA01
cuggugacggugaccuug

SEQ ID NO: 3455228 - RNA, 20 nt, Pseudomonas aeruginosa PA01
cuggugaugucgcggcaggc

SEQ ID NO: 3455229 - RNA, 21 nt, Pseudomonas aeruginosa PA01
cuggugaugucgcggcaggcg

SEQ ID NO: 3455230 - RNA, 14 nt, Pseudomonas aeruginosa PA01
cuggugcaccuggc

SEQ ID NO: 3455231 - RNA, 15 nt, Pseudomonas aeruginosa PA01
cuggugcaccuggcg

SEQ ID NO: 3455232 - RNA, 14 nt, Pseudomonas aeruginosa PA01
cuggugcacggcga

SEQ ID NO: 3455233 - RNA, 19 nt, Pseudomonas aeruginosa PA01
cuggugcaggucgcgcggc

SEQ ID NO: 3455234 - RNA, 20 nt, Pseudomonas aeruginosa PA01
cuggugcaggucgcgcggcg

SEQ ID NO: 3455235 - RNA, 15 nt, Pseudomonas aeruginosa PA01
cuggugcccgaugcc

SEQ ID NO: 3455236 - RNA, 22 nt, Pseudomonas aeruginosa PA01
cuggugcccugggcggccucgu

SEQ ID NO: 3455237 - RNA, 13 nt, Pseudomonas aeruginosa PA01
cuggugccgacgc

SEQ ID NO: 3455238 - RNA, 14 nt, Pseudomonas aeruginosa PA01
cuggugccgacgcu

SEQ ID NO: 3455239 - RNA, 16 nt, Pseudomonas aeruginosa PA01
cuggugccgaucagcc

SEQ ID NO: 3455240 - RNA, 17 nt, Pseudomonas aeruginosa PA01
cuggugccgaucagccc

SEQ ID NO: 3455241 - RNA, 17 nt, Pseudomonas aeruginosa PA01
cuggugccgcuguagga

SEQ ID NO: 3455242 - RNA, 20 nt, Pseudomonas aeruginosa PA01
cuggugccggauagaggaau

SEQ ID NO: 3455243 - RNA, 16 nt, Pseudomonas aeruginosa PA01
cuggugcgcguccauc

SEQ ID NO: 3455244 - RNA, 20 nt, Pseudomonas aeruginosa PA01
cuggugcgcguccaucccug

SEQ ID NO: 3455245 - RNA, 14 nt, Pseudomonas aeruginosa PA01
cugucgccggucag

SEQ ID NO: 3455246 - RNA, 22 nt, Pseudomonas aeruginosa PA01
cugucgccggucaggcugcggc

SEQ ID NO: 3455247 - RNA, 20 nt, Pseudomonas aeruginosa PA01
cugucgccguuggccuucac

SEQ ID NO: 3455248 - RNA, 18 nt, Pseudomonas aeruginosa PA01
cugucgcggacccgcgcc

SEQ ID NO: 3455249 - RNA, 23 nt, Pseudomonas aeruginosa PA01
cugucgcggacccgcgccggcag

SEQ ID NO: 3455250 - RNA, 22 nt, Pseudomonas aeruginosa PA01
cugucgcguucccacucgcgac

SEQ ID NO: 3455251 - RNA, 14 nt, Pseudomonas aeruginosa PA01
cugucgcucagcgg

SEQ ID NO: 3455252 - RNA, 17 nt, Pseudomonas aeruginosa PA01
cugucgcucagcgggcc

SEQ ID NO: 3455253 - RNA, 18 nt, Pseudomonas aeruginosa PA01
cugucggagagggagcgc

SEQ ID NO: 3455254 - RNA, 13 nt, Pseudomonas aeruginosa PA01
cugucggcccgcg

SEQ ID NO: 3455255 - RNA, 18 nt, Pseudomonas aeruginosa PA01
cugucggccucgacgagg

SEQ ID NO: 3455256 - RNA, 14 nt, Pseudomonas aeruginosa PA01
cugucggcucgcgc

SEQ ID NO: 3455257 - RNA, 18 nt, Pseudomonas aeruginosa PA01
cugucggcucgcgccggc

SEQ ID NO: 3455258 - RNA, 19 nt, Pseudomonas aeruginosa PA01
cugucggcucgcgccggcg

SEQ ID NO: 3455259 - RNA, 22 nt, Pseudomonas aeruginosa PA01
cugucggcucgcgccggcgcgu

SEQ ID NO: 3455260 - RNA, 18 nt, Pseudomonas aeruginosa PA01
cugucguaguccugggcc

SEQ ID NO: 3455261 - RNA, 20 nt, Pseudomonas aeruginosa PA01
cugucguaguccugggccgg

SEQ ID NO: 3455262 - RNA, 15 nt, Pseudomonas aeruginosa PA01
cugucguccagcggg

SEQ ID NO: 3455263 - RNA, 16 nt, Pseudomonas aeruginosa PA01
cugucguccagcgggu

SEQ ID NO: 3455264 - RNA, 22 nt, Pseudomonas aeruginosa PA01
cugucgucgaggguggcgccga

SEQ ID NO: 3455265 - RNA, 16 nt, Pseudomonas aeruginosa PA01
cugucgucggcgcggc

SEQ ID NO: 3455266 - RNA, 13 nt, Pseudomonas aeruginosa PA01
cugucgugccucc

SEQ ID NO: 3455267 - RNA, 17 nt, Pseudomonas aeruginosa PA01
cugucgugccuccagcc

SEQ ID NO: 3455268 - RNA, 18 nt, Pseudomonas aeruginosa PA01
cugucgugccuccagccu

SEQ ID NO: 3455269 - RNA, 19 nt, Pseudomonas aeruginosa PA01
cugucgugccuccagccuc

SEQ ID NO: 3455270 - RNA, 13 nt, Pseudomonas aeruginosa PA01
cugucguggacgc

SEQ ID NO: 3455271 - RNA, 18 nt, Pseudomonas aeruginosa PA01
cugucguuccggcucagc

SEQ ID NO: 3455272 - RNA, 21 nt, Pseudomonas aeruginosa PA01
cugucguuccggcucagccgc

SEQ ID NO: 3455273 - RNA, 23 nt, Pseudomonas aeruginosa PA01
cugucuacucgacgcugcccagc

SEQ ID NO: 3455274 - RNA, 22 nt, Pseudomonas aeruginosa PA01
cugucuaucccgugccgggcca

SEQ ID NO: 3455275 - RNA, 18 nt, Pseudomonas aeruginosa PA01
cugucuccgcaccuaccc

SEQ ID NO: 3455276 - RNA, 15 nt, Pseudomonas aeruginosa PA01
cugucucgccagccc

SEQ ID NO: 3455277 - RNA, 16 nt, Pseudomonas aeruginosa PA01
cugucucgccagcccg

SEQ ID NO: 3455278 - RNA, 17 nt, Pseudomonas aeruginosa PA01
cugucucgccagcccgg

SEQ ID NO: 3455279 - RNA, 18 nt, Pseudomonas aeruginosa PA01
cugucucgccagcccggc

SEQ ID NO: 3455280 - RNA, 13 nt, Pseudomonas aeruginosa PA01
cugucucgccgau

SEQ ID NO: 3455281 - RNA, 15 nt, Pseudomonas aeruginosa PA01
cugucucgccgaugc

SEQ ID NO: 3455282 - RNA, 17 nt, Pseudomonas aeruginosa PA01
cugugaucaggcugucc

SEQ ID NO: 3455283 - RNA, 23 nt, Pseudomonas aeruginosa PA01
cugugcacccagaccuuccagcc

SEQ ID NO: 3455284 - RNA, 20 nt, Pseudomonas aeruginosa PA01
cugugcagggucagucgagc

SEQ ID NO: 3455285 - RNA, 17 nt, Pseudomonas aeruginosa PA01
cugugccauuccugggc

SEQ ID NO: 3455286 - RNA, 21 nt, Pseudomonas aeruginosa PA01
cugugccauuccugggccccg

SEQ ID NO: 3455287 - RNA, 14 nt, Pseudomonas aeruginosa PA01
cugugccccaggca

SEQ ID NO: 3455288 - RNA, 15 nt, Pseudomonas aeruginosa PA01
cugugccgaggccgc

SEQ ID NO: 3455289 - RNA, 18 nt, Pseudomonas aeruginosa PA01
cugugccgaggccgccgc

SEQ ID NO: 3455290 - RNA, 19 nt, Pseudomonas aeruginosa PA01
cugugccgaggccgccgcg

SEQ ID NO: 3455291 - RNA, 22 nt, Pseudomonas aeruginosa PA01
cugugcgauuucgcugcgcagu

SEQ ID NO: 3455292 - RNA, 14 nt, Pseudomonas aeruginosa PA01
cugugcgccaggcc

SEQ ID NO: 3455293 - RNA, 16 nt, Pseudomonas aeruginosa PA01
cugugcgccaggccgg

SEQ ID NO: 3455294 - RNA, 13 nt, Pseudomonas aeruginosa PA01
cugugcggcagca

SEQ ID NO: 3455295 - RNA, 16 nt, Pseudomonas aeruginosa PA01
cugugcggcagcaggc

SEQ ID NO: 3455296 - RNA, 17 nt, Pseudomonas aeruginosa PA01
cugugcggcagcaggcu

SEQ ID NO: 3455297 - RNA, 12 nt, Pseudomonas aeruginosa PA01
cugugcggcgau

SEQ ID NO: 3455298 - RNA, 15 nt, Pseudomonas aeruginosa PA01
cugugcggcgauguc

SEQ ID NO: 3455299 - RNA, 23 nt, Pseudomonas aeruginosa PA01
cugugcggggaaagcuccucggc

SEQ ID NO: 3455300 - RNA, 20 nt, Pseudomonas aeruginosa PA01
cugugcgucgagggccuugu

SEQ ID NO: 3455301 - RNA, 15 nt, Pseudomonas aeruginosa PA01
cugugcucgacgggc

SEQ ID NO: 3455302 - RNA, 18 nt, Pseudomonas aeruginosa PA01
cugugcucgacgggcgcu

SEQ ID NO: 3455303 - RNA, 13 nt, Pseudomonas aeruginosa PA01
cugugcucgagga

SEQ ID NO: 3455304 - RNA, 16 nt, Pseudomonas aeruginosa PA01
cugugcugcaccagca

SEQ ID NO: 3455305 - RNA, 18 nt, Pseudomonas aeruginosa PA01
cugugcugcaccagcagg

SEQ ID NO: 3455306 - RNA, 15 nt, Pseudomonas aeruginosa PA01
cugugcugcgcgccg

SEQ ID NO: 3455307 - RNA, 14 nt, Pseudomonas aeruginosa PA01
cugugcuggccacc

SEQ ID NO: 3455308 - RNA, 15 nt, Pseudomonas aeruginosa PA01
cugugcuggccaccc

SEQ ID NO: 3455309 - RNA, 18 nt, Pseudomonas aeruginosa PA01
cugugcuggccacccuug

SEQ ID NO: 3455310 - RNA, 17 nt, Pseudomonas aeruginosa PA01
cugugcuuaauacggcg

SEQ ID NO: 3455311 - RNA, 20 nt, Pseudomonas aeruginosa PA01
cuguggaauguccugccgca

SEQ ID NO: 3455312 - RNA, 23 nt, Pseudomonas aeruginosa PA01
cuguggaauguccugccgcaggc

SEQ ID NO: 3455313 - RNA, 15 nt, Pseudomonas aeruginosa PA01
cuguggagccggugc

SEQ ID NO: 3455314 - RNA, 20 nt, Pseudomonas aeruginosa PA01
cuguggauaaaaaggcccgg

SEQ ID NO: 3455315 - RNA, 20 nt, Pseudomonas aeruginosa PA01
cuguggauaacucugugggc

SEQ ID NO: 3455316 - RNA, 13 nt, Pseudomonas aeruginosa PA01
cuguggcgcggcu

SEQ ID NO: 3455317 - RNA, 18 nt, Pseudomonas aeruginosa PA01
cuguggcgcggcuggaag

SEQ ID NO: 3455318 - RNA, 20 nt, Pseudomonas aeruginosa PA01
cuguggcguuauucgcccua

SEQ ID NO: 3455319 - RNA, 21 nt, Pseudomonas aeruginosa PA01
cugugggucgggucggcgaag

SEQ ID NO: 3455320 - RNA, 18 nt, Pseudomonas aeruginosa PA01
cugugguguagcgcaggu

SEQ ID NO: 3455321 - RNA, 17 nt, Pseudomonas aeruginosa PA01
cugugguuguggguaug

SEQ ID NO: 3455322 - RNA, 15 nt, Pseudomonas aeruginosa PA01
cuguguccggcggau

SEQ ID NO: 3455323 - RNA, 19 nt, Pseudomonas aeruginosa PA01
cuguucagcaggagcagcu

SEQ ID NO: 3455324 - RNA, 14 nt, Pseudomonas aeruginosa PA01
cuguucagcgggug

SEQ ID NO: 3455325 - RNA, 21 nt, Pseudomonas aeruginosa PA01
cuguuccacgagagaaaugaa

SEQ ID NO: 3455326 - RNA, 17 nt, Pseudomonas aeruginosa PA01
cuguuccagcaacgccu

SEQ ID NO: 3455327 - RNA, 22 nt, Pseudomonas aeruginosa PA01
cuguuccagggccugcuccagc

SEQ ID NO: 3455328 - RNA, 16 nt, Pseudomonas aeruginosa PA01
cuguuccgccguggga

SEQ ID NO: 3455329 - RNA, 15 nt, Pseudomonas aeruginosa PA01
cuguuccgggcccag

SEQ ID NO: 3455330 - RNA, 20 nt, Pseudomonas aeruginosa PA01
cuguuccucagccccucgcc

SEQ ID NO: 3455331 - RNA, 13 nt, Pseudomonas aeruginosa PA01
cuguucgaccagu

SEQ ID NO: 3455332 - RNA, 18 nt, Pseudomonas aeruginosa PA01
cuguucgaccaguugccc

SEQ ID NO: 3455333 - RNA, 23 nt, Pseudomonas aeruginosa PA01
cuguucgcccaaggccaggucga

SEQ ID NO: 3455334 - RNA, 19 nt, Pseudomonas aeruginosa PA01
cuguucgcgcccgucgucg

SEQ ID NO: 3455335 - RNA, 20 nt, Pseudomonas aeruginosa PA01
cuguucgcugccuuccuuuu

SEQ ID NO: 3455336 - RNA, 15 nt, Pseudomonas aeruginosa PA01
cuguucggcaggggg

SEQ ID NO: 3455337 - RNA, 14 nt, Pseudomonas aeruginosa PA01
cuguucggccuugc

SEQ ID NO: 3455338 - RNA, 22 nt, Pseudomonas aeruginosa PA01
cuguucggcgggaucgacgccg

SEQ ID NO: 3455339 - RNA, 16 nt, Pseudomonas aeruginosa PA01
cuguucgggucgcguu

SEQ ID NO: 3455340 - RNA, 19 nt, Pseudomonas aeruginosa PA01
cuguucgucuggcgccugg

SEQ ID NO: 3455341 - RNA, 22 nt, Pseudomonas aeruginosa PA01
cuguucgucuggcgccuggccu

SEQ ID NO: 3455342 - RNA, 18 nt, Pseudomonas aeruginosa PA01
cuguugaaaaccgguccc

SEQ ID NO: 3455343 - RNA, 17 nt, Pseudomonas aeruginosa PA01
cuguugcagagcggcca

SEQ ID NO: 3455344 - RNA, 19 nt, Pseudomonas aeruginosa PA01
cuguugcagagcggccagg

SEQ ID NO: 3455345 - RNA, 16 nt, Pseudomonas aeruginosa PA01
cuguugcccugggccg

SEQ ID NO: 3455346 - RNA, 21 nt, Pseudomonas aeruginosa PA01
cuguugcccugggccggcgcc

SEQ ID NO: 3455347 - RNA, 17 nt, Pseudomonas aeruginosa PA01
cuucaguucgggguggg

SEQ ID NO: 3455348 - RNA, 16 nt, Pseudomonas aeruginosa PA01
cuucaguucguugggc

SEQ ID NO: 3455349 - RNA, 15 nt, Pseudomonas aeruginosa PA01
cuucaucaccuugcc

SEQ ID NO: 3455350 - RNA, 16 nt, Pseudomonas aeruginosa PA01
cuucaucaggcggcac

SEQ ID NO: 3455351 - RNA, 13 nt, Pseudomonas aeruginosa PA01
cuucaucccuucu

SEQ ID NO: 3455352 - RNA, 16 nt, Pseudomonas aeruginosa PA01
cuucaucccuucuuuu

SEQ ID NO: 3455353 - RNA, 13 nt, Pseudomonas aeruginosa PA01
cuucauccugcgc

SEQ ID NO: 3455354 - RNA, 15 nt, Pseudomonas aeruginosa PA01
cuucauccugcgcgc

SEQ ID NO: 3455355 - RNA, 15 nt, Pseudomonas aeruginosa PA01
cuucaucggcccggc

SEQ ID NO: 3455356 - RNA, 23 nt, Pseudomonas aeruginosa PA01
cuucaugaacacauagaccagca

SEQ ID NO: 3455357 - RNA, 16 nt, Pseudomonas aeruginosa PA01
cuuccaccguggcgac

SEQ ID NO: 3455358 - RNA, 16 nt, Pseudomonas aeruginosa PA01
cuuccacgccuucgcg

SEQ ID NO: 3455359 - RNA, 18 nt, Pseudomonas aeruginosa PA01
cuuccacgccuucgcggc

SEQ ID NO: 3455360 - RNA, 19 nt, Pseudomonas aeruginosa PA01
cuuccacgccuucgcggcc

SEQ ID NO: 3455361 - RNA, 23 nt, Pseudomonas aeruginosa PA01
cuuccacgcgccgauccaggcgu

SEQ ID NO: 3455362 - RNA, 23 nt, Pseudomonas aeruginosa PA01
cuuccacgcugaggcucagcgcg

SEQ ID NO: 3455363 - RNA, 16 nt, Pseudomonas aeruginosa PA01
cuuccacuccaggcgg

SEQ ID NO: 3455364 - RNA, 13 nt, Pseudomonas aeruginosa PA01
cuuccacuuccac

SEQ ID NO: 3455365 - RNA, 16 nt, Pseudomonas aeruginosa PA01
cuuccacuuccaccgg

SEQ ID NO: 3455366 - RNA, 20 nt, Pseudomonas aeruginosa PA01
cuuccacuucgaagccgagc

SEQ ID NO: 3455367 - RNA, 18 nt, Pseudomonas aeruginosa PA01
cuuccacuugcgccggcu

SEQ ID NO: 3455368 - RNA, 20 nt, Pseudomonas aeruginosa PA01
cuuccacuugcgccggcugc

SEQ ID NO: 3455369 - RNA, 17 nt, Pseudomonas aeruginosa PA01
cuuccagaacgccgcgc

SEQ ID NO: 3455370 - RNA, 15 nt, Pseudomonas aeruginosa PA01
cuuccagaucgucuu

SEQ ID NO: 3455371 - RNA, 13 nt, Pseudomonas aeruginosa PA01
cuuccagcaccuc

SEQ ID NO: 3455372 - RNA, 17 nt, Pseudomonas aeruginosa PA01
cuuccagcacgccgauc

SEQ ID NO: 3455373 - RNA, 19 nt, Pseudomonas aeruginosa PA01
cuuccagcacgccgauccc

SEQ ID NO: 3455374 - RNA, 12 nt, Pseudomonas aeruginosa PA01
cuuccagcaggu

SEQ ID NO: 3455375 - RNA, 14 nt, Pseudomonas aeruginosa PA01
cuuccagccgcccu

SEQ ID NO: 3455376 - RNA, 14 nt, Pseudomonas aeruginosa PA01
cuuccagccgcgcg

SEQ ID NO: 3455377 - RNA, 16 nt, Pseudomonas aeruginosa PA01
cuuccagccgcgcgcg

SEQ ID NO: 3455378 - RNA, 21 nt, Pseudomonas aeruginosa PA01
cuuccagcgggcggaucagcu

SEQ ID NO: 3455379 - RNA, 23 nt, Pseudomonas aeruginosa PA01
cuuccagcgggcggaucagcucg

SEQ ID NO: 3455380 - RNA, 12 nt, Pseudomonas aeruginosa PA01
cuuccagcugcc

SEQ ID NO: 3455381 - RNA, 13 nt, Pseudomonas aeruginosa PA01
cuuccagcugcca

SEQ ID NO: 3455382 - RNA, 14 nt, Pseudomonas aeruginosa PA01
cuuccagcuugcgc

SEQ ID NO: 3455383 - RNA, 20 nt, Pseudomonas aeruginosa PA01
cuuccagcuugcgccagagc

SEQ ID NO: 3455384 - RNA, 13 nt, Pseudomonas aeruginosa PA01
cuuccagcuuggc

SEQ ID NO: 3455385 - RNA, 21 nt, Pseudomonas aeruginosa PA01
cuuccagcuuggcacggccgg

SEQ ID NO: 3455386 - RNA, 22 nt, Pseudomonas aeruginosa PA01
cuuccagcuuggcacggccggc

SEQ ID NO: 3455387 - RNA, 19 nt, Pseudomonas aeruginosa PA01
cuuccaggcgugccuguuc

SEQ ID NO: 3455388 - RNA, 16 nt, Pseudomonas aeruginosa PA01
cuuccagggcggcgcg

SEQ ID NO: 3455389 - RNA, 17 nt, Pseudomonas aeruginosa PA01
cuuccagggcggcgcgg

SEQ ID NO: 3455390 - RNA, 23 nt, Pseudomonas aeruginosa PA01
cuuccagggugggcggugcggca

SEQ ID NO: 3455391 - RNA, 18 nt, Pseudomonas aeruginosa PA01
cuuccaggguuuccagca

SEQ ID NO: 3455392 - RNA, 16 nt, Pseudomonas aeruginosa PA01
cuuccaguuggccggg

SEQ ID NO: 3455393 - RNA, 14 nt, Pseudomonas aeruginosa PA01
cuuccaucaccgcg

SEQ ID NO: 3455394 - RNA, 15 nt, Pseudomonas aeruginosa PA01
cuuccaucaccgcgu

SEQ ID NO: 3455395 - RNA, 13 nt, Pseudomonas aeruginosa PA01
cuuccaucagcuc

SEQ ID NO: 3455396 - RNA, 20 nt, Pseudomonas aeruginosa PA01
cuucccaauagguguagccc

SEQ ID NO: 3455397 - RNA, 15 nt, Pseudomonas aeruginosa PA01
cuucccagacgucca

SEQ ID NO: 3455398 - RNA, 21 nt, Pseudomonas aeruginosa PA01
cuucccagacguccagcgcca

SEQ ID NO: 3455399 - RNA, 21 nt, Pseudomonas aeruginosa PA01
cuucccagccgaggcagccgu

SEQ ID NO: 3455400 - RNA, 17 nt, Pseudomonas aeruginosa PA01
cuucccaggccagcggg

SEQ ID NO: 3455401 - RNA, 20 nt, Pseudomonas aeruginosa PA01
cuucccaggugcccuggaag

SEQ ID NO: 3455402 - RNA, 17 nt, Pseudomonas aeruginosa PA01
cuuccccguugccgagg

SEQ ID NO: 3455403 - RNA, 16 nt, Pseudomonas aeruginosa PA01
cuucccgcccaucaac

SEQ ID NO: 3455404 - RNA, 18 nt, Pseudomonas aeruginosa PA01
cuucccgcggcuccagcc

SEQ ID NO: 3455405 - RNA, 13 nt, Pseudomonas aeruginosa PA01
cuucccggcgcag

SEQ ID NO: 3455406 - RNA, 16 nt, Pseudomonas aeruginosa PA01
cuucccguaaggccag

SEQ ID NO: 3455407 - RNA, 17 nt, Pseudomonas aeruginosa PA01
cuucccguaaggccagg

SEQ ID NO: 3455408 - RNA, 22 nt, Pseudomonas aeruginosa PA01
cuucccguaaggccaggcucgg

SEQ ID NO: 3455409 - RNA, 22 nt, Pseudomonas aeruginosa PA01
cuuccgacucuccgcgccgcgg

SEQ ID NO: 3455410 - RNA, 12 nt, Pseudomonas aeruginosa PA01
cuuccgacuggu

SEQ ID NO: 3455411 - RNA, 19 nt, Pseudomonas aeruginosa PA01
cuuccgcaucggccgacag

SEQ ID NO: 3455412 - RNA, 15 nt, Pseudomonas aeruginosa PA01
cuuccgccagcaggc

SEQ ID NO: 3455413 - RNA, 21 nt, Pseudomonas aeruginosa PA01
cuuccgccagcaggcgcgggc

SEQ ID NO: 3455414 - RNA, 18 nt, Pseudomonas aeruginosa PA01
cuuccgccaggcgcagcc

SEQ ID NO: 3455415 - RNA, 20 nt, Pseudomonas aeruginosa PA01
cuuccgccaggcgcagccag

SEQ ID NO: 3455416 - RNA, 13 nt, Pseudomonas aeruginosa PA01
cuuccgccgccag

SEQ ID NO: 3455417 - RNA, 14 nt, Pseudomonas aeruginosa PA01
cuuccgccgccagg

SEQ ID NO: 3455418 - RNA, 17 nt, Pseudomonas aeruginosa PA01
cuuccgccggcgccgcc

SEQ ID NO: 3455419 - RNA, 14 nt, Pseudomonas aeruginosa PA01
cuuccgccucgcgc

SEQ ID NO: 3455420 - RNA, 17 nt, Pseudomonas aeruginosa PA01
cuuccgcgcccaggcug

SEQ ID NO: 3455421 - RNA, 20 nt, Pseudomonas aeruginosa PA01
cuuccgcgcccaggcugccg

SEQ ID NO: 3455422 - RNA, 17 nt, Pseudomonas aeruginosa PA01
cuuccggacugcccagc

SEQ ID NO: 3455423 - RNA, 19 nt, Pseudomonas aeruginosa PA01
cuuccggacugcccagcgc

SEQ ID NO: 3455424 - RNA, 23 nt, Pseudomonas aeruginosa PA01
cuuccggacugcccagcgccgcc

SEQ ID NO: 3455425 - RNA, 16 nt, Pseudomonas aeruginosa PA01
cuuccggcagccagcc

SEQ ID NO: 3455426 - RNA, 17 nt, Pseudomonas aeruginosa PA01
cuuccggcagccagccg

SEQ ID NO: 3455427 - RNA, 19 nt, Pseudomonas aeruginosa PA01
cuuccggcagccagccgcc

SEQ ID NO: 3455428 - RNA, 22 nt, Pseudomonas aeruginosa PA01
cuuccggcagccagccgccgaa

SEQ ID NO: 3455429 - RNA, 14 nt, Pseudomonas aeruginosa PA01
cuuccggcccggcc

SEQ ID NO: 3455430 - RNA, 13 nt, Pseudomonas aeruginosa PA01
cuuccggcgccaa

SEQ ID NO: 3455431 - RNA, 14 nt, Pseudomonas aeruginosa PA01
cuuccggcucgccg

SEQ ID NO: 3455432 - RNA, 21 nt, Pseudomonas aeruginosa PA01
cuuccgggaacacgucguugg

SEQ ID NO: 3455433 - RNA, 14 nt, Pseudomonas aeruginosa PA01
cuuccggugcaugc

SEQ ID NO: 3455434 - RNA, 17 nt, Pseudomonas aeruginosa PA01
cuuccggugcaugcgca

SEQ ID NO: 3455435 - RNA, 14 nt, Pseudomonas aeruginosa PA01
cuuccgucgucacc

SEQ ID NO: 3455436 - RNA, 16 nt, Pseudomonas aeruginosa PA01
cuuccgucgucaccuc

SEQ ID NO: 3455437 - RNA, 14 nt, Pseudomonas aeruginosa PA01
cuuccuccucgccg

SEQ ID NO: 3455438 - RNA, 16 nt, Pseudomonas aeruginosa PA01
cuuccucgcugccuac

SEQ ID NO: 3455439 - RNA, 19 nt, Pseudomonas aeruginosa PA01
cuuccucggacuugcucca

SEQ ID NO: 3455440 - RNA, 18 nt, Pseudomonas aeruginosa PA01
cuuccucggcacucagcc

SEQ ID NO: 3455441 - RNA, 20 nt, Pseudomonas aeruginosa PA01
cuuccucggcgaccaccgcg

SEQ ID NO: 3455442 - RNA, 19 nt, Pseudomonas aeruginosa PA01
cuuccucggugucggccaa

SEQ ID NO: 3455443 - RNA, 23 nt, Pseudomonas aeruginosa PA01
cuuccucggugucggccaacugg

SEQ ID NO: 3455444 - RNA, 15 nt, Pseudomonas aeruginosa PA01
cuuccucguggggcc

SEQ ID NO: 3455445 - RNA, 21 nt, Pseudomonas aeruginosa PA01
cuuccugaaggcgcggggcga

SEQ ID NO: 3455446 - RNA, 23 nt, Pseudomonas aeruginosa PA01
cuuccugagcagggucaugccua

SEQ ID NO: 3455447 - RNA, 21 nt, Pseudomonas aeruginosa PA01
cuuccugcacgcugcgccggc

SEQ ID NO: 3455448 - RNA, 15 nt, Pseudomonas aeruginosa PA01
cuuccugccagcgcg

SEQ ID NO: 3455449 - RNA, 18 nt, Pseudomonas aeruginosa PA01
cuuccugccagcgcgucg

SEQ ID NO: 3455450 - RNA, 13 nt, Pseudomonas aeruginosa PA01
cuucggauacauc

SEQ ID NO: 3455451 - RNA, 17 nt, Pseudomonas aeruginosa PA01
cuucggauacggcaggg

SEQ ID NO: 3455452 - RNA, 15 nt, Pseudomonas aeruginosa PA01
cuucggcaagcaccu

SEQ ID NO: 3455453 - RNA, 13 nt, Pseudomonas aeruginosa PA01
cuucggcaccccu

SEQ ID NO: 3455454 - RNA, 12 nt, Pseudomonas aeruginosa PA01
cuucggcagccu

SEQ ID NO: 3455455 - RNA, 16 nt, Pseudomonas aeruginosa PA01
cuucggcaggaccucg

SEQ ID NO: 3455456 - RNA, 23 nt, Pseudomonas aeruginosa PA01
cuucggcaggaccucgggcgaga

SEQ ID NO: 3455457 - RNA, 12 nt, Pseudomonas aeruginosa PA01
cuucggccaguu

SEQ ID NO: 3455458 - RNA, 13 nt, Pseudomonas aeruginosa PA01
cuucggcccgcug

SEQ ID NO: 3455459 - RNA, 19 nt, Pseudomonas aeruginosa PA01
cuucggccgcaccaggaug

SEQ ID NO: 3455460 - RNA, 15 nt, Pseudomonas aeruginosa PA01
cuucggcgcccacuc

SEQ ID NO: 3455461 - RNA, 12 nt, Pseudomonas aeruginosa PA01
cuucggcgcgac

SEQ ID NO: 3455462 - RNA, 17 nt, Pseudomonas aeruginosa PA01
cuucggcgcgccgguga

SEQ ID NO: 3455463 - RNA, 14 nt, Pseudomonas aeruginosa PA01
cuucggcgcgcggc

SEQ ID NO: 3455464 - RNA, 14 nt, Pseudomonas aeruginosa PA01
cuucggcgcgcugg

SEQ ID NO: 3455465 - RNA, 14 nt, Pseudomonas aeruginosa PA01
cuucggcgcucuuc

SEQ ID NO: 3455466 - RNA, 23 nt, Pseudomonas aeruginosa PA01
cuucggcgcucuucagcacgccc

SEQ ID NO: 3455467 - RNA, 14 nt, Pseudomonas aeruginosa PA01
cuucggcggccagc

SEQ ID NO: 3455468 - RNA, 14 nt, Pseudomonas aeruginosa PA01
cuucggcggccggg

SEQ ID NO: 3455469 - RNA, 14 nt, Pseudomonas aeruginosa PA01
cuucggcggcgccu

SEQ ID NO: 3455470 - RNA, 16 nt, Pseudomonas aeruginosa PA01
cuucggcgguggggcc

SEQ ID NO: 3455471 - RNA, 23 nt, Pseudomonas aeruginosa PA01
cuucggcgugcauggccgggccg

SEQ ID NO: 3455472 - RNA, 16 nt, Pseudomonas aeruginosa PA01
cuucgggagagcccgg

SEQ ID NO: 3455473 - RNA, 20 nt, Pseudomonas aeruginosa PA01
cuucgggagagcccgggcgc

SEQ ID NO: 3455474 - RNA, 21 nt, Pseudomonas aeruginosa PA01
cuucgggagucaacgccuggc

SEQ ID NO: 3455475 - RNA, 17 nt, Pseudomonas aeruginosa PA01
cuucgguaccugguccg

SEQ ID NO: 3455476 - RNA, 17 nt, Pseudomonas aeruginosa PA01
cuucggucgcgccccgc

SEQ ID NO: 3455477 - RNA, 17 nt, Pseudomonas aeruginosa PA01
cuucggucucguccggc

SEQ ID NO: 3455478 - RNA, 17 nt, Pseudomonas aeruginosa PA01
cuucgguguaucggcgg

SEQ ID NO: 3455479 - RNA, 18 nt, Pseudomonas aeruginosa PA01
cuucgguguaucggcgga

SEQ ID NO: 3455480 - RNA, 20 nt, Pseudomonas aeruginosa PA01
cuucguccagcgaggcgugg

SEQ ID NO: 3455481 - RNA, 14 nt, Pseudomonas aeruginosa PA01
cuucguccaggccg

SEQ ID NO: 3455482 - RNA, 15 nt, Pseudomonas aeruginosa PA01
cuucgucccaugacc

SEQ ID NO: 3455483 - RNA, 15 nt, Pseudomonas aeruginosa PA01
cuucguccgccuggg

SEQ ID NO: 3455484 - RNA, 20 nt, Pseudomonas aeruginosa PA01
cuucguccggccgcccgagc

SEQ ID NO: 3455485 - RNA, 15 nt, Pseudomonas aeruginosa PA01
cuucguccucguggc

SEQ ID NO: 3455486 - RNA, 15 nt, Pseudomonas aeruginosa PA01
cuucguccugcugcu

SEQ ID NO: 3455487 - RNA, 18 nt, Pseudomonas aeruginosa PA01
cuucguccugcugcuggc

SEQ ID NO: 3455488 - RNA, 19 nt, Pseudomonas aeruginosa PA01
cuucguccugcugcuggcc

SEQ ID NO: 3455489 - RNA, 21 nt, Pseudomonas aeruginosa PA01
cuucgucgaagaccagggugg

SEQ ID NO: 3455490 - RNA, 22 nt, Pseudomonas aeruginosa PA01
cuucgucgaagaccaggguggg

SEQ ID NO: 3455491 - RNA, 14 nt, Pseudomonas aeruginosa PA01
cuucgucgcgcagg

SEQ ID NO: 3455492 - RNA, 13 nt, Pseudomonas aeruginosa PA01
cuucgucggcuuc

SEQ ID NO: 3455493 - RNA, 16 nt, Pseudomonas aeruginosa PA01
cuucgugccacaggcc

SEQ ID NO: 3455494 - RNA, 18 nt, Pseudomonas aeruginosa PA01
cuucgugggccugcucgg

SEQ ID NO: 3455495 - RNA, 22 nt, Pseudomonas aeruginosa PA01
cuucguugaugcgcguggcacg

SEQ ID NO: 3455496 - RNA, 19 nt, Pseudomonas aeruginosa PA01
cuucguugcgaugggugcc

SEQ ID NO: 3455497 - RNA, 21 nt, Pseudomonas aeruginosa PA01
cuucuacgccuugcggcgccg

SEQ ID NO: 3455498 - RNA, 23 nt, Pseudomonas aeruginosa PA01
cuucuccaccggaucgcccuggc

SEQ ID NO: 3455499 - RNA, 12 nt, Pseudomonas aeruginosa PA01
cuucuccagaau

SEQ ID NO: 3455500 - RNA, 23 nt, Pseudomonas aeruginosa PA01
cuucuccagcagggucgccuggg

SEQ ID NO: 3455501 - RNA, 20 nt, Pseudomonas aeruginosa PA01
cuucuccagguacagccgca

SEQ ID NO: 3455502 - RNA, 21 nt, Pseudomonas aeruginosa PA01
cuucuccagguacagccgcag

SEQ ID NO: 3455503 - RNA, 15 nt, Pseudomonas aeruginosa PA01
cuucuccgccacccg

SEQ ID NO: 3455504 - RNA, 18 nt, Pseudomonas aeruginosa PA01
cuucuccgccgcgugcgc

SEQ ID NO: 3455505 - RNA, 20 nt, Pseudomonas aeruginosa PA01
cuucuccgccgcgugcgcgc

SEQ ID NO: 3455506 - RNA, 14 nt, Pseudomonas aeruginosa PA01
cuucuccggggccc

SEQ ID NO: 3455507 - RNA, 18 nt, Pseudomonas aeruginosa PA01
cuucuccggggcccggca

SEQ ID NO: 3455508 - RNA, 16 nt, Pseudomonas aeruginosa PA01
cuucucgaagcgcgcc

SEQ ID NO: 3455509 - RNA, 24 nt, Pseudomonas aeruginosa PA01
cuucucgaagcgcgccugcucuuc

SEQ ID NO: 3455510 - RNA, 21 nt, Pseudomonas aeruginosa PA01
cuucucgacgaaggcgcgcuc

SEQ ID NO: 3455511 - RNA, 19 nt, Pseudomonas aeruginosa PA01
cuucucgguagggccgagg

SEQ ID NO: 3455512 - RNA, 15 nt, Pseudomonas aeruginosa PA01
cuucucguagcgcuc

SEQ ID NO: 3455513 - RNA, 15 nt, Pseudomonas aeruginosa PA01
cuucucgucgaaggu

SEQ ID NO: 3455514 - RNA, 14 nt, Pseudomonas aeruginosa PA01
cuucucgucgccgc

SEQ ID NO: 3455515 - RNA, 17 nt, Pseudomonas aeruginosa PA01
cuucucgucgccgcccg

SEQ ID NO: 3455516 - RNA, 16 nt, Pseudomonas aeruginosa PA01
cuucucgucgccgccg

SEQ ID NO: 3455517 - RNA, 18 nt, Pseudomonas aeruginosa PA01
cuucucuuucaccugguc

SEQ ID NO: 3455518 - RNA, 19 nt, Pseudomonas aeruginosa PA01
cuucucuuucaccuggucg

SEQ ID NO: 3455519 - RNA, 19 nt, Pseudomonas aeruginosa PA01
cuucugcaauugcuugcgc

SEQ ID NO: 3455520 - RNA, 23 nt, Pseudomonas aeruginosa PA01
cuucugcaauugcuugcgcucga

SEQ ID NO: 3455521 - RNA, 19 nt, Pseudomonas aeruginosa PA01
cuucugcaccccgucgacg

SEQ ID NO: 3455522 - RNA, 15 nt, Pseudomonas aeruginosa PA01
cuucugcaccgugcg

SEQ ID NO: 3455523 - RNA, 14 nt, Pseudomonas aeruginosa PA01
cuucugcaccuugg

SEQ ID NO: 3455524 - RNA, 17 nt, Pseudomonas aeruginosa PA01
cuucugcaccuuggcca

SEQ ID NO: 3455525 - RNA, 16 nt, Pseudomonas aeruginosa PA01
cuucugcagcucggcc

SEQ ID NO: 3455526 - RNA, 23 nt, Pseudomonas aeruginosa PA01
cuucugcagcucggccugguccg

SEQ ID NO: 3455527 - RNA, 21 nt, Pseudomonas aeruginosa PA01
cuucugcagggcggcuuccag

SEQ ID NO: 3455528 - RNA, 23 nt, Pseudomonas aeruginosa PA01
cuucugcagggcggcuuccaggu

SEQ ID NO: 3455529 - RNA, 13 nt, Pseudomonas aeruginosa PA01
cuucugcgagccg

SEQ ID NO: 3455530 - RNA, 15 nt, Pseudomonas aeruginosa PA01
cuucugcgccuccuc

SEQ ID NO: 3455531 - RNA, 19 nt, Pseudomonas aeruginosa PA01
cuucugcgcguugcagcgc

SEQ ID NO: 3455532 - RNA, 13 nt, Pseudomonas aeruginosa PA01
cuucugcucggcc

SEQ ID NO: 3455533 - RNA, 15 nt, Pseudomonas aeruginosa PA01
cuucugcucggccug

SEQ ID NO: 3455534 - RNA, 19 nt, Pseudomonas aeruginosa PA01
cuucugcuggauccucgcc

SEQ ID NO: 3455535 - RNA, 22 nt, Pseudomonas aeruginosa PA01
cuucugcuggauccucgccucg

SEQ ID NO: 3455536 - RNA, 23 nt, Pseudomonas aeruginosa PA01
cuucugcuggauccucgccucgc

SEQ ID NO: 3455537 - RNA, 14 nt, Pseudomonas aeruginosa PA01
cuucugcuggccgc

SEQ ID NO: 3455538 - RNA, 15 nt, Pseudomonas aeruginosa PA01
cuucugcuggccgcg

SEQ ID NO: 3455539 - RNA, 21 nt, Pseudomonas aeruginosa PA01
cuucuggaaaucggcguccug

SEQ ID NO: 3455540 - RNA, 18 nt, Pseudomonas aeruginosa PA01
cuucuggaaggcggucag

SEQ ID NO: 3455541 - RNA, 14 nt, Pseudomonas aeruginosa PA01
cuucuggcugauca

SEQ ID NO: 3455542 - RNA, 19 nt, Pseudomonas aeruginosa PA01
cuucugguaggccagcagg

SEQ ID NO: 3455543 - RNA, 15 nt, Pseudomonas aeruginosa PA01
cuucuguccguugcg

SEQ ID NO: 3455544 - RNA, 19 nt, Pseudomonas aeruginosa PA01
cuucuguccguugcgcagc

SEQ ID NO: 3455545 - RNA, 13 nt, Pseudomonas aeruginosa PA01
cuucugucuuguc

SEQ ID NO: 3455546 - RNA, 14 nt, Pseudomonas aeruginosa PA01
cuucugucuugucc

SEQ ID NO: 3455547 - RNA, 15 nt, Pseudomonas aeruginosa PA01
cuucuucaccaggcc

SEQ ID NO: 3455548 - RNA, 22 nt, Pseudomonas aeruginosa PA01
cuucuuccccgccacuuccagc

SEQ ID NO: 3455549 - RNA, 18 nt, Pseudomonas aeruginosa PA01
cuucuucgcuggaccagg

SEQ ID NO: 3455550 - RNA, 20 nt, Pseudomonas aeruginosa PA01
cuucuucugcagcucggccu

SEQ ID NO: 3455551 - RNA, 16 nt, Pseudomonas aeruginosa PA01
cuucuugagcccuucg

SEQ ID NO: 3455552 - RNA, 20 nt, Pseudomonas aeruginosa PA01
cuucuuguauaccagcggcu

SEQ ID NO: 3455553 - RNA, 17 nt, Pseudomonas aeruginosa PA01
cuugcccgucgggcaag

SEQ ID NO: 3455554 - RNA, 20 nt, Pseudomonas aeruginosa PA01
cuugcccucagggaagaugc

SEQ ID NO: 3455555 - RNA, 14 nt, Pseudomonas aeruginosa PA01
cuugcccucgcgcc

SEQ ID NO: 3455556 - RNA, 14 nt, Pseudomonas aeruginosa PA01
cuugcccucgcgga

SEQ ID NO: 3455557 - RNA, 20 nt, Pseudomonas aeruginosa PA01
cuugcccucggcgcccgccu

SEQ ID NO: 3455558 - RNA, 18 nt, Pseudomonas aeruginosa PA01
cuugcccugcucgucgcu

SEQ ID NO: 3455559 - RNA, 13 nt, Pseudomonas aeruginosa PA01
cuugcccugggcg

SEQ ID NO: 3455560 - RNA, 22 nt, Pseudomonas aeruginosa PA01
cuugccgaagauacccagcggg

SEQ ID NO: 3455561 - RNA, 19 nt, Pseudomonas aeruginosa PA01
cuugccgacaagccuccag

SEQ ID NO: 3455562 - RNA, 20 nt, Pseudomonas aeruginosa PA01
cuugccgacaagccuccagc

SEQ ID NO: 3455563 - RNA, 23 nt, Pseudomonas aeruginosa PA01
cuugccgacaagccuccagcgcc

SEQ ID NO: 3455564 - RNA, 14 nt, Pseudomonas aeruginosa PA01
cuugccgacgccgc

SEQ ID NO: 3455565 - RNA, 22 nt, Pseudomonas aeruginosa PA01
cuugccgacgccgcggccggcg

SEQ ID NO: 3455566 - RNA, 22 nt, Pseudomonas aeruginosa PA01
cuugccgaggaagucggcggcc

SEQ ID NO: 3455567 - RNA, 23 nt, Pseudomonas aeruginosa PA01
cuugccgaggaagucggcggccg

SEQ ID NO: 3455568 - RNA, 24 nt, Pseudomonas aeruginosa PA01
cuugccgaggaagucggcggccgc

SEQ ID NO: 3455569 - RNA, 15 nt, Pseudomonas aeruginosa PA01
cuugccgccgccgga

SEQ ID NO: 3455570 - RNA, 22 nt, Pseudomonas aeruginosa PA01
cuugccgccgguucgcaggcca

SEQ ID NO: 3455571 - RNA, 13 nt, Pseudomonas aeruginosa PA01
cuugccgcgaccg

SEQ ID NO: 3455572 - RNA, 18 nt, Pseudomonas aeruginosa PA01
cuugccgcgagcuuggcc

SEQ ID NO: 3455573 - RNA, 19 nt, Pseudomonas aeruginosa PA01
cuugccgcgagcuuggccc

SEQ ID NO: 3455574 - RNA, 16 nt, Pseudomonas aeruginosa PA01
cuugccgcgcccggcc

SEQ ID NO: 3455575 - RNA, 18 nt, Pseudomonas aeruginosa PA01
cuugccgcucaggcugug

SEQ ID NO: 3455576 - RNA, 23 nt, Pseudomonas aeruginosa PA01
cuugccgcucaggcugugcagga

SEQ ID NO: 3455577 - RNA, 14 nt, Pseudomonas aeruginosa PA01
cuugccgcugcgca

SEQ ID NO: 3455578 - RNA, 15 nt, Pseudomonas aeruginosa PA01
cuugccgcugcgcgc

SEQ ID NO: 3455579 - RNA, 15 nt, Pseudomonas aeruginosa PA01
cuugccgcuguuacu

SEQ ID NO: 3455580 - RNA, 12 nt, Pseudomonas aeruginosa PA01
cuugccggcagc

SEQ ID NO: 3455581 - RNA, 15 nt, Pseudomonas aeruginosa PA01
cuugccggccgccag

SEQ ID NO: 3455582 - RNA, 17 nt, Pseudomonas aeruginosa PA01
cuugccggccgccagca

SEQ ID NO: 3455583 - RNA, 18 nt, Pseudomonas aeruginosa PA01
cuugccggccgccagcag

SEQ ID NO: 3455584 - RNA, 13 nt, Pseudomonas aeruginosa PA01
cuugccggcgccu

SEQ ID NO: 3455585 - RNA, 17 nt, Pseudomonas aeruginosa PA01
cuugccggcggcgcuga

SEQ ID NO: 3455586 - RNA, 14 nt, Pseudomonas aeruginosa PA01
cuugccggcugcgc

SEQ ID NO: 3455587 - RNA, 16 nt, Pseudomonas aeruginosa PA01
cuugccggcugcgccg

SEQ ID NO: 3455588 - RNA, 17 nt, Pseudomonas aeruginosa PA01
cuugccggcugcgccgc

SEQ ID NO: 3455589 - RNA, 18 nt, Pseudomonas aeruginosa PA01
cuugccggcugcgccgcg

SEQ ID NO: 3455590 - RNA, 15 nt, Pseudomonas aeruginosa PA01
cuugccggggucgag

SEQ ID NO: 3455591 - RNA, 22 nt, Pseudomonas aeruginosa PA01
cuugccgguuuguugcaggcug

SEQ ID NO: 3455592 - RNA, 14 nt, Pseudomonas aeruginosa PA01
cuugccguggcucc

SEQ ID NO: 3455593 - RNA, 19 nt, Pseudomonas aeruginosa PA01
cuugccguggcuccuggag

SEQ ID NO: 3455594 - RNA, 19 nt, Pseudomonas aeruginosa PA01
cuugccguugcucacgccg

SEQ ID NO: 3455595 - RNA, 17 nt, Pseudomonas aeruginosa PA01
cuugccguuggcgucgc

SEQ ID NO: 3455596 - RNA, 18 nt, Pseudomonas aeruginosa PA01
cuugccguuggcgucgcg

SEQ ID NO: 3455597 - RNA, 21 nt, Pseudomonas aeruginosa PA01
cuugccugucuacucgacgcu

SEQ ID NO: 3455598 - RNA, 13 nt, Pseudomonas aeruginosa PA01
cuugccuuccagg

SEQ ID NO: 3455599 - RNA, 14 nt, Pseudomonas aeruginosa PA01
cuugccuuccaggc

SEQ ID NO: 3455600 - RNA, 15 nt, Pseudomonas aeruginosa PA01
cuugccuuccaggcu

SEQ ID NO: 3455601 - RNA, 16 nt, Pseudomonas aeruginosa PA01
cuugccuuccugggcg

SEQ ID NO: 3455602 - RNA, 17 nt, Pseudomonas aeruginosa PA01
cuugccuuccugggcgu

SEQ ID NO: 3455603 - RNA, 19 nt, Pseudomonas aeruginosa PA01
cuugcgaaaagcccgccac

SEQ ID NO: 3455604 - RNA, 19 nt, Pseudomonas aeruginosa PA01
cuugcgaccagguccggag

SEQ ID NO: 3455605 - RNA, 23 nt, Pseudomonas aeruginosa PA01
cuugcgaucgaggaugaucggcu

SEQ ID NO: 3455606 - RNA, 14 nt, Pseudomonas aeruginosa PA01
cuugcgcaccaggg

SEQ ID NO: 3455607 - RNA, 19 nt, Pseudomonas aeruginosa PA01
cuugcgcaccagggccagg

SEQ ID NO: 3455608 - RNA, 13 nt, Pseudomonas aeruginosa PA01
cuugcgcaccgcc

SEQ ID NO: 3455609 - RNA, 18 nt, Pseudomonas aeruginosa PA01
cuugcgcaccgccugcag

SEQ ID NO: 3455610 - RNA, 18 nt, Pseudomonas aeruginosa PA01
cuugcgcagggcggcgag

SEQ ID NO: 3455611 - RNA, 19 nt, Pseudomonas aeruginosa PA01
cuugcgccagagcaggcgg

SEQ ID NO: 3455612 - RNA, 20 nt, Pseudomonas aeruginosa PA01
cuugcgccaggcccggcgcu

SEQ ID NO: 3455613 - RNA, 14 nt, Pseudomonas aeruginosa PA01
cuugcgccaggccu

SEQ ID NO: 3455614 - RNA, 15 nt, Pseudomonas aeruginosa PA01
cuugcgccaugcgcc

SEQ ID NO: 3455615 - RNA, 18 nt, Pseudomonas aeruginosa PA01
cuugcgccaugcgcccgc

SEQ ID NO: 3455616 - RNA, 13 nt, Pseudomonas aeruginosa PA01
cuugcgcccggcg

SEQ ID NO: 3455617 - RNA, 16 nt, Pseudomonas aeruginosa PA01
cuugcgcccggcgcga

SEQ ID NO: 3455618 - RNA, 17 nt, Pseudomonas aeruginosa PA01
cuugcgcccggcgcgac

SEQ ID NO: 3455619 - RNA, 12 nt, Pseudomonas aeruginosa PA01
cuugcgccgaag

SEQ ID NO: 3455620 - RNA, 16 nt, Pseudomonas aeruginosa PA01
cuugcgccgaccgcgc

SEQ ID NO: 3455621 - RNA, 17 nt, Pseudomonas aeruginosa PA01
cuugcgccgaccgcgcg

SEQ ID NO: 3455622 - RNA, 23 nt, Pseudomonas aeruginosa PA01
cuugcgccgaccgcgcgccugca

SEQ ID NO: 3455623 - RNA, 14 nt, Pseudomonas aeruginosa PA01
cuugcgcgccacca

SEQ ID NO: 3455624 - RNA, 16 nt, Pseudomonas aeruginosa PA01
cuugcgcgccaccagc

SEQ ID NO: 3455625 - RNA, 13 nt, Pseudomonas aeruginosa PA01
cuugcgcgccagg

SEQ ID NO: 3455626 - RNA, 13 nt, Pseudomonas aeruginosa PA01
cuugcgcgcggcg

SEQ ID NO: 3455627 - RNA, 16 nt, Pseudomonas aeruginosa PA01
cuugcgcgcggcgucg

SEQ ID NO: 3455628 - RNA, 11 nt, Pseudomonas aeruginosa PA01
cuugcgcggca

SEQ ID NO: 3455629 - RNA, 16 nt, Pseudomonas aeruginosa PA01
cuugcgcggcaggccg

SEQ ID NO: 3455630 - RNA, 19 nt, Pseudomonas aeruginosa PA01
cuugcgcggcaggccgucc

SEQ ID NO: 3455631 - RNA, 15 nt, Pseudomonas aeruginosa PA01
cuugcgcucuggcgc

SEQ ID NO: 3455632 - RNA, 16 nt, Pseudomonas aeruginosa PA01
cuugcgcuguuccgcc

SEQ ID NO: 3455633 - RNA, 17 nt, Pseudomonas aeruginosa PA01
cuugcgcuugccggccg

SEQ ID NO: 3455634 - RNA, 16 nt, Pseudomonas aeruginosa PA01
cuugcggaacccgcgc

SEQ ID NO: 3455635 - RNA, 23 nt, Pseudomonas aeruginosa PA01
cuugcggaacccgcgcaguuccu

SEQ ID NO: 3455636 - RNA, 21 nt, Pseudomonas aeruginosa PA01
cuugcggcaguccucgccguu

SEQ ID NO: 3455637 - RNA, 22 nt, Pseudomonas aeruginosa PA01
cuugcggcccccagaccgugga

SEQ ID NO: 3455638 - RNA, 14 nt, Pseudomonas aeruginosa PA01
cuugcggccguucu

SEQ ID NO: 3455639 - RNA, 19 nt, Pseudomonas aeruginosa PA01
cuugcggcgccgaggcccu

SEQ ID NO: 3455640 - RNA, 17 nt, Pseudomonas aeruginosa PA01
cuugcggggcggcgcau

SEQ ID NO: 3455641 - RNA, 16 nt, Pseudomonas aeruginosa PA01
cuugcgggugcgcagg

SEQ ID NO: 3455642 - RNA, 17 nt, Pseudomonas aeruginosa PA01
cuugcgggugcgcaggc

SEQ ID NO: 3455643 - RNA, 16 nt, Pseudomonas aeruginosa PA01
cuugcggguggucuug

SEQ ID NO: 3455644 - RNA, 17 nt, Pseudomonas aeruginosa PA01
cuugcggguggucuugc

SEQ ID NO: 3455645 - RNA, 16 nt, Pseudomonas aeruginosa PA01
cuugcgguuauccgcc

SEQ ID NO: 3455646 - RNA, 18 nt, Pseudomonas aeruginosa PA01
cuugcgguuauccgccgu

SEQ ID NO: 3455647 - RNA, 15 nt, Pseudomonas aeruginosa PA01
cuugcguaccagcgc

SEQ ID NO: 3455648 - RNA, 20 nt, Pseudomonas aeruginosa PA01
cuugcguaccagcgcgcagc

SEQ ID NO: 3455649 - RNA, 21 nt, Pseudomonas aeruginosa PA01
cuugcgucccugggccugcag

SEQ ID NO: 3455650 - RNA, 23 nt, Pseudomonas aeruginosa PA01
cuugcgucccugggccugcaggu

SEQ ID NO: 3455651 - RNA, 23 nt, Pseudomonas aeruginosa PA01
cuugcgucccuuggcgucgcggc

SEQ ID NO: 3455652 - RNA, 14 nt, Pseudomonas aeruginosa PA01
cuugcguccugccu

SEQ ID NO: 3455653 - RNA, 13 nt, Pseudomonas aeruginosa PA01
cuugcguuccucc

SEQ ID NO: 3455654 - RNA, 18 nt, Pseudomonas aeruginosa PA01
cuugcguucgcuccaguc

SEQ ID NO: 3455655 - RNA, 17 nt, Pseudomonas aeruginosa PA01
cuugcucaggucguagg

SEQ ID NO: 3455656 - RNA, 23 nt, Pseudomonas aeruginosa PA01
cuugucgcgguugccgaagcgcu

SEQ ID NO: 3455657 - RNA, 17 nt, Pseudomonas aeruginosa PA01
cuugucgcugaccggcc

SEQ ID NO: 3455658 - RNA, 14 nt, Pseudomonas aeruginosa PA01
cuugucggccgacg

SEQ ID NO: 3455659 - RNA, 15 nt, Pseudomonas aeruginosa PA01
cuugucguggcgggc

SEQ ID NO: 3455660 - RNA, 15 nt, Pseudomonas aeruginosa PA01
cuugucguucggccc

SEQ ID NO: 3455661 - RNA, 16 nt, Pseudomonas aeruginosa PA01
cuugucuuucugcgac

SEQ ID NO: 3455662 - RNA, 11 nt, Pseudomonas aeruginosa PA01
cuugugaaagg

SEQ ID NO: 3455663 - RNA, 18 nt, Pseudomonas aeruginosa PA01
cuugugaaagggcggcag

SEQ ID NO: 3455664 - RNA, 20 nt, Pseudomonas aeruginosa PA01
cuugugcgaauguccggcga

SEQ ID NO: 3455665 - RNA, 22 nt, Pseudomonas aeruginosa PA01
cuuguggccgaucuccugguag

SEQ ID NO: 3455666 - RNA, 14 nt, Pseudomonas aeruginosa PA01
cuuguucagggugg

SEQ ID NO: 3455667 - RNA, 17 nt, Pseudomonas aeruginosa PA01
cuuguucaggguggcga

SEQ ID NO: 3455668 - RNA, 21 nt, Pseudomonas aeruginosa PA01
cuuguucaggguggcgaccgc

SEQ ID NO: 3455669 - RNA, 16 nt, Pseudomonas aeruginosa PA01
cuuguuccaggcguug

SEQ ID NO: 3455670 - RNA, 23 nt, Pseudomonas aeruginosa PA01
cuuguucgcggcgaugcgcaugc

SEQ ID NO: 3455671 - RNA, 16 nt, Pseudomonas aeruginosa PA01
cuuguucgggucgcgg

SEQ ID NO: 3455672 - RNA, 15 nt, Pseudomonas aeruginosa PA01
cuuguuggccagcag

SEQ ID NO: 3455673 - RNA, 20 nt, Pseudomonas aeruginosa PA01
cuuguuggccagcagccagg

SEQ ID NO: 3455674 - RNA, 17 nt, Pseudomonas aeruginosa PA01
cuuguuuuccuggcccu

SEQ ID NO: 3455675 - RNA, 19 nt, Pseudomonas aeruginosa PA01
cuuguuuuccuggcccugg

SEQ ID NO: 3455676 - RNA, 12 nt, Pseudomonas aeruginosa PA01
cuuucaccuggu

SEQ ID NO: 3455677 - RNA, 18 nt, Pseudomonas aeruginosa PA01
cuuucagcgccgcucggc

SEQ ID NO: 3455678 - RNA, 23 nt, Pseudomonas aeruginosa PA01
cuuucagcgccgcucggcgagcc

SEQ ID NO: 3455679 - RNA, 13 nt, Pseudomonas aeruginosa PA01
cuuucaggcgcuc

SEQ ID NO: 3455680 - RNA, 18 nt, Pseudomonas aeruginosa PA01
cuuucagguccuugauca

SEQ ID NO: 3455681 - RNA, 19 nt, Pseudomonas aeruginosa PA01
cuuuccaccgccagcaccc

SEQ ID NO: 3455682 - RNA, 20 nt, Pseudomonas aeruginosa PA01
cuuuccaccgccagcaccca

SEQ ID NO: 3455683 - RNA, 16 nt, Pseudomonas aeruginosa PA01
cuuuccaggcgccgcu

SEQ ID NO: 3455684 - RNA, 16 nt, Pseudomonas aeruginosa PA01
cuuuccagggccuggc

SEQ ID NO: 3455685 - RNA, 17 nt, Pseudomonas aeruginosa PA01
cuuuccagggccuggcg

SEQ ID NO: 3455686 - RNA, 14 nt, Pseudomonas aeruginosa PA01
cuuuccgaaaccag

SEQ ID NO: 3455687 - RNA, 13 nt, Pseudomonas aeruginosa PA01
cuuuccgccgagc

SEQ ID NO: 3455688 - RNA, 21 nt, Pseudomonas aeruginosa PA01
cuuuccgccgagcguugggcc

SEQ ID NO: 3455689 - RNA, 15 nt, Pseudomonas aeruginosa PA01
cuuuccggcgcggcc

SEQ ID NO: 3455690 - RNA, 20 nt, Pseudomonas aeruginosa PA01
cuuuccgucucaggcgccag

SEQ ID NO: 3455691 - RNA, 21 nt, Pseudomonas aeruginosa PA01
cuuuccucggccaugccggcc

SEQ ID NO: 3455692 - RNA, 15 nt, Pseudomonas aeruginosa PA01
cuuuccugcgccucg

SEQ ID NO: 3455693 - RNA, 14 nt, Pseudomonas aeruginosa PA01
cuuuccugcuccag

SEQ ID NO: 3455694 - RNA, 17 nt, Pseudomonas aeruginosa PA01
cuuuccuggccgacccg

SEQ ID NO: 3455695 - RNA, 23 nt, Pseudomonas aeruginosa PA01
cuuuccuuucacaugcaccaggc

SEQ ID NO: 3455696 - RNA, 16 nt, Pseudomonas aeruginosa PA01
cuuucgaagcgcuccc

SEQ ID NO: 3455697 - RNA, 19 nt, Pseudomonas aeruginosa PA01
cuuucgagaaagcgcagga

SEQ ID NO: 3455698 - RNA, 22 nt, Pseudomonas aeruginosa PA01
cuuucgaucuggcugcccaggc

SEQ ID NO: 3455699 - RNA, 19 nt, Pseudomonas aeruginosa PA01
cuuucgaugguugccggug

SEQ ID NO: 3455700 - RNA, 20 nt, Pseudomonas aeruginosa PA01
cuuucgaugguugccggugu

SEQ ID NO: 3455701 - RNA, 22 nt, Pseudomonas aeruginosa PA01
cuuucgcgucugguagauggac

SEQ ID NO: 3455702 - RNA, 15 nt, Pseudomonas aeruginosa PA01
cuuucgcucaggccu

SEQ ID NO: 3455703 - RNA, 16 nt, Pseudomonas aeruginosa PA01
cuuucgcucaggccuc

SEQ ID NO: 3455704 - RNA, 17 nt, Pseudomonas aeruginosa PA01
cuuucggugaacuucuc

SEQ ID NO: 3455705 - RNA, 21 nt, Pseudomonas aeruginosa PA01
cuuucguaggcaggcgcggca

SEQ ID NO: 3455706 - RNA, 16 nt, Pseudomonas aeruginosa PA01
cuuucguuucagcgcc

SEQ ID NO: 3455707 - RNA, 13 nt, Pseudomonas aeruginosa PA01
cuuucugcccggc

SEQ ID NO: 3455708 - RNA, 15 nt, Pseudomonas aeruginosa PA01
cuuucugcccggcuu

SEQ ID NO: 3455709 - RNA, 22 nt, Pseudomonas aeruginosa PA01
cuuucuucgccuggcgcgacga

SEQ ID NO: 3455710 - RNA, 21 nt, Pseudomonas aeruginosa PA01
cuuugagggucagaccagccc

SEQ ID NO: 3455711 - RNA, 21 nt, Pseudomonas aeruginosa PA01
cuuugcccgucuagcgcaggc

SEQ ID NO: 3455712 - RNA, 11 nt, Pseudomonas aeruginosa PA01
cuuugcgcagc

SEQ ID NO: 3455713 - RNA, 12 nt, Pseudomonas aeruginosa PA01
cuuugcggcaag

SEQ ID NO: 3455714 - RNA, 21 nt, Pseudomonas aeruginosa PA01
cuuugcggcaaggcgaucccg

SEQ ID NO: 3455715 - RNA, 20 nt, Pseudomonas aeruginosa PA01
cuuuggucuaauggcaccug

SEQ ID NO: 3455716 - RNA, 18 nt, Pseudomonas aeruginosa PA01
cuuuucaauuccgccgcg

SEQ ID NO: 3455717 - RNA, 19 nt, Pseudomonas aeruginosa PA01
cuuuuccaccggccgcgcc

SEQ ID NO: 3455718 - RNA, 15 nt, Pseudomonas aeruginosa PA01
cuuuuccagcgcacc

SEQ ID NO: 3455719 - RNA, 14 nt, Pseudomonas aeruginosa PA01
cuuuucccagcggc

SEQ ID NO: 3455720 - RNA, 18 nt, Pseudomonas aeruginosa PA01
cuuuucccgaucguuggc

SEQ ID NO: 3455721 - RNA, 19 nt, Pseudomonas aeruginosa PA01
cuuuucccgcaccggcgcg

SEQ ID NO: 3455722 - RNA, 16 nt, Pseudomonas aeruginosa PA01
cuuuuccggcgccggc

SEQ ID NO: 3455723 - RNA, 20 nt, Pseudomonas aeruginosa PA01
cuuuuccuccagggugccga

SEQ ID NO: 3455724 - RNA, 22 nt, Pseudomonas aeruginosa PA01
cuuuuccuccagggugccgacc

SEQ ID NO: 3455725 - RNA, 19 nt, Pseudomonas aeruginosa PA01
cuuuuccucgaucaggccu

SEQ ID NO: 3455726 - RNA, 23 nt, Pseudomonas aeruginosa PA01
cuuuuccugcaacucgaaaaugu

SEQ ID NO: 3455727 - RNA, 18 nt, Pseudomonas aeruginosa PA01
cuuuucgaugguggaauc

SEQ ID NO: 3455728 - RNA, 15 nt, Pseudomonas aeruginosa PA01
cuuuucggcggccag

SEQ ID NO: 3455729 - RNA, 15 nt, Pseudomonas aeruginosa PA01
cuuuucucgccuccc

SEQ ID NO: 3455730 - RNA, 20 nt, Pseudomonas aeruginosa PA01
cuuuucuuuauuccucccau

SEQ ID NO: 3455731 - RNA, 20 nt, Pseudomonas aeruginosa PA01
cuuuuucaugcgcgggccga

SEQ ID NO: 3455732 - RNA, 15 nt, Pseudomonas aeruginosa PA01
cuuuuucaugcgugc

SEQ ID NO: 3455733 - RNA, 21 nt, Pseudomonas aeruginosa PA01
cuuuuucauggccuggcgcuc

SEQ ID NO: 3455734 - RNA, 15 nt, Pseudomonas aeruginosa PA01
cuuuuucauggcugg

SEQ ID NO: 3455735 - RNA, 22 nt, Pseudomonas aeruginosa PA01
cuuuuucauggcuggcccucag

SEQ ID NO: 3455736 - RNA, 17 nt, Pseudomonas aeruginosa PA01
cuuuuucgucgccagcc

SEQ ID NO: 3455737 - RNA, 16 nt, Pseudomonas aeruginosa PA01
cuuuuucguuggccag

SEQ ID NO: 3455738 - RNA, 22 nt, Pseudomonas aeruginosa PA01
cuuuuugcgccagguagccugg

SEQ ID NO: 3455739 - RNA, 15 nt, Pseudomonas aeruginosa PA01
cuuuuuucagccugu

SEQ ID NO: 3455740 - RNA, 19 nt, Pseudomonas aeruginosa PA01
cuuuuuucauggcggucag

SEQ ID NO: 3455741 - RNA, 13 nt, Pseudomonas aeruginosa PA01
gaaaaaaggggau

SEQ ID NO: 3455742 - RNA, 18 nt, Pseudomonas aeruginosa PA01
gaaaaacccaugcgguuc

SEQ ID NO: 3455743 - RNA, 18 nt, Pseudomonas aeruginosa PA01
gaaaaacggggcuccccu

SEQ ID NO: 3455744 - RNA, 19 nt, Pseudomonas aeruginosa PA01
gaaaaagacaaaauucucc

SEQ ID NO: 3455745 - RNA, 17 nt, Pseudomonas aeruginosa PA01
gaaaaagccccugcgcc

SEQ ID NO: 3455746 - RNA, 14 nt, Pseudomonas aeruginosa PA01
gaaaaagcccggcc

SEQ ID NO: 3455747 - RNA, 22 nt, Pseudomonas aeruginosa PA01
gaaaaagcccggccgcugccgg

SEQ ID NO: 3455748 - RNA, 18 nt, Pseudomonas aeruginosa PA01
gaaaaagcccggccuggu

SEQ ID NO: 3455749 - RNA, 22 nt, Pseudomonas aeruginosa PA01
gaaaaagcccggccuggugccg

SEQ ID NO: 3455750 - RNA, 21 nt, Pseudomonas aeruginosa PA01
gaaaaagccggcgcaugcgcc

SEQ ID NO: 3455751 - RNA, 17 nt, Pseudomonas aeruginosa PA01
gaaaaaggcgcgccggu

SEQ ID NO: 3455752 - RNA, 19 nt, Pseudomonas aeruginosa PA01
gaaaaagggaugccgccgg

SEQ ID NO: 3455753 - RNA, 18 nt, Pseudomonas aeruginosa PA01
gaaaaauauauuccuuua

SEQ ID NO: 3455754 - RNA, 21 nt, Pseudomonas aeruginosa PA01
gaaaacaagaagccccgcuau

SEQ ID NO: 3455755 - RNA, 15 nt, Pseudomonas aeruginosa PA01
gaaaacaucacggca

SEQ ID NO: 3455756 - RNA, 12 nt, Pseudomonas aeruginosa PA01
gaaaaccgcaga

SEQ ID NO: 3455757 - RNA, 16 nt, Pseudomonas aeruginosa PA01
gaaaacgcccggcaga

SEQ ID NO: 3455758 - RNA, 14 nt, Pseudomonas aeruginosa PA01
gaaauccaccagca

SEQ ID NO: 3455759 - RNA, 16 nt, Pseudomonas aeruginosa PA01
gaaauccaccagcacg

SEQ ID NO: 3455760 - RNA, 18 nt, Pseudomonas aeruginosa PA01
gaaauccaccuugccgcg

SEQ ID NO: 3455761 - RNA, 15 nt, Pseudomonas aeruginosa PA01
gaaauccgccgcgca

SEQ ID NO: 3455762 - RNA, 16 nt, Pseudomonas aeruginosa PA01
gaaauccgccgcgcac

SEQ ID NO: 3455763 - RNA, 17 nt, Pseudomonas aeruginosa PA01
gaaauccggcuggcgcc

SEQ ID NO: 3455764 - RNA, 18 nt, Pseudomonas aeruginosa PA01
gaaauccuccggacgccg

SEQ ID NO: 3455765 - RNA, 22 nt, Pseudomonas aeruginosa PA01
gaaauccuccggacgccgaacg

SEQ ID NO: 3455766 - RNA, 17 nt, Pseudomonas aeruginosa PA01
gaaauccucgcgcaccg

SEQ ID NO: 3455767 - RNA, 19 nt, Pseudomonas aeruginosa PA01
gaaaucgagcgccaggaac

SEQ ID NO: 3455768 - RNA, 19 nt, Pseudomonas aeruginosa PA01
gaaaucgccguugccuucg

SEQ ID NO: 3455769 - RNA, 13 nt, Pseudomonas aeruginosa PA01
gaaaucggagaag

SEQ ID NO: 3455770 - RNA, 16 nt, Pseudomonas aeruginosa PA01
gaaaucggcaggcugc

SEQ ID NO: 3455771 - RNA, 15 nt, Pseudomonas aeruginosa PA01
gaaaucggccacucc

SEQ ID NO: 3455772 - RNA, 19 nt, Pseudomonas aeruginosa PA01
gaaaucggccacuccagcc

SEQ ID NO: 3455773 - RNA, 17 nt, Pseudomonas aeruginosa PA01
gaaaucggcguccuggu

SEQ ID NO: 3455774 - RNA, 14 nt, Pseudomonas aeruginosa PA01
gaaaucgguugcga

SEQ ID NO: 3455775 - RNA, 17 nt, Pseudomonas aeruginosa PA01
gaaaugaaauagugcug

SEQ ID NO: 3455776 - RNA, 11 nt, Pseudomonas aeruginosa PA01
gaaaugcaggc

SEQ ID NO: 3455777 - RNA, 13 nt, Pseudomonas aeruginosa PA01
gaaaugcaggccg

SEQ ID NO: 3455778 - RNA, 21 nt, Pseudomonas aeruginosa PA01
gaaaugcaggccgguggucgg

SEQ ID NO: 3455779 - RNA, 13 nt, Pseudomonas aeruginosa PA01
gaaaugccuggcu

SEQ ID NO: 3455780 - RNA, 18 nt, Pseudomonas aeruginosa PA01
gaaaugcucgugcaggua

SEQ ID NO: 3455781 - RNA, 22 nt, Pseudomonas aeruginosa PA01
gaaaugcucgugcagguagccg

SEQ ID NO: 3455782 - RNA, 14 nt, Pseudomonas aeruginosa PA01
gaaauggcaaccca

SEQ ID NO: 3455783 - RNA, 14 nt, Pseudomonas aeruginosa PA01
gaaauggcagaaca

SEQ ID NO: 3455784 - RNA, 14 nt, Pseudomonas aeruginosa PA01
gaaauggcggacga

SEQ ID NO: 3455785 - RNA, 20 nt, Pseudomonas aeruginosa PA01
gaaauggguucccagcagca

SEQ ID NO: 3455786 - RNA, 14 nt, Pseudomonas aeruginosa PA01
gaaaugguggacca

SEQ ID NO: 3455787 - RNA, 22 nt, Pseudomonas aeruginosa PA01
gaaaugguggaccagcgccgcc

SEQ ID NO: 3455788 - RNA, 18 nt, Pseudomonas aeruginosa PA01
gaaauucagcgcuuccuu

SEQ ID NO: 3455789 - RNA, 15 nt, Pseudomonas aeruginosa PA01
gaaauucgcgcugga

SEQ ID NO: 3455790 - RNA, 17 nt, Pseudomonas aeruginosa PA01
gaacaacccgccagcaa

SEQ ID NO: 3455791 - RNA, 22 nt, Pseudomonas aeruginosa PA01
gaacaaccgcuugucgccuucc

SEQ ID NO: 3455792 - RNA, 23 nt, Pseudomonas aeruginosa PA01
gaacaacuggacgaaggccuccu

SEQ ID NO: 3455793 - RNA, 14 nt, Pseudomonas aeruginosa PA01
gaacaagccgccuu

SEQ ID NO: 3455794 - RNA, 14 nt, Pseudomonas aeruginosa PA01
gaacaaucccagcu

SEQ ID NO: 3455795 - RNA, 14 nt, Pseudomonas aeruginosa PA01
gaacacacccugcg

SEQ ID NO: 3455796 - RNA, 20 nt, Pseudomonas aeruginosa PA01
gaacacacgcuucugcuggc

SEQ ID NO: 3455797 - RNA, 23 nt, Pseudomonas aeruginosa PA01
gaacacacgcuucugcuggccgc

SEQ ID NO: 3455798 - RNA, 17 nt, Pseudomonas aeruginosa PA01
gaacacauagaccagca

SEQ ID NO: 3455799 - RNA, 24 nt, Pseudomonas aeruginosa PA01
gaacacauagaccagcagcgagca

SEQ ID NO: 3455800 - RNA, 17 nt, Pseudomonas aeruginosa PA01
gaacacaucgaccaggu

SEQ ID NO: 3455801 - RNA, 22 nt, Pseudomonas aeruginosa PA01
gaacacaucgaccaggucgcca

SEQ ID NO: 3455802 - RNA, 15 nt, Pseudomonas aeruginosa PA01
gaacaccaggccgca

SEQ ID NO: 3455803 - RNA, 15 nt, Pseudomonas aeruginosa PA01
gaacaccaggcgcca

SEQ ID NO: 3455804 - RNA, 19 nt, Pseudomonas aeruginosa PA01
gaacaccaggcgccaggga

SEQ ID NO: 3455805 - RNA, 15 nt, Pseudomonas aeruginosa PA01
gaacacccagaagcc

SEQ ID NO: 3455806 - RNA, 20 nt, Pseudomonas aeruginosa PA01
gaacacccagaagccgaccu

SEQ ID NO: 3455807 - RNA, 13 nt, Pseudomonas aeruginosa PA01
gaacaccgccugg

SEQ ID NO: 3455808 - RNA, 15 nt, Pseudomonas aeruginosa PA01
gaacaccggcgagca

SEQ ID NO: 3455809 - RNA, 16 nt, Pseudomonas aeruginosa PA01
gaacaccggcgccgcc

SEQ ID NO: 3455810 - RNA, 19 nt, Pseudomonas aeruginosa PA01
gaacaccggcgccgccugg

SEQ ID NO: 3455811 - RNA, 16 nt, Pseudomonas aeruginosa PA01
gaacaccgggccgccg

SEQ ID NO: 3455812 - RNA, 15 nt, Pseudomonas aeruginosa PA01
gaacacgcaaccccg

SEQ ID NO: 3455813 - RNA, 23 nt, Pseudomonas aeruginosa PA01
gaacacgcacaaugaaaaaggga

SEQ ID NO: 3455814 - RNA, 18 nt, Pseudomonas aeruginosa PA01
gaacacgccccagaagcc

SEQ ID NO: 3455815 - RNA, 16 nt, Pseudomonas aeruginosa PA01
gaacacgucggcgcgc

SEQ ID NO: 3455816 - RNA, 22 nt, Pseudomonas aeruginosa PA01
gaacacgucguugggccccacc

SEQ ID NO: 3455817 - RNA, 23 nt, Pseudomonas aeruginosa PA01
gaacacgucguugggccccaccg

SEQ ID NO: 3455818 - RNA, 16 nt, Pseudomonas aeruginosa PA01
gaacagacgcaggcag

SEQ ID NO: 3455819 - RNA, 21 nt, Pseudomonas aeruginosa PA01
gaacagaggaaggcgccggca

SEQ ID NO: 3455820 - RNA, 13 nt, Pseudomonas aeruginosa PA01
gaacagcaaagcg

SEQ ID NO: 3455821 - RNA, 17 nt, Pseudomonas aeruginosa PA01
gaacagcaaagcgcagg

SEQ ID NO: 3455822 - RNA, 16 nt, Pseudomonas aeruginosa PA01
gaacagcaacaccgcg

SEQ ID NO: 3455823 - RNA, 19 nt, Pseudomonas aeruginosa PA01
gaacagcaacaccgcgcag

SEQ ID NO: 3455824 - RNA, 11 nt, Pseudomonas aeruginosa PA01
gaacagcacca

SEQ ID NO: 3455825 - RNA, 14 nt, Pseudomonas aeruginosa PA01
gaacagcagccagg

SEQ ID NO: 3455826 - RNA, 16 nt, Pseudomonas aeruginosa PA01
gaacagcagccaggcg

SEQ ID NO: 3455827 - RNA, 12 nt, Pseudomonas aeruginosa PA01
gaacagcagcgg

SEQ ID NO: 3455828 - RNA, 14 nt, Pseudomonas aeruginosa PA01
gaacagcagcggca

SEQ ID NO: 3455829 - RNA, 20 nt, Pseudomonas aeruginosa PA01
gaacagcagcggcaccagca

SEQ ID NO: 3455830 - RNA, 21 nt, Pseudomonas aeruginosa PA01
gaacagcagcggcaccagcac

SEQ ID NO: 3455831 - RNA, 21 nt, Pseudomonas aeruginosa PA01
gaacagcagcgguaggcgcgu

SEQ ID NO: 3455832 - RNA, 14 nt, Pseudomonas aeruginosa PA01
gaacagcagcucgc

SEQ ID NO: 3455833 - RNA, 16 nt, Pseudomonas aeruginosa PA01
gaacagcagcucgccg

SEQ ID NO: 3455834 - RNA, 19 nt, Pseudomonas aeruginosa PA01
gaacagcaggaugccgcug

SEQ ID NO: 3455835 - RNA, 13 nt, Pseudomonas aeruginosa PA01
gaacagcaggguc

SEQ ID NO: 3455836 - RNA, 20 nt, Pseudomonas aeruginosa PA01
gaacagcagggucaggguga

SEQ ID NO: 3455837 - RNA, 11 nt, Pseudomonas aeruginosa PA01
gaacagcauca

SEQ ID NO: 3455838 - RNA, 19 nt, Pseudomonas aeruginosa PA01
gaacagccagaggucgagc

SEQ ID NO: 3455839 - RNA, 22 nt, Pseudomonas aeruginosa PA01
gaacagccagaggucgagcugg

SEQ ID NO: 3455840 - RNA, 21 nt, Pseudomonas aeruginosa PA01
gaacagcccgucgcgcgccgg

SEQ ID NO: 3455841 - RNA, 15 nt, Pseudomonas aeruginosa PA01
gaacagccgcagcgg

SEQ ID NO: 3455842 - RNA, 19 nt, Pseudomonas aeruginosa PA01
gaacagcgacucgaugcgc

SEQ ID NO: 3455843 - RNA, 18 nt, Pseudomonas aeruginosa PA01
gaacagcgagacccggua

SEQ ID NO: 3455844 - RNA, 20 nt, Pseudomonas aeruginosa PA01
gaacagcgagaccucgccca

SEQ ID NO: 3455845 - RNA, 19 nt, Pseudomonas aeruginosa PA01
gaacagcgagaggggcgcu

SEQ ID NO: 3455846 - RNA, 22 nt, Pseudomonas aeruginosa PA01
gaacagcgagaggggcgcucgu

SEQ ID NO: 3455847 - RNA, 16 nt, Pseudomonas aeruginosa PA01
gaacagcgccaccagc

SEQ ID NO: 3455848 - RNA, 18 nt, Pseudomonas aeruginosa PA01
gaacagcgccaccagcau

SEQ ID NO: 3455849 - RNA, 21 nt, Pseudomonas aeruginosa PA01
gaacagcgccaccagcaugcc

SEQ ID NO: 3455850 - RNA, 15 nt, Pseudomonas aeruginosa PA01
gaacagcgccagcgg

SEQ ID NO: 3455851 - RNA, 17 nt, Pseudomonas aeruginosa PA01
gaacagcgccagcggca

SEQ ID NO: 3455852 - RNA, 21 nt, Pseudomonas aeruginosa PA01
gaacagcgccagcggcagcgg

SEQ ID NO: 3455853 - RNA, 14 nt, Pseudomonas aeruginosa PA01
gaacagcgccgcgg

SEQ ID NO: 3455854 - RNA, 20 nt, Pseudomonas aeruginosa PA01
gaacagcgccgcggcuggcc

SEQ ID NO: 3455855 - RNA, 22 nt, Pseudomonas aeruginosa PA01
gaacagcgccgcggcuggccau

SEQ ID NO: 3455856 - RNA, 11 nt, Pseudomonas aeruginosa PA01
gaacagcgccu

SEQ ID NO: 3455857 - RNA, 13 nt, Pseudomonas aeruginosa PA01
gaacagcgcgcca

SEQ ID NO: 3455858 - RNA, 17 nt, Pseudomonas aeruginosa PA01
gaacagcggaaugcuuc

SEQ ID NO: 3455859 - RNA, 14 nt, Pseudomonas aeruginosa PA01
gaacagcggcuggc

SEQ ID NO: 3455860 - RNA, 15 nt, Pseudomonas aeruginosa PA01
gaacagcggcuggcc

SEQ ID NO: 3455861 - RNA, 20 nt, Pseudomonas aeruginosa PA01
gaacgaguugggcgaccugc

SEQ ID NO: 3455862 - RNA, 21 nt, Pseudomonas aeruginosa PA01
gaacgaguugggcgaccugcu

SEQ ID NO: 3455863 - RNA, 20 nt, Pseudomonas aeruginosa PA01
gaacgcacuucguccgccac

SEQ ID NO: 3455864 - RNA, 16 nt, Pseudomonas aeruginosa PA01
gaacgcaggggcaccg

SEQ ID NO: 3455865 - RNA, 21 nt, Pseudomonas aeruginosa PA01
gaacgcaggggcaccggcgga

SEQ ID NO: 3455866 - RNA, 17 nt, Pseudomonas aeruginosa PA01
gaacgccaccagggccu

SEQ ID NO: 3455867 - RNA, 18 nt, Pseudomonas aeruginosa PA01
gaacgccaggaucggcau

SEQ ID NO: 3455868 - RNA, 11 nt, Pseudomonas aeruginosa PA01
gaacgccaggc

SEQ ID NO: 3455869 - RNA, 13 nt, Pseudomonas aeruginosa PA01
gaacgccaggcag

SEQ ID NO: 3455870 - RNA, 15 nt, Pseudomonas aeruginosa PA01
gaacgccccaguaga

SEQ ID NO: 3455871 - RNA, 23 nt, Pseudomonas aeruginosa PA01
gaacgccccgcauugcggggcgu

SEQ ID NO: 3455872 - RNA, 16 nt, Pseudomonas aeruginosa PA01
gaacgcccgcggcagc

SEQ ID NO: 3455873 - RNA, 18 nt, Pseudomonas aeruginosa PA01
gaacgcccgcggcagcag

SEQ ID NO: 3455874 - RNA, 20 nt, Pseudomonas aeruginosa PA01
gaacgcccgcggcagcagcc

SEQ ID NO: 3455875 - RNA, 21 nt, Pseudomonas aeruginosa PA01
gaacgcccgcggcagcagcca

SEQ ID NO: 3455876 - RNA, 19 nt, Pseudomonas aeruginosa PA01
gaacgcccugacccgcacc

SEQ ID NO: 3455877 - RNA, 23 nt, Pseudomonas aeruginosa PA01
gaacgccgacccuagggucggcg

SEQ ID NO: 3455878 - RNA, 13 nt, Pseudomonas aeruginosa PA01
gaacgccgcagcu

SEQ ID NO: 3455879 - RNA, 23 nt, Pseudomonas aeruginosa PA01
gaacgccgccacgccgauaccgg

SEQ ID NO: 3455880 - RNA, 23 nt, Pseudomonas aeruginosa PA01
gaacgccgcccgucgcgccggcc

SEQ ID NO: 3455881 - RNA, 18 nt, Pseudomonas aeruginosa PA01
gaacgccgggcaacgcca

SEQ ID NO: 3455882 - RNA, 21 nt, Pseudomonas aeruginosa PA01
gaacgccgggcaacgccaggc

SEQ ID NO: 3455883 - RNA, 13 nt, Pseudomonas aeruginosa PA01
gaacgccucgcag

SEQ ID NO: 3455884 - RNA, 18 nt, Pseudomonas aeruginosa PA01
gaacgccucgcagagcgc

SEQ ID NO: 3455885 - RNA, 20 nt, Pseudomonas aeruginosa PA01
gaacgccucgcagagcgcca

SEQ ID NO: 3455886 - RNA, 21 nt, Pseudomonas aeruginosa PA01
gaacgccucgcagagcgccag

SEQ ID NO: 3455887 - RNA, 23 nt, Pseudomonas aeruginosa PA01
gaacgccucgcagagcgccagcc

SEQ ID NO: 3455888 - RNA, 14 nt, Pseudomonas aeruginosa PA01
gaacgccucgccaa

SEQ ID NO: 3455889 - RNA, 22 nt, Pseudomonas aeruginosa PA01
gaacgccuugguguagccgagc

SEQ ID NO: 3455890 - RNA, 15 nt, Pseudomonas aeruginosa PA01
gaacgcgcccggcca

SEQ ID NO: 3455891 - RNA, 16 nt, Pseudomonas aeruginosa PA01
gaacgcgcccggccag

SEQ ID NO: 3455892 - RNA, 19 nt, Pseudomonas aeruginosa PA01
gaacgcgcccggccaggcc

SEQ ID NO: 3455893 - RNA, 14 nt, Pseudomonas aeruginosa PA01
gaacgcgcgccuga

SEQ ID NO: 3455894 - RNA, 18 nt, Pseudomonas aeruginosa PA01
gaacgcgcggaccuucga

SEQ ID NO: 3455895 - RNA, 18 nt, Pseudomonas aeruginosa PA01
gaacgcgcugacggcaag

SEQ ID NO: 3455896 - RNA, 16 nt, Pseudomonas aeruginosa PA01
gaacgcggcgagaacu

SEQ ID NO: 3455897 - RNA, 19 nt, Pseudomonas aeruginosa PA01
gaacgcggcuucggucagg

SEQ ID NO: 3455898 - RNA, 23 nt, Pseudomonas aeruginosa PA01
gaacgcggcuucggucagguggg

SEQ ID NO: 3455899 - RNA, 23 nt, Pseudomonas aeruginosa PA01
gaacgcguaggggaccaccccgg

SEQ ID NO: 3455900 - RNA, 20 nt, Pseudomonas aeruginosa PA01
gaacgcgugaagcuggagca

SEQ ID NO: 3455901 - RNA, 23 nt, Pseudomonas aeruginosa PA01
gaacgcgugaagcuggagcagca

SEQ ID NO: 3455902 - RNA, 19 nt, Pseudomonas aeruginosa PA01
gaacgcucccagccgacgu

SEQ ID NO: 3455903 - RNA, 21 nt, Pseudomonas aeruginosa PA01
gaacggcagcuggauccgugc

SEQ ID NO: 3455904 - RNA, 22 nt, Pseudomonas aeruginosa PA01
gaacggccaggucuucuggaaa

SEQ ID NO: 3455905 - RNA, 12 nt, Pseudomonas aeruginosa PA01
gaacggcgcggu

SEQ ID NO: 3455906 - RNA, 14 nt, Pseudomonas aeruginosa PA01
gaacggcgcuucaa

SEQ ID NO: 3455907 - RNA, 18 nt, Pseudomonas aeruginosa PA01
gaacggcucgcgaccgag

SEQ ID NO: 3455908 - RNA, 19 nt, Pseudomonas aeruginosa PA01
gaacggcucgcgaccgaga

SEQ ID NO: 3455909 - RNA, 21 nt, Pseudomonas aeruginosa PA01
gaacggcuuguucagcucggc

SEQ ID NO: 3455910 - RNA, 21 nt, Pseudomonas aeruginosa PA01
gaacgggaaguaggccuggcc

SEQ ID NO: 3455911 - RNA, 23 nt, Pseudomonas aeruginosa PA01
gaacgggaaguaggccuggccgc

SEQ ID NO: 3455912 - RNA, 18 nt, Pseudomonas aeruginosa PA01
gaacgggacgccuggcgu

SEQ ID NO: 3455913 - RNA, 21 nt, Pseudomonas aeruginosa PA01
gaacgggcguugccggcauug

SEQ ID NO: 3455914 - RNA, 22 nt, Pseudomonas aeruginosa PA01
gaacgguggccccucagaagua

SEQ ID NO: 3455915 - RNA, 13 nt, Pseudomonas aeruginosa PA01
gaacgguugucga

SEQ ID NO: 3455916 - RNA, 18 nt, Pseudomonas aeruginosa PA01
gaacgguugucgaugcgc

SEQ ID NO: 3455917 - RNA, 14 nt, Pseudomonas aeruginosa PA01
gaacgucggccugg

SEQ ID NO: 3455918 - RNA, 14 nt, Pseudomonas aeruginosa PA01
gaacgucggcgggg

SEQ ID NO: 3455919 - RNA, 23 nt, Pseudomonas aeruginosa PA01
gaacgucuggccagaaggucggg

SEQ ID NO: 3455920 - RNA, 18 nt, Pseudomonas aeruginosa PA01
gaacgugcgcgcaacugg

SEQ ID NO: 3455921 - RNA, 14 nt, Pseudomonas aeruginosa PA01
gaacgugcggccug

SEQ ID NO: 3455922 - RNA, 17 nt, Pseudomonas aeruginosa PA01
gaacgugcggccugcaa

SEQ ID NO: 3455923 - RNA, 20 nt, Pseudomonas aeruginosa PA01
gaacucacggaugccgggcg

SEQ ID NO: 3455924 - RNA, 19 nt, Pseudomonas aeruginosa PA01
gaacuccaucucgcggcgg

SEQ ID NO: 3455925 - RNA, 16 nt, Pseudomonas aeruginosa PA01
gaacuccgagcaggac

SEQ ID NO: 3455926 - RNA, 14 nt, Pseudomonas aeruginosa PA01
gaacuccgccagca

SEQ ID NO: 3455927 - RNA, 21 nt, Pseudomonas aeruginosa PA01
gaacuccgccagcaccacccg

SEQ ID NO: 3455928 - RNA, 23 nt, Pseudomonas aeruginosa PA01
gaacuccgccagcaccacccggc

SEQ ID NO: 3455929 - RNA, 23 nt, Pseudomonas aeruginosa PA01
gaacuccgccagcuuguccgccg

SEQ ID NO: 3455930 - RNA, 18 nt, Pseudomonas aeruginosa PA01
gaacuccggggugaagcu

SEQ ID NO: 3455931 - RNA, 19 nt, Pseudomonas aeruginosa PA01
gaacuccggggugaagcuc

SEQ ID NO: 3455932 - RNA, 22 nt, Pseudomonas aeruginosa PA01
gaacuccugauagggggcugcg

SEQ ID NO: 3455933 - RNA, 14 nt, Pseudomonas aeruginosa PA01
gaacuccuugccgu

SEQ ID NO: 3455934 - RNA, 19 nt, Pseudomonas aeruginosa PA01
gaacucgaaggccagcucg

SEQ ID NO: 3455935 - RNA, 24 nt, Pseudomonas aeruginosa PA01
gaacucgaaggccagcucgucgcc

SEQ ID NO: 3455936 - RNA, 17 nt, Pseudomonas aeruginosa PA01
gaacucgacgcgccagg

SEQ ID NO: 3455937 - RNA, 20 nt, Pseudomonas aeruginosa PA01
gaacucgacgcgccaggugc

SEQ ID NO: 3455938 - RNA, 20 nt, Pseudomonas aeruginosa PA01
gaacucgacuucuucgcugg

SEQ ID NO: 3455939 - RNA, 14 nt, Pseudomonas aeruginosa PA01
gaacucgcccggcu

SEQ ID NO: 3455940 - RNA, 11 nt, Pseudomonas aeruginosa PA01
gaacucgccgu

SEQ ID NO: 3455941 - RNA, 17 nt, Pseudomonas aeruginosa PA01
gaacucgcuguagcaca

SEQ ID NO: 3455942 - RNA, 20 nt, Pseudomonas aeruginosa PA01
gaacucggcgcccagggcuu

SEQ ID NO: 3455943 - RNA, 19 nt, Pseudomonas aeruginosa PA01
gaacucggcgccgaucucc

SEQ ID NO: 3455944 - RNA, 19 nt, Pseudomonas aeruginosa PA01
gaacucgguguagcugagg

SEQ ID NO: 3455945 - RNA, 16 nt, Pseudomonas aeruginosa PA01
gaacucguagacgaau

SEQ ID NO: 3455946 - RNA, 20 nt, Pseudomonas aeruginosa PA01
gaacucguccggucgcaccg

SEQ ID NO: 3455947 - RNA, 15 nt, Pseudomonas aeruginosa PA01
gaacucgugcugcuu

SEQ ID NO: 3455948 - RNA, 15 nt, Pseudomonas aeruginosa PA01
gaacugcacccgccg

SEQ ID NO: 3455949 - RNA, 22 nt, Pseudomonas aeruginosa PA01
gaacugcacgcccaucgccacc

SEQ ID NO: 3455950 - RNA, 21 nt, Pseudomonas aeruginosa PA01
gaacugcagggcaucgaccag

SEQ ID NO: 3455951 - RNA, 18 nt, Pseudomonas aeruginosa PA01
gaacugcagggcgucgcc

SEQ ID NO: 3455952 - RNA, 23 nt, Pseudomonas aeruginosa PA01
gaacugcaugucgcugagcggcu

SEQ ID NO: 3455953 - RNA, 22 nt, Pseudomonas aeruginosa PA01
gaacugcccgcaggggcugccg

SEQ ID NO: 3455954 - RNA, 15 nt, Pseudomonas aeruginosa PA01
gaacugccgacggcg

SEQ ID NO: 3455955 - RNA, 17 nt, Pseudomonas aeruginosa PA01
gaacugccgacggcggc

SEQ ID NO: 3455956 - RNA, 23 nt, Pseudomonas aeruginosa PA01
gaacugccgacggcggcggcgga

SEQ ID NO: 3455957 - RNA, 16 nt, Pseudomonas aeruginosa PA01
gaacugccgggccagc

SEQ ID NO: 3455958 - RNA, 17 nt, Pseudomonas aeruginosa PA01
gaacugcgguccggcga

SEQ ID NO: 3455959 - RNA, 18 nt, Pseudomonas aeruginosa PA01
gaacugcucggcguccag

SEQ ID NO: 3455960 - RNA, 23 nt, Pseudomonas aeruginosa PA01
gaacugcucggcguccagcaggu

SEQ ID NO: 3455961 - RNA, 18 nt, Pseudomonas aeruginosa PA01
gaacuggaagccugccag

SEQ ID NO: 3455962 - RNA, 22 nt, Pseudomonas aeruginosa PA01
gaagcccgugucgccuuccggc

SEQ ID NO: 3455963 - RNA, 14 nt, Pseudomonas aeruginosa PA01
gaagcccucgcgac

SEQ ID NO: 3455964 - RNA, 17 nt, Pseudomonas aeruginosa PA01
gaagcccugcuggcgca

SEQ ID NO: 3455965 - RNA, 16 nt, Pseudomonas aeruginosa PA01
gaagccgaccggcgcc

SEQ ID NO: 3455966 - RNA, 21 nt, Pseudomonas aeruginosa PA01
gaagccgaccuugcgucuucg

SEQ ID NO: 3455967 - RNA, 16 nt, Pseudomonas aeruginosa PA01
gaagccgacgccgagc

SEQ ID NO: 3455968 - RNA, 22 nt, Pseudomonas aeruginosa PA01
gaagccgacgccgagcagcacc

SEQ ID NO: 3455969 - RNA, 22 nt, Pseudomonas aeruginosa PA01
gaagccgagcugccgggcgagc

SEQ ID NO: 3455970 - RNA, 16 nt, Pseudomonas aeruginosa PA01
gaagccgaucaggucg

SEQ ID NO: 3455971 - RNA, 17 nt, Pseudomonas aeruginosa PA01
gaagccgaucaggucgc

SEQ ID NO: 3455972 - RNA, 22 nt, Pseudomonas aeruginosa PA01
gaagccgaucaggucgcgcgcc

SEQ ID NO: 3455973 - RNA, 14 nt, Pseudomonas aeruginosa PA01
gaagccgcacuucc

SEQ ID NO: 3455974 - RNA, 15 nt, Pseudomonas aeruginosa PA01
gaagccgcacuucca

SEQ ID NO: 3455975 - RNA, 16 nt, Pseudomonas aeruginosa PA01
gaagccgcacuuccag

SEQ ID NO: 3455976 - RNA, 17 nt, Pseudomonas aeruginosa PA01
gaagccgcacuuccagg

SEQ ID NO: 3455977 - RNA, 20 nt, Pseudomonas aeruginosa PA01
gaagccgcacuuccaggugc

SEQ ID NO: 3455978 - RNA, 21 nt, Pseudomonas aeruginosa PA01
gaagccgcacuuccaggugcc

SEQ ID NO: 3455979 - RNA, 22 nt, Pseudomonas aeruginosa PA01
gaagccgcacuuccaggugcca

SEQ ID NO: 3455980 - RNA, 14 nt, Pseudomonas aeruginosa PA01
gaagccgccgccca

SEQ ID NO: 3455981 - RNA, 23 nt, Pseudomonas aeruginosa PA01
gaagccgccgcccagcagcacca

SEQ ID NO: 3455982 - RNA, 19 nt, Pseudomonas aeruginosa PA01
gaagccgccgccgagaacc

SEQ ID NO: 3455983 - RNA, 15 nt, Pseudomonas aeruginosa PA01
gaagccgcgcaaggc

SEQ ID NO: 3455984 - RNA, 17 nt, Pseudomonas aeruginosa PA01
gaagccgcgcaaggcag

SEQ ID NO: 3455985 - RNA, 11 nt, Pseudomonas aeruginosa PA01
gaagccgcgcc

SEQ ID NO: 3455986 - RNA, 22 nt, Pseudomonas aeruginosa PA01
gaagccgcgccccagcggcagg

SEQ ID NO: 3455987 - RNA, 15 nt, Pseudomonas aeruginosa PA01
gaagccgcgcccggc

SEQ ID NO: 3455988 - RNA, 18 nt, Pseudomonas aeruginosa PA01
gaagccgcgcccggccuc

SEQ ID NO: 3455989 - RNA, 19 nt, Pseudomonas aeruginosa PA01
gaagccgcgcccggccucc

SEQ ID NO: 3455990 - RNA, 13 nt, Pseudomonas aeruginosa PA01
gaagccgcgcucg

SEQ ID NO: 3455991 - RNA, 17 nt, Pseudomonas aeruginosa PA01
gaagccgcgcucgcgga

SEQ ID NO: 3455992 - RNA, 12 nt, Pseudomonas aeruginosa PA01
gaagccgcucgg

SEQ ID NO: 3455993 - RNA, 18 nt, Pseudomonas aeruginosa PA01
gaagccgcucggcguagc

SEQ ID NO: 3455994 - RNA, 17 nt, Pseudomonas aeruginosa PA01
gaagccgcugaccucgg

SEQ ID NO: 3455995 - RNA, 15 nt, Pseudomonas aeruginosa PA01
gaagccgcuggcauu

SEQ ID NO: 3455996 - RNA, 19 nt, Pseudomonas aeruginosa PA01
gaagccggauucgcgcagc

SEQ ID NO: 3455997 - RNA, 22 nt, Pseudomonas aeruginosa PA01
gaagccggauucgcgcagcagg

SEQ ID NO: 3455998 - RNA, 21 nt, Pseudomonas aeruginosa PA01
gaagccggcacgguagccgcc

SEQ ID NO: 3455999 - RNA, 17 nt, Pseudomonas aeruginosa PA01
gaagccggcagggauca

SEQ ID NO: 3456000 - RNA, 13 nt, Pseudomonas aeruginosa PA01
gaagccggccccu

SEQ ID NO: 3456001 - RNA, 20 nt, Pseudomonas aeruginosa PA01
gaagccggccccugggccgg

SEQ ID NO: 3456002 - RNA, 22 nt, Pseudomonas aeruginosa PA01
gaagccggcgauguucgccccc

SEQ ID NO: 3456003 - RNA, 18 nt, Pseudomonas aeruginosa PA01
gaagccgggaagccgcuc

SEQ ID NO: 3456004 - RNA, 19 nt, Pseudomonas aeruginosa PA01
gaagccgggaagccgcucg

SEQ ID NO: 3456005 - RNA, 16 nt, Pseudomonas aeruginosa PA01
gaagccggggcaggca

SEQ ID NO: 3456006 - RNA, 19 nt, Pseudomonas aeruginosa PA01
gaagccgugcaacuggguu

SEQ ID NO: 3456007 - RNA, 17 nt, Pseudomonas aeruginosa PA01
gaagccguggcgggcca

SEQ ID NO: 3456008 - RNA, 18 nt, Pseudomonas aeruginosa PA01
gaagccguggcgggccau

SEQ ID NO: 3456009 - RNA, 23 nt, Pseudomonas aeruginosa PA01
gaagccguuguagaucggcagca

SEQ ID NO: 3456010 - RNA, 15 nt, Pseudomonas aeruginosa PA01
gaagccugccagacc

SEQ ID NO: 3456011 - RNA, 20 nt, Pseudomonas aeruginosa PA01
gaagccuucgcccagguagg

SEQ ID NO: 3456012 - RNA, 14 nt, Pseudomonas aeruginosa PA01
gaagccuucgcccg

SEQ ID NO: 3456013 - RNA, 17 nt, Pseudomonas aeruginosa PA01
gaagccuucgcccggcu

SEQ ID NO: 3456014 - RNA, 23 nt, Pseudomonas aeruginosa PA01
gaagccuucgcccggcucgaccu

SEQ ID NO: 3456015 - RNA, 13 nt, Pseudomonas aeruginosa PA01
gaagcgaaccagg

SEQ ID NO: 3456016 - RNA, 14 nt, Pseudomonas aeruginosa PA01
gaagcgaaccaggc

SEQ ID NO: 3456017 - RNA, 17 nt, Pseudomonas aeruginosa PA01
gaagcgaaccaggcaau

SEQ ID NO: 3456018 - RNA, 14 nt, Pseudomonas aeruginosa PA01
gaagcgacggcgca

SEQ ID NO: 3456019 - RNA, 14 nt, Pseudomonas aeruginosa PA01
gaagcgauccagcg

SEQ ID NO: 3456020 - RNA, 17 nt, Pseudomonas aeruginosa PA01
gaagcgcaccaccugca

SEQ ID NO: 3456021 - RNA, 22 nt, Pseudomonas aeruginosa PA01
gaagcgcaccaccugcaugcuu

SEQ ID NO: 3456022 - RNA, 18 nt, Pseudomonas aeruginosa PA01
gaagcgcagcacgaugca

SEQ ID NO: 3456023 - RNA, 13 nt, Pseudomonas aeruginosa PA01
gaagcgcagcagg

SEQ ID NO: 3456024 - RNA, 13 nt, Pseudomonas aeruginosa PA01
gaagcgcagccau

SEQ ID NO: 3456025 - RNA, 14 nt, Pseudomonas aeruginosa PA01
gaagcgcaggccgc

SEQ ID NO: 3456026 - RNA, 15 nt, Pseudomonas aeruginosa PA01
gaagcgcaggccgcc

SEQ ID NO: 3456027 - RNA, 16 nt, Pseudomonas aeruginosa PA01
gaagcgcaggccgccg

SEQ ID NO: 3456028 - RNA, 18 nt, Pseudomonas aeruginosa PA01
gaagcgcaggccgccggc

SEQ ID NO: 3456029 - RNA, 16 nt, Pseudomonas aeruginosa PA01
gaagcgcaggcggcug

SEQ ID NO: 3456030 - RNA, 23 nt, Pseudomonas aeruginosa PA01
gaagcgcaggugcaccgcgcugg

SEQ ID NO: 3456031 - RNA, 18 nt, Pseudomonas aeruginosa PA01
gaagcgcaguacccggcc

SEQ ID NO: 3456032 - RNA, 20 nt, Pseudomonas aeruginosa PA01
gaagcgcaguacccggccgc

SEQ ID NO: 3456033 - RNA, 22 nt, Pseudomonas aeruginosa PA01
gaagcgcaguacccggccgccu

SEQ ID NO: 3456034 - RNA, 23 nt, Pseudomonas aeruginosa PA01
gaagcgcaguacccggccgccuu

SEQ ID NO: 3456035 - RNA, 15 nt, Pseudomonas aeruginosa PA01
gaagcgccaggcgug

SEQ ID NO: 3456036 - RNA, 22 nt, Pseudomonas aeruginosa PA01
gaagcgccaggcgugcagaccg

SEQ ID NO: 3456037 - RNA, 13 nt, Pseudomonas aeruginosa PA01
gaagcgccgcggc

SEQ ID NO: 3456038 - RNA, 16 nt, Pseudomonas aeruginosa PA01
gaagcgccgcggcccg

SEQ ID NO: 3456039 - RNA, 12 nt, Pseudomonas aeruginosa PA01
gaagcgccggcg

SEQ ID NO: 3456040 - RNA, 13 nt, Pseudomonas aeruginosa PA01
gaagcgccggcgg

SEQ ID NO: 3456041 - RNA, 14 nt, Pseudomonas aeruginosa PA01
gaagcgccggcggc

SEQ ID NO: 3456042 - RNA, 16 nt, Pseudomonas aeruginosa PA01
gaagcgccgggccgca

SEQ ID NO: 3456043 - RNA, 18 nt, Pseudomonas aeruginosa PA01
gaagcgccgggccgcauc

SEQ ID NO: 3456044 - RNA, 20 nt, Pseudomonas aeruginosa PA01
gaagcgccucgccuucgucc

SEQ ID NO: 3456045 - RNA, 16 nt, Pseudomonas aeruginosa PA01
gaagcgccugcgguga

SEQ ID NO: 3456046 - RNA, 22 nt, Pseudomonas aeruginosa PA01
gaagcgcgaguaguaggucggu

SEQ ID NO: 3456047 - RNA, 14 nt, Pseudomonas aeruginosa PA01
gaagcgcgccugcu

SEQ ID NO: 3456048 - RNA, 15 nt, Pseudomonas aeruginosa PA01
gaagcgcgccugcuc

SEQ ID NO: 3456049 - RNA, 13 nt, Pseudomonas aeruginosa PA01
gaagcgcgcgcca

SEQ ID NO: 3456050 - RNA, 15 nt, Pseudomonas aeruginosa PA01
gaagcgcgcgccagu

SEQ ID NO: 3456051 - RNA, 13 nt, Pseudomonas aeruginosa PA01
gaagcgcggcggc

SEQ ID NO: 3456052 - RNA, 20 nt, Pseudomonas aeruginosa PA01
gaagcgcggcggcgcggaga

SEQ ID NO: 3456053 - RNA, 16 nt, Pseudomonas aeruginosa PA01
gaagcgcucccagacc

SEQ ID NO: 3456054 - RNA, 19 nt, Pseudomonas aeruginosa PA01
gaagcgcucccagaccucg

SEQ ID NO: 3456055 - RNA, 20 nt, Pseudomonas aeruginosa PA01
gaagcgcucccagaccucga

SEQ ID NO: 3456056 - RNA, 22 nt, Pseudomonas aeruginosa PA01
gaagcgcucgacauacuccgcc

SEQ ID NO: 3456057 - RNA, 23 nt, Pseudomonas aeruginosa PA01
gaagcgcucgacauacuccgccg

SEQ ID NO: 3456058 - RNA, 14 nt, Pseudomonas aeruginosa PA01
gaagcgcucgcgcu

SEQ ID NO: 3456059 - RNA, 19 nt, Pseudomonas aeruginosa PA01
gaagcgcucgcgcuuccgg

SEQ ID NO: 3456060 - RNA, 20 nt, Pseudomonas aeruginosa PA01
gaagcgcucgcgcuuccggc

SEQ ID NO: 3456061 - RNA, 16 nt, Pseudomonas aeruginosa PA01
gaagcgcucggucagc

SEQ ID NO: 3456062 - RNA, 20 nt, Pseudomonas aeruginosa PA01
gaagcgcucggucagcuccc

SEQ ID NO: 3456063 - RNA, 18 nt, Pseudomonas aeruginosa PA01
gaagcgcugcucgaccac

SEQ ID NO: 3456064 - RNA, 20 nt, Pseudomonas aeruginosa PA01
gaaggcgaucaucgccaccg

SEQ ID NO: 3456065 - RNA, 16 nt, Pseudomonas aeruginosa PA01
gaaggcgccggcauug

SEQ ID NO: 3456066 - RNA, 16 nt, Pseudomonas aeruginosa PA01
gaaggcgcgcaccagc

SEQ ID NO: 3456067 - RNA, 18 nt, Pseudomonas aeruginosa PA01
gaaggcgcgcaccagcgg

SEQ ID NO: 3456068 - RNA, 14 nt, Pseudomonas aeruginosa PA01
gaaggcgcgcucga

SEQ ID NO: 3456069 - RNA, 14 nt, Pseudomonas aeruginosa PA01
gaaggcgcggcgga

SEQ ID NO: 3456070 - RNA, 15 nt, Pseudomonas aeruginosa PA01
gaaggcgcggggcga

SEQ ID NO: 3456071 - RNA, 17 nt, Pseudomonas aeruginosa PA01
gaaggcgcggggcgagg

SEQ ID NO: 3456072 - RNA, 13 nt, Pseudomonas aeruginosa PA01
gaaggcgcuccgg

SEQ ID NO: 3456073 - RNA, 14 nt, Pseudomonas aeruginosa PA01
gaaggcgcuccgga

SEQ ID NO: 3456074 - RNA, 19 nt, Pseudomonas aeruginosa PA01
gaaggcgcuccggaacgcc

SEQ ID NO: 3456075 - RNA, 15 nt, Pseudomonas aeruginosa PA01
gaaggcgcuggcgcu

SEQ ID NO: 3456076 - RNA, 12 nt, Pseudomonas aeruginosa PA01
gaaggcgcuggg

SEQ ID NO: 3456077 - RNA, 13 nt, Pseudomonas aeruginosa PA01
gaaggcgcugggc

SEQ ID NO: 3456078 - RNA, 17 nt, Pseudomonas aeruginosa PA01
gaaggcgcugggcggcu

SEQ ID NO: 3456079 - RNA, 15 nt, Pseudomonas aeruginosa PA01
gaaggcggcagcggu

SEQ ID NO: 3456080 - RNA, 13 nt, Pseudomonas aeruginosa PA01
gaaggcggcgcgg

SEQ ID NO: 3456081 - RNA, 18 nt, Pseudomonas aeruginosa PA01
gaaggcggcgcggcgggu

SEQ ID NO: 3456082 - RNA, 18 nt, Pseudomonas aeruginosa PA01
gaaggcgggcagccuggc

SEQ ID NO: 3456083 - RNA, 16 nt, Pseudomonas aeruginosa PA01
gaaggcggucagcagu

SEQ ID NO: 3456084 - RNA, 22 nt, Pseudomonas aeruginosa PA01
gaaggcggucagcaguugccgg

SEQ ID NO: 3456085 - RNA, 21 nt, Pseudomonas aeruginosa PA01
gaaggcgguguagaccaccag

SEQ ID NO: 3456086 - RNA, 17 nt, Pseudomonas aeruginosa PA01
gaaggcguagaccucgc

SEQ ID NO: 3456087 - RNA, 16 nt, Pseudomonas aeruginosa PA01
gaaggcgucauccgcc

SEQ ID NO: 3456088 - RNA, 17 nt, Pseudomonas aeruginosa PA01
gaaggcgucauccgcca

SEQ ID NO: 3456089 - RNA, 17 nt, Pseudomonas aeruginosa PA01
gaaggcgucgaaggccu

SEQ ID NO: 3456090 - RNA, 16 nt, Pseudomonas aeruginosa PA01
gaaggcgucggcuucg

SEQ ID NO: 3456091 - RNA, 14 nt, Pseudomonas aeruginosa PA01
gaaggcgugccgcu

SEQ ID NO: 3456092 - RNA, 15 nt, Pseudomonas aeruginosa PA01
gaaggcgugccgcug

SEQ ID NO: 3456093 - RNA, 17 nt, Pseudomonas aeruginosa PA01
gaaggcgugccgcuggc

SEQ ID NO: 3456094 - RNA, 23 nt, Pseudomonas aeruginosa PA01
gaaggcgugccgcuggccgacca

SEQ ID NO: 3456095 - RNA, 16 nt, Pseudomonas aeruginosa PA01
gaaggcgugggcgccg

SEQ ID NO: 3456096 - RNA, 21 nt, Pseudomonas aeruginosa PA01
gaaggcguucucguccucggc

SEQ ID NO: 3456097 - RNA, 15 nt, Pseudomonas aeruginosa PA01
gaaggcuccgcugcu

SEQ ID NO: 3456098 - RNA, 18 nt, Pseudomonas aeruginosa PA01
gaaggcuccgcugcucag

SEQ ID NO: 3456099 - RNA, 15 nt, Pseudomonas aeruginosa PA01
gaaggcuggagcgcu

SEQ ID NO: 3456100 - RNA, 17 nt, Pseudomonas aeruginosa PA01
gaaggcuggagcgcugc

SEQ ID NO: 3456101 - RNA, 18 nt, Pseudomonas aeruginosa PA01
gaaggcuuccggcuccag

SEQ ID NO: 3456102 - RNA, 13 nt, Pseudomonas aeruginosa PA01
gaaggcuuccugg

SEQ ID NO: 3456103 - RNA, 18 nt, Pseudomonas aeruginosa PA01
gaaggcuuccugguggaa

SEQ ID NO: 3456104 - RNA, 23 nt, Pseudomonas aeruginosa PA01
gaaggcuuccugguggaacagcc

SEQ ID NO: 3456105 - RNA, 17 nt, Pseudomonas aeruginosa PA01
gaaggcuucuuccuggc

SEQ ID NO: 3456106 - RNA, 22 nt, Pseudomonas aeruginosa PA01
gaaggcuugccacugcgcgcca

SEQ ID NO: 3456107 - RNA, 23 nt, Pseudomonas aeruginosa PA01
gaaggcuugccacugcgcgccag

SEQ ID NO: 3456108 - RNA, 13 nt, Pseudomonas aeruginosa PA01
gaaggcuuguccu

SEQ ID NO: 3456109 - RNA, 15 nt, Pseudomonas aeruginosa PA01
gaagggaaaaaaggg

SEQ ID NO: 3456110 - RNA, 15 nt, Pseudomonas aeruginosa PA01
gaagggcacgccgcu

SEQ ID NO: 3456111 - RNA, 18 nt, Pseudomonas aeruginosa PA01
gaagggcacgccgcucug

SEQ ID NO: 3456112 - RNA, 15 nt, Pseudomonas aeruginosa PA01
gaagggcaggccgau

SEQ ID NO: 3456113 - RNA, 17 nt, Pseudomonas aeruginosa PA01
gaagggcaggccgauca

SEQ ID NO: 3456114 - RNA, 13 nt, Pseudomonas aeruginosa PA01
gaagggccggacg

SEQ ID NO: 3456115 - RNA, 19 nt, Pseudomonas aeruginosa PA01
gaagggccguuuugccgcu

SEQ ID NO: 3456116 - RNA, 12 nt, Pseudomonas aeruginosa PA01
gaagggcgcgcc

SEQ ID NO: 3456117 - RNA, 12 nt, Pseudomonas aeruginosa PA01
gaagggcucagc

SEQ ID NO: 3456118 - RNA, 18 nt, Pseudomonas aeruginosa PA01
gaagggcucagcccaggc

SEQ ID NO: 3456119 - RNA, 21 nt, Pseudomonas aeruginosa PA01
gaagggcucagcccaggcgcc

SEQ ID NO: 3456120 - RNA, 24 nt, Pseudomonas aeruginosa PA01
gaagggcucagcccaggcgccgcu

SEQ ID NO: 3456121 - RNA, 16 nt, Pseudomonas aeruginosa PA01
gaaggggaaaccgagc

SEQ ID NO: 3456122 - RNA, 16 nt, Pseudomonas aeruginosa PA01
gaaggggagccgaggc

SEQ ID NO: 3456123 - RNA, 22 nt, Pseudomonas aeruginosa PA01
gaaggguuggccgcagcagcgg

SEQ ID NO: 3456124 - RNA, 20 nt, Pseudomonas aeruginosa PA01
gaagguaauguucuccuccc

SEQ ID NO: 3456125 - RNA, 15 nt, Pseudomonas aeruginosa PA01
gaagguaucggccau

SEQ ID NO: 3456126 - RNA, 19 nt, Pseudomonas aeruginosa PA01
gaaggucaaugccacgugc

SEQ ID NO: 3456127 - RNA, 18 nt, Pseudomonas aeruginosa PA01
gaaggucaccgaaaggcu

SEQ ID NO: 3456128 - RNA, 20 nt, Pseudomonas aeruginosa PA01
gaaggucagcacgccuucca

SEQ ID NO: 3456129 - RNA, 23 nt, Pseudomonas aeruginosa PA01
gaaggucagcacgccuuccagau

SEQ ID NO: 3456130 - RNA, 13 nt, Pseudomonas aeruginosa PA01
gaagguccaggcc

SEQ ID NO: 3456131 - RNA, 23 nt, Pseudomonas aeruginosa PA01
gaagguccgcgccaugccggcgc

SEQ ID NO: 3456132 - RNA, 15 nt, Pseudomonas aeruginosa PA01
gaaggucgccguccu

SEQ ID NO: 3456133 - RNA, 16 nt, Pseudomonas aeruginosa PA01
gaaggucgccguccug

SEQ ID NO: 3456134 - RNA, 14 nt, Pseudomonas aeruginosa PA01
gaaggucggcagca

SEQ ID NO: 3456135 - RNA, 14 nt, Pseudomonas aeruginosa PA01
gaaggucggcggca

SEQ ID NO: 3456136 - RNA, 19 nt, Pseudomonas aeruginosa PA01
gaaggucggcggcagcugc

SEQ ID NO: 3456137 - RNA, 16 nt, Pseudomonas aeruginosa PA01
gaaggucucgccgccg

SEQ ID NO: 3456138 - RNA, 19 nt, Pseudomonas aeruginosa PA01
gaaggucuugcccaacucc

SEQ ID NO: 3456139 - RNA, 21 nt, Pseudomonas aeruginosa PA01
gaaggucuugcccaacuccag

SEQ ID NO: 3456140 - RNA, 16 nt, Pseudomonas aeruginosa PA01
gaaggugaagcugccg

SEQ ID NO: 3456141 - RNA, 18 nt, Pseudomonas aeruginosa PA01
gaaggugcccagcggcgc

SEQ ID NO: 3456142 - RNA, 16 nt, Pseudomonas aeruginosa PA01
gaaggugcccagggcg

SEQ ID NO: 3456143 - RNA, 14 nt, Pseudomonas aeruginosa PA01
gaaggugccuucgu

SEQ ID NO: 3456144 - RNA, 17 nt, Pseudomonas aeruginosa PA01
gaagguucaggugaaaa

SEQ ID NO: 3456145 - RNA, 16 nt, Pseudomonas aeruginosa PA01
gaagguucucggccac

SEQ ID NO: 3456146 - RNA, 21 nt, Pseudomonas aeruginosa PA01
gaagguucucggccaccacca

SEQ ID NO: 3456147 - RNA, 22 nt, Pseudomonas aeruginosa PA01
gaagguucucggccaccaccac

SEQ ID NO: 3456148 - RNA, 16 nt, Pseudomonas aeruginosa PA01
gaagguugucgaagcg

SEQ ID NO: 3456149 - RNA, 17 nt, Pseudomonas aeruginosa PA01
gaagguuucguccccuu

SEQ ID NO: 3456150 - RNA, 15 nt, Pseudomonas aeruginosa PA01
gaaguaaucaccuuc

SEQ ID NO: 3456151 - RNA, 13 nt, Pseudomonas aeruginosa PA01
gaaguagaagcgc

SEQ ID NO: 3456152 - RNA, 14 nt, Pseudomonas aeruginosa PA01
gaaguagccggcgu

SEQ ID NO: 3456153 - RNA, 21 nt, Pseudomonas aeruginosa PA01
gaaguaguacugguccggguu

SEQ ID NO: 3456154 - RNA, 16 nt, Pseudomonas aeruginosa PA01
gaaguagugcagcugc

SEQ ID NO: 3456155 - RNA, 23 nt, Pseudomonas aeruginosa PA01
gaaguauucggcgggaacgccgg

SEQ ID NO: 3456156 - RNA, 14 nt, Pseudomonas aeruginosa PA01
gaaguccaccaggc

SEQ ID NO: 3456157 - RNA, 21 nt, Pseudomonas aeruginosa PA01
gaaguccaccaggcgccgggu

SEQ ID NO: 3456158 - RNA, 21 nt, Pseudomonas aeruginosa PA01
gaagucccauugcaucugcgc

SEQ ID NO: 3456159 - RNA, 19 nt, Pseudomonas aeruginosa PA01
gaaguccgggcgcggcugg

SEQ ID NO: 3456160 - RNA, 16 nt, Pseudomonas aeruginosa PA01
gaaguccggguugagc

SEQ ID NO: 3456161 - RNA, 13 nt, Pseudomonas aeruginosa PA01
gaaguccuggccg

SEQ ID NO: 3456162 - RNA, 17 nt, Pseudomonas aeruginosa PA01
gaaguccuggccgagca

SEQ ID NO: 3456163 - RNA, 17 nt, Pseudomonas aeruginosa PA01
gaagucgacgaucuguu

SEQ ID NO: 3456164 - RNA, 19 nt, Pseudomonas aeruginosa PA01
gaagucgcagucguagcgc

SEQ ID NO: 3456165 - RNA, 16 nt, Pseudomonas aeruginosa PA01
gaagucgcccgccggc

SEQ ID NO: 3456166 - RNA, 17 nt, Pseudomonas aeruginosa PA01
gaagucgcccgccggcg

SEQ ID NO: 3456167 - RNA, 13 nt, Pseudomonas aeruginosa PA01
gaauggagaugcc

SEQ ID NO: 3456168 - RNA, 22 nt, Pseudomonas aeruginosa PA01
gaauggaugcgcggcagcaggc

SEQ ID NO: 3456169 - RNA, 13 nt, Pseudomonas aeruginosa PA01
gaauggcagcagg

SEQ ID NO: 3456170 - RNA, 14 nt, Pseudomonas aeruginosa PA01
gaauggcagcaggc

SEQ ID NO: 3456171 - RNA, 20 nt, Pseudomonas aeruginosa PA01
gaauggcauucagcucgauc

SEQ ID NO: 3456172 - RNA, 18 nt, Pseudomonas aeruginosa PA01
gaauggcggauagccgca

SEQ ID NO: 3456173 - RNA, 12 nt, Pseudomonas aeruginosa PA01
gaauguccggcg

SEQ ID NO: 3456174 - RNA, 23 nt, Pseudomonas aeruginosa PA01
gaauguugcggcgguggccgcgu

SEQ ID NO: 3456175 - RNA, 13 nt, Pseudomonas aeruginosa PA01
gaauucaggcuuc

SEQ ID NO: 3456176 - RNA, 14 nt, Pseudomonas aeruginosa PA01
gaauucaggcuucc

SEQ ID NO: 3456177 - RNA, 17 nt, Pseudomonas aeruginosa PA01
gaauuccagcaggucgg

SEQ ID NO: 3456178 - RNA, 19 nt, Pseudomonas aeruginosa PA01
gaauuccagcaggucggca

SEQ ID NO: 3456179 - RNA, 22 nt, Pseudomonas aeruginosa PA01
gaauuccagcaggucggcagcg

SEQ ID NO: 3456180 - RNA, 21 nt, Pseudomonas aeruginosa PA01
gaauuccagcuuguccacgcc

SEQ ID NO: 3456181 - RNA, 14 nt, Pseudomonas aeruginosa PA01
gaauuccggcagcg

SEQ ID NO: 3456182 - RNA, 14 nt, Pseudomonas aeruginosa PA01
gaauugcgcacgca

SEQ ID NO: 3456183 - RNA, 11 nt, Pseudomonas aeruginosa PA01
gaauugcugac

SEQ ID NO: 3456184 - RNA, 22 nt, Pseudomonas aeruginosa PA01
gaauugcugacggcguggcgga

SEQ ID NO: 3456185 - RNA, 14 nt, Pseudomonas aeruginosa PA01
gaauuuccugcugg

SEQ ID NO: 3456186 - RNA, 18 nt, Pseudomonas aeruginosa PA01
gacaacacuuccucgugg

SEQ ID NO: 3456187 - RNA, 23 nt, Pseudomonas aeruginosa PA01
gacaacacuuccucguggggcca

SEQ ID NO: 3456188 - RNA, 17 nt, Pseudomonas aeruginosa PA01
gacaacgaaaagagccg

SEQ ID NO: 3456189 - RNA, 18 nt, Pseudomonas aeruginosa PA01
gacaacgaaaagagccgc

SEQ ID NO: 3456190 - RNA, 16 nt, Pseudomonas aeruginosa PA01
gacaacgacagccccg

SEQ ID NO: 3456191 - RNA, 18 nt, Pseudomonas aeruginosa PA01
gacaagcauucagcgcgc

SEQ ID NO: 3456192 - RNA, 23 nt, Pseudomonas aeruginosa PA01
gacaagcauucagcgcgccccgg

SEQ ID NO: 3456193 - RNA, 15 nt, Pseudomonas aeruginosa PA01
gacaagccuccagcg

SEQ ID NO: 3456194 - RNA, 17 nt, Pseudomonas aeruginosa PA01
gacaagccuccagcgcc

SEQ ID NO: 3456195 - RNA, 18 nt, Pseudomonas aeruginosa PA01
gacaagccuccagcgccg

SEQ ID NO: 3456196 - RNA, 19 nt, Pseudomonas aeruginosa PA01
gacaagccuccagcgccgc

SEQ ID NO: 3456197 - RNA, 14 nt, Pseudomonas aeruginosa PA01
gacaagcgucgccg

SEQ ID NO: 3456198 - RNA, 22 nt, Pseudomonas aeruginosa PA01
gacaagcgucgccggccgcugu

SEQ ID NO: 3456199 - RNA, 16 nt, Pseudomonas aeruginosa PA01
gacaaggagacucagc

SEQ ID NO: 3456200 - RNA, 19 nt, Pseudomonas aeruginosa PA01
gacaaggagacucagcgcg

SEQ ID NO: 3456201 - RNA, 20 nt, Pseudomonas aeruginosa PA01
gacaaggagcgcgagcggca

SEQ ID NO: 3456202 - RNA, 15 nt, Pseudomonas aeruginosa PA01
gacaagggccagagc

SEQ ID NO: 3456203 - RNA, 16 nt, Pseudomonas aeruginosa PA01
gacaagggccagagca

SEQ ID NO: 3456204 - RNA, 17 nt, Pseudomonas aeruginosa PA01
gacaagggccagagcac

SEQ ID NO: 3456205 - RNA, 18 nt, Pseudomonas aeruginosa PA01
gacaauagcgccacacgg

SEQ ID NO: 3456206 - RNA, 14 nt, Pseudomonas aeruginosa PA01
gacaaucagcggcg

SEQ ID NO: 3456207 - RNA, 15 nt, Pseudomonas aeruginosa PA01
gacaaucagcggcgg

SEQ ID NO: 3456208 - RNA, 23 nt, Pseudomonas aeruginosa PA01
gacaaucuugucguucggcccga

SEQ ID NO: 3456209 - RNA, 13 nt, Pseudomonas aeruginosa PA01
gacacauggucgg

SEQ ID NO: 3456210 - RNA, 19 nt, Pseudomonas aeruginosa PA01
gacacauggucggccaggu

SEQ ID NO: 3456211 - RNA, 12 nt, Pseudomonas aeruginosa PA01
gacaccaccagg

SEQ ID NO: 3456212 - RNA, 23 nt, Pseudomonas aeruginosa PA01
gacaccaugcuccgccuggcgga

SEQ ID NO: 3456213 - RNA, 16 nt, Pseudomonas aeruginosa PA01
gacaccccggucaggc

SEQ ID NO: 3456214 - RNA, 19 nt, Pseudomonas aeruginosa PA01
gacaccccggucaggccga

SEQ ID NO: 3456215 - RNA, 12 nt, Pseudomonas aeruginosa PA01
gacacccugccg

SEQ ID NO: 3456216 - RNA, 16 nt, Pseudomonas aeruginosa PA01
gacacccugccgcgcc

SEQ ID NO: 3456217 - RNA, 17 nt, Pseudomonas aeruginosa PA01
gacacccugccgcgccg

SEQ ID NO: 3456218 - RNA, 18 nt, Pseudomonas aeruginosa PA01
gacacccugccgcgccgg

SEQ ID NO: 3456219 - RNA, 17 nt, Pseudomonas aeruginosa PA01
gacacccugcugcugcu

SEQ ID NO: 3456220 - RNA, 19 nt, Pseudomonas aeruginosa PA01
gacacccugcugcugcuca

SEQ ID NO: 3456221 - RNA, 18 nt, Pseudomonas aeruginosa PA01
gacaccgaucaccuggcc

SEQ ID NO: 3456222 - RNA, 19 nt, Pseudomonas aeruginosa PA01
gacaccgaucaccuggccg

SEQ ID NO: 3456223 - RNA, 16 nt, Pseudomonas aeruginosa PA01
gacaccgaugccgaag

SEQ ID NO: 3456224 - RNA, 16 nt, Pseudomonas aeruginosa PA01
gacaccgccagcaccu

SEQ ID NO: 3456225 - RNA, 19 nt, Pseudomonas aeruginosa PA01
gacaccgccagcaccuggc

SEQ ID NO: 3456226 - RNA, 16 nt, Pseudomonas aeruginosa PA01
gacacgaaaaagccgg

SEQ ID NO: 3456227 - RNA, 20 nt, Pseudomonas aeruginosa PA01
gacacgagccgcugcggcuc

SEQ ID NO: 3456228 - RNA, 16 nt, Pseudomonas aeruginosa PA01
gacacgcacucauagc

SEQ ID NO: 3456229 - RNA, 18 nt, Pseudomonas aeruginosa PA01
gacacgcacucauagcuc

SEQ ID NO: 3456230 - RNA, 19 nt, Pseudomonas aeruginosa PA01
gacacgcacucauagcuca

SEQ ID NO: 3456231 - RNA, 23 nt, Pseudomonas aeruginosa PA01
gacacgcacucauagcucagcug

SEQ ID NO: 3456232 - RNA, 14 nt, Pseudomonas aeruginosa PA01
gacacgcaggcgcc

SEQ ID NO: 3456233 - RNA, 18 nt, Pseudomonas aeruginosa PA01
gacacgcaggcgccgaug

SEQ ID NO: 3456234 - RNA, 19 nt, Pseudomonas aeruginosa PA01
gacacgcucagccccgauc

SEQ ID NO: 3456235 - RNA, 18 nt, Pseudomonas aeruginosa PA01
gacacggauauccgggcc

SEQ ID NO: 3456236 - RNA, 20 nt, Pseudomonas aeruginosa PA01
gacacggauauccgggccca

SEQ ID NO: 3456237 - RNA, 23 nt, Pseudomonas aeruginosa PA01
gacacgguccaggaucauccgca

SEQ ID NO: 3456238 - RNA, 16 nt, Pseudomonas aeruginosa PA01
gacacgugccccaggc

SEQ ID NO: 3456239 - RNA, 22 nt, Pseudomonas aeruginosa PA01
gacacgugugucgacaccuggc

SEQ ID NO: 3456240 - RNA, 21 nt, Pseudomonas aeruginosa PA01
gacacucugguagcugcggcc

SEQ ID NO: 3456241 - RNA, 19 nt, Pseudomonas aeruginosa PA01
gacagagcggccggcgcgg

SEQ ID NO: 3456242 - RNA, 18 nt, Pseudomonas aeruginosa PA01
gacagaucgagagcuucu

SEQ ID NO: 3456243 - RNA, 18 nt, Pseudomonas aeruginosa PA01
gacagcaccacgccgcug

SEQ ID NO: 3456244 - RNA, 19 nt, Pseudomonas aeruginosa PA01
gacagcaccacgccgcugg

SEQ ID NO: 3456245 - RNA, 13 nt, Pseudomonas aeruginosa PA01
gacagcaccaugc

SEQ ID NO: 3456246 - RNA, 14 nt, Pseudomonas aeruginosa PA01
gacagcacgauggc

SEQ ID NO: 3456247 - RNA, 16 nt, Pseudomonas aeruginosa PA01
gacagcaggcugccga

SEQ ID NO: 3456248 - RNA, 17 nt, Pseudomonas aeruginosa PA01
gacagcagggucgcgcc

SEQ ID NO: 3456249 - RNA, 19 nt, Pseudomonas aeruginosa PA01
gacagcagggucgcgccgu

SEQ ID NO: 3456250 - RNA, 13 nt, Pseudomonas aeruginosa PA01
gacagcaggucgu

SEQ ID NO: 3456251 - RNA, 14 nt, Pseudomonas aeruginosa PA01
gacagcagguggcu

SEQ ID NO: 3456252 - RNA, 16 nt, Pseudomonas aeruginosa PA01
gacagcagguggcugg

SEQ ID NO: 3456253 - RNA, 17 nt, Pseudomonas aeruginosa PA01
gacagcagguggcuggu

SEQ ID NO: 3456254 - RNA, 23 nt, Pseudomonas aeruginosa PA01
gacagcaucugcugguccuggcg

SEQ ID NO: 3456255 - RNA, 13 nt, Pseudomonas aeruginosa PA01
gacagcauggccu

SEQ ID NO: 3456256 - RNA, 16 nt, Pseudomonas aeruginosa PA01
gacagccccggcccgg

SEQ ID NO: 3456257 - RNA, 17 nt, Pseudomonas aeruginosa PA01
gacagccccggcccggu

SEQ ID NO: 3456258 - RNA, 16 nt, Pseudomonas aeruginosa PA01
gacagcccgcgcucgg

SEQ ID NO: 3456259 - RNA, 14 nt, Pseudomonas aeruginosa PA01
gacagccucaagcc

SEQ ID NO: 3456260 - RNA, 15 nt, Pseudomonas aeruginosa PA01
gacagccuucgagcc

SEQ ID NO: 3456261 - RNA, 17 nt, Pseudomonas aeruginosa PA01
gacagccuucgagccac

SEQ ID NO: 3456262 - RNA, 12 nt, Pseudomonas aeruginosa PA01
gacagcgaaugc

SEQ ID NO: 3456263 - RNA, 23 nt, Pseudomonas aeruginosa PA01
gacagcgaaugcuugccggcgcc

SEQ ID NO: 3456264 - RNA, 13 nt, Pseudomonas aeruginosa PA01
gacagcggcuggc

SEQ ID NO: 3456265 - RNA, 14 nt, Pseudomonas aeruginosa PA01
gacagcggcuggcg

SEQ ID NO: 3456266 - RNA, 15 nt, Pseudomonas aeruginosa PA01
gacagcggcuggcgc

SEQ ID NO: 3456267 - RNA, 23 nt, Pseudomonas aeruginosa PA01
gacagcgucguaguggcgcaaca

SEQ ID NO: 3456268 - RNA, 20 nt, Pseudomonas aeruginosa PA01
gacagcucgcgggacagcuu

SEQ ID NO: 3456269 - RNA, 16 nt, Pseudomonas aeruginosa PA01
gacagcucguggcugg

SEQ ID NO: 3456270 - RNA, 15 nt, Pseudomonas aeruginosa PA01
gaccacacaugcagg

SEQ ID NO: 3456271 - RNA, 16 nt, Pseudomonas aeruginosa PA01
gaccacacaugcaggu

SEQ ID NO: 3456272 - RNA, 18 nt, Pseudomonas aeruginosa PA01
gaccacacaugcaggucg

SEQ ID NO: 3456273 - RNA, 19 nt, Pseudomonas aeruginosa PA01
gaccacacaugcaggucgu

SEQ ID NO: 3456274 - RNA, 12 nt, Pseudomonas aeruginosa PA01
gaccacaggcgg

SEQ ID NO: 3456275 - RNA, 14 nt, Pseudomonas aeruginosa PA01
gaccacaucggcca

SEQ ID NO: 3456276 - RNA, 15 nt, Pseudomonas aeruginosa PA01
gaccacaucggccag

SEQ ID NO: 3456277 - RNA, 16 nt, Pseudomonas aeruginosa PA01
gaccacaugggcgacc

SEQ ID NO: 3456278 - RNA, 20 nt, Pseudomonas aeruginosa PA01
gaccaccaccaggucggcgc

SEQ ID NO: 3456279 - RNA, 18 nt, Pseudomonas aeruginosa PA01
gaccaccacgucgaugcc

SEQ ID NO: 3456280 - RNA, 13 nt, Pseudomonas aeruginosa PA01
gaccaccagcagc

SEQ ID NO: 3456281 - RNA, 14 nt, Pseudomonas aeruginosa PA01
gaccaccagcagga

SEQ ID NO: 3456282 - RNA, 23 nt, Pseudomonas aeruginosa PA01
gaccaccagcgugguaccgcugc

SEQ ID NO: 3456283 - RNA, 22 nt, Pseudomonas aeruginosa PA01
gaccaccagggcgauggucccc

SEQ ID NO: 3456284 - RNA, 14 nt, Pseudomonas aeruginosa PA01
gaccaccaucaccg

SEQ ID NO: 3456285 - RNA, 18 nt, Pseudomonas aeruginosa PA01
gaccaccaucaccgccau

SEQ ID NO: 3456286 - RNA, 20 nt, Pseudomonas aeruginosa PA01
gaccaccauggucuuuccuu

SEQ ID NO: 3456287 - RNA, 19 nt, Pseudomonas aeruginosa PA01
gaccaccaugugcuggcgg

SEQ ID NO: 3456288 - RNA, 17 nt, Pseudomonas aeruginosa PA01
gaccaccccggucaugg

SEQ ID NO: 3456289 - RNA, 23 nt, Pseudomonas aeruginosa PA01
gaccacccggugcaggaacaggu

SEQ ID NO: 3456290 - RNA, 15 nt, Pseudomonas aeruginosa PA01
gaccaccgccaggcu

SEQ ID NO: 3456291 - RNA, 17 nt, Pseudomonas aeruginosa PA01
gaccaccgccaggcugg

SEQ ID NO: 3456292 - RNA, 17 nt, Pseudomonas aeruginosa PA01
gaccaccgugcgcaccu

SEQ ID NO: 3456293 - RNA, 19 nt, Pseudomonas aeruginosa PA01
gaccaccgugcgcaccucg

SEQ ID NO: 3456294 - RNA, 23 nt, Pseudomonas aeruginosa PA01
gaccaccguggcgccggcgcgcu

SEQ ID NO: 3456295 - RNA, 14 nt, Pseudomonas aeruginosa PA01
gaccaccucggcgu

SEQ ID NO: 3456296 - RNA, 22 nt, Pseudomonas aeruginosa PA01
gaccaccucggcgucggcaugg

SEQ ID NO: 3456297 - RNA, 23 nt, Pseudomonas aeruginosa PA01
gaccaccucggcgucggcauggc

SEQ ID NO: 3456298 - RNA, 14 nt, Pseudomonas aeruginosa PA01
gaccaccuucaggc

SEQ ID NO: 3456299 - RNA, 21 nt, Pseudomonas aeruginosa PA01
gaccaccuucaggcugcucau

SEQ ID NO: 3456300 - RNA, 21 nt, Pseudomonas aeruginosa PA01
gaccacgaagcgaccgaucau

SEQ ID NO: 3456301 - RNA, 17 nt, Pseudomonas aeruginosa PA01
gaccacgcagagcggca

SEQ ID NO: 3456302 - RNA, 13 nt, Pseudomonas aeruginosa PA01
gaccacgcaggcc

SEQ ID NO: 3456303 - RNA, 15 nt, Pseudomonas aeruginosa PA01
gaccacgcaggccag

SEQ ID NO: 3456304 - RNA, 13 nt, Pseudomonas aeruginosa PA01
gaccacgcccugc

SEQ ID NO: 3456305 - RNA, 14 nt, Pseudomonas aeruginosa PA01
gaccacgcccugcg

SEQ ID NO: 3456306 - RNA, 17 nt, Pseudomonas aeruginosa PA01
gaccacgcccugcgcca

SEQ ID NO: 3456307 - RNA, 20 nt, Pseudomonas aeruginosa PA01
gaccacgcccugcgccagca

SEQ ID NO: 3456308 - RNA, 21 nt, Pseudomonas aeruginosa PA01
gaccacgcccugcgccagcau

SEQ ID NO: 3456309 - RNA, 17 nt, Pseudomonas aeruginosa PA01
gaccacgcucaggucgg

SEQ ID NO: 3456310 - RNA, 23 nt, Pseudomonas aeruginosa PA01
gaccacgcucaggucggucgaac

SEQ ID NO: 3456311 - RNA, 15 nt, Pseudomonas aeruginosa PA01
gaccacgcuggucac

SEQ ID NO: 3456312 - RNA, 19 nt, Pseudomonas aeruginosa PA01
gaccacggccuucggcagg

SEQ ID NO: 3456313 - RNA, 13 nt, Pseudomonas aeruginosa PA01
gaccacggcgagg

SEQ ID NO: 3456314 - RNA, 21 nt, Pseudomonas aeruginosa PA01
gaccacggugaucaggcgcuu

SEQ ID NO: 3456315 - RNA, 13 nt, Pseudomonas aeruginosa PA01
gaccacuuccagg

SEQ ID NO: 3456316 - RNA, 22 nt, Pseudomonas aeruginosa PA01
gaccacuuccagguagcccacc

SEQ ID NO: 3456317 - RNA, 22 nt, Pseudomonas aeruginosa PA01
gaccagaacgaaaaaggcgcgc

SEQ ID NO: 3456318 - RNA, 15 nt, Pseudomonas aeruginosa PA01
gaccagagccgccga

SEQ ID NO: 3456319 - RNA, 16 nt, Pseudomonas aeruginosa PA01
gaccagagccgccgaa

SEQ ID NO: 3456320 - RNA, 16 nt, Pseudomonas aeruginosa PA01
gaccagaggcugaccc

SEQ ID NO: 3456321 - RNA, 19 nt, Pseudomonas aeruginosa PA01
gaccagaucggcauggccg

SEQ ID NO: 3456322 - RNA, 23 nt, Pseudomonas aeruginosa PA01
gaccagaucggcgcgcagggcca

SEQ ID NO: 3456323 - RNA, 17 nt, Pseudomonas aeruginosa PA01
gaccagcaccgccugca

SEQ ID NO: 3456324 - RNA, 22 nt, Pseudomonas aeruginosa PA01
gaccagcacggcgaauucgucg

SEQ ID NO: 3456325 - RNA, 19 nt, Pseudomonas aeruginosa PA01
gaccagcagcgagcaggcg

SEQ ID NO: 3456326 - RNA, 20 nt, Pseudomonas aeruginosa PA01
gaccagcagcgagcaggcga

SEQ ID NO: 3456327 - RNA, 13 nt, Pseudomonas aeruginosa PA01
gaccagcagcggc

SEQ ID NO: 3456328 - RNA, 15 nt, Pseudomonas aeruginosa PA01
gaccagcagcggcag

SEQ ID NO: 3456329 - RNA, 16 nt, Pseudomonas aeruginosa PA01
gaccagcagcggcagc

SEQ ID NO: 3456330 - RNA, 15 nt, Pseudomonas aeruginosa PA01
gaccagcagcggcuc

SEQ ID NO: 3456331 - RNA, 14 nt, Pseudomonas aeruginosa PA01
gaccagcaggaaaa

SEQ ID NO: 3456332 - RNA, 14 nt, Pseudomonas aeruginosa PA01
gaccagcagggcca

SEQ ID NO: 3456333 - RNA, 16 nt, Pseudomonas aeruginosa PA01
gaccagcagggccagc

SEQ ID NO: 3456334 - RNA, 20 nt, Pseudomonas aeruginosa PA01
gaccagcagggccagcagcg

SEQ ID NO: 3456335 - RNA, 21 nt, Pseudomonas aeruginosa PA01
gaccagcagggccagcagcgc

SEQ ID NO: 3456336 - RNA, 22 nt, Pseudomonas aeruginosa PA01
gaccagcagggccagcagcgcu

SEQ ID NO: 3456337 - RNA, 19 nt, Pseudomonas aeruginosa PA01
gaccagcagggugcggaug

SEQ ID NO: 3456338 - RNA, 14 nt, Pseudomonas aeruginosa PA01
gaccagcauggcgg

SEQ ID NO: 3456339 - RNA, 19 nt, Pseudomonas aeruginosa PA01
gaccagcauggcgggccau

SEQ ID NO: 3456340 - RNA, 21 nt, Pseudomonas aeruginosa PA01
gaccagcauggcgggccauug

SEQ ID NO: 3456341 - RNA, 19 nt, Pseudomonas aeruginosa PA01
gaccagccagucggcgguc

SEQ ID NO: 3456342 - RNA, 16 nt, Pseudomonas aeruginosa PA01
gaccagcccggcggcg

SEQ ID NO: 3456343 - RNA, 17 nt, Pseudomonas aeruginosa PA01
gaccagcccggcggcgg

SEQ ID NO: 3456344 - RNA, 13 nt, Pseudomonas aeruginosa PA01
gaccagcccguug

SEQ ID NO: 3456345 - RNA, 14 nt, Pseudomonas aeruginosa PA01
gaccagcccuggcg

SEQ ID NO: 3456346 - RNA, 16 nt, Pseudomonas aeruginosa PA01
gaccagcccuggcgcg

SEQ ID NO: 3456347 - RNA, 18 nt, Pseudomonas aeruginosa PA01
gaccagcccuggcgcggc

SEQ ID NO: 3456348 - RNA, 17 nt, Pseudomonas aeruginosa PA01
gaccagccgcaggcugc

SEQ ID NO: 3456349 - RNA, 19 nt, Pseudomonas aeruginosa PA01
gaccagccguccgcgggcg

SEQ ID NO: 3456350 - RNA, 21 nt, Pseudomonas aeruginosa PA01
gaccagccguccgcgggcgau

SEQ ID NO: 3456351 - RNA, 14 nt, Pseudomonas aeruginosa PA01
gaccagcgaaccgc

SEQ ID NO: 3456352 - RNA, 15 nt, Pseudomonas aeruginosa PA01
gaccagcgaaccgcc

SEQ ID NO: 3456353 - RNA, 16 nt, Pseudomonas aeruginosa PA01
gaccagcgaaccgccg

SEQ ID NO: 3456354 - RNA, 17 nt, Pseudomonas aeruginosa PA01
gaccagcgaaccgccgg

SEQ ID NO: 3456355 - RNA, 19 nt, Pseudomonas aeruginosa PA01
gaccagcgaaccgccggcc

SEQ ID NO: 3456356 - RNA, 18 nt, Pseudomonas aeruginosa PA01
gaccagcgcaagcggcgg

SEQ ID NO: 3456357 - RNA, 19 nt, Pseudomonas aeruginosa PA01
gaccagcgcaagcggcggc

SEQ ID NO: 3456358 - RNA, 18 nt, Pseudomonas aeruginosa PA01
gaccagcgcaucggcgcc

SEQ ID NO: 3456359 - RNA, 19 nt, Pseudomonas aeruginosa PA01
gaccagcgcaucggcgccu

SEQ ID NO: 3456360 - RNA, 14 nt, Pseudomonas aeruginosa PA01
gaccagcgccaggc

SEQ ID NO: 3456361 - RNA, 17 nt, Pseudomonas aeruginosa PA01
gaccagcgccaggcgcg

SEQ ID NO: 3456362 - RNA, 22 nt, Pseudomonas aeruginosa PA01
gaccagcgccaggcgcgguugc

SEQ ID NO: 3456363 - RNA, 11 nt, Pseudomonas aeruginosa PA01
gaccagcgccg

SEQ ID NO: 3456364 - RNA, 14 nt, Pseudomonas aeruginosa PA01
gaccagcgccgcca

SEQ ID NO: 3456365 - RNA, 13 nt, Pseudomonas aeruginosa PA01
gaccagcgccgcg

SEQ ID NO: 3456366 - RNA, 13 nt, Pseudomonas aeruginosa PA01
gaccagcgccugc

SEQ ID NO: 3456367 - RNA, 14 nt, Pseudomonas aeruginosa PA01
gaccagcgccugcu

SEQ ID NO: 3456368 - RNA, 18 nt, Pseudomonas aeruginosa PA01
gaccagcgcgcucuucgc

SEQ ID NO: 3456369 - RNA, 22 nt, Pseudomonas aeruginosa PA01
gaccagcgcgcucuucgccgcg

SEQ ID NO: 3456370 - RNA, 23 nt, Pseudomonas aeruginosa PA01
gaccagcgcggucucuucgucgg

SEQ ID NO: 3456371 - RNA, 23 nt, Pseudomonas aeruginosa PA01
gaccagcggcaccgagagcugca

SEQ ID NO: 3456372 - RNA, 13 nt, Pseudomonas aeruginosa PA01
gaccccggccugg

SEQ ID NO: 3456373 - RNA, 14 nt, Pseudomonas aeruginosa PA01
gaccccggccuggc

SEQ ID NO: 3456374 - RNA, 21 nt, Pseudomonas aeruginosa PA01
gaccccggcgaugcugcugau

SEQ ID NO: 3456375 - RNA, 15 nt, Pseudomonas aeruginosa PA01
gaccccggcggcgcg

SEQ ID NO: 3456376 - RNA, 16 nt, Pseudomonas aeruginosa PA01
gaccccggcggcgcgu

SEQ ID NO: 3456377 - RNA, 16 nt, Pseudomonas aeruginosa PA01
gacccgaaggucgccg

SEQ ID NO: 3456378 - RNA, 19 nt, Pseudomonas aeruginosa PA01
gacccgaaggucgccgucc

SEQ ID NO: 3456379 - RNA, 15 nt, Pseudomonas aeruginosa PA01
gacccgacugcagcg

SEQ ID NO: 3456380 - RNA, 14 nt, Pseudomonas aeruginosa PA01
gacccgcaccggca

SEQ ID NO: 3456381 - RNA, 15 nt, Pseudomonas aeruginosa PA01
gacccgcaccggcau

SEQ ID NO: 3456382 - RNA, 14 nt, Pseudomonas aeruginosa PA01
gacccgcacggcga

SEQ ID NO: 3456383 - RNA, 16 nt, Pseudomonas aeruginosa PA01
gacccgcagcggcgcu

SEQ ID NO: 3456384 - RNA, 14 nt, Pseudomonas aeruginosa PA01
gacccgcaggccgg

SEQ ID NO: 3456385 - RNA, 21 nt, Pseudomonas aeruginosa PA01
gacccgcaggccggccaggga

SEQ ID NO: 3456386 - RNA, 15 nt, Pseudomonas aeruginosa PA01
gacccgcaguuccuu

SEQ ID NO: 3456387 - RNA, 18 nt, Pseudomonas aeruginosa PA01
gacccgcaguuccuuggg

SEQ ID NO: 3456388 - RNA, 23 nt, Pseudomonas aeruginosa PA01
gacccgcaguuccuugggcaucg

SEQ ID NO: 3456389 - RNA, 16 nt, Pseudomonas aeruginosa PA01
gacccgccccugcucc

SEQ ID NO: 3456390 - RNA, 16 nt, Pseudomonas aeruginosa PA01
gacccgcccgccgucc

SEQ ID NO: 3456391 - RNA, 16 nt, Pseudomonas aeruginosa PA01
gacccgccgaccagca

SEQ ID NO: 3456392 - RNA, 22 nt, Pseudomonas aeruginosa PA01
gacccgccgaccagcacggcga

SEQ ID NO: 3456393 - RNA, 13 nt, Pseudomonas aeruginosa PA01
gacccgcgccggc

SEQ ID NO: 3456394 - RNA, 14 nt, Pseudomonas aeruginosa PA01
gacccgcgccggca

SEQ ID NO: 3456395 - RNA, 16 nt, Pseudomonas aeruginosa PA01
gacccgcgccggcagc

SEQ ID NO: 3456396 - RNA, 22 nt, Pseudomonas aeruginosa PA01
gacccgcgccggcagcucggcc

SEQ ID NO: 3456397 - RNA, 12 nt, Pseudomonas aeruginosa PA01
gacccgcggcag

SEQ ID NO: 3456398 - RNA, 14 nt, Pseudomonas aeruginosa PA01
gacccgcggcaggu

SEQ ID NO: 3456399 - RNA, 16 nt, Pseudomonas aeruginosa PA01
gacccgcuccucgucg

SEQ ID NO: 3456400 - RNA, 16 nt, Pseudomonas aeruginosa PA01
gacccgcucgccggga

SEQ ID NO: 3456401 - RNA, 15 nt, Pseudomonas aeruginosa PA01
gacccgcucggccuu

SEQ ID NO: 3456402 - RNA, 19 nt, Pseudomonas aeruginosa PA01
gacccgcucggccuuagcg

SEQ ID NO: 3456403 - RNA, 14 nt, Pseudomonas aeruginosa PA01
gacccgcugcacca

SEQ ID NO: 3456404 - RNA, 19 nt, Pseudomonas aeruginosa PA01
gacccgcuguccgccggcc

SEQ ID NO: 3456405 - RNA, 19 nt, Pseudomonas aeruginosa PA01
gacccgcuugagccauucg

SEQ ID NO: 3456406 - RNA, 17 nt, Pseudomonas aeruginosa PA01
gacccggccgaccaggu

SEQ ID NO: 3456407 - RNA, 17 nt, Pseudomonas aeruginosa PA01
gacccggcggaacaugg

SEQ ID NO: 3456408 - RNA, 17 nt, Pseudomonas aeruginosa PA01
gacccgggccuccuggc

SEQ ID NO: 3456409 - RNA, 18 nt, Pseudomonas aeruginosa PA01
gacccgggccuccuggcg

SEQ ID NO: 3456410 - RNA, 19 nt, Pseudomonas aeruginosa PA01
gacccgggccuccuggcgg

SEQ ID NO: 3456411 - RNA, 19 nt, Pseudomonas aeruginosa PA01
gacccgggucaggccgaga

SEQ ID NO: 3456412 - RNA, 14 nt, Pseudomonas aeruginosa PA01
gacccgggugccuu

SEQ ID NO: 3456413 - RNA, 15 nt, Pseudomonas aeruginosa PA01
gacccgguacagcgc

SEQ ID NO: 3456414 - RNA, 19 nt, Pseudomonas aeruginosa PA01
gacccgguacagcgccugg

SEQ ID NO: 3456415 - RNA, 23 nt, Pseudomonas aeruginosa PA01
gacccgguacagcgccuggucgg

SEQ ID NO: 3456416 - RNA, 23 nt, Pseudomonas aeruginosa PA01
gacccgguacuccuccagcaucc

SEQ ID NO: 3456417 - RNA, 13 nt, Pseudomonas aeruginosa PA01
gacccggucgcug

SEQ ID NO: 3456418 - RNA, 17 nt, Pseudomonas aeruginosa PA01
gacccggucgcugacca

SEQ ID NO: 3456419 - RNA, 18 nt, Pseudomonas aeruginosa PA01
gacccggucgcugaccag

SEQ ID NO: 3456420 - RNA, 19 nt, Pseudomonas aeruginosa PA01
gacccggucgcugaccagc

SEQ ID NO: 3456421 - RNA, 20 nt, Pseudomonas aeruginosa PA01
gacccggucgcugaccagcc

SEQ ID NO: 3456422 - RNA, 16 nt, Pseudomonas aeruginosa PA01
gacccgguuaccggcg

SEQ ID NO: 3456423 - RNA, 17 nt, Pseudomonas aeruginosa PA01
gacccgguuaccggcga

SEQ ID NO: 3456424 - RNA, 18 nt, Pseudomonas aeruginosa PA01
gacccgguuaccggcgac

SEQ ID NO: 3456425 - RNA, 17 nt, Pseudomonas aeruginosa PA01
gacccgugcgccgcggg

SEQ ID NO: 3456426 - RNA, 13 nt, Pseudomonas aeruginosa PA01
gacccguugccga

SEQ ID NO: 3456427 - RNA, 16 nt, Pseudomonas aeruginosa PA01
gacccguugccgaccg

SEQ ID NO: 3456428 - RNA, 18 nt, Pseudomonas aeruginosa PA01
gacccguugccgaccgag

SEQ ID NO: 3456429 - RNA, 20 nt, Pseudomonas aeruginosa PA01
gacccguugcgccucgccgc

SEQ ID NO: 3456430 - RNA, 22 nt, Pseudomonas aeruginosa PA01
gacccguugcgccucgccgccc

SEQ ID NO: 3456431 - RNA, 17 nt, Pseudomonas aeruginosa PA01
gacccuagggucggcgu

SEQ ID NO: 3456432 - RNA, 16 nt, Pseudomonas aeruginosa PA01
gacccucugguuggcc

SEQ ID NO: 3456433 - RNA, 22 nt, Pseudomonas aeruginosa PA01
gacccugcacccuuggcgcagg

SEQ ID NO: 3456434 - RNA, 13 nt, Pseudomonas aeruginosa PA01
gacccugcuggcc

SEQ ID NO: 3456435 - RNA, 14 nt, Pseudomonas aeruginosa PA01
gacccugcuggccg

SEQ ID NO: 3456436 - RNA, 20 nt, Pseudomonas aeruginosa PA01
gacccugcuggccggugccg

SEQ ID NO: 3456437 - RNA, 12 nt, Pseudomonas aeruginosa PA01
gacccuggccgc

SEQ ID NO: 3456438 - RNA, 13 nt, Pseudomonas aeruginosa PA01
gacccuggccgcg

SEQ ID NO: 3456439 - RNA, 18 nt, Pseudomonas aeruginosa PA01
gacccuggccgcgcggcu

SEQ ID NO: 3456440 - RNA, 15 nt, Pseudomonas aeruginosa PA01
gacccuggggucgcc

SEQ ID NO: 3456441 - RNA, 17 nt, Pseudomonas aeruginosa PA01
gacccuggggucgccgu

SEQ ID NO: 3456442 - RNA, 20 nt, Pseudomonas aeruginosa PA01
gacccugguaguccagcagg

SEQ ID NO: 3456443 - RNA, 21 nt, Pseudomonas aeruginosa PA01
gacccugguaguccagcaggu

SEQ ID NO: 3456444 - RNA, 16 nt, Pseudomonas aeruginosa PA01
gaccgaacagcgcgcc

SEQ ID NO: 3456445 - RNA, 20 nt, Pseudomonas aeruginosa PA01
gaccgaacaucagcagcagg

SEQ ID NO: 3456446 - RNA, 14 nt, Pseudomonas aeruginosa PA01
gaccgaagccgcgc

SEQ ID NO: 3456447 - RNA, 23 nt, Pseudomonas aeruginosa PA01
gaccgaagccgcgcagcacuucc

SEQ ID NO: 3456448 - RNA, 20 nt, Pseudomonas aeruginosa PA01
gaccgaccaguaccagcaau

SEQ ID NO: 3456449 - RNA, 16 nt, Pseudomonas aeruginosa PA01
gaccgacgcucgcggc

SEQ ID NO: 3456450 - RNA, 24 nt, Pseudomonas aeruginosa PA01
gaccgacgcucgcggcaucccgcc

SEQ ID NO: 3456451 - RNA, 16 nt, Pseudomonas aeruginosa PA01
gaccgacggcaacuga

SEQ ID NO: 3456452 - RNA, 20 nt, Pseudomonas aeruginosa PA01
gaccgacuuggcagucgccg

SEQ ID NO: 3456453 - RNA, 16 nt, Pseudomonas aeruginosa PA01
gaccgagaccgacgcu

SEQ ID NO: 3456454 - RNA, 18 nt, Pseudomonas aeruginosa PA01
gaccgagaccgacgcucg

SEQ ID NO: 3456455 - RNA, 23 nt, Pseudomonas aeruginosa PA01
gaccgagaccgacgcucgcggca

SEQ ID NO: 3456456 - RNA, 21 nt, Pseudomonas aeruginosa PA01
gaccgagauucugcaggcgcu

SEQ ID NO: 3456457 - RNA, 17 nt, Pseudomonas aeruginosa PA01
gaccgagauuggccgcc

SEQ ID NO: 3456458 - RNA, 19 nt, Pseudomonas aeruginosa PA01
gaccgagauuggccgccug

SEQ ID NO: 3456459 - RNA, 21 nt, Pseudomonas aeruginosa PA01
gaccgagauuggccgccugcu

SEQ ID NO: 3456460 - RNA, 23 nt, Pseudomonas aeruginosa PA01
gaccgagauuggccgccugcucg

SEQ ID NO: 3456461 - RNA, 10 nt, Pseudomonas aeruginosa PA01
gaccgagcag

SEQ ID NO: 3456462 - RNA, 16 nt, Pseudomonas aeruginosa PA01
gaccgagcagcggacg

SEQ ID NO: 3456463 - RNA, 17 nt, Pseudomonas aeruginosa PA01
gaccgagcaugcgcggc

SEQ ID NO: 3456464 - RNA, 21 nt, Pseudomonas aeruginosa PA01
gaccgauauaggggaugccuu

SEQ ID NO: 3456465 - RNA, 16 nt, Pseudomonas aeruginosa PA01
gaccgaucaugcccuu

SEQ ID NO: 3456466 - RNA, 21 nt, Pseudomonas aeruginosa PA01
gaccgauccagcagucgcggc

SEQ ID NO: 3456467 - RNA, 23 nt, Pseudomonas aeruginosa PA01
gaccgauccagcagucgcggccc

SEQ ID NO: 3456468 - RNA, 14 nt, Pseudomonas aeruginosa PA01
gaccgauggcgccg

SEQ ID NO: 3456469 - RNA, 16 nt, Pseudomonas aeruginosa PA01
gaccgauggcgccgcg

SEQ ID NO: 3456470 - RNA, 17 nt, Pseudomonas aeruginosa PA01
gaccgauggcgccgcga

SEQ ID NO: 3456471 - RNA, 21 nt, Pseudomonas aeruginosa PA01
gaccgcaccgccagcgucgcc

SEQ ID NO: 3456472 - RNA, 14 nt, Pseudomonas aeruginosa PA01
gaccgcagcccagu

SEQ ID NO: 3456473 - RNA, 17 nt, Pseudomonas aeruginosa PA01
gaccgcagcccaguucg

SEQ ID NO: 3456474 - RNA, 13 nt, Pseudomonas aeruginosa PA01
gaccgcagccggc

SEQ ID NO: 3456475 - RNA, 15 nt, Pseudomonas aeruginosa PA01
gaccguccgccugcg

SEQ ID NO: 3456476 - RNA, 14 nt, Pseudomonas aeruginosa PA01
gaccguccggucgc

SEQ ID NO: 3456477 - RNA, 15 nt, Pseudomonas aeruginosa PA01
gaccguccuggcccu

SEQ ID NO: 3456478 - RNA, 15 nt, Pseudomonas aeruginosa PA01
gaccgucgaaccagg

SEQ ID NO: 3456479 - RNA, 13 nt, Pseudomonas aeruginosa PA01
gaccgucgccacg

SEQ ID NO: 3456480 - RNA, 14 nt, Pseudomonas aeruginosa PA01
gaccgucgccacgc

SEQ ID NO: 3456481 - RNA, 20 nt, Pseudomonas aeruginosa PA01
gaccgucgcgauagacgccg

SEQ ID NO: 3456482 - RNA, 21 nt, Pseudomonas aeruginosa PA01
gaccgucgcgauagacgccgg

SEQ ID NO: 3456483 - RNA, 20 nt, Pseudomonas aeruginosa PA01
gaccgucggcaagcaggccg

SEQ ID NO: 3456484 - RNA, 13 nt, Pseudomonas aeruginosa PA01
gaccgucggccgg

SEQ ID NO: 3456485 - RNA, 23 nt, Pseudomonas aeruginosa PA01
gaccgucggccggggucaggccg

SEQ ID NO: 3456486 - RNA, 23 nt, Pseudomonas aeruginosa PA01
gaccgucgggcaguuccgccaga

SEQ ID NO: 3456487 - RNA, 14 nt, Pseudomonas aeruginosa PA01
gaccgugaggcgca

SEQ ID NO: 3456488 - RNA, 17 nt, Pseudomonas aeruginosa PA01
gaccgugaugcccagcg

SEQ ID NO: 3456489 - RNA, 23 nt, Pseudomonas aeruginosa PA01
gaccgugaugcccagcggcgcca

SEQ ID NO: 3456490 - RNA, 12 nt, Pseudomonas aeruginosa PA01
gaccgugccgcc

SEQ ID NO: 3456491 - RNA, 21 nt, Pseudomonas aeruginosa PA01
gaccgugcgggucgaggccga

SEQ ID NO: 3456492 - RNA, 22 nt, Pseudomonas aeruginosa PA01
gaccgugcgggucgaggccgaa

SEQ ID NO: 3456493 - RNA, 18 nt, Pseudomonas aeruginosa PA01
gaccguggauuucagcag

SEQ ID NO: 3456494 - RNA, 20 nt, Pseudomonas aeruginosa PA01
gaccguggauuucagcaggc

SEQ ID NO: 3456495 - RNA, 23 nt, Pseudomonas aeruginosa PA01
gaccguggauuucagcaggccga

SEQ ID NO: 3456496 - RNA, 19 nt, Pseudomonas aeruginosa PA01
gaccguggcgcuacgcucg

SEQ ID NO: 3456497 - RNA, 23 nt, Pseudomonas aeruginosa PA01
gaccguggcgcuacgcucgccga

SEQ ID NO: 3456498 - RNA, 14 nt, Pseudomonas aeruginosa PA01
gaccguggugacgg

SEQ ID NO: 3456499 - RNA, 23 nt, Pseudomonas aeruginosa PA01
gaccguggugacgguccgcgcca

SEQ ID NO: 3456500 - RNA, 14 nt, Pseudomonas aeruginosa PA01
gaccguuucgccgc

SEQ ID NO: 3456501 - RNA, 16 nt, Pseudomonas aeruginosa PA01
gaccguuucgccgccg

SEQ ID NO: 3456502 - RNA, 17 nt, Pseudomonas aeruginosa PA01
gaccguuucgccgccgg

SEQ ID NO: 3456503 - RNA, 20 nt, Pseudomonas aeruginosa PA01
gaccguuucgccgccggcca

SEQ ID NO: 3456504 - RNA, 22 nt, Pseudomonas aeruginosa PA01
gaccguuucgccgccggccagc

SEQ ID NO: 3456505 - RNA, 20 nt, Pseudomonas aeruginosa PA01
gaccucagaccacgcccugc

SEQ ID NO: 3456506 - RNA, 22 nt, Pseudomonas aeruginosa PA01
gaccuccagccggccauccagc

SEQ ID NO: 3456507 - RNA, 13 nt, Pseudomonas aeruginosa PA01
gaccuccaggccg

SEQ ID NO: 3456508 - RNA, 14 nt, Pseudomonas aeruginosa PA01
gaccuccaggccga

SEQ ID NO: 3456509 - RNA, 20 nt, Pseudomonas aeruginosa PA01
gaccuccaggccgaagccgc

SEQ ID NO: 3456510 - RNA, 14 nt, Pseudomonas aeruginosa PA01
gaccuccagggcca

SEQ ID NO: 3456511 - RNA, 16 nt, Pseudomonas aeruginosa PA01
gaccucccgcgccagc

SEQ ID NO: 3456512 - RNA, 20 nt, Pseudomonas aeruginosa PA01
gaccucccgcgccagcucga

SEQ ID NO: 3456513 - RNA, 11 nt, Pseudomonas aeruginosa PA01
gaccuccgcca

SEQ ID NO: 3456514 - RNA, 14 nt, Pseudomonas aeruginosa PA01
gaccuccgccagga

SEQ ID NO: 3456515 - RNA, 14 nt, Pseudomonas aeruginosa PA01
gaccuccgccaggu

SEQ ID NO: 3456516 - RNA, 21 nt, Pseudomonas aeruginosa PA01
gaccuccgccaggucgauccc

SEQ ID NO: 3456517 - RNA, 14 nt, Pseudomonas aeruginosa PA01
gaccuccggcgcca

SEQ ID NO: 3456518 - RNA, 16 nt, Pseudomonas aeruginosa PA01
gaccuccggcgccagg

SEQ ID NO: 3456519 - RNA, 17 nt, Pseudomonas aeruginosa PA01
gaccuccggcgccaggc

SEQ ID NO: 3456520 - RNA, 18 nt, Pseudomonas aeruginosa PA01
gaccuccggcgccaggcc

SEQ ID NO: 3456521 - RNA, 15 nt, Pseudomonas aeruginosa PA01
gaccuccugcacaua

SEQ ID NO: 3456522 - RNA, 13 nt, Pseudomonas aeruginosa PA01
gaccuccuggcgc

SEQ ID NO: 3456523 - RNA, 15 nt, Pseudomonas aeruginosa PA01
gaccucgacgccgag

SEQ ID NO: 3456524 - RNA, 16 nt, Pseudomonas aeruginosa PA01
gaccucgacgccgagc

SEQ ID NO: 3456525 - RNA, 17 nt, Pseudomonas aeruginosa PA01
gaccucgacgccgagcc

SEQ ID NO: 3456526 - RNA, 18 nt, Pseudomonas aeruginosa PA01
gaccucgacgccgagcca

SEQ ID NO: 3456527 - RNA, 16 nt, Pseudomonas aeruginosa PA01
gaccucgagcaggccg

SEQ ID NO: 3456528 - RNA, 20 nt, Pseudomonas aeruginosa PA01
gaccucgagcuggacgcgcu

SEQ ID NO: 3456529 - RNA, 16 nt, Pseudomonas aeruginosa PA01
gaccucggccagccag

SEQ ID NO: 3456530 - RNA, 21 nt, Pseudomonas aeruginosa PA01
gaccucggccagccagggcag

SEQ ID NO: 3456531 - RNA, 16 nt, Pseudomonas aeruginosa PA01
gaccucggccgcaucg

SEQ ID NO: 3456532 - RNA, 17 nt, Pseudomonas aeruginosa PA01
gaccucggccgcaucga

SEQ ID NO: 3456533 - RNA, 13 nt, Pseudomonas aeruginosa PA01
gaccucgggcagc

SEQ ID NO: 3456534 - RNA, 22 nt, Pseudomonas aeruginosa PA01
gaccucgggcgagaaucgccga

SEQ ID NO: 3456535 - RNA, 17 nt, Pseudomonas aeruginosa PA01
gaccucguugcaggcac

SEQ ID NO: 3456536 - RNA, 18 nt, Pseudomonas aeruginosa PA01
gaccugagaucagcgccc

SEQ ID NO: 3456537 - RNA, 14 nt, Pseudomonas aeruginosa PA01
gaccugcaauucca

SEQ ID NO: 3456538 - RNA, 19 nt, Pseudomonas aeruginosa PA01
gaccugcaauuccaccggc

SEQ ID NO: 3456539 - RNA, 17 nt, Pseudomonas aeruginosa PA01
gaccugcagcaggauca

SEQ ID NO: 3456540 - RNA, 14 nt, Pseudomonas aeruginosa PA01
gaccugcccgcugu

SEQ ID NO: 3456541 - RNA, 14 nt, Pseudomonas aeruginosa PA01
gaccugccgcccgg

SEQ ID NO: 3456542 - RNA, 15 nt, Pseudomonas aeruginosa PA01
gaccugccgcccggc

SEQ ID NO: 3456543 - RNA, 17 nt, Pseudomonas aeruginosa PA01
gaccugccgcccggcca

SEQ ID NO: 3456544 - RNA, 19 nt, Pseudomonas aeruginosa PA01
gaccugccgcccggccagg

SEQ ID NO: 3456545 - RNA, 21 nt, Pseudomonas aeruginosa PA01
gaccugccgcccggccaggcc

SEQ ID NO: 3456546 - RNA, 22 nt, Pseudomonas aeruginosa PA01
gaccugccgcccggccaggcca

SEQ ID NO: 3456547 - RNA, 17 nt, Pseudomonas aeruginosa PA01
gaccugcgaggcgucga

SEQ ID NO: 3456548 - RNA, 18 nt, Pseudomonas aeruginosa PA01
gaccugcggggcggauga

SEQ ID NO: 3456549 - RNA, 14 nt, Pseudomonas aeruginosa PA01
gaccugcucgcgca

SEQ ID NO: 3456550 - RNA, 21 nt, Pseudomonas aeruginosa PA01
gaccugcucgcgcaccgcggc

SEQ ID NO: 3456551 - RNA, 21 nt, Pseudomonas aeruginosa PA01
gaccugcucgucgaugcugcc

SEQ ID NO: 3456552 - RNA, 15 nt, Pseudomonas aeruginosa PA01
gaccugcugcccggc

SEQ ID NO: 3456553 - RNA, 16 nt, Pseudomonas aeruginosa PA01
gaccugcugggccagc

SEQ ID NO: 3456554 - RNA, 15 nt, Pseudomonas aeruginosa PA01
gaccuggaagcgggu

SEQ ID NO: 3456555 - RNA, 12 nt, Pseudomonas aeruginosa PA01
gaccuggccacg

SEQ ID NO: 3456556 - RNA, 14 nt, Pseudomonas aeruginosa PA01
gaccuggccgccgu

SEQ ID NO: 3456557 - RNA, 16 nt, Pseudomonas aeruginosa PA01
gaccuggccgccguug

SEQ ID NO: 3456558 - RNA, 13 nt, Pseudomonas aeruginosa PA01
gaccuggccgcug

SEQ ID NO: 3456559 - RNA, 11 nt, Pseudomonas aeruginosa PA01
gaccuggccgu

SEQ ID NO: 3456560 - RNA, 23 nt, Pseudomonas aeruginosa PA01
gaccuggccgucccugaccagca

SEQ ID NO: 3456561 - RNA, 13 nt, Pseudomonas aeruginosa PA01
gaccuggccguug

SEQ ID NO: 3456562 - RNA, 15 nt, Pseudomonas aeruginosa PA01
gaccuggccguuggc

SEQ ID NO: 3456563 - RNA, 14 nt, Pseudomonas aeruginosa PA01
gaccuggcgccgaa

SEQ ID NO: 3456564 - RNA, 22 nt, Pseudomonas aeruginosa PA01
gaccuggcugaggcguuccagu

SEQ ID NO: 3456565 - RNA, 19 nt, Pseudomonas aeruginosa PA01
gaccugggaacccuugcgc

SEQ ID NO: 3456566 - RNA, 22 nt, Pseudomonas aeruginosa PA01
gaccugggaacccuugcgcagg

SEQ ID NO: 3456567 - RNA, 14 nt, Pseudomonas aeruginosa PA01
gaccuggggcggcc

SEQ ID NO: 3456568 - RNA, 15 nt, Pseudomonas aeruginosa PA01
gaccuggggcggccu

SEQ ID NO: 3456569 - RNA, 22 nt, Pseudomonas aeruginosa PA01
gaccuggggcggccucaggccu

SEQ ID NO: 3456570 - RNA, 17 nt, Pseudomonas aeruginosa PA01
gaccugguagucgcggu

SEQ ID NO: 3456571 - RNA, 18 nt, Pseudomonas aeruginosa PA01
gaccugguagucgcgguu

SEQ ID NO: 3456572 - RNA, 15 nt, Pseudomonas aeruginosa PA01
gaccuggucguugcg

SEQ ID NO: 3456573 - RNA, 17 nt, Pseudomonas aeruginosa PA01
gaccugguggcgccggc

SEQ ID NO: 3456574 - RNA, 20 nt, Pseudomonas aeruginosa PA01
gaccuguccagucaccaggu

SEQ ID NO: 3456575 - RNA, 21 nt, Pseudomonas aeruginosa PA01
gaccugucggcucgcgccggc

SEQ ID NO: 3456576 - RNA, 22 nt, Pseudomonas aeruginosa PA01
gaccugucggcucgcgccggcg

SEQ ID NO: 3456577 - RNA, 23 nt, Pseudomonas aeruginosa PA01
gaccuguucgaaguucuccagca

SEQ ID NO: 3456578 - RNA, 19 nt, Pseudomonas aeruginosa PA01
gacgagacguugacgaucg

SEQ ID NO: 3456579 - RNA, 18 nt, Pseudomonas aeruginosa PA01
gacgagauugaugaagcg

SEQ ID NO: 3456580 - RNA, 18 nt, Pseudomonas aeruginosa PA01
gacgagcagcucgccggc

SEQ ID NO: 3456581 - RNA, 19 nt, Pseudomonas aeruginosa PA01
gacgagcagcucgccggcg

SEQ ID NO: 3456582 - RNA, 20 nt, Pseudomonas aeruginosa PA01
gacgagcagcucgccggcgu

SEQ ID NO: 3456583 - RNA, 17 nt, Pseudomonas aeruginosa PA01
gacgagccgcgacgcga

SEQ ID NO: 3456584 - RNA, 19 nt, Pseudomonas aeruginosa PA01
gacgagccggacggcggcg

SEQ ID NO: 3456585 - RNA, 15 nt, Pseudomonas aeruginosa PA01
gacgagcguccgccg

SEQ ID NO: 3456586 - RNA, 17 nt, Pseudomonas aeruginosa PA01
gacgagcguccgccgcc

SEQ ID NO: 3456587 - RNA, 17 nt, Pseudomonas aeruginosa PA01
gacgaggaacgccucgc

SEQ ID NO: 3456588 - RNA, 20 nt, Pseudomonas aeruginosa PA01
gacgaggaaggcgcgcacca

SEQ ID NO: 3456589 - RNA, 21 nt, Pseudomonas aeruginosa PA01
gacgaggaaggcgcgcaccag

SEQ ID NO: 3456590 - RNA, 12 nt, Pseudomonas aeruginosa PA01
gacgaggacgcc

SEQ ID NO: 3456591 - RNA, 13 nt, Pseudomonas aeruginosa PA01
gacgaggacgccg

SEQ ID NO: 3456592 - RNA, 15 nt, Pseudomonas aeruginosa PA01
gacgaggacgccgcc

SEQ ID NO: 3456593 - RNA, 16 nt, Pseudomonas aeruginosa PA01
gacgaggacgccgccg

SEQ ID NO: 3456594 - RNA, 15 nt, Pseudomonas aeruginosa PA01
gacgaggauggucag

SEQ ID NO: 3456595 - RNA, 18 nt, Pseudomonas aeruginosa PA01
gacgaggauggucaggcc

SEQ ID NO: 3456596 - RNA, 18 nt, Pseudomonas aeruginosa PA01
gacgaggcgcggcggagg

SEQ ID NO: 3456597 - RNA, 16 nt, Pseudomonas aeruginosa PA01
gacgaggggcugcgga

SEQ ID NO: 3456598 - RNA, 17 nt, Pseudomonas aeruginosa PA01
gacgauaucggcgccgg

SEQ ID NO: 3456599 - RNA, 19 nt, Pseudomonas aeruginosa PA01
gacgaucacccccagcgag

SEQ ID NO: 3456600 - RNA, 22 nt, Pseudomonas aeruginosa PA01
gacgaucacccccagcgagccg

SEQ ID NO: 3456601 - RNA, 22 nt, Pseudomonas aeruginosa PA01
gacgaucacucccugcucgcgc

SEQ ID NO: 3456602 - RNA, 13 nt, Pseudomonas aeruginosa PA01
gacgaucagcccg

SEQ ID NO: 3456603 - RNA, 18 nt, Pseudomonas aeruginosa PA01
gacgaucagcccgccggc

SEQ ID NO: 3456604 - RNA, 14 nt, Pseudomonas aeruginosa PA01
gacgaucagcggcc

SEQ ID NO: 3456605 - RNA, 16 nt, Pseudomonas aeruginosa PA01
gacgaucagcggcccg

SEQ ID NO: 3456606 - RNA, 16 nt, Pseudomonas aeruginosa PA01
gacgaucagcucuucc

SEQ ID NO: 3456607 - RNA, 15 nt, Pseudomonas aeruginosa PA01
gacgauccggccgau

SEQ ID NO: 3456608 - RNA, 16 nt, Pseudomonas aeruginosa PA01
gacgaucuccugcugg

SEQ ID NO: 3456609 - RNA, 17 nt, Pseudomonas aeruginosa PA01
gacgaucuggcagucgu

SEQ ID NO: 3456610 - RNA, 16 nt, Pseudomonas aeruginosa PA01
gacgaucuucugcacc

SEQ ID NO: 3456611 - RNA, 15 nt, Pseudomonas aeruginosa PA01
gacgaugaagcccca

SEQ ID NO: 3456612 - RNA, 17 nt, Pseudomonas aeruginosa PA01
gacgaugaucaccagga

SEQ ID NO: 3456613 - RNA, 12 nt, Pseudomonas aeruginosa PA01
gacgaugcaggg

SEQ ID NO: 3456614 - RNA, 16 nt, Pseudomonas aeruginosa PA01
gacgaugcagggcugc

SEQ ID NO: 3456615 - RNA, 14 nt, Pseudomonas aeruginosa PA01
gacgaugccgaucu

SEQ ID NO: 3456616 - RNA, 16 nt, Pseudomonas aeruginosa PA01
gacgaugccgccgccg

SEQ ID NO: 3456617 - RNA, 22 nt, Pseudomonas aeruginosa PA01
gacgaugccguucaggcgcgga

SEQ ID NO: 3456618 - RNA, 14 nt, Pseudomonas aeruginosa PA01
gacgaugccguucu

SEQ ID NO: 3456619 - RNA, 23 nt, Pseudomonas aeruginosa PA01
gacgaugccguucucggugacca

SEQ ID NO: 3456620 - RNA, 13 nt, Pseudomonas aeruginosa PA01
gacgaugcggccc

SEQ ID NO: 3456621 - RNA, 14 nt, Pseudomonas aeruginosa PA01
gacgaugcggcccg

SEQ ID NO: 3456622 - RNA, 17 nt, Pseudomonas aeruginosa PA01
gacgaugcggcccgccg

SEQ ID NO: 3456623 - RNA, 18 nt, Pseudomonas aeruginosa PA01
gacgaugcggcccgccgg

SEQ ID NO: 3456624 - RNA, 19 nt, Pseudomonas aeruginosa PA01
gacgaugcggcccgccggc

SEQ ID NO: 3456625 - RNA, 20 nt, Pseudomonas aeruginosa PA01
gacgauggccagcccggagc

SEQ ID NO: 3456626 - RNA, 13 nt, Pseudomonas aeruginosa PA01
gacgauggcccag

SEQ ID NO: 3456627 - RNA, 13 nt, Pseudomonas aeruginosa PA01
gacgauggccgcc

SEQ ID NO: 3456628 - RNA, 15 nt, Pseudomonas aeruginosa PA01
gacgauggccgccgc

SEQ ID NO: 3456629 - RNA, 17 nt, Pseudomonas aeruginosa PA01
gacgauggccgccgccg

SEQ ID NO: 3456630 - RNA, 14 nt, Pseudomonas aeruginosa PA01
gacgauggcgccau

SEQ ID NO: 3456631 - RNA, 13 nt, Pseudomonas aeruginosa PA01
gacgauggcgccu

SEQ ID NO: 3456632 - RNA, 16 nt, Pseudomonas aeruginosa PA01
gacgauggucgccgcg

SEQ ID NO: 3456633 - RNA, 17 nt, Pseudomonas aeruginosa PA01
gacgauggucgccgcga

SEQ ID NO: 3456634 - RNA, 23 nt, Pseudomonas aeruginosa PA01
gacgauggucgccgcgaccucgu

SEQ ID NO: 3456635 - RNA, 14 nt, Pseudomonas aeruginosa PA01
gacgauggugcgcu

SEQ ID NO: 3456636 - RNA, 18 nt, Pseudomonas aeruginosa PA01
gacgauguucgaggcgcc

SEQ ID NO: 3456637 - RNA, 22 nt, Pseudomonas aeruginosa PA01
gacgauguucgaggcgccgacc

SEQ ID NO: 3456638 - RNA, 23 nt, Pseudomonas aeruginosa PA01
gacgauguucgaggcgccgacca

SEQ ID NO: 3456639 - RNA, 20 nt, Pseudomonas aeruginosa PA01
gacgauguuguugcccacca

SEQ ID NO: 3456640 - RNA, 21 nt, Pseudomonas aeruginosa PA01
gacgauugaccucccgcgcca

SEQ ID NO: 3456641 - RNA, 23 nt, Pseudomonas aeruginosa PA01
gacgcacaccgucgaaccagccg

SEQ ID NO: 3456642 - RNA, 16 nt, Pseudomonas aeruginosa PA01
gacgcaccagcaggcc

SEQ ID NO: 3456643 - RNA, 18 nt, Pseudomonas aeruginosa PA01
gacgcaccagcaggccga

SEQ ID NO: 3456644 - RNA, 15 nt, Pseudomonas aeruginosa PA01
gacgcaccgagggca

SEQ ID NO: 3456645 - RNA, 18 nt, Pseudomonas aeruginosa PA01
gacgcacucauagcucag

SEQ ID NO: 3456646 - RNA, 23 nt, Pseudomonas aeruginosa PA01
gacgcacucauagcucagcugga

SEQ ID NO: 3456647 - RNA, 21 nt, Pseudomonas aeruginosa PA01
gacgcagagcgccaugacccg

SEQ ID NO: 3456648 - RNA, 22 nt, Pseudomonas aeruginosa PA01
gacgcagagcgccaugacccgc

SEQ ID NO: 3456649 - RNA, 13 nt, Pseudomonas aeruginosa PA01
gacgcagccgggc

SEQ ID NO: 3456650 - RNA, 21 nt, Pseudomonas aeruginosa PA01
gacgcagccguuggccagcag

SEQ ID NO: 3456651 - RNA, 16 nt, Pseudomonas aeruginosa PA01
gacgcagcgcgcgccg

SEQ ID NO: 3456652 - RNA, 20 nt, Pseudomonas aeruginosa PA01
gacgcagcgcgcgccgagca

SEQ ID NO: 3456653 - RNA, 21 nt, Pseudomonas aeruginosa PA01
gacgcagcgcgcgccgagcaa

SEQ ID NO: 3456654 - RNA, 23 nt, Pseudomonas aeruginosa PA01
gacgcaggacgucguagccaggc

SEQ ID NO: 3456655 - RNA, 13 nt, Pseudomonas aeruginosa PA01
gacgcaggcaggu

SEQ ID NO: 3456656 - RNA, 16 nt, Pseudomonas aeruginosa PA01
gacgcaggcaggucau

SEQ ID NO: 3456657 - RNA, 18 nt, Pseudomonas aeruginosa PA01
gacgcaggccgaccucgg

SEQ ID NO: 3456658 - RNA, 23 nt, Pseudomonas aeruginosa PA01
gacgcaggccgaccucggcgguc

SEQ ID NO: 3456659 - RNA, 14 nt, Pseudomonas aeruginosa PA01
gacgcagggcggcg

SEQ ID NO: 3456660 - RNA, 18 nt, Pseudomonas aeruginosa PA01
gacgcagggcggcgccug

SEQ ID NO: 3456661 - RNA, 20 nt, Pseudomonas aeruginosa PA01
gacgcagggcggcgccugga

SEQ ID NO: 3456662 - RNA, 23 nt, Pseudomonas aeruginosa PA01
gacgcagggcgguacgccgcgcu

SEQ ID NO: 3456663 - RNA, 23 nt, Pseudomonas aeruginosa PA01
gacgcaggguucggggaacagcg

SEQ ID NO: 3456664 - RNA, 16 nt, Pseudomonas aeruginosa PA01
gacgcaguuccgcggc

SEQ ID NO: 3456665 - RNA, 14 nt, Pseudomonas aeruginosa PA01
gacgcauaaccgcu

SEQ ID NO: 3456666 - RNA, 14 nt, Pseudomonas aeruginosa PA01
gacgcaugcgcggc

SEQ ID NO: 3456667 - RNA, 15 nt, Pseudomonas aeruginosa PA01
gacgccaccagccag

SEQ ID NO: 3456668 - RNA, 17 nt, Pseudomonas aeruginosa PA01
gacgccaccagccaggc

SEQ ID NO: 3456669 - RNA, 20 nt, Pseudomonas aeruginosa PA01
gacgccaccagccaggcggc

SEQ ID NO: 3456670 - RNA, 23 nt, Pseudomonas aeruginosa PA01
gacgccaccagccaggcggccac

SEQ ID NO: 3456671 - RNA, 13 nt, Pseudomonas aeruginosa PA01
gacgccaccaggc

SEQ ID NO: 3456672 - RNA, 15 nt, Pseudomonas aeruginosa PA01
gacgccaccaggccg

SEQ ID NO: 3456673 - RNA, 16 nt, Pseudomonas aeruginosa PA01
gacgccaccaggccgc

SEQ ID NO: 3456674 - RNA, 13 nt, Pseudomonas aeruginosa PA01
gacgccacccgca

SEQ ID NO: 3456675 - RNA, 17 nt, Pseudomonas aeruginosa PA01
gacgccagccgcccugg

SEQ ID NO: 3456676 - RNA, 19 nt, Pseudomonas aeruginosa PA01
gacgccagcucggccggca

SEQ ID NO: 3456677 - RNA, 21 nt, Pseudomonas aeruginosa PA01
gacgccagcucggccggcagg

SEQ ID NO: 3456678 - RNA, 14 nt, Pseudomonas aeruginosa PA01
gacgccaggcgucc

SEQ ID NO: 3456679 - RNA, 23 nt, Pseudomonas aeruginosa PA01
gacgccaguuucuaucucccuau

SEQ ID NO: 3456680 - RNA, 17 nt, Pseudomonas aeruginosa PA01
gacgcggacagccuggg

SEQ ID NO: 3456681 - RNA, 17 nt, Pseudomonas aeruginosa PA01
gacgcggaugcccuggu

SEQ ID NO: 3456682 - RNA, 17 nt, Pseudomonas aeruginosa PA01
gacgcggauuggccggg

SEQ ID NO: 3456683 - RNA, 12 nt, Pseudomonas aeruginosa PA01
gacgcggccugg

SEQ ID NO: 3456684 - RNA, 15 nt, Pseudomonas aeruginosa PA01
gacgcggccugggcc

SEQ ID NO: 3456685 - RNA, 16 nt, Pseudomonas aeruginosa PA01
gacgcggccugggccg

SEQ ID NO: 3456686 - RNA, 17 nt, Pseudomonas aeruginosa PA01
gacgcggccugggccga

SEQ ID NO: 3456687 - RNA, 18 nt, Pseudomonas aeruginosa PA01
gacgcggccugggccgaa

SEQ ID NO: 3456688 - RNA, 20 nt, Pseudomonas aeruginosa PA01
gacgcggcggcuccggcgcc

SEQ ID NO: 3456689 - RNA, 14 nt, Pseudomonas aeruginosa PA01
gacgcgggcccagc

SEQ ID NO: 3456690 - RNA, 11 nt, Pseudomonas aeruginosa PA01
gacgcguccgg

SEQ ID NO: 3456691 - RNA, 16 nt, Pseudomonas aeruginosa PA01
gacgcgucguccgagg

SEQ ID NO: 3456692 - RNA, 17 nt, Pseudomonas aeruginosa PA01
gacgcgucguccgaggc

SEQ ID NO: 3456693 - RNA, 23 nt, Pseudomonas aeruginosa PA01
gacgcuccaggugcacggccagg

SEQ ID NO: 3456694 - RNA, 14 nt, Pseudomonas aeruginosa PA01
gacgcuccugcgcc

SEQ ID NO: 3456695 - RNA, 17 nt, Pseudomonas aeruginosa PA01
gacgcuccugcgccggc

SEQ ID NO: 3456696 - RNA, 22 nt, Pseudomonas aeruginosa PA01
gacgcucggacagcuucugguu

SEQ ID NO: 3456697 - RNA, 12 nt, Pseudomonas aeruginosa PA01
gacgcucggcca

SEQ ID NO: 3456698 - RNA, 14 nt, Pseudomonas aeruginosa PA01
gacgcucggccagc

SEQ ID NO: 3456699 - RNA, 19 nt, Pseudomonas aeruginosa PA01
gacgcucggccagcguccu

SEQ ID NO: 3456700 - RNA, 16 nt, Pseudomonas aeruginosa PA01
gacgcucugcucggcc

SEQ ID NO: 3456701 - RNA, 18 nt, Pseudomonas aeruginosa PA01
gacgcucugcucggccag

SEQ ID NO: 3456702 - RNA, 22 nt, Pseudomonas aeruginosa PA01
gacgcucugcucggccagcgcc

SEQ ID NO: 3456703 - RNA, 20 nt, Pseudomonas aeruginosa PA01
gacgcucuucaccucgauga

SEQ ID NO: 3456704 - RNA, 17 nt, Pseudomonas aeruginosa PA01
gacgcugaugaugccgc

SEQ ID NO: 3456705 - RNA, 22 nt, Pseudomonas aeruginosa PA01
gacgcugaugaugccgcggcga

SEQ ID NO: 3456706 - RNA, 17 nt, Pseudomonas aeruginosa PA01
gacgcugaugccggcga

SEQ ID NO: 3456707 - RNA, 18 nt, Pseudomonas aeruginosa PA01
gacgcugaugccggcgaa

SEQ ID NO: 3456708 - RNA, 20 nt, Pseudomonas aeruginosa PA01
gacgcugaugccggcgaacu

SEQ ID NO: 3456709 - RNA, 14 nt, Pseudomonas aeruginosa PA01
gacgcugcccagcc

SEQ ID NO: 3456710 - RNA, 17 nt, Pseudomonas aeruginosa PA01
gacgcugcccagcccgc

SEQ ID NO: 3456711 - RNA, 13 nt, Pseudomonas aeruginosa PA01
gacgcugccgagg

SEQ ID NO: 3456712 - RNA, 22 nt, Pseudomonas aeruginosa PA01
gacgcugccgaggaacucgcgg

SEQ ID NO: 3456713 - RNA, 23 nt, Pseudomonas aeruginosa PA01
gacgcugccguucgcccgcggcg

SEQ ID NO: 3456714 - RNA, 18 nt, Pseudomonas aeruginosa PA01
gacgcugcgaccuggcgc

SEQ ID NO: 3456715 - RNA, 20 nt, Pseudomonas aeruginosa PA01
gacgcugcgaccuggcgccg

SEQ ID NO: 3456716 - RNA, 22 nt, Pseudomonas aeruginosa PA01
gacgcugcuaggcuggaagccg

SEQ ID NO: 3456717 - RNA, 16 nt, Pseudomonas aeruginosa PA01
gacgcugcucaccagg

SEQ ID NO: 3456718 - RNA, 21 nt, Pseudomonas aeruginosa PA01
gacgcugcucgacggcaccag

SEQ ID NO: 3456719 - RNA, 17 nt, Pseudomonas aeruginosa PA01
gacgcuggcgaucaugc

SEQ ID NO: 3456720 - RNA, 22 nt, Pseudomonas aeruginosa PA01
gacgcuggcgaucaugccuucg

SEQ ID NO: 3456721 - RNA, 16 nt, Pseudomonas aeruginosa PA01
gacgcuggcggugcgg

SEQ ID NO: 3456722 - RNA, 13 nt, Pseudomonas aeruginosa PA01
gacgcugggacgg

SEQ ID NO: 3456723 - RNA, 15 nt, Pseudomonas aeruginosa PA01
gacgcugggacggcu

SEQ ID NO: 3456724 - RNA, 17 nt, Pseudomonas aeruginosa PA01
gacgcugggacggcugc

SEQ ID NO: 3456725 - RNA, 22 nt, Pseudomonas aeruginosa PA01
gacgcugggcugggucggcugg

SEQ ID NO: 3456726 - RNA, 15 nt, Pseudomonas aeruginosa PA01
gacgcuggucaggcu

SEQ ID NO: 3456727 - RNA, 17 nt, Pseudomonas aeruginosa PA01
gacgcugucguggacgc

SEQ ID NO: 3456728 - RNA, 16 nt, Pseudomonas aeruginosa PA01
gacggaaacgacaggc

SEQ ID NO: 3456729 - RNA, 16 nt, Pseudomonas aeruginosa PA01
gacggaagcauggccg

SEQ ID NO: 3456730 - RNA, 18 nt, Pseudomonas aeruginosa PA01
gacggaagcauggccggc

SEQ ID NO: 3456731 - RNA, 13 nt, Pseudomonas aeruginosa PA01
gacggaagcccuc

SEQ ID NO: 3456732 - RNA, 15 nt, Pseudomonas aeruginosa PA01
gacggaagcccucga

SEQ ID NO: 3456733 - RNA, 13 nt, Pseudomonas aeruginosa PA01
gacggaaggugcg

SEQ ID NO: 3456734 - RNA, 23 nt, Pseudomonas aeruginosa PA01
gacggaccgcgacaacccugucc

SEQ ID NO: 3456735 - RNA, 18 nt, Pseudomonas aeruginosa PA01
gacggagagcagcagcuc

SEQ ID NO: 3456736 - RNA, 18 nt, Pseudomonas aeruginosa PA01
gacggauaacggcagccg

SEQ ID NO: 3456737 - RNA, 19 nt, Pseudomonas aeruginosa PA01
gacggauaacggcagccgc

SEQ ID NO: 3456738 - RNA, 21 nt, Pseudomonas aeruginosa PA01
gacggaucacggugccauccg

SEQ ID NO: 3456739 - RNA, 22 nt, Pseudomonas aeruginosa PA01
gacggcaaggaccugcugcccg

SEQ ID NO: 3456740 - RNA, 17 nt, Pseudomonas aeruginosa PA01
gacggcacgacgccggu

SEQ ID NO: 3456741 - RNA, 12 nt, Pseudomonas aeruginosa PA01
gacggcacgggg

SEQ ID NO: 3456742 - RNA, 20 nt, Pseudomonas aeruginosa PA01
gacggcacggggcgccuguc

SEQ ID NO: 3456743 - RNA, 16 nt, Pseudomonas aeruginosa PA01
gacggcagggucagcc

SEQ ID NO: 3456744 - RNA, 23 nt, Pseudomonas aeruginosa PA01
gacggcagggucagccgaugcuc

SEQ ID NO: 3456745 - RNA, 13 nt, Pseudomonas aeruginosa PA01
gacggcagguggc

SEQ ID NO: 3456746 - RNA, 23 nt, Pseudomonas aeruginosa PA01
gacggcagguggcgggucggcgg

SEQ ID NO: 3456747 - RNA, 12 nt, Pseudomonas aeruginosa PA01
gacggcauuccu

SEQ ID NO: 3456748 - RNA, 21 nt, Pseudomonas aeruginosa PA01
gacggcauuccugguccagcc

SEQ ID NO: 3456749 - RNA, 23 nt, Pseudomonas aeruginosa PA01
gacggcauuccugguccagccag

SEQ ID NO: 3456750 - RNA, 14 nt, Pseudomonas aeruginosa PA01
gacggcccgccccg

SEQ ID NO: 3456751 - RNA, 17 nt, Pseudomonas aeruginosa PA01
gacggcccgccccgcaa

SEQ ID NO: 3456752 - RNA, 14 nt, Pseudomonas aeruginosa PA01
gacggcccuccggc

SEQ ID NO: 3456753 - RNA, 18 nt, Pseudomonas aeruginosa PA01
gacggcccuccggcgcgu

SEQ ID NO: 3456754 - RNA, 20 nt, Pseudomonas aeruginosa PA01
gacggcccuccggcgcguug

SEQ ID NO: 3456755 - RNA, 20 nt, Pseudomonas aeruginosa PA01
gacggcccugacauccuugg

SEQ ID NO: 3456756 - RNA, 12 nt, Pseudomonas aeruginosa PA01
gacggccugcgc

SEQ ID NO: 3456757 - RNA, 23 nt, Pseudomonas aeruginosa PA01
gacggccuuggucucgcgggcga

SEQ ID NO: 3456758 - RNA, 17 nt, Pseudomonas aeruginosa PA01
gacggcgcaagggcgcc

SEQ ID NO: 3456759 - RNA, 17 nt, Pseudomonas aeruginosa PA01
gacggcggcgaccccga

SEQ ID NO: 3456760 - RNA, 12 nt, Pseudomonas aeruginosa PA01
gacggcggcugg

SEQ ID NO: 3456761 - RNA, 19 nt, Pseudomonas aeruginosa PA01
gacggcgggagcggccuga

SEQ ID NO: 3456762 - RNA, 21 nt, Pseudomonas aeruginosa PA01
gacggcgggagcggccugagc

SEQ ID NO: 3456763 - RNA, 12 nt, Pseudomonas aeruginosa PA01
gacggcgugcag

SEQ ID NO: 3456764 - RNA, 14 nt, Pseudomonas aeruginosa PA01
gacggcgugcaggu

SEQ ID NO: 3456765 - RNA, 16 nt, Pseudomonas aeruginosa PA01
gacggcgugccguggc

SEQ ID NO: 3456766 - RNA, 20 nt, Pseudomonas aeruginosa PA01
gacggcguucggggcccucc

SEQ ID NO: 3456767 - RNA, 12 nt, Pseudomonas aeruginosa PA01
gacggcuccgga

SEQ ID NO: 3456768 - RNA, 12 nt, Pseudomonas aeruginosa PA01
gacggcucgcgc

SEQ ID NO: 3456769 - RNA, 13 nt, Pseudomonas aeruginosa PA01
gacggcucgcgca

SEQ ID NO: 3456770 - RNA, 19 nt, Pseudomonas aeruginosa PA01
gacggcucgcgcagcggcg

SEQ ID NO: 3456771 - RNA, 20 nt, Pseudomonas aeruginosa PA01
gacggcucgcgcagcggcgc

SEQ ID NO: 3456772 - RNA, 16 nt, Pseudomonas aeruginosa PA01
gacggcucuggaugcg

SEQ ID NO: 3456773 - RNA, 12 nt, Pseudomonas aeruginosa PA01
gacggcucuucc

SEQ ID NO: 3456774 - RNA, 23 nt, Pseudomonas aeruginosa PA01
gacggcucuuccccuaccggcaa

SEQ ID NO: 3456775 - RNA, 16 nt, Pseudomonas aeruginosa PA01
gacggcugaggcuggc

SEQ ID NO: 3456776 - RNA, 18 nt, Pseudomonas aeruginosa PA01
gacggcugaggcuggcga

SEQ ID NO: 3456777 - RNA, 18 nt, Pseudomonas aeruginosa PA01
gacggcugcccaacuggc

SEQ ID NO: 3456778 - RNA, 17 nt, Pseudomonas aeruginosa PA01
gacggcugcuccggauc

SEQ ID NO: 3456779 - RNA, 21 nt, Pseudomonas aeruginosa PA01
gacggcuucgaccacgacccg

SEQ ID NO: 3456780 - RNA, 22 nt, Pseudomonas aeruginosa PA01
gacggcuucgaccacgacccgg

SEQ ID NO: 3456781 - RNA, 17 nt, Pseudomonas aeruginosa PA01
gacgggaagcgaaccag

SEQ ID NO: 3456782 - RNA, 21 nt, Pseudomonas aeruginosa PA01
gacgggaagcgaaccaggcaa

SEQ ID NO: 3456783 - RNA, 18 nt, Pseudomonas aeruginosa PA01
gacucgcgaucgaucggc

SEQ ID NO: 3456784 - RNA, 21 nt, Pseudomonas aeruginosa PA01
gacucgcgaucgaucggcugg

SEQ ID NO: 3456785 - RNA, 17 nt, Pseudomonas aeruginosa PA01
gacucgcuaucaggcau

SEQ ID NO: 3456786 - RNA, 15 nt, Pseudomonas aeruginosa PA01
gacucgcugccggcg

SEQ ID NO: 3456787 - RNA, 16 nt, Pseudomonas aeruginosa PA01
gacucgcugccggcgc

SEQ ID NO: 3456788 - RNA, 18 nt, Pseudomonas aeruginosa PA01
gacucgcugccggcgcgc

SEQ ID NO: 3456789 - RNA, 16 nt, Pseudomonas aeruginosa PA01
gacucgcugggcgccg

SEQ ID NO: 3456790 - RNA, 20 nt, Pseudomonas aeruginosa PA01
gacucgcugggcgccggcag

SEQ ID NO: 3456791 - RNA, 21 nt, Pseudomonas aeruginosa PA01
gacucgcugggcgccggcagg

SEQ ID NO: 3456792 - RNA, 23 nt, Pseudomonas aeruginosa PA01
gacucgcugggcgccggcaggcc

SEQ ID NO: 3456793 - RNA, 20 nt, Pseudomonas aeruginosa PA01
gacucggggcgccuccagcg

SEQ ID NO: 3456794 - RNA, 16 nt, Pseudomonas aeruginosa PA01
gacucggugcguagcg

SEQ ID NO: 3456795 - RNA, 21 nt, Pseudomonas aeruginosa PA01
gacucggugcguagcgacagg

SEQ ID NO: 3456796 - RNA, 23 nt, Pseudomonas aeruginosa PA01
gacucggugcguagcgacaggcc

SEQ ID NO: 3456797 - RNA, 18 nt, Pseudomonas aeruginosa PA01
gacucguugcacgcaggc

SEQ ID NO: 3456798 - RNA, 21 nt, Pseudomonas aeruginosa PA01
gacucguugcacgcaggccgc

SEQ ID NO: 3456799 - RNA, 15 nt, Pseudomonas aeruginosa PA01
gacucuccaggucgg

SEQ ID NO: 3456800 - RNA, 20 nt, Pseudomonas aeruginosa PA01
gacugaacucgguguagcug

SEQ ID NO: 3456801 - RNA, 22 nt, Pseudomonas aeruginosa PA01
gacugaccgucgggucgacccg

SEQ ID NO: 3456802 - RNA, 14 nt, Pseudomonas aeruginosa PA01
gacugacgaaggcu

SEQ ID NO: 3456803 - RNA, 22 nt, Pseudomonas aeruginosa PA01
gacugacgguggaggcgggcuc

SEQ ID NO: 3456804 - RNA, 14 nt, Pseudomonas aeruginosa PA01
gacugagccgcugg

SEQ ID NO: 3456805 - RNA, 17 nt, Pseudomonas aeruginosa PA01
gacugcaacuggccgag

SEQ ID NO: 3456806 - RNA, 16 nt, Pseudomonas aeruginosa PA01
gacugcacgcagacgu

SEQ ID NO: 3456807 - RNA, 19 nt, Pseudomonas aeruginosa PA01
gacugcaugaugccgugca

SEQ ID NO: 3456808 - RNA, 15 nt, Pseudomonas aeruginosa PA01
gacugccaacuggcg

SEQ ID NO: 3456809 - RNA, 17 nt, Pseudomonas aeruginosa PA01
gacugccaacuggcguc

SEQ ID NO: 3456810 - RNA, 15 nt, Pseudomonas aeruginosa PA01
gacugcccagcgccg

SEQ ID NO: 3456811 - RNA, 16 nt, Pseudomonas aeruginosa PA01
gacugcccagcgccgc

SEQ ID NO: 3456812 - RNA, 18 nt, Pseudomonas aeruginosa PA01
gacugcccagcgccgcca

SEQ ID NO: 3456813 - RNA, 19 nt, Pseudomonas aeruginosa PA01
gacugcccagcgccgccag

SEQ ID NO: 3456814 - RNA, 20 nt, Pseudomonas aeruginosa PA01
gacugcccagcgccgccagc

SEQ ID NO: 3456815 - RNA, 15 nt, Pseudomonas aeruginosa PA01
gacugccgucggcgc

SEQ ID NO: 3456816 - RNA, 16 nt, Pseudomonas aeruginosa PA01
gacugccgucggcgcc

SEQ ID NO: 3456817 - RNA, 17 nt, Pseudomonas aeruginosa PA01
gacugccugcagguagc

SEQ ID NO: 3456818 - RNA, 21 nt, Pseudomonas aeruginosa PA01
gacugcgagccgacuuccagc

SEQ ID NO: 3456819 - RNA, 16 nt, Pseudomonas aeruginosa PA01
gacugcgaggcggugc

SEQ ID NO: 3456820 - RNA, 19 nt, Pseudomonas aeruginosa PA01
gacugcgguuuuccugccc

SEQ ID NO: 3456821 - RNA, 12 nt, Pseudomonas aeruginosa PA01
gacugcucgccg

SEQ ID NO: 3456822 - RNA, 15 nt, Pseudomonas aeruginosa PA01
gacugcucgccgccg

SEQ ID NO: 3456823 - RNA, 15 nt, Pseudomonas aeruginosa PA01
gacugcugcugcggg

SEQ ID NO: 3456824 - RNA, 19 nt, Pseudomonas aeruginosa PA01
gacuggaugaacagcgaga

SEQ ID NO: 3456825 - RNA, 16 nt, Pseudomonas aeruginosa PA01
gacuggauucggccug

SEQ ID NO: 3456826 - RNA, 19 nt, Pseudomonas aeruginosa PA01
gacuggcagcgauaaccgc

SEQ ID NO: 3456827 - RNA, 13 nt, Pseudomonas aeruginosa PA01
gacuggcccuggu

SEQ ID NO: 3456828 - RNA, 19 nt, Pseudomonas aeruginosa PA01
gacuggggcaucucggcca

SEQ ID NO: 3456829 - RNA, 18 nt, Pseudomonas aeruginosa PA01
gacugguaggacagggcc

SEQ ID NO: 3456830 - RNA, 20 nt, Pseudomonas aeruginosa PA01
gacugguaggacagggccag

SEQ ID NO: 3456831 - RNA, 18 nt, Pseudomonas aeruginosa PA01
gacugguccugcggcggc

SEQ ID NO: 3456832 - RNA, 12 nt, Pseudomonas aeruginosa PA01
gacuggugggca

SEQ ID NO: 3456833 - RNA, 18 nt, Pseudomonas aeruginosa PA01
gacuguccaauauagcca

SEQ ID NO: 3456834 - RNA, 19 nt, Pseudomonas aeruginosa PA01
gacugucgagcagggucgc

SEQ ID NO: 3456835 - RNA, 15 nt, Pseudomonas aeruginosa PA01
gacugucgugccucc

SEQ ID NO: 3456836 - RNA, 21 nt, Pseudomonas aeruginosa PA01
gacugucgugccuccagccuc

SEQ ID NO: 3456837 - RNA, 15 nt, Pseudomonas aeruginosa PA01
gacugugguguagcg

SEQ ID NO: 3456838 - RNA, 20 nt, Pseudomonas aeruginosa PA01
gacugugguguagcgcaggu

SEQ ID NO: 3456839 - RNA, 16 nt, Pseudomonas aeruginosa PA01
gacuuccaggcgcagg

SEQ ID NO: 3456840 - RNA, 19 nt, Pseudomonas aeruginosa PA01
gacuuccaggcgcaggcga

SEQ ID NO: 3456841 - RNA, 14 nt, Pseudomonas aeruginosa PA01
gacuuccaucagcu

SEQ ID NO: 3456842 - RNA, 17 nt, Pseudomonas aeruginosa PA01
gacuuccaucagcucca

SEQ ID NO: 3456843 - RNA, 15 nt, Pseudomonas aeruginosa PA01
gacuucggcaagcac

SEQ ID NO: 3456844 - RNA, 15 nt, Pseudomonas aeruginosa PA01
gacuucggcgacagc

SEQ ID NO: 3456845 - RNA, 20 nt, Pseudomonas aeruginosa PA01
gacuucggucucguccggcg

SEQ ID NO: 3456846 - RNA, 20 nt, Pseudomonas aeruginosa PA01
gacuucgucgaagaccaggg

SEQ ID NO: 3456847 - RNA, 21 nt, Pseudomonas aeruginosa PA01
gacuucgucgaagaccagggu

SEQ ID NO: 3456848 - RNA, 23 nt, Pseudomonas aeruginosa PA01
gacuucgucgaagaccagggugg

SEQ ID NO: 3456849 - RNA, 22 nt, Pseudomonas aeruginosa PA01
gacuugaaccccgaacuucccc

SEQ ID NO: 3456850 - RNA, 23 nt, Pseudomonas aeruginosa PA01
gacuugccgaucaugggggccag

SEQ ID NO: 3456851 - RNA, 20 nt, Pseudomonas aeruginosa PA01
gacuuggagaagaucgccgu

SEQ ID NO: 3456852 - RNA, 20 nt, Pseudomonas aeruginosa PA01
gacuuggcagucgccgccag

SEQ ID NO: 3456853 - RNA, 16 nt, Pseudomonas aeruginosa PA01
gacuuguacucgccgg

SEQ ID NO: 3456854 - RNA, 20 nt, Pseudomonas aeruginosa PA01
gacuuucuugaccaugguga

SEQ ID NO: 3456855 - RNA, 9 nt, Pseudomonas aeruginosa PA01
gagaaaaac

SEQ ID NO: 3456856 - RNA, 21 nt, Pseudomonas aeruginosa PA01
gagaaaaaccacgggaauggc

SEQ ID NO: 3456857 - RNA, 19 nt, Pseudomonas aeruginosa PA01
gagaaauccggcuggcgcc

SEQ ID NO: 3456858 - RNA, 21 nt, Pseudomonas aeruginosa PA01
gagaaauccggcuggcgccgg

SEQ ID NO: 3456859 - RNA, 11 nt, Pseudomonas aeruginosa PA01
gagaacagcag

SEQ ID NO: 3456860 - RNA, 16 nt, Pseudomonas aeruginosa PA01
gagaacagcagcggca

SEQ ID NO: 3456861 - RNA, 13 nt, Pseudomonas aeruginosa PA01
gagaacagcaggg

SEQ ID NO: 3456862 - RNA, 13 nt, Pseudomonas aeruginosa PA01
gagaaccaguacu

SEQ ID NO: 3456863 - RNA, 16 nt, Pseudomonas aeruginosa PA01
gagaaccaguacuuga

SEQ ID NO: 3456864 - RNA, 22 nt, Pseudomonas aeruginosa PA01
gagaaccaguacuugaacagca

SEQ ID NO: 3456865 - RNA, 15 nt, Pseudomonas aeruginosa PA01
gagaacccggccagg

SEQ ID NO: 3456866 - RNA, 21 nt, Pseudomonas aeruginosa PA01
gagaacccggccaggcccuca

SEQ ID NO: 3456867 - RNA, 21 nt, Pseudomonas aeruginosa PA01
gagaacgcggcgaagggcgcu

SEQ ID NO: 3456868 - RNA, 22 nt, Pseudomonas aeruginosa PA01
gagaacgcggcgaagggcgcuu

SEQ ID NO: 3456869 - RNA, 23 nt, Pseudomonas aeruginosa PA01
gagaacgcggcgaagggcgcuuc

SEQ ID NO: 3456870 - RNA, 22 nt, Pseudomonas aeruginosa PA01
gagaacgcuucgaagcucucgc

SEQ ID NO: 3456871 - RNA, 21 nt, Pseudomonas aeruginosa PA01
gagaagaucgccguguugaug

SEQ ID NO: 3456872 - RNA, 16 nt, Pseudomonas aeruginosa PA01
gagaagccgaucaggu

SEQ ID NO: 3456873 - RNA, 14 nt, Pseudomonas aeruginosa PA01
gagaagcgccucgc

SEQ ID NO: 3456874 - RNA, 12 nt, Pseudomonas aeruginosa PA01
gagaaggagaac

SEQ ID NO: 3456875 - RNA, 21 nt, Pseudomonas aeruginosa PA01
gagaaggcguagaaacgcgcc

SEQ ID NO: 3456876 - RNA, 12 nt, Pseudomonas aeruginosa PA01
gagaaggcugcc

SEQ ID NO: 3456877 - RNA, 14 nt, Pseudomonas aeruginosa PA01
gagaaggcugccgg

SEQ ID NO: 3456878 - RNA, 15 nt, Pseudomonas aeruginosa PA01
gagaagggcgcgccc

SEQ ID NO: 3456879 - RNA, 18 nt, Pseudomonas aeruginosa PA01
gagaagguucucggccac

SEQ ID NO: 3456880 - RNA, 23 nt, Pseudomonas aeruginosa PA01
gagaaguagucauugcgcuguga

SEQ ID NO: 3456881 - RNA, 19 nt, Pseudomonas aeruginosa PA01
gagaauccgcucggugccu

SEQ ID NO: 3456882 - RNA, 15 nt, Pseudomonas aeruginosa PA01
gagaaugaaaaaggg

SEQ ID NO: 3456883 - RNA, 16 nt, Pseudomonas aeruginosa PA01
gagaaugaaaaaggga

SEQ ID NO: 3456884 - RNA, 20 nt, Pseudomonas aeruginosa PA01
gagaaugaaaaagggaugcc

SEQ ID NO: 3456885 - RNA, 22 nt, Pseudomonas aeruginosa PA01
gagcaccaggcgguacaccgcc

SEQ ID NO: 3456886 - RNA, 13 nt, Pseudomonas aeruginosa PA01
gagcaccaugcag

SEQ ID NO: 3456887 - RNA, 18 nt, Pseudomonas aeruginosa PA01
gagcaccaugcagcggca

SEQ ID NO: 3456888 - RNA, 22 nt, Pseudomonas aeruginosa PA01
gagcaccaugcagcggcauggu

SEQ ID NO: 3456889 - RNA, 19 nt, Pseudomonas aeruginosa PA01
gagcaccaugccgaugaca

SEQ ID NO: 3456890 - RNA, 19 nt, Pseudomonas aeruginosa PA01
gagcaccccgagcccggcc

SEQ ID NO: 3456891 - RNA, 14 nt, Pseudomonas aeruginosa PA01
gagcacccgggcga

SEQ ID NO: 3456892 - RNA, 23 nt, Pseudomonas aeruginosa PA01
gagcacccgggcgaccugcucgc

SEQ ID NO: 3456893 - RNA, 17 nt, Pseudomonas aeruginosa PA01
gagcaccgcgcagacca

SEQ ID NO: 3456894 - RNA, 19 nt, Pseudomonas aeruginosa PA01
gagcaccgcgccuuccagc

SEQ ID NO: 3456895 - RNA, 14 nt, Pseudomonas aeruginosa PA01
gagcaccggcagga

SEQ ID NO: 3456896 - RNA, 19 nt, Pseudomonas aeruginosa PA01
gagcaccgggacgaagcgg

SEQ ID NO: 3456897 - RNA, 21 nt, Pseudomonas aeruginosa PA01
gagcaccucgaccugguagcc

SEQ ID NO: 3456898 - RNA, 19 nt, Pseudomonas aeruginosa PA01
gagcacgccgcgaccgaag

SEQ ID NO: 3456899 - RNA, 20 nt, Pseudomonas aeruginosa PA01
gagcacgccgcgaccgaagc

SEQ ID NO: 3456900 - RNA, 14 nt, Pseudomonas aeruginosa PA01
gagcacgccgugca

SEQ ID NO: 3456901 - RNA, 15 nt, Pseudomonas aeruginosa PA01
gagcacggccguccu

SEQ ID NO: 3456902 - RNA, 23 nt, Pseudomonas aeruginosa PA01
gagcacggcgaacaccgggccgc

SEQ ID NO: 3456903 - RNA, 14 nt, Pseudomonas aeruginosa PA01
gagcacggcgcugg

SEQ ID NO: 3456904 - RNA, 18 nt, Pseudomonas aeruginosa PA01
gagcacggcgcuggucuc

SEQ ID NO: 3456905 - RNA, 19 nt, Pseudomonas aeruginosa PA01
gagcacggcgcuggucucu

SEQ ID NO: 3456906 - RNA, 22 nt, Pseudomonas aeruginosa PA01
gagcacgucgagcaguugcugg

SEQ ID NO: 3456907 - RNA, 19 nt, Pseudomonas aeruginosa PA01
gagcagaaccgccagcagu

SEQ ID NO: 3456908 - RNA, 21 nt, Pseudomonas aeruginosa PA01
gagcagaacuugcgcaccgcg

SEQ ID NO: 3456909 - RNA, 22 nt, Pseudomonas aeruginosa PA01
gagcagacacaaaaaacccggc

SEQ ID NO: 3456910 - RNA, 12 nt, Pseudomonas aeruginosa PA01
gagcagagucgc

SEQ ID NO: 3456911 - RNA, 24 nt, Pseudomonas aeruginosa PA01
gagcagaguuuagccgccagugca

SEQ ID NO: 3456912 - RNA, 18 nt, Pseudomonas aeruginosa PA01
gagcagcaccacggcgau

SEQ ID NO: 3456913 - RNA, 14 nt, Pseudomonas aeruginosa PA01
gagcagcaccagca

SEQ ID NO: 3456914 - RNA, 16 nt, Pseudomonas aeruginosa PA01
gagcagcaccagcacc

SEQ ID NO: 3456915 - RNA, 17 nt, Pseudomonas aeruginosa PA01
gagcagcaccagcacca

SEQ ID NO: 3456916 - RNA, 15 nt, Pseudomonas aeruginosa PA01
gagcagcaccaggcu

SEQ ID NO: 3456917 - RNA, 17 nt, Pseudomonas aeruginosa PA01
gagcagcaccaggcugg

SEQ ID NO: 3456918 - RNA, 15 nt, Pseudomonas aeruginosa PA01
gagcagcacggccuc

SEQ ID NO: 3456919 - RNA, 17 nt, Pseudomonas aeruginosa PA01
gagcagcacggccucgc

SEQ ID NO: 3456920 - RNA, 13 nt, Pseudomonas aeruginosa PA01
gagcagcagcgcc

SEQ ID NO: 3456921 - RNA, 14 nt, Pseudomonas aeruginosa PA01
gagcagcagcgccg

SEQ ID NO: 3456922 - RNA, 12 nt, Pseudomonas aeruginosa PA01
gagcagccaagc

SEQ ID NO: 3456923 - RNA, 18 nt, Pseudomonas aeruginosa PA01
gagcagccaagccaccag

SEQ ID NO: 3456924 - RNA, 19 nt, Pseudomonas aeruginosa PA01
gagcagccaagccaccagc

SEQ ID NO: 3456925 - RNA, 21 nt, Pseudomonas aeruginosa PA01
gagcagccaagccaccagcga

SEQ ID NO: 3456926 - RNA, 13 nt, Pseudomonas aeruginosa PA01
gagcagccaggcg

SEQ ID NO: 3456927 - RNA, 16 nt, Pseudomonas aeruginosa PA01
gagcagccaggcgaag

SEQ ID NO: 3456928 - RNA, 16 nt, Pseudomonas aeruginosa PA01
gagcagcccgggcaac

SEQ ID NO: 3456929 - RNA, 20 nt, Pseudomonas aeruginosa PA01
gagcagcccgggcaacugcc

SEQ ID NO: 3456930 - RNA, 23 nt, Pseudomonas aeruginosa PA01
gagcagcccgggcaacugccgau

SEQ ID NO: 3456931 - RNA, 15 nt, Pseudomonas aeruginosa PA01
gagcagcgccagcca

SEQ ID NO: 3456932 - RNA, 18 nt, Pseudomonas aeruginosa PA01
gagcagcgccagccaggg

SEQ ID NO: 3456933 - RNA, 23 nt, Pseudomonas aeruginosa PA01
gagcagcgccagccaggguacuu

SEQ ID NO: 3456934 - RNA, 12 nt, Pseudomonas aeruginosa PA01
gagcagcgccgc

SEQ ID NO: 3456935 - RNA, 14 nt, Pseudomonas aeruginosa PA01
gagcagcgccgcgg

SEQ ID NO: 3456936 - RNA, 17 nt, Pseudomonas aeruginosa PA01
gagcagcgccgcggugu

SEQ ID NO: 3456937 - RNA, 21 nt, Pseudomonas aeruginosa PA01
gagcagcgcggcggcggccag

SEQ ID NO: 3456938 - RNA, 23 nt, Pseudomonas aeruginosa PA01
gagcagcgcggcggcggccagca

SEQ ID NO: 3456939 - RNA, 16 nt, Pseudomonas aeruginosa PA01
gagcagcggacgcagc

SEQ ID NO: 3456940 - RNA, 15 nt, Pseudomonas aeruginosa PA01
gagcagcggcacgcu

SEQ ID NO: 3456941 - RNA, 23 nt, Pseudomonas aeruginosa PA01
gagcagcggcacgcucuggccgu

SEQ ID NO: 3456942 - RNA, 23 nt, Pseudomonas aeruginosa PA01
gagcagcggcgccaacucggccu

SEQ ID NO: 3456943 - RNA, 14 nt, Pseudomonas aeruginosa PA01
gagcagcggcgcgc

SEQ ID NO: 3456944 - RNA, 14 nt, Pseudomonas aeruginosa PA01
gagcagcggcgcuu

SEQ ID NO: 3456945 - RNA, 20 nt, Pseudomonas aeruginosa PA01
gagcagcggcgcuuuccacu

SEQ ID NO: 3456946 - RNA, 20 nt, Pseudomonas aeruginosa PA01
gagcagcucauucguaauga

SEQ ID NO: 3456947 - RNA, 14 nt, Pseudomonas aeruginosa PA01
gagcagcucgccgg

SEQ ID NO: 3456948 - RNA, 16 nt, Pseudomonas aeruginosa PA01
gagcagcucgccggcg

SEQ ID NO: 3456949 - RNA, 17 nt, Pseudomonas aeruginosa PA01
gagcagcucgccggcgu

SEQ ID NO: 3456950 - RNA, 19 nt, Pseudomonas aeruginosa PA01
gagcagcucgccggcgucc

SEQ ID NO: 3456951 - RNA, 17 nt, Pseudomonas aeruginosa PA01
gagcagcuugcgcgagu

SEQ ID NO: 3456952 - RNA, 20 nt, Pseudomonas aeruginosa PA01
gagcagcuugcgcgaguagg

SEQ ID NO: 3456953 - RNA, 21 nt, Pseudomonas aeruginosa PA01
gagcaggaacucgaucagcgc

SEQ ID NO: 3456954 - RNA, 22 nt, Pseudomonas aeruginosa PA01
gagcaggaacucgaucagcgcg

SEQ ID NO: 3456955 - RNA, 16 nt, Pseudomonas aeruginosa PA01
gagcaggacagcaggg

SEQ ID NO: 3456956 - RNA, 17 nt, Pseudomonas aeruginosa PA01
gagcaggacagcagggu

SEQ ID NO: 3456957 - RNA, 20 nt, Pseudomonas aeruginosa PA01
gagcaggacagcagggucgc

SEQ ID NO: 3456958 - RNA, 19 nt, Pseudomonas aeruginosa PA01
gagcaggacgccgaacccg

SEQ ID NO: 3456959 - RNA, 14 nt, Pseudomonas aeruginosa PA01
gagcaggacugccc

SEQ ID NO: 3456960 - RNA, 16 nt, Pseudomonas aeruginosa PA01
gagcaggacugcccgc

SEQ ID NO: 3456961 - RNA, 13 nt, Pseudomonas aeruginosa PA01
gagcaggaggaua

SEQ ID NO: 3456962 - RNA, 23 nt, Pseudomonas aeruginosa PA01
gagcaggccacgcaccagcuccc

SEQ ID NO: 3456963 - RNA, 21 nt, Pseudomonas aeruginosa PA01
gagcaggcccaugauggucgg

SEQ ID NO: 3456964 - RNA, 22 nt, Pseudomonas aeruginosa PA01
gagcaggcccaugauggucggc

SEQ ID NO: 3456965 - RNA, 13 nt, Pseudomonas aeruginosa PA01
gagcaggccgacg

SEQ ID NO: 3456966 - RNA, 15 nt, Pseudomonas aeruginosa PA01
gagcaggccgacggc

SEQ ID NO: 3456967 - RNA, 22 nt, Pseudomonas aeruginosa PA01
gagcaggccgacggcgcgcugc

SEQ ID NO: 3456968 - RNA, 17 nt, Pseudomonas aeruginosa PA01
gagcaggccuugcaggg

SEQ ID NO: 3456969 - RNA, 14 nt, Pseudomonas aeruginosa PA01
gagcaggcgccgga

SEQ ID NO: 3456970 - RNA, 14 nt, Pseudomonas aeruginosa PA01
gagcaggcgcgcca

SEQ ID NO: 3456971 - RNA, 20 nt, Pseudomonas aeruginosa PA01
gagcaggcgcgccaggccca

SEQ ID NO: 3456972 - RNA, 14 nt, Pseudomonas aeruginosa PA01
gagcaggcggccgu

SEQ ID NO: 3456973 - RNA, 16 nt, Pseudomonas aeruginosa PA01
gagcaggcguuccggg

SEQ ID NO: 3456974 - RNA, 11 nt, Pseudomonas aeruginosa PA01
gagcaggcugc

SEQ ID NO: 3456975 - RNA, 13 nt, Pseudomonas aeruginosa PA01
gagcaggcugcua

SEQ ID NO: 3456976 - RNA, 15 nt, Pseudomonas aeruginosa PA01
gagcaggcugcuagg

SEQ ID NO: 3456977 - RNA, 17 nt, Pseudomonas aeruginosa PA01
gagcagggcgaugccga

SEQ ID NO: 3456978 - RNA, 18 nt, Pseudomonas aeruginosa PA01
gagcagggcgaugccgau

SEQ ID NO: 3456979 - RNA, 19 nt, Pseudomonas aeruginosa PA01
gagcagggcgaugccgaug

SEQ ID NO: 3456980 - RNA, 12 nt, Pseudomonas aeruginosa PA01
gagcagggcgcc

SEQ ID NO: 3456981 - RNA, 15 nt, Pseudomonas aeruginosa PA01
gagcagggcgccgau

SEQ ID NO: 3456982 - RNA, 17 nt, Pseudomonas aeruginosa PA01
gagcagggcgccgauca

SEQ ID NO: 3456983 - RNA, 14 nt, Pseudomonas aeruginosa PA01
gagcagggcgcuga

SEQ ID NO: 3456984 - RNA, 20 nt, Pseudomonas aeruginosa PA01
gagcagggcgcugagcgcgg

SEQ ID NO: 3456985 - RNA, 17 nt, Pseudomonas aeruginosa PA01
gagcagggcgucgcccu

SEQ ID NO: 3456986 - RNA, 17 nt, Pseudomonas aeruginosa PA01
gagcagggucgcgagca

SEQ ID NO: 3456987 - RNA, 17 nt, Pseudomonas aeruginosa PA01
gagccgucgccggcgac

SEQ ID NO: 3456988 - RNA, 16 nt, Pseudomonas aeruginosa PA01
gagccgucggcuccgc

SEQ ID NO: 3456989 - RNA, 19 nt, Pseudomonas aeruginosa PA01
gagccgucggcuccgcuca

SEQ ID NO: 3456990 - RNA, 20 nt, Pseudomonas aeruginosa PA01
gagccguugaaacgcucggc

SEQ ID NO: 3456991 - RNA, 22 nt, Pseudomonas aeruginosa PA01
gagccuacggaggaaacccaug

SEQ ID NO: 3456992 - RNA, 20 nt, Pseudomonas aeruginosa PA01
gagccugcgugagcugggca

SEQ ID NO: 3456993 - RNA, 20 nt, Pseudomonas aeruginosa PA01
gagccuggaguugugccagc

SEQ ID NO: 3456994 - RNA, 19 nt, Pseudomonas aeruginosa PA01
gagccuggccaggcgcucc

SEQ ID NO: 3456995 - RNA, 22 nt, Pseudomonas aeruginosa PA01
gagccuggccaggcgcuccucc

SEQ ID NO: 3456996 - RNA, 16 nt, Pseudomonas aeruginosa PA01
gagccuucagcacggc

SEQ ID NO: 3456997 - RNA, 21 nt, Pseudomonas aeruginosa PA01
gagccuucagcacggcgcggg

SEQ ID NO: 3456998 - RNA, 22 nt, Pseudomonas aeruginosa PA01
gagccuuucacuuucagguccu

SEQ ID NO: 3456999 - RNA, 17 nt, Pseudomonas aeruginosa PA01
gagcgaaacggcgcuga

SEQ ID NO: 3457000 - RNA, 14 nt, Pseudomonas aeruginosa PA01
gagcgaaaucggca

SEQ ID NO: 3457001 - RNA, 22 nt, Pseudomonas aeruginosa PA01
gagcgaagugggggcaaaugcc

SEQ ID NO: 3457002 - RNA, 17 nt, Pseudomonas aeruginosa PA01
gagcgaauacaccgagc

SEQ ID NO: 3457003 - RNA, 18 nt, Pseudomonas aeruginosa PA01
gagcgaauacaccgagcg

SEQ ID NO: 3457004 - RNA, 21 nt, Pseudomonas aeruginosa PA01
gagcgacaccaugcuccgccu

SEQ ID NO: 3457005 - RNA, 15 nt, Pseudomonas aeruginosa PA01
gagcgaccggauggc

SEQ ID NO: 3457006 - RNA, 14 nt, Pseudomonas aeruginosa PA01
gagcgaucccaggu

SEQ ID NO: 3457007 - RNA, 15 nt, Pseudomonas aeruginosa PA01
gagcgaucccagguc

SEQ ID NO: 3457008 - RNA, 16 nt, Pseudomonas aeruginosa PA01
gagcgauguccaggcc

SEQ ID NO: 3457009 - RNA, 15 nt, Pseudomonas aeruginosa PA01
gagcgcagcgccacc

SEQ ID NO: 3457010 - RNA, 14 nt, Pseudomonas aeruginosa PA01
gagcgccagcacca

SEQ ID NO: 3457011 - RNA, 19 nt, Pseudomonas aeruginosa PA01
gagcgccagcaccagcagg

SEQ ID NO: 3457012 - RNA, 21 nt, Pseudomonas aeruginosa PA01
gagcgccagcaccagcaggag

SEQ ID NO: 3457013 - RNA, 17 nt, Pseudomonas aeruginosa PA01
gagcgccagcagguugg

SEQ ID NO: 3457014 - RNA, 20 nt, Pseudomonas aeruginosa PA01
gagcgccagcgagacgggcg

SEQ ID NO: 3457015 - RNA, 18 nt, Pseudomonas aeruginosa PA01
gagcgccaugacccgcgg

SEQ ID NO: 3457016 - RNA, 19 nt, Pseudomonas aeruginosa PA01
gagcgccaugacccgcggc

SEQ ID NO: 3457017 - RNA, 20 nt, Pseudomonas aeruginosa PA01
gagcgccaugacccgcggca

SEQ ID NO: 3457018 - RNA, 21 nt, Pseudomonas aeruginosa PA01
gagcgccaugacccgcggcag

SEQ ID NO: 3457019 - RNA, 22 nt, Pseudomonas aeruginosa PA01
gagcgccaugacccgcggcagg

SEQ ID NO: 3457020 - RNA, 22 nt, Pseudomonas aeruginosa PA01
gagcgcccgccgucauggcggg

SEQ ID NO: 3457021 - RNA, 13 nt, Pseudomonas aeruginosa PA01
gagcgccgaaggc

SEQ ID NO: 3457022 - RNA, 21 nt, Pseudomonas aeruginosa PA01
gagcgccgccaggcaggccgg

SEQ ID NO: 3457023 - RNA, 20 nt, Pseudomonas aeruginosa PA01
gagcgccgccuugagcggcg

SEQ ID NO: 3457024 - RNA, 12 nt, Pseudomonas aeruginosa PA01
gagcgccgcggc

SEQ ID NO: 3457025 - RNA, 14 nt, Pseudomonas aeruginosa PA01
gagcgccgcggcgg

SEQ ID NO: 3457026 - RNA, 15 nt, Pseudomonas aeruginosa PA01
gagcgccgcggcggc

SEQ ID NO: 3457027 - RNA, 24 nt, Pseudomonas aeruginosa PA01
gagcgccgcggcggcgugcaggcc

SEQ ID NO: 3457028 - RNA, 11 nt, Pseudomonas aeruginosa PA01
gagcgccggcg

SEQ ID NO: 3457029 - RNA, 12 nt, Pseudomonas aeruginosa PA01
gagcgccggcgc

SEQ ID NO: 3457030 - RNA, 14 nt, Pseudomonas aeruginosa PA01
gagcgccggcgcgg

SEQ ID NO: 3457031 - RNA, 20 nt, Pseudomonas aeruginosa PA01
gagcgccucgaaggccucgg

SEQ ID NO: 3457032 - RNA, 15 nt, Pseudomonas aeruginosa PA01
gagcgccucgaucgc

SEQ ID NO: 3457033 - RNA, 23 nt, Pseudomonas aeruginosa PA01
gagcgccuggcgucgaugccgaa

SEQ ID NO: 3457034 - RNA, 16 nt, Pseudomonas aeruginosa PA01
gagcgcgaaagcgccc

SEQ ID NO: 3457035 - RNA, 14 nt, Pseudomonas aeruginosa PA01
gagcgcgaggcgag

SEQ ID NO: 3457036 - RNA, 16 nt, Pseudomonas aeruginosa PA01
gagcgcgaucagccgc

SEQ ID NO: 3457037 - RNA, 17 nt, Pseudomonas aeruginosa PA01
gagcgcgaucagccgcu

SEQ ID NO: 3457038 - RNA, 22 nt, Pseudomonas aeruginosa PA01
gagcgcgaucagccgcuccagg

SEQ ID NO: 3457039 - RNA, 20 nt, Pseudomonas aeruginosa PA01
gagcgcgcccaggcaggcga

SEQ ID NO: 3457040 - RNA, 13 nt, Pseudomonas aeruginosa PA01
gagcgcgcccugc

SEQ ID NO: 3457041 - RNA, 20 nt, Pseudomonas aeruginosa PA01
gagcgcgcccugcaggccga

SEQ ID NO: 3457042 - RNA, 14 nt, Pseudomonas aeruginosa PA01
gagcgcgccgccga

SEQ ID NO: 3457043 - RNA, 14 nt, Pseudomonas aeruginosa PA01
gagcgcggccggcc

SEQ ID NO: 3457044 - RNA, 16 nt, Pseudomonas aeruginosa PA01
gagcgcggccggccac

SEQ ID NO: 3457045 - RNA, 18 nt, Pseudomonas aeruginosa PA01
gagcgcggcgcaggcgau

SEQ ID NO: 3457046 - RNA, 23 nt, Pseudomonas aeruginosa PA01
gagcgcggucacccauucgaugc

SEQ ID NO: 3457047 - RNA, 12 nt, Pseudomonas aeruginosa PA01
gagcgcucgcgc

SEQ ID NO: 3457048 - RNA, 19 nt, Pseudomonas aeruginosa PA01
gagcgcugccugcaccggg

SEQ ID NO: 3457049 - RNA, 23 nt, Pseudomonas aeruginosa PA01
gagcggaaacccgugguccgcca

SEQ ID NO: 3457050 - RNA, 21 nt, Pseudomonas aeruginosa PA01
gagcggaacgggacgccuggc

SEQ ID NO: 3457051 - RNA, 17 nt, Pseudomonas aeruginosa PA01
gagcggaucgucgcggc

SEQ ID NO: 3457052 - RNA, 18 nt, Pseudomonas aeruginosa PA01
gagcggaucgucgcggcg

SEQ ID NO: 3457053 - RNA, 19 nt, Pseudomonas aeruginosa PA01
gagcggaucgucgcggcgc

SEQ ID NO: 3457054 - RNA, 13 nt, Pseudomonas aeruginosa PA01
gagcggcaaggcc

SEQ ID NO: 3457055 - RNA, 22 nt, Pseudomonas aeruginosa PA01
gagcggcaccucgauggcggcg

SEQ ID NO: 3457056 - RNA, 14 nt, Pseudomonas aeruginosa PA01
gagcggcaggccgc

SEQ ID NO: 3457057 - RNA, 13 nt, Pseudomonas aeruginosa PA01
gagcggcccgcgg

SEQ ID NO: 3457058 - RNA, 12 nt, Pseudomonas aeruginosa PA01
gagcggccggcg

SEQ ID NO: 3457059 - RNA, 21 nt, Pseudomonas aeruginosa PA01
gagcggccugagcugccgcuu

SEQ ID NO: 3457060 - RNA, 12 nt, Pseudomonas aeruginosa PA01
gagcggcgccag

SEQ ID NO: 3457061 - RNA, 15 nt, Pseudomonas aeruginosa PA01
gagcggcgccaggcg

SEQ ID NO: 3457062 - RNA, 13 nt, Pseudomonas aeruginosa PA01
gagcggcggccgu

SEQ ID NO: 3457063 - RNA, 15 nt, Pseudomonas aeruginosa PA01
gagcggcggccgucg

SEQ ID NO: 3457064 - RNA, 12 nt, Pseudomonas aeruginosa PA01
gagcggcugccg

SEQ ID NO: 3457065 - RNA, 15 nt, Pseudomonas aeruginosa PA01
gagcggcugccgagg

SEQ ID NO: 3457066 - RNA, 16 nt, Pseudomonas aeruginosa PA01
gagcggcugguggccg

SEQ ID NO: 3457067 - RNA, 15 nt, Pseudomonas aeruginosa PA01
gagcgggccguuggc

SEQ ID NO: 3457068 - RNA, 13 nt, Pseudomonas aeruginosa PA01
gagcgggcgaggg

SEQ ID NO: 3457069 - RNA, 16 nt, Pseudomonas aeruginosa PA01
gagcggguagcgccgg

SEQ ID NO: 3457070 - RNA, 17 nt, Pseudomonas aeruginosa PA01
gagcggguagcgccggu

SEQ ID NO: 3457071 - RNA, 17 nt, Pseudomonas aeruginosa PA01
gagcgggucagcagcac

SEQ ID NO: 3457072 - RNA, 14 nt, Pseudomonas aeruginosa PA01
gagcgggucgaugg

SEQ ID NO: 3457073 - RNA, 18 nt, Pseudomonas aeruginosa PA01
gagcgggucgauggcugg

SEQ ID NO: 3457074 - RNA, 20 nt, Pseudomonas aeruginosa PA01
gagcggugaaaccggcaagc

SEQ ID NO: 3457075 - RNA, 18 nt, Pseudomonas aeruginosa PA01
gagcguccaccagcgccc

SEQ ID NO: 3457076 - RNA, 22 nt, Pseudomonas aeruginosa PA01
gagcguccaccagcgcccguag

SEQ ID NO: 3457077 - RNA, 15 nt, Pseudomonas aeruginosa PA01
gagcguccgccgccg

SEQ ID NO: 3457078 - RNA, 16 nt, Pseudomonas aeruginosa PA01
gagcguccgccgccgu

SEQ ID NO: 3457079 - RNA, 16 nt, Pseudomonas aeruginosa PA01
gagcgucgagucgcgc

SEQ ID NO: 3457080 - RNA, 17 nt, Pseudomonas aeruginosa PA01
gagcgugacccgcgcuu

SEQ ID NO: 3457081 - RNA, 13 nt, Pseudomonas aeruginosa PA01
gagcgugcggccg

SEQ ID NO: 3457082 - RNA, 13 nt, Pseudomonas aeruginosa PA01
gagcguuccauga

SEQ ID NO: 3457083 - RNA, 18 nt, Pseudomonas aeruginosa PA01
gagcguucggaucggccc

SEQ ID NO: 3457084 - RNA, 14 nt, Pseudomonas aeruginosa PA01
gagcuaauccggcg

SEQ ID NO: 3457085 - RNA, 23 nt, Pseudomonas aeruginosa PA01
gagcuaguuauugaaguggugau

SEQ ID NO: 3457086 - RNA, 23 nt, Pseudomonas aeruginosa PA01
gagcuccagggcugccaccgagg

SEQ ID NO: 3457087 - RNA, 14 nt, Pseudomonas aeruginosa PA01
gagcucccugccgc

SEQ ID NO: 3457088 - RNA, 12 nt, Pseudomonas aeruginosa PA01
gagcucggccag

SEQ ID NO: 3457089 - RNA, 16 nt, Pseudomonas aeruginosa PA01
gagcucggccaggcac

SEQ ID NO: 3457090 - RNA, 14 nt, Pseudomonas aeruginosa PA01
gaggaugucggcga

SEQ ID NO: 3457091 - RNA, 15 nt, Pseudomonas aeruginosa PA01
gaggauucagcagga

SEQ ID NO: 3457092 - RNA, 16 nt, Pseudomonas aeruginosa PA01
gaggauuuccgcgccc

SEQ ID NO: 3457093 - RNA, 23 nt, Pseudomonas aeruginosa PA01
gaggauuuccggcuugccgaugu

SEQ ID NO: 3457094 - RNA, 13 nt, Pseudomonas aeruginosa PA01
gaggcagguggcg

SEQ ID NO: 3457095 - RNA, 19 nt, Pseudomonas aeruginosa PA01
gaggcauucaucaccagcu

SEQ ID NO: 3457096 - RNA, 16 nt, Pseudomonas aeruginosa PA01
gaggcauucucgcgac

SEQ ID NO: 3457097 - RNA, 19 nt, Pseudomonas aeruginosa PA01
gaggcauugcacaacgggu

SEQ ID NO: 3457098 - RNA, 11 nt, Pseudomonas aeruginosa PA01
gaggccagcag

SEQ ID NO: 3457099 - RNA, 13 nt, Pseudomonas aeruginosa PA01
gaggccagcagca

SEQ ID NO: 3457100 - RNA, 13 nt, Pseudomonas aeruginosa PA01
gaggccagcaggc

SEQ ID NO: 3457101 - RNA, 16 nt, Pseudomonas aeruginosa PA01
gaggccagcaggccgu

SEQ ID NO: 3457102 - RNA, 20 nt, Pseudomonas aeruginosa PA01
gaggccaggaucgucggccc

SEQ ID NO: 3457103 - RNA, 20 nt, Pseudomonas aeruginosa PA01
gaggccaggccgagcgccag

SEQ ID NO: 3457104 - RNA, 19 nt, Pseudomonas aeruginosa PA01
gaggcccacgggcggccga

SEQ ID NO: 3457105 - RNA, 19 nt, Pseudomonas aeruginosa PA01
gaggcccagcgacuccgcc

SEQ ID NO: 3457106 - RNA, 17 nt, Pseudomonas aeruginosa PA01
gaggcccaucaggaugc

SEQ ID NO: 3457107 - RNA, 17 nt, Pseudomonas aeruginosa PA01
gaggcccguauggcggg

SEQ ID NO: 3457108 - RNA, 15 nt, Pseudomonas aeruginosa PA01
gaggcccucggcgcc

SEQ ID NO: 3457109 - RNA, 16 nt, Pseudomonas aeruginosa PA01
gaggcccucggcgccg

SEQ ID NO: 3457110 - RNA, 17 nt, Pseudomonas aeruginosa PA01
gaggcccucggcggcga

SEQ ID NO: 3457111 - RNA, 17 nt, Pseudomonas aeruginosa PA01
gaggccgaaauggcggu

SEQ ID NO: 3457112 - RNA, 19 nt, Pseudomonas aeruginosa PA01
gaggccgaaauggcggugg

SEQ ID NO: 3457113 - RNA, 22 nt, Pseudomonas aeruginosa PA01
gaggccgaaauggcgguggccg

SEQ ID NO: 3457114 - RNA, 16 nt, Pseudomonas aeruginosa PA01
gaggccgaccuugucc

SEQ ID NO: 3457115 - RNA, 17 nt, Pseudomonas aeruginosa PA01
gaggccgaccuugucca

SEQ ID NO: 3457116 - RNA, 23 nt, Pseudomonas aeruginosa PA01
gaggccgacgaacagccagaggu

SEQ ID NO: 3457117 - RNA, 16 nt, Pseudomonas aeruginosa PA01
gaggccgcccagcgca

SEQ ID NO: 3457118 - RNA, 18 nt, Pseudomonas aeruginosa PA01
gaggccgcccagcgcagc

SEQ ID NO: 3457119 - RNA, 19 nt, Pseudomonas aeruginosa PA01
gaggccgcccagcgcagcc

SEQ ID NO: 3457120 - RNA, 21 nt, Pseudomonas aeruginosa PA01
gaggccgcccagcgcagccug

SEQ ID NO: 3457121 - RNA, 13 nt, Pseudomonas aeruginosa PA01
gaggccgcccugg

SEQ ID NO: 3457122 - RNA, 19 nt, Pseudomonas aeruginosa PA01
gaggccgcccuggccgagc

SEQ ID NO: 3457123 - RNA, 23 nt, Pseudomonas aeruginosa PA01
gaggccgccgcgggcaaccgcgg

SEQ ID NO: 3457124 - RNA, 22 nt, Pseudomonas aeruginosa PA01
gaggccgcggagcaccgcgccu

SEQ ID NO: 3457125 - RNA, 19 nt, Pseudomonas aeruginosa PA01
gaggccggcaugcaggugg

SEQ ID NO: 3457126 - RNA, 21 nt, Pseudomonas aeruginosa PA01
gaggccggcaugcagguggcg

SEQ ID NO: 3457127 - RNA, 18 nt, Pseudomonas aeruginosa PA01
gaggccggccccaccagc

SEQ ID NO: 3457128 - RNA, 21 nt, Pseudomonas aeruginosa PA01
gaggccggccccaccagcaac

SEQ ID NO: 3457129 - RNA, 18 nt, Pseudomonas aeruginosa PA01
gaggccguaccagucgcc

SEQ ID NO: 3457130 - RNA, 22 nt, Pseudomonas aeruginosa PA01
gaggccguaccagucgcccgcu

SEQ ID NO: 3457131 - RNA, 18 nt, Pseudomonas aeruginosa PA01
gaggccgucgaaguggac

SEQ ID NO: 3457132 - RNA, 20 nt, Pseudomonas aeruginosa PA01
gaggccgucgaaguggacga

SEQ ID NO: 3457133 - RNA, 17 nt, Pseudomonas aeruginosa PA01
gaggccuucgccgacca

SEQ ID NO: 3457134 - RNA, 19 nt, Pseudomonas aeruginosa PA01
gaggccuucgccgaccagg

SEQ ID NO: 3457135 - RNA, 20 nt, Pseudomonas aeruginosa PA01
gaggccuucgccgaccaggu

SEQ ID NO: 3457136 - RNA, 23 nt, Pseudomonas aeruginosa PA01
gaggccuucgccgaccagguccg

SEQ ID NO: 3457137 - RNA, 14 nt, Pseudomonas aeruginosa PA01
gaggccuuucuucu

SEQ ID NO: 3457138 - RNA, 21 nt, Pseudomonas aeruginosa PA01
gaggcgaacggcagguggucg

SEQ ID NO: 3457139 - RNA, 17 nt, Pseudomonas aeruginosa PA01
gaggcgaccagccgggg

SEQ ID NO: 3457140 - RNA, 22 nt, Pseudomonas aeruginosa PA01
gaggcgacccgggucaggccga

SEQ ID NO: 3457141 - RNA, 23 nt, Pseudomonas aeruginosa PA01
gaggcgaggaaaaggaucgccgc

SEQ ID NO: 3457142 - RNA, 15 nt, Pseudomonas aeruginosa PA01
gaggcgaggguggcg

SEQ ID NO: 3457143 - RNA, 16 nt, Pseudomonas aeruginosa PA01
gaggcgaggguggcgc

SEQ ID NO: 3457144 - RNA, 15 nt, Pseudomonas aeruginosa PA01
gaggcgaggucgccg

SEQ ID NO: 3457145 - RNA, 14 nt, Pseudomonas aeruginosa PA01
gaggcgaucgccgc

SEQ ID NO: 3457146 - RNA, 14 nt, Pseudomonas aeruginosa PA01
gaggcgcagcagcg

SEQ ID NO: 3457147 - RNA, 18 nt, Pseudomonas aeruginosa PA01
gaggcgcagcagcgccag

SEQ ID NO: 3457148 - RNA, 19 nt, Pseudomonas aeruginosa PA01
gaggcgcagcagcgccagu

SEQ ID NO: 3457149 - RNA, 12 nt, Pseudomonas aeruginosa PA01
gaggcgcaugga

SEQ ID NO: 3457150 - RNA, 16 nt, Pseudomonas aeruginosa PA01
gaggcgccgaccacga

SEQ ID NO: 3457151 - RNA, 17 nt, Pseudomonas aeruginosa PA01
gaggcgccgcgccaggu

SEQ ID NO: 3457152 - RNA, 17 nt, Pseudomonas aeruginosa PA01
gaggcgcgccgacagca

SEQ ID NO: 3457153 - RNA, 13 nt, Pseudomonas aeruginosa PA01
gaggcgcgcgccg

SEQ ID NO: 3457154 - RNA, 12 nt, Pseudomonas aeruginosa PA01
gaggcgcggcgg

SEQ ID NO: 3457155 - RNA, 22 nt, Pseudomonas aeruginosa PA01
gaggcgcucaacgccucgcggc

SEQ ID NO: 3457156 - RNA, 20 nt, Pseudomonas aeruginosa PA01
gaggcgcuccaccagggccu

SEQ ID NO: 3457157 - RNA, 21 nt, Pseudomonas aeruginosa PA01
gaggcgcucuucacuuccagc

SEQ ID NO: 3457158 - RNA, 14 nt, Pseudomonas aeruginosa PA01
gaggcgcuggccag

SEQ ID NO: 3457159 - RNA, 15 nt, Pseudomonas aeruginosa PA01
gaggcgcuggccagc

SEQ ID NO: 3457160 - RNA, 18 nt, Pseudomonas aeruginosa PA01
gaggcgcuggccagcgcu

SEQ ID NO: 3457161 - RNA, 20 nt, Pseudomonas aeruginosa PA01
gaggcgcuucugcucggccu

SEQ ID NO: 3457162 - RNA, 22 nt, Pseudomonas aeruginosa PA01
gaggcgcuucugcucggccugg

SEQ ID NO: 3457163 - RNA, 18 nt, Pseudomonas aeruginosa PA01
gaggcggauuugccgccg

SEQ ID NO: 3457164 - RNA, 21 nt, Pseudomonas aeruginosa PA01
gaggcggauuugccgccgagg

SEQ ID NO: 3457165 - RNA, 14 nt, Pseudomonas aeruginosa PA01
gaggcggcgcagca

SEQ ID NO: 3457166 - RNA, 16 nt, Pseudomonas aeruginosa PA01
gaggcggucaugcgcc

SEQ ID NO: 3457167 - RNA, 22 nt, Pseudomonas aeruginosa PA01
gaggcggucuuuuugcagggaa

SEQ ID NO: 3457168 - RNA, 15 nt, Pseudomonas aeruginosa PA01
gaggcggugcagcgg

SEQ ID NO: 3457169 - RNA, 23 nt, Pseudomonas aeruginosa PA01
gaggcguaccggcuacaggccgu

SEQ ID NO: 3457170 - RNA, 17 nt, Pseudomonas aeruginosa PA01
gaggcgucgaaacgggc

SEQ ID NO: 3457171 - RNA, 20 nt, Pseudomonas aeruginosa PA01
gaggcgucgaaacgggcgcu

SEQ ID NO: 3457172 - RNA, 21 nt, Pseudomonas aeruginosa PA01
gaggcgucggcccuugugaaa

SEQ ID NO: 3457173 - RNA, 16 nt, Pseudomonas aeruginosa PA01
gaggcgucggcgggaa

SEQ ID NO: 3457174 - RNA, 18 nt, Pseudomonas aeruginosa PA01
gaggcguuauccgccgau

SEQ ID NO: 3457175 - RNA, 19 nt, Pseudomonas aeruginosa PA01
gaggcguuauccgccgaua

SEQ ID NO: 3457176 - RNA, 15 nt, Pseudomonas aeruginosa PA01
gaggcguuccaggug

SEQ ID NO: 3457177 - RNA, 21 nt, Pseudomonas aeruginosa PA01
gaggcguuccaguucggccgc

SEQ ID NO: 3457178 - RNA, 20 nt, Pseudomonas aeruginosa PA01
gaggcguucgaucuccucgc

SEQ ID NO: 3457179 - RNA, 19 nt, Pseudomonas aeruginosa PA01
gaggcuaacgccgaggaua

SEQ ID NO: 3457180 - RNA, 14 nt, Pseudomonas aeruginosa PA01
gaggcucagccgau

SEQ ID NO: 3457181 - RNA, 18 nt, Pseudomonas aeruginosa PA01
gaggcucccagguggaaa

SEQ ID NO: 3457182 - RNA, 15 nt, Pseudomonas aeruginosa PA01
gaggcucggcggcca

SEQ ID NO: 3457183 - RNA, 16 nt, Pseudomonas aeruginosa PA01
gaggcucggcggccau

SEQ ID NO: 3457184 - RNA, 15 nt, Pseudomonas aeruginosa PA01
gaggcucggucgcgc

SEQ ID NO: 3457185 - RNA, 16 nt, Pseudomonas aeruginosa PA01
gaggcugaucugccgg

SEQ ID NO: 3457186 - RNA, 13 nt, Pseudomonas aeruginosa PA01
gaggcugccgaag

SEQ ID NO: 3457187 - RNA, 15 nt, Pseudomonas aeruginosa PA01
gaggcugcgcuccag

SEQ ID NO: 3457188 - RNA, 19 nt, Pseudomonas aeruginosa PA01
gaggcugcgcuccaggcgg

SEQ ID NO: 3457189 - RNA, 13 nt, Pseudomonas aeruginosa PA01
gaggcuggccagc

SEQ ID NO: 3457190 - RNA, 14 nt, Pseudomonas aeruginosa PA01
gaggcuggcgaccg

SEQ ID NO: 3457191 - RNA, 12 nt, Pseudomonas aeruginosa PA01
gaggcuggcgcu

SEQ ID NO: 3457192 - RNA, 13 nt, Pseudomonas aeruginosa PA01
gaggucgacggcg

SEQ ID NO: 3457193 - RNA, 16 nt, Pseudomonas aeruginosa PA01
gaggucgacggcggcc

SEQ ID NO: 3457194 - RNA, 17 nt, Pseudomonas aeruginosa PA01
gaggucgacggcggccg

SEQ ID NO: 3457195 - RNA, 17 nt, Pseudomonas aeruginosa PA01
gaggucgcacgcagcgc

SEQ ID NO: 3457196 - RNA, 16 nt, Pseudomonas aeruginosa PA01
gaggucgccgccagcu

SEQ ID NO: 3457197 - RNA, 21 nt, Pseudomonas aeruginosa PA01
gaggucgccgccagcuaccgg

SEQ ID NO: 3457198 - RNA, 20 nt, Pseudomonas aeruginosa PA01
gaggucggcaaagccgcugu

SEQ ID NO: 3457199 - RNA, 13 nt, Pseudomonas aeruginosa PA01
gaggucggccugg

SEQ ID NO: 3457200 - RNA, 14 nt, Pseudomonas aeruginosa PA01
gaggucggccuggc

SEQ ID NO: 3457201 - RNA, 19 nt, Pseudomonas aeruginosa PA01
gaggucggccuggcugccg

SEQ ID NO: 3457202 - RNA, 12 nt, Pseudomonas aeruginosa PA01
gaggucggcgcg

SEQ ID NO: 3457203 - RNA, 13 nt, Pseudomonas aeruginosa PA01
gaggucggcgcgc

SEQ ID NO: 3457204 - RNA, 14 nt, Pseudomonas aeruginosa PA01
gaggucggcgcgcc

SEQ ID NO: 3457205 - RNA, 15 nt, Pseudomonas aeruginosa PA01
gaggucguccaccuc

SEQ ID NO: 3457206 - RNA, 23 nt, Pseudomonas aeruginosa PA01
gaggucguccaccuccaccuugc

SEQ ID NO: 3457207 - RNA, 15 nt, Pseudomonas aeruginosa PA01
gaggucuuggccagc

SEQ ID NO: 3457208 - RNA, 18 nt, Pseudomonas aeruginosa PA01
gaggucuuggccagccgc

SEQ ID NO: 3457209 - RNA, 15 nt, Pseudomonas aeruginosa PA01
gaggugcggcugccg

SEQ ID NO: 3457210 - RNA, 17 nt, Pseudomonas aeruginosa PA01
gagguggaugaacagcg

SEQ ID NO: 3457211 - RNA, 19 nt, Pseudomonas aeruginosa PA01
gaggugggcgcgccgcagu

SEQ ID NO: 3457212 - RNA, 13 nt, Pseudomonas aeruginosa PA01
gaggugucgccgc

SEQ ID NO: 3457213 - RNA, 16 nt, Pseudomonas aeruginosa PA01
gaggugucgccgcgga

SEQ ID NO: 3457214 - RNA, 17 nt, Pseudomonas aeruginosa PA01
gagguucaggccgggca

SEQ ID NO: 3457215 - RNA, 18 nt, Pseudomonas aeruginosa PA01
gagguuccgcggcgacgg

SEQ ID NO: 3457216 - RNA, 17 nt, Pseudomonas aeruginosa PA01
gagguucuccacuucca

SEQ ID NO: 3457217 - RNA, 16 nt, Pseudomonas aeruginosa PA01
gagguucuugcccagc

SEQ ID NO: 3457218 - RNA, 20 nt, Pseudomonas aeruginosa PA01
gagguucuugcccagcaacg

SEQ ID NO: 3457219 - RNA, 21 nt, Pseudomonas aeruginosa PA01
gagguucuugcccagcaacgc

SEQ ID NO: 3457220 - RNA, 20 nt, Pseudomonas aeruginosa PA01
gagguugauucaggcggcga

SEQ ID NO: 3457221 - RNA, 21 nt, Pseudomonas aeruginosa PA01
gagguugccgccgaucagcgc

SEQ ID NO: 3457222 - RNA, 14 nt, Pseudomonas aeruginosa PA01
gaguaccgcugcgg

SEQ ID NO: 3457223 - RNA, 18 nt, Pseudomonas aeruginosa PA01
gaguaccgcugcggccgg

SEQ ID NO: 3457224 - RNA, 20 nt, Pseudomonas aeruginosa PA01
gaguaccgcugcggccggcg

SEQ ID NO: 3457225 - RNA, 20 nt, Pseudomonas aeruginosa PA01
gaguacucggcuacgaaccg

SEQ ID NO: 3457226 - RNA, 19 nt, Pseudomonas aeruginosa PA01
gaguagcugaagcugucgc

SEQ ID NO: 3457227 - RNA, 13 nt, Pseudomonas aeruginosa PA01
gaguaguuucuga

SEQ ID NO: 3457228 - RNA, 16 nt, Pseudomonas aeruginosa PA01
gagucaacgccuggcc

SEQ ID NO: 3457229 - RNA, 22 nt, Pseudomonas aeruginosa PA01
gagucaacgccuggccacgcca

SEQ ID NO: 3457230 - RNA, 10 nt, Pseudomonas aeruginosa PA01
gaguccaggu

SEQ ID NO: 3457231 - RNA, 18 nt, Pseudomonas aeruginosa PA01
gaguccaugcucaggucg

SEQ ID NO: 3457232 - RNA, 18 nt, Pseudomonas aeruginosa PA01
gaguccccuaggggacgc

SEQ ID NO: 3457233 - RNA, 20 nt, Pseudomonas aeruginosa PA01
gagucccguccgcugcgcca

SEQ ID NO: 3457234 - RNA, 18 nt, Pseudomonas aeruginosa PA01
gaguccgacccgcuccgg

SEQ ID NO: 3457235 - RNA, 12 nt, Pseudomonas aeruginosa PA01
gaguccgccagc

SEQ ID NO: 3457236 - RNA, 15 nt, Pseudomonas aeruginosa PA01
gaguccgccagccgg

SEQ ID NO: 3457237 - RNA, 21 nt, Pseudomonas aeruginosa PA01
gaguccgcgcgcgcgcuccuc

SEQ ID NO: 3457238 - RNA, 22 nt, Pseudomonas aeruginosa PA01
gaguccuuguccagggccggau

SEQ ID NO: 3457239 - RNA, 19 nt, Pseudomonas aeruginosa PA01
gagucgaucaggucgccgc

SEQ ID NO: 3457240 - RNA, 13 nt, Pseudomonas aeruginosa PA01
gagucgccggcga

SEQ ID NO: 3457241 - RNA, 15 nt, Pseudomonas aeruginosa PA01
gagucgcgcagccag

SEQ ID NO: 3457242 - RNA, 15 nt, Pseudomonas aeruginosa PA01
gagucgcucgcgcag

SEQ ID NO: 3457243 - RNA, 17 nt, Pseudomonas aeruginosa PA01
gagucgcucgcgcaggu

SEQ ID NO: 3457244 - RNA, 19 nt, Pseudomonas aeruginosa PA01
gagucggcaacgauaccgc

SEQ ID NO: 3457245 - RNA, 21 nt, Pseudomonas aeruginosa PA01
gagugccgcggaauggcgcgc

SEQ ID NO: 3457246 - RNA, 14 nt, Pseudomonas aeruginosa PA01
gagugcgcccagca

SEQ ID NO: 3457247 - RNA, 20 nt, Pseudomonas aeruginosa PA01
gaguggccgcgccccacggc

SEQ ID NO: 3457248 - RNA, 19 nt, Pseudomonas aeruginosa PA01
gaguggccgcugagcagca

SEQ ID NO: 3457249 - RNA, 21 nt, Pseudomonas aeruginosa PA01
gaguggcgaagccagcacggu

SEQ ID NO: 3457250 - RNA, 16 nt, Pseudomonas aeruginosa PA01
gaguggcgcagcgccc

SEQ ID NO: 3457251 - RNA, 23 nt, Pseudomonas aeruginosa PA01
gaguggcgcagcgcccgauaggc

SEQ ID NO: 3457252 - RNA, 14 nt, Pseudomonas aeruginosa PA01
gagugggaugacga

SEQ ID NO: 3457253 - RNA, 23 nt, Pseudomonas aeruginosa PA01
gaguguucccucaggauagccgg

SEQ ID NO: 3457254 - RNA, 19 nt, Pseudomonas aeruginosa PA01
gaguucccagaccuggccg

SEQ ID NO: 3457255 - RNA, 21 nt, Pseudomonas aeruginosa PA01
gaguucccagaccuggccgcu

SEQ ID NO: 3457256 - RNA, 12 nt, Pseudomonas aeruginosa PA01
gaguuccgcgca

SEQ ID NO: 3457257 - RNA, 18 nt, Pseudomonas aeruginosa PA01
gaguucgaagcgccaggc

SEQ ID NO: 3457258 - RNA, 14 nt, Pseudomonas aeruginosa PA01
gaguucgacccaug

SEQ ID NO: 3457259 - RNA, 15 nt, Pseudomonas aeruginosa PA01
gaguucgcccagcuc

SEQ ID NO: 3457260 - RNA, 23 nt, Pseudomonas aeruginosa PA01
gaguucgcccagcucgccgcucc

SEQ ID NO: 3457261 - RNA, 16 nt, Pseudomonas aeruginosa PA01
gaguucgcccgcccca

SEQ ID NO: 3457262 - RNA, 20 nt, Pseudomonas aeruginosa PA01
gaguucgcgcgggucgucga

SEQ ID NO: 3457263 - RNA, 19 nt, Pseudomonas aeruginosa PA01
gaguucgcugaggacugcc

SEQ ID NO: 3457264 - RNA, 14 nt, Pseudomonas aeruginosa PA01
gaguucggcgagca

SEQ ID NO: 3457265 - RNA, 14 nt, Pseudomonas aeruginosa PA01
gaguucggcugcgu

SEQ ID NO: 3457266 - RNA, 20 nt, Pseudomonas aeruginosa PA01
gaguucgucaaccagcaccg

SEQ ID NO: 3457267 - RNA, 22 nt, Pseudomonas aeruginosa PA01
gaguucgucaaccagcaccgca

SEQ ID NO: 3457268 - RNA, 14 nt, Pseudomonas aeruginosa PA01
gaguugaccagcau

SEQ ID NO: 3457269 - RNA, 14 nt, Pseudomonas aeruginosa PA01
gaguugcaggccgg

SEQ ID NO: 3457270 - RNA, 23 nt, Pseudomonas aeruginosa PA01
gaguugcagggcuugugcagaga

SEQ ID NO: 3457271 - RNA, 18 nt, Pseudomonas aeruginosa PA01
gaguugccuguccagcuc

SEQ ID NO: 3457272 - RNA, 23 nt, Pseudomonas aeruginosa PA01
gaguuucaucucggcgcaggcau

SEQ ID NO: 3457273 - RNA, 13 nt, Pseudomonas aeruginosa PA01
gauaaaaaggccc

SEQ ID NO: 3457274 - RNA, 12 nt, Pseudomonas aeruginosa PA01
gauaaaauccac

SEQ ID NO: 3457275 - RNA, 16 nt, Pseudomonas aeruginosa PA01
gauaacaccaggagcg

SEQ ID NO: 3457276 - RNA, 22 nt, Pseudomonas aeruginosa PA01
gauaacaccaggagcgccagca

SEQ ID NO: 3457277 - RNA, 13 nt, Pseudomonas aeruginosa PA01
gauaaccgcaagc

SEQ ID NO: 3457278 - RNA, 14 nt, Pseudomonas aeruginosa PA01
gauaacgccaggac

SEQ ID NO: 3457279 - RNA, 16 nt, Pseudomonas aeruginosa PA01
gauaacgccgcuggcg

SEQ ID NO: 3457280 - RNA, 12 nt, Pseudomonas aeruginosa PA01
gauaacgccugu

SEQ ID NO: 3457281 - RNA, 17 nt, Pseudomonas aeruginosa PA01
gauaacguccgcgucau

SEQ ID NO: 3457282 - RNA, 13 nt, Pseudomonas aeruginosa PA01
gauaagccgcgcc

SEQ ID NO: 3457283 - RNA, 17 nt, Pseudomonas aeruginosa PA01
gauaagccgcgccaucg

SEQ ID NO: 3457284 - RNA, 18 nt, Pseudomonas aeruginosa PA01
gauaaucgcagcgcgguc

SEQ ID NO: 3457285 - RNA, 14 nt, Pseudomonas aeruginosa PA01
gauacaccagguug

SEQ ID NO: 3457286 - RNA, 19 nt, Pseudomonas aeruginosa PA01
gauacaccagguuggccag

SEQ ID NO: 3457287 - RNA, 20 nt, Pseudomonas aeruginosa PA01
gauacaccagguuggccagu

SEQ ID NO: 3457288 - RNA, 12 nt, Pseudomonas aeruginosa PA01
gauacagcagcc

SEQ ID NO: 3457289 - RNA, 14 nt, Pseudomonas aeruginosa PA01
gauacaggcgcagc

SEQ ID NO: 3457290 - RNA, 15 nt, Pseudomonas aeruginosa PA01
gauacaggcgcagca

SEQ ID NO: 3457291 - RNA, 21 nt, Pseudomonas aeruginosa PA01
gauacaucguucauguagcgc

SEQ ID NO: 3457292 - RNA, 14 nt, Pseudomonas aeruginosa PA01
gauaccacccgcag

SEQ ID NO: 3457293 - RNA, 17 nt, Pseudomonas aeruginosa PA01
gauaccagaucaccacc

SEQ ID NO: 3457294 - RNA, 14 nt, Pseudomonas aeruginosa PA01
gauaccagcgccgc

SEQ ID NO: 3457295 - RNA, 23 nt, Pseudomonas aeruginosa PA01
gaucaccucgaaccccuggcgcu

SEQ ID NO: 3457296 - RNA, 12 nt, Pseudomonas aeruginosa PA01
gaucaccugcuu

SEQ ID NO: 3457297 - RNA, 20 nt, Pseudomonas aeruginosa PA01
gaucaccugcuucugguugc

SEQ ID NO: 3457298 - RNA, 15 nt, Pseudomonas aeruginosa PA01
gaucaccuggaucgc

SEQ ID NO: 3457299 - RNA, 18 nt, Pseudomonas aeruginosa PA01
gaucaccuucaccggcac

SEQ ID NO: 3457300 - RNA, 16 nt, Pseudomonas aeruginosa PA01
gaucaccuugcccucg

SEQ ID NO: 3457301 - RNA, 23 nt, Pseudomonas aeruginosa PA01
gaucaccuuguacggcagcggcg

SEQ ID NO: 3457302 - RNA, 16 nt, Pseudomonas aeruginosa PA01
gaucacgaacagcuug

SEQ ID NO: 3457303 - RNA, 16 nt, Pseudomonas aeruginosa PA01
gaucacgaucggcacc

SEQ ID NO: 3457304 - RNA, 20 nt, Pseudomonas aeruginosa PA01
gaucacgauggccggcagca

SEQ ID NO: 3457305 - RNA, 22 nt, Pseudomonas aeruginosa PA01
gaucacgcaagugcccugggcg

SEQ ID NO: 3457306 - RNA, 12 nt, Pseudomonas aeruginosa PA01
gaucacgcagca

SEQ ID NO: 3457307 - RNA, 13 nt, Pseudomonas aeruginosa PA01
gaucacgccgaag

SEQ ID NO: 3457308 - RNA, 15 nt, Pseudomonas aeruginosa PA01
gaucacgccgcgcac

SEQ ID NO: 3457309 - RNA, 21 nt, Pseudomonas aeruginosa PA01
gaucacgccgcgcaccagcac

SEQ ID NO: 3457310 - RNA, 11 nt, Pseudomonas aeruginosa PA01
gaucacgcuga

SEQ ID NO: 3457311 - RNA, 15 nt, Pseudomonas aeruginosa PA01
gaucacggcgccccg

SEQ ID NO: 3457312 - RNA, 17 nt, Pseudomonas aeruginosa PA01
gaucacggcgccccggg

SEQ ID NO: 3457313 - RNA, 21 nt, Pseudomonas aeruginosa PA01
gaucacggugaugguaucgcc

SEQ ID NO: 3457314 - RNA, 20 nt, Pseudomonas aeruginosa PA01
gaucacguagaugccggugc

SEQ ID NO: 3457315 - RNA, 20 nt, Pseudomonas aeruginosa PA01
gaucacguaggacaggucgg

SEQ ID NO: 3457316 - RNA, 16 nt, Pseudomonas aeruginosa PA01
gaucacguccagguug

SEQ ID NO: 3457317 - RNA, 19 nt, Pseudomonas aeruginosa PA01
gaucacguccuugaccacg

SEQ ID NO: 3457318 - RNA, 21 nt, Pseudomonas aeruginosa PA01
gaucacgucguacucggcggg

SEQ ID NO: 3457319 - RNA, 14 nt, Pseudomonas aeruginosa PA01
gaucacucgccgcc

SEQ ID NO: 3457320 - RNA, 15 nt, Pseudomonas aeruginosa PA01
gaucacucgccgccg

SEQ ID NO: 3457321 - RNA, 16 nt, Pseudomonas aeruginosa PA01
gaucacucgccgccgu

SEQ ID NO: 3457322 - RNA, 16 nt, Pseudomonas aeruginosa PA01
gaucagcaccagcgga

SEQ ID NO: 3457323 - RNA, 11 nt, Pseudomonas aeruginosa PA01
gaucagcaccc

SEQ ID NO: 3457324 - RNA, 19 nt, Pseudomonas aeruginosa PA01
gaucagcacccggucggcc

SEQ ID NO: 3457325 - RNA, 14 nt, Pseudomonas aeruginosa PA01
gaucagcaccgcca

SEQ ID NO: 3457326 - RNA, 17 nt, Pseudomonas aeruginosa PA01
gaucagcaccgccacca

SEQ ID NO: 3457327 - RNA, 21 nt, Pseudomonas aeruginosa PA01
gaucagcaccgccaccagcga

SEQ ID NO: 3457328 - RNA, 15 nt, Pseudomonas aeruginosa PA01
gaucagcagcagcgc

SEQ ID NO: 3457329 - RNA, 14 nt, Pseudomonas aeruginosa PA01
gaucagcagcgcca

SEQ ID NO: 3457330 - RNA, 16 nt, Pseudomonas aeruginosa PA01
gaucagcagcgccacg

SEQ ID NO: 3457331 - RNA, 20 nt, Pseudomonas aeruginosa PA01
gaucagcagcgccacgcuga

SEQ ID NO: 3457332 - RNA, 19 nt, Pseudomonas aeruginosa PA01
gaucagcaggaugcagucg

SEQ ID NO: 3457333 - RNA, 22 nt, Pseudomonas aeruginosa PA01
gaucagccacgggcgccagcgg

SEQ ID NO: 3457334 - RNA, 16 nt, Pseudomonas aeruginosa PA01
gaucagccagccggcg

SEQ ID NO: 3457335 - RNA, 17 nt, Pseudomonas aeruginosa PA01
gaucagccagccggcga

SEQ ID NO: 3457336 - RNA, 14 nt, Pseudomonas aeruginosa PA01
gaucagccagggca

SEQ ID NO: 3457337 - RNA, 23 nt, Pseudomonas aeruginosa PA01
gaucagccagggcaacgccaggc

SEQ ID NO: 3457338 - RNA, 19 nt, Pseudomonas aeruginosa PA01
gaucagccauuggccgacg

SEQ ID NO: 3457339 - RNA, 20 nt, Pseudomonas aeruginosa PA01
gaucagccauuggccgacgc

SEQ ID NO: 3457340 - RNA, 17 nt, Pseudomonas aeruginosa PA01
gaucagcccgccaacgu

SEQ ID NO: 3457341 - RNA, 16 nt, Pseudomonas aeruginosa PA01
gaucagcccgcugacc

SEQ ID NO: 3457342 - RNA, 18 nt, Pseudomonas aeruginosa PA01
gaucagcccgcugaccgg

SEQ ID NO: 3457343 - RNA, 21 nt, Pseudomonas aeruginosa PA01
gaucagcccgcugaccgggcg

SEQ ID NO: 3457344 - RNA, 22 nt, Pseudomonas aeruginosa PA01
gaucagcccgcugaccgggcgg

SEQ ID NO: 3457345 - RNA, 16 nt, Pseudomonas aeruginosa PA01
gaucagcccgucggcc

SEQ ID NO: 3457346 - RNA, 20 nt, Pseudomonas aeruginosa PA01
gaucagcccuucgcgcucga

SEQ ID NO: 3457347 - RNA, 22 nt, Pseudomonas aeruginosa PA01
gaucagcccuucgcgcucgacg

SEQ ID NO: 3457348 - RNA, 15 nt, Pseudomonas aeruginosa PA01
gaucagccgcaggca

SEQ ID NO: 3457349 - RNA, 20 nt, Pseudomonas aeruginosa PA01
gaucagccggcccauccgcc

SEQ ID NO: 3457350 - RNA, 23 nt, Pseudomonas aeruginosa PA01
gaucagccggcccauccgccgca

SEQ ID NO: 3457351 - RNA, 14 nt, Pseudomonas aeruginosa PA01
gaucagccggcgcg

SEQ ID NO: 3457352 - RNA, 16 nt, Pseudomonas aeruginosa PA01
gaucagccggcgcgcu

SEQ ID NO: 3457353 - RNA, 18 nt, Pseudomonas aeruginosa PA01
gaucagccgggcgugucg

SEQ ID NO: 3457354 - RNA, 19 nt, Pseudomonas aeruginosa PA01
gaucagcgaaauggucacc

SEQ ID NO: 3457355 - RNA, 20 nt, Pseudomonas aeruginosa PA01
gaucagcgagagcuguccgg

SEQ ID NO: 3457356 - RNA, 19 nt, Pseudomonas aeruginosa PA01
gaucagcgagcuucgccgc

SEQ ID NO: 3457357 - RNA, 21 nt, Pseudomonas aeruginosa PA01
gaucagcgagcuucgccgcgc

SEQ ID NO: 3457358 - RNA, 16 nt, Pseudomonas aeruginosa PA01
gaucagcgcccggcac

SEQ ID NO: 3457359 - RNA, 19 nt, Pseudomonas aeruginosa PA01
gaucagcgcccggcacgcu

SEQ ID NO: 3457360 - RNA, 14 nt, Pseudomonas aeruginosa PA01
gaucagcgccucga

SEQ ID NO: 3457361 - RNA, 19 nt, Pseudomonas aeruginosa PA01
gaucagcgccucgaccucg

SEQ ID NO: 3457362 - RNA, 19 nt, Pseudomonas aeruginosa PA01
gaucagcggaccggugaga

SEQ ID NO: 3457363 - RNA, 19 nt, Pseudomonas aeruginosa PA01
gaucagcggcccgagcagg

SEQ ID NO: 3457364 - RNA, 11 nt, Pseudomonas aeruginosa PA01
gaucagcggcg

SEQ ID NO: 3457365 - RNA, 13 nt, Pseudomonas aeruginosa PA01
gaucagcggcggg

SEQ ID NO: 3457366 - RNA, 14 nt, Pseudomonas aeruginosa PA01
gaucagcggcgguc

SEQ ID NO: 3457367 - RNA, 13 nt, Pseudomonas aeruginosa PA01
gaucagcgggcgg

SEQ ID NO: 3457368 - RNA, 17 nt, Pseudomonas aeruginosa PA01
gaucagcucguugcccg

SEQ ID NO: 3457369 - RNA, 20 nt, Pseudomonas aeruginosa PA01
gaucagcucguugcccggcu

SEQ ID NO: 3457370 - RNA, 14 nt, Pseudomonas aeruginosa PA01
gaucagcuucagcu

SEQ ID NO: 3457371 - RNA, 16 nt, Pseudomonas aeruginosa PA01
gaucagcuucagcucc

SEQ ID NO: 3457372 - RNA, 18 nt, Pseudomonas aeruginosa PA01
gaucagcuucucuuucac

SEQ ID NO: 3457373 - RNA, 20 nt, Pseudomonas aeruginosa PA01
gaucagcuucucuuucaccu

SEQ ID NO: 3457374 - RNA, 22 nt, Pseudomonas aeruginosa PA01
gaucagcuucuucagcagcggg

SEQ ID NO: 3457375 - RNA, 16 nt, Pseudomonas aeruginosa PA01
gaucagcuuguggucg

SEQ ID NO: 3457376 - RNA, 22 nt, Pseudomonas aeruginosa PA01
gaucagcuuguggucguggcgg

SEQ ID NO: 3457377 - RNA, 11 nt, Pseudomonas aeruginosa PA01
gaucaggaaau

SEQ ID NO: 3457378 - RNA, 14 nt, Pseudomonas aeruginosa PA01
gaucaggaacaccc

SEQ ID NO: 3457379 - RNA, 17 nt, Pseudomonas aeruginosa PA01
gaucaggaacacccggu

SEQ ID NO: 3457380 - RNA, 17 nt, Pseudomonas aeruginosa PA01
gaucaggaagguccagg

SEQ ID NO: 3457381 - RNA, 16 nt, Pseudomonas aeruginosa PA01
gaucaggacgaugaag

SEQ ID NO: 3457382 - RNA, 18 nt, Pseudomonas aeruginosa PA01
gaucaggcagcgcgcggc

SEQ ID NO: 3457383 - RNA, 19 nt, Pseudomonas aeruginosa PA01
gaucaggccgagcaccggc

SEQ ID NO: 3457384 - RNA, 13 nt, Pseudomonas aeruginosa PA01
gaucaggccgaug

SEQ ID NO: 3457385 - RNA, 16 nt, Pseudomonas aeruginosa PA01
gaucaggccgaugcgc

SEQ ID NO: 3457386 - RNA, 14 nt, Pseudomonas aeruginosa PA01
gaucaggccggcgu

SEQ ID NO: 3457387 - RNA, 17 nt, Pseudomonas aeruginosa PA01
gaucaggccuuccggga

SEQ ID NO: 3457388 - RNA, 20 nt, Pseudomonas aeruginosa PA01
gaucaggcgcaugcccaggg

SEQ ID NO: 3457389 - RNA, 11 nt, Pseudomonas aeruginosa PA01
gaucaggcgcu

SEQ ID NO: 3457390 - RNA, 22 nt, Pseudomonas aeruginosa PA01
gaucaggcgggcuccgccgccg

SEQ ID NO: 3457391 - RNA, 17 nt, Pseudomonas aeruginosa PA01
gaucaggcguaggccgu

SEQ ID NO: 3457392 - RNA, 22 nt, Pseudomonas aeruginosa PA01
gaucaggcguaggccgucgcug

SEQ ID NO: 3457393 - RNA, 12 nt, Pseudomonas aeruginosa PA01
gaucaggcucga

SEQ ID NO: 3457394 - RNA, 16 nt, Pseudomonas aeruginosa PA01
gaucaggcuguccacg

SEQ ID NO: 3457395 - RNA, 19 nt, Pseudomonas aeruginosa PA01
gaucaggcuguccacgccg

SEQ ID NO: 3457396 - RNA, 15 nt, Pseudomonas aeruginosa PA01
gaucagggcaccgcc

SEQ ID NO: 3457397 - RNA, 14 nt, Pseudomonas aeruginosa PA01
gaucagggccucgc

SEQ ID NO: 3457398 - RNA, 20 nt, Pseudomonas aeruginosa PA01
gauccgcuccagcgccucga

SEQ ID NO: 3457399 - RNA, 17 nt, Pseudomonas aeruginosa PA01
gauccgcuccaggcugu

SEQ ID NO: 3457400 - RNA, 20 nt, Pseudomonas aeruginosa PA01
gauccgcucgaucccggcgc

SEQ ID NO: 3457401 - RNA, 16 nt, Pseudomonas aeruginosa PA01
gauccgcugggccuug

SEQ ID NO: 3457402 - RNA, 22 nt, Pseudomonas aeruginosa PA01
gauccggacuggauucggccug

SEQ ID NO: 3457403 - RNA, 21 nt, Pseudomonas aeruginosa PA01
gauccggccgaucuccuggcg

SEQ ID NO: 3457404 - RNA, 18 nt, Pseudomonas aeruginosa PA01
gauccggguggagaggcg

SEQ ID NO: 3457405 - RNA, 16 nt, Pseudomonas aeruginosa PA01
gauccggugcaggccg

SEQ ID NO: 3457406 - RNA, 17 nt, Pseudomonas aeruginosa PA01
gauccggugcaggccga

SEQ ID NO: 3457407 - RNA, 21 nt, Pseudomonas aeruginosa PA01
gauccggugcaggccgagcug

SEQ ID NO: 3457408 - RNA, 23 nt, Pseudomonas aeruginosa PA01
gauccggugcaggccgagcugcu

SEQ ID NO: 3457409 - RNA, 15 nt, Pseudomonas aeruginosa PA01
gauccguagggcgaa

SEQ ID NO: 3457410 - RNA, 16 nt, Pseudomonas aeruginosa PA01
gauccgugccaggcgc

SEQ ID NO: 3457411 - RNA, 14 nt, Pseudomonas aeruginosa PA01
gauccguggcgagc

SEQ ID NO: 3457412 - RNA, 12 nt, Pseudomonas aeruginosa PA01
gauccuccgcca

SEQ ID NO: 3457413 - RNA, 23 nt, Pseudomonas aeruginosa PA01
gauccuccuggggaaucugcgcc

SEQ ID NO: 3457414 - RNA, 12 nt, Pseudomonas aeruginosa PA01
gauccugacccc

SEQ ID NO: 3457415 - RNA, 16 nt, Pseudomonas aeruginosa PA01
gauccugaccccggcc

SEQ ID NO: 3457416 - RNA, 18 nt, Pseudomonas aeruginosa PA01
gauccugaccccggccug

SEQ ID NO: 3457417 - RNA, 20 nt, Pseudomonas aeruginosa PA01
gauccugaccccggccuggc

SEQ ID NO: 3457418 - RNA, 21 nt, Pseudomonas aeruginosa PA01
gauccugaccguccuggcccu

SEQ ID NO: 3457419 - RNA, 24 nt, Pseudomonas aeruginosa PA01
gauccugcucagcggcccagcgcc

SEQ ID NO: 3457420 - RNA, 12 nt, Pseudomonas aeruginosa PA01
gauccuggccgg

SEQ ID NO: 3457421 - RNA, 13 nt, Pseudomonas aeruginosa PA01
gauccuggccggc

SEQ ID NO: 3457422 - RNA, 14 nt, Pseudomonas aeruginosa PA01
gauccuggccggcg

SEQ ID NO: 3457423 - RNA, 18 nt, Pseudomonas aeruginosa PA01
gauccuggcggcacucca

SEQ ID NO: 3457424 - RNA, 16 nt, Pseudomonas aeruginosa PA01
gaucgaaaaaaggcgc

SEQ ID NO: 3457425 - RNA, 17 nt, Pseudomonas aeruginosa PA01
gaucgaacuggccagca

SEQ ID NO: 3457426 - RNA, 23 nt, Pseudomonas aeruginosa PA01
gaucgaagaagcgcaccaccugc

SEQ ID NO: 3457427 - RNA, 22 nt, Pseudomonas aeruginosa PA01
gaucgaaguagucggcguagcg

SEQ ID NO: 3457428 - RNA, 13 nt, Pseudomonas aeruginosa PA01
gaucgacagcagc

SEQ ID NO: 3457429 - RNA, 14 nt, Pseudomonas aeruginosa PA01
gaucgacagcagcg

SEQ ID NO: 3457430 - RNA, 17 nt, Pseudomonas aeruginosa PA01
gaucgacagcagcgcca

SEQ ID NO: 3457431 - RNA, 17 nt, Pseudomonas aeruginosa PA01
gaucgacaggccgccgu

SEQ ID NO: 3457432 - RNA, 14 nt, Pseudomonas aeruginosa PA01
gaucgaccugccgg

SEQ ID NO: 3457433 - RNA, 17 nt, Pseudomonas aeruginosa PA01
gaucgacgccgcuggcg

SEQ ID NO: 3457434 - RNA, 18 nt, Pseudomonas aeruginosa PA01
gaucgacgccgcuggcgg

SEQ ID NO: 3457435 - RNA, 16 nt, Pseudomonas aeruginosa PA01
gaucgacucgauggcg

SEQ ID NO: 3457436 - RNA, 17 nt, Pseudomonas aeruginosa PA01
gaucgacugcaugaccu

SEQ ID NO: 3457437 - RNA, 21 nt, Pseudomonas aeruginosa PA01
gaucgacugcaugaccuccag

SEQ ID NO: 3457438 - RNA, 13 nt, Pseudomonas aeruginosa PA01
gaucgagacgccg

SEQ ID NO: 3457439 - RNA, 18 nt, Pseudomonas aeruginosa PA01
gaucgagacgccguagcg

SEQ ID NO: 3457440 - RNA, 17 nt, Pseudomonas aeruginosa PA01
gaucgagagcuucucgg

SEQ ID NO: 3457441 - RNA, 21 nt, Pseudomonas aeruginosa PA01
gaucgagcagcggcgccaacu

SEQ ID NO: 3457442 - RNA, 17 nt, Pseudomonas aeruginosa PA01
gaucgagccagcgcucg

SEQ ID NO: 3457443 - RNA, 18 nt, Pseudomonas aeruginosa PA01
gaucgagccagcgcucga

SEQ ID NO: 3457444 - RNA, 23 nt, Pseudomonas aeruginosa PA01
gaucgagccagcgcucgaacgcc

SEQ ID NO: 3457445 - RNA, 14 nt, Pseudomonas aeruginosa PA01
gaucgagcccuggu

SEQ ID NO: 3457446 - RNA, 14 nt, Pseudomonas aeruginosa PA01
gaucgagccgccgg

SEQ ID NO: 3457447 - RNA, 23 nt, Pseudomonas aeruginosa PA01
gaucgaggaauuccggcagcgac

SEQ ID NO: 3457448 - RNA, 15 nt, Pseudomonas aeruginosa PA01
gaucgaggccuaccc

SEQ ID NO: 3457449 - RNA, 13 nt, Pseudomonas aeruginosa PA01
gaucgagucgccg

SEQ ID NO: 3457450 - RNA, 14 nt, Pseudomonas aeruginosa PA01
gaucgagucgccga

SEQ ID NO: 3457451 - RNA, 14 nt, Pseudomonas aeruginosa PA01
gaucgagucgccgg

SEQ ID NO: 3457452 - RNA, 18 nt, Pseudomonas aeruginosa PA01
gaucgagucgccggcgaa

SEQ ID NO: 3457453 - RNA, 12 nt, Pseudomonas aeruginosa PA01
gaucgaucagca

SEQ ID NO: 3457454 - RNA, 14 nt, Pseudomonas aeruginosa PA01
gaucgaucagcagc

SEQ ID NO: 3457455 - RNA, 15 nt, Pseudomonas aeruginosa PA01
gaucgaucagcagca

SEQ ID NO: 3457456 - RNA, 15 nt, Pseudomonas aeruginosa PA01
gaucgaucggcuggu

SEQ ID NO: 3457457 - RNA, 18 nt, Pseudomonas aeruginosa PA01
gaucgaucggcuggucgu

SEQ ID NO: 3457458 - RNA, 18 nt, Pseudomonas aeruginosa PA01
gaucgaucucgucggcgg

SEQ ID NO: 3457459 - RNA, 19 nt, Pseudomonas aeruginosa PA01
gaucgauguuuccgacccg

SEQ ID NO: 3457460 - RNA, 19 nt, Pseudomonas aeruginosa PA01
gaucgcauuguugcggucg

SEQ ID NO: 3457461 - RNA, 13 nt, Pseudomonas aeruginosa PA01
gaucgccaccccg

SEQ ID NO: 3457462 - RNA, 15 nt, Pseudomonas aeruginosa PA01
gaucgccaccccgcc

SEQ ID NO: 3457463 - RNA, 22 nt, Pseudomonas aeruginosa PA01
gaucgccaccccgccgcuggcg

SEQ ID NO: 3457464 - RNA, 13 nt, Pseudomonas aeruginosa PA01
gaucgccacgccg

SEQ ID NO: 3457465 - RNA, 15 nt, Pseudomonas aeruginosa PA01
gaucgccacgccggc

SEQ ID NO: 3457466 - RNA, 18 nt, Pseudomonas aeruginosa PA01
gaucgccacgccggcgcu

SEQ ID NO: 3457467 - RNA, 20 nt, Pseudomonas aeruginosa PA01
gaucgccacgccggcgcucc

SEQ ID NO: 3457468 - RNA, 12 nt, Pseudomonas aeruginosa PA01
gaucgccagcaa

SEQ ID NO: 3457469 - RNA, 23 nt, Pseudomonas aeruginosa PA01
gaucgccagcaauugccgcugca

SEQ ID NO: 3457470 - RNA, 14 nt, Pseudomonas aeruginosa PA01
gaucgccagcccgu

SEQ ID NO: 3457471 - RNA, 13 nt, Pseudomonas aeruginosa PA01
gaucgccagcgcc

SEQ ID NO: 3457472 - RNA, 16 nt, Pseudomonas aeruginosa PA01
gaucgccagcgccagc

SEQ ID NO: 3457473 - RNA, 20 nt, Pseudomonas aeruginosa PA01
gaucgccagcgguacccgcc

SEQ ID NO: 3457474 - RNA, 22 nt, Pseudomonas aeruginosa PA01
gaucgccagcgguacccgccgg

SEQ ID NO: 3457475 - RNA, 13 nt, Pseudomonas aeruginosa PA01
gaucgccagcucg

SEQ ID NO: 3457476 - RNA, 20 nt, Pseudomonas aeruginosa PA01
gaucgccaggcgauccagcg

SEQ ID NO: 3457477 - RNA, 14 nt, Pseudomonas aeruginosa PA01
gaucgccaggcuga

SEQ ID NO: 3457478 - RNA, 17 nt, Pseudomonas aeruginosa PA01
gaucgcccagcggcugg

SEQ ID NO: 3457479 - RNA, 20 nt, Pseudomonas aeruginosa PA01
gaucgcccagcggcuggcgg

SEQ ID NO: 3457480 - RNA, 15 nt, Pseudomonas aeruginosa PA01
gaucgcccgaacgcc

SEQ ID NO: 3457481 - RNA, 20 nt, Pseudomonas aeruginosa PA01
gaucgcccgccugauggcga

SEQ ID NO: 3457482 - RNA, 14 nt, Pseudomonas aeruginosa PA01
gaucgcccgcgccu

SEQ ID NO: 3457483 - RNA, 14 nt, Pseudomonas aeruginosa PA01
gaucgcccggcgcu

SEQ ID NO: 3457484 - RNA, 17 nt, Pseudomonas aeruginosa PA01
gaucgcccggcgcucca

SEQ ID NO: 3457485 - RNA, 21 nt, Pseudomonas aeruginosa PA01
gaucgcccggcgcuccaacag

SEQ ID NO: 3457486 - RNA, 15 nt, Pseudomonas aeruginosa PA01
gaucgcccuggcgcc

SEQ ID NO: 3457487 - RNA, 17 nt, Pseudomonas aeruginosa PA01
gaucgcccuggcgccag

SEQ ID NO: 3457488 - RNA, 21 nt, Pseudomonas aeruginosa PA01
gaucgccgaaaaauucagcgc

SEQ ID NO: 3457489 - RNA, 13 nt, Pseudomonas aeruginosa PA01
gaucgccgcgacc

SEQ ID NO: 3457490 - RNA, 18 nt, Pseudomonas aeruginosa PA01
gaucgccgcgaccugcuc

SEQ ID NO: 3457491 - RNA, 19 nt, Pseudomonas aeruginosa PA01
gaucgccgcgccgccgagg

SEQ ID NO: 3457492 - RNA, 20 nt, Pseudomonas aeruginosa PA01
gaucgccgcgccgccgaggg

SEQ ID NO: 3457493 - RNA, 13 nt, Pseudomonas aeruginosa PA01
gaucgccgcggcg

SEQ ID NO: 3457494 - RNA, 22 nt, Pseudomonas aeruginosa PA01
gaucgccgcguagcgccaggcc

SEQ ID NO: 3457495 - RNA, 16 nt, Pseudomonas aeruginosa PA01
gaucgccggguugccg

SEQ ID NO: 3457496 - RNA, 20 nt, Pseudomonas aeruginosa PA01
gaucgccggguugccgcugg

SEQ ID NO: 3457497 - RNA, 21 nt, Pseudomonas aeruginosa PA01
gaucgccggguugccgcuggc

SEQ ID NO: 3457498 - RNA, 23 nt, Pseudomonas aeruginosa PA01
gaucgccggguugccgcuggccu

SEQ ID NO: 3457499 - RNA, 20 nt, Pseudomonas aeruginosa PA01
gaucgccguguugaugccga

SEQ ID NO: 3457500 - RNA, 19 nt, Pseudomonas aeruginosa PA01
gaucgccuccaccagcgcc

SEQ ID NO: 3457501 - RNA, 20 nt, Pseudomonas aeruginosa PA01
gaucgccuccggcacgcugc

SEQ ID NO: 3457502 - RNA, 14 nt, Pseudomonas aeruginosa PA01
gaucgccucggcgc

SEQ ID NO: 3457503 - RNA, 14 nt, Pseudomonas aeruginosa PA01
gaucgccucgucga

SEQ ID NO: 3457504 - RNA, 21 nt, Pseudomonas aeruginosa PA01
gaucgccucgucgagcgcagc

SEQ ID NO: 3457505 - RNA, 20 nt, Pseudomonas aeruginosa PA01
gaucgccucguucagcagca

SEQ ID NO: 3457506 - RNA, 23 nt, Pseudomonas aeruginosa PA01
gaucgccucguucgucgccgacu

SEQ ID NO: 3457507 - RNA, 17 nt, Pseudomonas aeruginosa PA01
gaucgccuugcgcgugc

SEQ ID NO: 3457508 - RNA, 22 nt, Pseudomonas aeruginosa PA01
gaucgcgaagaacacgccccag

SEQ ID NO: 3457509 - RNA, 17 nt, Pseudomonas aeruginosa PA01
gaucgcgaagcgcagca

SEQ ID NO: 3457510 - RNA, 21 nt, Pseudomonas aeruginosa PA01
gaucgcgcaaugccgcgucga

SEQ ID NO: 3457511 - RNA, 19 nt, Pseudomonas aeruginosa PA01
gaucgcgcagaucgccgcg

SEQ ID NO: 3457512 - RNA, 18 nt, Pseudomonas aeruginosa PA01
gaucgcgccgagcuggcg

SEQ ID NO: 3457513 - RNA, 22 nt, Pseudomonas aeruginosa PA01
gaucgcgccgagcuggcgcgcg

SEQ ID NO: 3457514 - RNA, 21 nt, Pseudomonas aeruginosa PA01
gaucgcgccggaugggcgagc

SEQ ID NO: 3457515 - RNA, 16 nt, Pseudomonas aeruginosa PA01
gaucgcgccgucgcug

SEQ ID NO: 3457516 - RNA, 19 nt, Pseudomonas aeruginosa PA01
gaucgcgccgucgcuggcg

SEQ ID NO: 3457517 - RNA, 21 nt, Pseudomonas aeruginosa PA01
gaucgcgccgucgcuggcgau

SEQ ID NO: 3457518 - RNA, 14 nt, Pseudomonas aeruginosa PA01
gaucgcgcggcugg

SEQ ID NO: 3457519 - RNA, 15 nt, Pseudomonas aeruginosa PA01
gaucgcgcuggccag

SEQ ID NO: 3457520 - RNA, 16 nt, Pseudomonas aeruginosa PA01
gaucgcgcuggccagu

SEQ ID NO: 3457521 - RNA, 15 nt, Pseudomonas aeruginosa PA01
gaucgcgcugggcgc

SEQ ID NO: 3457522 - RNA, 18 nt, Pseudomonas aeruginosa PA01
gaucgcgcugggcgcagc

SEQ ID NO: 3457523 - RNA, 21 nt, Pseudomonas aeruginosa PA01
gaucgcgcugggcgcagcccu

SEQ ID NO: 3457524 - RNA, 17 nt, Pseudomonas aeruginosa PA01
gaucgcggccagccgcu

SEQ ID NO: 3457525 - RNA, 21 nt, Pseudomonas aeruginosa PA01
gaucgcggccuucucgucgcc

SEQ ID NO: 3457526 - RNA, 22 nt, Pseudomonas aeruginosa PA01
gaucgcggccuucucgucgccg

SEQ ID NO: 3457527 - RNA, 23 nt, Pseudomonas aeruginosa PA01
gaucgcggcgacgaucaccccca

SEQ ID NO: 3457528 - RNA, 15 nt, Pseudomonas aeruginosa PA01
gaucgcggcgcaggc

SEQ ID NO: 3457529 - RNA, 14 nt, Pseudomonas aeruginosa PA01
gaucgcguccaggg

SEQ ID NO: 3457530 - RNA, 15 nt, Pseudomonas aeruginosa PA01
gaucgcgucgcaggc

SEQ ID NO: 3457531 - RNA, 16 nt, Pseudomonas aeruginosa PA01
gaucgcgucgcaggcg

SEQ ID NO: 3457532 - RNA, 21 nt, Pseudomonas aeruginosa PA01
gaucgcgucgcaggcgaugcc

SEQ ID NO: 3457533 - RNA, 22 nt, Pseudomonas aeruginosa PA01
gaucgcgucguauaggcgcugg

SEQ ID NO: 3457534 - RNA, 23 nt, Pseudomonas aeruginosa PA01
gaucgcgucguauaggcgcuggu

SEQ ID NO: 3457535 - RNA, 18 nt, Pseudomonas aeruginosa PA01
gaucgcgugggccaccau

SEQ ID NO: 3457536 - RNA, 19 nt, Pseudomonas aeruginosa PA01
gaucgcguuccagcaacgg

SEQ ID NO: 3457537 - RNA, 14 nt, Pseudomonas aeruginosa PA01
gaucgcucccaggc

SEQ ID NO: 3457538 - RNA, 15 nt, Pseudomonas aeruginosa PA01
gaucgcucccaggcu

SEQ ID NO: 3457539 - RNA, 18 nt, Pseudomonas aeruginosa PA01
gaucgcucucgcgcuuga

SEQ ID NO: 3457540 - RNA, 16 nt, Pseudomonas aeruginosa PA01
gaucgcuucgcggauc

SEQ ID NO: 3457541 - RNA, 21 nt, Pseudomonas aeruginosa PA01
gaucggaagaucgcccgccug

SEQ ID NO: 3457542 - RNA, 20 nt, Pseudomonas aeruginosa PA01
gaucggauaccagaucacca

SEQ ID NO: 3457543 - RNA, 17 nt, Pseudomonas aeruginosa PA01
gaucggaugcacgugca

SEQ ID NO: 3457544 - RNA, 21 nt, Pseudomonas aeruginosa PA01
gaucggcaacgagcaggacug

SEQ ID NO: 3457545 - RNA, 14 nt, Pseudomonas aeruginosa PA01
gaucggcaccauca

SEQ ID NO: 3457546 - RNA, 15 nt, Pseudomonas aeruginosa PA01
gaucggcagcaucag

SEQ ID NO: 3457547 - RNA, 18 nt, Pseudomonas aeruginosa PA01
gaucggcagcaucagccg

SEQ ID NO: 3457548 - RNA, 21 nt, Pseudomonas aeruginosa PA01
gaucggcagcaucagccgcga

SEQ ID NO: 3457549 - RNA, 16 nt, Pseudomonas aeruginosa PA01
gaucggcagccguccg

SEQ ID NO: 3457550 - RNA, 20 nt, Pseudomonas aeruginosa PA01
gaucggcagccguccgccca

SEQ ID NO: 3457551 - RNA, 14 nt, Pseudomonas aeruginosa PA01
gaucggcagcucgc

SEQ ID NO: 3457552 - RNA, 17 nt, Pseudomonas aeruginosa PA01
gaucggcaggcuggcgu

SEQ ID NO: 3457553 - RNA, 16 nt, Pseudomonas aeruginosa PA01
gaucggcagggcgccg

SEQ ID NO: 3457554 - RNA, 17 nt, Pseudomonas aeruginosa PA01
gaucggcauggccgacc

SEQ ID NO: 3457555 - RNA, 19 nt, Pseudomonas aeruginosa PA01
gaucggcauggccgaccgc

SEQ ID NO: 3457556 - RNA, 20 nt, Pseudomonas aeruginosa PA01
gaucggcauggccgaccgcc

SEQ ID NO: 3457557 - RNA, 20 nt, Pseudomonas aeruginosa PA01
gaucggccaacugagcggcg

SEQ ID NO: 3457558 - RNA, 21 nt, Pseudomonas aeruginosa PA01
gaucggccaacugagcggcgg

SEQ ID NO: 3457559 - RNA, 19 nt, Pseudomonas aeruginosa PA01
gaucggcccuucgacaugg

SEQ ID NO: 3457560 - RNA, 23 nt, Pseudomonas aeruginosa PA01
gaucggcccuucgacaugggccg

SEQ ID NO: 3457561 - RNA, 16 nt, Pseudomonas aeruginosa PA01
gaucggccucgcggcg

SEQ ID NO: 3457562 - RNA, 18 nt, Pseudomonas aeruginosa PA01
gaucggccucgcggcgcu

SEQ ID NO: 3457563 - RNA, 14 nt, Pseudomonas aeruginosa PA01
gaucggccuuggcg

SEQ ID NO: 3457564 - RNA, 19 nt, Pseudomonas aeruginosa PA01
gaucggcgaucagcgggcg

SEQ ID NO: 3457565 - RNA, 18 nt, Pseudomonas aeruginosa PA01
gaucggcgcccagcacca

SEQ ID NO: 3457566 - RNA, 15 nt, Pseudomonas aeruginosa PA01
gaucggcggcgcggc

SEQ ID NO: 3457567 - RNA, 16 nt, Pseudomonas aeruginosa PA01
gaucggcggcgcggcg

SEQ ID NO: 3457568 - RNA, 16 nt, Pseudomonas aeruginosa PA01
gaucggcguggcgguc

SEQ ID NO: 3457569 - RNA, 14 nt, Pseudomonas aeruginosa PA01
gaucggcuccagcu

SEQ ID NO: 3457570 - RNA, 17 nt, Pseudomonas aeruginosa PA01
gaucggcugcaacgccg

SEQ ID NO: 3457571 - RNA, 20 nt, Pseudomonas aeruginosa PA01
gaucggcugcaacgccggcc

SEQ ID NO: 3457572 - RNA, 14 nt, Pseudomonas aeruginosa PA01
gaucggcuggucgu

SEQ ID NO: 3457573 - RNA, 22 nt, Pseudomonas aeruginosa PA01
gaucggcuugaagugauccagg

SEQ ID NO: 3457574 - RNA, 18 nt, Pseudomonas aeruginosa PA01
gaucgggcuucggcagca

SEQ ID NO: 3457575 - RNA, 21 nt, Pseudomonas aeruginosa PA01
gaucggggaagggacgucgcc

SEQ ID NO: 3457576 - RNA, 18 nt, Pseudomonas aeruginosa PA01
gaucggguagagcgcggc

SEQ ID NO: 3457577 - RNA, 15 nt, Pseudomonas aeruginosa PA01
gaucguaggcgcgca

SEQ ID NO: 3457578 - RNA, 18 nt, Pseudomonas aeruginosa PA01
gaucgucgaaagccucga

SEQ ID NO: 3457579 - RNA, 14 nt, Pseudomonas aeruginosa PA01
gaucgucgccaagc

SEQ ID NO: 3457580 - RNA, 15 nt, Pseudomonas aeruginosa PA01
gaucgucgccaagcc

SEQ ID NO: 3457581 - RNA, 12 nt, Pseudomonas aeruginosa PA01
gaucgucggccc

SEQ ID NO: 3457582 - RNA, 20 nt, Pseudomonas aeruginosa PA01
gaucgucucggugcucaggc

SEQ ID NO: 3457583 - RNA, 20 nt, Pseudomonas aeruginosa PA01
gaucgucuuucucgaucucg

SEQ ID NO: 3457584 - RNA, 14 nt, Pseudomonas aeruginosa PA01
gaucuccaggucgc

SEQ ID NO: 3457585 - RNA, 19 nt, Pseudomonas aeruginosa PA01
gaucucccguaccagcgcg

SEQ ID NO: 3457586 - RNA, 18 nt, Pseudomonas aeruginosa PA01
gaucuccgccaggcggcc

SEQ ID NO: 3457587 - RNA, 13 nt, Pseudomonas aeruginosa PA01
gaucuccgcgcca

SEQ ID NO: 3457588 - RNA, 19 nt, Pseudomonas aeruginosa PA01
gaucuccgcgccgggcugg

SEQ ID NO: 3457589 - RNA, 23 nt, Pseudomonas aeruginosa PA01
gaucuccgcgccgggcuggccgu

SEQ ID NO: 3457590 - RNA, 18 nt, Pseudomonas aeruginosa PA01
gaucuccggguccaucug

SEQ ID NO: 3457591 - RNA, 14 nt, Pseudomonas aeruginosa PA01
gaucuccuccgccc

SEQ ID NO: 3457592 - RNA, 18 nt, Pseudomonas aeruginosa PA01
gaucuccuccgccccggc

SEQ ID NO: 3457593 - RNA, 23 nt, Pseudomonas aeruginosa PA01
gaucuccuccgccccggcaagcg

SEQ ID NO: 3457594 - RNA, 20 nt, Pseudomonas aeruginosa PA01
gaucuccuccucggcggcuu

SEQ ID NO: 3457595 - RNA, 18 nt, Pseudomonas aeruginosa PA01
gaucuccucgacggcggg

SEQ ID NO: 3457596 - RNA, 22 nt, Pseudomonas aeruginosa PA01
gaucuccucgacggcgggagcg

SEQ ID NO: 3457597 - RNA, 16 nt, Pseudomonas aeruginosa PA01
gaucuccucgcgcagc

SEQ ID NO: 3457598 - RNA, 15 nt, Pseudomonas aeruginosa PA01
gaucuccucggccaa

SEQ ID NO: 3457599 - RNA, 11 nt, Pseudomonas aeruginosa PA01
gaucuccuggc

SEQ ID NO: 3457600 - RNA, 23 nt, Pseudomonas aeruginosa PA01
gaucucgaacucgaaggccagcu

SEQ ID NO: 3457601 - RNA, 22 nt, Pseudomonas aeruginosa PA01
gaucucgaagaccagcggagcg

SEQ ID NO: 3457602 - RNA, 23 nt, Pseudomonas aeruginosa PA01
gaucucgcaguacucguguucgg

SEQ ID NO: 3457603 - RNA, 23 nt, Pseudomonas aeruginosa PA01
gaugaugguauccaggcgguugc

SEQ ID NO: 3457604 - RNA, 22 nt, Pseudomonas aeruginosa PA01
gaugauggucaacaccagcgcc

SEQ ID NO: 3457605 - RNA, 19 nt, Pseudomonas aeruginosa PA01
gaugcaaccgcccuggucc

SEQ ID NO: 3457606 - RNA, 21 nt, Pseudomonas aeruginosa PA01
gaugcaauggauguugccgcc

SEQ ID NO: 3457607 - RNA, 19 nt, Pseudomonas aeruginosa PA01
gaugcacaccagcuccccg

SEQ ID NO: 3457608 - RNA, 15 nt, Pseudomonas aeruginosa PA01
gaugcaccggccacu

SEQ ID NO: 3457609 - RNA, 22 nt, Pseudomonas aeruginosa PA01
gaugcaccggccacucgcagcc

SEQ ID NO: 3457610 - RNA, 19 nt, Pseudomonas aeruginosa PA01
gaugcagagaaaaggccgc

SEQ ID NO: 3457611 - RNA, 18 nt, Pseudomonas aeruginosa PA01
gaugcagauccagcggca

SEQ ID NO: 3457612 - RNA, 12 nt, Pseudomonas aeruginosa PA01
gaugcagccggg

SEQ ID NO: 3457613 - RNA, 22 nt, Pseudomonas aeruginosa PA01
gaugcagccggggcucaggccu

SEQ ID NO: 3457614 - RNA, 16 nt, Pseudomonas aeruginosa PA01
gaugcagcgucgcgcg

SEQ ID NO: 3457615 - RNA, 23 nt, Pseudomonas aeruginosa PA01
gaugcaggcagugugcaccgagu

SEQ ID NO: 3457616 - RNA, 14 nt, Pseudomonas aeruginosa PA01
gaugcagucggcac

SEQ ID NO: 3457617 - RNA, 17 nt, Pseudomonas aeruginosa PA01
gaugcaguucguugagc

SEQ ID NO: 3457618 - RNA, 19 nt, Pseudomonas aeruginosa PA01
gaugcaguugagucgcgcg

SEQ ID NO: 3457619 - RNA, 16 nt, Pseudomonas aeruginosa PA01
gaugccaaguugccug

SEQ ID NO: 3457620 - RNA, 14 nt, Pseudomonas aeruginosa PA01
gaugccaucgaggc

SEQ ID NO: 3457621 - RNA, 20 nt, Pseudomonas aeruginosa PA01
gaugccaucgaggccaggcc

SEQ ID NO: 3457622 - RNA, 12 nt, Pseudomonas aeruginosa PA01
gaugccauggca

SEQ ID NO: 3457623 - RNA, 15 nt, Pseudomonas aeruginosa PA01
gaugccauggcaucc

SEQ ID NO: 3457624 - RNA, 18 nt, Pseudomonas aeruginosa PA01
gaugcccagccagggccg

SEQ ID NO: 3457625 - RNA, 22 nt, Pseudomonas aeruginosa PA01
gaugcccagccagggccgcgag

SEQ ID NO: 3457626 - RNA, 16 nt, Pseudomonas aeruginosa PA01
gaugcccagcggcgcc

SEQ ID NO: 3457627 - RNA, 18 nt, Pseudomonas aeruginosa PA01
gaugcccagcggcgccag

SEQ ID NO: 3457628 - RNA, 12 nt, Pseudomonas aeruginosa PA01
gaugcccaggcc

SEQ ID NO: 3457629 - RNA, 14 nt, Pseudomonas aeruginosa PA01
gaugcccaggccga

SEQ ID NO: 3457630 - RNA, 16 nt, Pseudomonas aeruginosa PA01
gaugcccaggccgccg

SEQ ID NO: 3457631 - RNA, 20 nt, Pseudomonas aeruginosa PA01
gaugcccaggccgccgaucc

SEQ ID NO: 3457632 - RNA, 18 nt, Pseudomonas aeruginosa PA01
gaugcccgccagcaggcg

SEQ ID NO: 3457633 - RNA, 19 nt, Pseudomonas aeruginosa PA01
gaugcccgccagcaggcgc

SEQ ID NO: 3457634 - RNA, 20 nt, Pseudomonas aeruginosa PA01
gaugcccgccagcaggcgcc

SEQ ID NO: 3457635 - RNA, 23 nt, Pseudomonas aeruginosa PA01
gaugcccgccagcaggcgccggc

SEQ ID NO: 3457636 - RNA, 12 nt, Pseudomonas aeruginosa PA01
gaugcccggccg

SEQ ID NO: 3457637 - RNA, 18 nt, Pseudomonas aeruginosa PA01
gaugcccggccgcaggca

SEQ ID NO: 3457638 - RNA, 13 nt, Pseudomonas aeruginosa PA01
gaugcccggcugg

SEQ ID NO: 3457639 - RNA, 23 nt, Pseudomonas aeruginosa PA01
gaugcccggcugguugccagcag

SEQ ID NO: 3457640 - RNA, 14 nt, Pseudomonas aeruginosa PA01
gaugcccgggcguu

SEQ ID NO: 3457641 - RNA, 17 nt, Pseudomonas aeruginosa PA01
gaugcccgggucgucgg

SEQ ID NO: 3457642 - RNA, 17 nt, Pseudomonas aeruginosa PA01
gaugcccggucaccacc

SEQ ID NO: 3457643 - RNA, 16 nt, Pseudomonas aeruginosa PA01
gaugcccgucaggccu

SEQ ID NO: 3457644 - RNA, 20 nt, Pseudomonas aeruginosa PA01
gaugcccgucaggccuugcg

SEQ ID NO: 3457645 - RNA, 14 nt, Pseudomonas aeruginosa PA01
gaugcccuccuggg

SEQ ID NO: 3457646 - RNA, 19 nt, Pseudomonas aeruginosa PA01
gaugcccucgcggcggcag

SEQ ID NO: 3457647 - RNA, 19 nt, Pseudomonas aeruginosa PA01
gaugcccugcucuuccagc

SEQ ID NO: 3457648 - RNA, 14 nt, Pseudomonas aeruginosa PA01
gaugcccuggccgc

SEQ ID NO: 3457649 - RNA, 22 nt, Pseudomonas aeruginosa PA01
gaugcccuggcuuuccagggcc

SEQ ID NO: 3457650 - RNA, 16 nt, Pseudomonas aeruginosa PA01
gaugcccuggucggcg

SEQ ID NO: 3457651 - RNA, 19 nt, Pseudomonas aeruginosa PA01
gaugcccuggucggcgguc

SEQ ID NO: 3457652 - RNA, 21 nt, Pseudomonas aeruginosa PA01
gaugcccuuggccagcgcggc

SEQ ID NO: 3457653 - RNA, 17 nt, Pseudomonas aeruginosa PA01
gaugccgaauccgcugu

SEQ ID NO: 3457654 - RNA, 14 nt, Pseudomonas aeruginosa PA01
gaugccgacgucga

SEQ ID NO: 3457655 - RNA, 16 nt, Pseudomonas aeruginosa PA01
gaugccgacgucgacu

SEQ ID NO: 3457656 - RNA, 15 nt, Pseudomonas aeruginosa PA01
gaugccgaggcggcc

SEQ ID NO: 3457657 - RNA, 16 nt, Pseudomonas aeruginosa PA01
gaugccgaugccgccg

SEQ ID NO: 3457658 - RNA, 17 nt, Pseudomonas aeruginosa PA01
gaugccgauggcgccgc

SEQ ID NO: 3457659 - RNA, 22 nt, Pseudomonas aeruginosa PA01
gaugccgauggcgccgccgagg

SEQ ID NO: 3457660 - RNA, 14 nt, Pseudomonas aeruginosa PA01
gaugccgcaggcau

SEQ ID NO: 3457661 - RNA, 15 nt, Pseudomonas aeruginosa PA01
gaugccgcccagcac

SEQ ID NO: 3457662 - RNA, 17 nt, Pseudomonas aeruginosa PA01
gaugccgcccagcaccg

SEQ ID NO: 3457663 - RNA, 20 nt, Pseudomonas aeruginosa PA01
gaugccgcccagcaccgagc

SEQ ID NO: 3457664 - RNA, 19 nt, Pseudomonas aeruginosa PA01
gaugccgcccugcggcagg

SEQ ID NO: 3457665 - RNA, 22 nt, Pseudomonas aeruginosa PA01
gaugccgcccugcggcaggcgc

SEQ ID NO: 3457666 - RNA, 20 nt, Pseudomonas aeruginosa PA01
gaugccgccgccgccccagc

SEQ ID NO: 3457667 - RNA, 21 nt, Pseudomonas aeruginosa PA01
gaugccgccgccgccccagca

SEQ ID NO: 3457668 - RNA, 11 nt, Pseudomonas aeruginosa PA01
gaugccgccgg

SEQ ID NO: 3457669 - RNA, 14 nt, Pseudomonas aeruginosa PA01
gaugccgccggcau

SEQ ID NO: 3457670 - RNA, 23 nt, Pseudomonas aeruginosa PA01
gaugccgccgggcaucaugccga

SEQ ID NO: 3457671 - RNA, 22 nt, Pseudomonas aeruginosa PA01
gaugccgccugcgucagcgagg

SEQ ID NO: 3457672 - RNA, 14 nt, Pseudomonas aeruginosa PA01
gaugccgcgccagg

SEQ ID NO: 3457673 - RNA, 16 nt, Pseudomonas aeruginosa PA01
gaugccgcgccaggcg

SEQ ID NO: 3457674 - RNA, 18 nt, Pseudomonas aeruginosa PA01
gaugccgcgccaggcgca

SEQ ID NO: 3457675 - RNA, 14 nt, Pseudomonas aeruginosa PA01
gaugccgcgcgccu

SEQ ID NO: 3457676 - RNA, 17 nt, Pseudomonas aeruginosa PA01
gaugccgcgcgccuggc

SEQ ID NO: 3457677 - RNA, 19 nt, Pseudomonas aeruginosa PA01
gaugccgcgcgccuggcug

SEQ ID NO: 3457678 - RNA, 23 nt, Pseudomonas aeruginosa PA01
gaugccgcgcgccuggcuggcca

SEQ ID NO: 3457679 - RNA, 23 nt, Pseudomonas aeruginosa PA01
gaugccggaaagccuggccggcg

SEQ ID NO: 3457680 - RNA, 20 nt, Pseudomonas aeruginosa PA01
gaugccggagagcagcacgg

SEQ ID NO: 3457681 - RNA, 20 nt, Pseudomonas aeruginosa PA01
gaugccggccggcagcgagc

SEQ ID NO: 3457682 - RNA, 14 nt, Pseudomonas aeruginosa PA01
gaugccggcgcugu

SEQ ID NO: 3457683 - RNA, 12 nt, Pseudomonas aeruginosa PA01
gaugccggcggc

SEQ ID NO: 3457684 - RNA, 13 nt, Pseudomonas aeruginosa PA01
gaugccggcggca

SEQ ID NO: 3457685 - RNA, 19 nt, Pseudomonas aeruginosa PA01
gaugccggcgucggcgagc

SEQ ID NO: 3457686 - RNA, 21 nt, Pseudomonas aeruginosa PA01
gaugccggcgucggcgagcag

SEQ ID NO: 3457687 - RNA, 22 nt, Pseudomonas aeruginosa PA01
gaugccggugcuggugcggccg

SEQ ID NO: 3457688 - RNA, 16 nt, Pseudomonas aeruginosa PA01
gaugccgguggcgccc

SEQ ID NO: 3457689 - RNA, 21 nt, Pseudomonas aeruginosa PA01
gaugccgguggcgcccagcca

SEQ ID NO: 3457690 - RNA, 22 nt, Pseudomonas aeruginosa PA01
gaugccgguggcgcccagccag

SEQ ID NO: 3457691 - RNA, 17 nt, Pseudomonas aeruginosa PA01
gaugccguucaggcgcg

SEQ ID NO: 3457692 - RNA, 18 nt, Pseudomonas aeruginosa PA01
gaugccguucucccgcgc

SEQ ID NO: 3457693 - RNA, 20 nt, Pseudomonas aeruginosa PA01
gaugccguuguggcaggcgc

SEQ ID NO: 3457694 - RNA, 21 nt, Pseudomonas aeruginosa PA01
gaugccguuguggcaggcgcu

SEQ ID NO: 3457695 - RNA, 13 nt, Pseudomonas aeruginosa PA01
gaugccuccggcu

SEQ ID NO: 3457696 - RNA, 15 nt, Pseudomonas aeruginosa PA01
gaugccuucggcggc

SEQ ID NO: 3457697 - RNA, 22 nt, Pseudomonas aeruginosa PA01
gaugccuucgggagagcccggg

SEQ ID NO: 3457698 - RNA, 21 nt, Pseudomonas aeruginosa PA01
gaugccuuucggggugcaggg

SEQ ID NO: 3457699 - RNA, 22 nt, Pseudomonas aeruginosa PA01
gaugccuuucggggugcagggg

SEQ ID NO: 3457700 - RNA, 18 nt, Pseudomonas aeruginosa PA01
gaugcgcaacgggcggcg

SEQ ID NO: 3457701 - RNA, 20 nt, Pseudomonas aeruginosa PA01
gaugcgcaacgggcggcggg

SEQ ID NO: 3457702 - RNA, 15 nt, Pseudomonas aeruginosa PA01
gaugcgcaggccggg

SEQ ID NO: 3457703 - RNA, 16 nt, Pseudomonas aeruginosa PA01
gaugcgcaggccggga

SEQ ID NO: 3457704 - RNA, 14 nt, Pseudomonas aeruginosa PA01
gaugcgccagcggc

SEQ ID NO: 3457705 - RNA, 18 nt, Pseudomonas aeruginosa PA01
gauggcuggucaggcuga

SEQ ID NO: 3457706 - RNA, 15 nt, Pseudomonas aeruginosa PA01
gauggcugucggcgc

SEQ ID NO: 3457707 - RNA, 16 nt, Pseudomonas aeruginosa PA01
gauggcugucggcgcc

SEQ ID NO: 3457708 - RNA, 23 nt, Pseudomonas aeruginosa PA01
gaugggcaggauaucgcccaggg

SEQ ID NO: 3457709 - RNA, 18 nt, Pseudomonas aeruginosa PA01
gaugggcgaagccggcgg

SEQ ID NO: 3457710 - RNA, 21 nt, Pseudomonas aeruginosa PA01
gaugggcgaagccggcggcgc

SEQ ID NO: 3457711 - RNA, 18 nt, Pseudomonas aeruginosa PA01
gaugggcgagaccgggga

SEQ ID NO: 3457712 - RNA, 16 nt, Pseudomonas aeruginosa PA01
gauggucaacaccagc

SEQ ID NO: 3457713 - RNA, 19 nt, Pseudomonas aeruginosa PA01
gauggucaacaccagcgcc

SEQ ID NO: 3457714 - RNA, 20 nt, Pseudomonas aeruginosa PA01
gauggucaacaccagcgccg

SEQ ID NO: 3457715 - RNA, 20 nt, Pseudomonas aeruginosa PA01
gauggucacgccgaggcugc

SEQ ID NO: 3457716 - RNA, 22 nt, Pseudomonas aeruginosa PA01
gauggucacgccgaggcugcgg

SEQ ID NO: 3457717 - RNA, 11 nt, Pseudomonas aeruginosa PA01
gauggucagga

SEQ ID NO: 3457718 - RNA, 14 nt, Pseudomonas aeruginosa PA01
gauggucaggacgc

SEQ ID NO: 3457719 - RNA, 16 nt, Pseudomonas aeruginosa PA01
gauggucaggccggcg

SEQ ID NO: 3457720 - RNA, 17 nt, Pseudomonas aeruginosa PA01
gauggucaggccggcgc

SEQ ID NO: 3457721 - RNA, 23 nt, Pseudomonas aeruginosa PA01
gauggucaggccggcgcgauccu

SEQ ID NO: 3457722 - RNA, 22 nt, Pseudomonas aeruginosa PA01
gauggucgagagaauccgccgu

SEQ ID NO: 3457723 - RNA, 17 nt, Pseudomonas aeruginosa PA01
gauggucgagggcgcgu

SEQ ID NO: 3457724 - RNA, 23 nt, Pseudomonas aeruginosa PA01
gauggucgccgcgaccucguugc

SEQ ID NO: 3457725 - RNA, 17 nt, Pseudomonas aeruginosa PA01
gauggugaacgccaggc

SEQ ID NO: 3457726 - RNA, 18 nt, Pseudomonas aeruginosa PA01
gauggugaacgccaggca

SEQ ID NO: 3457727 - RNA, 15 nt, Pseudomonas aeruginosa PA01
gauggugacguugcg

SEQ ID NO: 3457728 - RNA, 14 nt, Pseudomonas aeruginosa PA01
gauggugccgccgg

SEQ ID NO: 3457729 - RNA, 17 nt, Pseudomonas aeruginosa PA01
gaugguggaauccaggg

SEQ ID NO: 3457730 - RNA, 20 nt, Pseudomonas aeruginosa PA01
gaugguggaauccagggccg

SEQ ID NO: 3457731 - RNA, 19 nt, Pseudomonas aeruginosa PA01
gauggugggcucuaugcaa

SEQ ID NO: 3457732 - RNA, 16 nt, Pseudomonas aeruginosa PA01
gauggugugcagcagc

SEQ ID NO: 3457733 - RNA, 17 nt, Pseudomonas aeruginosa PA01
gauggugugcagcagca

SEQ ID NO: 3457734 - RNA, 15 nt, Pseudomonas aeruginosa PA01
gaugguugccggugu

SEQ ID NO: 3457735 - RNA, 23 nt, Pseudomonas aeruginosa PA01
gaugguugccguacuucagggug

SEQ ID NO: 3457736 - RNA, 21 nt, Pseudomonas aeruginosa PA01
gauguacaggaugggcgaagc

SEQ ID NO: 3457737 - RNA, 20 nt, Pseudomonas aeruginosa PA01
gauguacggcaccaccaccg

SEQ ID NO: 3457738 - RNA, 23 nt, Pseudomonas aeruginosa PA01
gauguagccggcuuccucgcccu

SEQ ID NO: 3457739 - RNA, 18 nt, Pseudomonas aeruginosa PA01
gauguaggccgcuuccgg

SEQ ID NO: 3457740 - RNA, 17 nt, Pseudomonas aeruginosa PA01
gauguaggccucggccu

SEQ ID NO: 3457741 - RNA, 17 nt, Pseudomonas aeruginosa PA01
gauguaggucaccgcgc

SEQ ID NO: 3457742 - RNA, 22 nt, Pseudomonas aeruginosa PA01
gauguaguucuugcgcauuuug

SEQ ID NO: 3457743 - RNA, 20 nt, Pseudomonas aeruginosa PA01
gauguauccguacuggcgcc

SEQ ID NO: 3457744 - RNA, 16 nt, Pseudomonas aeruginosa PA01
gaugucagcguagcug

SEQ ID NO: 3457745 - RNA, 16 nt, Pseudomonas aeruginosa PA01
gauguccaucagccgc

SEQ ID NO: 3457746 - RNA, 18 nt, Pseudomonas aeruginosa PA01
gauguccaucagccgcgc

SEQ ID NO: 3457747 - RNA, 19 nt, Pseudomonas aeruginosa PA01
gauguccaucagccgcgcg

SEQ ID NO: 3457748 - RNA, 22 nt, Pseudomonas aeruginosa PA01
gauguccccccuacgaaagcgc

SEQ ID NO: 3457749 - RNA, 14 nt, Pseudomonas aeruginosa PA01
gauguccccggcca

SEQ ID NO: 3457750 - RNA, 16 nt, Pseudomonas aeruginosa PA01
gauguccccggccagc

SEQ ID NO: 3457751 - RNA, 19 nt, Pseudomonas aeruginosa PA01
gauguccccggccagcagc

SEQ ID NO: 3457752 - RNA, 23 nt, Pseudomonas aeruginosa PA01
gauguccccggccagcagcgccu

SEQ ID NO: 3457753 - RNA, 15 nt, Pseudomonas aeruginosa PA01
gauguccgccgccca

SEQ ID NO: 3457754 - RNA, 17 nt, Pseudomonas aeruginosa PA01
gauguccgggaugccgg

SEQ ID NO: 3457755 - RNA, 20 nt, Pseudomonas aeruginosa PA01
gauguccgggaugccggugc

SEQ ID NO: 3457756 - RNA, 16 nt, Pseudomonas aeruginosa PA01
gauguccuggaucggc

SEQ ID NO: 3457757 - RNA, 14 nt, Pseudomonas aeruginosa PA01
gauguccugggcca

SEQ ID NO: 3457758 - RNA, 19 nt, Pseudomonas aeruginosa PA01
gauguccuuguucggcugg

SEQ ID NO: 3457759 - RNA, 22 nt, Pseudomonas aeruginosa PA01
gaugucgaacaacccgccagca

SEQ ID NO: 3457760 - RNA, 18 nt, Pseudomonas aeruginosa PA01
gaugucgaagcgcaggug

SEQ ID NO: 3457761 - RNA, 18 nt, Pseudomonas aeruginosa PA01
gaugucgaccacgaucuc

SEQ ID NO: 3457762 - RNA, 16 nt, Pseudomonas aeruginosa PA01
gaugucgaccugggua

SEQ ID NO: 3457763 - RNA, 13 nt, Pseudomonas aeruginosa PA01
gaugucgcggcag

SEQ ID NO: 3457764 - RNA, 14 nt, Pseudomonas aeruginosa PA01
gaugucgcggcgcu

SEQ ID NO: 3457765 - RNA, 14 nt, Pseudomonas aeruginosa PA01
gaugucgcggcuga

SEQ ID NO: 3457766 - RNA, 16 nt, Pseudomonas aeruginosa PA01
gaugucgcgggcaugc

SEQ ID NO: 3457767 - RNA, 15 nt, Pseudomonas aeruginosa PA01
gaugucgcuggccag

SEQ ID NO: 3457768 - RNA, 19 nt, Pseudomonas aeruginosa PA01
gaugucgcuggccagcuug

SEQ ID NO: 3457769 - RNA, 14 nt, Pseudomonas aeruginosa PA01
gaugucggccugca

SEQ ID NO: 3457770 - RNA, 17 nt, Pseudomonas aeruginosa PA01
gaugucguagccgcgcg

SEQ ID NO: 3457771 - RNA, 20 nt, Pseudomonas aeruginosa PA01
gaugucguagccgcgcgcca

SEQ ID NO: 3457772 - RNA, 22 nt, Pseudomonas aeruginosa PA01
gaugucguagccgcgcgccagc

SEQ ID NO: 3457773 - RNA, 23 nt, Pseudomonas aeruginosa PA01
gaugucguagccgcgcgccagca

SEQ ID NO: 3457774 - RNA, 21 nt, Pseudomonas aeruginosa PA01
gaugucgucgaacgacucuuc

SEQ ID NO: 3457775 - RNA, 15 nt, Pseudomonas aeruginosa PA01
gaugugcaccagcaa

SEQ ID NO: 3457776 - RNA, 13 nt, Pseudomonas aeruginosa PA01
gaugugcgcaggc

SEQ ID NO: 3457777 - RNA, 16 nt, Pseudomonas aeruginosa PA01
gaugugcgcaggcugg

SEQ ID NO: 3457778 - RNA, 20 nt, Pseudomonas aeruginosa PA01
gaugugcuugagucgcaggc

SEQ ID NO: 3457779 - RNA, 13 nt, Pseudomonas aeruginosa PA01
gauguggccgucg

SEQ ID NO: 3457780 - RNA, 21 nt, Pseudomonas aeruginosa PA01
gauguggccgucgcgccgcgg

SEQ ID NO: 3457781 - RNA, 23 nt, Pseudomonas aeruginosa PA01
gauguggccgucgcgccgcggaa

SEQ ID NO: 3457782 - RNA, 21 nt, Pseudomonas aeruginosa PA01
gauguggcuauccuccaggcc

SEQ ID NO: 3457783 - RNA, 13 nt, Pseudomonas aeruginosa PA01
gauguuccaggcc

SEQ ID NO: 3457784 - RNA, 15 nt, Pseudomonas aeruginosa PA01
gauguuccaggcccg

SEQ ID NO: 3457785 - RNA, 20 nt, Pseudomonas aeruginosa PA01
gauguuccaggcccgccgcg

SEQ ID NO: 3457786 - RNA, 17 nt, Pseudomonas aeruginosa PA01
gauguucgaggcgccga

SEQ ID NO: 3457787 - RNA, 19 nt, Pseudomonas aeruginosa PA01
gauguucgccacgcugcug

SEQ ID NO: 3457788 - RNA, 21 nt, Pseudomonas aeruginosa PA01
gauguucgccgaggggcggga

SEQ ID NO: 3457789 - RNA, 15 nt, Pseudomonas aeruginosa PA01
gauguucgccgccgc

SEQ ID NO: 3457790 - RNA, 23 nt, Pseudomonas aeruginosa PA01
gauguucuccacgucguccggcg

SEQ ID NO: 3457791 - RNA, 16 nt, Pseudomonas aeruginosa PA01
gauguugacgauggcc

SEQ ID NO: 3457792 - RNA, 18 nt, Pseudomonas aeruginosa PA01
gauguugacgauggccca

SEQ ID NO: 3457793 - RNA, 22 nt, Pseudomonas aeruginosa PA01
gauguugccgccgccgaggagg

SEQ ID NO: 3457794 - RNA, 23 nt, Pseudomonas aeruginosa PA01
gauguugccgccgccgaggagga

SEQ ID NO: 3457795 - RNA, 19 nt, Pseudomonas aeruginosa PA01
gauguuguugcccaccagc

SEQ ID NO: 3457796 - RNA, 22 nt, Pseudomonas aeruginosa PA01
gauuacuuggcuucagcuucua

SEQ ID NO: 3457797 - RNA, 12 nt, Pseudomonas aeruginosa PA01
gauucagaugcg

SEQ ID NO: 3457798 - RNA, 17 nt, Pseudomonas aeruginosa PA01
gauucaggcgcgcucgg

SEQ ID NO: 3457799 - RNA, 23 nt, Pseudomonas aeruginosa PA01
gauucaggcggcgaaagccaucu

SEQ ID NO: 3457800 - RNA, 15 nt, Pseudomonas aeruginosa PA01
gauucaucggcggca

SEQ ID NO: 3457801 - RNA, 13 nt, Pseudomonas aeruginosa PA01
gauucccagugcu

SEQ ID NO: 3457802 - RNA, 22 nt, Pseudomonas aeruginosa PA01
gauuccgccggaagcuuccagc

SEQ ID NO: 3457803 - RNA, 18 nt, Pseudomonas aeruginosa PA01
gauuccgggucgaggcug

SEQ ID NO: 3457804 - RNA, 22 nt, Pseudomonas aeruginosa PA01
gauuccgggucgaggcugccga

SEQ ID NO: 3457805 - RNA, 19 nt, Pseudomonas aeruginosa PA01
gauuccugucuccgcaccu

SEQ ID NO: 3457806 - RNA, 20 nt, Pseudomonas aeruginosa PA01
gauuccuuggucaggucgac

SEQ ID NO: 3457807 - RNA, 15 nt, Pseudomonas aeruginosa PA01
gcaaccgcggcggcc

SEQ ID NO: 3457808 - RNA, 20 nt, Pseudomonas aeruginosa PA01
gcaaccgcggcggccucagu

SEQ ID NO: 3457809 - RNA, 13 nt, Pseudomonas aeruginosa PA01
gcaaccgcugccg

SEQ ID NO: 3457810 - RNA, 14 nt, Pseudomonas aeruginosa PA01
gcaaccgcugccgc

SEQ ID NO: 3457811 - RNA, 21 nt, Pseudomonas aeruginosa PA01
gcaaccggguaccugcucgcg

SEQ ID NO: 3457812 - RNA, 16 nt, Pseudomonas aeruginosa PA01
gcaaccgguccucgcc

SEQ ID NO: 3457813 - RNA, 21 nt, Pseudomonas aeruginosa PA01
gcaaccgguuucccucgagca

SEQ ID NO: 3457814 - RNA, 17 nt, Pseudomonas aeruginosa PA01
gcaaccguuccagcgcc

SEQ ID NO: 3457815 - RNA, 13 nt, Pseudomonas aeruginosa PA01
gcaaccuguggaa

SEQ ID NO: 3457816 - RNA, 22 nt, Pseudomonas aeruginosa PA01
gcaaccuguggaauguccugcc

SEQ ID NO: 3457817 - RNA, 20 nt, Pseudomonas aeruginosa PA01
gcaacgaaaaagggcggcca

SEQ ID NO: 3457818 - RNA, 13 nt, Pseudomonas aeruginosa PA01
gcaacgaaaagcc

SEQ ID NO: 3457819 - RNA, 18 nt, Pseudomonas aeruginosa PA01
gcaacgaaaagccgcccc

SEQ ID NO: 3457820 - RNA, 18 nt, Pseudomonas aeruginosa PA01
gcaacgacgaggccugga

SEQ ID NO: 3457821 - RNA, 20 nt, Pseudomonas aeruginosa PA01
gcaacgacgaggccuggaug

SEQ ID NO: 3457822 - RNA, 22 nt, Pseudomonas aeruginosa PA01
gcaacgauaccgccgccggccu

SEQ ID NO: 3457823 - RNA, 15 nt, Pseudomonas aeruginosa PA01
gcaacgaucucgcuc

SEQ ID NO: 3457824 - RNA, 18 nt, Pseudomonas aeruginosa PA01
gcaacgaucucgcucucg

SEQ ID NO: 3457825 - RNA, 21 nt, Pseudomonas aeruginosa PA01
gcaacgcaaguaacacucgug

SEQ ID NO: 3457826 - RNA, 16 nt, Pseudomonas aeruginosa PA01
gcaacgccagcaggcg

SEQ ID NO: 3457827 - RNA, 13 nt, Pseudomonas aeruginosa PA01
gcaacgccaggcc

SEQ ID NO: 3457828 - RNA, 22 nt, Pseudomonas aeruginosa PA01
gcaacgccaggcugucagggcg

SEQ ID NO: 3457829 - RNA, 15 nt, Pseudomonas aeruginosa PA01
gcaacgcccgcgagc

SEQ ID NO: 3457830 - RNA, 21 nt, Pseudomonas aeruginosa PA01
gcaacgcccgcgagccguccu

SEQ ID NO: 3457831 - RNA, 13 nt, Pseudomonas aeruginosa PA01
gcaacgccgacgg

SEQ ID NO: 3457832 - RNA, 12 nt, Pseudomonas aeruginosa PA01
gcaacgccgccc

SEQ ID NO: 3457833 - RNA, 13 nt, Pseudomonas aeruginosa PA01
gcaacgccgcccc

SEQ ID NO: 3457834 - RNA, 14 nt, Pseudomonas aeruginosa PA01
gcaacgccgccccc

SEQ ID NO: 3457835 - RNA, 20 nt, Pseudomonas aeruginosa PA01
gcaacgccgcccccagcgcg

SEQ ID NO: 3457836 - RNA, 17 nt, Pseudomonas aeruginosa PA01
gcaacgccggcccgugc

SEQ ID NO: 3457837 - RNA, 18 nt, Pseudomonas aeruginosa PA01
gcaacgccggcccgugcc

SEQ ID NO: 3457838 - RNA, 18 nt, Pseudomonas aeruginosa PA01
gcaacgccuggugcaggu

SEQ ID NO: 3457839 - RNA, 21 nt, Pseudomonas aeruginosa PA01
gcaacgccuggugcaggucgc

SEQ ID NO: 3457840 - RNA, 22 nt, Pseudomonas aeruginosa PA01
gcaacgccuggugcaggucgcg

SEQ ID NO: 3457841 - RNA, 12 nt, Pseudomonas aeruginosa PA01
gcaacgcgccca

SEQ ID NO: 3457842 - RNA, 20 nt, Pseudomonas aeruginosa PA01
gcaacgcgcccacuccuccg

SEQ ID NO: 3457843 - RNA, 14 nt, Pseudomonas aeruginosa PA01
gcaacgcggcguca

SEQ ID NO: 3457844 - RNA, 22 nt, Pseudomonas aeruginosa PA01
gcaacgcgguuauccgccgcug

SEQ ID NO: 3457845 - RNA, 14 nt, Pseudomonas aeruginosa PA01
gcaacgcgugauac

SEQ ID NO: 3457846 - RNA, 15 nt, Pseudomonas aeruginosa PA01
gcaacgcuuccagca

SEQ ID NO: 3457847 - RNA, 21 nt, Pseudomonas aeruginosa PA01
gcaacgcuuccagcaccuccc

SEQ ID NO: 3457848 - RNA, 20 nt, Pseudomonas aeruginosa PA01
gcaacggacguuccaccugg

SEQ ID NO: 3457849 - RNA, 17 nt, Pseudomonas aeruginosa PA01
gcaacggcagcgcuucg

SEQ ID NO: 3457850 - RNA, 12 nt, Pseudomonas aeruginosa PA01
gcaacggcuggg

SEQ ID NO: 3457851 - RNA, 17 nt, Pseudomonas aeruginosa PA01
gcaacgggacgccaggc

SEQ ID NO: 3457852 - RNA, 18 nt, Pseudomonas aeruginosa PA01
gcaacgggacgccaggcg

SEQ ID NO: 3457853 - RNA, 12 nt, Pseudomonas aeruginosa PA01
gcaacgggcggc

SEQ ID NO: 3457854 - RNA, 16 nt, Pseudomonas aeruginosa PA01
gcaacguccucgcgcc

SEQ ID NO: 3457855 - RNA, 18 nt, Pseudomonas aeruginosa PA01
gcaacguccucgcgccgc

SEQ ID NO: 3457856 - RNA, 19 nt, Pseudomonas aeruginosa PA01
gcaacguccucgcgccgcu

SEQ ID NO: 3457857 - RNA, 18 nt, Pseudomonas aeruginosa PA01
gcaacuccagagccaugg

SEQ ID NO: 3457858 - RNA, 23 nt, Pseudomonas aeruginosa PA01
gcaacuccgccuguccaccggug

SEQ ID NO: 3457859 - RNA, 13 nt, Pseudomonas aeruginosa PA01
gcaacucgccgcc

SEQ ID NO: 3457860 - RNA, 15 nt, Pseudomonas aeruginosa PA01
gcaacucgccgccga

SEQ ID NO: 3457861 - RNA, 14 nt, Pseudomonas aeruginosa PA01
gcaacucggcgccg

SEQ ID NO: 3457862 - RNA, 15 nt, Pseudomonas aeruginosa PA01
gcaacucggcgccgu

SEQ ID NO: 3457863 - RNA, 17 nt, Pseudomonas aeruginosa PA01
gcaacucggcgccguug

SEQ ID NO: 3457864 - RNA, 15 nt, Pseudomonas aeruginosa PA01
gcaacucggcggcga

SEQ ID NO: 3457865 - RNA, 22 nt, Pseudomonas aeruginosa PA01
gcaacucggcggcgagcgccgc

SEQ ID NO: 3457866 - RNA, 18 nt, Pseudomonas aeruginosa PA01
gcaacucgucguccagcg

SEQ ID NO: 3457867 - RNA, 23 nt, Pseudomonas aeruginosa PA01
gcaacucgucguccagcggcucg

SEQ ID NO: 3457868 - RNA, 15 nt, Pseudomonas aeruginosa PA01
gcaacugaccuggcc

SEQ ID NO: 3457869 - RNA, 20 nt, Pseudomonas aeruginosa PA01
gcaacugacggcggaaggcg

SEQ ID NO: 3457870 - RNA, 19 nt, Pseudomonas aeruginosa PA01
gcaacugaucagccgggcg

SEQ ID NO: 3457871 - RNA, 14 nt, Pseudomonas aeruginosa PA01
gcaacugcacguug

SEQ ID NO: 3457872 - RNA, 20 nt, Pseudomonas aeruginosa PA01
gcaacugcauguugccguug

SEQ ID NO: 3457873 - RNA, 18 nt, Pseudomonas aeruginosa PA01
gcaacugccaaccgcgcu

SEQ ID NO: 3457874 - RNA, 21 nt, Pseudomonas aeruginosa PA01
gcaacugccaaccgcgcucgg

SEQ ID NO: 3457875 - RNA, 16 nt, Pseudomonas aeruginosa PA01
gcaacugccgcccgcu

SEQ ID NO: 3457876 - RNA, 13 nt, Pseudomonas aeruginosa PA01
gcaacugcgccag

SEQ ID NO: 3457877 - RNA, 16 nt, Pseudomonas aeruginosa PA01
gcaacugcguccgaug

SEQ ID NO: 3457878 - RNA, 19 nt, Pseudomonas aeruginosa PA01
gcaacugcucgaacugcuc

SEQ ID NO: 3457879 - RNA, 14 nt, Pseudomonas aeruginosa PA01
gcaacugcucgggc

SEQ ID NO: 3457880 - RNA, 22 nt, Pseudomonas aeruginosa PA01
gcaacuggaaggccgcgccgag

SEQ ID NO: 3457881 - RNA, 22 nt, Pseudomonas aeruginosa PA01
gcaacuggccgagaucggucac

SEQ ID NO: 3457882 - RNA, 15 nt, Pseudomonas aeruginosa PA01
gcaacuggcuggccu

SEQ ID NO: 3457883 - RNA, 17 nt, Pseudomonas aeruginosa PA01
gcaacuggcuggccugu

SEQ ID NO: 3457884 - RNA, 15 nt, Pseudomonas aeruginosa PA01
gcaacuggucgccgc

SEQ ID NO: 3457885 - RNA, 16 nt, Pseudomonas aeruginosa PA01
gcaacuggucgccgca

SEQ ID NO: 3457886 - RNA, 17 nt, Pseudomonas aeruginosa PA01
gcaacuggucgccgcag

SEQ ID NO: 3457887 - RNA, 21 nt, Pseudomonas aeruginosa PA01
gcaacuggucgcggcugcgcg

SEQ ID NO: 3457888 - RNA, 21 nt, Pseudomonas aeruginosa PA01
gcaagacgaaagagcccggca

SEQ ID NO: 3457889 - RNA, 17 nt, Pseudomonas aeruginosa PA01
gcaagauuaucagcaac

SEQ ID NO: 3457890 - RNA, 18 nt, Pseudomonas aeruginosa PA01
gcaagauuaucagcaacg

SEQ ID NO: 3457891 - RNA, 21 nt, Pseudomonas aeruginosa PA01
gcaagcaccuugagggccuug

SEQ ID NO: 3457892 - RNA, 12 nt, Pseudomonas aeruginosa PA01
gcaagcaggccg

SEQ ID NO: 3457893 - RNA, 14 nt, Pseudomonas aeruginosa PA01
gcaagcaggccgcg

SEQ ID NO: 3457894 - RNA, 21 nt, Pseudomonas aeruginosa PA01
gcaagccauuccaacuggcgu

SEQ ID NO: 3457895 - RNA, 24 nt, Pseudomonas aeruginosa PA01
gcaagccauuccaacuggcguagg

SEQ ID NO: 3457896 - RNA, 23 nt, Pseudomonas aeruginosa PA01
gcaagcccgugggaucgccacgc

SEQ ID NO: 3457897 - RNA, 19 nt, Pseudomonas aeruginosa PA01
gcaagccguagaacgccag

SEQ ID NO: 3457898 - RNA, 21 nt, Pseudomonas aeruginosa PA01
gcaagccguagaacgccagga

SEQ ID NO: 3457899 - RNA, 18 nt, Pseudomonas aeruginosa PA01
gcaagccuuccagguagu

SEQ ID NO: 3457900 - RNA, 16 nt, Pseudomonas aeruginosa PA01
gcaagcgcaugaggcu

SEQ ID NO: 3457901 - RNA, 22 nt, Pseudomonas aeruginosa PA01
gcaagcgcaugaggcuggccag

SEQ ID NO: 3457902 - RNA, 14 nt, Pseudomonas aeruginosa PA01
gcaagcgcccggcg

SEQ ID NO: 3457903 - RNA, 13 nt, Pseudomonas aeruginosa PA01
gcaagcggauauc

SEQ ID NO: 3457904 - RNA, 17 nt, Pseudomonas aeruginosa PA01
gcaagcggauauccccc

SEQ ID NO: 3457905 - RNA, 15 nt, Pseudomonas aeruginosa PA01
gcaagcgugccccga

SEQ ID NO: 3457906 - RNA, 17 nt, Pseudomonas aeruginosa PA01
gcaagcgugccccgacu

SEQ ID NO: 3457907 - RNA, 15 nt, Pseudomonas aeruginosa PA01
gcaagcuccccgccg

SEQ ID NO: 3457908 - RNA, 16 nt, Pseudomonas aeruginosa PA01
gcaagcuccccgccgc

SEQ ID NO: 3457909 - RNA, 22 nt, Pseudomonas aeruginosa PA01
gcaagcuccccgccgccaggcg

SEQ ID NO: 3457910 - RNA, 20 nt, Pseudomonas aeruginosa PA01
gcaccaugcccgcugggcag

SEQ ID NO: 3457911 - RNA, 21 nt, Pseudomonas aeruginosa PA01
gcaccaugcccuuguccggcc

SEQ ID NO: 3457912 - RNA, 13 nt, Pseudomonas aeruginosa PA01
gcaccaugccgau

SEQ ID NO: 3457913 - RNA, 20 nt, Pseudomonas aeruginosa PA01
gcacccagaccuuccagccg

SEQ ID NO: 3457914 - RNA, 21 nt, Pseudomonas aeruginosa PA01
gcacccagaccuuccagccgc

SEQ ID NO: 3457915 - RNA, 23 nt, Pseudomonas aeruginosa PA01
gcacccagaccuuccagccgcgc

SEQ ID NO: 3457916 - RNA, 20 nt, Pseudomonas aeruginosa PA01
gcacccaggauuuguccgcg

SEQ ID NO: 3457917 - RNA, 23 nt, Pseudomonas aeruginosa PA01
gcacccaggauuuguccgcgcca

SEQ ID NO: 3457918 - RNA, 12 nt, Pseudomonas aeruginosa PA01
gcacccaggcca

SEQ ID NO: 3457919 - RNA, 14 nt, Pseudomonas aeruginosa PA01
gcacccaggccacg

SEQ ID NO: 3457920 - RNA, 17 nt, Pseudomonas aeruginosa PA01
gcacccaggccacgccc

SEQ ID NO: 3457921 - RNA, 16 nt, Pseudomonas aeruginosa PA01
gcacccaggcgacgcu

SEQ ID NO: 3457922 - RNA, 24 nt, Pseudomonas aeruginosa PA01
gcacccagguagagaagcguucgc

SEQ ID NO: 3457923 - RNA, 20 nt, Pseudomonas aeruginosa PA01
gcacccagucuucgcuggcg

SEQ ID NO: 3457924 - RNA, 18 nt, Pseudomonas aeruginosa PA01
gcaccccauccucgccgg

SEQ ID NO: 3457925 - RNA, 13 nt, Pseudomonas aeruginosa PA01
gcacccccagcag

SEQ ID NO: 3457926 - RNA, 20 nt, Pseudomonas aeruginosa PA01
gcacccccagcaggccagcc

SEQ ID NO: 3457927 - RNA, 22 nt, Pseudomonas aeruginosa PA01
gcacccccagcaggccagccaa

SEQ ID NO: 3457928 - RNA, 17 nt, Pseudomonas aeruginosa PA01
gcaccccgagcccggcc

SEQ ID NO: 3457929 - RNA, 20 nt, Pseudomonas aeruginosa PA01
gcaccccgagcccggccggg

SEQ ID NO: 3457930 - RNA, 21 nt, Pseudomonas aeruginosa PA01
gcaccccgagcccggccggga

SEQ ID NO: 3457931 - RNA, 17 nt, Pseudomonas aeruginosa PA01
gcaccccgagcggcgcg

SEQ ID NO: 3457932 - RNA, 11 nt, Pseudomonas aeruginosa PA01
gcaccccuucg

SEQ ID NO: 3457933 - RNA, 18 nt, Pseudomonas aeruginosa PA01
gcaccccuugcagccagc

SEQ ID NO: 3457934 - RNA, 18 nt, Pseudomonas aeruginosa PA01
gcacccgcaccagccggc

SEQ ID NO: 3457935 - RNA, 20 nt, Pseudomonas aeruginosa PA01
gcacccgcaccagccggcgc

SEQ ID NO: 3457936 - RNA, 16 nt, Pseudomonas aeruginosa PA01
gcacccgcucggccuu

SEQ ID NO: 3457937 - RNA, 19 nt, Pseudomonas aeruginosa PA01
gcacccggaccuuguccag

SEQ ID NO: 3457938 - RNA, 14 nt, Pseudomonas aeruginosa PA01
gcacccggcccaug

SEQ ID NO: 3457939 - RNA, 12 nt, Pseudomonas aeruginosa PA01
gcacccgggcga

SEQ ID NO: 3457940 - RNA, 14 nt, Pseudomonas aeruginosa PA01
gcacccgggcgacc

SEQ ID NO: 3457941 - RNA, 17 nt, Pseudomonas aeruginosa PA01
gcacccgggcgaccugc

SEQ ID NO: 3457942 - RNA, 22 nt, Pseudomonas aeruginosa PA01
gcacccggucgaaccccuuccc

SEQ ID NO: 3457943 - RNA, 20 nt, Pseudomonas aeruginosa PA01
gcacccgguugaccccgcgg

SEQ ID NO: 3457944 - RNA, 21 nt, Pseudomonas aeruginosa PA01
gcacccucuuccgcgcugacc

SEQ ID NO: 3457945 - RNA, 14 nt, Pseudomonas aeruginosa PA01
gcacccuggacccg

SEQ ID NO: 3457946 - RNA, 18 nt, Pseudomonas aeruginosa PA01
gcacccuggacccgggcc

SEQ ID NO: 3457947 - RNA, 14 nt, Pseudomonas aeruginosa PA01
gcacccuuggcgca

SEQ ID NO: 3457948 - RNA, 16 nt, Pseudomonas aeruginosa PA01
gcacccuuggcgcagg

SEQ ID NO: 3457949 - RNA, 19 nt, Pseudomonas aeruginosa PA01
gcacccuuggcgcagguag

SEQ ID NO: 3457950 - RNA, 15 nt, Pseudomonas aeruginosa PA01
gcaccgaacggugca

SEQ ID NO: 3457951 - RNA, 16 nt, Pseudomonas aeruginosa PA01
gcaccgaacggugcag

SEQ ID NO: 3457952 - RNA, 15 nt, Pseudomonas aeruginosa PA01
gcaccgacgccgccu

SEQ ID NO: 3457953 - RNA, 21 nt, Pseudomonas aeruginosa PA01
gcaccgacgccgccugcgccu

SEQ ID NO: 3457954 - RNA, 15 nt, Pseudomonas aeruginosa PA01
gcaccgagcaggcac

SEQ ID NO: 3457955 - RNA, 17 nt, Pseudomonas aeruginosa PA01
gcaccgagcaggcaccc

SEQ ID NO: 3457956 - RNA, 15 nt, Pseudomonas aeruginosa PA01
gcaccgaggcgcgcc

SEQ ID NO: 3457957 - RNA, 16 nt, Pseudomonas aeruginosa PA01
gcaccgagucggcaac

SEQ ID NO: 3457958 - RNA, 16 nt, Pseudomonas aeruginosa PA01
gcaccgaguugaccag

SEQ ID NO: 3457959 - RNA, 19 nt, Pseudomonas aeruginosa PA01
gcaccgaucgcccgcgccu

SEQ ID NO: 3457960 - RNA, 18 nt, Pseudomonas aeruginosa PA01
gcaccgcaagggugcuca

SEQ ID NO: 3457961 - RNA, 13 nt, Pseudomonas aeruginosa PA01
gcaccgccaccag

SEQ ID NO: 3457962 - RNA, 15 nt, Pseudomonas aeruginosa PA01
gcaccgccaccagcg

SEQ ID NO: 3457963 - RNA, 17 nt, Pseudomonas aeruginosa PA01
gcaccgccaccagcgag

SEQ ID NO: 3457964 - RNA, 13 nt, Pseudomonas aeruginosa PA01
gcaccgccagcag

SEQ ID NO: 3457965 - RNA, 12 nt, Pseudomonas aeruginosa PA01
gcaccgccagcc

SEQ ID NO: 3457966 - RNA, 19 nt, Pseudomonas aeruginosa PA01
gcaccgccagcgucgccgc

SEQ ID NO: 3457967 - RNA, 20 nt, Pseudomonas aeruginosa PA01
gcaccgccagcgucgccgcc

SEQ ID NO: 3457968 - RNA, 12 nt, Pseudomonas aeruginosa PA01
gcaccgcccugc

SEQ ID NO: 3457969 - RNA, 20 nt, Pseudomonas aeruginosa PA01
gcaccgccggguacagcgcc

SEQ ID NO: 3457970 - RNA, 15 nt, Pseudomonas aeruginosa PA01
gcaccgccucgugca

SEQ ID NO: 3457971 - RNA, 22 nt, Pseudomonas aeruginosa PA01
gcaccgccucgugcagcaagcc

SEQ ID NO: 3457972 - RNA, 13 nt, Pseudomonas aeruginosa PA01
gcaccgccugcaa

SEQ ID NO: 3457973 - RNA, 14 nt, Pseudomonas aeruginosa PA01
gcaccgccugcaac

SEQ ID NO: 3457974 - RNA, 15 nt, Pseudomonas aeruginosa PA01
gcaccgccugcaacu

SEQ ID NO: 3457975 - RNA, 17 nt, Pseudomonas aeruginosa PA01
gcaccgccugcaacucg

SEQ ID NO: 3457976 - RNA, 19 nt, Pseudomonas aeruginosa PA01
gcaccgccugcaacucguc

SEQ ID NO: 3457977 - RNA, 14 nt, Pseudomonas aeruginosa PA01
gcaccgccugcagc

SEQ ID NO: 3457978 - RNA, 15 nt, Pseudomonas aeruginosa PA01
gcaccgccugcagca

SEQ ID NO: 3457979 - RNA, 22 nt, Pseudomonas aeruginosa PA01
gcaccgccugcagcaccaccuc

SEQ ID NO: 3457980 - RNA, 14 nt, Pseudomonas aeruginosa PA01
gcaccgccuggcgc

SEQ ID NO: 3457981 - RNA, 15 nt, Pseudomonas aeruginosa PA01
gcaccgccuggcgca

SEQ ID NO: 3457982 - RNA, 18 nt, Pseudomonas aeruginosa PA01
gcaccgcgagcaugcuca

SEQ ID NO: 3457983 - RNA, 12 nt, Pseudomonas aeruginosa PA01
gcaccgcgcagc

SEQ ID NO: 3457984 - RNA, 14 nt, Pseudomonas aeruginosa PA01
gcaccgcgccggcg

SEQ ID NO: 3457985 - RNA, 15 nt, Pseudomonas aeruginosa PA01
gcaccgcgccggcgg

SEQ ID NO: 3457986 - RNA, 16 nt, Pseudomonas aeruginosa PA01
gcaccgcgccggcggu

SEQ ID NO: 3457987 - RNA, 13 nt, Pseudomonas aeruginosa PA01
gcaccgcgccggg

SEQ ID NO: 3457988 - RNA, 15 nt, Pseudomonas aeruginosa PA01
gcaccgcgccgggaa

SEQ ID NO: 3457989 - RNA, 12 nt, Pseudomonas aeruginosa PA01
gcaccgcgccuu

SEQ ID NO: 3457990 - RNA, 23 nt, Pseudomonas aeruginosa PA01
gcaccgcgccuuccagcccuucg

SEQ ID NO: 3457991 - RNA, 22 nt, Pseudomonas aeruginosa PA01
gcaccgcgcgcuuuuccggcgc

SEQ ID NO: 3457992 - RNA, 12 nt, Pseudomonas aeruginosa PA01
gcaccgcggcca

SEQ ID NO: 3457993 - RNA, 14 nt, Pseudomonas aeruginosa PA01
gcaccgcggccagu

SEQ ID NO: 3457994 - RNA, 13 nt, Pseudomonas aeruginosa PA01
gcaccgcggcgag

SEQ ID NO: 3457995 - RNA, 15 nt, Pseudomonas aeruginosa PA01
gcaccgcggcgagcc

SEQ ID NO: 3457996 - RNA, 16 nt, Pseudomonas aeruginosa PA01
gcaccgcggcgcggau

SEQ ID NO: 3457997 - RNA, 20 nt, Pseudomonas aeruginosa PA01
gcaccgcuucugugggcagc

SEQ ID NO: 3457998 - RNA, 17 nt, Pseudomonas aeruginosa PA01
gcaccgcuugccagccg

SEQ ID NO: 3457999 - RNA, 18 nt, Pseudomonas aeruginosa PA01
gcaccgcuugccagccgc

SEQ ID NO: 3458000 - RNA, 16 nt, Pseudomonas aeruginosa PA01
gcaccgcuuucaccag

SEQ ID NO: 3458001 - RNA, 20 nt, Pseudomonas aeruginosa PA01
gcaccgcuuucaccaggguc

SEQ ID NO: 3458002 - RNA, 21 nt, Pseudomonas aeruginosa PA01
gcaccgcuuucaccagggucg

SEQ ID NO: 3458003 - RNA, 24 nt, Pseudomonas aeruginosa PA01
gcaccggcauguagcgcgccgagg

SEQ ID NO: 3458004 - RNA, 19 nt, Pseudomonas aeruginosa PA01
gcaccggccacucgcagcc

SEQ ID NO: 3458005 - RNA, 21 nt, Pseudomonas aeruginosa PA01
gcaccggccacucgcagccgc

SEQ ID NO: 3458006 - RNA, 22 nt, Pseudomonas aeruginosa PA01
gcaccggccacucgcagccgcg

SEQ ID NO: 3458007 - RNA, 15 nt, Pseudomonas aeruginosa PA01
gcaccggccaggcgc

SEQ ID NO: 3458008 - RNA, 16 nt, Pseudomonas aeruginosa PA01
gcaccggccaggcgcu

SEQ ID NO: 3458009 - RNA, 18 nt, Pseudomonas aeruginosa PA01
gcaccggcgauggccggc

SEQ ID NO: 3458010 - RNA, 21 nt, Pseudomonas aeruginosa PA01
gcaccggcgauggccggcacc

SEQ ID NO: 3458011 - RNA, 15 nt, Pseudomonas aeruginosa PA01
gcaccggcgcgccgg

SEQ ID NO: 3458012 - RNA, 16 nt, Pseudomonas aeruginosa PA01
gcaccggcgcgccgga

SEQ ID NO: 3458013 - RNA, 13 nt, Pseudomonas aeruginosa PA01
gcacgaugcugaa

SEQ ID NO: 3458014 - RNA, 17 nt, Pseudomonas aeruginosa PA01
gcacgaugucgaccugg

SEQ ID NO: 3458015 - RNA, 21 nt, Pseudomonas aeruginosa PA01
gcacgcaauagugcagcucca

SEQ ID NO: 3458016 - RNA, 21 nt, Pseudomonas aeruginosa PA01
gcacgcaauggcgcagccgcu

SEQ ID NO: 3458017 - RNA, 20 nt, Pseudomonas aeruginosa PA01
gcacgcacgcgccugcuuca

SEQ ID NO: 3458018 - RNA, 13 nt, Pseudomonas aeruginosa PA01
gcacgcagcgccg

SEQ ID NO: 3458019 - RNA, 14 nt, Pseudomonas aeruginosa PA01
gcacgcagcgccgc

SEQ ID NO: 3458020 - RNA, 16 nt, Pseudomonas aeruginosa PA01
gcacgcagcgccgcgu

SEQ ID NO: 3458021 - RNA, 14 nt, Pseudomonas aeruginosa PA01
gcacgcaggccgcu

SEQ ID NO: 3458022 - RNA, 17 nt, Pseudomonas aeruginosa PA01
gcacgcaggccgcugcc

SEQ ID NO: 3458023 - RNA, 18 nt, Pseudomonas aeruginosa PA01
gcacgcaggccgcugccu

SEQ ID NO: 3458024 - RNA, 20 nt, Pseudomonas aeruginosa PA01
gcacgcaggccgcugccugu

SEQ ID NO: 3458025 - RNA, 14 nt, Pseudomonas aeruginosa PA01
gcacgcagggcuau

SEQ ID NO: 3458026 - RNA, 14 nt, Pseudomonas aeruginosa PA01
gcacgcauagcgcg

SEQ ID NO: 3458027 - RNA, 18 nt, Pseudomonas aeruginosa PA01
gcacgcauagcgcgcugu

SEQ ID NO: 3458028 - RNA, 15 nt, Pseudomonas aeruginosa PA01
gcacgcccaggcgcu

SEQ ID NO: 3458029 - RNA, 22 nt, Pseudomonas aeruginosa PA01
gcacgcccaggcgcucggcgac

SEQ ID NO: 3458030 - RNA, 15 nt, Pseudomonas aeruginosa PA01
gcacgcccaucgcca

SEQ ID NO: 3458031 - RNA, 22 nt, Pseudomonas aeruginosa PA01
gcacgcccaucgccaccagcag

SEQ ID NO: 3458032 - RNA, 22 nt, Pseudomonas aeruginosa PA01
gcacgccccauccgggcggcgg

SEQ ID NO: 3458033 - RNA, 21 nt, Pseudomonas aeruginosa PA01
gcacgcccuugcuguucgccu

SEQ ID NO: 3458034 - RNA, 14 nt, Pseudomonas aeruginosa PA01
gcacgccgcgaccg

SEQ ID NO: 3458035 - RNA, 15 nt, Pseudomonas aeruginosa PA01
gcacgccgcggaagg

SEQ ID NO: 3458036 - RNA, 13 nt, Pseudomonas aeruginosa PA01
gcacgccggccuc

SEQ ID NO: 3458037 - RNA, 15 nt, Pseudomonas aeruginosa PA01
gcacgccggccucgc

SEQ ID NO: 3458038 - RNA, 18 nt, Pseudomonas aeruginosa PA01
gcacgccggccucgcgca

SEQ ID NO: 3458039 - RNA, 20 nt, Pseudomonas aeruginosa PA01
gcacgccggccucgcgcaac

SEQ ID NO: 3458040 - RNA, 12 nt, Pseudomonas aeruginosa PA01
gcacgccggugg

SEQ ID NO: 3458041 - RNA, 21 nt, Pseudomonas aeruginosa PA01
gcacgccgguggccaggcucu

SEQ ID NO: 3458042 - RNA, 21 nt, Pseudomonas aeruginosa PA01
gcacgccgugcaucaccggca

SEQ ID NO: 3458043 - RNA, 17 nt, Pseudomonas aeruginosa PA01
gcacgccguggaccagg

SEQ ID NO: 3458044 - RNA, 23 nt, Pseudomonas aeruginosa PA01
gcacgccuuccggguugaaggcg

SEQ ID NO: 3458045 - RNA, 22 nt, Pseudomonas aeruginosa PA01
gcacgcgcaguacgaucagcca

SEQ ID NO: 3458046 - RNA, 15 nt, Pseudomonas aeruginosa PA01
gcacgcgccgggucg

SEQ ID NO: 3458047 - RNA, 17 nt, Pseudomonas aeruginosa PA01
gcacgcggagggcggcc

SEQ ID NO: 3458048 - RNA, 14 nt, Pseudomonas aeruginosa PA01
gcacgcguccgacc

SEQ ID NO: 3458049 - RNA, 15 nt, Pseudomonas aeruginosa PA01
gcacgcguccgacca

SEQ ID NO: 3458050 - RNA, 14 nt, Pseudomonas aeruginosa PA01
gcacgcguggcgag

SEQ ID NO: 3458051 - RNA, 13 nt, Pseudomonas aeruginosa PA01
gcacgcucaggca

SEQ ID NO: 3458052 - RNA, 17 nt, Pseudomonas aeruginosa PA01
gcacgcucaggcagcga

SEQ ID NO: 3458053 - RNA, 15 nt, Pseudomonas aeruginosa PA01
gcacgcucaggcgca

SEQ ID NO: 3458054 - RNA, 13 nt, Pseudomonas aeruginosa PA01
gcacgcucaugcg

SEQ ID NO: 3458055 - RNA, 16 nt, Pseudomonas aeruginosa PA01
gcacgcuccagaucgc

SEQ ID NO: 3458056 - RNA, 18 nt, Pseudomonas aeruginosa PA01
gcacgcuccagggcggcc

SEQ ID NO: 3458057 - RNA, 19 nt, Pseudomonas aeruginosa PA01
gcacgcuccagggcggccc

SEQ ID NO: 3458058 - RNA, 12 nt, Pseudomonas aeruginosa PA01
gcacgcucuucu

SEQ ID NO: 3458059 - RNA, 19 nt, Pseudomonas aeruginosa PA01
gcacgcugaagaucgccac

SEQ ID NO: 3458060 - RNA, 17 nt, Pseudomonas aeruginosa PA01
gcacgcugacgccggca

SEQ ID NO: 3458061 - RNA, 19 nt, Pseudomonas aeruginosa PA01
gcacgcugacgccggcacc

SEQ ID NO: 3458062 - RNA, 13 nt, Pseudomonas aeruginosa PA01
gcacgcugccagc

SEQ ID NO: 3458063 - RNA, 17 nt, Pseudomonas aeruginosa PA01
gcacgcugccagcaggc

SEQ ID NO: 3458064 - RNA, 14 nt, Pseudomonas aeruginosa PA01
gcacgcugccgccg

SEQ ID NO: 3458065 - RNA, 15 nt, Pseudomonas aeruginosa PA01
gcacgcugccgccga

SEQ ID NO: 3458066 - RNA, 13 nt, Pseudomonas aeruginosa PA01
gcacgcugcgccg

SEQ ID NO: 3458067 - RNA, 16 nt, Pseudomonas aeruginosa PA01
gcacgcugcgccggcg

SEQ ID NO: 3458068 - RNA, 20 nt, Pseudomonas aeruginosa PA01
gcacgcugcgccggcgcugc

SEQ ID NO: 3458069 - RNA, 22 nt, Pseudomonas aeruginosa PA01
gcacgcugcgccggcgcugcga

SEQ ID NO: 3458070 - RNA, 21 nt, Pseudomonas aeruginosa PA01
gcacgcugcuugcgcaccucc

SEQ ID NO: 3458071 - RNA, 12 nt, Pseudomonas aeruginosa PA01
gcacgcuggcgu

SEQ ID NO: 3458072 - RNA, 13 nt, Pseudomonas aeruginosa PA01
gcacgcuggcguc

SEQ ID NO: 3458073 - RNA, 13 nt, Pseudomonas aeruginosa PA01
gcacgcuggugcc

SEQ ID NO: 3458074 - RNA, 15 nt, Pseudomonas aeruginosa PA01
gcacgcuggugccga

SEQ ID NO: 3458075 - RNA, 18 nt, Pseudomonas aeruginosa PA01
gcacgcuguagaccagcu

SEQ ID NO: 3458076 - RNA, 16 nt, Pseudomonas aeruginosa PA01
gcacgcuucuccucgg

SEQ ID NO: 3458077 - RNA, 17 nt, Pseudomonas aeruginosa PA01
gcacgcuucuccucggc

SEQ ID NO: 3458078 - RNA, 19 nt, Pseudomonas aeruginosa PA01
gcacgcuucuccucggccg

SEQ ID NO: 3458079 - RNA, 21 nt, Pseudomonas aeruginosa PA01
gcacgcuucuccucggccgac

SEQ ID NO: 3458080 - RNA, 17 nt, Pseudomonas aeruginosa PA01
gcacggaaacgccgaga

SEQ ID NO: 3458081 - RNA, 16 nt, Pseudomonas aeruginosa PA01
gcacggaagcgcugcu

SEQ ID NO: 3458082 - RNA, 19 nt, Pseudomonas aeruginosa PA01
gcacggaagcgcugcucga

SEQ ID NO: 3458083 - RNA, 21 nt, Pseudomonas aeruginosa PA01
gcacggaagcgcugcucgacc

SEQ ID NO: 3458084 - RNA, 22 nt, Pseudomonas aeruginosa PA01
gcacggaagcgcugcucgacca

SEQ ID NO: 3458085 - RNA, 23 nt, Pseudomonas aeruginosa PA01
gcacggaagcgcugcucgaccac

SEQ ID NO: 3458086 - RNA, 23 nt, Pseudomonas aeruginosa PA01
gcacggaaucggacgaucgacga

SEQ ID NO: 3458087 - RNA, 13 nt, Pseudomonas aeruginosa PA01
gcacggaggcgcu

SEQ ID NO: 3458088 - RNA, 17 nt, Pseudomonas aeruginosa PA01
gcacggaggcgcucagg

SEQ ID NO: 3458089 - RNA, 16 nt, Pseudomonas aeruginosa PA01
gcacggauaccacccg

SEQ ID NO: 3458090 - RNA, 22 nt, Pseudomonas aeruginosa PA01
gcacggauaccacccgcagccc

SEQ ID NO: 3458091 - RNA, 18 nt, Pseudomonas aeruginosa PA01
gcacggaucgcgcugggc

SEQ ID NO: 3458092 - RNA, 20 nt, Pseudomonas aeruginosa PA01
gcacggaucgcgcugggcgc

SEQ ID NO: 3458093 - RNA, 16 nt, Pseudomonas aeruginosa PA01
gcacggcaacgucgcg

SEQ ID NO: 3458094 - RNA, 20 nt, Pseudomonas aeruginosa PA01
gcacggcaacgucgcggaug

SEQ ID NO: 3458095 - RNA, 19 nt, Pseudomonas aeruginosa PA01
gcacggcaucgauccgcac

SEQ ID NO: 3458096 - RNA, 20 nt, Pseudomonas aeruginosa PA01
gcacggcaucgauccgcacc

SEQ ID NO: 3458097 - RNA, 13 nt, Pseudomonas aeruginosa PA01
gcacggccaggcc

SEQ ID NO: 3458098 - RNA, 12 nt, Pseudomonas aeruginosa PA01
gcacggccggcg

SEQ ID NO: 3458099 - RNA, 20 nt, Pseudomonas aeruginosa PA01
gcacggccgguagucggggc

SEQ ID NO: 3458100 - RNA, 17 nt, Pseudomonas aeruginosa PA01
gcacggccgucacggcc

SEQ ID NO: 3458101 - RNA, 14 nt, Pseudomonas aeruginosa PA01
gcacggccguccug

SEQ ID NO: 3458102 - RNA, 13 nt, Pseudomonas aeruginosa PA01
gcacggccucgcg

SEQ ID NO: 3458103 - RNA, 22 nt, Pseudomonas aeruginosa PA01
gcacggccucgcgugcgcuggu

SEQ ID NO: 3458104 - RNA, 17 nt, Pseudomonas aeruginosa PA01
gcacggccugcaccugc

SEQ ID NO: 3458105 - RNA, 21 nt, Pseudomonas aeruginosa PA01
gcacggcgacgcugucgugga

SEQ ID NO: 3458106 - RNA, 19 nt, Pseudomonas aeruginosa PA01
gcacggcgauacccaggcc

SEQ ID NO: 3458107 - RNA, 21 nt, Pseudomonas aeruginosa PA01
gcacggcgauacccaggccgu

SEQ ID NO: 3458108 - RNA, 12 nt, Pseudomonas aeruginosa PA01
gcacggcgcggg

SEQ ID NO: 3458109 - RNA, 14 nt, Pseudomonas aeruginosa PA01
gcacggcgcgggug

SEQ ID NO: 3458110 - RNA, 22 nt, Pseudomonas aeruginosa PA01
gcacggcgggacaggaacgccc

SEQ ID NO: 3458111 - RNA, 14 nt, Pseudomonas aeruginosa PA01
gcacggcucggcga

SEQ ID NO: 3458112 - RNA, 17 nt, Pseudomonas aeruginosa PA01
gcacggcucggcgagga

SEQ ID NO: 3458113 - RNA, 20 nt, Pseudomonas aeruginosa PA01
gcacggcuucagcgccaggc

SEQ ID NO: 3458114 - RNA, 21 nt, Pseudomonas aeruginosa PA01
gcacggcuucagcgccaggcc

SEQ ID NO: 3458115 - RNA, 23 nt, Pseudomonas aeruginosa PA01
gcacgggauuuccgauccuccug

SEQ ID NO: 3458116 - RNA, 18 nt, Pseudomonas aeruginosa PA01
gcagaccuggugggcggc

SEQ ID NO: 3458117 - RNA, 19 nt, Pseudomonas aeruginosa PA01
gcagaccuggugggcggcg

SEQ ID NO: 3458118 - RNA, 22 nt, Pseudomonas aeruginosa PA01
gcagaccuggugggcggcggcu

SEQ ID NO: 3458119 - RNA, 19 nt, Pseudomonas aeruginosa PA01
gcagaccuucgaagacccc

SEQ ID NO: 3458120 - RNA, 22 nt, Pseudomonas aeruginosa PA01
gcagacgaucuccugcugggcg

SEQ ID NO: 3458121 - RNA, 23 nt, Pseudomonas aeruginosa PA01
gcagacgaucuccugcugggcgu

SEQ ID NO: 3458122 - RNA, 21 nt, Pseudomonas aeruginosa PA01
gcagacgaucuggcagucguc

SEQ ID NO: 3458123 - RNA, 15 nt, Pseudomonas aeruginosa PA01
gcagacgauugaccu

SEQ ID NO: 3458124 - RNA, 20 nt, Pseudomonas aeruginosa PA01
gcagacgauugaccucccgc

SEQ ID NO: 3458125 - RNA, 22 nt, Pseudomonas aeruginosa PA01
gcagacgauugaccucccgcgc

SEQ ID NO: 3458126 - RNA, 18 nt, Pseudomonas aeruginosa PA01
gcagacgggugcugaaga

SEQ ID NO: 3458127 - RNA, 21 nt, Pseudomonas aeruginosa PA01
gcagacgguucagcagcggca

SEQ ID NO: 3458128 - RNA, 12 nt, Pseudomonas aeruginosa PA01
gcagacgucgag

SEQ ID NO: 3458129 - RNA, 18 nt, Pseudomonas aeruginosa PA01
gcagacgucgagguaguc

SEQ ID NO: 3458130 - RNA, 22 nt, Pseudomonas aeruginosa PA01
gcagacguggcauucgucgccg

SEQ ID NO: 3458131 - RNA, 15 nt, Pseudomonas aeruginosa PA01
gcagacuccggcgca

SEQ ID NO: 3458132 - RNA, 16 nt, Pseudomonas aeruginosa PA01
gcagacuccggcgcag

SEQ ID NO: 3458133 - RNA, 20 nt, Pseudomonas aeruginosa PA01
gcagacuccggcgcagccca

SEQ ID NO: 3458134 - RNA, 16 nt, Pseudomonas aeruginosa PA01
gcagagaaaaggccgc

SEQ ID NO: 3458135 - RNA, 17 nt, Pseudomonas aeruginosa PA01
gcagagaaaaggccgcu

SEQ ID NO: 3458136 - RNA, 15 nt, Pseudomonas aeruginosa PA01
gcagagacgcagcgc

SEQ ID NO: 3458137 - RNA, 22 nt, Pseudomonas aeruginosa PA01
gcagagaggcuggcgcucugca

SEQ ID NO: 3458138 - RNA, 15 nt, Pseudomonas aeruginosa PA01
gcagagaucggcggc

SEQ ID NO: 3458139 - RNA, 17 nt, Pseudomonas aeruginosa PA01
gcagagcagagucgccg

SEQ ID NO: 3458140 - RNA, 18 nt, Pseudomonas aeruginosa PA01
gcagagcagagucgccgg

SEQ ID NO: 3458141 - RNA, 13 nt, Pseudomonas aeruginosa PA01
gcagagccagccg

SEQ ID NO: 3458142 - RNA, 13 nt, Pseudomonas aeruginosa PA01
gcagagcgccagc

SEQ ID NO: 3458143 - RNA, 14 nt, Pseudomonas aeruginosa PA01
gcagagcgccagcc

SEQ ID NO: 3458144 - RNA, 20 nt, Pseudomonas aeruginosa PA01
gcagagcgccagccagcgcg

SEQ ID NO: 3458145 - RNA, 22 nt, Pseudomonas aeruginosa PA01
gcagagcgccagccagcgcggc

SEQ ID NO: 3458146 - RNA, 23 nt, Pseudomonas aeruginosa PA01
gcagagcgccagccagcgcggcu

SEQ ID NO: 3458147 - RNA, 18 nt, Pseudomonas aeruginosa PA01
gcagagcggcaggccgcc

SEQ ID NO: 3458148 - RNA, 21 nt, Pseudomonas aeruginosa PA01
gcagagcggcaggccgccgau

SEQ ID NO: 3458149 - RNA, 13 nt, Pseudomonas aeruginosa PA01
gcagagcggccag

SEQ ID NO: 3458150 - RNA, 14 nt, Pseudomonas aeruginosa PA01
gcagagcggccagg

SEQ ID NO: 3458151 - RNA, 21 nt, Pseudomonas aeruginosa PA01
gcagagcggugaaaccggcaa

SEQ ID NO: 3458152 - RNA, 12 nt, Pseudomonas aeruginosa PA01
gcagagcuggaa

SEQ ID NO: 3458153 - RNA, 18 nt, Pseudomonas aeruginosa PA01
gcagagggcguccugcuu

SEQ ID NO: 3458154 - RNA, 18 nt, Pseudomonas aeruginosa PA01
gcagagggucgccagcga

SEQ ID NO: 3458155 - RNA, 19 nt, Pseudomonas aeruginosa PA01
gcagagggucgccagcgag

SEQ ID NO: 3458156 - RNA, 16 nt, Pseudomonas aeruginosa PA01
gcagaguggcgcggcu

SEQ ID NO: 3458157 - RNA, 17 nt, Pseudomonas aeruginosa PA01
gcagaguuuagccgcca

SEQ ID NO: 3458158 - RNA, 20 nt, Pseudomonas aeruginosa PA01
gcagaguuucucggucgccg

SEQ ID NO: 3458159 - RNA, 22 nt, Pseudomonas aeruginosa PA01
gcagaguuucucggucgccgcc

SEQ ID NO: 3458160 - RNA, 16 nt, Pseudomonas aeruginosa PA01
gcagauaaagcuggac

SEQ ID NO: 3458161 - RNA, 13 nt, Pseudomonas aeruginosa PA01
gcagauaaggcgu

SEQ ID NO: 3458162 - RNA, 14 nt, Pseudomonas aeruginosa PA01
gcagauagggcauc

SEQ ID NO: 3458163 - RNA, 15 nt, Pseudomonas aeruginosa PA01
gcagauccagcggca

SEQ ID NO: 3458164 - RNA, 17 nt, Pseudomonas aeruginosa PA01
gcagauccagcggcagg

SEQ ID NO: 3458165 - RNA, 21 nt, Pseudomonas aeruginosa PA01
gcagauccgccgugaggcgcg

SEQ ID NO: 3458166 - RNA, 14 nt, Pseudomonas aeruginosa PA01
gcagaucgccgcgu

SEQ ID NO: 3458167 - RNA, 14 nt, Pseudomonas aeruginosa PA01
gcagaucgcggcgc

SEQ ID NO: 3458168 - RNA, 17 nt, Pseudomonas aeruginosa PA01
gcagaucgcggcgcagg

SEQ ID NO: 3458169 - RNA, 18 nt, Pseudomonas aeruginosa PA01
gcagaucgcggcgcaggc

SEQ ID NO: 3458170 - RNA, 16 nt, Pseudomonas aeruginosa PA01
gcagaucggugcgggc

SEQ ID NO: 3458171 - RNA, 17 nt, Pseudomonas aeruginosa PA01
gcagaucucccuguccu

SEQ ID NO: 3458172 - RNA, 16 nt, Pseudomonas aeruginosa PA01
gcagaugaucgccacc

SEQ ID NO: 3458173 - RNA, 20 nt, Pseudomonas aeruginosa PA01
gcagaugcggggcgaccagc

SEQ ID NO: 3458174 - RNA, 21 nt, Pseudomonas aeruginosa PA01
gcagaugcggggcgaccagca

SEQ ID NO: 3458175 - RNA, 13 nt, Pseudomonas aeruginosa PA01
gcagaugcuccag

SEQ ID NO: 3458176 - RNA, 16 nt, Pseudomonas aeruginosa PA01
gcagaugcuccaggga

SEQ ID NO: 3458177 - RNA, 22 nt, Pseudomonas aeruginosa PA01
gcagaugcuccagggagcgcuc

SEQ ID NO: 3458178 - RNA, 14 nt, Pseudomonas aeruginosa PA01
gcagauggucgccg

SEQ ID NO: 3458179 - RNA, 20 nt, Pseudomonas aeruginosa PA01
gcagcaacucgccgccgaca

SEQ ID NO: 3458180 - RNA, 15 nt, Pseudomonas aeruginosa PA01
gcagcaacuggucgc

SEQ ID NO: 3458181 - RNA, 21 nt, Pseudomonas aeruginosa PA01
gcagcaacuggucgccgcagg

SEQ ID NO: 3458182 - RNA, 14 nt, Pseudomonas aeruginosa PA01
gcagcaagccgaug

SEQ ID NO: 3458183 - RNA, 13 nt, Pseudomonas aeruginosa PA01
gcagcaagccgca

SEQ ID NO: 3458184 - RNA, 15 nt, Pseudomonas aeruginosa PA01
gcagcaagccgcagc

SEQ ID NO: 3458185 - RNA, 19 nt, Pseudomonas aeruginosa PA01
gcagcacauagagggucag

SEQ ID NO: 3458186 - RNA, 23 nt, Pseudomonas aeruginosa PA01
gcagcacauagagggucagccgg

SEQ ID NO: 3458187 - RNA, 20 nt, Pseudomonas aeruginosa PA01
gcagcaccaccucgccaagc

SEQ ID NO: 3458188 - RNA, 21 nt, Pseudomonas aeruginosa PA01
gcagcaccaccucgccaagcu

SEQ ID NO: 3458189 - RNA, 14 nt, Pseudomonas aeruginosa PA01
gcagcaccagcacc

SEQ ID NO: 3458190 - RNA, 16 nt, Pseudomonas aeruginosa PA01
gcagcaccagcaccag

SEQ ID NO: 3458191 - RNA, 17 nt, Pseudomonas aeruginosa PA01
gcagcaccagcaccagc

SEQ ID NO: 3458192 - RNA, 13 nt, Pseudomonas aeruginosa PA01
gcagcaccaggcc

SEQ ID NO: 3458193 - RNA, 14 nt, Pseudomonas aeruginosa PA01
gcagcaccaggcca

SEQ ID NO: 3458194 - RNA, 15 nt, Pseudomonas aeruginosa PA01
gcagcaccaggccau

SEQ ID NO: 3458195 - RNA, 13 nt, Pseudomonas aeruginosa PA01
gcagcaccaggcu

SEQ ID NO: 3458196 - RNA, 15 nt, Pseudomonas aeruginosa PA01
gcagcaccaggcugg

SEQ ID NO: 3458197 - RNA, 19 nt, Pseudomonas aeruginosa PA01
gcagcaccaggcuggccag

SEQ ID NO: 3458198 - RNA, 17 nt, Pseudomonas aeruginosa PA01
gcagcaccaucagccag

SEQ ID NO: 3458199 - RNA, 18 nt, Pseudomonas aeruginosa PA01
gcagcaccaucagccagc

SEQ ID NO: 3458200 - RNA, 21 nt, Pseudomonas aeruginosa PA01
gcagcaccaucagccagccca

SEQ ID NO: 3458201 - RNA, 23 nt, Pseudomonas aeruginosa PA01
gcagcaccaucagccagcccagu

SEQ ID NO: 3458202 - RNA, 14 nt, Pseudomonas aeruginosa PA01
gcagcacccccagc

SEQ ID NO: 3458203 - RNA, 20 nt, Pseudomonas aeruginosa PA01
gcagcacccccagcaggcca

SEQ ID NO: 3458204 - RNA, 22 nt, Pseudomonas aeruginosa PA01
gcagcacccgcaccagccggcg

SEQ ID NO: 3458205 - RNA, 23 nt, Pseudomonas aeruginosa PA01
gcagcacccgcaccagccggcgc

SEQ ID NO: 3458206 - RNA, 15 nt, Pseudomonas aeruginosa PA01
gcagcaccgccuggu

SEQ ID NO: 3458207 - RNA, 21 nt, Pseudomonas aeruginosa PA01
gcagcaccgcgagcaugcuca

SEQ ID NO: 3458208 - RNA, 14 nt, Pseudomonas aeruginosa PA01
gcagcaccgcgcgc

SEQ ID NO: 3458209 - RNA, 20 nt, Pseudomonas aeruginosa PA01
gcagcacgcccugggacagg

SEQ ID NO: 3458210 - RNA, 21 nt, Pseudomonas aeruginosa PA01
gcagcacgcccugggacaggc

SEQ ID NO: 3458211 - RNA, 14 nt, Pseudomonas aeruginosa PA01
gcagcacgcuggcg

SEQ ID NO: 3458212 - RNA, 13 nt, Pseudomonas aeruginosa PA01
gcagcacggccuc

SEQ ID NO: 3458213 - RNA, 15 nt, Pseudomonas aeruginosa PA01
gcagcacggccucgc

SEQ ID NO: 3458214 - RNA, 14 nt, Pseudomonas aeruginosa PA01
gcagcacggcgacg

SEQ ID NO: 3458215 - RNA, 19 nt, Pseudomonas aeruginosa PA01
gcagcacggcgacgaaggc

SEQ ID NO: 3458216 - RNA, 22 nt, Pseudomonas aeruginosa PA01
gcagcacggcgacgaaggccug

SEQ ID NO: 3458217 - RNA, 19 nt, Pseudomonas aeruginosa PA01
gcagcacggcgauacccag

SEQ ID NO: 3458218 - RNA, 23 nt, Pseudomonas aeruginosa PA01
gcagccaggcgaagcggcuggcc

SEQ ID NO: 3458219 - RNA, 22 nt, Pseudomonas aeruginosa PA01
gcagccaggcgauggugcgcuc

SEQ ID NO: 3458220 - RNA, 22 nt, Pseudomonas aeruginosa PA01
gcagccaucgcauagccggcgc

SEQ ID NO: 3458221 - RNA, 21 nt, Pseudomonas aeruginosa PA01
gcagccaugaaaaagccggga

SEQ ID NO: 3458222 - RNA, 13 nt, Pseudomonas aeruginosa PA01
gcagccauggcug

SEQ ID NO: 3458223 - RNA, 17 nt, Pseudomonas aeruginosa PA01
gcagccauggcuggugc

SEQ ID NO: 3458224 - RNA, 16 nt, Pseudomonas aeruginosa PA01
gcagcccagccgcucg

SEQ ID NO: 3458225 - RNA, 18 nt, Pseudomonas aeruginosa PA01
gcagcccagccgcucgcg

SEQ ID NO: 3458226 - RNA, 19 nt, Pseudomonas aeruginosa PA01
gcagcccaguucgcgcagg

SEQ ID NO: 3458227 - RNA, 22 nt, Pseudomonas aeruginosa PA01
gcagcccaguucgcgcaggacc

SEQ ID NO: 3458228 - RNA, 23 nt, Pseudomonas aeruginosa PA01
gcagcccaguucgcgcaggaccu

SEQ ID NO: 3458229 - RNA, 14 nt, Pseudomonas aeruginosa PA01
gcagccccgaggcc

SEQ ID NO: 3458230 - RNA, 17 nt, Pseudomonas aeruginosa PA01
gcagccccgaggccagc

SEQ ID NO: 3458231 - RNA, 23 nt, Pseudomonas aeruginosa PA01
gcagccccuugcgcucuggcgca

SEQ ID NO: 3458232 - RNA, 18 nt, Pseudomonas aeruginosa PA01
gcagcccgggcaacugcc

SEQ ID NO: 3458233 - RNA, 21 nt, Pseudomonas aeruginosa PA01
gcagcccgggcaacugccgau

SEQ ID NO: 3458234 - RNA, 20 nt, Pseudomonas aeruginosa PA01
gcagcccggucacgccggga

SEQ ID NO: 3458235 - RNA, 22 nt, Pseudomonas aeruginosa PA01
gcagcccgguccguccagcgcg

SEQ ID NO: 3458236 - RNA, 17 nt, Pseudomonas aeruginosa PA01
gcagcccuaggcgaccc

SEQ ID NO: 3458237 - RNA, 16 nt, Pseudomonas aeruginosa PA01
gcagcccuggcguggc

SEQ ID NO: 3458238 - RNA, 18 nt, Pseudomonas aeruginosa PA01
gcagcccuggcguggccg

SEQ ID NO: 3458239 - RNA, 21 nt, Pseudomonas aeruginosa PA01
gcagcccuggcguggccggcg

SEQ ID NO: 3458240 - RNA, 23 nt, Pseudomonas aeruginosa PA01
gcagcccuugcaaccgccgccgc

SEQ ID NO: 3458241 - RNA, 17 nt, Pseudomonas aeruginosa PA01
gcagccgaauacccggu

SEQ ID NO: 3458242 - RNA, 16 nt, Pseudomonas aeruginosa PA01
gcagccgaucgaagaa

SEQ ID NO: 3458243 - RNA, 14 nt, Pseudomonas aeruginosa PA01
gcagccgcaaggcc

SEQ ID NO: 3458244 - RNA, 20 nt, Pseudomonas aeruginosa PA01
gcagccgcaaggccagggcg

SEQ ID NO: 3458245 - RNA, 22 nt, Pseudomonas aeruginosa PA01
gcagccgcaaggccagggcggc

SEQ ID NO: 3458246 - RNA, 16 nt, Pseudomonas aeruginosa PA01
gcagccgcaggaugcc

SEQ ID NO: 3458247 - RNA, 19 nt, Pseudomonas aeruginosa PA01
gcagccgcaggaugccgcc

SEQ ID NO: 3458248 - RNA, 20 nt, Pseudomonas aeruginosa PA01
gcagccgcaggaugccgccu

SEQ ID NO: 3458249 - RNA, 21 nt, Pseudomonas aeruginosa PA01
gcagccgcaggaugccgccug

SEQ ID NO: 3458250 - RNA, 15 nt, Pseudomonas aeruginosa PA01
gcagccgccgcggca

SEQ ID NO: 3458251 - RNA, 21 nt, Pseudomonas aeruginosa PA01
gcagccgccgcggcaccggcg

SEQ ID NO: 3458252 - RNA, 14 nt, Pseudomonas aeruginosa PA01
gcagccgcgcaacc

SEQ ID NO: 3458253 - RNA, 13 nt, Pseudomonas aeruginosa PA01
gcagccgcgcucg

SEQ ID NO: 3458254 - RNA, 15 nt, Pseudomonas aeruginosa PA01
gcagccgcgcucggc

SEQ ID NO: 3458255 - RNA, 17 nt, Pseudomonas aeruginosa PA01
gcagccgcgcucggcca

SEQ ID NO: 3458256 - RNA, 19 nt, Pseudomonas aeruginosa PA01
gcagccgcgugcgcgccgc

SEQ ID NO: 3458257 - RNA, 14 nt, Pseudomonas aeruginosa PA01
gcagccgcucggcc

SEQ ID NO: 3458258 - RNA, 16 nt, Pseudomonas aeruginosa PA01
gcagccggaccagccg

SEQ ID NO: 3458259 - RNA, 21 nt, Pseudomonas aeruginosa PA01
gcagccggaccagccguccgc

SEQ ID NO: 3458260 - RNA, 15 nt, Pseudomonas aeruginosa PA01
gcagccggccaugcu

SEQ ID NO: 3458261 - RNA, 19 nt, Pseudomonas aeruginosa PA01
gcagccggccaugcuggcg

SEQ ID NO: 3458262 - RNA, 12 nt, Pseudomonas aeruginosa PA01
gcagccggcggc

SEQ ID NO: 3458263 - RNA, 18 nt, Pseudomonas aeruginosa PA01
gcagccggggcucaggcc

SEQ ID NO: 3458264 - RNA, 19 nt, Pseudomonas aeruginosa PA01
gcagccggggcucaggccu

SEQ ID NO: 3458265 - RNA, 20 nt, Pseudomonas aeruginosa PA01
gcagccggggcucaggccuu

SEQ ID NO: 3458266 - RNA, 22 nt, Pseudomonas aeruginosa PA01
gcagccggggcucaggccuugg

SEQ ID NO: 3458267 - RNA, 20 nt, Pseudomonas aeruginosa PA01
gcagccgguggucuucagca

SEQ ID NO: 3458268 - RNA, 19 nt, Pseudomonas aeruginosa PA01
gcagccguauggccccucc

SEQ ID NO: 3458269 - RNA, 17 nt, Pseudomonas aeruginosa PA01
gcagccgucggugaucg

SEQ ID NO: 3458270 - RNA, 17 nt, Pseudomonas aeruginosa PA01
gcagccguuggccagca

SEQ ID NO: 3458271 - RNA, 19 nt, Pseudomonas aeruginosa PA01
gcagccguuggccagcagg

SEQ ID NO: 3458272 - RNA, 23 nt, Pseudomonas aeruginosa PA01
gcagccguuggccagcaggcgcc

SEQ ID NO: 3458273 - RNA, 16 nt, Pseudomonas aeruginosa PA01
gcagccguuggcguca

SEQ ID NO: 3458274 - RNA, 15 nt, Pseudomonas aeruginosa PA01
gcagccucagcgaca

SEQ ID NO: 3458275 - RNA, 18 nt, Pseudomonas aeruginosa PA01
gcagccucaguggaucgu

SEQ ID NO: 3458276 - RNA, 15 nt, Pseudomonas aeruginosa PA01
gcagccugcuggccu

SEQ ID NO: 3458277 - RNA, 18 nt, Pseudomonas aeruginosa PA01
gcagccugcuggccuggg

SEQ ID NO: 3458278 - RNA, 12 nt, Pseudomonas aeruginosa PA01
gcagccuggcgu

SEQ ID NO: 3458279 - RNA, 20 nt, Pseudomonas aeruginosa PA01
gcagccuggcgucgcacugc

SEQ ID NO: 3458280 - RNA, 14 nt, Pseudomonas aeruginosa PA01
gcagccuggggguc

SEQ ID NO: 3458281 - RNA, 15 nt, Pseudomonas aeruginosa PA01
gcagccugggggucu

SEQ ID NO: 3458282 - RNA, 14 nt, Pseudomonas aeruginosa PA01
gcagccuuggccac

SEQ ID NO: 3458283 - RNA, 18 nt, Pseudomonas aeruginosa PA01
gcagccuuggccacggca

SEQ ID NO: 3458284 - RNA, 19 nt, Pseudomonas aeruginosa PA01
gcagccuuggccacggcau

SEQ ID NO: 3458285 - RNA, 12 nt, Pseudomonas aeruginosa PA01
gcagcgaacgcc

SEQ ID NO: 3458286 - RNA, 17 nt, Pseudomonas aeruginosa PA01
gcagcgaacgccgcagc

SEQ ID NO: 3458287 - RNA, 18 nt, Pseudomonas aeruginosa PA01
gcagcgaagaucuuuucg

SEQ ID NO: 3458288 - RNA, 19 nt, Pseudomonas aeruginosa PA01
gcagcgacacaacgcugca

SEQ ID NO: 3458289 - RNA, 13 nt, Pseudomonas aeruginosa PA01
gcagcgaccugac

SEQ ID NO: 3458290 - RNA, 21 nt, Pseudomonas aeruginosa PA01
gcagcgaccugacccgcuccu

SEQ ID NO: 3458291 - RNA, 23 nt, Pseudomonas aeruginosa PA01
gcagcgaccugacccgcuccucg

SEQ ID NO: 3458292 - RNA, 15 nt, Pseudomonas aeruginosa PA01
gcagcgacuccagcc

SEQ ID NO: 3458293 - RNA, 19 nt, Pseudomonas aeruginosa PA01
gcagcgacuccagccaggc

SEQ ID NO: 3458294 - RNA, 20 nt, Pseudomonas aeruginosa PA01
gcagcgacuccagccaggcg

SEQ ID NO: 3458295 - RNA, 21 nt, Pseudomonas aeruginosa PA01
gcagcgacuccagccaggcga

SEQ ID NO: 3458296 - RNA, 22 nt, Pseudomonas aeruginosa PA01
gcagcgacuccagccaggcgau

SEQ ID NO: 3458297 - RNA, 16 nt, Pseudomonas aeruginosa PA01
gcagcgacucgcuggg

SEQ ID NO: 3458298 - RNA, 17 nt, Pseudomonas aeruginosa PA01
gcagcgacucgcugggc

SEQ ID NO: 3458299 - RNA, 19 nt, Pseudomonas aeruginosa PA01
gcagcgacucgcugggcgc

SEQ ID NO: 3458300 - RNA, 22 nt, Pseudomonas aeruginosa PA01
gcagcgacucgcugggcgccgg

SEQ ID NO: 3458301 - RNA, 22 nt, Pseudomonas aeruginosa PA01
gcagcgaggggaagaucuccgg

SEQ ID NO: 3458302 - RNA, 14 nt, Pseudomonas aeruginosa PA01
gcagcgaucagcac

SEQ ID NO: 3458303 - RNA, 15 nt, Pseudomonas aeruginosa PA01
gcagcgaucagcacc

SEQ ID NO: 3458304 - RNA, 16 nt, Pseudomonas aeruginosa PA01
gcagcgaucagcacca

SEQ ID NO: 3458305 - RNA, 15 nt, Pseudomonas aeruginosa PA01
gcagcgaucgccgcc

SEQ ID NO: 3458306 - RNA, 16 nt, Pseudomonas aeruginosa PA01
gcagcgaucgccgcca

SEQ ID NO: 3458307 - RNA, 19 nt, Pseudomonas aeruginosa PA01
gcagcgaugccuccggcuu

SEQ ID NO: 3458308 - RNA, 15 nt, Pseudomonas aeruginosa PA01
gcagcgcaagucggc

SEQ ID NO: 3458309 - RNA, 22 nt, Pseudomonas aeruginosa PA01
gcagcgcaagucggccugcacc

SEQ ID NO: 3458310 - RNA, 16 nt, Pseudomonas aeruginosa PA01
gcagcgcaccauccuc

SEQ ID NO: 3458311 - RNA, 16 nt, Pseudomonas aeruginosa PA01
gcagcgcagccgaucg

SEQ ID NO: 3458312 - RNA, 15 nt, Pseudomonas aeruginosa PA01
gcagcgccaccagga

SEQ ID NO: 3458313 - RNA, 13 nt, Pseudomonas aeruginosa PA01
gcagcgccacgcu

SEQ ID NO: 3458314 - RNA, 18 nt, Pseudomonas aeruginosa PA01
gcagcgccacgcugauca

SEQ ID NO: 3458315 - RNA, 18 nt, Pseudomonas aeruginosa PA01
gcagcgccacuuccagcu

SEQ ID NO: 3458316 - RNA, 17 nt, Pseudomonas aeruginosa PA01
gcagcgccaggaagccg

SEQ ID NO: 3458317 - RNA, 20 nt, Pseudomonas aeruginosa PA01
gcagcgccaggaagccgcgc

SEQ ID NO: 3458318 - RNA, 14 nt, Pseudomonas aeruginosa PA01
gcagcgccagggcc

SEQ ID NO: 3458319 - RNA, 23 nt, Pseudomonas aeruginosa PA01
gcagcgccaguacuccgagggcc

SEQ ID NO: 3458320 - RNA, 15 nt, Pseudomonas aeruginosa PA01
gcagcgggccaggcg

SEQ ID NO: 3458321 - RNA, 17 nt, Pseudomonas aeruginosa PA01
gcagcgggcguccggcg

SEQ ID NO: 3458322 - RNA, 21 nt, Pseudomonas aeruginosa PA01
gcagcgggcugaagugggucg

SEQ ID NO: 3458323 - RNA, 24 nt, Pseudomonas aeruginosa PA01
gcagcgggucgaucaggcgcaugc

SEQ ID NO: 3458324 - RNA, 22 nt, Pseudomonas aeruginosa PA01
gcagcgguacggucgaggcgga

SEQ ID NO: 3458325 - RNA, 23 nt, Pseudomonas aeruginosa PA01
gcagcgguaguucagucgguuag

SEQ ID NO: 3458326 - RNA, 13 nt, Pseudomonas aeruginosa PA01
gcagcggucgccg

SEQ ID NO: 3458327 - RNA, 14 nt, Pseudomonas aeruginosa PA01
gcagcggucgccgg

SEQ ID NO: 3458328 - RNA, 15 nt, Pseudomonas aeruginosa PA01
gcagcggucgccggu

SEQ ID NO: 3458329 - RNA, 19 nt, Pseudomonas aeruginosa PA01
gcagcggugaagguccgcg

SEQ ID NO: 3458330 - RNA, 22 nt, Pseudomonas aeruginosa PA01
gcagcggugaagguccgcgcca

SEQ ID NO: 3458331 - RNA, 16 nt, Pseudomonas aeruginosa PA01
gcagcgguucgcccgc

SEQ ID NO: 3458332 - RNA, 23 nt, Pseudomonas aeruginosa PA01
gcagcguccgaacgcgcugacgg

SEQ ID NO: 3458333 - RNA, 13 nt, Pseudomonas aeruginosa PA01
gcagcguccugcc

SEQ ID NO: 3458334 - RNA, 17 nt, Pseudomonas aeruginosa PA01
gcagcguccugcccucc

SEQ ID NO: 3458335 - RNA, 18 nt, Pseudomonas aeruginosa PA01
gcagcguccugcccuccu

SEQ ID NO: 3458336 - RNA, 15 nt, Pseudomonas aeruginosa PA01
gcagcgucgacgccg

SEQ ID NO: 3458337 - RNA, 16 nt, Pseudomonas aeruginosa PA01
gcagcgucgacgccga

SEQ ID NO: 3458338 - RNA, 17 nt, Pseudomonas aeruginosa PA01
gcagcgucgacgccgag

SEQ ID NO: 3458339 - RNA, 19 nt, Pseudomonas aeruginosa PA01
gcagcgucgacgccgagcu

SEQ ID NO: 3458340 - RNA, 20 nt, Pseudomonas aeruginosa PA01
gcagcgucgacgccgagcug

SEQ ID NO: 3458341 - RNA, 16 nt, Pseudomonas aeruginosa PA01
gcagcgucgccgggcg

SEQ ID NO: 3458342 - RNA, 16 nt, Pseudomonas aeruginosa PA01
gcagcgucgcgcgucc

SEQ ID NO: 3458343 - RNA, 18 nt, Pseudomonas aeruginosa PA01
gcagcgucgcgcguccag

SEQ ID NO: 3458344 - RNA, 22 nt, Pseudomonas aeruginosa PA01
gcagcgucgcgucggccuggcg

SEQ ID NO: 3458345 - RNA, 20 nt, Pseudomonas aeruginosa PA01
gcagcgucucagcccucggc

SEQ ID NO: 3458346 - RNA, 18 nt, Pseudomonas aeruginosa PA01
gcagcgucucggcugccg

SEQ ID NO: 3458347 - RNA, 19 nt, Pseudomonas aeruginosa PA01
gcagcgucucggcugccgc

SEQ ID NO: 3458348 - RNA, 21 nt, Pseudomonas aeruginosa PA01
gcagcgucucggcugccgcca

SEQ ID NO: 3458349 - RNA, 20 nt, Pseudomonas aeruginosa PA01
gcagcgugcucacggcauuc

SEQ ID NO: 3458350 - RNA, 16 nt, Pseudomonas aeruginosa PA01
gcagcguuccagcgcu

SEQ ID NO: 3458351 - RNA, 17 nt, Pseudomonas aeruginosa PA01
gcagcguuccagcgcug

SEQ ID NO: 3458352 - RNA, 21 nt, Pseudomonas aeruginosa PA01
gcagcguuccagcgcuggcag

SEQ ID NO: 3458353 - RNA, 22 nt, Pseudomonas aeruginosa PA01
gcagcguuccagcgcuggcagg

SEQ ID NO: 3458354 - RNA, 19 nt, Pseudomonas aeruginosa PA01
gcagcuccaccgauggcgc

SEQ ID NO: 3458355 - RNA, 18 nt, Pseudomonas aeruginosa PA01
gcagcucccuugccgccg

SEQ ID NO: 3458356 - RNA, 22 nt, Pseudomonas aeruginosa PA01
gcagcucccuugccgccgguuc

SEQ ID NO: 3458357 - RNA, 13 nt, Pseudomonas aeruginosa PA01
gcagcuccggcag

SEQ ID NO: 3458358 - RNA, 17 nt, Pseudomonas aeruginosa PA01
gcagcuccggcagcagg

SEQ ID NO: 3458359 - RNA, 18 nt, Pseudomonas aeruginosa PA01
gcagcuccggcagcaggg

SEQ ID NO: 3458360 - RNA, 16 nt, Pseudomonas aeruginosa PA01
gcagcuccggcgggcg

SEQ ID NO: 3458361 - RNA, 18 nt, Pseudomonas aeruginosa PA01
gcagcuccucggcguggc

SEQ ID NO: 3458362 - RNA, 14 nt, Pseudomonas aeruginosa PA01
gcagcuccuggucg

SEQ ID NO: 3458363 - RNA, 19 nt, Pseudomonas aeruginosa PA01
gcagcucgaaauccggugc

SEQ ID NO: 3458364 - RNA, 16 nt, Pseudomonas aeruginosa PA01
gcagcucgacuuccug

SEQ ID NO: 3458365 - RNA, 14 nt, Pseudomonas aeruginosa PA01
gcagcucgccggcg

SEQ ID NO: 3458366 - RNA, 17 nt, Pseudomonas aeruginosa PA01
gcagcucgccggcgucc

SEQ ID NO: 3458367 - RNA, 18 nt, Pseudomonas aeruginosa PA01
gcagcucggcacgcagca

SEQ ID NO: 3458368 - RNA, 20 nt, Pseudomonas aeruginosa PA01
gcagcucggcacgcagcagc

SEQ ID NO: 3458369 - RNA, 21 nt, Pseudomonas aeruginosa PA01
gcagcucggcacgcagcagcu

SEQ ID NO: 3458370 - RNA, 15 nt, Pseudomonas aeruginosa PA01
gcagcucggccuggu

SEQ ID NO: 3458371 - RNA, 21 nt, Pseudomonas aeruginosa PA01
gcagcucggccugguccggca

SEQ ID NO: 3458372 - RNA, 12 nt, Pseudomonas aeruginosa PA01
gcagcucggcga

SEQ ID NO: 3458373 - RNA, 14 nt, Pseudomonas aeruginosa PA01
gcagcucggcgaca

SEQ ID NO: 3458374 - RNA, 22 nt, Pseudomonas aeruginosa PA01
gcagcucggcgacauagccggc

SEQ ID NO: 3458375 - RNA, 17 nt, Pseudomonas aeruginosa PA01
gcagcucggugagcagg

SEQ ID NO: 3458376 - RNA, 21 nt, Pseudomonas aeruginosa PA01
gcagcucggugagcaggcgcc

SEQ ID NO: 3458377 - RNA, 22 nt, Pseudomonas aeruginosa PA01
gcagcucggugagcaggcgccg

SEQ ID NO: 3458378 - RNA, 19 nt, Pseudomonas aeruginosa PA01
gcagcucguccauguugcg

SEQ ID NO: 3458379 - RNA, 16 nt, Pseudomonas aeruginosa PA01
gcagcucguucgccca

SEQ ID NO: 3458380 - RNA, 18 nt, Pseudomonas aeruginosa PA01
gcagcucguugcacagcg

SEQ ID NO: 3458381 - RNA, 23 nt, Pseudomonas aeruginosa PA01
gcagcucguugcacagcgcccag

SEQ ID NO: 3458382 - RNA, 22 nt, Pseudomonas aeruginosa PA01
gcagcuggauccgugccaggcg

SEQ ID NO: 3458383 - RNA, 15 nt, Pseudomonas aeruginosa PA01
gcagcuucggcgcga

SEQ ID NO: 3458384 - RNA, 17 nt, Pseudomonas aeruginosa PA01
gcagcuucuccagggaa

SEQ ID NO: 3458385 - RNA, 20 nt, Pseudomonas aeruginosa PA01
gcagcuucuccagggaaacc

SEQ ID NO: 3458386 - RNA, 17 nt, Pseudomonas aeruginosa PA01
gcagcuucugcagggcg

SEQ ID NO: 3458387 - RNA, 20 nt, Pseudomonas aeruginosa PA01
gcagcuugccggcauagccg

SEQ ID NO: 3458388 - RNA, 17 nt, Pseudomonas aeruginosa PA01
gcagcuugccuuccagg

SEQ ID NO: 3458389 - RNA, 20 nt, Pseudomonas aeruginosa PA01
gcagcuugccuuccaggcug

SEQ ID NO: 3458390 - RNA, 21 nt, Pseudomonas aeruginosa PA01
gcagcuugccuuccaggcugu

SEQ ID NO: 3458391 - RNA, 14 nt, Pseudomonas aeruginosa PA01
gcagcuugcgcgcc

SEQ ID NO: 3458392 - RNA, 17 nt, Pseudomonas aeruginosa PA01
gcagcuugcgcgccagg

SEQ ID NO: 3458393 - RNA, 16 nt, Pseudomonas aeruginosa PA01
gcagcuugcucgaugc

SEQ ID NO: 3458394 - RNA, 23 nt, Pseudomonas aeruginosa PA01
gcagcuuggcgaauagccggcgc

SEQ ID NO: 3458395 - RNA, 15 nt, Pseudomonas aeruginosa PA01
gcagcuugguaucca

SEQ ID NO: 3458396 - RNA, 19 nt, Pseudomonas aeruginosa PA01
gcagcuugguauccaccuc

SEQ ID NO: 3458397 - RNA, 14 nt, Pseudomonas aeruginosa PA01
gcagcuugugggca

SEQ ID NO: 3458398 - RNA, 23 nt, Pseudomonas aeruginosa PA01
gcaggaaaagcggaagggccgag

SEQ ID NO: 3458399 - RNA, 14 nt, Pseudomonas aeruginosa PA01
gcaggaaaccccuc

SEQ ID NO: 3458400 - RNA, 18 nt, Pseudomonas aeruginosa PA01
gcaggaaauccgccgcgc

SEQ ID NO: 3458401 - RNA, 13 nt, Pseudomonas aeruginosa PA01
gcaggaacagcca

SEQ ID NO: 3458402 - RNA, 12 nt, Pseudomonas aeruginosa PA01
gcaggaacaggu

SEQ ID NO: 3458403 - RNA, 21 nt, Pseudomonas aeruginosa PA01
gcaggaacagguucggcaggc

SEQ ID NO: 3458404 - RNA, 21 nt, Pseudomonas aeruginosa PA01
gcaggaaccgacgcgcaggag

SEQ ID NO: 3458405 - RNA, 22 nt, Pseudomonas aeruginosa PA01
gcaggaacucgaucagcgcggc

SEQ ID NO: 3458406 - RNA, 22 nt, Pseudomonas aeruginosa PA01
gcaggaacuggucgauccgcgc

SEQ ID NO: 3458407 - RNA, 14 nt, Pseudomonas aeruginosa PA01
gcaggaagaagccg

SEQ ID NO: 3458408 - RNA, 16 nt, Pseudomonas aeruginosa PA01
gcaggaagaagccgau

SEQ ID NO: 3458409 - RNA, 12 nt, Pseudomonas aeruginosa PA01
gcaggaagccga

SEQ ID NO: 3458410 - RNA, 15 nt, Pseudomonas aeruginosa PA01
gcaggaagcugacga

SEQ ID NO: 3458411 - RNA, 18 nt, Pseudomonas aeruginosa PA01
gcaggaagcugacgaaca

SEQ ID NO: 3458412 - RNA, 15 nt, Pseudomonas aeruginosa PA01
gcaggaagcugcgcu

SEQ ID NO: 3458413 - RNA, 15 nt, Pseudomonas aeruginosa PA01
gcaggaaggcuuccg

SEQ ID NO: 3458414 - RNA, 20 nt, Pseudomonas aeruginosa PA01
gcaggaaggcuuccggcucc

SEQ ID NO: 3458415 - RNA, 19 nt, Pseudomonas aeruginosa PA01
gcaggaaguggcggaugca

SEQ ID NO: 3458416 - RNA, 20 nt, Pseudomonas aeruginosa PA01
gcaggaaguugauggucagg

SEQ ID NO: 3458417 - RNA, 22 nt, Pseudomonas aeruginosa PA01
gcaggaaguugauggucaggcu

SEQ ID NO: 3458418 - RNA, 23 nt, Pseudomonas aeruginosa PA01
gcaggaaguugauggucaggcug

SEQ ID NO: 3458419 - RNA, 14 nt, Pseudomonas aeruginosa PA01
gcaggacagcaggg

SEQ ID NO: 3458420 - RNA, 20 nt, Pseudomonas aeruginosa PA01
gcaggacagcagggucgcgc

SEQ ID NO: 3458421 - RNA, 15 nt, Pseudomonas aeruginosa PA01
gcaggaccacgcugg

SEQ ID NO: 3458422 - RNA, 16 nt, Pseudomonas aeruginosa PA01
gcaggccgaggucggc

SEQ ID NO: 3458423 - RNA, 19 nt, Pseudomonas aeruginosa PA01
gcaggccgaggucggcggc

SEQ ID NO: 3458424 - RNA, 17 nt, Pseudomonas aeruginosa PA01
gcaggccgagguuucca

SEQ ID NO: 3458425 - RNA, 22 nt, Pseudomonas aeruginosa PA01
gcaggccgaucaccagcgccag

SEQ ID NO: 3458426 - RNA, 20 nt, Pseudomonas aeruginosa PA01
gcaggccgaucucgugggcc

SEQ ID NO: 3458427 - RNA, 13 nt, Pseudomonas aeruginosa PA01
gcaggccgauggc

SEQ ID NO: 3458428 - RNA, 15 nt, Pseudomonas aeruginosa PA01
gcaggccgauggccc

SEQ ID NO: 3458429 - RNA, 17 nt, Pseudomonas aeruginosa PA01
gcaggccgauggccccg

SEQ ID NO: 3458430 - RNA, 15 nt, Pseudomonas aeruginosa PA01
gcaggccgccgagug

SEQ ID NO: 3458431 - RNA, 13 nt, Pseudomonas aeruginosa PA01
gcaggccgccgau

SEQ ID NO: 3458432 - RNA, 14 nt, Pseudomonas aeruginosa PA01
gcaggccgccgcgu

SEQ ID NO: 3458433 - RNA, 21 nt, Pseudomonas aeruginosa PA01
gcaggccgccgcgugccgccg

SEQ ID NO: 3458434 - RNA, 16 nt, Pseudomonas aeruginosa PA01
gcaggccgccggcggc

SEQ ID NO: 3458435 - RNA, 17 nt, Pseudomonas aeruginosa PA01
gcaggccgccggcggcc

SEQ ID NO: 3458436 - RNA, 22 nt, Pseudomonas aeruginosa PA01
gcaggccgcgcgauggccggcg

SEQ ID NO: 3458437 - RNA, 18 nt, Pseudomonas aeruginosa PA01
gcaggccgcuggcgacgc

SEQ ID NO: 3458438 - RNA, 10 nt, Pseudomonas aeruginosa PA01
gcaggccggc

SEQ ID NO: 3458439 - RNA, 11 nt, Pseudomonas aeruginosa PA01
gcaggccggcg

SEQ ID NO: 3458440 - RNA, 12 nt, Pseudomonas aeruginosa PA01
gcaggccggcga

SEQ ID NO: 3458441 - RNA, 13 nt, Pseudomonas aeruginosa PA01
gcaggccggcgac

SEQ ID NO: 3458442 - RNA, 15 nt, Pseudomonas aeruginosa PA01
gcaggccggcgacca

SEQ ID NO: 3458443 - RNA, 16 nt, Pseudomonas aeruginosa PA01
gcaggccggcgaccag

SEQ ID NO: 3458444 - RNA, 14 nt, Pseudomonas aeruginosa PA01
gcaggccggcgagc

SEQ ID NO: 3458445 - RNA, 16 nt, Pseudomonas aeruginosa PA01
gcaggccggcgagcca

SEQ ID NO: 3458446 - RNA, 18 nt, Pseudomonas aeruginosa PA01
gcaggccggcgagccagg

SEQ ID NO: 3458447 - RNA, 12 nt, Pseudomonas aeruginosa PA01
gcaggccgggaa

SEQ ID NO: 3458448 - RNA, 17 nt, Pseudomonas aeruginosa PA01
gcaggccgggcuggcca

SEQ ID NO: 3458449 - RNA, 18 nt, Pseudomonas aeruginosa PA01
gcaggccgggcuggccac

SEQ ID NO: 3458450 - RNA, 20 nt, Pseudomonas aeruginosa PA01
gcaggccgggcuggccaccg

SEQ ID NO: 3458451 - RNA, 23 nt, Pseudomonas aeruginosa PA01
gcaggccguccuugaguagcugg

SEQ ID NO: 3458452 - RNA, 19 nt, Pseudomonas aeruginosa PA01
gcaggccgugggccggcgc

SEQ ID NO: 3458453 - RNA, 23 nt, Pseudomonas aeruginosa PA01
gcaggccgugggccggcgcgccg

SEQ ID NO: 3458454 - RNA, 11 nt, Pseudomonas aeruginosa PA01
gcaggccugga

SEQ ID NO: 3458455 - RNA, 21 nt, Pseudomonas aeruginosa PA01
gcaggccuggaauaccccgcg

SEQ ID NO: 3458456 - RNA, 17 nt, Pseudomonas aeruginosa PA01
gcaggccuggagcgccu

SEQ ID NO: 3458457 - RNA, 13 nt, Pseudomonas aeruginosa PA01
gcaggccugggca

SEQ ID NO: 3458458 - RNA, 23 nt, Pseudomonas aeruginosa PA01
gcaggccugguaggcgucgucga

SEQ ID NO: 3458459 - RNA, 17 nt, Pseudomonas aeruginosa PA01
gcaggccuuccacgccu

SEQ ID NO: 3458460 - RNA, 13 nt, Pseudomonas aeruginosa PA01
gcaggccuuccca

SEQ ID NO: 3458461 - RNA, 21 nt, Pseudomonas aeruginosa PA01
gcaggccuucgacuucgacga

SEQ ID NO: 3458462 - RNA, 15 nt, Pseudomonas aeruginosa PA01
gcaggccuucggcgc

SEQ ID NO: 3458463 - RNA, 16 nt, Pseudomonas aeruginosa PA01
gcaggccuucggcgcc

SEQ ID NO: 3458464 - RNA, 18 nt, Pseudomonas aeruginosa PA01
gcaggccuucggcgccgg

SEQ ID NO: 3458465 - RNA, 23 nt, Pseudomonas aeruginosa PA01
gcaggccuucggcgccggagcug

SEQ ID NO: 3458466 - RNA, 17 nt, Pseudomonas aeruginosa PA01
gcaggccuugcagggcc

SEQ ID NO: 3458467 - RNA, 19 nt, Pseudomonas aeruginosa PA01
gcaggccuugcagggccgc

SEQ ID NO: 3458468 - RNA, 21 nt, Pseudomonas aeruginosa PA01
gcaggccuugcagggccgcca

SEQ ID NO: 3458469 - RNA, 13 nt, Pseudomonas aeruginosa PA01
gcaggcgaacagg

SEQ ID NO: 3458470 - RNA, 20 nt, Pseudomonas aeruginosa PA01
gcaggcgaacagggccauca

SEQ ID NO: 3458471 - RNA, 17 nt, Pseudomonas aeruginosa PA01
gcaggcgaacugccgac

SEQ ID NO: 3458472 - RNA, 18 nt, Pseudomonas aeruginosa PA01
gcaggcgaacugccgacg

SEQ ID NO: 3458473 - RNA, 20 nt, Pseudomonas aeruginosa PA01
gcaggcgaacugccgacggc

SEQ ID NO: 3458474 - RNA, 23 nt, Pseudomonas aeruginosa PA01
gcaggcgacggucaggccgagca

SEQ ID NO: 3458475 - RNA, 22 nt, Pseudomonas aeruginosa PA01
gcaggcgauacaggcggugacg

SEQ ID NO: 3458476 - RNA, 18 nt, Pseudomonas aeruginosa PA01
gcaggcgaugaccgcccc

SEQ ID NO: 3458477 - RNA, 13 nt, Pseudomonas aeruginosa PA01
gcaggcgaugccg

SEQ ID NO: 3458478 - RNA, 17 nt, Pseudomonas aeruginosa PA01
gcaggcgaugccgacgc

SEQ ID NO: 3458479 - RNA, 22 nt, Pseudomonas aeruginosa PA01
gcaggcgcaaccagaccagcag

SEQ ID NO: 3458480 - RNA, 24 nt, Pseudomonas aeruginosa PA01
gcaggcgcaaccagaccagcagga

SEQ ID NO: 3458481 - RNA, 14 nt, Pseudomonas aeruginosa PA01
gcaggcgcacgcgc

SEQ ID NO: 3458482 - RNA, 16 nt, Pseudomonas aeruginosa PA01
gcaggcgcacgcgcag

SEQ ID NO: 3458483 - RNA, 14 nt, Pseudomonas aeruginosa PA01
gcaggcgcagcagc

SEQ ID NO: 3458484 - RNA, 15 nt, Pseudomonas aeruginosa PA01
gcaggcgcagcagcg

SEQ ID NO: 3458485 - RNA, 18 nt, Pseudomonas aeruginosa PA01
gcaggcgcaggucggccu

SEQ ID NO: 3458486 - RNA, 19 nt, Pseudomonas aeruginosa PA01
gcaggcgcauggcguucug

SEQ ID NO: 3458487 - RNA, 19 nt, Pseudomonas aeruginosa PA01
gcaggcgcauguccagcca

SEQ ID NO: 3458488 - RNA, 20 nt, Pseudomonas aeruginosa PA01
gcaggcgcauguccagccag

SEQ ID NO: 3458489 - RNA, 21 nt, Pseudomonas aeruginosa PA01
gcaggcgccaaccgggcagca

SEQ ID NO: 3458490 - RNA, 17 nt, Pseudomonas aeruginosa PA01
gcaggcgcccggucagg

SEQ ID NO: 3458491 - RNA, 20 nt, Pseudomonas aeruginosa PA01
gcaggcgcccggucagguug

SEQ ID NO: 3458492 - RNA, 13 nt, Pseudomonas aeruginosa PA01
gcaggcgcccugg

SEQ ID NO: 3458493 - RNA, 15 nt, Pseudomonas aeruginosa PA01
gcaggcgcccuggcc

SEQ ID NO: 3458494 - RNA, 19 nt, Pseudomonas aeruginosa PA01
gcaggcgcccuggccgucg

SEQ ID NO: 3458495 - RNA, 21 nt, Pseudomonas aeruginosa PA01
gcaggcgccgauggcugucgg

SEQ ID NO: 3458496 - RNA, 14 nt, Pseudomonas aeruginosa PA01
gcaggcgccgcgca

SEQ ID NO: 3458497 - RNA, 20 nt, Pseudomonas aeruginosa PA01
gcaggcgccggaccaacugc

SEQ ID NO: 3458498 - RNA, 12 nt, Pseudomonas aeruginosa PA01
gcaggcgccggc

SEQ ID NO: 3458499 - RNA, 17 nt, Pseudomonas aeruginosa PA01
gcaggcgccggccgggc

SEQ ID NO: 3458500 - RNA, 13 nt, Pseudomonas aeruginosa PA01
gcaggcgccggcg

SEQ ID NO: 3458501 - RNA, 16 nt, Pseudomonas aeruginosa PA01
gcaggcgcgccaggcc

SEQ ID NO: 3458502 - RNA, 21 nt, Pseudomonas aeruginosa PA01
gcaggcgcgccaggcccacgc

SEQ ID NO: 3458503 - RNA, 18 nt, Pseudomonas aeruginosa PA01
gcaggcgcggcauagaug

SEQ ID NO: 3458504 - RNA, 21 nt, Pseudomonas aeruginosa PA01
gcaggcgcgggcuggccaccg

SEQ ID NO: 3458505 - RNA, 15 nt, Pseudomonas aeruginosa PA01
gcaggcgcgggucau

SEQ ID NO: 3458506 - RNA, 19 nt, Pseudomonas aeruginosa PA01
gcaggcgcgggucaucggc

SEQ ID NO: 3458507 - RNA, 16 nt, Pseudomonas aeruginosa PA01
gcaggcgcuauccgcc

SEQ ID NO: 3458508 - RNA, 22 nt, Pseudomonas aeruginosa PA01
gcaggcgcuauccgccguuacg

SEQ ID NO: 3458509 - RNA, 16 nt, Pseudomonas aeruginosa PA01
gcaggcgcuccuggug

SEQ ID NO: 3458510 - RNA, 17 nt, Pseudomonas aeruginosa PA01
gcaggcgcuccuggugc

SEQ ID NO: 3458511 - RNA, 16 nt, Pseudomonas aeruginosa PA01
gcaggcgcucggcgac

SEQ ID NO: 3458512 - RNA, 14 nt, Pseudomonas aeruginosa PA01
gcaggcgcuggccg

SEQ ID NO: 3458513 - RNA, 14 nt, Pseudomonas aeruginosa PA01
gcaggcgcuggcgg

SEQ ID NO: 3458514 - RNA, 19 nt, Pseudomonas aeruginosa PA01
gcaggcgcuucagcgccuc

SEQ ID NO: 3458515 - RNA, 22 nt, Pseudomonas aeruginosa PA01
gcaggcgcuucagcgccucgac

SEQ ID NO: 3458516 - RNA, 19 nt, Pseudomonas aeruginosa PA01
gcaggcggaaaaagcgcgg

SEQ ID NO: 3458517 - RNA, 22 nt, Pseudomonas aeruginosa PA01
gcaggcggaaaaagcgcggagg

SEQ ID NO: 3458518 - RNA, 20 nt, Pseudomonas aeruginosa PA01
gcaggcggaguagccggcgg

SEQ ID NO: 3458519 - RNA, 21 nt, Pseudomonas aeruginosa PA01
gcaggcggaguagccggcggc

SEQ ID NO: 3458520 - RNA, 20 nt, Pseudomonas aeruginosa PA01
gcaggcggaucgcccggcgc

SEQ ID NO: 3458521 - RNA, 15 nt, Pseudomonas aeruginosa PA01
gcaggcggaucgccg

SEQ ID NO: 3458522 - RNA, 14 nt, Pseudomonas aeruginosa PA01
gcaggcggcccaug

SEQ ID NO: 3458523 - RNA, 21 nt, Pseudomonas aeruginosa PA01
gcaggcggcccaugcggaucg

SEQ ID NO: 3458524 - RNA, 14 nt, Pseudomonas aeruginosa PA01
gcagggcgucgccc

SEQ ID NO: 3458525 - RNA, 18 nt, Pseudomonas aeruginosa PA01
gcagggcgucgcccucgg

SEQ ID NO: 3458526 - RNA, 21 nt, Pseudomonas aeruginosa PA01
gcagggcgucgcccucggcgc

SEQ ID NO: 3458527 - RNA, 14 nt, Pseudomonas aeruginosa PA01
gcagggcgucggcg

SEQ ID NO: 3458528 - RNA, 16 nt, Pseudomonas aeruginosa PA01
gcagggcgucggcgug

SEQ ID NO: 3458529 - RNA, 20 nt, Pseudomonas aeruginosa PA01
gcagggcuauguauucggcg

SEQ ID NO: 3458530 - RNA, 22 nt, Pseudomonas aeruginosa PA01
gcagggcuauguauucggcggu

SEQ ID NO: 3458531 - RNA, 21 nt, Pseudomonas aeruginosa PA01
gcagggcucgugccaucaggc

SEQ ID NO: 3458532 - RNA, 23 nt, Pseudomonas aeruginosa PA01
gcagggcugcuguugccagggau

SEQ ID NO: 3458533 - RNA, 22 nt, Pseudomonas aeruginosa PA01
gcagggcuuccuuggcgggaug

SEQ ID NO: 3458534 - RNA, 17 nt, Pseudomonas aeruginosa PA01
gcagggcuugugcagag

SEQ ID NO: 3458535 - RNA, 17 nt, Pseudomonas aeruginosa PA01
gcaggggcaccggcgga

SEQ ID NO: 3458536 - RNA, 14 nt, Pseudomonas aeruginosa PA01
gcaggggcgcgccg

SEQ ID NO: 3458537 - RNA, 15 nt, Pseudomonas aeruginosa PA01
gcaggggcgcgccgg

SEQ ID NO: 3458538 - RNA, 16 nt, Pseudomonas aeruginosa PA01
gcaggggcgcgccggc

SEQ ID NO: 3458539 - RNA, 17 nt, Pseudomonas aeruginosa PA01
gcaggggcgcgccggcu

SEQ ID NO: 3458540 - RNA, 20 nt, Pseudomonas aeruginosa PA01
gcaggggcgcgccggcuugg

SEQ ID NO: 3458541 - RNA, 15 nt, Pseudomonas aeruginosa PA01
gcaggggcgcggcgc

SEQ ID NO: 3458542 - RNA, 13 nt, Pseudomonas aeruginosa PA01
gcaggggcugccg

SEQ ID NO: 3458543 - RNA, 19 nt, Pseudomonas aeruginosa PA01
gcaggggcuuucuucgccu

SEQ ID NO: 3458544 - RNA, 22 nt, Pseudomonas aeruginosa PA01
gcagggggacgaaaaccgcaga

SEQ ID NO: 3458545 - RNA, 18 nt, Pseudomonas aeruginosa PA01
gcagggggcuuugcggcc

SEQ ID NO: 3458546 - RNA, 15 nt, Pseudomonas aeruginosa PA01
gcagggggucuucga

SEQ ID NO: 3458547 - RNA, 14 nt, Pseudomonas aeruginosa PA01
gcaggguaccgcug

SEQ ID NO: 3458548 - RNA, 15 nt, Pseudomonas aeruginosa PA01
gcaggguaccgcugg

SEQ ID NO: 3458549 - RNA, 18 nt, Pseudomonas aeruginosa PA01
gcaggguaccgcuggcgc

SEQ ID NO: 3458550 - RNA, 19 nt, Pseudomonas aeruginosa PA01
gcaggguaccgcuggcgcu

SEQ ID NO: 3458551 - RNA, 20 nt, Pseudomonas aeruginosa PA01
gcaggguaccgcuggcgcug

SEQ ID NO: 3458552 - RNA, 19 nt, Pseudomonas aeruginosa PA01
gcaggguauuuuccagcag

SEQ ID NO: 3458553 - RNA, 20 nt, Pseudomonas aeruginosa PA01
gcaggguauuuuccagcagg

SEQ ID NO: 3458554 - RNA, 21 nt, Pseudomonas aeruginosa PA01
gcaggguauuuuccagcaggc

SEQ ID NO: 3458555 - RNA, 15 nt, Pseudomonas aeruginosa PA01
gcagggucacgcugg

SEQ ID NO: 3458556 - RNA, 15 nt, Pseudomonas aeruginosa PA01
gcagggucagcagcg

SEQ ID NO: 3458557 - RNA, 17 nt, Pseudomonas aeruginosa PA01
gcagggucagcagcgcc

SEQ ID NO: 3458558 - RNA, 20 nt, Pseudomonas aeruginosa PA01
gcagggucagcagcgccagu

SEQ ID NO: 3458559 - RNA, 17 nt, Pseudomonas aeruginosa PA01
gcagggucagccgaugc

SEQ ID NO: 3458560 - RNA, 14 nt, Pseudomonas aeruginosa PA01
gcagggucaggccc

SEQ ID NO: 3458561 - RNA, 14 nt, Pseudomonas aeruginosa PA01
gcaggguccaugga

SEQ ID NO: 3458562 - RNA, 19 nt, Pseudomonas aeruginosa PA01
gcaggguccauggaccgag

SEQ ID NO: 3458563 - RNA, 12 nt, Pseudomonas aeruginosa PA01
gcagggucgagg

SEQ ID NO: 3458564 - RNA, 22 nt, Pseudomonas aeruginosa PA01
gcagggucgaggcaaucugccc

SEQ ID NO: 3458565 - RNA, 17 nt, Pseudomonas aeruginosa PA01
gcagggucgccgggucg

SEQ ID NO: 3458566 - RNA, 15 nt, Pseudomonas aeruginosa PA01
gcagggucgccuggg

SEQ ID NO: 3458567 - RNA, 16 nt, Pseudomonas aeruginosa PA01
gcagggucgccugggu

SEQ ID NO: 3458568 - RNA, 14 nt, Pseudomonas aeruginosa PA01
gcagggucgcgagc

SEQ ID NO: 3458569 - RNA, 20 nt, Pseudomonas aeruginosa PA01
gcagggucgcgccguccauc

SEQ ID NO: 3458570 - RNA, 23 nt, Pseudomonas aeruginosa PA01
gcagggucgcuuccucggcacuc

SEQ ID NO: 3458571 - RNA, 15 nt, Pseudomonas aeruginosa PA01
gcagggucucgcugc

SEQ ID NO: 3458572 - RNA, 18 nt, Pseudomonas aeruginosa PA01
gcagggucuucaggcgcc

SEQ ID NO: 3458573 - RNA, 13 nt, Pseudomonas aeruginosa PA01
gcagggugaagcu

SEQ ID NO: 3458574 - RNA, 15 nt, Pseudomonas aeruginosa PA01
gcagggugaagcugc

SEQ ID NO: 3458575 - RNA, 15 nt, Pseudomonas aeruginosa PA01
gcagggugacgguga

SEQ ID NO: 3458576 - RNA, 12 nt, Pseudomonas aeruginosa PA01
gcagggugcccu

SEQ ID NO: 3458577 - RNA, 16 nt, Pseudomonas aeruginosa PA01
gcagggugcggcugcu

SEQ ID NO: 3458578 - RNA, 12 nt, Pseudomonas aeruginosa PA01
gcagggugcugu

SEQ ID NO: 3458579 - RNA, 22 nt, Pseudomonas aeruginosa PA01
gcagggugcuguguucgaucuc

SEQ ID NO: 3458580 - RNA, 13 nt, Pseudomonas aeruginosa PA01
gcaggguggccag

SEQ ID NO: 3458581 - RNA, 16 nt, Pseudomonas aeruginosa PA01
gcaggguggccagggu

SEQ ID NO: 3458582 - RNA, 13 nt, Pseudomonas aeruginosa PA01
gcaggguggcgca

SEQ ID NO: 3458583 - RNA, 16 nt, Pseudomonas aeruginosa PA01
gcaggguguugaucac

SEQ ID NO: 3458584 - RNA, 23 nt, Pseudomonas aeruginosa PA01
gcaggguucggggaacagcgcca

SEQ ID NO: 3458585 - RNA, 19 nt, Pseudomonas aeruginosa PA01
gcagguaacccgcggcgag

SEQ ID NO: 3458586 - RNA, 20 nt, Pseudomonas aeruginosa PA01
gcagguaacccgcggcgagg

SEQ ID NO: 3458587 - RNA, 18 nt, Pseudomonas aeruginosa PA01
gcagguacggcgccgcug

SEQ ID NO: 3458588 - RNA, 19 nt, Pseudomonas aeruginosa PA01
gcagguacggcgccgcugc

SEQ ID NO: 3458589 - RNA, 17 nt, Pseudomonas aeruginosa PA01
gcagguacucgccggcg

SEQ ID NO: 3458590 - RNA, 23 nt, Pseudomonas aeruginosa PA01
gcagguagaaggugcccagcggc

SEQ ID NO: 3458591 - RNA, 18 nt, Pseudomonas aeruginosa PA01
gcagguagaccacgcagg

SEQ ID NO: 3458592 - RNA, 21 nt, Pseudomonas aeruginosa PA01
gcagguagaccacgcaggcca

SEQ ID NO: 3458593 - RNA, 13 nt, Pseudomonas aeruginosa PA01
gcagguagaccuc

SEQ ID NO: 3458594 - RNA, 13 nt, Pseudomonas aeruginosa PA01
gcagguagcagcc

SEQ ID NO: 3458595 - RNA, 15 nt, Pseudomonas aeruginosa PA01
gcagguagccagggg

SEQ ID NO: 3458596 - RNA, 16 nt, Pseudomonas aeruginosa PA01
gcagguagccaggggu

SEQ ID NO: 3458597 - RNA, 23 nt, Pseudomonas aeruginosa PA01
gcagguagccaggggucaggccg

SEQ ID NO: 3458598 - RNA, 15 nt, Pseudomonas aeruginosa PA01
gcagguagccgccuu

SEQ ID NO: 3458599 - RNA, 14 nt, Pseudomonas aeruginosa PA01
gcagguagccgcgc

SEQ ID NO: 3458600 - RNA, 17 nt, Pseudomonas aeruginosa PA01
gcagguagccgcgccgg

SEQ ID NO: 3458601 - RNA, 16 nt, Pseudomonas aeruginosa PA01
gcagguagccugcggc

SEQ ID NO: 3458602 - RNA, 20 nt, Pseudomonas aeruginosa PA01
gcagguagccugcggccagc

SEQ ID NO: 3458603 - RNA, 23 nt, Pseudomonas aeruginosa PA01
gcagguagccugcggccagcgcc

SEQ ID NO: 3458604 - RNA, 24 nt, Pseudomonas aeruginosa PA01
gcagguagccugcggccagcgcca

SEQ ID NO: 3458605 - RNA, 12 nt, Pseudomonas aeruginosa PA01
gcagguagcgcu

SEQ ID NO: 3458606 - RNA, 15 nt, Pseudomonas aeruginosa PA01
gcagguagcgcugcg

SEQ ID NO: 3458607 - RNA, 16 nt, Pseudomonas aeruginosa PA01
gcagguagcgcugcgc

SEQ ID NO: 3458608 - RNA, 22 nt, Pseudomonas aeruginosa PA01
gcagguagcggcgaagcgcagg

SEQ ID NO: 3458609 - RNA, 15 nt, Pseudomonas aeruginosa PA01
gcagguagcugagca

SEQ ID NO: 3458610 - RNA, 17 nt, Pseudomonas aeruginosa PA01
gcagguagcugcuccag

SEQ ID NO: 3458611 - RNA, 16 nt, Pseudomonas aeruginosa PA01
gcagguaguccagcca

SEQ ID NO: 3458612 - RNA, 17 nt, Pseudomonas aeruginosa PA01
gcagguaguccagccag

SEQ ID NO: 3458613 - RNA, 18 nt, Pseudomonas aeruginosa PA01
gcagguaguccagccagu

SEQ ID NO: 3458614 - RNA, 20 nt, Pseudomonas aeruginosa PA01
gcagguaguccagccagugc

SEQ ID NO: 3458615 - RNA, 22 nt, Pseudomonas aeruginosa PA01
gcagguagucgcucauggcgcc

SEQ ID NO: 3458616 - RNA, 15 nt, Pseudomonas aeruginosa PA01
gcagguagugcucgg

SEQ ID NO: 3458617 - RNA, 18 nt, Pseudomonas aeruginosa PA01
gcagguagugcucggcca

SEQ ID NO: 3458618 - RNA, 19 nt, Pseudomonas aeruginosa PA01
gcagguagugcucggccag

SEQ ID NO: 3458619 - RNA, 18 nt, Pseudomonas aeruginosa PA01
gcagguaguggcccucga

SEQ ID NO: 3458620 - RNA, 21 nt, Pseudomonas aeruginosa PA01
gcagguaguucuccaggccca

SEQ ID NO: 3458621 - RNA, 15 nt, Pseudomonas aeruginosa PA01
gcagguaucgcuggg

SEQ ID NO: 3458622 - RNA, 18 nt, Pseudomonas aeruginosa PA01
gcagguaucgcugggcgc

SEQ ID NO: 3458623 - RNA, 20 nt, Pseudomonas aeruginosa PA01
gcagguaucgcugggcgccu

SEQ ID NO: 3458624 - RNA, 15 nt, Pseudomonas aeruginosa PA01
gcaggucacgcccug

SEQ ID NO: 3458625 - RNA, 21 nt, Pseudomonas aeruginosa PA01
gcaggucaugaaggaaaccgg

SEQ ID NO: 3458626 - RNA, 15 nt, Pseudomonas aeruginosa PA01
gcagucgcuuccgcg

SEQ ID NO: 3458627 - RNA, 20 nt, Pseudomonas aeruginosa PA01
gcagucgcuuccgcgcggcg

SEQ ID NO: 3458628 - RNA, 15 nt, Pseudomonas aeruginosa PA01
gcagucgggcucaga

SEQ ID NO: 3458629 - RNA, 18 nt, Pseudomonas aeruginosa PA01
gcagucgguagaaauccu

SEQ ID NO: 3458630 - RNA, 18 nt, Pseudomonas aeruginosa PA01
gcagucguaggucugccc

SEQ ID NO: 3458631 - RNA, 18 nt, Pseudomonas aeruginosa PA01
gcagucgucaagcgcgga

SEQ ID NO: 3458632 - RNA, 24 nt, Pseudomonas aeruginosa PA01
gcagugcgccgcagcgcaagucgg

SEQ ID NO: 3458633 - RNA, 18 nt, Pseudomonas aeruginosa PA01
gcagugcucgaucaggcu

SEQ ID NO: 3458634 - RNA, 15 nt, Pseudomonas aeruginosa PA01
gcaguggcgccagcc

SEQ ID NO: 3458635 - RNA, 23 nt, Pseudomonas aeruginosa PA01
gcaguggcgccagccagcccggc

SEQ ID NO: 3458636 - RNA, 15 nt, Pseudomonas aeruginosa PA01
gcaguggcuccgcgc

SEQ ID NO: 3458637 - RNA, 18 nt, Pseudomonas aeruginosa PA01
gcaguggcuccgcgcguu

SEQ ID NO: 3458638 - RNA, 21 nt, Pseudomonas aeruginosa PA01
gcaguggugauccgcacccgc

SEQ ID NO: 3458639 - RNA, 15 nt, Pseudomonas aeruginosa PA01
gcagugugccgcccu

SEQ ID NO: 3458640 - RNA, 20 nt, Pseudomonas aeruginosa PA01
gcaguucagccacugccgcc

SEQ ID NO: 3458641 - RNA, 18 nt, Pseudomonas aeruginosa PA01
gcaguucccccagcaccu

SEQ ID NO: 3458642 - RNA, 21 nt, Pseudomonas aeruginosa PA01
gcaguucccccagcaccugga

SEQ ID NO: 3458643 - RNA, 15 nt, Pseudomonas aeruginosa PA01
gcaguuccgcggcgu

SEQ ID NO: 3458644 - RNA, 21 nt, Pseudomonas aeruginosa PA01
gcaguuccucgccgcugcugg

SEQ ID NO: 3458645 - RNA, 19 nt, Pseudomonas aeruginosa PA01
gcaguucgaccuccaggcc

SEQ ID NO: 3458646 - RNA, 23 nt, Pseudomonas aeruginosa PA01
gcaguucgccccgccgccaggcg

SEQ ID NO: 3458647 - RNA, 22 nt, Pseudomonas aeruginosa PA01
gcaguucgccguucagcuccca

SEQ ID NO: 3458648 - RNA, 15 nt, Pseudomonas aeruginosa PA01
gcaguucgcgggccg

SEQ ID NO: 3458649 - RNA, 13 nt, Pseudomonas aeruginosa PA01
gcaguucgcgggu

SEQ ID NO: 3458650 - RNA, 21 nt, Pseudomonas aeruginosa PA01
gcaguucguccaucgccaggc

SEQ ID NO: 3458651 - RNA, 22 nt, Pseudomonas aeruginosa PA01
gcaguucguccaucgccaggcc

SEQ ID NO: 3458652 - RNA, 17 nt, Pseudomonas aeruginosa PA01
gcaguucgucgccacgc

SEQ ID NO: 3458653 - RNA, 22 nt, Pseudomonas aeruginosa PA01
gcaguucgucgccacgcccgcc

SEQ ID NO: 3458654 - RNA, 23 nt, Pseudomonas aeruginosa PA01
gcaguucgucuuccagcggccac

SEQ ID NO: 3458655 - RNA, 20 nt, Pseudomonas aeruginosa PA01
gcaguugagucgcgcgcgcu

SEQ ID NO: 3458656 - RNA, 21 nt, Pseudomonas aeruginosa PA01
gcaguugcaacagcgcggcgg

SEQ ID NO: 3458657 - RNA, 15 nt, Pseudomonas aeruginosa PA01
gcaguugcaguaccu

SEQ ID NO: 3458658 - RNA, 19 nt, Pseudomonas aeruginosa PA01
gcaguugcaguaccugcuc

SEQ ID NO: 3458659 - RNA, 15 nt, Pseudomonas aeruginosa PA01
gcaguugccaggagg

SEQ ID NO: 3458660 - RNA, 15 nt, Pseudomonas aeruginosa PA01
gcaguugcgggcgca

SEQ ID NO: 3458661 - RNA, 17 nt, Pseudomonas aeruginosa PA01
gcaguugcgggcgcagg

SEQ ID NO: 3458662 - RNA, 12 nt, Pseudomonas aeruginosa PA01
gcauaaccgcuc

SEQ ID NO: 3458663 - RNA, 17 nt, Pseudomonas aeruginosa PA01
gcauaaccgcuugcggu

SEQ ID NO: 3458664 - RNA, 17 nt, Pseudomonas aeruginosa PA01
gcauaaccggaagcgau

SEQ ID NO: 3458665 - RNA, 16 nt, Pseudomonas aeruginosa PA01
gcauacacaugcaggc

SEQ ID NO: 3458666 - RNA, 17 nt, Pseudomonas aeruginosa PA01
gcauacacaugcaggcu

SEQ ID NO: 3458667 - RNA, 20 nt, Pseudomonas aeruginosa PA01
gcauacacaugcaggcucga

SEQ ID NO: 3458668 - RNA, 18 nt, Pseudomonas aeruginosa PA01
gcauacgaaaacggcccu

SEQ ID NO: 3458669 - RNA, 19 nt, Pseudomonas aeruginosa PA01
gcauacgcucuaucgacgg

SEQ ID NO: 3458670 - RNA, 19 nt, Pseudomonas aeruginosa PA01
gcauagaugccggccucga

SEQ ID NO: 3458671 - RNA, 21 nt, Pseudomonas aeruginosa PA01
gcauagaugccggccucgacg

SEQ ID NO: 3458672 - RNA, 16 nt, Pseudomonas aeruginosa PA01
gcauagaugucgaagu

SEQ ID NO: 3458673 - RNA, 13 nt, Pseudomonas aeruginosa PA01
gcauagcaggccu

SEQ ID NO: 3458674 - RNA, 16 nt, Pseudomonas aeruginosa PA01
gcauagcaggccugga

SEQ ID NO: 3458675 - RNA, 17 nt, Pseudomonas aeruginosa PA01
gcauagcaggccuggag

SEQ ID NO: 3458676 - RNA, 22 nt, Pseudomonas aeruginosa PA01
gcauagccgaacuccgccagca

SEQ ID NO: 3458677 - RNA, 17 nt, Pseudomonas aeruginosa PA01
gcauagccggcgcgccc

SEQ ID NO: 3458678 - RNA, 19 nt, Pseudomonas aeruginosa PA01
gcauaggcggccagccuuc

SEQ ID NO: 3458679 - RNA, 20 nt, Pseudomonas aeruginosa PA01
gcauaggucaugcccaggcc

SEQ ID NO: 3458680 - RNA, 21 nt, Pseudomonas aeruginosa PA01
gcauaggucaugcccaggccg

SEQ ID NO: 3458681 - RNA, 17 nt, Pseudomonas aeruginosa PA01
gcauauucuucaacagc

SEQ ID NO: 3458682 - RNA, 14 nt, Pseudomonas aeruginosa PA01
gcaucaccaggcug

SEQ ID NO: 3458683 - RNA, 15 nt, Pseudomonas aeruginosa PA01
gcaucaccaggcugc

SEQ ID NO: 3458684 - RNA, 21 nt, Pseudomonas aeruginosa PA01
gcaucaccaggcugccgccgu

SEQ ID NO: 3458685 - RNA, 13 nt, Pseudomonas aeruginosa PA01
gcaucaccccgca

SEQ ID NO: 3458686 - RNA, 22 nt, Pseudomonas aeruginosa PA01
gcaucaccgcgguggaggcggc

SEQ ID NO: 3458687 - RNA, 17 nt, Pseudomonas aeruginosa PA01
gcaucaccggcagcagc

SEQ ID NO: 3458688 - RNA, 14 nt, Pseudomonas aeruginosa PA01
gcaucaccggcggg

SEQ ID NO: 3458689 - RNA, 15 nt, Pseudomonas aeruginosa PA01
gcaucaccggcggga

SEQ ID NO: 3458690 - RNA, 18 nt, Pseudomonas aeruginosa PA01
gcaucagaggcaacacca

SEQ ID NO: 3458691 - RNA, 19 nt, Pseudomonas aeruginosa PA01
gcaucagcaauuccgcagc

SEQ ID NO: 3458692 - RNA, 12 nt, Pseudomonas aeruginosa PA01
gcaucagcagga

SEQ ID NO: 3458693 - RNA, 14 nt, Pseudomonas aeruginosa PA01
gcaucagcaggaag

SEQ ID NO: 3458694 - RNA, 19 nt, Pseudomonas aeruginosa PA01
gcaucagccccucggccag

SEQ ID NO: 3458695 - RNA, 13 nt, Pseudomonas aeruginosa PA01
gcaucagccgcga

SEQ ID NO: 3458696 - RNA, 23 nt, Pseudomonas aeruginosa PA01
gcaucagcgacagcauggccuug

SEQ ID NO: 3458697 - RNA, 13 nt, Pseudomonas aeruginosa PA01
gcaucagcgccgg

SEQ ID NO: 3458698 - RNA, 15 nt, Pseudomonas aeruginosa PA01
gcaucagcgccgguu

SEQ ID NO: 3458699 - RNA, 12 nt, Pseudomonas aeruginosa PA01
gcaucaggcgcu

SEQ ID NO: 3458700 - RNA, 14 nt, Pseudomonas aeruginosa PA01
gcaucaggucggcg

SEQ ID NO: 3458701 - RNA, 18 nt, Pseudomonas aeruginosa PA01
gcaucaggucggucuggc

SEQ ID NO: 3458702 - RNA, 19 nt, Pseudomonas aeruginosa PA01
gcaucaggucggucuggcg

SEQ ID NO: 3458703 - RNA, 21 nt, Pseudomonas aeruginosa PA01
gcaucaggucggucuggcggc

SEQ ID NO: 3458704 - RNA, 24 nt, Pseudomonas aeruginosa PA01
gcaucaguagcgggcauccagcgg

SEQ ID NO: 3458705 - RNA, 15 nt, Pseudomonas aeruginosa PA01
gcaucagugcucauc

SEQ ID NO: 3458706 - RNA, 21 nt, Pseudomonas aeruginosa PA01
gcaucaugaucugguagacca

SEQ ID NO: 3458707 - RNA, 22 nt, Pseudomonas aeruginosa PA01
gcaucaugccgagcaucagcga

SEQ ID NO: 3458708 - RNA, 21 nt, Pseudomonas aeruginosa PA01
gcauccacagggucggcagga

SEQ ID NO: 3458709 - RNA, 13 nt, Pseudomonas aeruginosa PA01
gcauccagcaccg

SEQ ID NO: 3458710 - RNA, 17 nt, Pseudomonas aeruginosa PA01
gcauccagcauccgugc

SEQ ID NO: 3458711 - RNA, 19 nt, Pseudomonas aeruginosa PA01
gcauccagcauccgugcga

SEQ ID NO: 3458712 - RNA, 15 nt, Pseudomonas aeruginosa PA01
gcauccagggucgcg

SEQ ID NO: 3458713 - RNA, 19 nt, Pseudomonas aeruginosa PA01
gcauccagguaaaggccac

SEQ ID NO: 3458714 - RNA, 18 nt, Pseudomonas aeruginosa PA01
gcauccaguucguucugg

SEQ ID NO: 3458715 - RNA, 20 nt, Pseudomonas aeruginosa PA01
gcauccccggaccagggcgc

SEQ ID NO: 3458716 - RNA, 22 nt, Pseudomonas aeruginosa PA01
gcaucccgcccggucucagccg

SEQ ID NO: 3458717 - RNA, 13 nt, Pseudomonas aeruginosa PA01
gcauccgccgcag

SEQ ID NO: 3458718 - RNA, 14 nt, Pseudomonas aeruginosa PA01
gcauccgccgcaga

SEQ ID NO: 3458719 - RNA, 14 nt, Pseudomonas aeruginosa PA01
gcauccgccgcugg

SEQ ID NO: 3458720 - RNA, 18 nt, Pseudomonas aeruginosa PA01
gcauccgccgcuggggac

SEQ ID NO: 3458721 - RNA, 13 nt, Pseudomonas aeruginosa PA01
gcauccggcaggc

SEQ ID NO: 3458722 - RNA, 22 nt, Pseudomonas aeruginosa PA01
gcauccguaaaauggcgcgccu

SEQ ID NO: 3458723 - RNA, 23 nt, Pseudomonas aeruginosa PA01
gcauccguaaaauggcgcgccuc

SEQ ID NO: 3458724 - RNA, 19 nt, Pseudomonas aeruginosa PA01
gcauccguuugggaucggu

SEQ ID NO: 3458725 - RNA, 24 nt, Pseudomonas aeruginosa PA01
gcauccguuuugaacgggcucacc

SEQ ID NO: 3458726 - RNA, 20 nt, Pseudomonas aeruginosa PA01
gcauccuccacccccgcaac

SEQ ID NO: 3458727 - RNA, 14 nt, Pseudomonas aeruginosa PA01
gcauccugccgccu

SEQ ID NO: 3458728 - RNA, 14 nt, Pseudomonas aeruginosa PA01
gcaugcagguggcg

SEQ ID NO: 3458729 - RNA, 18 nt, Pseudomonas aeruginosa PA01
gcaugcagguggcgcuca

SEQ ID NO: 3458730 - RNA, 12 nt, Pseudomonas aeruginosa PA01
gcaugccagggc

SEQ ID NO: 3458731 - RNA, 14 nt, Pseudomonas aeruginosa PA01
gcaugccagggccu

SEQ ID NO: 3458732 - RNA, 11 nt, Pseudomonas aeruginosa PA01
gcaugccaucu

SEQ ID NO: 3458733 - RNA, 16 nt, Pseudomonas aeruginosa PA01
gcaugccaucuuccug

SEQ ID NO: 3458734 - RNA, 23 nt, Pseudomonas aeruginosa PA01
gcaugccaucuuccugugcgagg

SEQ ID NO: 3458735 - RNA, 20 nt, Pseudomonas aeruginosa PA01
gcaugcccagcguggccagc

SEQ ID NO: 3458736 - RNA, 22 nt, Pseudomonas aeruginosa PA01
gcaugcccagcguggccagcga

SEQ ID NO: 3458737 - RNA, 13 nt, Pseudomonas aeruginosa PA01
gcaugcccaggcu

SEQ ID NO: 3458738 - RNA, 13 nt, Pseudomonas aeruginosa PA01
gcaugcccagggc

SEQ ID NO: 3458739 - RNA, 19 nt, Pseudomonas aeruginosa PA01
gcaugcccagggccagcag

SEQ ID NO: 3458740 - RNA, 20 nt, Pseudomonas aeruginosa PA01
gcaugcccagggccagcagc

SEQ ID NO: 3458741 - RNA, 17 nt, Pseudomonas aeruginosa PA01
gcaugcccgcgucgcgc

SEQ ID NO: 3458742 - RNA, 20 nt, Pseudomonas aeruginosa PA01
gcaugcccgcgucgcgcgcg

SEQ ID NO: 3458743 - RNA, 18 nt, Pseudomonas aeruginosa PA01
gcaugccggccgucgcgc

SEQ ID NO: 3458744 - RNA, 20 nt, Pseudomonas aeruginosa PA01
gcaugccggggaaccacacc

SEQ ID NO: 3458745 - RNA, 18 nt, Pseudomonas aeruginosa PA01
gcaugccgggguccgccg

SEQ ID NO: 3458746 - RNA, 16 nt, Pseudomonas aeruginosa PA01
gcaugccgugggcgcc

SEQ ID NO: 3458747 - RNA, 18 nt, Pseudomonas aeruginosa PA01
gcaugccguugggccagg

SEQ ID NO: 3458748 - RNA, 19 nt, Pseudomonas aeruginosa PA01
gcaugccguugggccaggg

SEQ ID NO: 3458749 - RNA, 21 nt, Pseudomonas aeruginosa PA01
gcaugccguugggccagggcc

SEQ ID NO: 3458750 - RNA, 14 nt, Pseudomonas aeruginosa PA01
gcaugcgcagcgcg

SEQ ID NO: 3458751 - RNA, 16 nt, Pseudomonas aeruginosa PA01
gcaugcggccccggcg

SEQ ID NO: 3458752 - RNA, 17 nt, Pseudomonas aeruginosa PA01
gcaugcggccccggcgc

SEQ ID NO: 3458753 - RNA, 13 nt, Pseudomonas aeruginosa PA01
gcaugcgggcgau

SEQ ID NO: 3458754 - RNA, 13 nt, Pseudomonas aeruginosa PA01
gcaugcucagccg

SEQ ID NO: 3458755 - RNA, 22 nt, Pseudomonas aeruginosa PA01
gcaugcucagccgcgccggggc

SEQ ID NO: 3458756 - RNA, 16 nt, Pseudomonas aeruginosa PA01
gcaugcucggccaggu

SEQ ID NO: 3458757 - RNA, 18 nt, Pseudomonas aeruginosa PA01
gcaugcucggccagguau

SEQ ID NO: 3458758 - RNA, 17 nt, Pseudomonas aeruginosa PA01
gcaugcucgggcugccg

SEQ ID NO: 3458759 - RNA, 18 nt, Pseudomonas aeruginosa PA01
gcaugcugcucggcauuc

SEQ ID NO: 3458760 - RNA, 16 nt, Pseudomonas aeruginosa PA01
gcaugcuugccagaau

SEQ ID NO: 3458761 - RNA, 17 nt, Pseudomonas aeruginosa PA01
gcaugcuuuugaacacc

SEQ ID NO: 3458762 - RNA, 19 nt, Pseudomonas aeruginosa PA01
gcauggacaggucgacggc

SEQ ID NO: 3458763 - RNA, 20 nt, Pseudomonas aeruginosa PA01
gcauggagacggcccgcccc

SEQ ID NO: 3458764 - RNA, 20 nt, Pseudomonas aeruginosa PA01
gcauggaucaacuggucgca

SEQ ID NO: 3458765 - RNA, 16 nt, Pseudomonas aeruginosa PA01
gcauggccacgcucuc

SEQ ID NO: 3458766 - RNA, 20 nt, Pseudomonas aeruginosa PA01
gcauggccgaccgccaggcc

SEQ ID NO: 3458767 - RNA, 15 nt, Pseudomonas aeruginosa PA01
gcauggccggcuacu

SEQ ID NO: 3458768 - RNA, 16 nt, Pseudomonas aeruginosa PA01
gcauggccgggccgau

SEQ ID NO: 3458769 - RNA, 14 nt, Pseudomonas aeruginosa PA01
gcauggcgaccugg

SEQ ID NO: 3458770 - RNA, 12 nt, Pseudomonas aeruginosa PA01
gcauggcgcucu

SEQ ID NO: 3458771 - RNA, 12 nt, Pseudomonas aeruginosa PA01
gcauggcggcga

SEQ ID NO: 3458772 - RNA, 14 nt, Pseudomonas aeruginosa PA01
gcauggcguucugc

SEQ ID NO: 3458773 - RNA, 14 nt, Pseudomonas aeruginosa PA01
gcauggcuggcgcu

SEQ ID NO: 3458774 - RNA, 21 nt, Pseudomonas aeruginosa PA01
gcauggcuggcgcuaccgcgc

SEQ ID NO: 3458775 - RNA, 18 nt, Pseudomonas aeruginosa PA01
gcauggcuucgggaucgu

SEQ ID NO: 3458776 - RNA, 17 nt, Pseudomonas aeruginosa PA01
gcauggcuuuccaggcg

SEQ ID NO: 3458777 - RNA, 18 nt, Pseudomonas aeruginosa PA01
gcauggcuuuccaggcgc

SEQ ID NO: 3458778 - RNA, 20 nt, Pseudomonas aeruginosa PA01
gcauggcuuuccaggcgccg

SEQ ID NO: 3458779 - RNA, 18 nt, Pseudomonas aeruginosa PA01
gcaugggcauccugccgc

SEQ ID NO: 3458780 - RNA, 20 nt, Pseudomonas aeruginosa PA01
gcaugggcauccugccgccu

SEQ ID NO: 3458781 - RNA, 21 nt, Pseudomonas aeruginosa PA01
gcaugggcauccugccgccug

SEQ ID NO: 3458782 - RNA, 14 nt, Pseudomonas aeruginosa PA01
gcauggggcggcac

SEQ ID NO: 3458783 - RNA, 15 nt, Pseudomonas aeruginosa PA01
gcaugggucagcgcc

SEQ ID NO: 3458784 - RNA, 17 nt, Pseudomonas aeruginosa PA01
gcaugggucagcgccag

SEQ ID NO: 3458785 - RNA, 17 nt, Pseudomonas aeruginosa PA01
gcaugguccguucggcg

SEQ ID NO: 3458786 - RNA, 20 nt, Pseudomonas aeruginosa PA01
gcaugguccguucggcgccc

SEQ ID NO: 3458787 - RNA, 20 nt, Pseudomonas aeruginosa PA01
gcauggucgcgcuguugccg

SEQ ID NO: 3458788 - RNA, 22 nt, Pseudomonas aeruginosa PA01
gcauggucgcgcuguugccgcg

SEQ ID NO: 3458789 - RNA, 19 nt, Pseudomonas aeruginosa PA01
gcaugguguccggcggcga

SEQ ID NO: 3458790 - RNA, 15 nt, Pseudomonas aeruginosa PA01
gcaugguuaccucgu

SEQ ID NO: 3458791 - RNA, 18 nt, Pseudomonas aeruginosa PA01
gcaugguuaccucguugc

SEQ ID NO: 3458792 - RNA, 19 nt, Pseudomonas aeruginosa PA01
gcaugguuaccucguugcg

SEQ ID NO: 3458793 - RNA, 23 nt, Pseudomonas aeruginosa PA01
gcauguagcgcuccucgcgcugc

SEQ ID NO: 3458794 - RNA, 19 nt, Pseudomonas aeruginosa PA01
gcauguccaccgccgccag

SEQ ID NO: 3458795 - RNA, 21 nt, Pseudomonas aeruginosa PA01
gcauguccaccgccgccagca

SEQ ID NO: 3458796 - RNA, 23 nt, Pseudomonas aeruginosa PA01
gcauguccaccgccgccagcaac

SEQ ID NO: 3458797 - RNA, 14 nt, Pseudomonas aeruginosa PA01
gcauguccagccag

SEQ ID NO: 3458798 - RNA, 14 nt, Pseudomonas aeruginosa PA01
gcauguccgcaggc

SEQ ID NO: 3458799 - RNA, 22 nt, Pseudomonas aeruginosa PA01
gcauguccgcaggcaggucgcu

SEQ ID NO: 3458800 - RNA, 15 nt, Pseudomonas aeruginosa PA01
gcauguccucggcgc

SEQ ID NO: 3458801 - RNA, 18 nt, Pseudomonas aeruginosa PA01
gcauguccugcaggcuca

SEQ ID NO: 3458802 - RNA, 23 nt, Pseudomonas aeruginosa PA01
gcauguccugcaggcucagcacc

SEQ ID NO: 3458803 - RNA, 19 nt, Pseudomonas aeruginosa PA01
gcaugucgagauugucgcg

SEQ ID NO: 3458804 - RNA, 19 nt, Pseudomonas aeruginosa PA01
gcaugucgcugagcggcug

SEQ ID NO: 3458805 - RNA, 14 nt, Pseudomonas aeruginosa PA01
gcaugugccaggcc

SEQ ID NO: 3458806 - RNA, 12 nt, Pseudomonas aeruginosa PA01
gcaugugggcga

SEQ ID NO: 3458807 - RNA, 13 nt, Pseudomonas aeruginosa PA01
gcauguucaugcg

SEQ ID NO: 3458808 - RNA, 15 nt, Pseudomonas aeruginosa PA01
gcauguucaugcgcu

SEQ ID NO: 3458809 - RNA, 17 nt, Pseudomonas aeruginosa PA01
gcauguucaugcgcugg

SEQ ID NO: 3458810 - RNA, 19 nt, Pseudomonas aeruginosa PA01
gcauguucaugcgcuggua

SEQ ID NO: 3458811 - RNA, 18 nt, Pseudomonas aeruginosa PA01
gcauguuccuccagagug

SEQ ID NO: 3458812 - RNA, 15 nt, Pseudomonas aeruginosa PA01
gcauguuggcgccuu

SEQ ID NO: 3458813 - RNA, 22 nt, Pseudomonas aeruginosa PA01
gcauguuguuauggccgacccg

SEQ ID NO: 3458814 - RNA, 16 nt, Pseudomonas aeruginosa PA01
gcauuccagaaacggc

SEQ ID NO: 3458815 - RNA, 20 nt, Pseudomonas aeruginosa PA01
gcauuccuccagggucgccc

SEQ ID NO: 3458816 - RNA, 21 nt, Pseudomonas aeruginosa PA01
gcauucgcagcggccccgagc

SEQ ID NO: 3458817 - RNA, 21 nt, Pseudomonas aeruginosa PA01
gcauucgcgcugguugcccag

SEQ ID NO: 3458818 - RNA, 14 nt, Pseudomonas aeruginosa PA01
gcauucguccagcc

SEQ ID NO: 3458819 - RNA, 16 nt, Pseudomonas aeruginosa PA01
gcauucguccagccgc

SEQ ID NO: 3458820 - RNA, 21 nt, Pseudomonas aeruginosa PA01
gcauucguccagccgccgcug

SEQ ID NO: 3458821 - RNA, 12 nt, Pseudomonas aeruginosa PA01
gcauucgucgcc

SEQ ID NO: 3458822 - RNA, 15 nt, Pseudomonas aeruginosa PA01
gcauucgucgccgcu

SEQ ID NO: 3458823 - RNA, 16 nt, Pseudomonas aeruginosa PA01
gcauucgucgccgcug

SEQ ID NO: 3458824 - RNA, 22 nt, Pseudomonas aeruginosa PA01
gcauucucgcgacccuggccgc

SEQ ID NO: 3458825 - RNA, 16 nt, Pseudomonas aeruginosa PA01
gcauugagcgccagca

SEQ ID NO: 3458826 - RNA, 17 nt, Pseudomonas aeruginosa PA01
gcauugagcgccagcag

SEQ ID NO: 3458827 - RNA, 14 nt, Pseudomonas aeruginosa PA01
gcauuggcacccug

SEQ ID NO: 3458828 - RNA, 16 nt, Pseudomonas aeruginosa PA01
gcauuggcacccugga

SEQ ID NO: 3458829 - RNA, 14 nt, Pseudomonas aeruginosa PA01
gcauuggccaggcc

SEQ ID NO: 3458830 - RNA, 16 nt, Pseudomonas aeruginosa PA01
gcauuggccaggcccc

SEQ ID NO: 3458831 - RNA, 24 nt, Pseudomonas aeruginosa PA01
gccaccagcagggccaggccgagc

SEQ ID NO: 3458832 - RNA, 14 nt, Pseudomonas aeruginosa PA01
gccaccagcaugcc

SEQ ID NO: 3458833 - RNA, 15 nt, Pseudomonas aeruginosa PA01
gccaccagcaugccc

SEQ ID NO: 3458834 - RNA, 18 nt, Pseudomonas aeruginosa PA01
gccaccagcaugcccagc

SEQ ID NO: 3458835 - RNA, 15 nt, Pseudomonas aeruginosa PA01
gccaccagccaggcg

SEQ ID NO: 3458836 - RNA, 19 nt, Pseudomonas aeruginosa PA01
gccaccagccaggcggcca

SEQ ID NO: 3458837 - RNA, 21 nt, Pseudomonas aeruginosa PA01
gccaccagccaggcggccacc

SEQ ID NO: 3458838 - RNA, 23 nt, Pseudomonas aeruginosa PA01
gccaccagccagucgagacgcca

SEQ ID NO: 3458839 - RNA, 12 nt, Pseudomonas aeruginosa PA01
gccaccagccga

SEQ ID NO: 3458840 - RNA, 13 nt, Pseudomonas aeruginosa PA01
gccaccagccgaa

SEQ ID NO: 3458841 - RNA, 13 nt, Pseudomonas aeruginosa PA01
gccaccagcgagu

SEQ ID NO: 3458842 - RNA, 18 nt, Pseudomonas aeruginosa PA01
gccaccagcguggcgcgc

SEQ ID NO: 3458843 - RNA, 13 nt, Pseudomonas aeruginosa PA01
gccaccaggccgc

SEQ ID NO: 3458844 - RNA, 14 nt, Pseudomonas aeruginosa PA01
gccaccaggccgcu

SEQ ID NO: 3458845 - RNA, 18 nt, Pseudomonas aeruginosa PA01
gccaccaggccgcugccg

SEQ ID NO: 3458846 - RNA, 20 nt, Pseudomonas aeruginosa PA01
gccaccaggccgcugccgcc

SEQ ID NO: 3458847 - RNA, 19 nt, Pseudomonas aeruginosa PA01
gccaccaggcuuacccgcg

SEQ ID NO: 3458848 - RNA, 22 nt, Pseudomonas aeruginosa PA01
gccaccaggcuuacccgcgacc

SEQ ID NO: 3458849 - RNA, 16 nt, Pseudomonas aeruginosa PA01
gccaccagggccuugc

SEQ ID NO: 3458850 - RNA, 17 nt, Pseudomonas aeruginosa PA01
gccaccagggccuugcc

SEQ ID NO: 3458851 - RNA, 17 nt, Pseudomonas aeruginosa PA01
gccaccaucacgucgcg

SEQ ID NO: 3458852 - RNA, 23 nt, Pseudomonas aeruginosa PA01
gccaccaucacgucgcgcaccug

SEQ ID NO: 3458853 - RNA, 16 nt, Pseudomonas aeruginosa PA01
gccaccccgccgcgca

SEQ ID NO: 3458854 - RNA, 15 nt, Pseudomonas aeruginosa PA01
gccaccccgccgcug

SEQ ID NO: 3458855 - RNA, 20 nt, Pseudomonas aeruginosa PA01
gccaccccgccgcuggcggc

SEQ ID NO: 3458856 - RNA, 16 nt, Pseudomonas aeruginosa PA01
gccaccccgccggcgu

SEQ ID NO: 3458857 - RNA, 18 nt, Pseudomonas aeruginosa PA01
gccaccccgcuccgcuca

SEQ ID NO: 3458858 - RNA, 20 nt, Pseudomonas aeruginosa PA01
gccacccgaagguguccgcc

SEQ ID NO: 3458859 - RNA, 20 nt, Pseudomonas aeruginosa PA01
gccacccgcaucgaggccgc

SEQ ID NO: 3458860 - RNA, 21 nt, Pseudomonas aeruginosa PA01
gccacccgcaucgaggccgcc

SEQ ID NO: 3458861 - RNA, 22 nt, Pseudomonas aeruginosa PA01
gccacccgcaucgaggccgccc

SEQ ID NO: 3458862 - RNA, 13 nt, Pseudomonas aeruginosa PA01
gccacccgccucg

SEQ ID NO: 3458863 - RNA, 13 nt, Pseudomonas aeruginosa PA01
gccacccgcgggc

SEQ ID NO: 3458864 - RNA, 12 nt, Pseudomonas aeruginosa PA01
gccacccggcgc

SEQ ID NO: 3458865 - RNA, 14 nt, Pseudomonas aeruginosa PA01
gccacccggcgccc

SEQ ID NO: 3458866 - RNA, 15 nt, Pseudomonas aeruginosa PA01
gccacccggcgcccg

SEQ ID NO: 3458867 - RNA, 17 nt, Pseudomonas aeruginosa PA01
gccacccggcgcccggc

SEQ ID NO: 3458868 - RNA, 19 nt, Pseudomonas aeruginosa PA01
gccacccggcgcccggcgc

SEQ ID NO: 3458869 - RNA, 12 nt, Pseudomonas aeruginosa PA01
gccacccuugcg

SEQ ID NO: 3458870 - RNA, 19 nt, Pseudomonas aeruginosa PA01
gccacccuugcgcccggcu

SEQ ID NO: 3458871 - RNA, 23 nt, Pseudomonas aeruginosa PA01
gccacccuugcguccugccucgg

SEQ ID NO: 3458872 - RNA, 13 nt, Pseudomonas aeruginosa PA01
gccacccuuggag

SEQ ID NO: 3458873 - RNA, 20 nt, Pseudomonas aeruginosa PA01
gccacccuuggagccgcccu

SEQ ID NO: 3458874 - RNA, 18 nt, Pseudomonas aeruginosa PA01
gccaccgacccucggcga

SEQ ID NO: 3458875 - RNA, 19 nt, Pseudomonas aeruginosa PA01
gccaccgacccucggcgag

SEQ ID NO: 3458876 - RNA, 16 nt, Pseudomonas aeruginosa PA01
gccaccgauucgccgg

SEQ ID NO: 3458877 - RNA, 17 nt, Pseudomonas aeruginosa PA01
gccaccgauucgccggc

SEQ ID NO: 3458878 - RNA, 19 nt, Pseudomonas aeruginosa PA01
gccaccgauucgccggcca

SEQ ID NO: 3458879 - RNA, 18 nt, Pseudomonas aeruginosa PA01
gccaccgccaccgccgga

SEQ ID NO: 3458880 - RNA, 15 nt, Pseudomonas aeruginosa PA01
gccaccgccaggacc

SEQ ID NO: 3458881 - RNA, 20 nt, Pseudomonas aeruginosa PA01
gccaccgccuggucgccggg

SEQ ID NO: 3458882 - RNA, 16 nt, Pseudomonas aeruginosa PA01
gccaccgcgacgcgcu

SEQ ID NO: 3458883 - RNA, 13 nt, Pseudomonas aeruginosa PA01
gccaccgcgcgcc

SEQ ID NO: 3458884 - RNA, 14 nt, Pseudomonas aeruginosa PA01
gccaccgcgcgccc

SEQ ID NO: 3458885 - RNA, 18 nt, Pseudomonas aeruginosa PA01
gccaccgcggcguccgcg

SEQ ID NO: 3458886 - RNA, 19 nt, Pseudomonas aeruginosa PA01
gccaccgcggcguccgcgu

SEQ ID NO: 3458887 - RNA, 21 nt, Pseudomonas aeruginosa PA01
gccaccggcguuauccgccga

SEQ ID NO: 3458888 - RNA, 21 nt, Pseudomonas aeruginosa PA01
gccaccggcugcauguccgcc

SEQ ID NO: 3458889 - RNA, 18 nt, Pseudomonas aeruginosa PA01
gccaccgggaucagcggc

SEQ ID NO: 3458890 - RNA, 15 nt, Pseudomonas aeruginosa PA01
gccaccgggaucugg

SEQ ID NO: 3458891 - RNA, 22 nt, Pseudomonas aeruginosa PA01
gccaccgggaucuggcccugca

SEQ ID NO: 3458892 - RNA, 19 nt, Pseudomonas aeruginosa PA01
gccaccgggugcagguuca

SEQ ID NO: 3458893 - RNA, 20 nt, Pseudomonas aeruginosa PA01
gccaccgggugcagguucac

SEQ ID NO: 3458894 - RNA, 22 nt, Pseudomonas aeruginosa PA01
gccaccgggugcagguucaccg

SEQ ID NO: 3458895 - RNA, 20 nt, Pseudomonas aeruginosa PA01
gccaccgguggacugguuga

SEQ ID NO: 3458896 - RNA, 13 nt, Pseudomonas aeruginosa PA01
gccaccugagcga

SEQ ID NO: 3458897 - RNA, 13 nt, Pseudomonas aeruginosa PA01
gccaccugccccg

SEQ ID NO: 3458898 - RNA, 22 nt, Pseudomonas aeruginosa PA01
gccaccugccccgggcgccggg

SEQ ID NO: 3458899 - RNA, 23 nt, Pseudomonas aeruginosa PA01
gccaccugcucgcugaaccgcgu

SEQ ID NO: 3458900 - RNA, 14 nt, Pseudomonas aeruginosa PA01
gccaccuggcucug

SEQ ID NO: 3458901 - RNA, 18 nt, Pseudomonas aeruginosa PA01
gccaccugguucaucgag

SEQ ID NO: 3458902 - RNA, 18 nt, Pseudomonas aeruginosa PA01
gccaccuguuccacgaga

SEQ ID NO: 3458903 - RNA, 19 nt, Pseudomonas aeruginosa PA01
gccaccuucgcccgcugcg

SEQ ID NO: 3458904 - RNA, 22 nt, Pseudomonas aeruginosa PA01
gccaccuugcgucccugggccu

SEQ ID NO: 3458905 - RNA, 22 nt, Pseudomonas aeruginosa PA01
gccacgaacugcauggccuugu

SEQ ID NO: 3458906 - RNA, 16 nt, Pseudomonas aeruginosa PA01
gccacgacccugcugg

SEQ ID NO: 3458907 - RNA, 19 nt, Pseudomonas aeruginosa PA01
gccacgacccugcuggccg

SEQ ID NO: 3458908 - RNA, 23 nt, Pseudomonas aeruginosa PA01
gccacgacccugcuggccggugc

SEQ ID NO: 3458909 - RNA, 20 nt, Pseudomonas aeruginosa PA01
gccacgacguaauucgcuga

SEQ ID NO: 3458910 - RNA, 16 nt, Pseudomonas aeruginosa PA01
gccacgcaauccucgg

SEQ ID NO: 3458911 - RNA, 19 nt, Pseudomonas aeruginosa PA01
gccacgcaauccucggugc

SEQ ID NO: 3458912 - RNA, 16 nt, Pseudomonas aeruginosa PA01
gccacgcaccaccagg

SEQ ID NO: 3458913 - RNA, 14 nt, Pseudomonas aeruginosa PA01
gccacgcaccagcu

SEQ ID NO: 3458914 - RNA, 16 nt, Pseudomonas aeruginosa PA01
gccacgcaccagcucc

SEQ ID NO: 3458915 - RNA, 24 nt, Pseudomonas aeruginosa PA01
gccacgcaccagcucccggcucaa

SEQ ID NO: 3458916 - RNA, 14 nt, Pseudomonas aeruginosa PA01
gccacgcaggaaca

SEQ ID NO: 3458917 - RNA, 19 nt, Pseudomonas aeruginosa PA01
gccacgcaggaacagcucc

SEQ ID NO: 3458918 - RNA, 18 nt, Pseudomonas aeruginosa PA01
gccacgcaguucgcgggc

SEQ ID NO: 3458919 - RNA, 20 nt, Pseudomonas aeruginosa PA01
gccacgcaguucgcgggccg

SEQ ID NO: 3458920 - RNA, 19 nt, Pseudomonas aeruginosa PA01
gccacgccauucgaauggc

SEQ ID NO: 3458921 - RNA, 13 nt, Pseudomonas aeruginosa PA01
gccacgcccgccg

SEQ ID NO: 3458922 - RNA, 15 nt, Pseudomonas aeruginosa PA01
gccacgcccgccgug

SEQ ID NO: 3458923 - RNA, 16 nt, Pseudomonas aeruginosa PA01
gccacgcccgccgugg

SEQ ID NO: 3458924 - RNA, 18 nt, Pseudomonas aeruginosa PA01
gccacgcccgccguggcg

SEQ ID NO: 3458925 - RNA, 19 nt, Pseudomonas aeruginosa PA01
gccacgcccgccguggcgg

SEQ ID NO: 3458926 - RNA, 21 nt, Pseudomonas aeruginosa PA01
gccacgcccgccguggcggua

SEQ ID NO: 3458927 - RNA, 16 nt, Pseudomonas aeruginosa PA01
gccacgccgacgccga

SEQ ID NO: 3458928 - RNA, 19 nt, Pseudomonas aeruginosa PA01
gccacgccgauaccggccu

SEQ ID NO: 3458929 - RNA, 13 nt, Pseudomonas aeruginosa PA01
gccacgccgccgu

SEQ ID NO: 3458930 - RNA, 13 nt, Pseudomonas aeruginosa PA01
gccacgccggcgc

SEQ ID NO: 3458931 - RNA, 14 nt, Pseudomonas aeruginosa PA01
gccacgccggcgcu

SEQ ID NO: 3458932 - RNA, 15 nt, Pseudomonas aeruginosa PA01
gccacgccggcgcuc

SEQ ID NO: 3458933 - RNA, 19 nt, Pseudomonas aeruginosa PA01
gccagaagcgacuguccaa

SEQ ID NO: 3458934 - RNA, 14 nt, Pseudomonas aeruginosa PA01
gccagaagcgcucg

SEQ ID NO: 3458935 - RNA, 13 nt, Pseudomonas aeruginosa PA01
gccagaagcggcc

SEQ ID NO: 3458936 - RNA, 15 nt, Pseudomonas aeruginosa PA01
gccagaagcggccga

SEQ ID NO: 3458937 - RNA, 20 nt, Pseudomonas aeruginosa PA01
gccagaagcggccgaccagg

SEQ ID NO: 3458938 - RNA, 21 nt, Pseudomonas aeruginosa PA01
gccagaagcggccgaccaggc

SEQ ID NO: 3458939 - RNA, 14 nt, Pseudomonas aeruginosa PA01
gccagaaggccugc

SEQ ID NO: 3458940 - RNA, 15 nt, Pseudomonas aeruginosa PA01
gccagaaggccugcg

SEQ ID NO: 3458941 - RNA, 16 nt, Pseudomonas aeruginosa PA01
gccagaaggccugcgc

SEQ ID NO: 3458942 - RNA, 17 nt, Pseudomonas aeruginosa PA01
gccagaaggccugcgcu

SEQ ID NO: 3458943 - RNA, 23 nt, Pseudomonas aeruginosa PA01
gccagaagguaucggccauggcc

SEQ ID NO: 3458944 - RNA, 14 nt, Pseudomonas aeruginosa PA01
gccagaaggucggg

SEQ ID NO: 3458945 - RNA, 16 nt, Pseudomonas aeruginosa PA01
gccagaaggucgggga

SEQ ID NO: 3458946 - RNA, 19 nt, Pseudomonas aeruginosa PA01
gccagaauuccagcagguc

SEQ ID NO: 3458947 - RNA, 23 nt, Pseudomonas aeruginosa PA01
gccagaauuccagcaggucggca

SEQ ID NO: 3458948 - RNA, 21 nt, Pseudomonas aeruginosa PA01
gccagacaggccagcucgccc

SEQ ID NO: 3458949 - RNA, 15 nt, Pseudomonas aeruginosa PA01
gccagaccagcccca

SEQ ID NO: 3458950 - RNA, 14 nt, Pseudomonas aeruginosa PA01
gccagaccggcagc

SEQ ID NO: 3458951 - RNA, 19 nt, Pseudomonas aeruginosa PA01
gccagaccggcagcgccgc

SEQ ID NO: 3458952 - RNA, 15 nt, Pseudomonas aeruginosa PA01
gccagacgaucagcg

SEQ ID NO: 3458953 - RNA, 13 nt, Pseudomonas aeruginosa PA01
gccagacgcucgg

SEQ ID NO: 3458954 - RNA, 16 nt, Pseudomonas aeruginosa PA01
gccagacgcucggcuu

SEQ ID NO: 3458955 - RNA, 15 nt, Pseudomonas aeruginosa PA01
gccagacguccggca

SEQ ID NO: 3458956 - RNA, 15 nt, Pseudomonas aeruginosa PA01
gccagagaucgccca

SEQ ID NO: 3458957 - RNA, 18 nt, Pseudomonas aeruginosa PA01
gccagagaucgcccagcg

SEQ ID NO: 3458958 - RNA, 20 nt, Pseudomonas aeruginosa PA01
gccagagaucgcccagcggc

SEQ ID NO: 3458959 - RNA, 22 nt, Pseudomonas aeruginosa PA01
gccagagaucgcccagcggcug

SEQ ID NO: 3458960 - RNA, 13 nt, Pseudomonas aeruginosa PA01
gccagagcagcgu

SEQ ID NO: 3458961 - RNA, 16 nt, Pseudomonas aeruginosa PA01
gccagagcagcgucgu

SEQ ID NO: 3458962 - RNA, 14 nt, Pseudomonas aeruginosa PA01
gccagagcaggcgg

SEQ ID NO: 3458963 - RNA, 19 nt, Pseudomonas aeruginosa PA01
gccagagcccgucgaagcc

SEQ ID NO: 3458964 - RNA, 23 nt, Pseudomonas aeruginosa PA01
gccagagcgcgcuacucagguga

SEQ ID NO: 3458965 - RNA, 18 nt, Pseudomonas aeruginosa PA01
gccagagcgcugccugca

SEQ ID NO: 3458966 - RNA, 16 nt, Pseudomonas aeruginosa PA01
gccagagcuccagggc

SEQ ID NO: 3458967 - RNA, 16 nt, Pseudomonas aeruginosa PA01
gccagagcuucugcug

SEQ ID NO: 3458968 - RNA, 16 nt, Pseudomonas aeruginosa PA01
gccagaggaucggcca

SEQ ID NO: 3458969 - RNA, 12 nt, Pseudomonas aeruginosa PA01
gccagaggcugc

SEQ ID NO: 3458970 - RNA, 16 nt, Pseudomonas aeruginosa PA01
gccagaggcugcgcuc

SEQ ID NO: 3458971 - RNA, 18 nt, Pseudomonas aeruginosa PA01
gccagaggcugcgcucca

SEQ ID NO: 3458972 - RNA, 19 nt, Pseudomonas aeruginosa PA01
gccagaggcugcgcuccag

SEQ ID NO: 3458973 - RNA, 20 nt, Pseudomonas aeruginosa PA01
gccagaggcugcgcuccagg

SEQ ID NO: 3458974 - RNA, 19 nt, Pseudomonas aeruginosa PA01
gccagaguugccuguccag

SEQ ID NO: 3458975 - RNA, 20 nt, Pseudomonas aeruginosa PA01
gccagaguugccuguccagc

SEQ ID NO: 3458976 - RNA, 22 nt, Pseudomonas aeruginosa PA01
gccagaugacgauggccgccgc

SEQ ID NO: 3458977 - RNA, 16 nt, Pseudomonas aeruginosa PA01
gccagcaaacccgggc

SEQ ID NO: 3458978 - RNA, 17 nt, Pseudomonas aeruginosa PA01
gccagcaaacccgggcc

SEQ ID NO: 3458979 - RNA, 12 nt, Pseudomonas aeruginosa PA01
gccagcaacagu

SEQ ID NO: 3458980 - RNA, 16 nt, Pseudomonas aeruginosa PA01
gccagcaacggcuccu

SEQ ID NO: 3458981 - RNA, 16 nt, Pseudomonas aeruginosa PA01
gccagcaagacggucc

SEQ ID NO: 3458982 - RNA, 18 nt, Pseudomonas aeruginosa PA01
gccagcaauacccgccgc

SEQ ID NO: 3458983 - RNA, 20 nt, Pseudomonas aeruginosa PA01
gccagcaauacccgccgcug

SEQ ID NO: 3458984 - RNA, 17 nt, Pseudomonas aeruginosa PA01
gccagcaaugcccgcgc

SEQ ID NO: 3458985 - RNA, 19 nt, Pseudomonas aeruginosa PA01
gccagcaaugcccgcgccu

SEQ ID NO: 3458986 - RNA, 20 nt, Pseudomonas aeruginosa PA01
gccagcaauugccgcugcac

SEQ ID NO: 3458987 - RNA, 15 nt, Pseudomonas aeruginosa PA01
gccagcaccacccgg

SEQ ID NO: 3458988 - RNA, 18 nt, Pseudomonas aeruginosa PA01
gccagcaccacccggccg

SEQ ID NO: 3458989 - RNA, 19 nt, Pseudomonas aeruginosa PA01
gccagcaccacccggccgc

SEQ ID NO: 3458990 - RNA, 20 nt, Pseudomonas aeruginosa PA01
gccagcaccacccggccgcg

SEQ ID NO: 3458991 - RNA, 14 nt, Pseudomonas aeruginosa PA01
gccagcaccagcag

SEQ ID NO: 3458992 - RNA, 15 nt, Pseudomonas aeruginosa PA01
gccagcaccagcagg

SEQ ID NO: 3458993 - RNA, 18 nt, Pseudomonas aeruginosa PA01
gccagcaccagcaggagc

SEQ ID NO: 3458994 - RNA, 20 nt, Pseudomonas aeruginosa PA01
gccagcaccagcaggagcau

SEQ ID NO: 3458995 - RNA, 12 nt, Pseudomonas aeruginosa PA01
gccagcaccagu

SEQ ID NO: 3458996 - RNA, 18 nt, Pseudomonas aeruginosa PA01
gccagcaccagucccugg

SEQ ID NO: 3458997 - RNA, 20 nt, Pseudomonas aeruginosa PA01
gccagcaccagucccuggcc

SEQ ID NO: 3458998 - RNA, 22 nt, Pseudomonas aeruginosa PA01
gccagcaccagucccuggccgg

SEQ ID NO: 3458999 - RNA, 20 nt, Pseudomonas aeruginosa PA01
gccagcaccaugcgcggcag

SEQ ID NO: 3459000 - RNA, 12 nt, Pseudomonas aeruginosa PA01
gccagcacccag

SEQ ID NO: 3459001 - RNA, 15 nt, Pseudomonas aeruginosa PA01
gccagcacccagucu

SEQ ID NO: 3459002 - RNA, 17 nt, Pseudomonas aeruginosa PA01
gccagcaccguggucag

SEQ ID NO: 3459003 - RNA, 18 nt, Pseudomonas aeruginosa PA01
gccagcaccucgacgccc

SEQ ID NO: 3459004 - RNA, 20 nt, Pseudomonas aeruginosa PA01
gccagcaccucgacgcccgc

SEQ ID NO: 3459005 - RNA, 21 nt, Pseudomonas aeruginosa PA01
gccagcaccucgacgcccgcu

SEQ ID NO: 3459006 - RNA, 22 nt, Pseudomonas aeruginosa PA01
gccagcaccucguaggccgacu

SEQ ID NO: 3459007 - RNA, 16 nt, Pseudomonas aeruginosa PA01
gccagcaccuucaccg

SEQ ID NO: 3459008 - RNA, 17 nt, Pseudomonas aeruginosa PA01
gccagcaccuucaccgu

SEQ ID NO: 3459009 - RNA, 22 nt, Pseudomonas aeruginosa PA01
gccagcaccuucaucaccaggu

SEQ ID NO: 3459010 - RNA, 14 nt, Pseudomonas aeruginosa PA01
gccagcacggcgca

SEQ ID NO: 3459011 - RNA, 11 nt, Pseudomonas aeruginosa PA01
gccagcagcac

SEQ ID NO: 3459012 - RNA, 14 nt, Pseudomonas aeruginosa PA01
gccagcagcacgcc

SEQ ID NO: 3459013 - RNA, 19 nt, Pseudomonas aeruginosa PA01
gccagcagcacggcgacga

SEQ ID NO: 3459014 - RNA, 24 nt, Pseudomonas aeruginosa PA01
gccagcagcacggcgacgaaggcc

SEQ ID NO: 3459015 - RNA, 15 nt, Pseudomonas aeruginosa PA01
gccagcagcagaagg

SEQ ID NO: 3459016 - RNA, 22 nt, Pseudomonas aeruginosa PA01
gccagcagcagaagggcggaga

SEQ ID NO: 3459017 - RNA, 20 nt, Pseudomonas aeruginosa PA01
gccagcagcaucggaccggu

SEQ ID NO: 3459018 - RNA, 15 nt, Pseudomonas aeruginosa PA01
gccagcagccaggcc

SEQ ID NO: 3459019 - RNA, 13 nt, Pseudomonas aeruginosa PA01
gccagcagcccgg

SEQ ID NO: 3459020 - RNA, 14 nt, Pseudomonas aeruginosa PA01
gccagcagcccggc

SEQ ID NO: 3459021 - RNA, 21 nt, Pseudomonas aeruginosa PA01
gccagcagcccggccuggauc

SEQ ID NO: 3459022 - RNA, 17 nt, Pseudomonas aeruginosa PA01
gccagcagcgcugauca

SEQ ID NO: 3459023 - RNA, 17 nt, Pseudomonas aeruginosa PA01
gccagcagcggcggcgc

SEQ ID NO: 3459024 - RNA, 13 nt, Pseudomonas aeruginosa PA01
gccagcagcuccg

SEQ ID NO: 3459025 - RNA, 22 nt, Pseudomonas aeruginosa PA01
gccagcagcuccgggcuggcca

SEQ ID NO: 3459026 - RNA, 11 nt, Pseudomonas aeruginosa PA01
gccagcaggau

SEQ ID NO: 3459027 - RNA, 23 nt, Pseudomonas aeruginosa PA01
gccagcaggaucgacagcagcgc

SEQ ID NO: 3459028 - RNA, 13 nt, Pseudomonas aeruginosa PA01
gccagcaggccga

SEQ ID NO: 3459029 - RNA, 21 nt, Pseudomonas aeruginosa PA01
gccagcaggccgagcccgagu

SEQ ID NO: 3459030 - RNA, 16 nt, Pseudomonas aeruginosa PA01
gccagcaggccgagcg

SEQ ID NO: 3459031 - RNA, 19 nt, Pseudomonas aeruginosa PA01
gccagcaggccgagcgugg

SEQ ID NO: 3459032 - RNA, 18 nt, Pseudomonas aeruginosa PA01
gccagcaggccgaucagc

SEQ ID NO: 3459033 - RNA, 19 nt, Pseudomonas aeruginosa PA01
gccagcaggccgaucagcg

SEQ ID NO: 3459034 - RNA, 21 nt, Pseudomonas aeruginosa PA01
gccagcaggccgaucagcggc

SEQ ID NO: 3459035 - RNA, 15 nt, Pseudomonas aeruginosa PA01
gccagcaggccgugg

SEQ ID NO: 3459036 - RNA, 11 nt, Pseudomonas aeruginosa PA01
gccagccgcca

SEQ ID NO: 3459037 - RNA, 16 nt, Pseudomonas aeruginosa PA01
gccagccgccaggacg

SEQ ID NO: 3459038 - RNA, 13 nt, Pseudomonas aeruginosa PA01
gccagccgccauc

SEQ ID NO: 3459039 - RNA, 18 nt, Pseudomonas aeruginosa PA01
gccagccgccaucaccag

SEQ ID NO: 3459040 - RNA, 15 nt, Pseudomonas aeruginosa PA01
gccagccgcccuggc

SEQ ID NO: 3459041 - RNA, 22 nt, Pseudomonas aeruginosa PA01
gccagccgcccuggcucugggc

SEQ ID NO: 3459042 - RNA, 15 nt, Pseudomonas aeruginosa PA01
gccagccgccgaagg

SEQ ID NO: 3459043 - RNA, 21 nt, Pseudomonas aeruginosa PA01
gccagccgccgaagggccgca

SEQ ID NO: 3459044 - RNA, 13 nt, Pseudomonas aeruginosa PA01
gccagccgcgagu

SEQ ID NO: 3459045 - RNA, 13 nt, Pseudomonas aeruginosa PA01
gccagccgcgcca

SEQ ID NO: 3459046 - RNA, 15 nt, Pseudomonas aeruginosa PA01
gccagccgcgccagu

SEQ ID NO: 3459047 - RNA, 16 nt, Pseudomonas aeruginosa PA01
gccagccgcgccagug

SEQ ID NO: 3459048 - RNA, 17 nt, Pseudomonas aeruginosa PA01
gccagccgcgccagugc

SEQ ID NO: 3459049 - RNA, 12 nt, Pseudomonas aeruginosa PA01
gccagccgcgcg

SEQ ID NO: 3459050 - RNA, 14 nt, Pseudomonas aeruginosa PA01
gccagccgcgcgcc

SEQ ID NO: 3459051 - RNA, 15 nt, Pseudomonas aeruginosa PA01
gccagccgcgcgccg

SEQ ID NO: 3459052 - RNA, 18 nt, Pseudomonas aeruginosa PA01
gccagccgcgcgccgcau

SEQ ID NO: 3459053 - RNA, 14 nt, Pseudomonas aeruginosa PA01
gccagccgcgcggc

SEQ ID NO: 3459054 - RNA, 15 nt, Pseudomonas aeruginosa PA01
gccagccgcggauca

SEQ ID NO: 3459055 - RNA, 18 nt, Pseudomonas aeruginosa PA01
gccagccgcggaucaccu

SEQ ID NO: 3459056 - RNA, 23 nt, Pseudomonas aeruginosa PA01
gccagccgcggaucaccuggccg

SEQ ID NO: 3459057 - RNA, 14 nt, Pseudomonas aeruginosa PA01
gccagccgcuagcg

SEQ ID NO: 3459058 - RNA, 18 nt, Pseudomonas aeruginosa PA01
gccagccgcuuccggcgc

SEQ ID NO: 3459059 - RNA, 19 nt, Pseudomonas aeruginosa PA01
gccagccgcuuccggcgcu

SEQ ID NO: 3459060 - RNA, 17 nt, Pseudomonas aeruginosa PA01
gccagccggcgaagggc

SEQ ID NO: 3459061 - RNA, 20 nt, Pseudomonas aeruginosa PA01
gccagccggcgaagggcagg

SEQ ID NO: 3459062 - RNA, 13 nt, Pseudomonas aeruginosa PA01
gccagccggcgcc

SEQ ID NO: 3459063 - RNA, 14 nt, Pseudomonas aeruginosa PA01
gccagccggcgccg

SEQ ID NO: 3459064 - RNA, 14 nt, Pseudomonas aeruginosa PA01
gccagccgucgucg

SEQ ID NO: 3459065 - RNA, 19 nt, Pseudomonas aeruginosa PA01
gccagccguggcaggcgcc

SEQ ID NO: 3459066 - RNA, 20 nt, Pseudomonas aeruginosa PA01
gccagccguggcaggcgccc

SEQ ID NO: 3459067 - RNA, 22 nt, Pseudomonas aeruginosa PA01
gccagccguggcaggcgcccgg

SEQ ID NO: 3459068 - RNA, 18 nt, Pseudomonas aeruginosa PA01
gccagccguucgcuggac

SEQ ID NO: 3459069 - RNA, 19 nt, Pseudomonas aeruginosa PA01
gccagccguucgcuggaca

SEQ ID NO: 3459070 - RNA, 17 nt, Pseudomonas aeruginosa PA01
gccagccucagguacgg

SEQ ID NO: 3459071 - RNA, 14 nt, Pseudomonas aeruginosa PA01
gccagccucggcga

SEQ ID NO: 3459072 - RNA, 17 nt, Pseudomonas aeruginosa PA01
gccagccucggcgaagu

SEQ ID NO: 3459073 - RNA, 17 nt, Pseudomonas aeruginosa PA01
gccagccugcagccagc

SEQ ID NO: 3459074 - RNA, 12 nt, Pseudomonas aeruginosa PA01
gccagccuggcc

SEQ ID NO: 3459075 - RNA, 15 nt, Pseudomonas aeruginosa PA01
gccagccuggccagc

SEQ ID NO: 3459076 - RNA, 23 nt, Pseudomonas aeruginosa PA01
gccagccuggccagcgcuucgcg

SEQ ID NO: 3459077 - RNA, 17 nt, Pseudomonas aeruginosa PA01
gccagccuucccggcgc

SEQ ID NO: 3459078 - RNA, 19 nt, Pseudomonas aeruginosa PA01
gccagccuucccggcgcuu

SEQ ID NO: 3459079 - RNA, 17 nt, Pseudomonas aeruginosa PA01
gccagcgaacccaggcc

SEQ ID NO: 3459080 - RNA, 21 nt, Pseudomonas aeruginosa PA01
gccagcgaacccaggccgcgc

SEQ ID NO: 3459081 - RNA, 24 nt, Pseudomonas aeruginosa PA01
gccagcgaacccaggccgcgcagc

SEQ ID NO: 3459082 - RNA, 14 nt, Pseudomonas aeruginosa PA01
gccagcgaacgcac

SEQ ID NO: 3459083 - RNA, 15 nt, Pseudomonas aeruginosa PA01
gccagcgaacgcacu

SEQ ID NO: 3459084 - RNA, 23 nt, Pseudomonas aeruginosa PA01
gccagcgaacgcacuucguccgc

SEQ ID NO: 3459085 - RNA, 19 nt, Pseudomonas aeruginosa PA01
gccagcgacucgcucgcuu

SEQ ID NO: 3459086 - RNA, 23 nt, Pseudomonas aeruginosa PA01
gccagcgcaccuacuaccgcugg

SEQ ID NO: 3459087 - RNA, 12 nt, Pseudomonas aeruginosa PA01
gccagcgcaucg

SEQ ID NO: 3459088 - RNA, 19 nt, Pseudomonas aeruginosa PA01
gccagcgccaccagcaggg

SEQ ID NO: 3459089 - RNA, 20 nt, Pseudomonas aeruginosa PA01
gccagcgccaccagcagggc

SEQ ID NO: 3459090 - RNA, 22 nt, Pseudomonas aeruginosa PA01
gccagcgccaccagcagggcca

SEQ ID NO: 3459091 - RNA, 13 nt, Pseudomonas aeruginosa PA01
gccagcgccacgc

SEQ ID NO: 3459092 - RNA, 14 nt, Pseudomonas aeruginosa PA01
gccagcgccacgcc

SEQ ID NO: 3459093 - RNA, 16 nt, Pseudomonas aeruginosa PA01
gccagcgccacgccgc

SEQ ID NO: 3459094 - RNA, 17 nt, Pseudomonas aeruginosa PA01
gccagcgccacgccgcu

SEQ ID NO: 3459095 - RNA, 17 nt, Pseudomonas aeruginosa PA01
gccagcgccacggcgau

SEQ ID NO: 3459096 - RNA, 21 nt, Pseudomonas aeruginosa PA01
gccagcgccacggcgaucgcc

SEQ ID NO: 3459097 - RNA, 22 nt, Pseudomonas aeruginosa PA01
gccagcgccacggcgaucgccg

SEQ ID NO: 3459098 - RNA, 23 nt, Pseudomonas aeruginosa PA01
gccagcgccacggcgaucgccgg

SEQ ID NO: 3459099 - RNA, 15 nt, Pseudomonas aeruginosa PA01
gccagcgccagcagg

SEQ ID NO: 3459100 - RNA, 16 nt, Pseudomonas aeruginosa PA01
gccagcgccagcaggu

SEQ ID NO: 3459101 - RNA, 13 nt, Pseudomonas aeruginosa PA01
gccagcgccagga

SEQ ID NO: 3459102 - RNA, 14 nt, Pseudomonas aeruginosa PA01
gccagcgccaggag

SEQ ID NO: 3459103 - RNA, 15 nt, Pseudomonas aeruginosa PA01
gccagcgccaggagc

SEQ ID NO: 3459104 - RNA, 16 nt, Pseudomonas aeruginosa PA01
gccagcgccaggagca

SEQ ID NO: 3459105 - RNA, 13 nt, Pseudomonas aeruginosa PA01
gccagcgccaggu

SEQ ID NO: 3459106 - RNA, 15 nt, Pseudomonas aeruginosa PA01
gccagcgcccaggcc

SEQ ID NO: 3459107 - RNA, 18 nt, Pseudomonas aeruginosa PA01
gccagcgcccaggccggg

SEQ ID NO: 3459108 - RNA, 17 nt, Pseudomonas aeruginosa PA01
gccagcgccccaccagg

SEQ ID NO: 3459109 - RNA, 18 nt, Pseudomonas aeruginosa PA01
gccagcgccccaccaggc

SEQ ID NO: 3459110 - RNA, 15 nt, Pseudomonas aeruginosa PA01
gccagcgccgccagu

SEQ ID NO: 3459111 - RNA, 16 nt, Pseudomonas aeruginosa PA01
gccagcgccgccgcgu

SEQ ID NO: 3459112 - RNA, 17 nt, Pseudomonas aeruginosa PA01
gccagcgccgccgcgug

SEQ ID NO: 3459113 - RNA, 16 nt, Pseudomonas aeruginosa PA01
gccagcgccgccgcug

SEQ ID NO: 3459114 - RNA, 20 nt, Pseudomonas aeruginosa PA01
gccagcgccggccauugccg

SEQ ID NO: 3459115 - RNA, 13 nt, Pseudomonas aeruginosa PA01
gccagcgccuggc

SEQ ID NO: 3459116 - RNA, 15 nt, Pseudomonas aeruginosa PA01
gccagcgccuggcgc

SEQ ID NO: 3459117 - RNA, 16 nt, Pseudomonas aeruginosa PA01
gccagcgccuggcgca

SEQ ID NO: 3459118 - RNA, 18 nt, Pseudomonas aeruginosa PA01
gccagcgccuggcgcaac

SEQ ID NO: 3459119 - RNA, 19 nt, Pseudomonas aeruginosa PA01
gccagcgccuucgugacca

SEQ ID NO: 3459120 - RNA, 12 nt, Pseudomonas aeruginosa PA01
gccagcgcgcgc

SEQ ID NO: 3459121 - RNA, 14 nt, Pseudomonas aeruginosa PA01
gccagcgcgcgccg

SEQ ID NO: 3459122 - RNA, 15 nt, Pseudomonas aeruginosa PA01
gccagcgcgcgccga

SEQ ID NO: 3459123 - RNA, 22 nt, Pseudomonas aeruginosa PA01
gccagcgcgcgccgacaggcau

SEQ ID NO: 3459124 - RNA, 15 nt, Pseudomonas aeruginosa PA01
gccagcgcggccgcc

SEQ ID NO: 3459125 - RNA, 15 nt, Pseudomonas aeruginosa PA01
gccagcgcggcgcgc

SEQ ID NO: 3459126 - RNA, 16 nt, Pseudomonas aeruginosa PA01
gccagcgcggcgcgcu

SEQ ID NO: 3459127 - RNA, 18 nt, Pseudomonas aeruginosa PA01
gccagcgcggcgcgcuga

SEQ ID NO: 3459128 - RNA, 14 nt, Pseudomonas aeruginosa PA01
gccagcgcggcgcu

SEQ ID NO: 3459129 - RNA, 13 nt, Pseudomonas aeruginosa PA01
gccagcgcggcgg

SEQ ID NO: 3459130 - RNA, 16 nt, Pseudomonas aeruginosa PA01
gccagcgcggcggaca

SEQ ID NO: 3459131 - RNA, 20 nt, Pseudomonas aeruginosa PA01
gccagcgcggcucgggcggc

SEQ ID NO: 3459132 - RNA, 23 nt, Pseudomonas aeruginosa PA01
gccagcgcguagcuuuccgcggc

SEQ ID NO: 3459133 - RNA, 17 nt, Pseudomonas aeruginosa PA01
gccagcgcgucggcacg

SEQ ID NO: 3459134 - RNA, 22 nt, Pseudomonas aeruginosa PA01
gccagcgcgucggcacgccgaa

SEQ ID NO: 3459135 - RNA, 20 nt, Pseudomonas aeruginosa PA01
gccagcgcucgaacgccgcc

SEQ ID NO: 3459136 - RNA, 17 nt, Pseudomonas aeruginosa PA01
gccagcgcuuccaccgc

SEQ ID NO: 3459137 - RNA, 18 nt, Pseudomonas aeruginosa PA01
gccagcgcuuccaccgcc

SEQ ID NO: 3459138 - RNA, 22 nt, Pseudomonas aeruginosa PA01
gccagcgcuuccaccgccugcc

SEQ ID NO: 3459139 - RNA, 21 nt, Pseudomonas aeruginosa PA01
gccaggacgccaccaggccgc

SEQ ID NO: 3459140 - RNA, 22 nt, Pseudomonas aeruginosa PA01
gccaggacgccaccaggccgcu

SEQ ID NO: 3459141 - RNA, 13 nt, Pseudomonas aeruginosa PA01
gccaggacgcugg

SEQ ID NO: 3459142 - RNA, 16 nt, Pseudomonas aeruginosa PA01
gccaggacgcuggcga

SEQ ID NO: 3459143 - RNA, 18 nt, Pseudomonas aeruginosa PA01
gccaggacggcaggguca

SEQ ID NO: 3459144 - RNA, 21 nt, Pseudomonas aeruginosa PA01
gccaggacggcagggucagcc

SEQ ID NO: 3459145 - RNA, 15 nt, Pseudomonas aeruginosa PA01
gccaggacucgccau

SEQ ID NO: 3459146 - RNA, 17 nt, Pseudomonas aeruginosa PA01
gccaggacucgccaucg

SEQ ID NO: 3459147 - RNA, 14 nt, Pseudomonas aeruginosa PA01
gccaggagaaccug

SEQ ID NO: 3459148 - RNA, 15 nt, Pseudomonas aeruginosa PA01
gccaggagcacgccg

SEQ ID NO: 3459149 - RNA, 18 nt, Pseudomonas aeruginosa PA01
gccaggagcacgccgugc

SEQ ID NO: 3459150 - RNA, 14 nt, Pseudomonas aeruginosa PA01
gccaggagcagggc

SEQ ID NO: 3459151 - RNA, 19 nt, Pseudomonas aeruginosa PA01
gccaggagcagggcgccga

SEQ ID NO: 3459152 - RNA, 20 nt, Pseudomonas aeruginosa PA01
gccaggagcagggcgccgau

SEQ ID NO: 3459153 - RNA, 16 nt, Pseudomonas aeruginosa PA01
gccaggagcaucggcg

SEQ ID NO: 3459154 - RNA, 17 nt, Pseudomonas aeruginosa PA01
gccaggagcaucggcgc

SEQ ID NO: 3459155 - RNA, 22 nt, Pseudomonas aeruginosa PA01
gccaggagcaucggcgcggccu

SEQ ID NO: 3459156 - RNA, 13 nt, Pseudomonas aeruginosa PA01
gccaggagccuac

SEQ ID NO: 3459157 - RNA, 14 nt, Pseudomonas aeruginosa PA01
gccaggagcuugcc

SEQ ID NO: 3459158 - RNA, 16 nt, Pseudomonas aeruginosa PA01
gccaggagcuugccga

SEQ ID NO: 3459159 - RNA, 20 nt, Pseudomonas aeruginosa PA01
gccaggaggauucgccagcc

SEQ ID NO: 3459160 - RNA, 19 nt, Pseudomonas aeruginosa PA01
gccaggaggcccacgggcg

SEQ ID NO: 3459161 - RNA, 20 nt, Pseudomonas aeruginosa PA01
gccaggaucagucccuugau

SEQ ID NO: 3459162 - RNA, 20 nt, Pseudomonas aeruginosa PA01
gccaggaucggcauggccac

SEQ ID NO: 3459163 - RNA, 22 nt, Pseudomonas aeruginosa PA01
gccaggaucggcauggccacgc

SEQ ID NO: 3459164 - RNA, 14 nt, Pseudomonas aeruginosa PA01
gccaggaucgucgg

SEQ ID NO: 3459165 - RNA, 19 nt, Pseudomonas aeruginosa PA01
gccaggaucgucggcccgc

SEQ ID NO: 3459166 - RNA, 20 nt, Pseudomonas aeruginosa PA01
gccaggaucgucggcccgca

SEQ ID NO: 3459167 - RNA, 22 nt, Pseudomonas aeruginosa PA01
gccaggauuucuccugcggucg

SEQ ID NO: 3459168 - RNA, 16 nt, Pseudomonas aeruginosa PA01
gccaggcaccaccucg

SEQ ID NO: 3459169 - RNA, 17 nt, Pseudomonas aeruginosa PA01
gccaggcaccggaccga

SEQ ID NO: 3459170 - RNA, 12 nt, Pseudomonas aeruginosa PA01
gccaggcagacc

SEQ ID NO: 3459171 - RNA, 18 nt, Pseudomonas aeruginosa PA01
gccaggcagaccagcgca

SEQ ID NO: 3459172 - RNA, 17 nt, Pseudomonas aeruginosa PA01
gccaggcagaccaggcc

SEQ ID NO: 3459173 - RNA, 22 nt, Pseudomonas aeruginosa PA01
gccaggcagaccaggccgagca

SEQ ID NO: 3459174 - RNA, 21 nt, Pseudomonas aeruginosa PA01
gccaggcagaccugcagcagg

SEQ ID NO: 3459175 - RNA, 17 nt, Pseudomonas aeruginosa PA01
gccaggcaggccgggcu

SEQ ID NO: 3459176 - RNA, 16 nt, Pseudomonas aeruginosa PA01
gccaggcaggcgguca

SEQ ID NO: 3459177 - RNA, 16 nt, Pseudomonas aeruginosa PA01
gccaggcauuccucca

SEQ ID NO: 3459178 - RNA, 23 nt, Pseudomonas aeruginosa PA01
gccaggcauuccuccagggucgc

SEQ ID NO: 3459179 - RNA, 12 nt, Pseudomonas aeruginosa PA01
gccaggccacgg

SEQ ID NO: 3459180 - RNA, 14 nt, Pseudomonas aeruginosa PA01
gccaggccacggcc

SEQ ID NO: 3459181 - RNA, 19 nt, Pseudomonas aeruginosa PA01
gccaggccacggccggcga

SEQ ID NO: 3459182 - RNA, 22 nt, Pseudomonas aeruginosa PA01
gccaggccacggccggcgaggc

SEQ ID NO: 3459183 - RNA, 18 nt, Pseudomonas aeruginosa PA01
gccaggccacggcggaag

SEQ ID NO: 3459184 - RNA, 23 nt, Pseudomonas aeruginosa PA01
gccaggccauugaaggccgacac

SEQ ID NO: 3459185 - RNA, 15 nt, Pseudomonas aeruginosa PA01
gccaggccccaggcc

SEQ ID NO: 3459186 - RNA, 19 nt, Pseudomonas aeruginosa PA01
gccaggccccaggccgccg

SEQ ID NO: 3459187 - RNA, 21 nt, Pseudomonas aeruginosa PA01
gccaggccccaggccgccgcc

SEQ ID NO: 3459188 - RNA, 16 nt, Pseudomonas aeruginosa PA01
gccaggccccagggcc

SEQ ID NO: 3459189 - RNA, 13 nt, Pseudomonas aeruginosa PA01
gccaggcccggcg

SEQ ID NO: 3459190 - RNA, 14 nt, Pseudomonas aeruginosa PA01
gccaggcccggcgc

SEQ ID NO: 3459191 - RNA, 16 nt, Pseudomonas aeruginosa PA01
gccaggcccggcgcug

SEQ ID NO: 3459192 - RNA, 17 nt, Pseudomonas aeruginosa PA01
gccaggcccggcgcugc

SEQ ID NO: 3459193 - RNA, 12 nt, Pseudomonas aeruginosa PA01
gccaggcccggu

SEQ ID NO: 3459194 - RNA, 16 nt, Pseudomonas aeruginosa PA01
gccaggcccucggcga

SEQ ID NO: 3459195 - RNA, 18 nt, Pseudomonas aeruginosa PA01
gccaggcccuuggucagg

SEQ ID NO: 3459196 - RNA, 20 nt, Pseudomonas aeruginosa PA01
gccaggcccuuggucaggcc

SEQ ID NO: 3459197 - RNA, 15 nt, Pseudomonas aeruginosa PA01
gccaggccgacccgc

SEQ ID NO: 3459198 - RNA, 13 nt, Pseudomonas aeruginosa PA01
gccaggccgagca

SEQ ID NO: 3459199 - RNA, 14 nt, Pseudomonas aeruginosa PA01
gccaggccgagcaa

SEQ ID NO: 3459200 - RNA, 20 nt, Pseudomonas aeruginosa PA01
gccaggccgagcaauccggc

SEQ ID NO: 3459201 - RNA, 22 nt, Pseudomonas aeruginosa PA01
gccaggccgagcaauccggcgc

SEQ ID NO: 3459202 - RNA, 13 nt, Pseudomonas aeruginosa PA01
gccaggccgagcg

SEQ ID NO: 3459203 - RNA, 19 nt, Pseudomonas aeruginosa PA01
gccaggccgagcgcgccgc

SEQ ID NO: 3459204 - RNA, 21 nt, Pseudomonas aeruginosa PA01
gccaggccgagcgcgccgccg

SEQ ID NO: 3459205 - RNA, 22 nt, Pseudomonas aeruginosa PA01
gccaggccgagcgcgccgccga

SEQ ID NO: 3459206 - RNA, 18 nt, Pseudomonas aeruginosa PA01
gccaggccgagcgugcgc

SEQ ID NO: 3459207 - RNA, 15 nt, Pseudomonas aeruginosa PA01
gccaggccgaucagc

SEQ ID NO: 3459208 - RNA, 14 nt, Pseudomonas aeruginosa PA01
gccaggccgcaagu

SEQ ID NO: 3459209 - RNA, 13 nt, Pseudomonas aeruginosa PA01
gccaggccgccca

SEQ ID NO: 3459210 - RNA, 16 nt, Pseudomonas aeruginosa PA01
gccaggccgcccagga

SEQ ID NO: 3459211 - RNA, 16 nt, Pseudomonas aeruginosa PA01
gccaggccgccgaaga

SEQ ID NO: 3459212 - RNA, 19 nt, Pseudomonas aeruginosa PA01
gccaggccgccgaagaacu

SEQ ID NO: 3459213 - RNA, 13 nt, Pseudomonas aeruginosa PA01
gccaggccggagc

SEQ ID NO: 3459214 - RNA, 21 nt, Pseudomonas aeruginosa PA01
gccaggccggagccgcguuca

SEQ ID NO: 3459215 - RNA, 13 nt, Pseudomonas aeruginosa PA01
gccaggccggcga

SEQ ID NO: 3459216 - RNA, 17 nt, Pseudomonas aeruginosa PA01
gccaggccggcgagggc

SEQ ID NO: 3459217 - RNA, 15 nt, Pseudomonas aeruginosa PA01
gccaggccggcgcau

SEQ ID NO: 3459218 - RNA, 17 nt, Pseudomonas aeruginosa PA01
gccaggccggcgcaucg

SEQ ID NO: 3459219 - RNA, 16 nt, Pseudomonas aeruginosa PA01
gccaggccggcgccuu

SEQ ID NO: 3459220 - RNA, 13 nt, Pseudomonas aeruginosa PA01
gccaggccggugc

SEQ ID NO: 3459221 - RNA, 20 nt, Pseudomonas aeruginosa PA01
gccaggccggugcagaagac

SEQ ID NO: 3459222 - RNA, 22 nt, Pseudomonas aeruginosa PA01
gccaggccguagaccaccagca

SEQ ID NO: 3459223 - RNA, 23 nt, Pseudomonas aeruginosa PA01
gccaggccguagaccaccagcag

SEQ ID NO: 3459224 - RNA, 13 nt, Pseudomonas aeruginosa PA01
gccaggccguucu

SEQ ID NO: 3459225 - RNA, 14 nt, Pseudomonas aeruginosa PA01
gccaggccucggcg

SEQ ID NO: 3459226 - RNA, 19 nt, Pseudomonas aeruginosa PA01
gccaggccucggcgcgggc

SEQ ID NO: 3459227 - RNA, 21 nt, Pseudomonas aeruginosa PA01
gccaggccucggcgcgggccu

SEQ ID NO: 3459228 - RNA, 12 nt, Pseudomonas aeruginosa PA01
gccaggccuggg

SEQ ID NO: 3459229 - RNA, 13 nt, Pseudomonas aeruginosa PA01
gccaggccugggu

SEQ ID NO: 3459230 - RNA, 19 nt, Pseudomonas aeruginosa PA01
gccaggccugggucaccag

SEQ ID NO: 3459231 - RNA, 16 nt, Pseudomonas aeruginosa PA01
gccaggccuugcagca

SEQ ID NO: 3459232 - RNA, 17 nt, Pseudomonas aeruginosa PA01
gccaggccuugugcgcc

SEQ ID NO: 3459233 - RNA, 19 nt, Pseudomonas aeruginosa PA01
gccaggccuugugcgccag

SEQ ID NO: 3459234 - RNA, 21 nt, Pseudomonas aeruginosa PA01
gccaggccuugugcgccagcu

SEQ ID NO: 3459235 - RNA, 23 nt, Pseudomonas aeruginosa PA01
gccaggccuugugcgccagcucg

SEQ ID NO: 3459236 - RNA, 22 nt, Pseudomonas aeruginosa PA01
gccaggcgaagaaagccccugc

SEQ ID NO: 3459237 - RNA, 15 nt, Pseudomonas aeruginosa PA01
gccaggcgaagcggc

SEQ ID NO: 3459238 - RNA, 18 nt, Pseudomonas aeruginosa PA01
gccaggcgaagcggcugg

SEQ ID NO: 3459239 - RNA, 19 nt, Pseudomonas aeruginosa PA01
gccaggcgaaggcgauccc

SEQ ID NO: 3459240 - RNA, 17 nt, Pseudomonas aeruginosa PA01
gccaggcgaggaacagc

SEQ ID NO: 3459241 - RNA, 18 nt, Pseudomonas aeruginosa PA01
gccaggcgaggaacagcg

SEQ ID NO: 3459242 - RNA, 13 nt, Pseudomonas aeruginosa PA01
gccagggcgcuca

SEQ ID NO: 3459243 - RNA, 13 nt, Pseudomonas aeruginosa PA01
gccagggcggcgc

SEQ ID NO: 3459244 - RNA, 22 nt, Pseudomonas aeruginosa PA01
gccagggcggcgccgaacaggg

SEQ ID NO: 3459245 - RNA, 23 nt, Pseudomonas aeruginosa PA01
gccagggcggcgccgaacagggc

SEQ ID NO: 3459246 - RNA, 14 nt, Pseudomonas aeruginosa PA01
gccagggcggcggc

SEQ ID NO: 3459247 - RNA, 13 nt, Pseudomonas aeruginosa PA01
gccagggcgguga

SEQ ID NO: 3459248 - RNA, 15 nt, Pseudomonas aeruginosa PA01
gccagggcggugagg

SEQ ID NO: 3459249 - RNA, 20 nt, Pseudomonas aeruginosa PA01
gccagggcggugagguugcc

SEQ ID NO: 3459250 - RNA, 13 nt, Pseudomonas aeruginosa PA01
gccagggcgucgg

SEQ ID NO: 3459251 - RNA, 15 nt, Pseudomonas aeruginosa PA01
gccagggcgucggag

SEQ ID NO: 3459252 - RNA, 18 nt, Pseudomonas aeruginosa PA01
gccagggcguugcucgaa

SEQ ID NO: 3459253 - RNA, 15 nt, Pseudomonas aeruginosa PA01
gccagggcuucccag

SEQ ID NO: 3459254 - RNA, 19 nt, Pseudomonas aeruginosa PA01
gccagggcuucccaggcca

SEQ ID NO: 3459255 - RNA, 21 nt, Pseudomonas aeruginosa PA01
gccagggcuucccaggccagc

SEQ ID NO: 3459256 - RNA, 15 nt, Pseudomonas aeruginosa PA01
gccaggggagcgccg

SEQ ID NO: 3459257 - RNA, 19 nt, Pseudomonas aeruginosa PA01
gccaggggagcgccggcgc

SEQ ID NO: 3459258 - RNA, 15 nt, Pseudomonas aeruginosa PA01
gccaggggcacgcug

SEQ ID NO: 3459259 - RNA, 19 nt, Pseudomonas aeruginosa PA01
gccaggggcacgcuggcga

SEQ ID NO: 3459260 - RNA, 19 nt, Pseudomonas aeruginosa PA01
gccaggggcuagucgcgca

SEQ ID NO: 3459261 - RNA, 21 nt, Pseudomonas aeruginosa PA01
gccaggggcuagucgcgcagc

SEQ ID NO: 3459262 - RNA, 15 nt, Pseudomonas aeruginosa PA01
gccaggggcugaaca

SEQ ID NO: 3459263 - RNA, 18 nt, Pseudomonas aeruginosa PA01
gccaggggcugaacagcg

SEQ ID NO: 3459264 - RNA, 20 nt, Pseudomonas aeruginosa PA01
gccaggggcugaacagcgcc

SEQ ID NO: 3459265 - RNA, 22 nt, Pseudomonas aeruginosa PA01
gccagggggaucgcgaagaaca

SEQ ID NO: 3459266 - RNA, 16 nt, Pseudomonas aeruginosa PA01
gccagggggccuggcu

SEQ ID NO: 3459267 - RNA, 17 nt, Pseudomonas aeruginosa PA01
gccagggggccuggcuc

SEQ ID NO: 3459268 - RNA, 19 nt, Pseudomonas aeruginosa PA01
gccagggggccuggcucga

SEQ ID NO: 3459269 - RNA, 16 nt, Pseudomonas aeruginosa PA01
gccagggguaggagga

SEQ ID NO: 3459270 - RNA, 15 nt, Pseudomonas aeruginosa PA01
gccaggggucaggcc

SEQ ID NO: 3459271 - RNA, 17 nt, Pseudomonas aeruginosa PA01
gccaggggucaggccga

SEQ ID NO: 3459272 - RNA, 14 nt, Pseudomonas aeruginosa PA01
gccaggggugccuu

SEQ ID NO: 3459273 - RNA, 22 nt, Pseudomonas aeruginosa PA01
gccaggggugccuugccaaggu

SEQ ID NO: 3459274 - RNA, 18 nt, Pseudomonas aeruginosa PA01
gccaggguaccguugcgc

SEQ ID NO: 3459275 - RNA, 21 nt, Pseudomonas aeruginosa PA01
gccaggguaccguugcgcagg

SEQ ID NO: 3459276 - RNA, 23 nt, Pseudomonas aeruginosa PA01
gccaggguacuucgugccacagg

SEQ ID NO: 3459277 - RNA, 19 nt, Pseudomonas aeruginosa PA01
gccagggucagcucgacag

SEQ ID NO: 3459278 - RNA, 22 nt, Pseudomonas aeruginosa PA01
gccaggguccgcuucagcgcgc

SEQ ID NO: 3459279 - RNA, 15 nt, Pseudomonas aeruginosa PA01
gccagggucgccagc

SEQ ID NO: 3459280 - RNA, 18 nt, Pseudomonas aeruginosa PA01
gccagggucgccagcagg

SEQ ID NO: 3459281 - RNA, 18 nt, Pseudomonas aeruginosa PA01
gccagggucuugccgacc

SEQ ID NO: 3459282 - RNA, 18 nt, Pseudomonas aeruginosa PA01
gccagggugcugcccagg

SEQ ID NO: 3459283 - RNA, 21 nt, Pseudomonas aeruginosa PA01
gccagggugcugcccagggcc

SEQ ID NO: 3459284 - RNA, 23 nt, Pseudomonas aeruginosa PA01
gccaggguguacuugacggcgcc

SEQ ID NO: 3459285 - RNA, 23 nt, Pseudomonas aeruginosa PA01
gccagguaauagccguugaggcc

SEQ ID NO: 3459286 - RNA, 18 nt, Pseudomonas aeruginosa PA01
gccagguacggaugccgc

SEQ ID NO: 3459287 - RNA, 18 nt, Pseudomonas aeruginosa PA01
gccagguacuggcgaugg

SEQ ID NO: 3459288 - RNA, 16 nt, Pseudomonas aeruginosa PA01
gccagguacuuggcca

SEQ ID NO: 3459289 - RNA, 19 nt, Pseudomonas aeruginosa PA01
gccagguacuuggccacgc

SEQ ID NO: 3459290 - RNA, 23 nt, Pseudomonas aeruginosa PA01
gccagguacuuggccacgccuuc

SEQ ID NO: 3459291 - RNA, 14 nt, Pseudomonas aeruginosa PA01
gccagguagccugg

SEQ ID NO: 3459292 - RNA, 15 nt, Pseudomonas aeruginosa PA01
gccagguagccugga

SEQ ID NO: 3459293 - RNA, 21 nt, Pseudomonas aeruginosa PA01
gccagguagcggaccccggcc

SEQ ID NO: 3459294 - RNA, 22 nt, Pseudomonas aeruginosa PA01
gccagguagcggcguucgccga

SEQ ID NO: 3459295 - RNA, 15 nt, Pseudomonas aeruginosa PA01
gccagguaggcgacg

SEQ ID NO: 3459296 - RNA, 21 nt, Pseudomonas aeruginosa PA01
gccagguaggcgacgaagcug

SEQ ID NO: 3459297 - RNA, 15 nt, Pseudomonas aeruginosa PA01
gccagguaguccagc

SEQ ID NO: 3459298 - RNA, 16 nt, Pseudomonas aeruginosa PA01
gccagguauuccgccc

SEQ ID NO: 3459299 - RNA, 22 nt, Pseudomonas aeruginosa PA01
gccagguauucgcgcucggcga

SEQ ID NO: 3459300 - RNA, 12 nt, Pseudomonas aeruginosa PA01
gccaggucagcc

SEQ ID NO: 3459301 - RNA, 21 nt, Pseudomonas aeruginosa PA01
gccaggucagccaccugcucg

SEQ ID NO: 3459302 - RNA, 16 nt, Pseudomonas aeruginosa PA01
gccagguccaggcuca

SEQ ID NO: 3459303 - RNA, 18 nt, Pseudomonas aeruginosa PA01
gccagguccgaacagagg

SEQ ID NO: 3459304 - RNA, 19 nt, Pseudomonas aeruginosa PA01
gccagguccgaacagagga

SEQ ID NO: 3459305 - RNA, 20 nt, Pseudomonas aeruginosa PA01
gccagguccgccugguccag

SEQ ID NO: 3459306 - RNA, 21 nt, Pseudomonas aeruginosa PA01
gccagguccgccugguccagc

SEQ ID NO: 3459307 - RNA, 15 nt, Pseudomonas aeruginosa PA01
gccaggucgagggca

SEQ ID NO: 3459308 - RNA, 19 nt, Pseudomonas aeruginosa PA01
gccaggucgauccccaacc

SEQ ID NO: 3459309 - RNA, 22 nt, Pseudomonas aeruginosa PA01
gccaggucgauccccaacccgg

SEQ ID NO: 3459310 - RNA, 14 nt, Pseudomonas aeruginosa PA01
gccaggucgcgacu

SEQ ID NO: 3459311 - RNA, 18 nt, Pseudomonas aeruginosa PA01
gccaggucgcgacugacc

SEQ ID NO: 3459312 - RNA, 19 nt, Pseudomonas aeruginosa PA01
gccaggucgcgcagggcca

SEQ ID NO: 3459313 - RNA, 13 nt, Pseudomonas aeruginosa PA01
gccaggucgcggg

SEQ ID NO: 3459314 - RNA, 16 nt, Pseudomonas aeruginosa PA01
gccaggucgcggguga

SEQ ID NO: 3459315 - RNA, 19 nt, Pseudomonas aeruginosa PA01
gccaggucgucgcgcuuga

SEQ ID NO: 3459316 - RNA, 20 nt, Pseudomonas aeruginosa PA01
gccaggucuucuggaaaucg

SEQ ID NO: 3459317 - RNA, 22 nt, Pseudomonas aeruginosa PA01
gccaggugcaggaagcgccggg

SEQ ID NO: 3459318 - RNA, 23 nt, Pseudomonas aeruginosa PA01
gccaggugcaggaagcgccgggc

SEQ ID NO: 3459319 - RNA, 14 nt, Pseudomonas aeruginosa PA01
gccaggugcgcugg

SEQ ID NO: 3459320 - RNA, 16 nt, Pseudomonas aeruginosa PA01
gccaggugcgcugguu

SEQ ID NO: 3459321 - RNA, 18 nt, Pseudomonas aeruginosa PA01
gccagguggaagcgcgcg

SEQ ID NO: 3459322 - RNA, 14 nt, Pseudomonas aeruginosa PA01
gccagguggcgggc

SEQ ID NO: 3459323 - RNA, 23 nt, Pseudomonas aeruginosa PA01
gccagguucuugaugucagcgua

SEQ ID NO: 3459324 - RNA, 15 nt, Pseudomonas aeruginosa PA01
gccagguugaccagu

SEQ ID NO: 3459325 - RNA, 21 nt, Pseudomonas aeruginosa PA01
gccagguugcguuccaacugg

SEQ ID NO: 3459326 - RNA, 23 nt, Pseudomonas aeruginosa PA01
gccagguuggcaacugcguccga

SEQ ID NO: 3459327 - RNA, 17 nt, Pseudomonas aeruginosa PA01
gccagguuggccuggcc

SEQ ID NO: 3459328 - RNA, 18 nt, Pseudomonas aeruginosa PA01
gccagguuggccuggccc

SEQ ID NO: 3459329 - RNA, 22 nt, Pseudomonas aeruginosa PA01
gccagguuggccuggcccggcg

SEQ ID NO: 3459330 - RNA, 23 nt, Pseudomonas aeruginosa PA01
gccagguuggccuggcccggcgc

SEQ ID NO: 3459331 - RNA, 16 nt, Pseudomonas aeruginosa PA01
gccagguuuccggcag

SEQ ID NO: 3459332 - RNA, 22 nt, Pseudomonas aeruginosa PA01
gccaguaguccuccgcgcccag

SEQ ID NO: 3459333 - RNA, 13 nt, Pseudomonas aeruginosa PA01
gccagucaucgcg

SEQ ID NO: 3459334 - RNA, 14 nt, Pseudomonas aeruginosa PA01
gccaguccacgacg

SEQ ID NO: 3459335 - RNA, 20 nt, Pseudomonas aeruginosa PA01
gccaguccacgacgaacggc

SEQ ID NO: 3459336 - RNA, 21 nt, Pseudomonas aeruginosa PA01
gccagucccgcaaagcccgcu

SEQ ID NO: 3459337 - RNA, 15 nt, Pseudomonas aeruginosa PA01
gccaguccggcagca

SEQ ID NO: 3459338 - RNA, 17 nt, Pseudomonas aeruginosa PA01
gccaguccggcagcacg

SEQ ID NO: 3459339 - RNA, 22 nt, Pseudomonas aeruginosa PA01
gccaguccuggacccguugccg

SEQ ID NO: 3459340 - RNA, 18 nt, Pseudomonas aeruginosa PA01
gccagucgagacgccagc

SEQ ID NO: 3459341 - RNA, 23 nt, Pseudomonas aeruginosa PA01
gccagucgagacgccagccgccc

SEQ ID NO: 3459342 - RNA, 15 nt, Pseudomonas aeruginosa PA01
gccagucgagagcgg

SEQ ID NO: 3459343 - RNA, 17 nt, Pseudomonas aeruginosa PA01
gccagucggccuggcuc

SEQ ID NO: 3459344 - RNA, 13 nt, Pseudomonas aeruginosa PA01
gccaucgaucagc

SEQ ID NO: 3459345 - RNA, 14 nt, Pseudomonas aeruginosa PA01
gccaucgaucagca

SEQ ID NO: 3459346 - RNA, 17 nt, Pseudomonas aeruginosa PA01
gccaucgaucagcagcg

SEQ ID NO: 3459347 - RNA, 20 nt, Pseudomonas aeruginosa PA01
gccaucgaucagcagcgcca

SEQ ID NO: 3459348 - RNA, 22 nt, Pseudomonas aeruginosa PA01
gccaucgaucagcagcgccacg

SEQ ID NO: 3459349 - RNA, 20 nt, Pseudomonas aeruginosa PA01
gccaucgauggucacuggcg

SEQ ID NO: 3459350 - RNA, 16 nt, Pseudomonas aeruginosa PA01
gccaucgauggucagg

SEQ ID NO: 3459351 - RNA, 17 nt, Pseudomonas aeruginosa PA01
gccaucgauggucaggc

SEQ ID NO: 3459352 - RNA, 20 nt, Pseudomonas aeruginosa PA01
gccaucgauggucaggcugg

SEQ ID NO: 3459353 - RNA, 19 nt, Pseudomonas aeruginosa PA01
gccaucgaugugagcccca

SEQ ID NO: 3459354 - RNA, 16 nt, Pseudomonas aeruginosa PA01
gccaucgcauagccgg

SEQ ID NO: 3459355 - RNA, 21 nt, Pseudomonas aeruginosa PA01
gccaucgcccgguugccuucg

SEQ ID NO: 3459356 - RNA, 12 nt, Pseudomonas aeruginosa PA01
gccaucgccggc

SEQ ID NO: 3459357 - RNA, 18 nt, Pseudomonas aeruginosa PA01
gccaucgccggcccgcgc

SEQ ID NO: 3459358 - RNA, 21 nt, Pseudomonas aeruginosa PA01
gccaucgccggcccgcgcggc

SEQ ID NO: 3459359 - RNA, 22 nt, Pseudomonas aeruginosa PA01
gccaucgccggcccgcgcggca

SEQ ID NO: 3459360 - RNA, 23 nt, Pseudomonas aeruginosa PA01
gccaucgccggcccgcgcggcaa

SEQ ID NO: 3459361 - RNA, 13 nt, Pseudomonas aeruginosa PA01
gccaucgccgucu

SEQ ID NO: 3459362 - RNA, 16 nt, Pseudomonas aeruginosa PA01
gccaucgccucgccgg

SEQ ID NO: 3459363 - RNA, 18 nt, Pseudomonas aeruginosa PA01
gccaucgccucgccggcc

SEQ ID NO: 3459364 - RNA, 23 nt, Pseudomonas aeruginosa PA01
gccaucgcggaaacccuuccagc

SEQ ID NO: 3459365 - RNA, 14 nt, Pseudomonas aeruginosa PA01
gccaucgcucaccg

SEQ ID NO: 3459366 - RNA, 18 nt, Pseudomonas aeruginosa PA01
gccaucgcuuuccuggcc

SEQ ID NO: 3459367 - RNA, 20 nt, Pseudomonas aeruginosa PA01
gccaucgcuuuccuggccga

SEQ ID NO: 3459368 - RNA, 15 nt, Pseudomonas aeruginosa PA01
gccaucggccugggg

SEQ ID NO: 3459369 - RNA, 18 nt, Pseudomonas aeruginosa PA01
gccaucggccuggggcuc

SEQ ID NO: 3459370 - RNA, 23 nt, Pseudomonas aeruginosa PA01
gccaucggccuggggcucggcuu

SEQ ID NO: 3459371 - RNA, 20 nt, Pseudomonas aeruginosa PA01
gccaucggcgguacgcccuc

SEQ ID NO: 3459372 - RNA, 19 nt, Pseudomonas aeruginosa PA01
gccaucggucgcgccccca

SEQ ID NO: 3459373 - RNA, 23 nt, Pseudomonas aeruginosa PA01
gccaucggucgcgcccccaucug

SEQ ID NO: 3459374 - RNA, 14 nt, Pseudomonas aeruginosa PA01
gccaucuccucgcu

SEQ ID NO: 3459375 - RNA, 16 nt, Pseudomonas aeruginosa PA01
gccaucuccucgcuga

SEQ ID NO: 3459376 - RNA, 14 nt, Pseudomonas aeruginosa PA01
gccaucuggcugcc

SEQ ID NO: 3459377 - RNA, 15 nt, Pseudomonas aeruginosa PA01
gccaucuggcugccg

SEQ ID NO: 3459378 - RNA, 13 nt, Pseudomonas aeruginosa PA01
gccaucuuccugu

SEQ ID NO: 3459379 - RNA, 17 nt, Pseudomonas aeruginosa PA01
gccaucuuccugugcga

SEQ ID NO: 3459380 - RNA, 17 nt, Pseudomonas aeruginosa PA01
gccaucuucucgaagcg

SEQ ID NO: 3459381 - RNA, 22 nt, Pseudomonas aeruginosa PA01
gccaucuucucgaagcgcgccu

SEQ ID NO: 3459382 - RNA, 18 nt, Pseudomonas aeruginosa PA01
gccaugaaaaagccggga

SEQ ID NO: 3459383 - RNA, 15 nt, Pseudomonas aeruginosa PA01
gccaugaccucggcc

SEQ ID NO: 3459384 - RNA, 16 nt, Pseudomonas aeruginosa PA01
gccaugaccucggcca

SEQ ID NO: 3459385 - RNA, 17 nt, Pseudomonas aeruginosa PA01
gccaugagcagggcgga

SEQ ID NO: 3459386 - RNA, 15 nt, Pseudomonas aeruginosa PA01
gccaugagccggggu

SEQ ID NO: 3459387 - RNA, 21 nt, Pseudomonas aeruginosa PA01
gccaugaucaucgccugcugg

SEQ ID NO: 3459388 - RNA, 17 nt, Pseudomonas aeruginosa PA01
gccaugauccggugcag

SEQ ID NO: 3459389 - RNA, 21 nt, Pseudomonas aeruginosa PA01
gccaugauccggugcaggccg

SEQ ID NO: 3459390 - RNA, 20 nt, Pseudomonas aeruginosa PA01
gccaugcaagaacgccgacc

SEQ ID NO: 3459391 - RNA, 14 nt, Pseudomonas aeruginosa PA01
gccaugcacacgcu

SEQ ID NO: 3459392 - RNA, 17 nt, Pseudomonas aeruginosa PA01
gccaugcaggccagggc

SEQ ID NO: 3459393 - RNA, 18 nt, Pseudomonas aeruginosa PA01
gccaugcccagacgccgc

SEQ ID NO: 3459394 - RNA, 17 nt, Pseudomonas aeruginosa PA01
gccaugcccggcuggcg

SEQ ID NO: 3459395 - RNA, 23 nt, Pseudomonas aeruginosa PA01
gccaugcccgucgaccaucacca

SEQ ID NO: 3459396 - RNA, 13 nt, Pseudomonas aeruginosa PA01
gccaugccgccga

SEQ ID NO: 3459397 - RNA, 14 nt, Pseudomonas aeruginosa PA01
gccaugccgccgac

SEQ ID NO: 3459398 - RNA, 16 nt, Pseudomonas aeruginosa PA01
gccaugccgccgacgc

SEQ ID NO: 3459399 - RNA, 14 nt, Pseudomonas aeruginosa PA01
gccaugccggccag

SEQ ID NO: 3459400 - RNA, 13 nt, Pseudomonas aeruginosa PA01
gccaugccggcgc

SEQ ID NO: 3459401 - RNA, 16 nt, Pseudomonas aeruginosa PA01
gccaugccggcgccga

SEQ ID NO: 3459402 - RNA, 21 nt, Pseudomonas aeruginosa PA01
gccaugccguucaggccggcg

SEQ ID NO: 3459403 - RNA, 16 nt, Pseudomonas aeruginosa PA01
gccaugcgcucggggu

SEQ ID NO: 3459404 - RNA, 18 nt, Pseudomonas aeruginosa PA01
gccaugcgcucggggucg

SEQ ID NO: 3459405 - RNA, 22 nt, Pseudomonas aeruginosa PA01
gccaugcucggccagcucgccg

SEQ ID NO: 3459406 - RNA, 23 nt, Pseudomonas aeruginosa PA01
gccaugcucggccagcucgccga

SEQ ID NO: 3459407 - RNA, 18 nt, Pseudomonas aeruginosa PA01
gccaugcucuucaggcug

SEQ ID NO: 3459408 - RNA, 12 nt, Pseudomonas aeruginosa PA01
gccaugcuggcg

SEQ ID NO: 3459409 - RNA, 13 nt, Pseudomonas aeruginosa PA01
gccauggaucacc

SEQ ID NO: 3459410 - RNA, 15 nt, Pseudomonas aeruginosa PA01
gccauggcauccccu

SEQ ID NO: 3459411 - RNA, 14 nt, Pseudomonas aeruginosa PA01
gccauggccgagcc

SEQ ID NO: 3459412 - RNA, 20 nt, Pseudomonas aeruginosa PA01
gccauggccgagcccagcgg

SEQ ID NO: 3459413 - RNA, 13 nt, Pseudomonas aeruginosa PA01
gccauggcgcuga

SEQ ID NO: 3459414 - RNA, 22 nt, Pseudomonas aeruginosa PA01
gccauggcgcugaggaagagca

SEQ ID NO: 3459415 - RNA, 17 nt, Pseudomonas aeruginosa PA01
gccauggcgcuugcgca

SEQ ID NO: 3459416 - RNA, 21 nt, Pseudomonas aeruginosa PA01
gccauggcggacauguugcag

SEQ ID NO: 3459417 - RNA, 13 nt, Pseudomonas aeruginosa PA01
gccauggcggcgg

SEQ ID NO: 3459418 - RNA, 14 nt, Pseudomonas aeruginosa PA01
gccauggcggcgga

SEQ ID NO: 3459419 - RNA, 21 nt, Pseudomonas aeruginosa PA01
gccauggcgggucacgccgaa

SEQ ID NO: 3459420 - RNA, 19 nt, Pseudomonas aeruginosa PA01
gccauggcgguuccuccau

SEQ ID NO: 3459421 - RNA, 13 nt, Pseudomonas aeruginosa PA01
gccauggcuggug

SEQ ID NO: 3459422 - RNA, 15 nt, Pseudomonas aeruginosa PA01
gccaugggcacgccg

SEQ ID NO: 3459423 - RNA, 17 nt, Pseudomonas aeruginosa PA01
gccaugggcacgccggu

SEQ ID NO: 3459424 - RNA, 18 nt, Pseudomonas aeruginosa PA01
gccaugggcacgccggug

SEQ ID NO: 3459425 - RNA, 15 nt, Pseudomonas aeruginosa PA01
gccaugggccggccg

SEQ ID NO: 3459426 - RNA, 16 nt, Pseudomonas aeruginosa PA01
gccaugggccggccga

SEQ ID NO: 3459427 - RNA, 19 nt, Pseudomonas aeruginosa PA01
gccaugggccggccgacga

SEQ ID NO: 3459428 - RNA, 18 nt, Pseudomonas aeruginosa PA01
gccauggguggaacccgc

SEQ ID NO: 3459429 - RNA, 20 nt, Pseudomonas aeruginosa PA01
gccauggguggaacccgcuu

SEQ ID NO: 3459430 - RNA, 17 nt, Pseudomonas aeruginosa PA01
gccaugggugucggcga

SEQ ID NO: 3459431 - RNA, 18 nt, Pseudomonas aeruginosa PA01
gccaugggugucggcgau

SEQ ID NO: 3459432 - RNA, 19 nt, Pseudomonas aeruginosa PA01
gccauggucucgcugaccc

SEQ ID NO: 3459433 - RNA, 19 nt, Pseudomonas aeruginosa PA01
gccaugguuuaccaggacc

SEQ ID NO: 3459434 - RNA, 23 nt, Pseudomonas aeruginosa PA01
gccaugguuuaccaggaccagcg

SEQ ID NO: 3459435 - RNA, 20 nt, Pseudomonas aeruginosa PA01
gccauguacguaucccagcg

SEQ ID NO: 3459436 - RNA, 13 nt, Pseudomonas aeruginosa PA01
gccaugugcuccu

SEQ ID NO: 3459437 - RNA, 19 nt, Pseudomonas aeruginosa PA01
gccauguuccacaugcgcu

SEQ ID NO: 3459438 - RNA, 15 nt, Pseudomonas aeruginosa PA01
gccauguuggccuug

SEQ ID NO: 3459439 - RNA, 23 nt, Pseudomonas aeruginosa PA01
gccauguuggccuugagcaggcg

SEQ ID NO: 3459440 - RNA, 17 nt, Pseudomonas aeruginosa PA01
gccauucaggcggauca

SEQ ID NO: 3459441 - RNA, 20 nt, Pseudomonas aeruginosa PA01
gccauuccugggccccggcc

SEQ ID NO: 3459442 - RNA, 19 nt, Pseudomonas aeruginosa PA01
gccauuccuuccaggguuu

SEQ ID NO: 3459443 - RNA, 23 nt, Pseudomonas aeruginosa PA01
gccauuccuugauuugcccggcg

SEQ ID NO: 3459444 - RNA, 20 nt, Pseudomonas aeruginosa PA01
gccauucgaauggcgccggc

SEQ ID NO: 3459445 - RNA, 22 nt, Pseudomonas aeruginosa PA01
gccauucgaauggcgccggcca

SEQ ID NO: 3459446 - RNA, 14 nt, Pseudomonas aeruginosa PA01
gcccagcagcacca

SEQ ID NO: 3459447 - RNA, 20 nt, Pseudomonas aeruginosa PA01
gcccagcagcaccaucagcc

SEQ ID NO: 3459448 - RNA, 15 nt, Pseudomonas aeruginosa PA01
gcccagcagcaggcc

SEQ ID NO: 3459449 - RNA, 19 nt, Pseudomonas aeruginosa PA01
gcccagcagcaggccggcg

SEQ ID NO: 3459450 - RNA, 13 nt, Pseudomonas aeruginosa PA01
gcccagcagcgcu

SEQ ID NO: 3459451 - RNA, 14 nt, Pseudomonas aeruginosa PA01
gcccagcagcgcuc

SEQ ID NO: 3459452 - RNA, 15 nt, Pseudomonas aeruginosa PA01
gcccagcagcgcuca

SEQ ID NO: 3459453 - RNA, 13 nt, Pseudomonas aeruginosa PA01
gcccagcagcggc

SEQ ID NO: 3459454 - RNA, 14 nt, Pseudomonas aeruginosa PA01
gcccagcagcggca

SEQ ID NO: 3459455 - RNA, 21 nt, Pseudomonas aeruginosa PA01
gcccagcagcggcaggagcgu

SEQ ID NO: 3459456 - RNA, 10 nt, Pseudomonas aeruginosa PA01
gcccagcagg

SEQ ID NO: 3459457 - RNA, 15 nt, Pseudomonas aeruginosa PA01
gcccagcaggccggc

SEQ ID NO: 3459458 - RNA, 16 nt, Pseudomonas aeruginosa PA01
gcccagcaggccggcc

SEQ ID NO: 3459459 - RNA, 17 nt, Pseudomonas aeruginosa PA01
gcccagcaggccggcca

SEQ ID NO: 3459460 - RNA, 18 nt, Pseudomonas aeruginosa PA01
gcccagcaggccggccag

SEQ ID NO: 3459461 - RNA, 19 nt, Pseudomonas aeruginosa PA01
gcccagcaggccggccagc

SEQ ID NO: 3459462 - RNA, 20 nt, Pseudomonas aeruginosa PA01
gcccagcaggccggccagcc

SEQ ID NO: 3459463 - RNA, 14 nt, Pseudomonas aeruginosa PA01
gcccagcaggcgcg

SEQ ID NO: 3459464 - RNA, 15 nt, Pseudomonas aeruginosa PA01
gcccagcaggcgcgc

SEQ ID NO: 3459465 - RNA, 19 nt, Pseudomonas aeruginosa PA01
gcccagcaggcucaucgcc

SEQ ID NO: 3459466 - RNA, 20 nt, Pseudomonas aeruginosa PA01
gcccagcaggcucaucgccc

SEQ ID NO: 3459467 - RNA, 23 nt, Pseudomonas aeruginosa PA01
gcccagcaggcugcugcugcggc

SEQ ID NO: 3459468 - RNA, 16 nt, Pseudomonas aeruginosa PA01
gcccagcagggccagc

SEQ ID NO: 3459469 - RNA, 15 nt, Pseudomonas aeruginosa PA01
gcccagccagagcgu

SEQ ID NO: 3459470 - RNA, 15 nt, Pseudomonas aeruginosa PA01
gcccagccagggccg

SEQ ID NO: 3459471 - RNA, 17 nt, Pseudomonas aeruginosa PA01
gcccagccagggccgcg

SEQ ID NO: 3459472 - RNA, 18 nt, Pseudomonas aeruginosa PA01
gcccagccagggccgcga

SEQ ID NO: 3459473 - RNA, 20 nt, Pseudomonas aeruginosa PA01
gcccagccccaccgccaggu

SEQ ID NO: 3459474 - RNA, 12 nt, Pseudomonas aeruginosa PA01
gcccagcccgcc

SEQ ID NO: 3459475 - RNA, 14 nt, Pseudomonas aeruginosa PA01
gcccagcccgccuu

SEQ ID NO: 3459476 - RNA, 16 nt, Pseudomonas aeruginosa PA01
gcccagcccgccuucc

SEQ ID NO: 3459477 - RNA, 14 nt, Pseudomonas aeruginosa PA01
gcccagccgcggcg

SEQ ID NO: 3459478 - RNA, 15 nt, Pseudomonas aeruginosa PA01
gcccagccgcggcgc

SEQ ID NO: 3459479 - RNA, 17 nt, Pseudomonas aeruginosa PA01
gcccagccgcggcgcca

SEQ ID NO: 3459480 - RNA, 17 nt, Pseudomonas aeruginosa PA01
gcccagcgagccgauca

SEQ ID NO: 3459481 - RNA, 21 nt, Pseudomonas aeruginosa PA01
gcccagcgagccgaucaccag

SEQ ID NO: 3459482 - RNA, 22 nt, Pseudomonas aeruginosa PA01
gcccagcgagccgaucaccagc

SEQ ID NO: 3459483 - RNA, 16 nt, Pseudomonas aeruginosa PA01
gcccagcgcagccugc

SEQ ID NO: 3459484 - RNA, 17 nt, Pseudomonas aeruginosa PA01
gcccagcgcagccugcu

SEQ ID NO: 3459485 - RNA, 14 nt, Pseudomonas aeruginosa PA01
gcccagcgcaggcc

SEQ ID NO: 3459486 - RNA, 17 nt, Pseudomonas aeruginosa PA01
gcccagcgcaggccgau

SEQ ID NO: 3459487 - RNA, 14 nt, Pseudomonas aeruginosa PA01
gcccagcgccccgc

SEQ ID NO: 3459488 - RNA, 16 nt, Pseudomonas aeruginosa PA01
gcccagcgccccgccu

SEQ ID NO: 3459489 - RNA, 11 nt, Pseudomonas aeruginosa PA01
gcccagcgccg

SEQ ID NO: 3459490 - RNA, 19 nt, Pseudomonas aeruginosa PA01
gcccagcgccgccagcagg

SEQ ID NO: 3459491 - RNA, 21 nt, Pseudomonas aeruginosa PA01
gcccagcgccgccagcagguc

SEQ ID NO: 3459492 - RNA, 23 nt, Pseudomonas aeruginosa PA01
gcccagcgccgccagcaggucgg

SEQ ID NO: 3459493 - RNA, 16 nt, Pseudomonas aeruginosa PA01
gcccagcgccgccugc

SEQ ID NO: 3459494 - RNA, 17 nt, Pseudomonas aeruginosa PA01
gcccagcgccgccugcu

SEQ ID NO: 3459495 - RNA, 19 nt, Pseudomonas aeruginosa PA01
gcccagcgccgccugcugg

SEQ ID NO: 3459496 - RNA, 22 nt, Pseudomonas aeruginosa PA01
gcccagcgccgccugcuggcug

SEQ ID NO: 3459497 - RNA, 14 nt, Pseudomonas aeruginosa PA01
gcccagcgccugca

SEQ ID NO: 3459498 - RNA, 13 nt, Pseudomonas aeruginosa PA01
gcccagcgccugu

SEQ ID NO: 3459499 - RNA, 16 nt, Pseudomonas aeruginosa PA01
gcccagcgcggcgccc

SEQ ID NO: 3459500 - RNA, 17 nt, Pseudomonas aeruginosa PA01
gcccagcgcggcgcccc

SEQ ID NO: 3459501 - RNA, 18 nt, Pseudomonas aeruginosa PA01
gcccagcgcggcgcccca

SEQ ID NO: 3459502 - RNA, 20 nt, Pseudomonas aeruginosa PA01
gcccagcgcggcgccccagg

SEQ ID NO: 3459503 - RNA, 22 nt, Pseudomonas aeruginosa PA01
gcccagcgcggcgccccaggcg

SEQ ID NO: 3459504 - RNA, 18 nt, Pseudomonas aeruginosa PA01
gcccagcgcuuccucggg

SEQ ID NO: 3459505 - RNA, 19 nt, Pseudomonas aeruginosa PA01
gcccagcgcuuccucgggc

SEQ ID NO: 3459506 - RNA, 20 nt, Pseudomonas aeruginosa PA01
gcccagcgcuuccucgggca

SEQ ID NO: 3459507 - RNA, 15 nt, Pseudomonas aeruginosa PA01
gcccagcggaugcgc

SEQ ID NO: 3459508 - RNA, 15 nt, Pseudomonas aeruginosa PA01
gcccagcggcagggc

SEQ ID NO: 3459509 - RNA, 19 nt, Pseudomonas aeruginosa PA01
gcccagcggcagggcggcg

SEQ ID NO: 3459510 - RNA, 20 nt, Pseudomonas aeruginosa PA01
gcccagcggcagggcggcga

SEQ ID NO: 3459511 - RNA, 21 nt, Pseudomonas aeruginosa PA01
gcccagcggcagggcggcgau

SEQ ID NO: 3459512 - RNA, 22 nt, Pseudomonas aeruginosa PA01
gcccagcggcagggcggcgaug

SEQ ID NO: 3459513 - RNA, 16 nt, Pseudomonas aeruginosa PA01
gcccagcggcaggucg

SEQ ID NO: 3459514 - RNA, 12 nt, Pseudomonas aeruginosa PA01
gcccagcggcgc

SEQ ID NO: 3459515 - RNA, 16 nt, Pseudomonas aeruginosa PA01
gcccagcggcgccagc

SEQ ID NO: 3459516 - RNA, 17 nt, Pseudomonas aeruginosa PA01
gcccagcggcgccagcu

SEQ ID NO: 3459517 - RNA, 13 nt, Pseudomonas aeruginosa PA01
gcccagcggcgcg

SEQ ID NO: 3459518 - RNA, 24 nt, Pseudomonas aeruginosa PA01
gcccagcggcgcggcguaccagcc

SEQ ID NO: 3459519 - RNA, 13 nt, Pseudomonas aeruginosa PA01
gcccagcggcugg

SEQ ID NO: 3459520 - RNA, 14 nt, Pseudomonas aeruginosa PA01
gcccagcggcuggc

SEQ ID NO: 3459521 - RNA, 20 nt, Pseudomonas aeruginosa PA01
gcccagcggcuggcgggcga

SEQ ID NO: 3459522 - RNA, 19 nt, Pseudomonas aeruginosa PA01
gcccagcgguacuaucccg

SEQ ID NO: 3459523 - RNA, 16 nt, Pseudomonas aeruginosa PA01
gcccagcguggccagc

SEQ ID NO: 3459524 - RNA, 17 nt, Pseudomonas aeruginosa PA01
gcccagcguggccagcg

SEQ ID NO: 3459525 - RNA, 21 nt, Pseudomonas aeruginosa PA01
gcccagcguggccagcgaacc

SEQ ID NO: 3459526 - RNA, 16 nt, Pseudomonas aeruginosa PA01
gcccagcguucggcgc

SEQ ID NO: 3459527 - RNA, 17 nt, Pseudomonas aeruginosa PA01
gcccagcguucggcgcu

SEQ ID NO: 3459528 - RNA, 18 nt, Pseudomonas aeruginosa PA01
gcccagcguucggcgcug

SEQ ID NO: 3459529 - RNA, 19 nt, Pseudomonas aeruginosa PA01
gcccagcguucggcgcugg

SEQ ID NO: 3459530 - RNA, 22 nt, Pseudomonas aeruginosa PA01
gcccagcguucggcgcuggcgc

SEQ ID NO: 3459531 - RNA, 15 nt, Pseudomonas aeruginosa PA01
gcccagcucgccgcu

SEQ ID NO: 3459532 - RNA, 17 nt, Pseudomonas aeruginosa PA01
gcccagcucgccgcucc

SEQ ID NO: 3459533 - RNA, 17 nt, Pseudomonas aeruginosa PA01
gcccagcucguccaggc

SEQ ID NO: 3459534 - RNA, 20 nt, Pseudomonas aeruginosa PA01
gcccagcucguccaggcaag

SEQ ID NO: 3459535 - RNA, 18 nt, Pseudomonas aeruginosa PA01
gcccagcuugauguagga

SEQ ID NO: 3459536 - RNA, 19 nt, Pseudomonas aeruginosa PA01
gcccagcuuggccacgucc

SEQ ID NO: 3459537 - RNA, 21 nt, Pseudomonas aeruginosa PA01
gcccaggacaacgacagcccc

SEQ ID NO: 3459538 - RNA, 22 nt, Pseudomonas aeruginosa PA01
gcccaggacaacgacagccccg

SEQ ID NO: 3459539 - RNA, 23 nt, Pseudomonas aeruginosa PA01
gcccaggacaacgacagccccgg

SEQ ID NO: 3459540 - RNA, 21 nt, Pseudomonas aeruginosa PA01
gcccaggcagaucgcgccgag

SEQ ID NO: 3459541 - RNA, 20 nt, Pseudomonas aeruginosa PA01
gcccaggcagcagagcgcca

SEQ ID NO: 3459542 - RNA, 12 nt, Pseudomonas aeruginosa PA01
gcccaggcaggc

SEQ ID NO: 3459543 - RNA, 14 nt, Pseudomonas aeruginosa PA01
gcccaggcaggcga

SEQ ID NO: 3459544 - RNA, 17 nt, Pseudomonas aeruginosa PA01
gcccaggcaggcgauga

SEQ ID NO: 3459545 - RNA, 14 nt, Pseudomonas aeruginosa PA01
gcccaggcccagcg

SEQ ID NO: 3459546 - RNA, 15 nt, Pseudomonas aeruginosa PA01
gcccaggcccagcgc

SEQ ID NO: 3459547 - RNA, 16 nt, Pseudomonas aeruginosa PA01
gcccaggcccagcgcg

SEQ ID NO: 3459548 - RNA, 20 nt, Pseudomonas aeruginosa PA01
gcccaggcccagcgcggcgc

SEQ ID NO: 3459549 - RNA, 19 nt, Pseudomonas aeruginosa PA01
gcccaucucgguguccacc

SEQ ID NO: 3459550 - RNA, 23 nt, Pseudomonas aeruginosa PA01
gcccaucuucagcaucaggucgg

SEQ ID NO: 3459551 - RNA, 17 nt, Pseudomonas aeruginosa PA01
gcccaucuucaggccgu

SEQ ID NO: 3459552 - RNA, 18 nt, Pseudomonas aeruginosa PA01
gcccaugaaaaagccccg

SEQ ID NO: 3459553 - RNA, 19 nt, Pseudomonas aeruginosa PA01
gcccaugaaaaagccccgc

SEQ ID NO: 3459554 - RNA, 22 nt, Pseudomonas aeruginosa PA01
gcccaugaaaaagccccgccga

SEQ ID NO: 3459555 - RNA, 20 nt, Pseudomonas aeruginosa PA01
gcccaugaaaaagcccggcc

SEQ ID NO: 3459556 - RNA, 21 nt, Pseudomonas aeruginosa PA01
gcccaugaaaaagcccggccu

SEQ ID NO: 3459557 - RNA, 21 nt, Pseudomonas aeruginosa PA01
gcccaugaaaaauggccgcuu

SEQ ID NO: 3459558 - RNA, 14 nt, Pseudomonas aeruginosa PA01
gcccaugccgcccg

SEQ ID NO: 3459559 - RNA, 15 nt, Pseudomonas aeruginosa PA01
gcccaugccgcccgg

SEQ ID NO: 3459560 - RNA, 19 nt, Pseudomonas aeruginosa PA01
gcccaugccgcccggccgc

SEQ ID NO: 3459561 - RNA, 15 nt, Pseudomonas aeruginosa PA01
gcccaugccuccgac

SEQ ID NO: 3459562 - RNA, 20 nt, Pseudomonas aeruginosa PA01
gcccaugccuugcagcgcca

SEQ ID NO: 3459563 - RNA, 13 nt, Pseudomonas aeruginosa PA01
gcccaugcgcggc

SEQ ID NO: 3459564 - RNA, 14 nt, Pseudomonas aeruginosa PA01
gcccaugcgcggcg

SEQ ID NO: 3459565 - RNA, 14 nt, Pseudomonas aeruginosa PA01
gcccaugcggaucg

SEQ ID NO: 3459566 - RNA, 16 nt, Pseudomonas aeruginosa PA01
gcccauggcacgcagg

SEQ ID NO: 3459567 - RNA, 18 nt, Pseudomonas aeruginosa PA01
gcccauggcacgcagggc

SEQ ID NO: 3459568 - RNA, 21 nt, Pseudomonas aeruginosa PA01
gcccauggcacgcagggcuau

SEQ ID NO: 3459569 - RNA, 13 nt, Pseudomonas aeruginosa PA01
gcccauggcgacg

SEQ ID NO: 3459570 - RNA, 15 nt, Pseudomonas aeruginosa PA01
gcccauggucagcgg

SEQ ID NO: 3459571 - RNA, 20 nt, Pseudomonas aeruginosa PA01
gcccauguagaccaccagcg

SEQ ID NO: 3459572 - RNA, 22 nt, Pseudomonas aeruginosa PA01
gcccaugugcuugaccgccgcc

SEQ ID NO: 3459573 - RNA, 23 nt, Pseudomonas aeruginosa PA01
gcccauugcccggccaggcgcgg

SEQ ID NO: 3459574 - RNA, 22 nt, Pseudomonas aeruginosa PA01
gcccauuucguagcccaggcgg

SEQ ID NO: 3459575 - RNA, 18 nt, Pseudomonas aeruginosa PA01
gccccaaggggccgcgcu

SEQ ID NO: 3459576 - RNA, 13 nt, Pseudomonas aeruginosa PA01
gccccacaggccc

SEQ ID NO: 3459577 - RNA, 14 nt, Pseudomonas aeruginosa PA01
gccccacaggcccu

SEQ ID NO: 3459578 - RNA, 19 nt, Pseudomonas aeruginosa PA01
gccccacaggcccugcagc

SEQ ID NO: 3459579 - RNA, 19 nt, Pseudomonas aeruginosa PA01
gccccaccaccaucgccgc

SEQ ID NO: 3459580 - RNA, 22 nt, Pseudomonas aeruginosa PA01
gccccaccaccaucgccgcgga

SEQ ID NO: 3459581 - RNA, 20 nt, Pseudomonas aeruginosa PA01
gccccaccccaggguuggcg

SEQ ID NO: 3459582 - RNA, 21 nt, Pseudomonas aeruginosa PA01
gccccaccgaauaccagggcu

SEQ ID NO: 3459583 - RNA, 13 nt, Pseudomonas aeruginosa PA01
gccccaccgccag

SEQ ID NO: 3459584 - RNA, 14 nt, Pseudomonas aeruginosa PA01
gccccaccgccagg

SEQ ID NO: 3459585 - RNA, 14 nt, Pseudomonas aeruginosa PA01
gccccaccuggcga

SEQ ID NO: 3459586 - RNA, 19 nt, Pseudomonas aeruginosa PA01
gccccaccuggcgacaggc

SEQ ID NO: 3459587 - RNA, 21 nt, Pseudomonas aeruginosa PA01
gccccacggcgcggccgugcc

SEQ ID NO: 3459588 - RNA, 23 nt, Pseudomonas aeruginosa PA01
gccccacggcgcggccgugccuc

SEQ ID NO: 3459589 - RNA, 20 nt, Pseudomonas aeruginosa PA01
gccccacuuccggcccggcc

SEQ ID NO: 3459590 - RNA, 15 nt, Pseudomonas aeruginosa PA01
gccccagacccaggu

SEQ ID NO: 3459591 - RNA, 16 nt, Pseudomonas aeruginosa PA01
gccccagacccaggug

SEQ ID NO: 3459592 - RNA, 22 nt, Pseudomonas aeruginosa PA01
gccccagacccaggugcgcagg

SEQ ID NO: 3459593 - RNA, 15 nt, Pseudomonas aeruginosa PA01
gccccagaccugaua

SEQ ID NO: 3459594 - RNA, 17 nt, Pseudomonas aeruginosa PA01
gccccagagcccgccga

SEQ ID NO: 3459595 - RNA, 18 nt, Pseudomonas aeruginosa PA01
gccccagagcccgccgaa

SEQ ID NO: 3459596 - RNA, 20 nt, Pseudomonas aeruginosa PA01
gccccagagcccgccgaaca

SEQ ID NO: 3459597 - RNA, 15 nt, Pseudomonas aeruginosa PA01
gccccagaucgccag

SEQ ID NO: 3459598 - RNA, 19 nt, Pseudomonas aeruginosa PA01
gccccagaucgccagcgcc

SEQ ID NO: 3459599 - RNA, 20 nt, Pseudomonas aeruginosa PA01
gccccagaucgccagcgcca

SEQ ID NO: 3459600 - RNA, 22 nt, Pseudomonas aeruginosa PA01
gccccagaucgccagcgccagc

SEQ ID NO: 3459601 - RNA, 13 nt, Pseudomonas aeruginosa PA01
gccccagcaccuc

SEQ ID NO: 3459602 - RNA, 17 nt, Pseudomonas aeruginosa PA01
gccccagcaccucgccg

SEQ ID NO: 3459603 - RNA, 18 nt, Pseudomonas aeruginosa PA01
gccccagcacgccgagca

SEQ ID NO: 3459604 - RNA, 18 nt, Pseudomonas aeruginosa PA01
gccccagcacugguggac

SEQ ID NO: 3459605 - RNA, 14 nt, Pseudomonas aeruginosa PA01
gccccagcccaggg

SEQ ID NO: 3459606 - RNA, 17 nt, Pseudomonas aeruginosa PA01
gccccagcccagggcga

SEQ ID NO: 3459607 - RNA, 19 nt, Pseudomonas aeruginosa PA01
gccccagcccagggcgauc

SEQ ID NO: 3459608 - RNA, 18 nt, Pseudomonas aeruginosa PA01
gccccagccucggcaggg

SEQ ID NO: 3459609 - RNA, 23 nt, Pseudomonas aeruginosa PA01
gccccagccucggcagggcgccc

SEQ ID NO: 3459610 - RNA, 16 nt, Pseudomonas aeruginosa PA01
gccccagccuugcugg

SEQ ID NO: 3459611 - RNA, 23 nt, Pseudomonas aeruginosa PA01
gccccagccuugcuggacuuccc

SEQ ID NO: 3459612 - RNA, 18 nt, Pseudomonas aeruginosa PA01
gccccagcgcaucgcgca

SEQ ID NO: 3459613 - RNA, 21 nt, Pseudomonas aeruginosa PA01
gccccagcgccugggccgcgc

SEQ ID NO: 3459614 - RNA, 14 nt, Pseudomonas aeruginosa PA01
gccccagcgcgagc

SEQ ID NO: 3459615 - RNA, 16 nt, Pseudomonas aeruginosa PA01
gccccagcgcgagcgu

SEQ ID NO: 3459616 - RNA, 16 nt, Pseudomonas aeruginosa PA01
gccccagcggcaggca

SEQ ID NO: 3459617 - RNA, 24 nt, Pseudomonas aeruginosa PA01
gccccagcggucgauccgaccugg

SEQ ID NO: 3459618 - RNA, 19 nt, Pseudomonas aeruginosa PA01
gccccaggaaggagcgaaa

SEQ ID NO: 3459619 - RNA, 15 nt, Pseudomonas aeruginosa PA01
gccccaggcacggcu

SEQ ID NO: 3459620 - RNA, 12 nt, Pseudomonas aeruginosa PA01
gccccaggccga

SEQ ID NO: 3459621 - RNA, 15 nt, Pseudomonas aeruginosa PA01
gccccaggccgccgc

SEQ ID NO: 3459622 - RNA, 17 nt, Pseudomonas aeruginosa PA01
gccccaggccgccgccu

SEQ ID NO: 3459623 - RNA, 18 nt, Pseudomonas aeruginosa PA01
gccccaggccgccgccug

SEQ ID NO: 3459624 - RNA, 12 nt, Pseudomonas aeruginosa PA01
gccccaggcgau

SEQ ID NO: 3459625 - RNA, 19 nt, Pseudomonas aeruginosa PA01
gccccaggcgauccacagc

SEQ ID NO: 3459626 - RNA, 17 nt, Pseudomonas aeruginosa PA01
gccccaggcgcccaggc

SEQ ID NO: 3459627 - RNA, 19 nt, Pseudomonas aeruginosa PA01
gccccaggcgcccaggcag

SEQ ID NO: 3459628 - RNA, 14 nt, Pseudomonas aeruginosa PA01
gccccaggcgcggc

SEQ ID NO: 3459629 - RNA, 17 nt, Pseudomonas aeruginosa PA01
gccccaggcugcccagg

SEQ ID NO: 3459630 - RNA, 23 nt, Pseudomonas aeruginosa PA01
gccccaggcugcccagguagccg

SEQ ID NO: 3459631 - RNA, 18 nt, Pseudomonas aeruginosa PA01
gccccagggaaucgucac

SEQ ID NO: 3459632 - RNA, 17 nt, Pseudomonas aeruginosa PA01
gccccagggccggcgcc

SEQ ID NO: 3459633 - RNA, 18 nt, Pseudomonas aeruginosa PA01
gccccagggccggcgccc

SEQ ID NO: 3459634 - RNA, 19 nt, Pseudomonas aeruginosa PA01
gccccagggccggcgcccu

SEQ ID NO: 3459635 - RNA, 21 nt, Pseudomonas aeruginosa PA01
gccccagggccggcgcccuuc

SEQ ID NO: 3459636 - RNA, 18 nt, Pseudomonas aeruginosa PA01
gccccauccgacgccggc

SEQ ID NO: 3459637 - RNA, 15 nt, Pseudomonas aeruginosa PA01
gccccauccgggcgg

SEQ ID NO: 3459638 - RNA, 21 nt, Pseudomonas aeruginosa PA01
gccccaugccguucagcgucc

SEQ ID NO: 3459639 - RNA, 23 nt, Pseudomonas aeruginosa PA01
gcccccaacggaaaaaggcgccu

SEQ ID NO: 3459640 - RNA, 14 nt, Pseudomonas aeruginosa PA01
gcccccacgacgca

SEQ ID NO: 3459641 - RNA, 22 nt, Pseudomonas aeruginosa PA01
gcccccacgacgcacucauagc

SEQ ID NO: 3459642 - RNA, 12 nt, Pseudomonas aeruginosa PA01
gcccccagcgcc

SEQ ID NO: 3459643 - RNA, 16 nt, Pseudomonas aeruginosa PA01
gcccccagcgcgccgc

SEQ ID NO: 3459644 - RNA, 19 nt, Pseudomonas aeruginosa PA01
gcccccagcgcgccgccga

SEQ ID NO: 3459645 - RNA, 16 nt, Pseudomonas aeruginosa PA01
gcccccauaccgccuc

SEQ ID NO: 3459646 - RNA, 17 nt, Pseudomonas aeruginosa PA01
gcccccauaccgccucg

SEQ ID NO: 3459647 - RNA, 21 nt, Pseudomonas aeruginosa PA01
gcccccaugaaaaaggcgccc

SEQ ID NO: 3459648 - RNA, 23 nt, Pseudomonas aeruginosa PA01
gcccccaugaaaaaggcgcccgc

SEQ ID NO: 3459649 - RNA, 14 nt, Pseudomonas aeruginosa PA01
gcccccccagcacg

SEQ ID NO: 3459650 - RNA, 20 nt, Pseudomonas aeruginosa PA01
gcccccccagcacggaugcc

SEQ ID NO: 3459651 - RNA, 16 nt, Pseudomonas aeruginosa PA01
gccccgugcaccgagg

SEQ ID NO: 3459652 - RNA, 21 nt, Pseudomonas aeruginosa PA01
gccccgugcaccgaggcgcgc

SEQ ID NO: 3459653 - RNA, 14 nt, Pseudomonas aeruginosa PA01
gccccguggcgggc

SEQ ID NO: 3459654 - RNA, 17 nt, Pseudomonas aeruginosa PA01
gccccguggcgggccag

SEQ ID NO: 3459655 - RNA, 19 nt, Pseudomonas aeruginosa PA01
gccccguggcgggccagca

SEQ ID NO: 3459656 - RNA, 23 nt, Pseudomonas aeruginosa PA01
gccccguggcgggccagcaggcg

SEQ ID NO: 3459657 - RNA, 17 nt, Pseudomonas aeruginosa PA01
gccccguuaaugccggu

SEQ ID NO: 3459658 - RNA, 19 nt, Pseudomonas aeruginosa PA01
gccccguuggcgcgggcga

SEQ ID NO: 3459659 - RNA, 20 nt, Pseudomonas aeruginosa PA01
gccccguuggcgcgggcgaa

SEQ ID NO: 3459660 - RNA, 23 nt, Pseudomonas aeruginosa PA01
gccccguuggcgcgggcgaaggc

SEQ ID NO: 3459661 - RNA, 20 nt, Pseudomonas aeruginosa PA01
gccccguuugccgucggcgc

SEQ ID NO: 3459662 - RNA, 17 nt, Pseudomonas aeruginosa PA01
gccccuagaccaacugc

SEQ ID NO: 3459663 - RNA, 17 nt, Pseudomonas aeruginosa PA01
gccccucacaccaccag

SEQ ID NO: 3459664 - RNA, 21 nt, Pseudomonas aeruginosa PA01
gccccucacaccaccagcauc

SEQ ID NO: 3459665 - RNA, 12 nt, Pseudomonas aeruginosa PA01
gccccuccaccu

SEQ ID NO: 3459666 - RNA, 19 nt, Pseudomonas aeruginosa PA01
gccccuccaccucgacccu

SEQ ID NO: 3459667 - RNA, 21 nt, Pseudomonas aeruginosa PA01
gccccuccaccucgacccugg

SEQ ID NO: 3459668 - RNA, 15 nt, Pseudomonas aeruginosa PA01
gccccuccaguuccu

SEQ ID NO: 3459669 - RNA, 15 nt, Pseudomonas aeruginosa PA01
gccccucccagccac

SEQ ID NO: 3459670 - RNA, 14 nt, Pseudomonas aeruginosa PA01
gccccucgcgcauc

SEQ ID NO: 3459671 - RNA, 17 nt, Pseudomonas aeruginosa PA01
gccccucggccaggacc

SEQ ID NO: 3459672 - RNA, 22 nt, Pseudomonas aeruginosa PA01
gccccucuuccacgcgccgauc

SEQ ID NO: 3459673 - RNA, 14 nt, Pseudomonas aeruginosa PA01
gccccugccgcgga

SEQ ID NO: 3459674 - RNA, 20 nt, Pseudomonas aeruginosa PA01
gccccugccgcggauacggc

SEQ ID NO: 3459675 - RNA, 15 nt, Pseudomonas aeruginosa PA01
gccccugcgaccgug

SEQ ID NO: 3459676 - RNA, 23 nt, Pseudomonas aeruginosa PA01
gccccugcgaccgugaggcgcag

SEQ ID NO: 3459677 - RNA, 11 nt, Pseudomonas aeruginosa PA01
gccccugcgcc

SEQ ID NO: 3459678 - RNA, 13 nt, Pseudomonas aeruginosa PA01
gccccugcgccuc

SEQ ID NO: 3459679 - RNA, 13 nt, Pseudomonas aeruginosa PA01
gccccugcggacc

SEQ ID NO: 3459680 - RNA, 15 nt, Pseudomonas aeruginosa PA01
gccccugcggcgccg

SEQ ID NO: 3459681 - RNA, 18 nt, Pseudomonas aeruginosa PA01
gccccugcggcgccgguu

SEQ ID NO: 3459682 - RNA, 12 nt, Pseudomonas aeruginosa PA01
gccccuggcgcu

SEQ ID NO: 3459683 - RNA, 15 nt, Pseudomonas aeruginosa PA01
gccccuggcgcuggg

SEQ ID NO: 3459684 - RNA, 15 nt, Pseudomonas aeruginosa PA01
gccccuggcucaggc

SEQ ID NO: 3459685 - RNA, 18 nt, Pseudomonas aeruginosa PA01
gccccuggcucaggcacu

SEQ ID NO: 3459686 - RNA, 20 nt, Pseudomonas aeruginosa PA01
gccccuggcucaggcacucg

SEQ ID NO: 3459687 - RNA, 13 nt, Pseudomonas aeruginosa PA01
gccccugggccgg

SEQ ID NO: 3459688 - RNA, 16 nt, Pseudomonas aeruginosa PA01
gccccuucagcuccag

SEQ ID NO: 3459689 - RNA, 14 nt, Pseudomonas aeruginosa PA01
gccccuugcgcucu

SEQ ID NO: 3459690 - RNA, 13 nt, Pseudomonas aeruginosa PA01
gccccuugcgcug

SEQ ID NO: 3459691 - RNA, 23 nt, Pseudomonas aeruginosa PA01
gccccuugcgcuguuccgccgug

SEQ ID NO: 3459692 - RNA, 16 nt, Pseudomonas aeruginosa PA01
gccccuuggccagcac

SEQ ID NO: 3459693 - RNA, 15 nt, Pseudomonas aeruginosa PA01
gcccgaacgccgacc

SEQ ID NO: 3459694 - RNA, 17 nt, Pseudomonas aeruginosa PA01
gcccgaacgccgaccga

SEQ ID NO: 3459695 - RNA, 15 nt, Pseudomonas aeruginosa PA01
gcccgaaggccccuu

SEQ ID NO: 3459696 - RNA, 14 nt, Pseudomonas aeruginosa PA01
gcccgaauguucca

SEQ ID NO: 3459697 - RNA, 16 nt, Pseudomonas aeruginosa PA01
gcccgaccccacgccg

SEQ ID NO: 3459698 - RNA, 23 nt, Pseudomonas aeruginosa PA01
gcccgaccggguugaugccgagg

SEQ ID NO: 3459699 - RNA, 18 nt, Pseudomonas aeruginosa PA01
gcccgaccgguuccagcg

SEQ ID NO: 3459700 - RNA, 20 nt, Pseudomonas aeruginosa PA01
gcccgaccgguuccagcggc

SEQ ID NO: 3459701 - RNA, 21 nt, Pseudomonas aeruginosa PA01
gcccgaccgguuccagcggcc

SEQ ID NO: 3459702 - RNA, 23 nt, Pseudomonas aeruginosa PA01
gcccgaccgguuccagcggccgc

SEQ ID NO: 3459703 - RNA, 22 nt, Pseudomonas aeruginosa PA01
gcccgacgaaauagucgcgggc

SEQ ID NO: 3459704 - RNA, 18 nt, Pseudomonas aeruginosa PA01
gcccgacgaagacgcuca

SEQ ID NO: 3459705 - RNA, 22 nt, Pseudomonas aeruginosa PA01
gcccgacgaaguugcaggccag

SEQ ID NO: 3459706 - RNA, 23 nt, Pseudomonas aeruginosa PA01
gcccgacgaaguugcaggccagc

SEQ ID NO: 3459707 - RNA, 12 nt, Pseudomonas aeruginosa PA01
gcccgacgccgc

SEQ ID NO: 3459708 - RNA, 14 nt, Pseudomonas aeruginosa PA01
gcccgacgccgccc

SEQ ID NO: 3459709 - RNA, 15 nt, Pseudomonas aeruginosa PA01
gcccgacgccgcccg

SEQ ID NO: 3459710 - RNA, 19 nt, Pseudomonas aeruginosa PA01
gcccgacggcuugaucacg

SEQ ID NO: 3459711 - RNA, 23 nt, Pseudomonas aeruginosa PA01
gcccgacggcuugaucacgccga

SEQ ID NO: 3459712 - RNA, 22 nt, Pseudomonas aeruginosa PA01
gcccgacugcgaaaaagaacgc

SEQ ID NO: 3459713 - RNA, 21 nt, Pseudomonas aeruginosa PA01
gcccgagaagccggggcaggc

SEQ ID NO: 3459714 - RNA, 19 nt, Pseudomonas aeruginosa PA01
gcccgagaggguggucgcg

SEQ ID NO: 3459715 - RNA, 22 nt, Pseudomonas aeruginosa PA01
gcccgagaggguggucgcgcuc

SEQ ID NO: 3459716 - RNA, 18 nt, Pseudomonas aeruginosa PA01
gcccgagcaggcugccga

SEQ ID NO: 3459717 - RNA, 13 nt, Pseudomonas aeruginosa PA01
gcccgagccgcug

SEQ ID NO: 3459718 - RNA, 14 nt, Pseudomonas aeruginosa PA01
gcccgagcgacugg

SEQ ID NO: 3459719 - RNA, 23 nt, Pseudomonas aeruginosa PA01
gcccgagcgacuggaugaacagc

SEQ ID NO: 3459720 - RNA, 19 nt, Pseudomonas aeruginosa PA01
gcccgagcuuugcgcagcc

SEQ ID NO: 3459721 - RNA, 14 nt, Pseudomonas aeruginosa PA01
gcccgaggcgaccu

SEQ ID NO: 3459722 - RNA, 22 nt, Pseudomonas aeruginosa PA01
gcccgaggcgaccuuggccagc

SEQ ID NO: 3459723 - RNA, 21 nt, Pseudomonas aeruginosa PA01
gcccgaggcguuauccgccga

SEQ ID NO: 3459724 - RNA, 13 nt, Pseudomonas aeruginosa PA01
gcccgagggcggc

SEQ ID NO: 3459725 - RNA, 14 nt, Pseudomonas aeruginosa PA01
gcccgagggcggca

SEQ ID NO: 3459726 - RNA, 17 nt, Pseudomonas aeruginosa PA01
gcccgagggcggcaggg

SEQ ID NO: 3459727 - RNA, 19 nt, Pseudomonas aeruginosa PA01
gcccgagggucgccuugac

SEQ ID NO: 3459728 - RNA, 19 nt, Pseudomonas aeruginosa PA01
gcccgaggugucgccgcgg

SEQ ID NO: 3459729 - RNA, 20 nt, Pseudomonas aeruginosa PA01
gcccgaggugucgccgcgga

SEQ ID NO: 3459730 - RNA, 24 nt, Pseudomonas aeruginosa PA01
gcccgaggugucgccgcggacggc

SEQ ID NO: 3459731 - RNA, 21 nt, Pseudomonas aeruginosa PA01
gcccgagucccuugcggcaga

SEQ ID NO: 3459732 - RNA, 14 nt, Pseudomonas aeruginosa PA01
gcccgagugccggc

SEQ ID NO: 3459733 - RNA, 15 nt, Pseudomonas aeruginosa PA01
gcccgagugccggcg

SEQ ID NO: 3459734 - RNA, 19 nt, Pseudomonas aeruginosa PA01
gcccgagugccggcgcguc

SEQ ID NO: 3459735 - RNA, 17 nt, Pseudomonas aeruginosa PA01
gcccgagugcgcccagc

SEQ ID NO: 3459736 - RNA, 18 nt, Pseudomonas aeruginosa PA01
gcccgagugcgcccagca

SEQ ID NO: 3459737 - RNA, 19 nt, Pseudomonas aeruginosa PA01
gcccgagugcgcccagcag

SEQ ID NO: 3459738 - RNA, 20 nt, Pseudomonas aeruginosa PA01
gcccgagugcgcccagcagc

SEQ ID NO: 3459739 - RNA, 15 nt, Pseudomonas aeruginosa PA01
gcccgauaggcgccg

SEQ ID NO: 3459740 - RNA, 17 nt, Pseudomonas aeruginosa PA01
gcccgauaggcgccggc

SEQ ID NO: 3459741 - RNA, 19 nt, Pseudomonas aeruginosa PA01
gcccgauaggcgccggcgc

SEQ ID NO: 3459742 - RNA, 17 nt, Pseudomonas aeruginosa PA01
gcccgaucgccucgucg

SEQ ID NO: 3459743 - RNA, 18 nt, Pseudomonas aeruginosa PA01
gcccgaugaucgagcgca

SEQ ID NO: 3459744 - RNA, 14 nt, Pseudomonas aeruginosa PA01
gcccgaugccgcgc

SEQ ID NO: 3459745 - RNA, 15 nt, Pseudomonas aeruginosa PA01
gcccgaugccgcgcc

SEQ ID NO: 3459746 - RNA, 17 nt, Pseudomonas aeruginosa PA01
gcccgcaaucagcgggc

SEQ ID NO: 3459747 - RNA, 19 nt, Pseudomonas aeruginosa PA01
gcccgcaauccgaccgggg

SEQ ID NO: 3459748 - RNA, 14 nt, Pseudomonas aeruginosa PA01
gcccgcaccacccg

SEQ ID NO: 3459749 - RNA, 18 nt, Pseudomonas aeruginosa PA01
gcccgcaccacccgcugc

SEQ ID NO: 3459750 - RNA, 13 nt, Pseudomonas aeruginosa PA01
gcccgcacgaggc

SEQ ID NO: 3459751 - RNA, 18 nt, Pseudomonas aeruginosa PA01
gcccgcacgaggcgggcu

SEQ ID NO: 3459752 - RNA, 15 nt, Pseudomonas aeruginosa PA01
gcccgcagccacagg

SEQ ID NO: 3459753 - RNA, 16 nt, Pseudomonas aeruginosa PA01
gcccgcggaccgggcg

SEQ ID NO: 3459754 - RNA, 18 nt, Pseudomonas aeruginosa PA01
gcccgcggaccgggcggc

SEQ ID NO: 3459755 - RNA, 21 nt, Pseudomonas aeruginosa PA01
gcccgcggaccgggcggcgcg

SEQ ID NO: 3459756 - RNA, 19 nt, Pseudomonas aeruginosa PA01
gcccgcggaucgcgccguc

SEQ ID NO: 3459757 - RNA, 20 nt, Pseudomonas aeruginosa PA01
gcccgcggaucgcgccgucg

SEQ ID NO: 3459758 - RNA, 16 nt, Pseudomonas aeruginosa PA01
gcccgcggcagcagcc

SEQ ID NO: 3459759 - RNA, 19 nt, Pseudomonas aeruginosa PA01
gcccgcggcaucggccugg

SEQ ID NO: 3459760 - RNA, 12 nt, Pseudomonas aeruginosa PA01
gcccgcggcgag

SEQ ID NO: 3459761 - RNA, 13 nt, Pseudomonas aeruginosa PA01
gcccgcggcgagc

SEQ ID NO: 3459762 - RNA, 16 nt, Pseudomonas aeruginosa PA01
gcccgcggcgagcagc

SEQ ID NO: 3459763 - RNA, 19 nt, Pseudomonas aeruginosa PA01
gcccgcggcgagcagcggc

SEQ ID NO: 3459764 - RNA, 14 nt, Pseudomonas aeruginosa PA01
gcccgcggcggcga

SEQ ID NO: 3459765 - RNA, 18 nt, Pseudomonas aeruginosa PA01
gcccgcggcggcgacgcu

SEQ ID NO: 3459766 - RNA, 22 nt, Pseudomonas aeruginosa PA01
gcccgcggcggcgacgcuggcg

SEQ ID NO: 3459767 - RNA, 12 nt, Pseudomonas aeruginosa PA01
gcccgcgggcag

SEQ ID NO: 3459768 - RNA, 14 nt, Pseudomonas aeruginosa PA01
gcccgcgggcgccu

SEQ ID NO: 3459769 - RNA, 15 nt, Pseudomonas aeruginosa PA01
gcccgcgggcgccuu

SEQ ID NO: 3459770 - RNA, 18 nt, Pseudomonas aeruginosa PA01
gcccgcgguauucuccag

SEQ ID NO: 3459771 - RNA, 19 nt, Pseudomonas aeruginosa PA01
gcccgcgguauucuccagc

SEQ ID NO: 3459772 - RNA, 20 nt, Pseudomonas aeruginosa PA01
gcccgcgguauucuccagca

SEQ ID NO: 3459773 - RNA, 18 nt, Pseudomonas aeruginosa PA01
gcccgcggucacucggcc

SEQ ID NO: 3459774 - RNA, 22 nt, Pseudomonas aeruginosa PA01
gcccgcggucacucggccucgg

SEQ ID NO: 3459775 - RNA, 23 nt, Pseudomonas aeruginosa PA01
gcccgcggucacucggccucggc

SEQ ID NO: 3459776 - RNA, 24 nt, Pseudomonas aeruginosa PA01
gcccgcggucacucggccucggcg

SEQ ID NO: 3459777 - RNA, 18 nt, Pseudomonas aeruginosa PA01
gcccgcgucgcgcgcggc

SEQ ID NO: 3459778 - RNA, 20 nt, Pseudomonas aeruginosa PA01
gcccgcgucgcgcgcggcau

SEQ ID NO: 3459779 - RNA, 23 nt, Pseudomonas aeruginosa PA01
gcccgcgucgcgcgcggcaucca

SEQ ID NO: 3459780 - RNA, 19 nt, Pseudomonas aeruginosa PA01
gcccgcucaagggcuggca

SEQ ID NO: 3459781 - RNA, 22 nt, Pseudomonas aeruginosa PA01
gcccgcucaagggcuggcaggu

SEQ ID NO: 3459782 - RNA, 19 nt, Pseudomonas aeruginosa PA01
gcccgcucaugagauccgc

SEQ ID NO: 3459783 - RNA, 21 nt, Pseudomonas aeruginosa PA01
gcccgcucaugagauccgcca

SEQ ID NO: 3459784 - RNA, 22 nt, Pseudomonas aeruginosa PA01
gcccgcucaugagauccgccag

SEQ ID NO: 3459785 - RNA, 13 nt, Pseudomonas aeruginosa PA01
gcccgcucggggc

SEQ ID NO: 3459786 - RNA, 14 nt, Pseudomonas aeruginosa PA01
gcccgcucggggca

SEQ ID NO: 3459787 - RNA, 13 nt, Pseudomonas aeruginosa PA01
gcccgcugaccgg

SEQ ID NO: 3459788 - RNA, 15 nt, Pseudomonas aeruginosa PA01
gcccgcugaccgggc

SEQ ID NO: 3459789 - RNA, 17 nt, Pseudomonas aeruginosa PA01
gcccgcugaccgggcgg

SEQ ID NO: 3459790 - RNA, 18 nt, Pseudomonas aeruginosa PA01
gcccgcugaccgggcgga

SEQ ID NO: 3459791 - RNA, 21 nt, Pseudomonas aeruginosa PA01
gcccgcugcaugugccaggcc

SEQ ID NO: 3459792 - RNA, 16 nt, Pseudomonas aeruginosa PA01
gcccgcugcgcugcca

SEQ ID NO: 3459793 - RNA, 18 nt, Pseudomonas aeruginosa PA01
gcccgcugcgcugccagc

SEQ ID NO: 3459794 - RNA, 19 nt, Pseudomonas aeruginosa PA01
gcccgcugcgcugccagcg

SEQ ID NO: 3459795 - RNA, 22 nt, Pseudomonas aeruginosa PA01
gcccgcugcgcugccagcgccg

SEQ ID NO: 3459796 - RNA, 23 nt, Pseudomonas aeruginosa PA01
gcccgcugcgcugccagcgccgc

SEQ ID NO: 3459797 - RNA, 12 nt, Pseudomonas aeruginosa PA01
gcccgcugggca

SEQ ID NO: 3459798 - RNA, 17 nt, Pseudomonas aeruginosa PA01
gcccgcuucgagcgggc

SEQ ID NO: 3459799 - RNA, 14 nt, Pseudomonas aeruginosa PA01
gcccgcuucgccau

SEQ ID NO: 3459800 - RNA, 15 nt, Pseudomonas aeruginosa PA01
gcccgcuucgccauc

SEQ ID NO: 3459801 - RNA, 18 nt, Pseudomonas aeruginosa PA01
gcccgcuugcgccgccuc

SEQ ID NO: 3459802 - RNA, 22 nt, Pseudomonas aeruginosa PA01
gcccgcuugcgccgccucgcgc

SEQ ID NO: 3459803 - RNA, 15 nt, Pseudomonas aeruginosa PA01
gcccggagaccgugc

SEQ ID NO: 3459804 - RNA, 19 nt, Pseudomonas aeruginosa PA01
gcccggagaccgugccgcc

SEQ ID NO: 3459805 - RNA, 18 nt, Pseudomonas aeruginosa PA01
gcccggagaucgccgcgc

SEQ ID NO: 3459806 - RNA, 15 nt, Pseudomonas aeruginosa PA01
gcccggagccaacgc

SEQ ID NO: 3459807 - RNA, 17 nt, Pseudomonas aeruginosa PA01
gcccggagccaacgccc

SEQ ID NO: 3459808 - RNA, 20 nt, Pseudomonas aeruginosa PA01
gcccggagccaacgcccggg

SEQ ID NO: 3459809 - RNA, 14 nt, Pseudomonas aeruginosa PA01
gcccggagcgcgag

SEQ ID NO: 3459810 - RNA, 15 nt, Pseudomonas aeruginosa PA01
gcccggagcggcugc

SEQ ID NO: 3459811 - RNA, 18 nt, Pseudomonas aeruginosa PA01
gcccggagcggcugccga

SEQ ID NO: 3459812 - RNA, 18 nt, Pseudomonas aeruginosa PA01
gcccggauagacgccguc

SEQ ID NO: 3459813 - RNA, 20 nt, Pseudomonas aeruginosa PA01
gcccggauuuugggcagcgu

SEQ ID NO: 3459814 - RNA, 17 nt, Pseudomonas aeruginosa PA01
gcccggcaaaugccggg

SEQ ID NO: 3459815 - RNA, 18 nt, Pseudomonas aeruginosa PA01
gcccggcaaaugccgggc

SEQ ID NO: 3459816 - RNA, 19 nt, Pseudomonas aeruginosa PA01
gcccggcaaaugccgggcu

SEQ ID NO: 3459817 - RNA, 16 nt, Pseudomonas aeruginosa PA01
gcccggcaccaccggu

SEQ ID NO: 3459818 - RNA, 14 nt, Pseudomonas aeruginosa PA01
gcccggcaccaggc

SEQ ID NO: 3459819 - RNA, 12 nt, Pseudomonas aeruginosa PA01
gcccggcaccgg

SEQ ID NO: 3459820 - RNA, 15 nt, Pseudomonas aeruginosa PA01
gcccggcaccggggu

SEQ ID NO: 3459821 - RNA, 15 nt, Pseudomonas aeruginosa PA01
gcccggcacgcucca

SEQ ID NO: 3459822 - RNA, 18 nt, Pseudomonas aeruginosa PA01
gcccggcacgcuccaggg

SEQ ID NO: 3459823 - RNA, 15 nt, Pseudomonas aeruginosa PA01
gcccggcacucgccg

SEQ ID NO: 3459824 - RNA, 13 nt, Pseudomonas aeruginosa PA01
gcccggcagaucu

SEQ ID NO: 3459825 - RNA, 13 nt, Pseudomonas aeruginosa PA01
gcccggcagcagg

SEQ ID NO: 3459826 - RNA, 14 nt, Pseudomonas aeruginosa PA01
gcccggcagcaggc

SEQ ID NO: 3459827 - RNA, 16 nt, Pseudomonas aeruginosa PA01
gcccggcagcaggccg

SEQ ID NO: 3459828 - RNA, 17 nt, Pseudomonas aeruginosa PA01
gcccggcagcaggccgc

SEQ ID NO: 3459829 - RNA, 18 nt, Pseudomonas aeruginosa PA01
gcccggcagcaggccgcc

SEQ ID NO: 3459830 - RNA, 20 nt, Pseudomonas aeruginosa PA01
gcccggcagcaggccgccgc

SEQ ID NO: 3459831 - RNA, 11 nt, Pseudomonas aeruginosa PA01
gcccggcagcg

SEQ ID NO: 3459832 - RNA, 14 nt, Pseudomonas aeruginosa PA01
gcccggcagcgccg

SEQ ID NO: 3459833 - RNA, 15 nt, Pseudomonas aeruginosa PA01
gcccggcagcgccgg

SEQ ID NO: 3459834 - RNA, 15 nt, Pseudomonas aeruginosa PA01
gcccggcagcggcug

SEQ ID NO: 3459835 - RNA, 16 nt, Pseudomonas aeruginosa PA01
gcccggcagcggcugg

SEQ ID NO: 3459836 - RNA, 19 nt, Pseudomonas aeruginosa PA01
gcccggcagcggcuggccg

SEQ ID NO: 3459837 - RNA, 21 nt, Pseudomonas aeruginosa PA01
gcccggcagcggcuggccguc

SEQ ID NO: 3459838 - RNA, 23 nt, Pseudomonas aeruginosa PA01
gcccggcagcggcuggccgucga

SEQ ID NO: 3459839 - RNA, 14 nt, Pseudomonas aeruginosa PA01
gcccggcagcuccc

SEQ ID NO: 3459840 - RNA, 22 nt, Pseudomonas aeruginosa PA01
gcccggcagcucccuugccgcc

SEQ ID NO: 3459841 - RNA, 20 nt, Pseudomonas aeruginosa PA01
gcccggcaggcagugccggg

SEQ ID NO: 3459842 - RNA, 23 nt, Pseudomonas aeruginosa PA01
gcccggcaggcagugccgggcgu

SEQ ID NO: 3459843 - RNA, 14 nt, Pseudomonas aeruginosa PA01
gcccggcaggcgca

SEQ ID NO: 3459844 - RNA, 16 nt, Pseudomonas aeruginosa PA01
gcccggcauaggcgcc

SEQ ID NO: 3459845 - RNA, 18 nt, Pseudomonas aeruginosa PA01
gcccggcauaggcgccag

SEQ ID NO: 3459846 - RNA, 21 nt, Pseudomonas aeruginosa PA01
gcccggcauaggcgccagccu

SEQ ID NO: 3459847 - RNA, 16 nt, Pseudomonas aeruginosa PA01
gcccggcaucugccgg

SEQ ID NO: 3459848 - RNA, 20 nt, Pseudomonas aeruginosa PA01
gcccggccaauggccgggcu

SEQ ID NO: 3459849 - RNA, 15 nt, Pseudomonas aeruginosa PA01
gcccggccaggccac

SEQ ID NO: 3459850 - RNA, 18 nt, Pseudomonas aeruginosa PA01
gcccggccaggccacggc

SEQ ID NO: 3459851 - RNA, 20 nt, Pseudomonas aeruginosa PA01
gcccggccaggccacggcgg

SEQ ID NO: 3459852 - RNA, 22 nt, Pseudomonas aeruginosa PA01
gcccggccaggccacggcggaa

SEQ ID NO: 3459853 - RNA, 13 nt, Pseudomonas aeruginosa PA01
gcccggccaggcg

SEQ ID NO: 3459854 - RNA, 14 nt, Pseudomonas aeruginosa PA01
gcccggccaggcga

SEQ ID NO: 3459855 - RNA, 17 nt, Pseudomonas aeruginosa PA01
gcccgggguuggcgcug

SEQ ID NO: 3459856 - RNA, 21 nt, Pseudomonas aeruginosa PA01
gcccgggguuggcgcugacca

SEQ ID NO: 3459857 - RNA, 22 nt, Pseudomonas aeruginosa PA01
gcccgggucacggucagcucgg

SEQ ID NO: 3459858 - RNA, 20 nt, Pseudomonas aeruginosa PA01
gcccgggucgucggucggcc

SEQ ID NO: 3459859 - RNA, 21 nt, Pseudomonas aeruginosa PA01
gcccgggucgucggucggcca

SEQ ID NO: 3459860 - RNA, 22 nt, Pseudomonas aeruginosa PA01
gcccgggucgucggucggccag

SEQ ID NO: 3459861 - RNA, 23 nt, Pseudomonas aeruginosa PA01
gcccgggucgucggucggccagg

SEQ ID NO: 3459862 - RNA, 20 nt, Pseudomonas aeruginosa PA01
gcccggguggauaucgucgg

SEQ ID NO: 3459863 - RNA, 22 nt, Pseudomonas aeruginosa PA01
gcccggguugcccucgcagccg

SEQ ID NO: 3459864 - RNA, 18 nt, Pseudomonas aeruginosa PA01
gcccggguugccguagcg

SEQ ID NO: 3459865 - RNA, 15 nt, Pseudomonas aeruginosa PA01
gcccgguauucagcc

SEQ ID NO: 3459866 - RNA, 17 nt, Pseudomonas aeruginosa PA01
gcccgguauucagccag

SEQ ID NO: 3459867 - RNA, 21 nt, Pseudomonas aeruginosa PA01
gcccgguauucagccagagcc

SEQ ID NO: 3459868 - RNA, 15 nt, Pseudomonas aeruginosa PA01
gcccggucaccaccc

SEQ ID NO: 3459869 - RNA, 21 nt, Pseudomonas aeruginosa PA01
gcccggucaccacccagccgc

SEQ ID NO: 3459870 - RNA, 17 nt, Pseudomonas aeruginosa PA01
gcccggucacgccggga

SEQ ID NO: 3459871 - RNA, 21 nt, Pseudomonas aeruginosa PA01
gcccggucagcuucgccgccc

SEQ ID NO: 3459872 - RNA, 22 nt, Pseudomonas aeruginosa PA01
gcccggucagcuucgccgcccu

SEQ ID NO: 3459873 - RNA, 23 nt, Pseudomonas aeruginosa PA01
gcccggucagcuucgccgcccug

SEQ ID NO: 3459874 - RNA, 24 nt, Pseudomonas aeruginosa PA01
gcccggucagcuucgccgcccugg

SEQ ID NO: 3459875 - RNA, 13 nt, Pseudomonas aeruginosa PA01
gcccgguccaacc

SEQ ID NO: 3459876 - RNA, 14 nt, Pseudomonas aeruginosa PA01
gcccgguccgucca

SEQ ID NO: 3459877 - RNA, 23 nt, Pseudomonas aeruginosa PA01
gcccgguccguccagcgcgcccg

SEQ ID NO: 3459878 - RNA, 14 nt, Pseudomonas aeruginosa PA01
gcccggucuagccg

SEQ ID NO: 3459879 - RNA, 19 nt, Pseudomonas aeruginosa PA01
gcccggucuagccgggccu

SEQ ID NO: 3459880 - RNA, 19 nt, Pseudomonas aeruginosa PA01
gcccggucuagcgccccgg

SEQ ID NO: 3459881 - RNA, 22 nt, Pseudomonas aeruginosa PA01
gcccggucuagcgccccggccg

SEQ ID NO: 3459882 - RNA, 14 nt, Pseudomonas aeruginosa PA01
gcccggucucagcc

SEQ ID NO: 3459883 - RNA, 19 nt, Pseudomonas aeruginosa PA01
gcccgguggaauaccgcug

SEQ ID NO: 3459884 - RNA, 21 nt, Pseudomonas aeruginosa PA01
gcccgguggaauaccgcugcg

SEQ ID NO: 3459885 - RNA, 22 nt, Pseudomonas aeruginosa PA01
gcccgguggccuccugcaacgc

SEQ ID NO: 3459886 - RNA, 19 nt, Pseudomonas aeruginosa PA01
gcccgguggggcgggcgaa

SEQ ID NO: 3459887 - RNA, 21 nt, Pseudomonas aeruginosa PA01
gcccgguggggcgggcgaagc

SEQ ID NO: 3459888 - RNA, 19 nt, Pseudomonas aeruginosa PA01
gcccggugucgacgacgaa

SEQ ID NO: 3459889 - RNA, 21 nt, Pseudomonas aeruginosa PA01
gcccgguucagcgggacagcu

SEQ ID NO: 3459890 - RNA, 20 nt, Pseudomonas aeruginosa PA01
gcccgguugagauccuggcc

SEQ ID NO: 3459891 - RNA, 15 nt, Pseudomonas aeruginosa PA01
gcccgguugccuucg

SEQ ID NO: 3459892 - RNA, 16 nt, Pseudomonas aeruginosa PA01
gcccgguugccuucgu

SEQ ID NO: 3459893 - RNA, 18 nt, Pseudomonas aeruginosa PA01
gcccgguugccuucgucg

SEQ ID NO: 3459894 - RNA, 18 nt, Pseudomonas aeruginosa PA01
gcccgguuggccaggacc

SEQ ID NO: 3459895 - RNA, 19 nt, Pseudomonas aeruginosa PA01
gcccgguuggccaggacca

SEQ ID NO: 3459896 - RNA, 21 nt, Pseudomonas aeruginosa PA01
gcccguaccaagcgagacgcc

SEQ ID NO: 3459897 - RNA, 14 nt, Pseudomonas aeruginosa PA01
gcccguagggcgaa

SEQ ID NO: 3459898 - RNA, 20 nt, Pseudomonas aeruginosa PA01
gcccguagucguucagcgcc

SEQ ID NO: 3459899 - RNA, 22 nt, Pseudomonas aeruginosa PA01
gcccguagucguucagcgccuc

SEQ ID NO: 3459900 - RNA, 20 nt, Pseudomonas aeruginosa PA01
gcccguauggcgggccuugc

SEQ ID NO: 3459901 - RNA, 22 nt, Pseudomonas aeruginosa PA01
gcccguccgucccacaggccgg

SEQ ID NO: 3459902 - RNA, 23 nt, Pseudomonas aeruginosa PA01
gcccguccgucccacaggccggc

SEQ ID NO: 3459903 - RNA, 22 nt, Pseudomonas aeruginosa PA01
gcccguccuccaaagccuggag

SEQ ID NO: 3459904 - RNA, 12 nt, Pseudomonas aeruginosa PA01
gcccgucgaagc

SEQ ID NO: 3459905 - RNA, 17 nt, Pseudomonas aeruginosa PA01
gcccgucgaagccaggc

SEQ ID NO: 3459906 - RNA, 15 nt, Pseudomonas aeruginosa PA01
gcccgucgaccauca

SEQ ID NO: 3459907 - RNA, 23 nt, Pseudomonas aeruginosa PA01
gcccgucgaccaucaccagcgcc

SEQ ID NO: 3459908 - RNA, 15 nt, Pseudomonas aeruginosa PA01
gcccgucgcgccggc

SEQ ID NO: 3459909 - RNA, 18 nt, Pseudomonas aeruginosa PA01
gcccgucgcgccggccau

SEQ ID NO: 3459910 - RNA, 14 nt, Pseudomonas aeruginosa PA01
gcccgucgcgcgcc

SEQ ID NO: 3459911 - RNA, 15 nt, Pseudomonas aeruginosa PA01
gcccgucgcgcgccg

SEQ ID NO: 3459912 - RNA, 17 nt, Pseudomonas aeruginosa PA01
gcccgucgcgcgccgga

SEQ ID NO: 3459913 - RNA, 20 nt, Pseudomonas aeruginosa PA01
gcccgucgcgcgccggagcc

SEQ ID NO: 3459914 - RNA, 13 nt, Pseudomonas aeruginosa PA01
gcccgucggccuc

SEQ ID NO: 3459915 - RNA, 19 nt, Pseudomonas aeruginosa PA01
gcccgucggccucgccgau

SEQ ID NO: 3459916 - RNA, 12 nt, Pseudomonas aeruginosa PA01
gcccgucgucgu

SEQ ID NO: 3459917 - RNA, 17 nt, Pseudomonas aeruginosa PA01
gcccgucgucguggcga

SEQ ID NO: 3459918 - RNA, 17 nt, Pseudomonas aeruginosa PA01
gcccgucuagcgcaggc

SEQ ID NO: 3459919 - RNA, 15 nt, Pseudomonas aeruginosa PA01
gcccgugcccguccu

SEQ ID NO: 3459920 - RNA, 12 nt, Pseudomonas aeruginosa PA01
gcccgugccgac

SEQ ID NO: 3459921 - RNA, 15 nt, Pseudomonas aeruginosa PA01
gcccgugccucggcg

SEQ ID NO: 3459922 - RNA, 14 nt, Pseudomonas aeruginosa PA01
gcccgugcggcacg

SEQ ID NO: 3459923 - RNA, 16 nt, Pseudomonas aeruginosa PA01
gcccgugcggcacgcu

SEQ ID NO: 3459924 - RNA, 15 nt, Pseudomonas aeruginosa PA01
gcccguggcagguga

SEQ ID NO: 3459925 - RNA, 14 nt, Pseudomonas aeruginosa PA01
gcccguggcgcgga

SEQ ID NO: 3459926 - RNA, 20 nt, Pseudomonas aeruginosa PA01
gcccguggcgcggacgggcc

SEQ ID NO: 3459927 - RNA, 22 nt, Pseudomonas aeruginosa PA01
gcccguggcuggggccggccug

SEQ ID NO: 3459928 - RNA, 22 nt, Pseudomonas aeruginosa PA01
gcccgugggaucgccacgccgg

SEQ ID NO: 3459929 - RNA, 21 nt, Pseudomonas aeruginosa PA01
gcccgugggguauuccaggcg

SEQ ID NO: 3459930 - RNA, 23 nt, Pseudomonas aeruginosa PA01
gcccgugggguauuccaggcgaa

SEQ ID NO: 3459931 - RNA, 18 nt, Pseudomonas aeruginosa PA01
gcccgugguagucgagcc

SEQ ID NO: 3459932 - RNA, 20 nt, Pseudomonas aeruginosa PA01
gcccgugguagucgagccgg

SEQ ID NO: 3459933 - RNA, 21 nt, Pseudomonas aeruginosa PA01
gcccgugguagucgagccgga

SEQ ID NO: 3459934 - RNA, 12 nt, Pseudomonas aeruginosa PA01
gcccgugucgcc

SEQ ID NO: 3459935 - RNA, 13 nt, Pseudomonas aeruginosa PA01
gcccgugucgccu

SEQ ID NO: 3459936 - RNA, 20 nt, Pseudomonas aeruginosa PA01
gcccgugucgccuuccggca

SEQ ID NO: 3459937 - RNA, 21 nt, Pseudomonas aeruginosa PA01
gcccgugucgccuuccggcag

SEQ ID NO: 3459938 - RNA, 16 nt, Pseudomonas aeruginosa PA01
gcccguguucggccag

SEQ ID NO: 3459939 - RNA, 22 nt, Pseudomonas aeruginosa PA01
gcccguguucggccagccggcg

SEQ ID NO: 3459940 - RNA, 23 nt, Pseudomonas aeruginosa PA01
gcccguguucggccagccggcgc

SEQ ID NO: 3459941 - RNA, 16 nt, Pseudomonas aeruginosa PA01
gcccguuccaccgccu

SEQ ID NO: 3459942 - RNA, 22 nt, Pseudomonas aeruginosa PA01
gcccguuccaccgccuggacca

SEQ ID NO: 3459943 - RNA, 22 nt, Pseudomonas aeruginosa PA01
gcccguucgaucaauugccggu

SEQ ID NO: 3459944 - RNA, 17 nt, Pseudomonas aeruginosa PA01
gcccguugcgguagugc

SEQ ID NO: 3459945 - RNA, 17 nt, Pseudomonas aeruginosa PA01
gcccuacaaugauggcc

SEQ ID NO: 3459946 - RNA, 20 nt, Pseudomonas aeruginosa PA01
gcccuacaaugauggcccuu

SEQ ID NO: 3459947 - RNA, 16 nt, Pseudomonas aeruginosa PA01
gcccuacccgacaggc

SEQ ID NO: 3459948 - RNA, 22 nt, Pseudomonas aeruginosa PA01
gcccuacccgacaggcagcgcc

SEQ ID NO: 3459949 - RNA, 22 nt, Pseudomonas aeruginosa PA01
gcccuaccgcccacccugcgcg

SEQ ID NO: 3459950 - RNA, 22 nt, Pseudomonas aeruginosa PA01
gcccuacgcaacccgcccggcu

SEQ ID NO: 3459951 - RNA, 19 nt, Pseudomonas aeruginosa PA01
gcccuacggggcgugucga

SEQ ID NO: 3459952 - RNA, 20 nt, Pseudomonas aeruginosa PA01
gcccuacgggggcgugucga

SEQ ID NO: 3459953 - RNA, 15 nt, Pseudomonas aeruginosa PA01
gcccuaggcgacccg

SEQ ID NO: 3459954 - RNA, 19 nt, Pseudomonas aeruginosa PA01
gcccuaggcgacccggcau

SEQ ID NO: 3459955 - RNA, 19 nt, Pseudomonas aeruginosa PA01
gcccucaagucuccagcga

SEQ ID NO: 3459956 - RNA, 15 nt, Pseudomonas aeruginosa PA01
gcccugcaacaggac

SEQ ID NO: 3459957 - RNA, 16 nt, Pseudomonas aeruginosa PA01
gcccugcaacaggacc

SEQ ID NO: 3459958 - RNA, 17 nt, Pseudomonas aeruginosa PA01
gcccugcaccuugggau

SEQ ID NO: 3459959 - RNA, 23 nt, Pseudomonas aeruginosa PA01
gcccugcaccuugggaucgucga

SEQ ID NO: 3459960 - RNA, 14 nt, Pseudomonas aeruginosa PA01
gcccugcagcgcca

SEQ ID NO: 3459961 - RNA, 13 nt, Pseudomonas aeruginosa PA01
gcccugcagcgcg

SEQ ID NO: 3459962 - RNA, 13 nt, Pseudomonas aeruginosa PA01
gcccugcaggccg

SEQ ID NO: 3459963 - RNA, 15 nt, Pseudomonas aeruginosa PA01
gcccugcaggccgaa

SEQ ID NO: 3459964 - RNA, 21 nt, Pseudomonas aeruginosa PA01
gcccugcaggccgaauccgcc

SEQ ID NO: 3459965 - RNA, 22 nt, Pseudomonas aeruginosa PA01
gcccugcaggccgaauccgccg

SEQ ID NO: 3459966 - RNA, 21 nt, Pseudomonas aeruginosa PA01
gcccugccacuugcgggugcg

SEQ ID NO: 3459967 - RNA, 21 nt, Pseudomonas aeruginosa PA01
gcccugccagaggaucggcca

SEQ ID NO: 3459968 - RNA, 22 nt, Pseudomonas aeruginosa PA01
gcccugccagaggaucggccaa

SEQ ID NO: 3459969 - RNA, 14 nt, Pseudomonas aeruginosa PA01
gcccugccagcggg

SEQ ID NO: 3459970 - RNA, 13 nt, Pseudomonas aeruginosa PA01
gcccugccccuuc

SEQ ID NO: 3459971 - RNA, 17 nt, Pseudomonas aeruginosa PA01
gcccugccccuucggcu

SEQ ID NO: 3459972 - RNA, 13 nt, Pseudomonas aeruginosa PA01
gcccugcccggug

SEQ ID NO: 3459973 - RNA, 14 nt, Pseudomonas aeruginosa PA01
gcccugccggcgca

SEQ ID NO: 3459974 - RNA, 15 nt, Pseudomonas aeruginosa PA01
gcccugccggcgcag

SEQ ID NO: 3459975 - RNA, 16 nt, Pseudomonas aeruginosa PA01
gcccugccggcgcaga

SEQ ID NO: 3459976 - RNA, 18 nt, Pseudomonas aeruginosa PA01
gcccugccggcgcagauc

SEQ ID NO: 3459977 - RNA, 18 nt, Pseudomonas aeruginosa PA01
gcccugcgcagcuaggcg

SEQ ID NO: 3459978 - RNA, 14 nt, Pseudomonas aeruginosa PA01
gcccugcgccagca

SEQ ID NO: 3459979 - RNA, 15 nt, Pseudomonas aeruginosa PA01
gcccugcgcgauccc

SEQ ID NO: 3459980 - RNA, 19 nt, Pseudomonas aeruginosa PA01
gcccugcgcgaucccccgc

SEQ ID NO: 3459981 - RNA, 16 nt, Pseudomonas aeruginosa PA01
gcccugcgcgcgcguu

SEQ ID NO: 3459982 - RNA, 23 nt, Pseudomonas aeruginosa PA01
gcccugcgcgcgcguuucagcgc

SEQ ID NO: 3459983 - RNA, 17 nt, Pseudomonas aeruginosa PA01
gcccugcggcaggcgcc

SEQ ID NO: 3459984 - RNA, 18 nt, Pseudomonas aeruginosa PA01
gcccugcggcaggcgcca

SEQ ID NO: 3459985 - RNA, 14 nt, Pseudomonas aeruginosa PA01
gcccugcgucgcag

SEQ ID NO: 3459986 - RNA, 23 nt, Pseudomonas aeruginosa PA01
gcccugcgucgcagagacgcagc

SEQ ID NO: 3459987 - RNA, 17 nt, Pseudomonas aeruginosa PA01
gcccugcuccuccaggc

SEQ ID NO: 3459988 - RNA, 13 nt, Pseudomonas aeruginosa PA01
gcccugcucgccg

SEQ ID NO: 3459989 - RNA, 14 nt, Pseudomonas aeruginosa PA01
gcccugcucgccgg

SEQ ID NO: 3459990 - RNA, 18 nt, Pseudomonas aeruginosa PA01
gcccugcucgccggcgcg

SEQ ID NO: 3459991 - RNA, 22 nt, Pseudomonas aeruginosa PA01
gcccugcucgccggcgcgggcg

SEQ ID NO: 3459992 - RNA, 17 nt, Pseudomonas aeruginosa PA01
gcccugcucuuccagcg

SEQ ID NO: 3459993 - RNA, 20 nt, Pseudomonas aeruginosa PA01
gcccugcucuuccagcgggc

SEQ ID NO: 3459994 - RNA, 23 nt, Pseudomonas aeruginosa PA01
gcccugcucuuccagcgggcgga

SEQ ID NO: 3459995 - RNA, 12 nt, Pseudomonas aeruginosa PA01
gcccugcugcuc

SEQ ID NO: 3459996 - RNA, 18 nt, Pseudomonas aeruginosa PA01
gcccugcugcucgccaug

SEQ ID NO: 3459997 - RNA, 13 nt, Pseudomonas aeruginosa PA01
gcccugcuggcgc

SEQ ID NO: 3459998 - RNA, 14 nt, Pseudomonas aeruginosa PA01
gcccugcuggcgca

SEQ ID NO: 3459999 - RNA, 15 nt, Pseudomonas aeruginosa PA01
gcccugcuggcgcag

SEQ ID NO: 3460000 - RNA, 20 nt, Pseudomonas aeruginosa PA01
gcccugcuggcgcagccagg

SEQ ID NO: 3460001 - RNA, 24 nt, Pseudomonas aeruginosa PA01
gcccugcuggcgcagccaggcgau

SEQ ID NO: 3460002 - RNA, 21 nt, Pseudomonas aeruginosa PA01
gcccugcuucgaacgugcgcg

SEQ ID NO: 3460003 - RNA, 18 nt, Pseudomonas aeruginosa PA01
gcccugcuuggccagcgc

SEQ ID NO: 3460004 - RNA, 19 nt, Pseudomonas aeruginosa PA01
gcccuggaaaggccucggc

SEQ ID NO: 3460005 - RNA, 21 nt, Pseudomonas aeruginosa PA01
gcccuggaaaggccucggcga

SEQ ID NO: 3460006 - RNA, 15 nt, Pseudomonas aeruginosa PA01
gcccuggaagccggc

SEQ ID NO: 3460007 - RNA, 19 nt, Pseudomonas aeruginosa PA01
gcccuggaagccggcaggg

SEQ ID NO: 3460008 - RNA, 18 nt, Pseudomonas aeruginosa PA01
gcccuggauaucugggcc

SEQ ID NO: 3460009 - RNA, 19 nt, Pseudomonas aeruginosa PA01
gcccuggauaucugggcca

SEQ ID NO: 3460010 - RNA, 20 nt, Pseudomonas aeruginosa PA01
gcccuggcagacgcugcucg

SEQ ID NO: 3460011 - RNA, 14 nt, Pseudomonas aeruginosa PA01
gcccuggccgacgc

SEQ ID NO: 3460012 - RNA, 15 nt, Pseudomonas aeruginosa PA01
gcccuggccgcugcc

SEQ ID NO: 3460013 - RNA, 19 nt, Pseudomonas aeruginosa PA01
gcccuggccgcugccgcuc

SEQ ID NO: 3460014 - RNA, 13 nt, Pseudomonas aeruginosa PA01
gcccuggccggca

SEQ ID NO: 3460015 - RNA, 14 nt, Pseudomonas aeruginosa PA01
gcccuggccggcac

SEQ ID NO: 3460016 - RNA, 15 nt, Pseudomonas aeruginosa PA01
gcccuggccgucggc

SEQ ID NO: 3460017 - RNA, 18 nt, Pseudomonas aeruginosa PA01
gcccuggccgucggccug

SEQ ID NO: 3460018 - RNA, 15 nt, Pseudomonas aeruginosa PA01
gcccuggccucggcg

SEQ ID NO: 3460019 - RNA, 16 nt, Pseudomonas aeruginosa PA01
gcccuggccucggcgu

SEQ ID NO: 3460020 - RNA, 15 nt, Pseudomonas aeruginosa PA01
gcccuggccuuggcc

SEQ ID NO: 3460021 - RNA, 20 nt, Pseudomonas aeruginosa PA01
gcccuggcgcagacaggccu

SEQ ID NO: 3460022 - RNA, 14 nt, Pseudomonas aeruginosa PA01
gcccuggcgcaggc

SEQ ID NO: 3460023 - RNA, 16 nt, Pseudomonas aeruginosa PA01
gcccuggcgcaggcgg

SEQ ID NO: 3460024 - RNA, 15 nt, Pseudomonas aeruginosa PA01
gcccuggcgccagcg

SEQ ID NO: 3460025 - RNA, 18 nt, Pseudomonas aeruginosa PA01
gcccuggcgccagcguug

SEQ ID NO: 3460026 - RNA, 12 nt, Pseudomonas aeruginosa PA01
gcccuggcgcgc

SEQ ID NO: 3460027 - RNA, 13 nt, Pseudomonas aeruginosa PA01
gcccuggcgcgcg

SEQ ID NO: 3460028 - RNA, 16 nt, Pseudomonas aeruginosa PA01
gcccuggcgcgcgccc

SEQ ID NO: 3460029 - RNA, 23 nt, Pseudomonas aeruginosa PA01
gcccuggcgcggcaaagugcggu

SEQ ID NO: 3460030 - RNA, 17 nt, Pseudomonas aeruginosa PA01
gcccuggcguggccggc

SEQ ID NO: 3460031 - RNA, 18 nt, Pseudomonas aeruginosa PA01
gcccuggcguggccggcg

SEQ ID NO: 3460032 - RNA, 19 nt, Pseudomonas aeruginosa PA01
gcccuggcguggccggcga

SEQ ID NO: 3460033 - RNA, 18 nt, Pseudomonas aeruginosa PA01
gcccuggcucuugccgcg

SEQ ID NO: 3460034 - RNA, 21 nt, Pseudomonas aeruginosa PA01
gcccuggcuuuccagggccug

SEQ ID NO: 3460035 - RNA, 19 nt, Pseudomonas aeruginosa PA01
gcccugggacaggcguccc

SEQ ID NO: 3460036 - RNA, 19 nt, Pseudomonas aeruginosa PA01
gcccugggccccggccggc

SEQ ID NO: 3460037 - RNA, 21 nt, Pseudomonas aeruginosa PA01
gcccugggccccggccggcag

SEQ ID NO: 3460038 - RNA, 13 nt, Pseudomonas aeruginosa PA01
gcccugggccggc

SEQ ID NO: 3460039 - RNA, 14 nt, Pseudomonas aeruginosa PA01
gcccugggccggcg

SEQ ID NO: 3460040 - RNA, 20 nt, Pseudomonas aeruginosa PA01
gcccugggccggcgccagca

SEQ ID NO: 3460041 - RNA, 21 nt, Pseudomonas aeruginosa PA01
gcccugggccggcgccagcag

SEQ ID NO: 3460042 - RNA, 23 nt, Pseudomonas aeruginosa PA01
gcccugggccggcgccagcaggc

SEQ ID NO: 3460043 - RNA, 17 nt, Pseudomonas aeruginosa PA01
gcccugggcgaacagca

SEQ ID NO: 3460044 - RNA, 20 nt, Pseudomonas aeruginosa PA01
gcccugggcgaacagcaccc

SEQ ID NO: 3460045 - RNA, 23 nt, Pseudomonas aeruginosa PA01
gcccugggcgaacagcacccagg

SEQ ID NO: 3460046 - RNA, 11 nt, Pseudomonas aeruginosa PA01
gcccugggcgc

SEQ ID NO: 3460047 - RNA, 15 nt, Pseudomonas aeruginosa PA01
gcccugggcgccgcc

SEQ ID NO: 3460048 - RNA, 18 nt, Pseudomonas aeruginosa PA01
gcccugggcgccgccggu

SEQ ID NO: 3460049 - RNA, 15 nt, Pseudomonas aeruginosa PA01
gcccugggcggccuc

SEQ ID NO: 3460050 - RNA, 16 nt, Pseudomonas aeruginosa PA01
gcccugggcggccucg

SEQ ID NO: 3460051 - RNA, 17 nt, Pseudomonas aeruginosa PA01
gcccugggcggccucgu

SEQ ID NO: 3460052 - RNA, 14 nt, Pseudomonas aeruginosa PA01
gcccugggcggcga

SEQ ID NO: 3460053 - RNA, 17 nt, Pseudomonas aeruginosa PA01
gcccugggcggcgaccu

SEQ ID NO: 3460054 - RNA, 22 nt, Pseudomonas aeruginosa PA01
gcccugggguuucugcuggcca

SEQ ID NO: 3460055 - RNA, 15 nt, Pseudomonas aeruginosa PA01
gcccuggguggucug

SEQ ID NO: 3460056 - RNA, 20 nt, Pseudomonas aeruginosa PA01
gcccuggguggucugcacgg

SEQ ID NO: 3460057 - RNA, 21 nt, Pseudomonas aeruginosa PA01
gcccuggguggucugcacggc

SEQ ID NO: 3460058 - RNA, 21 nt, Pseudomonas aeruginosa PA01
gcccugguaggugcgcuggcg

SEQ ID NO: 3460059 - RNA, 18 nt, Pseudomonas aeruginosa PA01
gccgaacgguagguagcg

SEQ ID NO: 3460060 - RNA, 23 nt, Pseudomonas aeruginosa PA01
gccgaacgguagguagcguugcg

SEQ ID NO: 3460061 - RNA, 15 nt, Pseudomonas aeruginosa PA01
gccgaacuccgccag

SEQ ID NO: 3460062 - RNA, 16 nt, Pseudomonas aeruginosa PA01
gccgaacuccgccagc

SEQ ID NO: 3460063 - RNA, 17 nt, Pseudomonas aeruginosa PA01
gccgaacuccgccagca

SEQ ID NO: 3460064 - RNA, 20 nt, Pseudomonas aeruginosa PA01
gccgaacuccgccagcacca

SEQ ID NO: 3460065 - RNA, 22 nt, Pseudomonas aeruginosa PA01
gccgaacuccggugucaggccg

SEQ ID NO: 3460066 - RNA, 23 nt, Pseudomonas aeruginosa PA01
gccgaacuccggugucaggccga

SEQ ID NO: 3460067 - RNA, 24 nt, Pseudomonas aeruginosa PA01
gccgaacuccggugucaggccgag

SEQ ID NO: 3460068 - RNA, 15 nt, Pseudomonas aeruginosa PA01
gccgaacucuggcgg

SEQ ID NO: 3460069 - RNA, 16 nt, Pseudomonas aeruginosa PA01
gccgaacucuggcggc

SEQ ID NO: 3460070 - RNA, 18 nt, Pseudomonas aeruginosa PA01
gccgaacucuggcggcgu

SEQ ID NO: 3460071 - RNA, 14 nt, Pseudomonas aeruginosa PA01
gccgaacugcaggg

SEQ ID NO: 3460072 - RNA, 16 nt, Pseudomonas aeruginosa PA01
gccgaacugcagggcg

SEQ ID NO: 3460073 - RNA, 19 nt, Pseudomonas aeruginosa PA01
gccgaacugcagggcgucg

SEQ ID NO: 3460074 - RNA, 23 nt, Pseudomonas aeruginosa PA01
gccgaacugcagggcgucgccgg

SEQ ID NO: 3460075 - RNA, 15 nt, Pseudomonas aeruginosa PA01
gccgaacuucuccgc

SEQ ID NO: 3460076 - RNA, 16 nt, Pseudomonas aeruginosa PA01
gccgaacuucuccgcc

SEQ ID NO: 3460077 - RNA, 19 nt, Pseudomonas aeruginosa PA01
gccgaacuucuccgccacc

SEQ ID NO: 3460078 - RNA, 17 nt, Pseudomonas aeruginosa PA01
gccgaagaacaccacgc

SEQ ID NO: 3460079 - RNA, 18 nt, Pseudomonas aeruginosa PA01
gccgaagaccaccauggu

SEQ ID NO: 3460080 - RNA, 17 nt, Pseudomonas aeruginosa PA01
gccgaagacgccugucg

SEQ ID NO: 3460081 - RNA, 15 nt, Pseudomonas aeruginosa PA01
gccgaagaggcccuc

SEQ ID NO: 3460082 - RNA, 19 nt, Pseudomonas aeruginosa PA01
gccgaagaggcccucggcg

SEQ ID NO: 3460083 - RNA, 20 nt, Pseudomonas aeruginosa PA01
gccgaagauacccagcgggc

SEQ ID NO: 3460084 - RNA, 20 nt, Pseudomonas aeruginosa PA01
gccgaagauccgcuccaggc

SEQ ID NO: 3460085 - RNA, 17 nt, Pseudomonas aeruginosa PA01
gccgaagcccgugucgc

SEQ ID NO: 3460086 - RNA, 15 nt, Pseudomonas aeruginosa PA01
gccgaagccgacgcc

SEQ ID NO: 3460087 - RNA, 16 nt, Pseudomonas aeruginosa PA01
gccgaagccgacgccg

SEQ ID NO: 3460088 - RNA, 17 nt, Pseudomonas aeruginosa PA01
gccgaagccgacgccga

SEQ ID NO: 3460089 - RNA, 20 nt, Pseudomonas aeruginosa PA01
gccgaagccgacgccgagca

SEQ ID NO: 3460090 - RNA, 14 nt, Pseudomonas aeruginosa PA01
gccgaagccgccgg

SEQ ID NO: 3460091 - RNA, 16 nt, Pseudomonas aeruginosa PA01
gccgaagccgccggga

SEQ ID NO: 3460092 - RNA, 12 nt, Pseudomonas aeruginosa PA01
gccgaagcgcuc

SEQ ID NO: 3460093 - RNA, 22 nt, Pseudomonas aeruginosa PA01
gccgaagcgcucggucagcucc

SEQ ID NO: 3460094 - RNA, 13 nt, Pseudomonas aeruginosa PA01
gccgaagcggggc

SEQ ID NO: 3460095 - RNA, 19 nt, Pseudomonas aeruginosa PA01
gccgaagcgugggcggccg

SEQ ID NO: 3460096 - RNA, 20 nt, Pseudomonas aeruginosa PA01
gccgaagcgugggcggccgg

SEQ ID NO: 3460097 - RNA, 23 nt, Pseudomonas aeruginosa PA01
gccgaagcgugggcggccggcca

SEQ ID NO: 3460098 - RNA, 15 nt, Pseudomonas aeruginosa PA01
gccgaaggaaucacc

SEQ ID NO: 3460099 - RNA, 15 nt, Pseudomonas aeruginosa PA01
gccgaaggacaggcc

SEQ ID NO: 3460100 - RNA, 16 nt, Pseudomonas aeruginosa PA01
gccgaaggacaggccg

SEQ ID NO: 3460101 - RNA, 17 nt, Pseudomonas aeruginosa PA01
gccgaaggacaggccgu

SEQ ID NO: 3460102 - RNA, 16 nt, Pseudomonas aeruginosa PA01
gccgaaggccagcuug

SEQ ID NO: 3460103 - RNA, 13 nt, Pseudomonas aeruginosa PA01
gccgaaggccagg

SEQ ID NO: 3460104 - RNA, 14 nt, Pseudomonas aeruginosa PA01
gccgaaggccagga

SEQ ID NO: 3460105 - RNA, 15 nt, Pseudomonas aeruginosa PA01
gccgaaggccaggcc

SEQ ID NO: 3460106 - RNA, 16 nt, Pseudomonas aeruginosa PA01
gccgaaggccaggccg

SEQ ID NO: 3460107 - RNA, 22 nt, Pseudomonas aeruginosa PA01
gccgaaggccaggccggcgccu

SEQ ID NO: 3460108 - RNA, 15 nt, Pseudomonas aeruginosa PA01
gccgaaggccuggcc

SEQ ID NO: 3460109 - RNA, 20 nt, Pseudomonas aeruginosa PA01
gccgaaggccuggccguugc

SEQ ID NO: 3460110 - RNA, 15 nt, Pseudomonas aeruginosa PA01
gccgaaggcgucagu

SEQ ID NO: 3460111 - RNA, 15 nt, Pseudomonas aeruginosa PA01
gccgaaggcgugggc

SEQ ID NO: 3460112 - RNA, 19 nt, Pseudomonas aeruginosa PA01
gccgaaggcgugggcgccg

SEQ ID NO: 3460113 - RNA, 20 nt, Pseudomonas aeruginosa PA01
gccgaaggcgugggcgccgg

SEQ ID NO: 3460114 - RNA, 17 nt, Pseudomonas aeruginosa PA01
gccgaagggaaacacca

SEQ ID NO: 3460115 - RNA, 20 nt, Pseudomonas aeruginosa PA01
gccgaagggaaacaccaggc

SEQ ID NO: 3460116 - RNA, 21 nt, Pseudomonas aeruginosa PA01
gccgaagggaaacaccaggcc

SEQ ID NO: 3460117 - RNA, 24 nt, Pseudomonas aeruginosa PA01
gccgaagggaaacaccaggccgau

SEQ ID NO: 3460118 - RNA, 14 nt, Pseudomonas aeruginosa PA01
gccgaagggccgca

SEQ ID NO: 3460119 - RNA, 18 nt, Pseudomonas aeruginosa PA01
gccgaagggccgcagguu

SEQ ID NO: 3460120 - RNA, 18 nt, Pseudomonas aeruginosa PA01
gccgaaggugcaggccgc

SEQ ID NO: 3460121 - RNA, 20 nt, Pseudomonas aeruginosa PA01
gccgaaggugcaggccgcgc

SEQ ID NO: 3460122 - RNA, 22 nt, Pseudomonas aeruginosa PA01
gccgaaggugcaggccgcgcga

SEQ ID NO: 3460123 - RNA, 23 nt, Pseudomonas aeruginosa PA01
gccgaaggugcaggccgcgcgau

SEQ ID NO: 3460124 - RNA, 16 nt, Pseudomonas aeruginosa PA01
gccgaaguagccggcg

SEQ ID NO: 3460125 - RNA, 13 nt, Pseudomonas aeruginosa PA01
gccgaaguccugc

SEQ ID NO: 3460126 - RNA, 21 nt, Pseudomonas aeruginosa PA01
gccgaaguccugcaacagggc

SEQ ID NO: 3460127 - RNA, 12 nt, Pseudomonas aeruginosa PA01
gccgaagucggc

SEQ ID NO: 3460128 - RNA, 16 nt, Pseudomonas aeruginosa PA01
gccgaagucggcgagc

SEQ ID NO: 3460129 - RNA, 22 nt, Pseudomonas aeruginosa PA01
gccgaagucggcgagccggcgc

SEQ ID NO: 3460130 - RNA, 16 nt, Pseudomonas aeruginosa PA01
gccgaaguucuucagc

SEQ ID NO: 3460131 - RNA, 19 nt, Pseudomonas aeruginosa PA01
gccgaaguucuucagcagc

SEQ ID NO: 3460132 - RNA, 16 nt, Pseudomonas aeruginosa PA01
gccgaaguuguagaug

SEQ ID NO: 3460133 - RNA, 16 nt, Pseudomonas aeruginosa PA01
gccgaauauuucccau

SEQ ID NO: 3460134 - RNA, 15 nt, Pseudomonas aeruginosa PA01
gccgaauccaggccg

SEQ ID NO: 3460135 - RNA, 18 nt, Pseudomonas aeruginosa PA01
gccgaauccaggccgacg

SEQ ID NO: 3460136 - RNA, 17 nt, Pseudomonas aeruginosa PA01
gccgaauccgccggcga

SEQ ID NO: 3460137 - RNA, 16 nt, Pseudomonas aeruginosa PA01
gccgaauccuccagcc

SEQ ID NO: 3460138 - RNA, 20 nt, Pseudomonas aeruginosa PA01
gccgaauccuccagccggcg

SEQ ID NO: 3460139 - RNA, 17 nt, Pseudomonas aeruginosa PA01
gccgaaucgaacagggc

SEQ ID NO: 3460140 - RNA, 18 nt, Pseudomonas aeruginosa PA01
gccgaaucgaacagggcg

SEQ ID NO: 3460141 - RNA, 19 nt, Pseudomonas aeruginosa PA01
gccgaauugggucugcugg

SEQ ID NO: 3460142 - RNA, 14 nt, Pseudomonas aeruginosa PA01
gccgacacccgcgc

SEQ ID NO: 3460143 - RNA, 18 nt, Pseudomonas aeruginosa PA01
gccgacacccgcgccgcc

SEQ ID NO: 3460144 - RNA, 19 nt, Pseudomonas aeruginosa PA01
gccgacacccgcgccgccg

SEQ ID NO: 3460145 - RNA, 23 nt, Pseudomonas aeruginosa PA01
gccgacacccgcgccgccgcggc

SEQ ID NO: 3460146 - RNA, 17 nt, Pseudomonas aeruginosa PA01
gccgacacgggugccgg

SEQ ID NO: 3460147 - RNA, 19 nt, Pseudomonas aeruginosa PA01
gccgacagagcggccggcg

SEQ ID NO: 3460148 - RNA, 17 nt, Pseudomonas aeruginosa PA01
gccgacagcacgauggc

SEQ ID NO: 3460149 - RNA, 21 nt, Pseudomonas aeruginosa PA01
gccgacagcacgauggcgagg

SEQ ID NO: 3460150 - RNA, 12 nt, Pseudomonas aeruginosa PA01
gccgacagcggc

SEQ ID NO: 3460151 - RNA, 16 nt, Pseudomonas aeruginosa PA01
gccgacagcggcuggc

SEQ ID NO: 3460152 - RNA, 17 nt, Pseudomonas aeruginosa PA01
gccgacagcggcuggcg

SEQ ID NO: 3460153 - RNA, 13 nt, Pseudomonas aeruginosa PA01
gccgacaggccgg

SEQ ID NO: 3460154 - RNA, 17 nt, Pseudomonas aeruginosa PA01
gccgacaggccggugcc

SEQ ID NO: 3460155 - RNA, 20 nt, Pseudomonas aeruginosa PA01
gccgacaggccggugccgcc

SEQ ID NO: 3460156 - RNA, 22 nt, Pseudomonas aeruginosa PA01
gccgacaggccggugccgccgg

SEQ ID NO: 3460157 - RNA, 22 nt, Pseudomonas aeruginosa PA01
gccgacaggucgcuuucgcgca

SEQ ID NO: 3460158 - RNA, 23 nt, Pseudomonas aeruginosa PA01
gccgacaggucgcuuucgcgcag

SEQ ID NO: 3460159 - RNA, 16 nt, Pseudomonas aeruginosa PA01
gccgacaggucggccg

SEQ ID NO: 3460160 - RNA, 17 nt, Pseudomonas aeruginosa PA01
gccgacaggucggccgg

SEQ ID NO: 3460161 - RNA, 20 nt, Pseudomonas aeruginosa PA01
gccgacggacguccuccugg

SEQ ID NO: 3460162 - RNA, 14 nt, Pseudomonas aeruginosa PA01
gccgacggcgcgcu

SEQ ID NO: 3460163 - RNA, 16 nt, Pseudomonas aeruginosa PA01
gccgacggcgcgcugc

SEQ ID NO: 3460164 - RNA, 20 nt, Pseudomonas aeruginosa PA01
gccgacggcggccggauggc

SEQ ID NO: 3460165 - RNA, 13 nt, Pseudomonas aeruginosa PA01
gccgacggcggcg

SEQ ID NO: 3460166 - RNA, 15 nt, Pseudomonas aeruginosa PA01
gccgacggcggcggc

SEQ ID NO: 3460167 - RNA, 14 nt, Pseudomonas aeruginosa PA01
gccgacggcgugcc

SEQ ID NO: 3460168 - RNA, 15 nt, Pseudomonas aeruginosa PA01
gccgacggcgugccg

SEQ ID NO: 3460169 - RNA, 18 nt, Pseudomonas aeruginosa PA01
gccgacggcgugccgugg

SEQ ID NO: 3460170 - RNA, 18 nt, Pseudomonas aeruginosa PA01
gccgacggcuucgaccac

SEQ ID NO: 3460171 - RNA, 20 nt, Pseudomonas aeruginosa PA01
gccgacggcuucgaccacga

SEQ ID NO: 3460172 - RNA, 22 nt, Pseudomonas aeruginosa PA01
gccgacggcuucgaccacgacc

SEQ ID NO: 3460173 - RNA, 22 nt, Pseudomonas aeruginosa PA01
gccgacggguucuucucgucga

SEQ ID NO: 3460174 - RNA, 13 nt, Pseudomonas aeruginosa PA01
gccgacguagccg

SEQ ID NO: 3460175 - RNA, 15 nt, Pseudomonas aeruginosa PA01
gccgacguagccgcg

SEQ ID NO: 3460176 - RNA, 16 nt, Pseudomonas aeruginosa PA01
gccgacguagccgcgu

SEQ ID NO: 3460177 - RNA, 19 nt, Pseudomonas aeruginosa PA01
gccgacguagggcaucgcc

SEQ ID NO: 3460178 - RNA, 22 nt, Pseudomonas aeruginosa PA01
gccgacgucacggauaggcggc

SEQ ID NO: 3460179 - RNA, 19 nt, Pseudomonas aeruginosa PA01
gccgacguccaucagcguc

SEQ ID NO: 3460180 - RNA, 15 nt, Pseudomonas aeruginosa PA01
gccgacguccuccag

SEQ ID NO: 3460181 - RNA, 17 nt, Pseudomonas aeruginosa PA01
gccgacguccuccagga

SEQ ID NO: 3460182 - RNA, 18 nt, Pseudomonas aeruginosa PA01
gccgacguccuccaggac

SEQ ID NO: 3460183 - RNA, 21 nt, Pseudomonas aeruginosa PA01
gccgacguccuccaggaccag

SEQ ID NO: 3460184 - RNA, 12 nt, Pseudomonas aeruginosa PA01
gccgacgugcac

SEQ ID NO: 3460185 - RNA, 15 nt, Pseudomonas aeruginosa PA01
gccgacucgcgaucg

SEQ ID NO: 3460186 - RNA, 21 nt, Pseudomonas aeruginosa PA01
gccgacugcaacuggccgaga

SEQ ID NO: 3460187 - RNA, 21 nt, Pseudomonas aeruginosa PA01
gccgacugcgguuuuccugcc

SEQ ID NO: 3460188 - RNA, 22 nt, Pseudomonas aeruginosa PA01
gccgacugcgguuuuccugccc

SEQ ID NO: 3460189 - RNA, 16 nt, Pseudomonas aeruginosa PA01
gccgacuggcagcgau

SEQ ID NO: 3460190 - RNA, 21 nt, Pseudomonas aeruginosa PA01
gccgacuggcgguacgcugca

SEQ ID NO: 3460191 - RNA, 20 nt, Pseudomonas aeruginosa PA01
gccgacuuccaggcgcaggc

SEQ ID NO: 3460192 - RNA, 23 nt, Pseudomonas aeruginosa PA01
gccgacuuccaggcgcaggcgag

SEQ ID NO: 3460193 - RNA, 18 nt, Pseudomonas aeruginosa PA01
gccgagaaaguucccgca

SEQ ID NO: 3460194 - RNA, 16 nt, Pseudomonas aeruginosa PA01
gccgagaacccggcca

SEQ ID NO: 3460195 - RNA, 20 nt, Pseudomonas aeruginosa PA01
gccgagaacccggccaggcc

SEQ ID NO: 3460196 - RNA, 17 nt, Pseudomonas aeruginosa PA01
gccgagaacgcggcgaa

SEQ ID NO: 3460197 - RNA, 16 nt, Pseudomonas aeruginosa PA01
gccgagaagcagaacg

SEQ ID NO: 3460198 - RNA, 22 nt, Pseudomonas aeruginosa PA01
gccgagaagcagaacgccccgc

SEQ ID NO: 3460199 - RNA, 23 nt, Pseudomonas aeruginosa PA01
gccgagaagcagaacgccccgca

SEQ ID NO: 3460200 - RNA, 20 nt, Pseudomonas aeruginosa PA01
gccgagaagguucucggcca

SEQ ID NO: 3460201 - RNA, 21 nt, Pseudomonas aeruginosa PA01
gccgagaagguucucggccac

SEQ ID NO: 3460202 - RNA, 23 nt, Pseudomonas aeruginosa PA01
gccgagaagguucucggccacca

SEQ ID NO: 3460203 - RNA, 17 nt, Pseudomonas aeruginosa PA01
gccgagaaucugcccgg

SEQ ID NO: 3460204 - RNA, 21 nt, Pseudomonas aeruginosa PA01
gccgagaaucugcccggccau

SEQ ID NO: 3460205 - RNA, 19 nt, Pseudomonas aeruginosa PA01
gccgagacgaucagcagga

SEQ ID NO: 3460206 - RNA, 19 nt, Pseudomonas aeruginosa PA01
gccgagauagcggcaacgc

SEQ ID NO: 3460207 - RNA, 16 nt, Pseudomonas aeruginosa PA01
gccgagauccugcagc

SEQ ID NO: 3460208 - RNA, 15 nt, Pseudomonas aeruginosa PA01
gccgagcaacggcag

SEQ ID NO: 3460209 - RNA, 13 nt, Pseudomonas aeruginosa PA01
gccgagcaacucg

SEQ ID NO: 3460210 - RNA, 16 nt, Pseudomonas aeruginosa PA01
gccgagcaacucggcg

SEQ ID NO: 3460211 - RNA, 18 nt, Pseudomonas aeruginosa PA01
gccgagcaacucggcggc

SEQ ID NO: 3460212 - RNA, 20 nt, Pseudomonas aeruginosa PA01
gccgagcaacucggcggcga

SEQ ID NO: 3460213 - RNA, 22 nt, Pseudomonas aeruginosa PA01
gccgagcaacucggcggcgagc

SEQ ID NO: 3460214 - RNA, 13 nt, Pseudomonas aeruginosa PA01
gccgagcaacugc

SEQ ID NO: 3460215 - RNA, 18 nt, Pseudomonas aeruginosa PA01
gccgagcaagccuuccag

SEQ ID NO: 3460216 - RNA, 16 nt, Pseudomonas aeruginosa PA01
gccgagcaauccggcg

SEQ ID NO: 3460217 - RNA, 18 nt, Pseudomonas aeruginosa PA01
gccgagcaauccggcgcu

SEQ ID NO: 3460218 - RNA, 19 nt, Pseudomonas aeruginosa PA01
gccgagcaauccggcgcug

SEQ ID NO: 3460219 - RNA, 23 nt, Pseudomonas aeruginosa PA01
gccgagcaauccggcgcugccga

SEQ ID NO: 3460220 - RNA, 12 nt, Pseudomonas aeruginosa PA01
gccgagcacagg

SEQ ID NO: 3460221 - RNA, 17 nt, Pseudomonas aeruginosa PA01
gccgagcaccacgcgca

SEQ ID NO: 3460222 - RNA, 15 nt, Pseudomonas aeruginosa PA01
gccgagcaccccgac

SEQ ID NO: 3460223 - RNA, 12 nt, Pseudomonas aeruginosa PA01
gccgagcaccgg

SEQ ID NO: 3460224 - RNA, 23 nt, Pseudomonas aeruginosa PA01
gccgagcaccggcaggacgauga

SEQ ID NO: 3460225 - RNA, 16 nt, Pseudomonas aeruginosa PA01
gccgagcagcaccagg

SEQ ID NO: 3460226 - RNA, 18 nt, Pseudomonas aeruginosa PA01
gccgagcagcaccaggcu

SEQ ID NO: 3460227 - RNA, 19 nt, Pseudomonas aeruginosa PA01
gccgagcagcaccaggcug

SEQ ID NO: 3460228 - RNA, 20 nt, Pseudomonas aeruginosa PA01
gccgagcagcaccaggcugg

SEQ ID NO: 3460229 - RNA, 14 nt, Pseudomonas aeruginosa PA01
gccgagcagcgcca

SEQ ID NO: 3460230 - RNA, 16 nt, Pseudomonas aeruginosa PA01
gccgagcagcgccagc

SEQ ID NO: 3460231 - RNA, 17 nt, Pseudomonas aeruginosa PA01
gccgagcagcgccagcc

SEQ ID NO: 3460232 - RNA, 15 nt, Pseudomonas aeruginosa PA01
gccgagcagcggcgc

SEQ ID NO: 3460233 - RNA, 18 nt, Pseudomonas aeruginosa PA01
gccgagcagcggcgcgcc

SEQ ID NO: 3460234 - RNA, 18 nt, Pseudomonas aeruginosa PA01
gccgagcaggaagaagcc

SEQ ID NO: 3460235 - RNA, 23 nt, Pseudomonas aeruginosa PA01
gccgagcaggaagaagccgauca

SEQ ID NO: 3460236 - RNA, 12 nt, Pseudomonas aeruginosa PA01
gccgagcaggcc

SEQ ID NO: 3460237 - RNA, 21 nt, Pseudomonas aeruginosa PA01
gccgagcaggccacgcaccag

SEQ ID NO: 3460238 - RNA, 14 nt, Pseudomonas aeruginosa PA01
gccgagcaggccca

SEQ ID NO: 3460239 - RNA, 15 nt, Pseudomonas aeruginosa PA01
gccgagcaggcccau

SEQ ID NO: 3460240 - RNA, 19 nt, Pseudomonas aeruginosa PA01
gccgagcaggcgcgccagg

SEQ ID NO: 3460241 - RNA, 20 nt, Pseudomonas aeruginosa PA01
gccgagcaggcgcgccaggc

SEQ ID NO: 3460242 - RNA, 13 nt, Pseudomonas aeruginosa PA01
gccgagcaggguc

SEQ ID NO: 3460243 - RNA, 18 nt, Pseudomonas aeruginosa PA01
gccgagcagggucacgcc

SEQ ID NO: 3460244 - RNA, 20 nt, Pseudomonas aeruginosa PA01
gccgagcagggucacgccga

SEQ ID NO: 3460245 - RNA, 18 nt, Pseudomonas aeruginosa PA01
gccgagcaggugcaugua

SEQ ID NO: 3460246 - RNA, 18 nt, Pseudomonas aeruginosa PA01
gccgagcaucagcgacug

SEQ ID NO: 3460247 - RNA, 19 nt, Pseudomonas aeruginosa PA01
gccgagcaucagcgacugg

SEQ ID NO: 3460248 - RNA, 14 nt, Pseudomonas aeruginosa PA01
gccgagcauccagg

SEQ ID NO: 3460249 - RNA, 15 nt, Pseudomonas aeruginosa PA01
gccgagcauccaggu

SEQ ID NO: 3460250 - RNA, 17 nt, Pseudomonas aeruginosa PA01
gccgagcaugcgggcga

SEQ ID NO: 3460251 - RNA, 19 nt, Pseudomonas aeruginosa PA01
gccgagcaugcgggcgauc

SEQ ID NO: 3460252 - RNA, 23 nt, Pseudomonas aeruginosa PA01
gccgagcauguaggcgcaccagg

SEQ ID NO: 3460253 - RNA, 16 nt, Pseudomonas aeruginosa PA01
gccgagccagccgcgg

SEQ ID NO: 3460254 - RNA, 17 nt, Pseudomonas aeruginosa PA01
gccgagccagccgcgga

SEQ ID NO: 3460255 - RNA, 14 nt, Pseudomonas aeruginosa PA01
gccgagccagguac

SEQ ID NO: 3460256 - RNA, 20 nt, Pseudomonas aeruginosa PA01
gccgagcccccauaccgccu

SEQ ID NO: 3460257 - RNA, 18 nt, Pseudomonas aeruginosa PA01
gccgagcccccggcgccc

SEQ ID NO: 3460258 - RNA, 19 nt, Pseudomonas aeruginosa PA01
gccgagcccccggcgccca

SEQ ID NO: 3460259 - RNA, 22 nt, Pseudomonas aeruginosa PA01
gccgagcccccggcgcccagaa

SEQ ID NO: 3460260 - RNA, 22 nt, Pseudomonas aeruginosa PA01
gccgagccccgguuacucgccg

SEQ ID NO: 3460261 - RNA, 23 nt, Pseudomonas aeruginosa PA01
gccgagccccgguuacucgccgg

SEQ ID NO: 3460262 - RNA, 17 nt, Pseudomonas aeruginosa PA01
gccgagcccgagugcgc

SEQ ID NO: 3460263 - RNA, 18 nt, Pseudomonas aeruginosa PA01
gccgagggcgcgcaguag

SEQ ID NO: 3460264 - RNA, 20 nt, Pseudomonas aeruginosa PA01
gccgagggcgcggcgccagc

SEQ ID NO: 3460265 - RNA, 18 nt, Pseudomonas aeruginosa PA01
gccgagggcugccgcccg

SEQ ID NO: 3460266 - RNA, 19 nt, Pseudomonas aeruginosa PA01
gccgagggcugccgcccgg

SEQ ID NO: 3460267 - RNA, 22 nt, Pseudomonas aeruginosa PA01
gccgagggcuguaaucgccgcu

SEQ ID NO: 3460268 - RNA, 16 nt, Pseudomonas aeruginosa PA01
gccgagggugaucagc

SEQ ID NO: 3460269 - RNA, 20 nt, Pseudomonas aeruginosa PA01
gccgaggucaguucggugcc

SEQ ID NO: 3460270 - RNA, 22 nt, Pseudomonas aeruginosa PA01
gccgaggucgaggauguaguag

SEQ ID NO: 3460271 - RNA, 15 nt, Pseudomonas aeruginosa PA01
gccgaggucgccgcc

SEQ ID NO: 3460272 - RNA, 19 nt, Pseudomonas aeruginosa PA01
gccgaggucgccgccagcu

SEQ ID NO: 3460273 - RNA, 15 nt, Pseudomonas aeruginosa PA01
gccgaggucgcgggc

SEQ ID NO: 3460274 - RNA, 16 nt, Pseudomonas aeruginosa PA01
gccgaggucgcgggcc

SEQ ID NO: 3460275 - RNA, 20 nt, Pseudomonas aeruginosa PA01
gccgaggucgucgcugagca

SEQ ID NO: 3460276 - RNA, 20 nt, Pseudomonas aeruginosa PA01
gccgaggucuuggccagccg

SEQ ID NO: 3460277 - RNA, 23 nt, Pseudomonas aeruginosa PA01
gccgaggucuuggccagccgcgc

SEQ ID NO: 3460278 - RNA, 14 nt, Pseudomonas aeruginosa PA01
gccgaggugcggcu

SEQ ID NO: 3460279 - RNA, 16 nt, Pseudomonas aeruginosa PA01
gccgagguggagauca

SEQ ID NO: 3460280 - RNA, 22 nt, Pseudomonas aeruginosa PA01
gccgagguucuugcccagcaac

SEQ ID NO: 3460281 - RNA, 14 nt, Pseudomonas aeruginosa PA01
gccgaguccgcgcg

SEQ ID NO: 3460282 - RNA, 17 nt, Pseudomonas aeruginosa PA01
gccgaguccgcgcgcgc

SEQ ID NO: 3460283 - RNA, 15 nt, Pseudomonas aeruginosa PA01
gccgaguggccgcug

SEQ ID NO: 3460284 - RNA, 19 nt, Pseudomonas aeruginosa PA01
gccgaguggccgcugagca

SEQ ID NO: 3460285 - RNA, 22 nt, Pseudomonas aeruginosa PA01
gccgaguggccgcugagcagca

SEQ ID NO: 3460286 - RNA, 12 nt, Pseudomonas aeruginosa PA01
gccgaguucgcg

SEQ ID NO: 3460287 - RNA, 16 nt, Pseudomonas aeruginosa PA01
gccgaguucgcgcagg

SEQ ID NO: 3460288 - RNA, 21 nt, Pseudomonas aeruginosa PA01
gccgaguucgcgcaggcgcug

SEQ ID NO: 3460289 - RNA, 13 nt, Pseudomonas aeruginosa PA01
gccgauacccugg

SEQ ID NO: 3460290 - RNA, 21 nt, Pseudomonas aeruginosa PA01
gccgauacccugggagccgcc

SEQ ID NO: 3460291 - RNA, 22 nt, Pseudomonas aeruginosa PA01
gccgauacccugggagccgccg

SEQ ID NO: 3460292 - RNA, 23 nt, Pseudomonas aeruginosa PA01
gccgauacccugggagccgccgg

SEQ ID NO: 3460293 - RNA, 14 nt, Pseudomonas aeruginosa PA01
gccgaucaacgcgg

SEQ ID NO: 3460294 - RNA, 19 nt, Pseudomonas aeruginosa PA01
gccgaucaacgcggccagc

SEQ ID NO: 3460295 - RNA, 21 nt, Pseudomonas aeruginosa PA01
gccgaucaacgcggccagcag

SEQ ID NO: 3460296 - RNA, 22 nt, Pseudomonas aeruginosa PA01
gccgaucaacgcggccagcagc

SEQ ID NO: 3460297 - RNA, 15 nt, Pseudomonas aeruginosa PA01
gccgaucaaugcguu

SEQ ID NO: 3460298 - RNA, 14 nt, Pseudomonas aeruginosa PA01
gccgaucaccacca

SEQ ID NO: 3460299 - RNA, 15 nt, Pseudomonas aeruginosa PA01
gccgaucaccaccag

SEQ ID NO: 3460300 - RNA, 16 nt, Pseudomonas aeruginosa PA01
gccgaucaccaccagc

SEQ ID NO: 3460301 - RNA, 20 nt, Pseudomonas aeruginosa PA01
gccgaucaccaccagcauca

SEQ ID NO: 3460302 - RNA, 20 nt, Pseudomonas aeruginosa PA01
gccgaucaccaccagcgccg

SEQ ID NO: 3460303 - RNA, 22 nt, Pseudomonas aeruginosa PA01
gccgaucaccaccagcgccgcc

SEQ ID NO: 3460304 - RNA, 17 nt, Pseudomonas aeruginosa PA01
gccgaucaccaccugga

SEQ ID NO: 3460305 - RNA, 16 nt, Pseudomonas aeruginosa PA01
gccgaucaccagcgcc

SEQ ID NO: 3460306 - RNA, 17 nt, Pseudomonas aeruginosa PA01
gccgaucaccagcgcca

SEQ ID NO: 3460307 - RNA, 18 nt, Pseudomonas aeruginosa PA01
gccgaucaccagcgccag

SEQ ID NO: 3460308 - RNA, 20 nt, Pseudomonas aeruginosa PA01
gccgaucaccagcgccaggc

SEQ ID NO: 3460309 - RNA, 13 nt, Pseudomonas aeruginosa PA01
gccgaucaccagg

SEQ ID NO: 3460310 - RNA, 16 nt, Pseudomonas aeruginosa PA01
gccgaucaccaggauc

SEQ ID NO: 3460311 - RNA, 13 nt, Pseudomonas aeruginosa PA01
gccgaucaccccg

SEQ ID NO: 3460312 - RNA, 13 nt, Pseudomonas aeruginosa PA01
gccgaucaccgcc

SEQ ID NO: 3460313 - RNA, 14 nt, Pseudomonas aeruginosa PA01
gccgaucaccuggc

SEQ ID NO: 3460314 - RNA, 20 nt, Pseudomonas aeruginosa PA01
gccgaucaccuucaccggca

SEQ ID NO: 3460315 - RNA, 13 nt, Pseudomonas aeruginosa PA01
gccgaucagccau

SEQ ID NO: 3460316 - RNA, 22 nt, Pseudomonas aeruginosa PA01
gccgaucagccauuggccgacg

SEQ ID NO: 3460317 - RNA, 17 nt, Pseudomonas aeruginosa PA01
gccgaucagcccgucgg

SEQ ID NO: 3460318 - RNA, 18 nt, Pseudomonas aeruginosa PA01
gccgaucagcccgucggc

SEQ ID NO: 3460319 - RNA, 13 nt, Pseudomonas aeruginosa PA01
gccgaucagcgcc

SEQ ID NO: 3460320 - RNA, 14 nt, Pseudomonas aeruginosa PA01
gccgaucagcgccu

SEQ ID NO: 3460321 - RNA, 14 nt, Pseudomonas aeruginosa PA01
gccgaucagcggcg

SEQ ID NO: 3460322 - RNA, 19 nt, Pseudomonas aeruginosa PA01
gccgaucagcuuggccuug

SEQ ID NO: 3460323 - RNA, 13 nt, Pseudomonas aeruginosa PA01
gccgaucaggcgu

SEQ ID NO: 3460324 - RNA, 15 nt, Pseudomonas aeruginosa PA01
gccgaucaggcguag

SEQ ID NO: 3460325 - RNA, 19 nt, Pseudomonas aeruginosa PA01
gccgaucaggcguaggccg

SEQ ID NO: 3460326 - RNA, 22 nt, Pseudomonas aeruginosa PA01
gccgaucaggcguaggccgucg

SEQ ID NO: 3460327 - RNA, 14 nt, Pseudomonas aeruginosa PA01
gccgaucaggcuga

SEQ ID NO: 3460328 - RNA, 22 nt, Pseudomonas aeruginosa PA01
gccgaucaggcugaagcggccg

SEQ ID NO: 3460329 - RNA, 21 nt, Pseudomonas aeruginosa PA01
gccgaucaguggucgcagcuc

SEQ ID NO: 3460330 - RNA, 23 nt, Pseudomonas aeruginosa PA01
gccgaucaguggucgcagcucca

SEQ ID NO: 3460331 - RNA, 14 nt, Pseudomonas aeruginosa PA01
gccgaucaucauca

SEQ ID NO: 3460332 - RNA, 18 nt, Pseudomonas aeruginosa PA01
gccgaucaucggcugguc

SEQ ID NO: 3460333 - RNA, 19 nt, Pseudomonas aeruginosa PA01
gccgaucaucggcuggucg

SEQ ID NO: 3460334 - RNA, 16 nt, Pseudomonas aeruginosa PA01
gccgaucaucuucugg

SEQ ID NO: 3460335 - RNA, 20 nt, Pseudomonas aeruginosa PA01
gccgaucaugcucggcggug

SEQ ID NO: 3460336 - RNA, 13 nt, Pseudomonas aeruginosa PA01
gccgauccaggcg

SEQ ID NO: 3460337 - RNA, 14 nt, Pseudomonas aeruginosa PA01
gccgauccaggcgu

SEQ ID NO: 3460338 - RNA, 23 nt, Pseudomonas aeruginosa PA01
gccgaucccgacgcccuccagca

SEQ ID NO: 3460339 - RNA, 12 nt, Pseudomonas aeruginosa PA01
gccgaucccgau

SEQ ID NO: 3460340 - RNA, 17 nt, Pseudomonas aeruginosa PA01
gccgaucccggcggcga

SEQ ID NO: 3460341 - RNA, 14 nt, Pseudomonas aeruginosa PA01
gccgauccgcgaau

SEQ ID NO: 3460342 - RNA, 22 nt, Pseudomonas aeruginosa PA01
gccgauccgcgaauagggcggc

SEQ ID NO: 3460343 - RNA, 22 nt, Pseudomonas aeruginosa PA01
gccgaucgaagaaggcucaccg

SEQ ID NO: 3460344 - RNA, 14 nt, Pseudomonas aeruginosa PA01
gccgaucgagcggc

SEQ ID NO: 3460345 - RNA, 19 nt, Pseudomonas aeruginosa PA01
gccgaucgagcggcccgcg

SEQ ID NO: 3460346 - RNA, 20 nt, Pseudomonas aeruginosa PA01
gccgaucgagcggcccgcgg

SEQ ID NO: 3460347 - RNA, 21 nt, Pseudomonas aeruginosa PA01
gccgaucgagcggcccgcggu

SEQ ID NO: 3460348 - RNA, 23 nt, Pseudomonas aeruginosa PA01
gccgaucgagcggcccgcgguca

SEQ ID NO: 3460349 - RNA, 12 nt, Pseudomonas aeruginosa PA01
gccgaucgccgc

SEQ ID NO: 3460350 - RNA, 13 nt, Pseudomonas aeruginosa PA01
gccgaucgccgcg

SEQ ID NO: 3460351 - RNA, 15 nt, Pseudomonas aeruginosa PA01
gccgaucgccgcgcg

SEQ ID NO: 3460352 - RNA, 15 nt, Pseudomonas aeruginosa PA01
gccgaucgccucguu

SEQ ID NO: 3460353 - RNA, 22 nt, Pseudomonas aeruginosa PA01
gccgaucggcauguugugcuug

SEQ ID NO: 3460354 - RNA, 13 nt, Pseudomonas aeruginosa PA01
gccgaucuccugg

SEQ ID NO: 3460355 - RNA, 18 nt, Pseudomonas aeruginosa PA01
gccgaucuccuggcgggu

SEQ ID NO: 3460356 - RNA, 14 nt, Pseudomonas aeruginosa PA01
gccgaucuccuggu

SEQ ID NO: 3460357 - RNA, 13 nt, Pseudomonas aeruginosa PA01
gccgaucucguag

SEQ ID NO: 3460358 - RNA, 18 nt, Pseudomonas aeruginosa PA01
gccgaucucguaggcauc

SEQ ID NO: 3460359 - RNA, 19 nt, Pseudomonas aeruginosa PA01
gccgaucucguaggcaucc

SEQ ID NO: 3460360 - RNA, 21 nt, Pseudomonas aeruginosa PA01
gccgaucucgugggccagcag

SEQ ID NO: 3460361 - RNA, 22 nt, Pseudomonas aeruginosa PA01
gccgaucucgugggccagcagg

SEQ ID NO: 3460362 - RNA, 13 nt, Pseudomonas aeruginosa PA01
gccgaucugcugg

SEQ ID NO: 3460363 - RNA, 17 nt, Pseudomonas aeruginosa PA01
gccgaucugcuggguca

SEQ ID NO: 3460364 - RNA, 18 nt, Pseudomonas aeruginosa PA01
gccgaucuucagcagcag

SEQ ID NO: 3460365 - RNA, 12 nt, Pseudomonas aeruginosa PA01
gccgcagcagcg

SEQ ID NO: 3460366 - RNA, 14 nt, Pseudomonas aeruginosa PA01
gccgcagcagcggc

SEQ ID NO: 3460367 - RNA, 20 nt, Pseudomonas aeruginosa PA01
gccgcagcagcggcaaaggc

SEQ ID NO: 3460368 - RNA, 17 nt, Pseudomonas aeruginosa PA01
gccgcagcagcggcgac

SEQ ID NO: 3460369 - RNA, 20 nt, Pseudomonas aeruginosa PA01
gccgcagcagguucgaaugc

SEQ ID NO: 3460370 - RNA, 21 nt, Pseudomonas aeruginosa PA01
gccgcagcagguucgaaugcu

SEQ ID NO: 3460371 - RNA, 19 nt, Pseudomonas aeruginosa PA01
gccgcagcccuaggcgacc

SEQ ID NO: 3460372 - RNA, 21 nt, Pseudomonas aeruginosa PA01
gccgcagcccuaggcgacccg

SEQ ID NO: 3460373 - RNA, 14 nt, Pseudomonas aeruginosa PA01
gccgcagccguggc

SEQ ID NO: 3460374 - RNA, 16 nt, Pseudomonas aeruginosa PA01
gccgcagccguggcgc

SEQ ID NO: 3460375 - RNA, 12 nt, Pseudomonas aeruginosa PA01
gccgcagcgccc

SEQ ID NO: 3460376 - RNA, 19 nt, Pseudomonas aeruginosa PA01
gccgcagcgccccucccag

SEQ ID NO: 3460377 - RNA, 12 nt, Pseudomonas aeruginosa PA01
gccgcagcgccu

SEQ ID NO: 3460378 - RNA, 14 nt, Pseudomonas aeruginosa PA01
gccgcagcgccucc

SEQ ID NO: 3460379 - RNA, 17 nt, Pseudomonas aeruginosa PA01
gccgcagcggcaugccc

SEQ ID NO: 3460380 - RNA, 13 nt, Pseudomonas aeruginosa PA01
gccgcagcggcca

SEQ ID NO: 3460381 - RNA, 16 nt, Pseudomonas aeruginosa PA01
gccgcagcggccaggg

SEQ ID NO: 3460382 - RNA, 18 nt, Pseudomonas aeruginosa PA01
gccgcagcggccagggaa

SEQ ID NO: 3460383 - RNA, 20 nt, Pseudomonas aeruginosa PA01
gccgcagcggcucgugucga

SEQ ID NO: 3460384 - RNA, 18 nt, Pseudomonas aeruginosa PA01
gccgcagcggcuguugcc

SEQ ID NO: 3460385 - RNA, 14 nt, Pseudomonas aeruginosa PA01
gccgcagcucggcc

SEQ ID NO: 3460386 - RNA, 18 nt, Pseudomonas aeruginosa PA01
gccgcagcucggccucga

SEQ ID NO: 3460387 - RNA, 15 nt, Pseudomonas aeruginosa PA01
gccgcaggaugccgc

SEQ ID NO: 3460388 - RNA, 21 nt, Pseudomonas aeruginosa PA01
gccgcaggaugccgccugcgu

SEQ ID NO: 3460389 - RNA, 12 nt, Pseudomonas aeruginosa PA01
gccgcaggcaga

SEQ ID NO: 3460390 - RNA, 24 nt, Pseudomonas aeruginosa PA01
gccgcaggcagcacaugccacgca

SEQ ID NO: 3460391 - RNA, 18 nt, Pseudomonas aeruginosa PA01
gccgcaggcaguggcgcc

SEQ ID NO: 3460392 - RNA, 15 nt, Pseudomonas aeruginosa PA01
gccgcaggccgcggc

SEQ ID NO: 3460393 - RNA, 12 nt, Pseudomonas aeruginosa PA01
gccgcaggccgu

SEQ ID NO: 3460394 - RNA, 21 nt, Pseudomonas aeruginosa PA01
gccgcaggcgcuauccgccgu

SEQ ID NO: 3460395 - RNA, 15 nt, Pseudomonas aeruginosa PA01
gccgcaggcgggcgc

SEQ ID NO: 3460396 - RNA, 19 nt, Pseudomonas aeruginosa PA01
gccgcaggcgggcgccauc

SEQ ID NO: 3460397 - RNA, 22 nt, Pseudomonas aeruginosa PA01
gccgcaggcgggcgccaucgcu

SEQ ID NO: 3460398 - RNA, 12 nt, Pseudomonas aeruginosa PA01
gccgcaggcugc

SEQ ID NO: 3460399 - RNA, 14 nt, Pseudomonas aeruginosa PA01
gccgcaggcugccg

SEQ ID NO: 3460400 - RNA, 15 nt, Pseudomonas aeruginosa PA01
gccgcaggcugccgu

SEQ ID NO: 3460401 - RNA, 16 nt, Pseudomonas aeruginosa PA01
gccgcaggcugccguc

SEQ ID NO: 3460402 - RNA, 17 nt, Pseudomonas aeruginosa PA01
gccgcagggugcggcug

SEQ ID NO: 3460403 - RNA, 18 nt, Pseudomonas aeruginosa PA01
gccgcagggugcggcugc

SEQ ID NO: 3460404 - RNA, 15 nt, Pseudomonas aeruginosa PA01
gccgcaggucggcgu

SEQ ID NO: 3460405 - RNA, 16 nt, Pseudomonas aeruginosa PA01
gccgcaggucggcguc

SEQ ID NO: 3460406 - RNA, 17 nt, Pseudomonas aeruginosa PA01
gccgcaggucggcgucu

SEQ ID NO: 3460407 - RNA, 21 nt, Pseudomonas aeruginosa PA01
gccgcaggucuugucgcgggu

SEQ ID NO: 3460408 - RNA, 22 nt, Pseudomonas aeruginosa PA01
gccgcaggucuugucgcggguc

SEQ ID NO: 3460409 - RNA, 14 nt, Pseudomonas aeruginosa PA01
gccgcaggugaagc

SEQ ID NO: 3460410 - RNA, 15 nt, Pseudomonas aeruginosa PA01
gccgcaggugaagcu

SEQ ID NO: 3460411 - RNA, 18 nt, Pseudomonas aeruginosa PA01
gccgcagguuggccccgc

SEQ ID NO: 3460412 - RNA, 24 nt, Pseudomonas aeruginosa PA01
gccgcagguuggccccgccgagga

SEQ ID NO: 3460413 - RNA, 22 nt, Pseudomonas aeruginosa PA01
gccgcaguacgaggggccgccg

SEQ ID NO: 3460414 - RNA, 21 nt, Pseudomonas aeruginosa PA01
gccgcaguagaugccgcgucg

SEQ ID NO: 3460415 - RNA, 17 nt, Pseudomonas aeruginosa PA01
gccgcaguccagggcga

SEQ ID NO: 3460416 - RNA, 11 nt, Pseudomonas aeruginosa PA01
gccgcaguccg

SEQ ID NO: 3460417 - RNA, 19 nt, Pseudomonas aeruginosa PA01
gccgcaguuguuccucgcg

SEQ ID NO: 3460418 - RNA, 21 nt, Pseudomonas aeruginosa PA01
gccgcaguuguuccucgcggc

SEQ ID NO: 3460419 - RNA, 22 nt, Pseudomonas aeruginosa PA01
gccgcaguuguuccucgcggcu

SEQ ID NO: 3460420 - RNA, 23 nt, Pseudomonas aeruginosa PA01
gccgcaguuguuccucgcggcuc

SEQ ID NO: 3460421 - RNA, 13 nt, Pseudomonas aeruginosa PA01
gccgcauccgcgg

SEQ ID NO: 3460422 - RNA, 15 nt, Pseudomonas aeruginosa PA01
gccgcauccgcggcc

SEQ ID NO: 3460423 - RNA, 18 nt, Pseudomonas aeruginosa PA01
gccgcaucgaccuugccc

SEQ ID NO: 3460424 - RNA, 24 nt, Pseudomonas aeruginosa PA01
gccgcaucgcgggcgugcuccagc

SEQ ID NO: 3460425 - RNA, 15 nt, Pseudomonas aeruginosa PA01
gccgcaucgcugacc

SEQ ID NO: 3460426 - RNA, 13 nt, Pseudomonas aeruginosa PA01
gccgcaugccggg

SEQ ID NO: 3460427 - RNA, 15 nt, Pseudomonas aeruginosa PA01
gccgcaugccggggu

SEQ ID NO: 3460428 - RNA, 17 nt, Pseudomonas aeruginosa PA01
gccgcauuggccaggcc

SEQ ID NO: 3460429 - RNA, 18 nt, Pseudomonas aeruginosa PA01
gccgcauuggccaggccc

SEQ ID NO: 3460430 - RNA, 22 nt, Pseudomonas aeruginosa PA01
gccgcauuggccaggccccagg

SEQ ID NO: 3460431 - RNA, 18 nt, Pseudomonas aeruginosa PA01
gccgccaaccacuccgcc

SEQ ID NO: 3460432 - RNA, 12 nt, Pseudomonas aeruginosa PA01
gccgccaacugg

SEQ ID NO: 3460433 - RNA, 13 nt, Pseudomonas aeruginosa PA01
gccgccaagcccu

SEQ ID NO: 3460434 - RNA, 16 nt, Pseudomonas aeruginosa PA01
gccgccaccacgauca

SEQ ID NO: 3460435 - RNA, 21 nt, Pseudomonas aeruginosa PA01
gccgccaccacgaucaggccc

SEQ ID NO: 3460436 - RNA, 20 nt, Pseudomonas aeruginosa PA01
gccgccaccgccaccgccgg

SEQ ID NO: 3460437 - RNA, 21 nt, Pseudomonas aeruginosa PA01
gccgccaccgccaccgccgga

SEQ ID NO: 3460438 - RNA, 15 nt, Pseudomonas aeruginosa PA01
gccgccacgccgaua

SEQ ID NO: 3460439 - RNA, 14 nt, Pseudomonas aeruginosa PA01
gccgccacggcggu

SEQ ID NO: 3460440 - RNA, 14 nt, Pseudomonas aeruginosa PA01
gccgccacgugcac

SEQ ID NO: 3460441 - RNA, 21 nt, Pseudomonas aeruginosa PA01
gccgccacgugcacgccgugc

SEQ ID NO: 3460442 - RNA, 22 nt, Pseudomonas aeruginosa PA01
gccgccacgugcacgccgugca

SEQ ID NO: 3460443 - RNA, 20 nt, Pseudomonas aeruginosa PA01
gccgccagaaagccucaggc

SEQ ID NO: 3460444 - RNA, 22 nt, Pseudomonas aeruginosa PA01
gccgccagaaagccucaggcgc

SEQ ID NO: 3460445 - RNA, 12 nt, Pseudomonas aeruginosa PA01
gccgccagcaac

SEQ ID NO: 3460446 - RNA, 13 nt, Pseudomonas aeruginosa PA01
gccgccagcaaca

SEQ ID NO: 3460447 - RNA, 23 nt, Pseudomonas aeruginosa PA01
gccgccagcaacaguugccgcag

SEQ ID NO: 3460448 - RNA, 14 nt, Pseudomonas aeruginosa PA01
gccgccagcaacgg

SEQ ID NO: 3460449 - RNA, 12 nt, Pseudomonas aeruginosa PA01
gccgccagcagg

SEQ ID NO: 3460450 - RNA, 13 nt, Pseudomonas aeruginosa PA01
gccgccagcagga

SEQ ID NO: 3460451 - RNA, 16 nt, Pseudomonas aeruginosa PA01
gccgccagcaggccga

SEQ ID NO: 3460452 - RNA, 17 nt, Pseudomonas aeruginosa PA01
gccgccagcaggccgaa

SEQ ID NO: 3460453 - RNA, 20 nt, Pseudomonas aeruginosa PA01
gccgccagcaggucggccug

SEQ ID NO: 3460454 - RNA, 21 nt, Pseudomonas aeruginosa PA01
gccgccagcaggucggccugc

SEQ ID NO: 3460455 - RNA, 19 nt, Pseudomonas aeruginosa PA01
gccgccagcauggcgaagc

SEQ ID NO: 3460456 - RNA, 17 nt, Pseudomonas aeruginosa PA01
gccgccagccagagcag

SEQ ID NO: 3460457 - RNA, 19 nt, Pseudomonas aeruginosa PA01
gccgccagccagagcagcg

SEQ ID NO: 3460458 - RNA, 14 nt, Pseudomonas aeruginosa PA01
gccgccagccgcca

SEQ ID NO: 3460459 - RNA, 13 nt, Pseudomonas aeruginosa PA01
gccgccagcgcgg

SEQ ID NO: 3460460 - RNA, 17 nt, Pseudomonas aeruginosa PA01
gccgccagcgcggcgcu

SEQ ID NO: 3460461 - RNA, 15 nt, Pseudomonas aeruginosa PA01
gccgccagcuaccgg

SEQ ID NO: 3460462 - RNA, 12 nt, Pseudomonas aeruginosa PA01
gccgccagcuca

SEQ ID NO: 3460463 - RNA, 17 nt, Pseudomonas aeruginosa PA01
gccgccagcucauggag

SEQ ID NO: 3460464 - RNA, 14 nt, Pseudomonas aeruginosa PA01
gccgccaggacggc

SEQ ID NO: 3460465 - RNA, 22 nt, Pseudomonas aeruginosa PA01
gccgccaggacggcagggucag

SEQ ID NO: 3460466 - RNA, 13 nt, Pseudomonas aeruginosa PA01
gccgccaggcaga

SEQ ID NO: 3460467 - RNA, 16 nt, Pseudomonas aeruginosa PA01
gccgccaggcagacca

SEQ ID NO: 3460468 - RNA, 23 nt, Pseudomonas aeruginosa PA01
gccgcccuugucgaugagccagc

SEQ ID NO: 3460469 - RNA, 13 nt, Pseudomonas aeruginosa PA01
gccgcccuuuucc

SEQ ID NO: 3460470 - RNA, 21 nt, Pseudomonas aeruginosa PA01
gccgccgaaaugcugcaggcc

SEQ ID NO: 3460471 - RNA, 19 nt, Pseudomonas aeruginosa PA01
gccgccgaacacgcacaau

SEQ ID NO: 3460472 - RNA, 22 nt, Pseudomonas aeruginosa PA01
gccgccgaacaugccgaagagc

SEQ ID NO: 3460473 - RNA, 19 nt, Pseudomonas aeruginosa PA01
gccgccgaagcccuuggag

SEQ ID NO: 3460474 - RNA, 16 nt, Pseudomonas aeruginosa PA01
gccgccgaagccgacg

SEQ ID NO: 3460475 - RNA, 17 nt, Pseudomonas aeruginosa PA01
gccgccgaagccgacgc

SEQ ID NO: 3460476 - RNA, 19 nt, Pseudomonas aeruginosa PA01
gccgccgaagccgacgccg

SEQ ID NO: 3460477 - RNA, 17 nt, Pseudomonas aeruginosa PA01
gccgccgacacccgcgc

SEQ ID NO: 3460478 - RNA, 20 nt, Pseudomonas aeruginosa PA01
gccgccgacacccgcgccgc

SEQ ID NO: 3460479 - RNA, 22 nt, Pseudomonas aeruginosa PA01
gccgccgacacccgcgccgccg

SEQ ID NO: 3460480 - RNA, 13 nt, Pseudomonas aeruginosa PA01
gccgccgacaggu

SEQ ID NO: 3460481 - RNA, 14 nt, Pseudomonas aeruginosa PA01
gccgccgaccgggc

SEQ ID NO: 3460482 - RNA, 14 nt, Pseudomonas aeruginosa PA01
gccgccgaccucgg

SEQ ID NO: 3460483 - RNA, 13 nt, Pseudomonas aeruginosa PA01
gccgccgacgccg

SEQ ID NO: 3460484 - RNA, 14 nt, Pseudomonas aeruginosa PA01
gccgccgacgccgg

SEQ ID NO: 3460485 - RNA, 15 nt, Pseudomonas aeruginosa PA01
gccgccgacgccgga

SEQ ID NO: 3460486 - RNA, 22 nt, Pseudomonas aeruginosa PA01
gccgccgacgucacggauaggc

SEQ ID NO: 3460487 - RNA, 22 nt, Pseudomonas aeruginosa PA01
gccgccgacgucguggauaggc

SEQ ID NO: 3460488 - RNA, 17 nt, Pseudomonas aeruginosa PA01
gccgccgagaacccggc

SEQ ID NO: 3460489 - RNA, 20 nt, Pseudomonas aeruginosa PA01
gccgccgagaacccggccag

SEQ ID NO: 3460490 - RNA, 21 nt, Pseudomonas aeruginosa PA01
gccgccgagaacccggccagg

SEQ ID NO: 3460491 - RNA, 16 nt, Pseudomonas aeruginosa PA01
gccgccgagcaacugc

SEQ ID NO: 3460492 - RNA, 17 nt, Pseudomonas aeruginosa PA01
gccgccgagcaggccca

SEQ ID NO: 3460493 - RNA, 20 nt, Pseudomonas aeruginosa PA01
gccgccgagcaugcgggcga

SEQ ID NO: 3460494 - RNA, 12 nt, Pseudomonas aeruginosa PA01
gccgccgagcgc

SEQ ID NO: 3460495 - RNA, 14 nt, Pseudomonas aeruginosa PA01
gccgccgagcgccu

SEQ ID NO: 3460496 - RNA, 18 nt, Pseudomonas aeruginosa PA01
gccgccgagcgccuggca

SEQ ID NO: 3460497 - RNA, 21 nt, Pseudomonas aeruginosa PA01
gccgccgaggauagcguccag

SEQ ID NO: 3460498 - RNA, 22 nt, Pseudomonas aeruginosa PA01
gccgccgaggauagcguccagc

SEQ ID NO: 3460499 - RNA, 15 nt, Pseudomonas aeruginosa PA01
gccgccgaggcgcgc

SEQ ID NO: 3460500 - RNA, 19 nt, Pseudomonas aeruginosa PA01
gccgccgaggcgcgccacg

SEQ ID NO: 3460501 - RNA, 14 nt, Pseudomonas aeruginosa PA01
gccgccgaggugcg

SEQ ID NO: 3460502 - RNA, 19 nt, Pseudomonas aeruginosa PA01
gccgccgaggugcggcuug

SEQ ID NO: 3460503 - RNA, 14 nt, Pseudomonas aeruginosa PA01
gccgccgagguugc

SEQ ID NO: 3460504 - RNA, 18 nt, Pseudomonas aeruginosa PA01
gccgccgaguacacaaug

SEQ ID NO: 3460505 - RNA, 22 nt, Pseudomonas aeruginosa PA01
gccgccgagugugccggccaug

SEQ ID NO: 3460506 - RNA, 17 nt, Pseudomonas aeruginosa PA01
gccgccgauccaggaac

SEQ ID NO: 3460507 - RNA, 15 nt, Pseudomonas aeruginosa PA01
gccgccgaucugcug

SEQ ID NO: 3460508 - RNA, 12 nt, Pseudomonas aeruginosa PA01
gccgccgaugcc

SEQ ID NO: 3460509 - RNA, 13 nt, Pseudomonas aeruginosa PA01
gccgccgaugccg

SEQ ID NO: 3460510 - RNA, 14 nt, Pseudomonas aeruginosa PA01
gccgccgaugccga

SEQ ID NO: 3460511 - RNA, 14 nt, Pseudomonas aeruginosa PA01
gccgccgaugcugu

SEQ ID NO: 3460512 - RNA, 21 nt, Pseudomonas aeruginosa PA01
gccgccgaugcuguucagcag

SEQ ID NO: 3460513 - RNA, 15 nt, Pseudomonas aeruginosa PA01
gccgccgcaaccgcc

SEQ ID NO: 3460514 - RNA, 15 nt, Pseudomonas aeruginosa PA01
gccgccgcagagcca

SEQ ID NO: 3460515 - RNA, 14 nt, Pseudomonas aeruginosa PA01
gccgccgcagccgu

SEQ ID NO: 3460516 - RNA, 11 nt, Pseudomonas aeruginosa PA01
gccgccgccca

SEQ ID NO: 3460517 - RNA, 15 nt, Pseudomonas aeruginosa PA01
gccgccgcccagcag

SEQ ID NO: 3460518 - RNA, 17 nt, Pseudomonas aeruginosa PA01
gccgccgcccagcagca

SEQ ID NO: 3460519 - RNA, 11 nt, Pseudomonas aeruginosa PA01
gccgccgccga

SEQ ID NO: 3460520 - RNA, 13 nt, Pseudomonas aeruginosa PA01
gccgccgccgaca

SEQ ID NO: 3460521 - RNA, 14 nt, Pseudomonas aeruginosa PA01
gccgccgccgaccg

SEQ ID NO: 3460522 - RNA, 14 nt, Pseudomonas aeruginosa PA01
gccgccgccgagaa

SEQ ID NO: 3460523 - RNA, 12 nt, Pseudomonas aeruginosa PA01
gccgccgccgcc

SEQ ID NO: 3460524 - RNA, 13 nt, Pseudomonas aeruginosa PA01
gccgccgccgccc

SEQ ID NO: 3460525 - RNA, 14 nt, Pseudomonas aeruginosa PA01
gccgccgccgccgu

SEQ ID NO: 3460526 - RNA, 14 nt, Pseudomonas aeruginosa PA01
gccgccgccgcgcc

SEQ ID NO: 3460527 - RNA, 15 nt, Pseudomonas aeruginosa PA01
gccgccgccgcgccg

SEQ ID NO: 3460528 - RNA, 16 nt, Pseudomonas aeruginosa PA01
gccgccgccgcgccgg

SEQ ID NO: 3460529 - RNA, 16 nt, Pseudomonas aeruginosa PA01
gccgccgccggaggga

SEQ ID NO: 3460530 - RNA, 12 nt, Pseudomonas aeruginosa PA01
gccgccgccguc

SEQ ID NO: 3460531 - RNA, 13 nt, Pseudomonas aeruginosa PA01
gccgccgccugcu

SEQ ID NO: 3460532 - RNA, 16 nt, Pseudomonas aeruginosa PA01
gccgccgccugcucgc

SEQ ID NO: 3460533 - RNA, 21 nt, Pseudomonas aeruginosa PA01
gccgccgccugcucgccgcug

SEQ ID NO: 3460534 - RNA, 14 nt, Pseudomonas aeruginosa PA01
gccgccgccuuggc

SEQ ID NO: 3460535 - RNA, 15 nt, Pseudomonas aeruginosa PA01
gccgccgccuuggca

SEQ ID NO: 3460536 - RNA, 16 nt, Pseudomonas aeruginosa PA01
gccgccgcgcagcacc

SEQ ID NO: 3460537 - RNA, 17 nt, Pseudomonas aeruginosa PA01
gccgccgcgcagcacca

SEQ ID NO: 3460538 - RNA, 13 nt, Pseudomonas aeruginosa PA01
gccgccgcgcagg

SEQ ID NO: 3460539 - RNA, 17 nt, Pseudomonas aeruginosa PA01
gccgccgcgcaggcggu

SEQ ID NO: 3460540 - RNA, 15 nt, Pseudomonas aeruginosa PA01
gccgccgcgcccggc

SEQ ID NO: 3460541 - RNA, 16 nt, Pseudomonas aeruginosa PA01
gccgccgcgcccggcg

SEQ ID NO: 3460542 - RNA, 22 nt, Pseudomonas aeruginosa PA01
gccgccgcgcccggcgccaggc

SEQ ID NO: 3460543 - RNA, 12 nt, Pseudomonas aeruginosa PA01
gccgccgcgccu

SEQ ID NO: 3460544 - RNA, 13 nt, Pseudomonas aeruginosa PA01
gccgccgcgccuu

SEQ ID NO: 3460545 - RNA, 15 nt, Pseudomonas aeruginosa PA01
gccgccgcgccuuga

SEQ ID NO: 3460546 - RNA, 17 nt, Pseudomonas aeruginosa PA01
gccgccgcggcaccggc

SEQ ID NO: 3460547 - RNA, 12 nt, Pseudomonas aeruginosa PA01
gccgccgcggcc

SEQ ID NO: 3460548 - RNA, 13 nt, Pseudomonas aeruginosa PA01
gccgccgcggcca

SEQ ID NO: 3460549 - RNA, 15 nt, Pseudomonas aeruginosa PA01
gccgccgcggccagc

SEQ ID NO: 3460550 - RNA, 14 nt, Pseudomonas aeruginosa PA01
gccgccgcgggcaa

SEQ ID NO: 3460551 - RNA, 19 nt, Pseudomonas aeruginosa PA01
gccgccgcgggcaaccgcg

SEQ ID NO: 3460552 - RNA, 21 nt, Pseudomonas aeruginosa PA01
gccgccgcgggcaaccgcggc

SEQ ID NO: 3460553 - RNA, 14 nt, Pseudomonas aeruginosa PA01
gccgccgcgggcga

SEQ ID NO: 3460554 - RNA, 22 nt, Pseudomonas aeruginosa PA01
gccgccgcgggcgaacggcagc

SEQ ID NO: 3460555 - RNA, 22 nt, Pseudomonas aeruginosa PA01
gccgccgcgucgucggcgacgc

SEQ ID NO: 3460556 - RNA, 13 nt, Pseudomonas aeruginosa PA01
gccgccgcgugcc

SEQ ID NO: 3460557 - RNA, 14 nt, Pseudomonas aeruginosa PA01
gccgccgcgugggc

SEQ ID NO: 3460558 - RNA, 14 nt, Pseudomonas aeruginosa PA01
gccgccgcuggccu

SEQ ID NO: 3460559 - RNA, 18 nt, Pseudomonas aeruginosa PA01
gccgccgcuggccuggcc

SEQ ID NO: 3460560 - RNA, 19 nt, Pseudomonas aeruginosa PA01
gccgccgcuggccuggcca

SEQ ID NO: 3460561 - RNA, 23 nt, Pseudomonas aeruginosa PA01
gccgccgcuggccuggccacccu

SEQ ID NO: 3460562 - RNA, 13 nt, Pseudomonas aeruginosa PA01
gccgccgcuggcg

SEQ ID NO: 3460563 - RNA, 15 nt, Pseudomonas aeruginosa PA01
gccgccggaccgucg

SEQ ID NO: 3460564 - RNA, 16 nt, Pseudomonas aeruginosa PA01
gccgccggacuuggag

SEQ ID NO: 3460565 - RNA, 23 nt, Pseudomonas aeruginosa PA01
gccgccggagggaaugaagaagc

SEQ ID NO: 3460566 - RNA, 15 nt, Pseudomonas aeruginosa PA01
gccgccggcaucccu

SEQ ID NO: 3460567 - RNA, 13 nt, Pseudomonas aeruginosa PA01
gccgccggccacc

SEQ ID NO: 3460568 - RNA, 18 nt, Pseudomonas aeruginosa PA01
gccgccggccaccagcag

SEQ ID NO: 3460569 - RNA, 21 nt, Pseudomonas aeruginosa PA01
gccgccggccaccagcagcaa

SEQ ID NO: 3460570 - RNA, 15 nt, Pseudomonas aeruginosa PA01
gccgccggccagccg

SEQ ID NO: 3460571 - RNA, 12 nt, Pseudomonas aeruginosa PA01
gccgccggcgaa

SEQ ID NO: 3460572 - RNA, 17 nt, Pseudomonas aeruginosa PA01
gccgcgaaccgggucgu

SEQ ID NO: 3460573 - RNA, 18 nt, Pseudomonas aeruginosa PA01
gccgcgaagcccagcgcc

SEQ ID NO: 3460574 - RNA, 13 nt, Pseudomonas aeruginosa PA01
gccgcgacaggau

SEQ ID NO: 3460575 - RNA, 19 nt, Pseudomonas aeruginosa PA01
gccgcgaccgaagccgcgc

SEQ ID NO: 3460576 - RNA, 20 nt, Pseudomonas aeruginosa PA01
gccgcgaccgaagccgcgca

SEQ ID NO: 3460577 - RNA, 24 nt, Pseudomonas aeruginosa PA01
gccgcgaccgggcaugccgugggc

SEQ ID NO: 3460578 - RNA, 13 nt, Pseudomonas aeruginosa PA01
gccgcgaccugcu

SEQ ID NO: 3460579 - RNA, 16 nt, Pseudomonas aeruginosa PA01
gccgcgaccugcucgu

SEQ ID NO: 3460580 - RNA, 17 nt, Pseudomonas aeruginosa PA01
gccgcgaccugcucguc

SEQ ID NO: 3460581 - RNA, 18 nt, Pseudomonas aeruginosa PA01
gccgcgaccugcucgucg

SEQ ID NO: 3460582 - RNA, 19 nt, Pseudomonas aeruginosa PA01
gccgcgaccugcucgucga

SEQ ID NO: 3460583 - RNA, 22 nt, Pseudomonas aeruginosa PA01
gccgcgaccugcucgucgaugc

SEQ ID NO: 3460584 - RNA, 20 nt, Pseudomonas aeruginosa PA01
gccgcgacgacugcggcagc

SEQ ID NO: 3460585 - RNA, 21 nt, Pseudomonas aeruginosa PA01
gccgcgacgcgaccuccggcg

SEQ ID NO: 3460586 - RNA, 13 nt, Pseudomonas aeruginosa PA01
gccgcgacgcucc

SEQ ID NO: 3460587 - RNA, 15 nt, Pseudomonas aeruginosa PA01
gccgcgacgcuccag

SEQ ID NO: 3460588 - RNA, 19 nt, Pseudomonas aeruginosa PA01
gccgcgacgcuccagcggc

SEQ ID NO: 3460589 - RNA, 22 nt, Pseudomonas aeruginosa PA01
gccgcgacgcuccagcggcagc

SEQ ID NO: 3460590 - RNA, 14 nt, Pseudomonas aeruginosa PA01
gccgcgacggcugc

SEQ ID NO: 3460591 - RNA, 18 nt, Pseudomonas aeruginosa PA01
gccgcgacggcugcuccg

SEQ ID NO: 3460592 - RNA, 17 nt, Pseudomonas aeruginosa PA01
gccgcgacucggcugca

SEQ ID NO: 3460593 - RNA, 15 nt, Pseudomonas aeruginosa PA01
gccgcgagcaccaug

SEQ ID NO: 3460594 - RNA, 14 nt, Pseudomonas aeruginosa PA01
gccgcgagccagcc

SEQ ID NO: 3460595 - RNA, 19 nt, Pseudomonas aeruginosa PA01
gccgcgagccagccguggc

SEQ ID NO: 3460596 - RNA, 23 nt, Pseudomonas aeruginosa PA01
gccgcgagccuucagcacggcgc

SEQ ID NO: 3460597 - RNA, 16 nt, Pseudomonas aeruginosa PA01
gccgcgagcgccgccg

SEQ ID NO: 3460598 - RNA, 14 nt, Pseudomonas aeruginosa PA01
gccgcgagcgcggc

SEQ ID NO: 3460599 - RNA, 15 nt, Pseudomonas aeruginosa PA01
gccgcgagcgcggcc

SEQ ID NO: 3460600 - RNA, 16 nt, Pseudomonas aeruginosa PA01
gccgcgagcgcggccg

SEQ ID NO: 3460601 - RNA, 19 nt, Pseudomonas aeruginosa PA01
gccgcgagcuuggcccugg

SEQ ID NO: 3460602 - RNA, 21 nt, Pseudomonas aeruginosa PA01
gccgcgagcuuggcccuggcc

SEQ ID NO: 3460603 - RNA, 23 nt, Pseudomonas aeruginosa PA01
gccgcgagcuuggcccuggccuu

SEQ ID NO: 3460604 - RNA, 21 nt, Pseudomonas aeruginosa PA01
gccgcgaggggaacauugcca

SEQ ID NO: 3460605 - RNA, 18 nt, Pseudomonas aeruginosa PA01
gccgcgaguccuucggcg

SEQ ID NO: 3460606 - RNA, 16 nt, Pseudomonas aeruginosa PA01
gccgcgauauucgccc

SEQ ID NO: 3460607 - RNA, 14 nt, Pseudomonas aeruginosa PA01
gccgcgauggcucg

SEQ ID NO: 3460608 - RNA, 18 nt, Pseudomonas aeruginosa PA01
gccgcgauggcucgcggc

SEQ ID NO: 3460609 - RNA, 19 nt, Pseudomonas aeruginosa PA01
gccgcgauggcucgcggcg

SEQ ID NO: 3460610 - RNA, 20 nt, Pseudomonas aeruginosa PA01
gccgcgauggcucgcggcgc

SEQ ID NO: 3460611 - RNA, 22 nt, Pseudomonas aeruginosa PA01
gccgcgaugguaggugccaugg

SEQ ID NO: 3460612 - RNA, 12 nt, Pseudomonas aeruginosa PA01
gccgcgcaaccg

SEQ ID NO: 3460613 - RNA, 22 nt, Pseudomonas aeruginosa PA01
gccgcgcaaccguuccagcgcc

SEQ ID NO: 3460614 - RNA, 23 nt, Pseudomonas aeruginosa PA01
gccgcgcaaccguuccagcgccu

SEQ ID NO: 3460615 - RNA, 14 nt, Pseudomonas aeruginosa PA01
gccgcgcaaggcag

SEQ ID NO: 3460616 - RNA, 15 nt, Pseudomonas aeruginosa PA01
gccgcgcaaggcagc

SEQ ID NO: 3460617 - RNA, 23 nt, Pseudomonas aeruginosa PA01
gccgcgcaccaccgagagcggcg

SEQ ID NO: 3460618 - RNA, 12 nt, Pseudomonas aeruginosa PA01
gccgcgcaccag

SEQ ID NO: 3460619 - RNA, 13 nt, Pseudomonas aeruginosa PA01
gccgcgcaccagc

SEQ ID NO: 3460620 - RNA, 23 nt, Pseudomonas aeruginosa PA01
gccgcgcaccagcacuuccggcg

SEQ ID NO: 3460621 - RNA, 22 nt, Pseudomonas aeruginosa PA01
gccgcgcaccucgaccgcgccg

SEQ ID NO: 3460622 - RNA, 15 nt, Pseudomonas aeruginosa PA01
gccgcgcaccugggc

SEQ ID NO: 3460623 - RNA, 17 nt, Pseudomonas aeruginosa PA01
gccgcgcaccugggcgu

SEQ ID NO: 3460624 - RNA, 23 nt, Pseudomonas aeruginosa PA01
gccgcgcaccugggcguuggcca

SEQ ID NO: 3460625 - RNA, 22 nt, Pseudomonas aeruginosa PA01
gccgcgcacuuguagaggauca

SEQ ID NO: 3460626 - RNA, 19 nt, Pseudomonas aeruginosa PA01
gccgcgcagaucgcgucca

SEQ ID NO: 3460627 - RNA, 20 nt, Pseudomonas aeruginosa PA01
gccgcgcagaucgcguccag

SEQ ID NO: 3460628 - RNA, 21 nt, Pseudomonas aeruginosa PA01
gccgcgcagcaacggcgcauc

SEQ ID NO: 3460629 - RNA, 13 nt, Pseudomonas aeruginosa PA01
gccgcgcagcacc

SEQ ID NO: 3460630 - RNA, 22 nt, Pseudomonas aeruginosa PA01
gccgcgcagcacuuccugaagg

SEQ ID NO: 3460631 - RNA, 13 nt, Pseudomonas aeruginosa PA01
gccgcgcagcagu

SEQ ID NO: 3460632 - RNA, 21 nt, Pseudomonas aeruginosa PA01
gccgcgcagcaguaccuggcg

SEQ ID NO: 3460633 - RNA, 23 nt, Pseudomonas aeruginosa PA01
gccgcgcagcaguaccuggcggu

SEQ ID NO: 3460634 - RNA, 16 nt, Pseudomonas aeruginosa PA01
gccgcgcagcgcggcg

SEQ ID NO: 3460635 - RNA, 21 nt, Pseudomonas aeruginosa PA01
gccgcgcagcgcggcgcuggg

SEQ ID NO: 3460636 - RNA, 21 nt, Pseudomonas aeruginosa PA01
gccgcgcagcuugccuuccag

SEQ ID NO: 3460637 - RNA, 12 nt, Pseudomonas aeruginosa PA01
gccgcgcaggaa

SEQ ID NO: 3460638 - RNA, 22 nt, Pseudomonas aeruginosa PA01
gccgcgcaggaagaaggcgucc

SEQ ID NO: 3460639 - RNA, 15 nt, Pseudomonas aeruginosa PA01
gccgcgcagguucau

SEQ ID NO: 3460640 - RNA, 22 nt, Pseudomonas aeruginosa PA01
gccgcgcagguucaucgccgcc

SEQ ID NO: 3460641 - RNA, 20 nt, Pseudomonas aeruginosa PA01
gccgcgcagucccgcgcggc

SEQ ID NO: 3460642 - RNA, 18 nt, Pseudomonas aeruginosa PA01
gccgcgcaucaccccgca

SEQ ID NO: 3460643 - RNA, 20 nt, Pseudomonas aeruginosa PA01
gccgcgcaucaccccgcaac

SEQ ID NO: 3460644 - RNA, 15 nt, Pseudomonas aeruginosa PA01
gccgcgcauccucgg

SEQ ID NO: 3460645 - RNA, 20 nt, Pseudomonas aeruginosa PA01
gccgcgcauccucggcaucc

SEQ ID NO: 3460646 - RNA, 22 nt, Pseudomonas aeruginosa PA01
gccgcgccaaaaagcaggacgg

SEQ ID NO: 3460647 - RNA, 20 nt, Pseudomonas aeruginosa PA01
gccgcgccaacuggcgcaac

SEQ ID NO: 3460648 - RNA, 13 nt, Pseudomonas aeruginosa PA01
gccgcgccagcag

SEQ ID NO: 3460649 - RNA, 15 nt, Pseudomonas aeruginosa PA01
gccgcgccagcaggc

SEQ ID NO: 3460650 - RNA, 17 nt, Pseudomonas aeruginosa PA01
gccgcgccagcaggcgc

SEQ ID NO: 3460651 - RNA, 22 nt, Pseudomonas aeruginosa PA01
gccgcgccagcaggcgcagcag

SEQ ID NO: 3460652 - RNA, 13 nt, Pseudomonas aeruginosa PA01
gccgcgccaggcg

SEQ ID NO: 3460653 - RNA, 17 nt, Pseudomonas aeruginosa PA01
gccgcgccaggcgcagu

SEQ ID NO: 3460654 - RNA, 19 nt, Pseudomonas aeruginosa PA01
gccgcgccaggcgcaguag

SEQ ID NO: 3460655 - RNA, 22 nt, Pseudomonas aeruginosa PA01
gccgcgccaggcgcaguaggcc

SEQ ID NO: 3460656 - RNA, 14 nt, Pseudomonas aeruginosa PA01
gccgcgccagugcc

SEQ ID NO: 3460657 - RNA, 15 nt, Pseudomonas aeruginosa PA01
gccgcgccagugccu

SEQ ID NO: 3460658 - RNA, 23 nt, Pseudomonas aeruginosa PA01
gccgcgccagugccugcaccacg

SEQ ID NO: 3460659 - RNA, 20 nt, Pseudomonas aeruginosa PA01
gccgcgccaucggucgcgcc

SEQ ID NO: 3460660 - RNA, 22 nt, Pseudomonas aeruginosa PA01
gccgcgccaucggucgcgcccc

SEQ ID NO: 3460661 - RNA, 13 nt, Pseudomonas aeruginosa PA01
gccgcgccccacg

SEQ ID NO: 3460662 - RNA, 18 nt, Pseudomonas aeruginosa PA01
gccgcgccccagcggcag

SEQ ID NO: 3460663 - RNA, 16 nt, Pseudomonas aeruginosa PA01
gccgcgcccggccagg

SEQ ID NO: 3460664 - RNA, 17 nt, Pseudomonas aeruginosa PA01
gccgcgcccggccaggc

SEQ ID NO: 3460665 - RNA, 15 nt, Pseudomonas aeruginosa PA01
gccgcgcccggccuc

SEQ ID NO: 3460666 - RNA, 19 nt, Pseudomonas aeruginosa PA01
gccgcgcccggccuucacc

SEQ ID NO: 3460667 - RNA, 22 nt, Pseudomonas aeruginosa PA01
gccgcgcccggccuucaccgcg

SEQ ID NO: 3460668 - RNA, 13 nt, Pseudomonas aeruginosa PA01
gccgcgcccggcg

SEQ ID NO: 3460669 - RNA, 18 nt, Pseudomonas aeruginosa PA01
gccgcgcccggcgccagg

SEQ ID NO: 3460670 - RNA, 20 nt, Pseudomonas aeruginosa PA01
gccgcgcccggcgccaggcu

SEQ ID NO: 3460671 - RNA, 21 nt, Pseudomonas aeruginosa PA01
gccgcgcccggcgccaggcug

SEQ ID NO: 3460672 - RNA, 15 nt, Pseudomonas aeruginosa PA01
gccgcgccgacccag

SEQ ID NO: 3460673 - RNA, 13 nt, Pseudomonas aeruginosa PA01
gccgcgccgagcc

SEQ ID NO: 3460674 - RNA, 15 nt, Pseudomonas aeruginosa PA01
gccgcggcccugcgc

SEQ ID NO: 3460675 - RNA, 21 nt, Pseudomonas aeruginosa PA01
gccgcggcccugcgccgcagc

SEQ ID NO: 3460676 - RNA, 23 nt, Pseudomonas aeruginosa PA01
gccgcggccgaaaucgaugucgc

SEQ ID NO: 3460677 - RNA, 14 nt, Pseudomonas aeruginosa PA01
gccgcggccgggga

SEQ ID NO: 3460678 - RNA, 20 nt, Pseudomonas aeruginosa PA01
gccgcggcgaacaucaucca

SEQ ID NO: 3460679 - RNA, 18 nt, Pseudomonas aeruginosa PA01
gccgcggcgaagcgcucg

SEQ ID NO: 3460680 - RNA, 15 nt, Pseudomonas aeruginosa PA01
gccgcggcgaccagc

SEQ ID NO: 3460681 - RNA, 17 nt, Pseudomonas aeruginosa PA01
gccgcggcgaccagcgc

SEQ ID NO: 3460682 - RNA, 19 nt, Pseudomonas aeruginosa PA01
gccgcggcgaccagcgcgg

SEQ ID NO: 3460683 - RNA, 16 nt, Pseudomonas aeruginosa PA01
gccgcggcgaccaugu

SEQ ID NO: 3460684 - RNA, 15 nt, Pseudomonas aeruginosa PA01
gccgcggcgagcauc

SEQ ID NO: 3460685 - RNA, 19 nt, Pseudomonas aeruginosa PA01
gccgcggcgauaggcgcgc

SEQ ID NO: 3460686 - RNA, 14 nt, Pseudomonas aeruginosa PA01
gccgcggcgcggag

SEQ ID NO: 3460687 - RNA, 20 nt, Pseudomonas aeruginosa PA01
gccgcggcgcggagagucgg

SEQ ID NO: 3460688 - RNA, 13 nt, Pseudomonas aeruginosa PA01
gccgcggcggcgg

SEQ ID NO: 3460689 - RNA, 14 nt, Pseudomonas aeruginosa PA01
gccgcggcggcgug

SEQ ID NO: 3460690 - RNA, 18 nt, Pseudomonas aeruginosa PA01
gccgcggcggcgugcagg

SEQ ID NO: 3460691 - RNA, 22 nt, Pseudomonas aeruginosa PA01
gccgcggcggcgugcaggccga

SEQ ID NO: 3460692 - RNA, 16 nt, Pseudomonas aeruginosa PA01
gccgcggcguuagccg

SEQ ID NO: 3460693 - RNA, 20 nt, Pseudomonas aeruginosa PA01
gccgcggcguuagccgccug

SEQ ID NO: 3460694 - RNA, 19 nt, Pseudomonas aeruginosa PA01
gccgcggcguugucggcca

SEQ ID NO: 3460695 - RNA, 21 nt, Pseudomonas aeruginosa PA01
gccgcggcguugucggccagc

SEQ ID NO: 3460696 - RNA, 15 nt, Pseudomonas aeruginosa PA01
gccgcggcuggcagg

SEQ ID NO: 3460697 - RNA, 19 nt, Pseudomonas aeruginosa PA01
gccgcggcuggcaggugcc

SEQ ID NO: 3460698 - RNA, 23 nt, Pseudomonas aeruginosa PA01
gccgcggcuggcaggugccgcuc

SEQ ID NO: 3460699 - RNA, 14 nt, Pseudomonas aeruginosa PA01
gccgcggcuggcca

SEQ ID NO: 3460700 - RNA, 15 nt, Pseudomonas aeruginosa PA01
gccgcggcuggccau

SEQ ID NO: 3460701 - RNA, 14 nt, Pseudomonas aeruginosa PA01
gccgcgggacgccg

SEQ ID NO: 3460702 - RNA, 15 nt, Pseudomonas aeruginosa PA01
gccgcgggacgccgc

SEQ ID NO: 3460703 - RNA, 18 nt, Pseudomonas aeruginosa PA01
gccgcgggacgccgcagg

SEQ ID NO: 3460704 - RNA, 14 nt, Pseudomonas aeruginosa PA01
gccgcgggaggccg

SEQ ID NO: 3460705 - RNA, 15 nt, Pseudomonas aeruginosa PA01
gccgcgggaggccgc

SEQ ID NO: 3460706 - RNA, 20 nt, Pseudomonas aeruginosa PA01
gccgcgggaggccgccucga

SEQ ID NO: 3460707 - RNA, 18 nt, Pseudomonas aeruginosa PA01
gccgcgggcaaccgcggc

SEQ ID NO: 3460708 - RNA, 19 nt, Pseudomonas aeruginosa PA01
gccgcgggcaaccgcggcg

SEQ ID NO: 3460709 - RNA, 20 nt, Pseudomonas aeruginosa PA01
gccgcgggcaaccgcggcgg

SEQ ID NO: 3460710 - RNA, 13 nt, Pseudomonas aeruginosa PA01
gccgcgggccagc

SEQ ID NO: 3460711 - RNA, 16 nt, Pseudomonas aeruginosa PA01
gccgcgggcgaacggc

SEQ ID NO: 3460712 - RNA, 20 nt, Pseudomonas aeruginosa PA01
gccgcgggcgaacggcagcg

SEQ ID NO: 3460713 - RNA, 16 nt, Pseudomonas aeruginosa PA01
gccgcgggcguugcgc

SEQ ID NO: 3460714 - RNA, 19 nt, Pseudomonas aeruginosa PA01
gccgcgggcguugcgcgcc

SEQ ID NO: 3460715 - RNA, 21 nt, Pseudomonas aeruginosa PA01
gccgcgggcuauucccgccgc

SEQ ID NO: 3460716 - RNA, 23 nt, Pseudomonas aeruginosa PA01
gccgcgggcuauucccgccgcuc

SEQ ID NO: 3460717 - RNA, 22 nt, Pseudomonas aeruginosa PA01
gccgcggggaggaagcuccccg

SEQ ID NO: 3460718 - RNA, 23 nt, Pseudomonas aeruginosa PA01
gccgcggggaggaagcuccccgc

SEQ ID NO: 3460719 - RNA, 17 nt, Pseudomonas aeruginosa PA01
gccgcggguagcguugg

SEQ ID NO: 3460720 - RNA, 23 nt, Pseudomonas aeruginosa PA01
gccgcggguagcguuggaguagg

SEQ ID NO: 3460721 - RNA, 15 nt, Pseudomonas aeruginosa PA01
gccgcgggucaccag

SEQ ID NO: 3460722 - RNA, 16 nt, Pseudomonas aeruginosa PA01
gccgcgggucaccagc

SEQ ID NO: 3460723 - RNA, 19 nt, Pseudomonas aeruginosa PA01
gccgcgggucaccagcgcc

SEQ ID NO: 3460724 - RNA, 20 nt, Pseudomonas aeruginosa PA01
gccgcgggucaccagcgccg

SEQ ID NO: 3460725 - RNA, 21 nt, Pseudomonas aeruginosa PA01
gccgcgggucaccagcgccgg

SEQ ID NO: 3460726 - RNA, 14 nt, Pseudomonas aeruginosa PA01
gccgcgggucucga

SEQ ID NO: 3460727 - RNA, 22 nt, Pseudomonas aeruginosa PA01
gccgcgggucucgaucagcgcc

SEQ ID NO: 3460728 - RNA, 16 nt, Pseudomonas aeruginosa PA01
gccgcgggucugcucg

SEQ ID NO: 3460729 - RNA, 17 nt, Pseudomonas aeruginosa PA01
gccgcgggucugcucgg

SEQ ID NO: 3460730 - RNA, 17 nt, Pseudomonas aeruginosa PA01
gccgcgggucuugcgca

SEQ ID NO: 3460731 - RNA, 18 nt, Pseudomonas aeruginosa PA01
gccgcgggucuugcgcag

SEQ ID NO: 3460732 - RNA, 22 nt, Pseudomonas aeruginosa PA01
gccgcggguuccucacggcgca

SEQ ID NO: 3460733 - RNA, 17 nt, Pseudomonas aeruginosa PA01
gccgcgguaggucagcg

SEQ ID NO: 3460734 - RNA, 14 nt, Pseudomonas aeruginosa PA01
gccgcgguccaucc

SEQ ID NO: 3460735 - RNA, 24 nt, Pseudomonas aeruginosa PA01
gccgcggucgaugucgcggcccug

SEQ ID NO: 3460736 - RNA, 17 nt, Pseudomonas aeruginosa PA01
gccgcggucgggcagau

SEQ ID NO: 3460737 - RNA, 15 nt, Pseudomonas aeruginosa PA01
gccgcggucuucgcg

SEQ ID NO: 3460738 - RNA, 18 nt, Pseudomonas aeruginosa PA01
gccgcggucuucgcguug

SEQ ID NO: 3460739 - RNA, 15 nt, Pseudomonas aeruginosa PA01
gccgcggugcgggcc

SEQ ID NO: 3460740 - RNA, 16 nt, Pseudomonas aeruginosa PA01
gccgcggugcgggccu

SEQ ID NO: 3460741 - RNA, 14 nt, Pseudomonas aeruginosa PA01
gccgcggugucggc

SEQ ID NO: 3460742 - RNA, 18 nt, Pseudomonas aeruginosa PA01
gccgcgguuuccgugcgg

SEQ ID NO: 3460743 - RNA, 14 nt, Pseudomonas aeruginosa PA01
gccgcguaagcggc

SEQ ID NO: 3460744 - RNA, 15 nt, Pseudomonas aeruginosa PA01
gccgcguaagcggcc

SEQ ID NO: 3460745 - RNA, 16 nt, Pseudomonas aeruginosa PA01
gccgcguaagcggccu

SEQ ID NO: 3460746 - RNA, 17 nt, Pseudomonas aeruginosa PA01
gccgcguaagcggccuu

SEQ ID NO: 3460747 - RNA, 18 nt, Pseudomonas aeruginosa PA01
gccgcguagcgccaggcc

SEQ ID NO: 3460748 - RNA, 19 nt, Pseudomonas aeruginosa PA01
gccgcguagcgccaggccu

SEQ ID NO: 3460749 - RNA, 14 nt, Pseudomonas aeruginosa PA01
gccgcgucccugca

SEQ ID NO: 3460750 - RNA, 18 nt, Pseudomonas aeruginosa PA01
gccgcgucccugcacagg

SEQ ID NO: 3460751 - RNA, 21 nt, Pseudomonas aeruginosa PA01
gccgcgucccugcacagggac

SEQ ID NO: 3460752 - RNA, 22 nt, Pseudomonas aeruginosa PA01
gccgcguccgagagcagggccu

SEQ ID NO: 3460753 - RNA, 13 nt, Pseudomonas aeruginosa PA01
gccgcgucgaagc

SEQ ID NO: 3460754 - RNA, 19 nt, Pseudomonas aeruginosa PA01
gccgcgucgaagcugucgg

SEQ ID NO: 3460755 - RNA, 20 nt, Pseudomonas aeruginosa PA01
gccgcgucgaagcugucggc

SEQ ID NO: 3460756 - RNA, 15 nt, Pseudomonas aeruginosa PA01
gccgcgucgaagucg

SEQ ID NO: 3460757 - RNA, 15 nt, Pseudomonas aeruginosa PA01
gccgcgucgcccagg

SEQ ID NO: 3460758 - RNA, 17 nt, Pseudomonas aeruginosa PA01
gccgcgucgcccaggcc

SEQ ID NO: 3460759 - RNA, 18 nt, Pseudomonas aeruginosa PA01
gccgcgucgcccaggccg

SEQ ID NO: 3460760 - RNA, 19 nt, Pseudomonas aeruginosa PA01
gccgcgucgcccaggccgc

SEQ ID NO: 3460761 - RNA, 20 nt, Pseudomonas aeruginosa PA01
gccgcgucgcccaggccgcu

SEQ ID NO: 3460762 - RNA, 12 nt, Pseudomonas aeruginosa PA01
gccgcgucgccg

SEQ ID NO: 3460763 - RNA, 14 nt, Pseudomonas aeruginosa PA01
gccgcgucgccgcc

SEQ ID NO: 3460764 - RNA, 16 nt, Pseudomonas aeruginosa PA01
gccgcgucgccgccag

SEQ ID NO: 3460765 - RNA, 17 nt, Pseudomonas aeruginosa PA01
gccgcgucgccgccagc

SEQ ID NO: 3460766 - RNA, 14 nt, Pseudomonas aeruginosa PA01
gccgcgucgucggc

SEQ ID NO: 3460767 - RNA, 15 nt, Pseudomonas aeruginosa PA01
gccgcgucgucggcg

SEQ ID NO: 3460768 - RNA, 14 nt, Pseudomonas aeruginosa PA01
gccgcgugccgccg

SEQ ID NO: 3460769 - RNA, 15 nt, Pseudomonas aeruginosa PA01
gccgcgugccgccgg

SEQ ID NO: 3460770 - RNA, 18 nt, Pseudomonas aeruginosa PA01
gccgcgugccgccggacc

SEQ ID NO: 3460771 - RNA, 15 nt, Pseudomonas aeruginosa PA01
gccgcgugcgcgccc

SEQ ID NO: 3460772 - RNA, 16 nt, Pseudomonas aeruginosa PA01
gccgcgugcgcgccgc

SEQ ID NO: 3460773 - RNA, 23 nt, Pseudomonas aeruginosa PA01
gccgcgugcgcgccgccgggcgc

SEQ ID NO: 3460774 - RNA, 22 nt, Pseudomonas aeruginosa PA01
gccgcguucagucccgcggcgc

SEQ ID NO: 3460775 - RNA, 22 nt, Pseudomonas aeruginosa PA01
gccgcguuccuugugcacgaac

SEQ ID NO: 3460776 - RNA, 16 nt, Pseudomonas aeruginosa PA01
gccgcugcgcaucagg

SEQ ID NO: 3460777 - RNA, 14 nt, Pseudomonas aeruginosa PA01
gccgcugcgcgcag

SEQ ID NO: 3460778 - RNA, 15 nt, Pseudomonas aeruginosa PA01
gccgcugcgcgcagu

SEQ ID NO: 3460779 - RNA, 14 nt, Pseudomonas aeruginosa PA01
gccgcugcggcggu

SEQ ID NO: 3460780 - RNA, 15 nt, Pseudomonas aeruginosa PA01
gccgcugcggcucgc

SEQ ID NO: 3460781 - RNA, 18 nt, Pseudomonas aeruginosa PA01
gccgcugcggcucgccga

SEQ ID NO: 3460782 - RNA, 19 nt, Pseudomonas aeruginosa PA01
gccgcugcggcucgccgau

SEQ ID NO: 3460783 - RNA, 14 nt, Pseudomonas aeruginosa PA01
gccgcugcggcugc

SEQ ID NO: 3460784 - RNA, 17 nt, Pseudomonas aeruginosa PA01
gccgcugcggcugcagg

SEQ ID NO: 3460785 - RNA, 20 nt, Pseudomonas aeruginosa PA01
gccgcugcggcugcagggcc

SEQ ID NO: 3460786 - RNA, 12 nt, Pseudomonas aeruginosa PA01
gccgcugcugca

SEQ ID NO: 3460787 - RNA, 13 nt, Pseudomonas aeruginosa PA01
gccgcugcugcaa

SEQ ID NO: 3460788 - RNA, 14 nt, Pseudomonas aeruginosa PA01
gccgcugcugcaac

SEQ ID NO: 3460789 - RNA, 18 nt, Pseudomonas aeruginosa PA01
gccgcugcugcaaccgau

SEQ ID NO: 3460790 - RNA, 15 nt, Pseudomonas aeruginosa PA01
gccgcuggaaccggc

SEQ ID NO: 3460791 - RNA, 20 nt, Pseudomonas aeruginosa PA01
gccgcuggaaccggccggca

SEQ ID NO: 3460792 - RNA, 22 nt, Pseudomonas aeruginosa PA01
gccgcuggaaccggccggcagg

SEQ ID NO: 3460793 - RNA, 16 nt, Pseudomonas aeruginosa PA01
gccgcuggacgaaccg

SEQ ID NO: 3460794 - RNA, 23 nt, Pseudomonas aeruginosa PA01
gccgcuggcauacacaugcaggc

SEQ ID NO: 3460795 - RNA, 15 nt, Pseudomonas aeruginosa PA01
gccgcuggccgacca

SEQ ID NO: 3460796 - RNA, 14 nt, Pseudomonas aeruginosa PA01
gccgcuggccuggc

SEQ ID NO: 3460797 - RNA, 16 nt, Pseudomonas aeruginosa PA01
gccgcuggccuggcca

SEQ ID NO: 3460798 - RNA, 21 nt, Pseudomonas aeruginosa PA01
gccgcuggccuggccacccuu

SEQ ID NO: 3460799 - RNA, 15 nt, Pseudomonas aeruginosa PA01
gccgcuggcgacgcu

SEQ ID NO: 3460800 - RNA, 13 nt, Pseudomonas aeruginosa PA01
gccgcuggcgauc

SEQ ID NO: 3460801 - RNA, 18 nt, Pseudomonas aeruginosa PA01
gccgcuggcgaucucggc

SEQ ID NO: 3460802 - RNA, 20 nt, Pseudomonas aeruginosa PA01
gccgcuggcgaucucggcgc

SEQ ID NO: 3460803 - RNA, 16 nt, Pseudomonas aeruginosa PA01
gccgcuggcgcugacc

SEQ ID NO: 3460804 - RNA, 13 nt, Pseudomonas aeruginosa PA01
gccgcuggcggca

SEQ ID NO: 3460805 - RNA, 16 nt, Pseudomonas aeruginosa PA01
gccgcuggcggcaugc

SEQ ID NO: 3460806 - RNA, 14 nt, Pseudomonas aeruginosa PA01
gccgcuggcggccu

SEQ ID NO: 3460807 - RNA, 15 nt, Pseudomonas aeruginosa PA01
gccgcuggcggccuu

SEQ ID NO: 3460808 - RNA, 13 nt, Pseudomonas aeruginosa PA01
gccgcuggcggcg

SEQ ID NO: 3460809 - RNA, 14 nt, Pseudomonas aeruginosa PA01
gccgcuggcggcga

SEQ ID NO: 3460810 - RNA, 22 nt, Pseudomonas aeruginosa PA01
gccgcuggcggcgacgaagguc

SEQ ID NO: 3460811 - RNA, 19 nt, Pseudomonas aeruginosa PA01
gccgcuggcguuguugccg

SEQ ID NO: 3460812 - RNA, 19 nt, Pseudomonas aeruginosa PA01
gccgcugggccacguucug

SEQ ID NO: 3460813 - RNA, 20 nt, Pseudomonas aeruginosa PA01
gccgcugguccagcuggcgc

SEQ ID NO: 3460814 - RNA, 21 nt, Pseudomonas aeruginosa PA01
gccgcugguccagcuggcgca

SEQ ID NO: 3460815 - RNA, 16 nt, Pseudomonas aeruginosa PA01
gccgcuggugaucgac

SEQ ID NO: 3460816 - RNA, 17 nt, Pseudomonas aeruginosa PA01
gccgcuggugaucgacc

SEQ ID NO: 3460817 - RNA, 18 nt, Pseudomonas aeruginosa PA01
gccgcuggugaucgacca

SEQ ID NO: 3460818 - RNA, 19 nt, Pseudomonas aeruginosa PA01
gccgcuggugaucgaccac

SEQ ID NO: 3460819 - RNA, 21 nt, Pseudomonas aeruginosa PA01
gccgcuggugaucgaccacac

SEQ ID NO: 3460820 - RNA, 14 nt, Pseudomonas aeruginosa PA01
gccgcuguacaagc

SEQ ID NO: 3460821 - RNA, 15 nt, Pseudomonas aeruginosa PA01
gccgcugucguccag

SEQ ID NO: 3460822 - RNA, 16 nt, Pseudomonas aeruginosa PA01
gccgcugucguccagc

SEQ ID NO: 3460823 - RNA, 17 nt, Pseudomonas aeruginosa PA01
gccgcugucguccagcg

SEQ ID NO: 3460824 - RNA, 21 nt, Pseudomonas aeruginosa PA01
gccgcugucgucuucggccag

SEQ ID NO: 3460825 - RNA, 23 nt, Pseudomonas aeruginosa PA01
gccgcugucuaucugcgccgaag

SEQ ID NO: 3460826 - RNA, 22 nt, Pseudomonas aeruginosa PA01
gccgcuguggaaguacggcgcg

SEQ ID NO: 3460827 - RNA, 17 nt, Pseudomonas aeruginosa PA01
gccgcugugugccucug

SEQ ID NO: 3460828 - RNA, 15 nt, Pseudomonas aeruginosa PA01
gccgcuuacgcggcc

SEQ ID NO: 3460829 - RNA, 17 nt, Pseudomonas aeruginosa PA01
gccgcuuacgcggccuu

SEQ ID NO: 3460830 - RNA, 17 nt, Pseudomonas aeruginosa PA01
gccgcuucaagcggcca

SEQ ID NO: 3460831 - RNA, 17 nt, Pseudomonas aeruginosa PA01
gccgcuuccgccaggcg

SEQ ID NO: 3460832 - RNA, 20 nt, Pseudomonas aeruginosa PA01
gccgcuuccgccaggcgcag

SEQ ID NO: 3460833 - RNA, 15 nt, Pseudomonas aeruginosa PA01
gccgcuuccgccggc

SEQ ID NO: 3460834 - RNA, 19 nt, Pseudomonas aeruginosa PA01
gccgcuuccgccggcgccg

SEQ ID NO: 3460835 - RNA, 16 nt, Pseudomonas aeruginosa PA01
gccgcuuccggcccgg

SEQ ID NO: 3460836 - RNA, 19 nt, Pseudomonas aeruginosa PA01
gccgcuuccggcccggcca

SEQ ID NO: 3460837 - RNA, 20 nt, Pseudomonas aeruginosa PA01
gccgcuuccggcccggccag

SEQ ID NO: 3460838 - RNA, 15 nt, Pseudomonas aeruginosa PA01
gccgcuuccggcgcu

SEQ ID NO: 3460839 - RNA, 16 nt, Pseudomonas aeruginosa PA01
gccgcuucgccgcccu

SEQ ID NO: 3460840 - RNA, 22 nt, Pseudomonas aeruginosa PA01
gccgcuucgcgguagacgcagg

SEQ ID NO: 3460841 - RNA, 14 nt, Pseudomonas aeruginosa PA01
gccgcuucggcugc

SEQ ID NO: 3460842 - RNA, 15 nt, Pseudomonas aeruginosa PA01
gccgcuugaagcggc

SEQ ID NO: 3460843 - RNA, 17 nt, Pseudomonas aeruginosa PA01
gccgcuugaagcggcca

SEQ ID NO: 3460844 - RNA, 20 nt, Pseudomonas aeruginosa PA01
gccgcuugcccucgcgcccg

SEQ ID NO: 3460845 - RNA, 20 nt, Pseudomonas aeruginosa PA01
gccgcuuggagcgggcgccg

SEQ ID NO: 3460846 - RNA, 18 nt, Pseudomonas aeruginosa PA01
gccgcuuggccauggcgc

SEQ ID NO: 3460847 - RNA, 19 nt, Pseudomonas aeruginosa PA01
gccgcuuggccauggcgcu

SEQ ID NO: 3460848 - RNA, 20 nt, Pseudomonas aeruginosa PA01
gccgcuuugcagggucacgc

SEQ ID NO: 3460849 - RNA, 18 nt, Pseudomonas aeruginosa PA01
gccggaaaaagcaccgac

SEQ ID NO: 3460850 - RNA, 16 nt, Pseudomonas aeruginosa PA01
gccggaaaacagcgag

SEQ ID NO: 3460851 - RNA, 20 nt, Pseudomonas aeruginosa PA01
gccggaaagcaguucgcccg

SEQ ID NO: 3460852 - RNA, 22 nt, Pseudomonas aeruginosa PA01
gccggaaagcaguucgcccggc

SEQ ID NO: 3460853 - RNA, 16 nt, Pseudomonas aeruginosa PA01
gccggaaagccuggcc

SEQ ID NO: 3460854 - RNA, 20 nt, Pseudomonas aeruginosa PA01
gccggaaagccuggccggcg

SEQ ID NO: 3460855 - RNA, 21 nt, Pseudomonas aeruginosa PA01
gccggaaagccuggccggcga

SEQ ID NO: 3460856 - RNA, 23 nt, Pseudomonas aeruginosa PA01
gccggaaagccuggccggcgaac

SEQ ID NO: 3460857 - RNA, 21 nt, Pseudomonas aeruginosa PA01
gccggaaccuguccgaacagg

SEQ ID NO: 3460858 - RNA, 12 nt, Pseudomonas aeruginosa PA01
gccggaacggcu

SEQ ID NO: 3460859 - RNA, 18 nt, Pseudomonas aeruginosa PA01
gccggaagacggaaacgc

SEQ ID NO: 3460860 - RNA, 11 nt, Pseudomonas aeruginosa PA01
gccggaagcgc

SEQ ID NO: 3460861 - RNA, 17 nt, Pseudomonas aeruginosa PA01
gccggaagcgcucgcgc

SEQ ID NO: 3460862 - RNA, 16 nt, Pseudomonas aeruginosa PA01
gccggaagcuuccagc

SEQ ID NO: 3460863 - RNA, 15 nt, Pseudomonas aeruginosa PA01
gccggaaguggcagc

SEQ ID NO: 3460864 - RNA, 20 nt, Pseudomonas aeruginosa PA01
gccggaaucacgcugcucgc

SEQ ID NO: 3460865 - RNA, 18 nt, Pseudomonas aeruginosa PA01
gccggacaacaggccggg

SEQ ID NO: 3460866 - RNA, 19 nt, Pseudomonas aeruginosa PA01
gccggacaacaggccgggc

SEQ ID NO: 3460867 - RNA, 23 nt, Pseudomonas aeruginosa PA01
gccggacaacaggccgggcggcg

SEQ ID NO: 3460868 - RNA, 21 nt, Pseudomonas aeruginosa PA01
gccggacaggaaaaagcccgc

SEQ ID NO: 3460869 - RNA, 23 nt, Pseudomonas aeruginosa PA01
gccggacaggaaaaagcccgcgu

SEQ ID NO: 3460870 - RNA, 19 nt, Pseudomonas aeruginosa PA01
gccggaccaacugcgaacc

SEQ ID NO: 3460871 - RNA, 18 nt, Pseudomonas aeruginosa PA01
gccggaccagaucggcgc

SEQ ID NO: 3460872 - RNA, 19 nt, Pseudomonas aeruginosa PA01
gccggaccagaucggcgcg

SEQ ID NO: 3460873 - RNA, 20 nt, Pseudomonas aeruginosa PA01
gccggaccagaucggcgcgc

SEQ ID NO: 3460874 - RNA, 15 nt, Pseudomonas aeruginosa PA01
gccggaccagccggu

SEQ ID NO: 3460875 - RNA, 21 nt, Pseudomonas aeruginosa PA01
gccggaccagccggucccggg

SEQ ID NO: 3460876 - RNA, 13 nt, Pseudomonas aeruginosa PA01
gccggacccugcc

SEQ ID NO: 3460877 - RNA, 15 nt, Pseudomonas aeruginosa PA01
gccggaccgucgcga

SEQ ID NO: 3460878 - RNA, 15 nt, Pseudomonas aeruginosa PA01
gccggcauccagcau

SEQ ID NO: 3460879 - RNA, 19 nt, Pseudomonas aeruginosa PA01
gccggcauccuguggcugc

SEQ ID NO: 3460880 - RNA, 13 nt, Pseudomonas aeruginosa PA01
gccggcaucgcca

SEQ ID NO: 3460881 - RNA, 17 nt, Pseudomonas aeruginosa PA01
gccggcaucgccauggc

SEQ ID NO: 3460882 - RNA, 19 nt, Pseudomonas aeruginosa PA01
gccggcaucgccauggcgc

SEQ ID NO: 3460883 - RNA, 16 nt, Pseudomonas aeruginosa PA01
gccggcaucguggcca

SEQ ID NO: 3460884 - RNA, 21 nt, Pseudomonas aeruginosa PA01
gccggcaucguggccaugggu

SEQ ID NO: 3460885 - RNA, 18 nt, Pseudomonas aeruginosa PA01
gccggcaugcucagccgc

SEQ ID NO: 3460886 - RNA, 20 nt, Pseudomonas aeruginosa PA01
gccggcaugcucagccgcgc

SEQ ID NO: 3460887 - RNA, 21 nt, Pseudomonas aeruginosa PA01
gccggcaugcucagccgcgcc

SEQ ID NO: 3460888 - RNA, 23 nt, Pseudomonas aeruginosa PA01
gccggcaugcucagccgcgccgg

SEQ ID NO: 3460889 - RNA, 17 nt, Pseudomonas aeruginosa PA01
gccggcauugcccaaua

SEQ ID NO: 3460890 - RNA, 22 nt, Pseudomonas aeruginosa PA01
gccggcauugccgacuuccucg

SEQ ID NO: 3460891 - RNA, 18 nt, Pseudomonas aeruginosa PA01
gccggcauuggcacccug

SEQ ID NO: 3460892 - RNA, 19 nt, Pseudomonas aeruginosa PA01
gccggcauuggcacccugg

SEQ ID NO: 3460893 - RNA, 15 nt, Pseudomonas aeruginosa PA01
gccggccaaccaccg

SEQ ID NO: 3460894 - RNA, 16 nt, Pseudomonas aeruginosa PA01
gccggccaaccaccgg

SEQ ID NO: 3460895 - RNA, 16 nt, Pseudomonas aeruginosa PA01
gccggccaccagcagc

SEQ ID NO: 3460896 - RNA, 13 nt, Pseudomonas aeruginosa PA01
gccggccaccagg

SEQ ID NO: 3460897 - RNA, 14 nt, Pseudomonas aeruginosa PA01
gccggccaccaggc

SEQ ID NO: 3460898 - RNA, 15 nt, Pseudomonas aeruginosa PA01
gccggccaccaggcu

SEQ ID NO: 3460899 - RNA, 22 nt, Pseudomonas aeruginosa PA01
gccggccaccaucacgucgcgc

SEQ ID NO: 3460900 - RNA, 18 nt, Pseudomonas aeruginosa PA01
gccggccacgcgaccagc

SEQ ID NO: 3460901 - RNA, 21 nt, Pseudomonas aeruginosa PA01
gccggccacgcgaccagcgcc

SEQ ID NO: 3460902 - RNA, 13 nt, Pseudomonas aeruginosa PA01
gccggccagcacc

SEQ ID NO: 3460903 - RNA, 14 nt, Pseudomonas aeruginosa PA01
gccggccagcaccu

SEQ ID NO: 3460904 - RNA, 14 nt, Pseudomonas aeruginosa PA01
gccggccagccgcg

SEQ ID NO: 3460905 - RNA, 16 nt, Pseudomonas aeruginosa PA01
gccggccagccgcgcc

SEQ ID NO: 3460906 - RNA, 23 nt, Pseudomonas aeruginosa PA01
gccggccagccgcgccagugccu

SEQ ID NO: 3460907 - RNA, 13 nt, Pseudomonas aeruginosa PA01
gccggccaggaag

SEQ ID NO: 3460908 - RNA, 16 nt, Pseudomonas aeruginosa PA01
gccggccaggaaggcc

SEQ ID NO: 3460909 - RNA, 18 nt, Pseudomonas aeruginosa PA01
gccggccaggaaggccgc

SEQ ID NO: 3460910 - RNA, 12 nt, Pseudomonas aeruginosa PA01
gccggccagggc

SEQ ID NO: 3460911 - RNA, 14 nt, Pseudomonas aeruginosa PA01
gccggccagggcga

SEQ ID NO: 3460912 - RNA, 14 nt, Pseudomonas aeruginosa PA01
gccggccagggcgc

SEQ ID NO: 3460913 - RNA, 20 nt, Pseudomonas aeruginosa PA01
gccggccagggcgcgguagg

SEQ ID NO: 3460914 - RNA, 22 nt, Pseudomonas aeruginosa PA01
gccggccagggcgcgguaggga

SEQ ID NO: 3460915 - RNA, 17 nt, Pseudomonas aeruginosa PA01
gccggccaggggcugaa

SEQ ID NO: 3460916 - RNA, 13 nt, Pseudomonas aeruginosa PA01
gccggccaggguc

SEQ ID NO: 3460917 - RNA, 20 nt, Pseudomonas aeruginosa PA01
gccggccagggucgccagca

SEQ ID NO: 3460918 - RNA, 23 nt, Pseudomonas aeruginosa PA01
gccggccagguagcggaccccgg

SEQ ID NO: 3460919 - RNA, 22 nt, Pseudomonas aeruginosa PA01
gccggccagguagcggcguucg

SEQ ID NO: 3460920 - RNA, 21 nt, Pseudomonas aeruginosa PA01
gccggccaggucguugcgccg

SEQ ID NO: 3460921 - RNA, 13 nt, Pseudomonas aeruginosa PA01
gccggccaggugg

SEQ ID NO: 3460922 - RNA, 15 nt, Pseudomonas aeruginosa PA01
gccggccaguuggug

SEQ ID NO: 3460923 - RNA, 14 nt, Pseudomonas aeruginosa PA01
gccggccauccagc

SEQ ID NO: 3460924 - RNA, 16 nt, Pseudomonas aeruginosa PA01
gccggccauccagcca

SEQ ID NO: 3460925 - RNA, 17 nt, Pseudomonas aeruginosa PA01
gccggccauccagccag

SEQ ID NO: 3460926 - RNA, 22 nt, Pseudomonas aeruginosa PA01
gccggccauccagccaggcgcu

SEQ ID NO: 3460927 - RNA, 19 nt, Pseudomonas aeruginosa PA01
gccggccaugcaggccagg

SEQ ID NO: 3460928 - RNA, 16 nt, Pseudomonas aeruginosa PA01
gccggccaugcuggcg

SEQ ID NO: 3460929 - RNA, 18 nt, Pseudomonas aeruginosa PA01
gccggccauucgcugucg

SEQ ID NO: 3460930 - RNA, 20 nt, Pseudomonas aeruginosa PA01
gccggccauucgcugucgag

SEQ ID NO: 3460931 - RNA, 13 nt, Pseudomonas aeruginosa PA01
gccggcccagcag

SEQ ID NO: 3460932 - RNA, 15 nt, Pseudomonas aeruginosa PA01
gccggcccagcaggc

SEQ ID NO: 3460933 - RNA, 19 nt, Pseudomonas aeruginosa PA01
gccggcccagcaggccggc

SEQ ID NO: 3460934 - RNA, 21 nt, Pseudomonas aeruginosa PA01
gccggcccagcaggccggcca

SEQ ID NO: 3460935 - RNA, 23 nt, Pseudomonas aeruginosa PA01
gccggcccagcaggccggccagc

SEQ ID NO: 3460936 - RNA, 14 nt, Pseudomonas aeruginosa PA01
gccggcccauccgc

SEQ ID NO: 3460937 - RNA, 15 nt, Pseudomonas aeruginosa PA01
gccggcccauccgcc

SEQ ID NO: 3460938 - RNA, 18 nt, Pseudomonas aeruginosa PA01
gccggccccaccagcaac

SEQ ID NO: 3460939 - RNA, 12 nt, Pseudomonas aeruginosa PA01
gccggccccugg

SEQ ID NO: 3460940 - RNA, 14 nt, Pseudomonas aeruginosa PA01
gccggccccugggc

SEQ ID NO: 3460941 - RNA, 15 nt, Pseudomonas aeruginosa PA01
gccggccccugggcc

SEQ ID NO: 3460942 - RNA, 22 nt, Pseudomonas aeruginosa PA01
gccggcccgggucacggucagc

SEQ ID NO: 3460943 - RNA, 20 nt, Pseudomonas aeruginosa PA01
gccggcccgugcccguccua

SEQ ID NO: 3460944 - RNA, 13 nt, Pseudomonas aeruginosa PA01
gccggcccucgcg

SEQ ID NO: 3460945 - RNA, 16 nt, Pseudomonas aeruginosa PA01
gccggcccucgcgagc

SEQ ID NO: 3460946 - RNA, 18 nt, Pseudomonas aeruginosa PA01
gccggccgaucuucagca

SEQ ID NO: 3460947 - RNA, 14 nt, Pseudomonas aeruginosa PA01
gccggccgccagca

SEQ ID NO: 3460948 - RNA, 15 nt, Pseudomonas aeruginosa PA01
gccggccgcgucgcc

SEQ ID NO: 3460949 - RNA, 18 nt, Pseudomonas aeruginosa PA01
gccggccgcgucgcccag

SEQ ID NO: 3460950 - RNA, 14 nt, Pseudomonas aeruginosa PA01
gccggccggcagcg

SEQ ID NO: 3460951 - RNA, 11 nt, Pseudomonas aeruginosa PA01
gccggccggga

SEQ ID NO: 3460952 - RNA, 14 nt, Pseudomonas aeruginosa PA01
gccggccggggccg

SEQ ID NO: 3460953 - RNA, 13 nt, Pseudomonas aeruginosa PA01
gccggccggggcg

SEQ ID NO: 3460954 - RNA, 15 nt, Pseudomonas aeruginosa PA01
gccggccggggcgcg

SEQ ID NO: 3460955 - RNA, 16 nt, Pseudomonas aeruginosa PA01
gccggccggggcgcgc

SEQ ID NO: 3460956 - RNA, 18 nt, Pseudomonas aeruginosa PA01
gccggccggggcgcgccc

SEQ ID NO: 3460957 - RNA, 15 nt, Pseudomonas aeruginosa PA01
gccggccgggugacg

SEQ ID NO: 3460958 - RNA, 20 nt, Pseudomonas aeruginosa PA01
gccggccgucccagucggcg

SEQ ID NO: 3460959 - RNA, 24 nt, Pseudomonas aeruginosa PA01
gccggccgucgcgcaccacccauc

SEQ ID NO: 3460960 - RNA, 23 nt, Pseudomonas aeruginosa PA01
gccggccgugcggagggucaggc

SEQ ID NO: 3460961 - RNA, 13 nt, Pseudomonas aeruginosa PA01
gccggccuccagc

SEQ ID NO: 3460962 - RNA, 15 nt, Pseudomonas aeruginosa PA01
gccggccuccagcac

SEQ ID NO: 3460963 - RNA, 16 nt, Pseudomonas aeruginosa PA01
gccggccuccagcacu

SEQ ID NO: 3460964 - RNA, 15 nt, Pseudomonas aeruginosa PA01
gccggccuccagcgc

SEQ ID NO: 3460965 - RNA, 22 nt, Pseudomonas aeruginosa PA01
gccggccuccagcgccucgccg

SEQ ID NO: 3460966 - RNA, 15 nt, Pseudomonas aeruginosa PA01
gccggccucgacgca

SEQ ID NO: 3460967 - RNA, 17 nt, Pseudomonas aeruginosa PA01
gccggccucgacgcaga

SEQ ID NO: 3460968 - RNA, 13 nt, Pseudomonas aeruginosa PA01
gccggccucgagg

SEQ ID NO: 3460969 - RNA, 16 nt, Pseudomonas aeruginosa PA01
gccggccucgaggaac

SEQ ID NO: 3460970 - RNA, 16 nt, Pseudomonas aeruginosa PA01
gccggccucgcugccg

SEQ ID NO: 3460971 - RNA, 21 nt, Pseudomonas aeruginosa PA01
gccggccucgcugccgccgca

SEQ ID NO: 3460972 - RNA, 17 nt, Pseudomonas aeruginosa PA01
gccggccucggcggcgc

SEQ ID NO: 3460973 - RNA, 12 nt, Pseudomonas aeruginosa PA01
gccggccugcgc

SEQ ID NO: 3460974 - RNA, 13 nt, Pseudomonas aeruginosa PA01
gccggccugcgcg

SEQ ID NO: 3460975 - RNA, 19 nt, Pseudomonas aeruginosa PA01
gccggccugcgcgcaccag

SEQ ID NO: 3460976 - RNA, 20 nt, Pseudomonas aeruginosa PA01
gccggccugcgcgcaccagg

SEQ ID NO: 3460977 - RNA, 21 nt, Pseudomonas aeruginosa PA01
gccggccugcgcgcaccaggc

SEQ ID NO: 3460978 - RNA, 22 nt, Pseudomonas aeruginosa PA01
gccggccugcgcgcaccaggcc

SEQ ID NO: 3460979 - RNA, 22 nt, Pseudomonas aeruginosa PA01
gccggccugggccccggcgccg

SEQ ID NO: 3460980 - RNA, 23 nt, Pseudomonas aeruginosa PA01
gccggccuugcuuugcgccucgc

SEQ ID NO: 3460981 - RNA, 12 nt, Pseudomonas aeruginosa PA01
gccggcgcgccg

SEQ ID NO: 3460982 - RNA, 13 nt, Pseudomonas aeruginosa PA01
gccggcgcgccgu

SEQ ID NO: 3460983 - RNA, 12 nt, Pseudomonas aeruginosa PA01
gccggcgcgcgg

SEQ ID NO: 3460984 - RNA, 15 nt, Pseudomonas aeruginosa PA01
gccggcgcgcggcgg

SEQ ID NO: 3460985 - RNA, 16 nt, Pseudomonas aeruginosa PA01
gccggcgcgcggcggg

SEQ ID NO: 3460986 - RNA, 13 nt, Pseudomonas aeruginosa PA01
gccggcgcgcuug

SEQ ID NO: 3460987 - RNA, 14 nt, Pseudomonas aeruginosa PA01
gccggcgcggcgca

SEQ ID NO: 3460988 - RNA, 16 nt, Pseudomonas aeruginosa PA01
gccggcgcggcgcagc

SEQ ID NO: 3460989 - RNA, 15 nt, Pseudomonas aeruginosa PA01
gccggcgcggcguuc

SEQ ID NO: 3460990 - RNA, 21 nt, Pseudomonas aeruginosa PA01
gccggcgcgggcggccucgau

SEQ ID NO: 3460991 - RNA, 17 nt, Pseudomonas aeruginosa PA01
gccggcgcggucucgcg

SEQ ID NO: 3460992 - RNA, 18 nt, Pseudomonas aeruginosa PA01
gccggcgcgucccugggc

SEQ ID NO: 3460993 - RNA, 22 nt, Pseudomonas aeruginosa PA01
gccggcgcgucccugggcgcag

SEQ ID NO: 3460994 - RNA, 21 nt, Pseudomonas aeruginosa PA01
gccggcgcguucacuccacga

SEQ ID NO: 3460995 - RNA, 16 nt, Pseudomonas aeruginosa PA01
gccggcgcucggccag

SEQ ID NO: 3460996 - RNA, 18 nt, Pseudomonas aeruginosa PA01
gccggcgcucggccaggu

SEQ ID NO: 3460997 - RNA, 20 nt, Pseudomonas aeruginosa PA01
gccggcgcucggccaggucg

SEQ ID NO: 3460998 - RNA, 12 nt, Pseudomonas aeruginosa PA01
gccggcgcugcg

SEQ ID NO: 3460999 - RNA, 17 nt, Pseudomonas aeruginosa PA01
gccggcgcugcgagcgc

SEQ ID NO: 3461000 - RNA, 14 nt, Pseudomonas aeruginosa PA01
gccggcgcugguug

SEQ ID NO: 3461001 - RNA, 16 nt, Pseudomonas aeruginosa PA01
gccggcgcugucucgc

SEQ ID NO: 3461002 - RNA, 21 nt, Pseudomonas aeruginosa PA01
gccggcgcugucucgccagcc

SEQ ID NO: 3461003 - RNA, 15 nt, Pseudomonas aeruginosa PA01
gccggcgcuucugcg

SEQ ID NO: 3461004 - RNA, 19 nt, Pseudomonas aeruginosa PA01
gccggcgcuucugcgagcc

SEQ ID NO: 3461005 - RNA, 23 nt, Pseudomonas aeruginosa PA01
gccggcgcuucugcgagccgcgc

SEQ ID NO: 3461006 - RNA, 12 nt, Pseudomonas aeruginosa PA01
gccggcggauca

SEQ ID NO: 3461007 - RNA, 18 nt, Pseudomonas aeruginosa PA01
gccggcggaucacaggcu

SEQ ID NO: 3461008 - RNA, 16 nt, Pseudomonas aeruginosa PA01
gccggcggaucagccc

SEQ ID NO: 3461009 - RNA, 21 nt, Pseudomonas aeruginosa PA01
gccggcggaucagcccgcuga

SEQ ID NO: 3461010 - RNA, 12 nt, Pseudomonas aeruginosa PA01
gccggcggcauc

SEQ ID NO: 3461011 - RNA, 14 nt, Pseudomonas aeruginosa PA01
gccggcggccaggg

SEQ ID NO: 3461012 - RNA, 12 nt, Pseudomonas aeruginosa PA01
gccggcggccga

SEQ ID NO: 3461013 - RNA, 15 nt, Pseudomonas aeruginosa PA01
gccggcggccugagc

SEQ ID NO: 3461014 - RNA, 17 nt, Pseudomonas aeruginosa PA01
gccggcggccugagccg

SEQ ID NO: 3461015 - RNA, 19 nt, Pseudomonas aeruginosa PA01
gccggcggccugagccggc

SEQ ID NO: 3461016 - RNA, 16 nt, Pseudomonas aeruginosa PA01
gccggcggccugcccc

SEQ ID NO: 3461017 - RNA, 18 nt, Pseudomonas aeruginosa PA01
gccggcggccugccccgc

SEQ ID NO: 3461018 - RNA, 13 nt, Pseudomonas aeruginosa PA01
gccggcggcgaug

SEQ ID NO: 3461019 - RNA, 13 nt, Pseudomonas aeruginosa PA01
gccggcggcgcgg

SEQ ID NO: 3461020 - RNA, 17 nt, Pseudomonas aeruginosa PA01
gccggcggcgcggcagu

SEQ ID NO: 3461021 - RNA, 14 nt, Pseudomonas aeruginosa PA01
gccggcggcgcguc

SEQ ID NO: 3461022 - RNA, 15 nt, Pseudomonas aeruginosa PA01
gccggcggcggacgc

SEQ ID NO: 3461023 - RNA, 17 nt, Pseudomonas aeruginosa PA01
gccggcggcggacgcag

SEQ ID NO: 3461024 - RNA, 11 nt, Pseudomonas aeruginosa PA01
gccggcggcgu

SEQ ID NO: 3461025 - RNA, 15 nt, Pseudomonas aeruginosa PA01
gccggcgggcgcgag

SEQ ID NO: 3461026 - RNA, 22 nt, Pseudomonas aeruginosa PA01
gccggcgggcgcgaggcgcccg

SEQ ID NO: 3461027 - RNA, 11 nt, Pseudomonas aeruginosa PA01
gccggcgggga

SEQ ID NO: 3461028 - RNA, 21 nt, Pseudomonas aeruginosa PA01
gccggcggggaagccuucgcc

SEQ ID NO: 3461029 - RNA, 21 nt, Pseudomonas aeruginosa PA01
gccggcgguggacgucggcgu

SEQ ID NO: 3461030 - RNA, 22 nt, Pseudomonas aeruginosa PA01
gccggcguacuucggcgcggug

SEQ ID NO: 3461031 - RNA, 13 nt, Pseudomonas aeruginosa PA01
gccggcguccagg

SEQ ID NO: 3461032 - RNA, 18 nt, Pseudomonas aeruginosa PA01
gccggcguccaggaggga

SEQ ID NO: 3461033 - RNA, 13 nt, Pseudomonas aeruginosa PA01
gccggcguccgcc

SEQ ID NO: 3461034 - RNA, 15 nt, Pseudomonas aeruginosa PA01
gccggcguccgccgg

SEQ ID NO: 3461035 - RNA, 15 nt, Pseudomonas aeruginosa PA01
gccggcguccuugcc

SEQ ID NO: 3461036 - RNA, 17 nt, Pseudomonas aeruginosa PA01
gccggcguccuugccga

SEQ ID NO: 3461037 - RNA, 19 nt, Pseudomonas aeruginosa PA01
gccggcguccuugccgagg

SEQ ID NO: 3461038 - RNA, 13 nt, Pseudomonas aeruginosa PA01
gccggcgucggcg

SEQ ID NO: 3461039 - RNA, 14 nt, Pseudomonas aeruginosa PA01
gccggcgucggcga

SEQ ID NO: 3461040 - RNA, 16 nt, Pseudomonas aeruginosa PA01
gccggcgucggcgagc

SEQ ID NO: 3461041 - RNA, 19 nt, Pseudomonas aeruginosa PA01
gccggcgucguccugcgcg

SEQ ID NO: 3461042 - RNA, 14 nt, Pseudomonas aeruginosa PA01
gccggcgugaacgc

SEQ ID NO: 3461043 - RNA, 20 nt, Pseudomonas aeruginosa PA01
gccggcgugaacgcggcgag

SEQ ID NO: 3461044 - RNA, 13 nt, Pseudomonas aeruginosa PA01
gccggcgugcccu

SEQ ID NO: 3461045 - RNA, 16 nt, Pseudomonas aeruginosa PA01
gccggcgugccgaccu

SEQ ID NO: 3461046 - RNA, 19 nt, Pseudomonas aeruginosa PA01
gccggcguuauccgccgau

SEQ ID NO: 3461047 - RNA, 15 nt, Pseudomonas aeruginosa PA01
gccggcguucgacgc

SEQ ID NO: 3461048 - RNA, 16 nt, Pseudomonas aeruginosa PA01
gccggcguucgacgcc

SEQ ID NO: 3461049 - RNA, 21 nt, Pseudomonas aeruginosa PA01
gccggcguucgacgccuugcc

SEQ ID NO: 3461050 - RNA, 22 nt, Pseudomonas aeruginosa PA01
gccggcguucgacgccuugccc

SEQ ID NO: 3461051 - RNA, 17 nt, Pseudomonas aeruginosa PA01
gccggcguugcgcgccc

SEQ ID NO: 3461052 - RNA, 18 nt, Pseudomonas aeruginosa PA01
gccggcguuggcgucgcu

SEQ ID NO: 3461053 - RNA, 23 nt, Pseudomonas aeruginosa PA01
gccggcguuggcgucgcugccgc

SEQ ID NO: 3461054 - RNA, 16 nt, Pseudomonas aeruginosa PA01
gccggcuaaccgcgaa

SEQ ID NO: 3461055 - RNA, 19 nt, Pseudomonas aeruginosa PA01
gccggcuaaccgcgaagcg

SEQ ID NO: 3461056 - RNA, 21 nt, Pseudomonas aeruginosa PA01
gccggcucagcgcuucggcuc

SEQ ID NO: 3461057 - RNA, 21 nt, Pseudomonas aeruginosa PA01
gccggcucccugcaauggggc

SEQ ID NO: 3461058 - RNA, 20 nt, Pseudomonas aeruginosa PA01
gccggcuccuugcgccguug

SEQ ID NO: 3461059 - RNA, 23 nt, Pseudomonas aeruginosa PA01
gccggcuccuugcgccguugccg

SEQ ID NO: 3461060 - RNA, 15 nt, Pseudomonas aeruginosa PA01
gccggcucgcccagc

SEQ ID NO: 3461061 - RNA, 16 nt, Pseudomonas aeruginosa PA01
gccggcucgcccagca

SEQ ID NO: 3461062 - RNA, 19 nt, Pseudomonas aeruginosa PA01
gccggcucgcccagcaggc

SEQ ID NO: 3461063 - RNA, 21 nt, Pseudomonas aeruginosa PA01
gccggcucgcccagcaggcgc

SEQ ID NO: 3461064 - RNA, 14 nt, Pseudomonas aeruginosa PA01
gccggcucggugua

SEQ ID NO: 3461065 - RNA, 14 nt, Pseudomonas aeruginosa PA01
gccggcugacgcug

SEQ ID NO: 3461066 - RNA, 15 nt, Pseudomonas aeruginosa PA01
gccggcugacgcugg

SEQ ID NO: 3461067 - RNA, 13 nt, Pseudomonas aeruginosa PA01
gccggcugaugcc

SEQ ID NO: 3461068 - RNA, 17 nt, Pseudomonas aeruginosa PA01
gccggcugaugcccggg

SEQ ID NO: 3461069 - RNA, 20 nt, Pseudomonas aeruginosa PA01
gccggcugaugcccgggucg

SEQ ID NO: 3461070 - RNA, 22 nt, Pseudomonas aeruginosa PA01
gccggcugaugcccgggucguc

SEQ ID NO: 3461071 - RNA, 15 nt, Pseudomonas aeruginosa PA01
gccggcugccgaaga

SEQ ID NO: 3461072 - RNA, 14 nt, Pseudomonas aeruginosa PA01
gccggcugccgcgc

SEQ ID NO: 3461073 - RNA, 15 nt, Pseudomonas aeruginosa PA01
gccggcugccgcgcg

SEQ ID NO: 3461074 - RNA, 21 nt, Pseudomonas aeruginosa PA01
gccggcugcgccgcguucgcc

SEQ ID NO: 3461075 - RNA, 23 nt, Pseudomonas aeruginosa PA01
gccggcugcgccgcguucgccga

SEQ ID NO: 3461076 - RNA, 13 nt, Pseudomonas aeruginosa PA01
gccggcugcuccg

SEQ ID NO: 3461077 - RNA, 22 nt, Pseudomonas aeruginosa PA01
gccggcugcuccgggcggcugu

SEQ ID NO: 3461078 - RNA, 14 nt, Pseudomonas aeruginosa PA01
gccggcugugcagg

SEQ ID NO: 3461079 - RNA, 15 nt, Pseudomonas aeruginosa PA01
gccggcugugcaggg

SEQ ID NO: 3461080 - RNA, 13 nt, Pseudomonas aeruginosa PA01
gccggcuucagca

SEQ ID NO: 3461081 - RNA, 18 nt, Pseudomonas aeruginosa PA01
gccggcuuccaccagacg

SEQ ID NO: 3461082 - RNA, 20 nt, Pseudomonas aeruginosa PA01
gccggcuuccaccagacgca

SEQ ID NO: 3461083 - RNA, 22 nt, Pseudomonas aeruginosa PA01
gccggcuuccaccagacgcagc

SEQ ID NO: 3461084 - RNA, 16 nt, Pseudomonas aeruginosa PA01
gccgggcuucuucagg

SEQ ID NO: 3461085 - RNA, 21 nt, Pseudomonas aeruginosa PA01
gccgggcuuuuucaugggcgc

SEQ ID NO: 3461086 - RNA, 22 nt, Pseudomonas aeruginosa PA01
gccgggcuuuuucaugggcgcg

SEQ ID NO: 3461087 - RNA, 20 nt, Pseudomonas aeruginosa PA01
gccgggcuuuuucucgucgc

SEQ ID NO: 3461088 - RNA, 21 nt, Pseudomonas aeruginosa PA01
gccgggcuuuuucucgucgcg

SEQ ID NO: 3461089 - RNA, 22 nt, Pseudomonas aeruginosa PA01
gccgggcuuuuucucgucgcgc

SEQ ID NO: 3461090 - RNA, 17 nt, Pseudomonas aeruginosa PA01
gccgggcuuuuuugggu

SEQ ID NO: 3461091 - RNA, 13 nt, Pseudomonas aeruginosa PA01
gccggggaacagg

SEQ ID NO: 3461092 - RNA, 20 nt, Pseudomonas aeruginosa PA01
gccggggaaccacaccugca

SEQ ID NO: 3461093 - RNA, 21 nt, Pseudomonas aeruginosa PA01
gccggggaagauguucgccgc

SEQ ID NO: 3461094 - RNA, 22 nt, Pseudomonas aeruginosa PA01
gccggggaagauguucgccgcc

SEQ ID NO: 3461095 - RNA, 15 nt, Pseudomonas aeruginosa PA01
gccggggaucggcau

SEQ ID NO: 3461096 - RNA, 14 nt, Pseudomonas aeruginosa PA01
gccggggcagcagg

SEQ ID NO: 3461097 - RNA, 22 nt, Pseudomonas aeruginosa PA01
gccggggcaggcaugcggcccc

SEQ ID NO: 3461098 - RNA, 15 nt, Pseudomonas aeruginosa PA01
gccggggccggcacc

SEQ ID NO: 3461099 - RNA, 18 nt, Pseudomonas aeruginosa PA01
gccggggccuacugcugg

SEQ ID NO: 3461100 - RNA, 13 nt, Pseudomonas aeruginosa PA01
gccggggcgcgcc

SEQ ID NO: 3461101 - RNA, 14 nt, Pseudomonas aeruginosa PA01
gccggggcgcgccc

SEQ ID NO: 3461102 - RNA, 18 nt, Pseudomonas aeruginosa PA01
gccggggcggauucaggc

SEQ ID NO: 3461103 - RNA, 22 nt, Pseudomonas aeruginosa PA01
gccggggcggauucaggcgcgc

SEQ ID NO: 3461104 - RNA, 15 nt, Pseudomonas aeruginosa PA01
gccggggcgggccgc

SEQ ID NO: 3461105 - RNA, 17 nt, Pseudomonas aeruginosa PA01
gccggggcgggccgcgc

SEQ ID NO: 3461106 - RNA, 20 nt, Pseudomonas aeruginosa PA01
gccggggcgugcaggccgcc

SEQ ID NO: 3461107 - RNA, 22 nt, Pseudomonas aeruginosa PA01
gccggggcgugcaggccgccga

SEQ ID NO: 3461108 - RNA, 14 nt, Pseudomonas aeruginosa PA01
gccgggggcggcga

SEQ ID NO: 3461109 - RNA, 18 nt, Pseudomonas aeruginosa PA01
gccgggggcggcgccugg

SEQ ID NO: 3461110 - RNA, 19 nt, Pseudomonas aeruginosa PA01
gccgggggucgcggcgacc

SEQ ID NO: 3461111 - RNA, 16 nt, Pseudomonas aeruginosa PA01
gccgggggucgcgggu

SEQ ID NO: 3461112 - RNA, 18 nt, Pseudomonas aeruginosa PA01
gccggggucaggccgagg

SEQ ID NO: 3461113 - RNA, 19 nt, Pseudomonas aeruginosa PA01
gccgggguggaguaccagg

SEQ ID NO: 3461114 - RNA, 21 nt, Pseudomonas aeruginosa PA01
gccgggguggaguaccaggcc

SEQ ID NO: 3461115 - RNA, 22 nt, Pseudomonas aeruginosa PA01
gccgggguugaguugcaggccg

SEQ ID NO: 3461116 - RNA, 23 nt, Pseudomonas aeruginosa PA01
gccgggguugaguugcaggccgg

SEQ ID NO: 3461117 - RNA, 16 nt, Pseudomonas aeruginosa PA01
gccggguacagcgcca

SEQ ID NO: 3461118 - RNA, 22 nt, Pseudomonas aeruginosa PA01
gccggguacagcgccacggcca

SEQ ID NO: 3461119 - RNA, 21 nt, Pseudomonas aeruginosa PA01
gccggguagcguuaucgccgg

SEQ ID NO: 3461120 - RNA, 23 nt, Pseudomonas aeruginosa PA01
gccggguagcguuaucgccgguc

SEQ ID NO: 3461121 - RNA, 20 nt, Pseudomonas aeruginosa PA01
gccggguauccagcacccgc

SEQ ID NO: 3461122 - RNA, 16 nt, Pseudomonas aeruginosa PA01
gccgggucagacugag

SEQ ID NO: 3461123 - RNA, 18 nt, Pseudomonas aeruginosa PA01
gccgggucaucaccggca

SEQ ID NO: 3461124 - RNA, 20 nt, Pseudomonas aeruginosa PA01
gccggguccaccgcggccuc

SEQ ID NO: 3461125 - RNA, 23 nt, Pseudomonas aeruginosa PA01
gccggguccaccgcggccucgcu

SEQ ID NO: 3461126 - RNA, 12 nt, Pseudomonas aeruginosa PA01
gccgggucgaca

SEQ ID NO: 3461127 - RNA, 19 nt, Pseudomonas aeruginosa PA01
gccgggucgacaugcaggc

SEQ ID NO: 3461128 - RNA, 22 nt, Pseudomonas aeruginosa PA01
gccgggucgacaugcaggccgg

SEQ ID NO: 3461129 - RNA, 21 nt, Pseudomonas aeruginosa PA01
gccgggucgaccuugccgacg

SEQ ID NO: 3461130 - RNA, 22 nt, Pseudomonas aeruginosa PA01
gccgggucgacuucgcaccagc

SEQ ID NO: 3461131 - RNA, 14 nt, Pseudomonas aeruginosa PA01
gccgggucgauggg

SEQ ID NO: 3461132 - RNA, 23 nt, Pseudomonas aeruginosa PA01
gccgggucgaugggccguaggug

SEQ ID NO: 3461133 - RNA, 17 nt, Pseudomonas aeruginosa PA01
gccgggucguacaccag

SEQ ID NO: 3461134 - RNA, 19 nt, Pseudomonas aeruginosa PA01
gccgggugaccgugcgggu

SEQ ID NO: 3461135 - RNA, 13 nt, Pseudomonas aeruginosa PA01
gccgggugccggu

SEQ ID NO: 3461136 - RNA, 14 nt, Pseudomonas aeruginosa PA01
gccgggugccggug

SEQ ID NO: 3461137 - RNA, 20 nt, Pseudomonas aeruginosa PA01
gccgggugcuaugcgccggg

SEQ ID NO: 3461138 - RNA, 18 nt, Pseudomonas aeruginosa PA01
gccggguucaucgacacc

SEQ ID NO: 3461139 - RNA, 13 nt, Pseudomonas aeruginosa PA01
gccggguucccag

SEQ ID NO: 3461140 - RNA, 21 nt, Pseudomonas aeruginosa PA01
gccggguucccaguugcuggg

SEQ ID NO: 3461141 - RNA, 22 nt, Pseudomonas aeruginosa PA01
gccggguucccaguugcugggc

SEQ ID NO: 3461142 - RNA, 14 nt, Pseudomonas aeruginosa PA01
gccggguugccgcu

SEQ ID NO: 3461143 - RNA, 16 nt, Pseudomonas aeruginosa PA01
gccggguugccgcugg

SEQ ID NO: 3461144 - RNA, 19 nt, Pseudomonas aeruginosa PA01
gccggguugccgcuggccu

SEQ ID NO: 3461145 - RNA, 20 nt, Pseudomonas aeruginosa PA01
gccggguugccgcuggccuc

SEQ ID NO: 3461146 - RNA, 15 nt, Pseudomonas aeruginosa PA01
gccggguugcgccgc

SEQ ID NO: 3461147 - RNA, 22 nt, Pseudomonas aeruginosa PA01
gccggguugcgccgcaaguggc

SEQ ID NO: 3461148 - RNA, 21 nt, Pseudomonas aeruginosa PA01
gccggguugcgccuccgggcg

SEQ ID NO: 3461149 - RNA, 16 nt, Pseudomonas aeruginosa PA01
gccggguuguccaggc

SEQ ID NO: 3461150 - RNA, 15 nt, Pseudomonas aeruginosa PA01
gccggguuucacggc

SEQ ID NO: 3461151 - RNA, 18 nt, Pseudomonas aeruginosa PA01
gccgguaauuggccaggc

SEQ ID NO: 3461152 - RNA, 19 nt, Pseudomonas aeruginosa PA01
gccgguaauuggccaggcu

SEQ ID NO: 3461153 - RNA, 14 nt, Pseudomonas aeruginosa PA01
gccgguacgcacca

SEQ ID NO: 3461154 - RNA, 15 nt, Pseudomonas aeruginosa PA01
gccgguacgcaccag

SEQ ID NO: 3461155 - RNA, 16 nt, Pseudomonas aeruginosa PA01
gccgguacgcaccagc

SEQ ID NO: 3461156 - RNA, 18 nt, Pseudomonas aeruginosa PA01
gccgguacgcaccagcgg

SEQ ID NO: 3461157 - RNA, 18 nt, Pseudomonas aeruginosa PA01
gccgguacucgccgggcg

SEQ ID NO: 3461158 - RNA, 19 nt, Pseudomonas aeruginosa PA01
gccgguacucgccgggcgu

SEQ ID NO: 3461159 - RNA, 14 nt, Pseudomonas aeruginosa PA01
gccgguagccggcg

SEQ ID NO: 3461160 - RNA, 15 nt, Pseudomonas aeruginosa PA01
gccgguagccggcga

SEQ ID NO: 3461161 - RNA, 16 nt, Pseudomonas aeruginosa PA01
gccgguagccggcgau

SEQ ID NO: 3461162 - RNA, 17 nt, Pseudomonas aeruginosa PA01
gccgguagccggcgauc

SEQ ID NO: 3461163 - RNA, 18 nt, Pseudomonas aeruginosa PA01
gccgguagccggcgauca

SEQ ID NO: 3461164 - RNA, 20 nt, Pseudomonas aeruginosa PA01
gccgguagccggcgaucagc

SEQ ID NO: 3461165 - RNA, 15 nt, Pseudomonas aeruginosa PA01
gccgguagccguucg

SEQ ID NO: 3461166 - RNA, 15 nt, Pseudomonas aeruginosa PA01
gccgguagcggcgca

SEQ ID NO: 3461167 - RNA, 17 nt, Pseudomonas aeruginosa PA01
gccgguagcggcgcacc

SEQ ID NO: 3461168 - RNA, 14 nt, Pseudomonas aeruginosa PA01
gccgguagcuggcc

SEQ ID NO: 3461169 - RNA, 17 nt, Pseudomonas aeruginosa PA01
gccgguaggucaccagg

SEQ ID NO: 3461170 - RNA, 22 nt, Pseudomonas aeruginosa PA01
gccgguaguagcgauugcagcg

SEQ ID NO: 3461171 - RNA, 14 nt, Pseudomonas aeruginosa PA01
gccgguagucgggg

SEQ ID NO: 3461172 - RNA, 17 nt, Pseudomonas aeruginosa PA01
gccgguagugcuucagg

SEQ ID NO: 3461173 - RNA, 18 nt, Pseudomonas aeruginosa PA01
gccgguagugcuucaggu

SEQ ID NO: 3461174 - RNA, 19 nt, Pseudomonas aeruginosa PA01
gccggucaaccgcgggcga

SEQ ID NO: 3461175 - RNA, 18 nt, Pseudomonas aeruginosa PA01
gccggucaccacuggaaa

SEQ ID NO: 3461176 - RNA, 21 nt, Pseudomonas aeruginosa PA01
gccggucaccacuggaaacgc

SEQ ID NO: 3461177 - RNA, 13 nt, Pseudomonas aeruginosa PA01
gccggucaggcgc

SEQ ID NO: 3461178 - RNA, 13 nt, Pseudomonas aeruginosa PA01
gccggucaggcug

SEQ ID NO: 3461179 - RNA, 14 nt, Pseudomonas aeruginosa PA01
gccggucaggcugc

SEQ ID NO: 3461180 - RNA, 15 nt, Pseudomonas aeruginosa PA01
gccggucaggcugcg

SEQ ID NO: 3461181 - RNA, 16 nt, Pseudomonas aeruginosa PA01
gccggucaggcuggug

SEQ ID NO: 3461182 - RNA, 20 nt, Pseudomonas aeruginosa PA01
gccggucaggcuggugccgc

SEQ ID NO: 3461183 - RNA, 14 nt, Pseudomonas aeruginosa PA01
gccggucagguagg

SEQ ID NO: 3461184 - RNA, 21 nt, Pseudomonas aeruginosa PA01
gccggucagguaggcaucgac

SEQ ID NO: 3461185 - RNA, 14 nt, Pseudomonas aeruginosa PA01
gccggucauugucg

SEQ ID NO: 3461186 - RNA, 18 nt, Pseudomonas aeruginosa PA01
gccguagaggucgccguc

SEQ ID NO: 3461187 - RNA, 16 nt, Pseudomonas aeruginosa PA01
gccguagaguucggcu

SEQ ID NO: 3461188 - RNA, 22 nt, Pseudomonas aeruginosa PA01
gccguagccgaacggguagagc

SEQ ID NO: 3461189 - RNA, 14 nt, Pseudomonas aeruginosa PA01
gccguagccggugc

SEQ ID NO: 3461190 - RNA, 13 nt, Pseudomonas aeruginosa PA01
gccguagccgucg

SEQ ID NO: 3461191 - RNA, 22 nt, Pseudomonas aeruginosa PA01
gccguagccgucgaacagcagc

SEQ ID NO: 3461192 - RNA, 20 nt, Pseudomonas aeruginosa PA01
gccguagcgaugcgguuccu

SEQ ID NO: 3461193 - RNA, 14 nt, Pseudomonas aeruginosa PA01
gccguagcgcaguu

SEQ ID NO: 3461194 - RNA, 21 nt, Pseudomonas aeruginosa PA01
gccguagcgcaguucgccgcc

SEQ ID NO: 3461195 - RNA, 22 nt, Pseudomonas aeruginosa PA01
gccguagcgcaguucgccgccg

SEQ ID NO: 3461196 - RNA, 23 nt, Pseudomonas aeruginosa PA01
gccguagcgcaguucgccgccga

SEQ ID NO: 3461197 - RNA, 23 nt, Pseudomonas aeruginosa PA01
gccguagcgcuucaucaggcugc

SEQ ID NO: 3461198 - RNA, 20 nt, Pseudomonas aeruginosa PA01
gccguagcggccucguucgg

SEQ ID NO: 3461199 - RNA, 17 nt, Pseudomonas aeruginosa PA01
gccguagcugcgcgccu

SEQ ID NO: 3461200 - RNA, 13 nt, Pseudomonas aeruginosa PA01
gccguaggccacu

SEQ ID NO: 3461201 - RNA, 16 nt, Pseudomonas aeruginosa PA01
gccguaggcgauggcc

SEQ ID NO: 3461202 - RNA, 21 nt, Pseudomonas aeruginosa PA01
gccguaguggcguuccaggcg

SEQ ID NO: 3461203 - RNA, 15 nt, Pseudomonas aeruginosa PA01
gccguauccgcggca

SEQ ID NO: 3461204 - RNA, 16 nt, Pseudomonas aeruginosa PA01
gccguauccgcggcag

SEQ ID NO: 3461205 - RNA, 19 nt, Pseudomonas aeruginosa PA01
gccguauccgcggcagggg

SEQ ID NO: 3461206 - RNA, 17 nt, Pseudomonas aeruginosa PA01
gccgucaagcaacggcg

SEQ ID NO: 3461207 - RNA, 15 nt, Pseudomonas aeruginosa PA01
gccgucaccagcagc

SEQ ID NO: 3461208 - RNA, 16 nt, Pseudomonas aeruginosa PA01
gccgucaccagcagcc

SEQ ID NO: 3461209 - RNA, 22 nt, Pseudomonas aeruginosa PA01
gccgucaccagcagccccgagg

SEQ ID NO: 3461210 - RNA, 17 nt, Pseudomonas aeruginosa PA01
gccgucacggccuccgg

SEQ ID NO: 3461211 - RNA, 18 nt, Pseudomonas aeruginosa PA01
gccgucacggccuccggu

SEQ ID NO: 3461212 - RNA, 17 nt, Pseudomonas aeruginosa PA01
gccgucacuugaagucc

SEQ ID NO: 3461213 - RNA, 16 nt, Pseudomonas aeruginosa PA01
gccguccaccaagcgg

SEQ ID NO: 3461214 - RNA, 15 nt, Pseudomonas aeruginosa PA01
gccguccaccagcca

SEQ ID NO: 3461215 - RNA, 16 nt, Pseudomonas aeruginosa PA01
gccguccaccagccag

SEQ ID NO: 3461216 - RNA, 17 nt, Pseudomonas aeruginosa PA01
gccguccaccagccagc

SEQ ID NO: 3461217 - RNA, 20 nt, Pseudomonas aeruginosa PA01
gccguccaccagccagcucg

SEQ ID NO: 3461218 - RNA, 21 nt, Pseudomonas aeruginosa PA01
gccguccaccagccagcucgg

SEQ ID NO: 3461219 - RNA, 15 nt, Pseudomonas aeruginosa PA01
gccguccagccggcg

SEQ ID NO: 3461220 - RNA, 16 nt, Pseudomonas aeruginosa PA01
gccguccagccggcgc

SEQ ID NO: 3461221 - RNA, 17 nt, Pseudomonas aeruginosa PA01
gccguccagccggcgcu

SEQ ID NO: 3461222 - RNA, 18 nt, Pseudomonas aeruginosa PA01
gccguccagccggcgcuu

SEQ ID NO: 3461223 - RNA, 20 nt, Pseudomonas aeruginosa PA01
gccguccagccggcgcuucu

SEQ ID NO: 3461224 - RNA, 13 nt, Pseudomonas aeruginosa PA01
gccguccagcgag

SEQ ID NO: 3461225 - RNA, 23 nt, Pseudomonas aeruginosa PA01
gccguccagcgagaacuugccgg

SEQ ID NO: 3461226 - RNA, 15 nt, Pseudomonas aeruginosa PA01
gccguccaggcugcc

SEQ ID NO: 3461227 - RNA, 16 nt, Pseudomonas aeruginosa PA01
gccguccaggcugccg

SEQ ID NO: 3461228 - RNA, 19 nt, Pseudomonas aeruginosa PA01
gccguccaggcugccgccu

SEQ ID NO: 3461229 - RNA, 17 nt, Pseudomonas aeruginosa PA01
gccguccaguucuucca

SEQ ID NO: 3461230 - RNA, 15 nt, Pseudomonas aeruginosa PA01
gccgucccagucggc

SEQ ID NO: 3461231 - RNA, 17 nt, Pseudomonas aeruginosa PA01
gccgucccagucggcgu

SEQ ID NO: 3461232 - RNA, 20 nt, Pseudomonas aeruginosa PA01
gccgucccagucggcguccg

SEQ ID NO: 3461233 - RNA, 22 nt, Pseudomonas aeruginosa PA01
gccgucccagucggcguccgcc

SEQ ID NO: 3461234 - RNA, 18 nt, Pseudomonas aeruginosa PA01
gccgucccauuccucggc

SEQ ID NO: 3461235 - RNA, 14 nt, Pseudomonas aeruginosa PA01
gccguccgccaggu

SEQ ID NO: 3461236 - RNA, 16 nt, Pseudomonas aeruginosa PA01
gccguccgcccaguuc

SEQ ID NO: 3461237 - RNA, 22 nt, Pseudomonas aeruginosa PA01
gccguccgcccaguucgccggc

SEQ ID NO: 3461238 - RNA, 24 nt, Pseudomonas aeruginosa PA01
gccguccgcccaguucgccggcca

SEQ ID NO: 3461239 - RNA, 14 nt, Pseudomonas aeruginosa PA01
gccguccgcgggcg

SEQ ID NO: 3461240 - RNA, 13 nt, Pseudomonas aeruginosa PA01
gccguccgucggc

SEQ ID NO: 3461241 - RNA, 14 nt, Pseudomonas aeruginosa PA01
gccguccgucggca

SEQ ID NO: 3461242 - RNA, 15 nt, Pseudomonas aeruginosa PA01
gccguccgucggcag

SEQ ID NO: 3461243 - RNA, 20 nt, Pseudomonas aeruginosa PA01
gccguccgucggcaguggug

SEQ ID NO: 3461244 - RNA, 14 nt, Pseudomonas aeruginosa PA01
gccguccucgucga

SEQ ID NO: 3461245 - RNA, 16 nt, Pseudomonas aeruginosa PA01
gccguccugcaacugc

SEQ ID NO: 3461246 - RNA, 18 nt, Pseudomonas aeruginosa PA01
gccguccugcaacugcuc

SEQ ID NO: 3461247 - RNA, 19 nt, Pseudomonas aeruginosa PA01
gccguccugcaacugcucg

SEQ ID NO: 3461248 - RNA, 21 nt, Pseudomonas aeruginosa PA01
gccguccugcaacugcucgau

SEQ ID NO: 3461249 - RNA, 17 nt, Pseudomonas aeruginosa PA01
gccguccugcggccgca

SEQ ID NO: 3461250 - RNA, 14 nt, Pseudomonas aeruginosa PA01
gccguccugcuuga

SEQ ID NO: 3461251 - RNA, 18 nt, Pseudomonas aeruginosa PA01
gccguccuucaggacgaa

SEQ ID NO: 3461252 - RNA, 23 nt, Pseudomonas aeruginosa PA01
gccguccuugaguagcuggcgca

SEQ ID NO: 3461253 - RNA, 22 nt, Pseudomonas aeruginosa PA01
gccguccuugucgcagcggccg

SEQ ID NO: 3461254 - RNA, 17 nt, Pseudomonas aeruginosa PA01
gccgucgaacagcagcu

SEQ ID NO: 3461255 - RNA, 21 nt, Pseudomonas aeruginosa PA01
gccgucgaagggcacgccgcu

SEQ ID NO: 3461256 - RNA, 22 nt, Pseudomonas aeruginosa PA01
gccgucgaagggcacgccgcuc

SEQ ID NO: 3461257 - RNA, 23 nt, Pseudomonas aeruginosa PA01
gccgucgacacugauauccgcuc

SEQ ID NO: 3461258 - RNA, 14 nt, Pseudomonas aeruginosa PA01
gccgucgacccgcc

SEQ ID NO: 3461259 - RNA, 14 nt, Pseudomonas aeruginosa PA01
gccgucgagcacca

SEQ ID NO: 3461260 - RNA, 15 nt, Pseudomonas aeruginosa PA01
gccgucgagcaccag

SEQ ID NO: 3461261 - RNA, 16 nt, Pseudomonas aeruginosa PA01
gccgucgagcaccagc

SEQ ID NO: 3461262 - RNA, 17 nt, Pseudomonas aeruginosa PA01
gccgucgagcaccagca

SEQ ID NO: 3461263 - RNA, 18 nt, Pseudomonas aeruginosa PA01
gccgucgagcaccagcag

SEQ ID NO: 3461264 - RNA, 22 nt, Pseudomonas aeruginosa PA01
gccgucgagcaccagcaggucg

SEQ ID NO: 3461265 - RNA, 13 nt, Pseudomonas aeruginosa PA01
gccgucgagccag

SEQ ID NO: 3461266 - RNA, 21 nt, Pseudomonas aeruginosa PA01
gccgucgagccagcccagcgg

SEQ ID NO: 3461267 - RNA, 19 nt, Pseudomonas aeruginosa PA01
gccgucgaggucggcgauc

SEQ ID NO: 3461268 - RNA, 22 nt, Pseudomonas aeruginosa PA01
gccgucgaucagguaggccggc

SEQ ID NO: 3461269 - RNA, 19 nt, Pseudomonas aeruginosa PA01
gccgucgcacucuuccugg

SEQ ID NO: 3461270 - RNA, 13 nt, Pseudomonas aeruginosa PA01
gccgucgccgcug

SEQ ID NO: 3461271 - RNA, 16 nt, Pseudomonas aeruginosa PA01
gccgucgccgcugaug

SEQ ID NO: 3461272 - RNA, 18 nt, Pseudomonas aeruginosa PA01
gccgucgccgcugaugcg

SEQ ID NO: 3461273 - RNA, 14 nt, Pseudomonas aeruginosa PA01
gccgucgcgcacca

SEQ ID NO: 3461274 - RNA, 19 nt, Pseudomonas aeruginosa PA01
gccgucgcgcucuuccuuc

SEQ ID NO: 3461275 - RNA, 20 nt, Pseudomonas aeruginosa PA01
gccgucgcggaagccgugca

SEQ ID NO: 3461276 - RNA, 13 nt, Pseudomonas aeruginosa PA01
gccgucgcugccg

SEQ ID NO: 3461277 - RNA, 14 nt, Pseudomonas aeruginosa PA01
gccgucgcugccga

SEQ ID NO: 3461278 - RNA, 15 nt, Pseudomonas aeruginosa PA01
gccgucgcugccgag

SEQ ID NO: 3461279 - RNA, 14 nt, Pseudomonas aeruginosa PA01
gccgucgcuggcga

SEQ ID NO: 3461280 - RNA, 17 nt, Pseudomonas aeruginosa PA01
gccgucgcuggcuuccu

SEQ ID NO: 3461281 - RNA, 17 nt, Pseudomonas aeruginosa PA01
gccgucggacucgacgu

SEQ ID NO: 3461282 - RNA, 19 nt, Pseudomonas aeruginosa PA01
gccgucggccugcuugcag

SEQ ID NO: 3461283 - RNA, 23 nt, Pseudomonas aeruginosa PA01
gccgucggccugcuugcaggagu

SEQ ID NO: 3461284 - RNA, 13 nt, Pseudomonas aeruginosa PA01
gccgucggccugg

SEQ ID NO: 3461285 - RNA, 15 nt, Pseudomonas aeruginosa PA01
gccgucggccuggcg

SEQ ID NO: 3461286 - RNA, 12 nt, Pseudomonas aeruginosa PA01
gccgucggcgau

SEQ ID NO: 3461287 - RNA, 23 nt, Pseudomonas aeruginosa PA01
gccgucggcgaucgccaguuccg

SEQ ID NO: 3461288 - RNA, 16 nt, Pseudomonas aeruginosa PA01
gccgucggcgcggggc

SEQ ID NO: 3461289 - RNA, 18 nt, Pseudomonas aeruginosa PA01
gccgucggcgcggggcgu

SEQ ID NO: 3461290 - RNA, 11 nt, Pseudomonas aeruginosa PA01
gccgucggcgg

SEQ ID NO: 3461291 - RNA, 12 nt, Pseudomonas aeruginosa PA01
gccgucggcggu

SEQ ID NO: 3461292 - RNA, 14 nt, Pseudomonas aeruginosa PA01
gccgucggcgguca

SEQ ID NO: 3461293 - RNA, 15 nt, Pseudomonas aeruginosa PA01
gccgucggcuccgcu

SEQ ID NO: 3461294 - RNA, 17 nt, Pseudomonas aeruginosa PA01
gccgucgggcauggcga

SEQ ID NO: 3461295 - RNA, 19 nt, Pseudomonas aeruginosa PA01
gccgucgggcauggcgauc

SEQ ID NO: 3461296 - RNA, 15 nt, Pseudomonas aeruginosa PA01
gccgucgguguccgc

SEQ ID NO: 3461297 - RNA, 21 nt, Pseudomonas aeruginosa PA01
gccgucgguguccgcggugcc

SEQ ID NO: 3461298 - RNA, 23 nt, Pseudomonas aeruginosa PA01
gccgucgguguccgcggugccgc

SEQ ID NO: 3461299 - RNA, 17 nt, Pseudomonas aeruginosa PA01
gccgucguagcgcagcg

SEQ ID NO: 3461300 - RNA, 19 nt, Pseudomonas aeruginosa PA01
gccgucguagcgcagcggc

SEQ ID NO: 3461301 - RNA, 20 nt, Pseudomonas aeruginosa PA01
gccgucguagcgcagcggca

SEQ ID NO: 3461302 - RNA, 15 nt, Pseudomonas aeruginosa PA01
gccgucguccggguu

SEQ ID NO: 3461303 - RNA, 16 nt, Pseudomonas aeruginosa PA01
gccgucguccggguuc

SEQ ID NO: 3461304 - RNA, 14 nt, Pseudomonas aeruginosa PA01
gccgucuccaggcg

SEQ ID NO: 3461305 - RNA, 23 nt, Pseudomonas aeruginosa PA01
gccgucuccaggcgcgccgugcg

SEQ ID NO: 3461306 - RNA, 20 nt, Pseudomonas aeruginosa PA01
gccgucuuccagggcggcgc

SEQ ID NO: 3461307 - RNA, 15 nt, Pseudomonas aeruginosa PA01
gccgucuugccgcug

SEQ ID NO: 3461308 - RNA, 20 nt, Pseudomonas aeruginosa PA01
gccgugaaaagcggcgugca

SEQ ID NO: 3461309 - RNA, 21 nt, Pseudomonas aeruginosa PA01
gccgugaagcacggugacacc

SEQ ID NO: 3461310 - RNA, 15 nt, Pseudomonas aeruginosa PA01
gccgugagcacgagg

SEQ ID NO: 3461311 - RNA, 16 nt, Pseudomonas aeruginosa PA01
gccgugaggcgcgcgc

SEQ ID NO: 3461312 - RNA, 19 nt, Pseudomonas aeruginosa PA01
gccgugaggcgcgcgccga

SEQ ID NO: 3461313 - RNA, 20 nt, Pseudomonas aeruginosa PA01
gccgugaggcgcgcgccgaa

SEQ ID NO: 3461314 - RNA, 16 nt, Pseudomonas aeruginosa PA01
gccgugaucaccugga

SEQ ID NO: 3461315 - RNA, 23 nt, Pseudomonas aeruginosa PA01
gccgugcaacuggguugccaggu

SEQ ID NO: 3461316 - RNA, 12 nt, Pseudomonas aeruginosa PA01
gccgugcagcag

SEQ ID NO: 3461317 - RNA, 13 nt, Pseudomonas aeruginosa PA01
gccgugcagcagc

SEQ ID NO: 3461318 - RNA, 14 nt, Pseudomonas aeruginosa PA01
gccgugcagcagcg

SEQ ID NO: 3461319 - RNA, 18 nt, Pseudomonas aeruginosa PA01
gccgugcagcagcgaccu

SEQ ID NO: 3461320 - RNA, 13 nt, Pseudomonas aeruginosa PA01
gccgugcagcccu

SEQ ID NO: 3461321 - RNA, 14 nt, Pseudomonas aeruginosa PA01
gccgugcagcccuc

SEQ ID NO: 3461322 - RNA, 14 nt, Pseudomonas aeruginosa PA01
gccgugcaggguca

SEQ ID NO: 3461323 - RNA, 17 nt, Pseudomonas aeruginosa PA01
gccgugcagggucaggu

SEQ ID NO: 3461324 - RNA, 15 nt, Pseudomonas aeruginosa PA01
gccgugcaucaccgg

SEQ ID NO: 3461325 - RNA, 16 nt, Pseudomonas aeruginosa PA01
gccgugcaucaccggc

SEQ ID NO: 3461326 - RNA, 17 nt, Pseudomonas aeruginosa PA01
gccgugcaucaccggca

SEQ ID NO: 3461327 - RNA, 18 nt, Pseudomonas aeruginosa PA01
gccgugcaucaccggcag

SEQ ID NO: 3461328 - RNA, 21 nt, Pseudomonas aeruginosa PA01
gccgugcaucaccggcagcag

SEQ ID NO: 3461329 - RNA, 22 nt, Pseudomonas aeruginosa PA01
gccgugcaucaccggcagcagc

SEQ ID NO: 3461330 - RNA, 23 nt, Pseudomonas aeruginosa PA01
gccgugcaucaccggcagcagcg

SEQ ID NO: 3461331 - RNA, 14 nt, Pseudomonas aeruginosa PA01
gccgugcaugccga

SEQ ID NO: 3461332 - RNA, 15 nt, Pseudomonas aeruginosa PA01
gccgugcaugccgac

SEQ ID NO: 3461333 - RNA, 17 nt, Pseudomonas aeruginosa PA01
gccgugcaugccgacga

SEQ ID NO: 3461334 - RNA, 18 nt, Pseudomonas aeruginosa PA01
gccgugccucagagucgc

SEQ ID NO: 3461335 - RNA, 13 nt, Pseudomonas aeruginosa PA01
gccgugcgcuccg

SEQ ID NO: 3461336 - RNA, 16 nt, Pseudomonas aeruginosa PA01
gccgugcgcuccgcca

SEQ ID NO: 3461337 - RNA, 17 nt, Pseudomonas aeruginosa PA01
gccgugcgcuccgccag

SEQ ID NO: 3461338 - RNA, 18 nt, Pseudomonas aeruginosa PA01
gccgugcgcuccgccagg

SEQ ID NO: 3461339 - RNA, 22 nt, Pseudomonas aeruginosa PA01
gccgugcgcuccgccaggccgc

SEQ ID NO: 3461340 - RNA, 21 nt, Pseudomonas aeruginosa PA01
gccgugcggagggucaggccg

SEQ ID NO: 3461341 - RNA, 22 nt, Pseudomonas aeruginosa PA01
gccgugcggagggucaggccga

SEQ ID NO: 3461342 - RNA, 18 nt, Pseudomonas aeruginosa PA01
gccgugcggcguucgccg

SEQ ID NO: 3461343 - RNA, 22 nt, Pseudomonas aeruginosa PA01
gccgugcucgaugaucgacugc

SEQ ID NO: 3461344 - RNA, 14 nt, Pseudomonas aeruginosa PA01
gccguggaacgcag

SEQ ID NO: 3461345 - RNA, 18 nt, Pseudomonas aeruginosa PA01
gccguggaccaacagccg

SEQ ID NO: 3461346 - RNA, 21 nt, Pseudomonas aeruginosa PA01
gccguggaccaacagccggcg

SEQ ID NO: 3461347 - RNA, 16 nt, Pseudomonas aeruginosa PA01
gccguggaccaggauc

SEQ ID NO: 3461348 - RNA, 20 nt, Pseudomonas aeruginosa PA01
gccguggaccaggaucaccu

SEQ ID NO: 3461349 - RNA, 18 nt, Pseudomonas aeruginosa PA01
gccguggaucgcccggcu

SEQ ID NO: 3461350 - RNA, 19 nt, Pseudomonas aeruginosa PA01
gccguggaugucgaggaac

SEQ ID NO: 3461351 - RNA, 13 nt, Pseudomonas aeruginosa PA01
gccguggcaccag

SEQ ID NO: 3461352 - RNA, 14 nt, Pseudomonas aeruginosa PA01
gccguggcaccagg

SEQ ID NO: 3461353 - RNA, 15 nt, Pseudomonas aeruginosa PA01
gccguggcacccagg

SEQ ID NO: 3461354 - RNA, 19 nt, Pseudomonas aeruginosa PA01
gccguggcacccaggccac

SEQ ID NO: 3461355 - RNA, 16 nt, Pseudomonas aeruginosa PA01
gccguggcgccccagg

SEQ ID NO: 3461356 - RNA, 17 nt, Pseudomonas aeruginosa PA01
gccguggcgccccaggc

SEQ ID NO: 3461357 - RNA, 18 nt, Pseudomonas aeruginosa PA01
gccguggcgccccaggcg

SEQ ID NO: 3461358 - RNA, 20 nt, Pseudomonas aeruginosa PA01
gccguggcgccccaggcggg

SEQ ID NO: 3461359 - RNA, 21 nt, Pseudomonas aeruginosa PA01
gccguggcgccccaggcgggc

SEQ ID NO: 3461360 - RNA, 13 nt, Pseudomonas aeruginosa PA01
gccguggcgcgaa

SEQ ID NO: 3461361 - RNA, 14 nt, Pseudomonas aeruginosa PA01
gccguggcggcgcg

SEQ ID NO: 3461362 - RNA, 15 nt, Pseudomonas aeruginosa PA01
gccguggcggcgcgc

SEQ ID NO: 3461363 - RNA, 20 nt, Pseudomonas aeruginosa PA01
gccguggcgguacuccgggu

SEQ ID NO: 3461364 - RNA, 14 nt, Pseudomonas aeruginosa PA01
gccguggcuccugg

SEQ ID NO: 3461365 - RNA, 18 nt, Pseudomonas aeruginosa PA01
gccguggcucggcggcag

SEQ ID NO: 3461366 - RNA, 19 nt, Pseudomonas aeruginosa PA01
gccguggcugugcuggcca

SEQ ID NO: 3461367 - RNA, 20 nt, Pseudomonas aeruginosa PA01
gccguggcugugcuggccac

SEQ ID NO: 3461368 - RNA, 23 nt, Pseudomonas aeruginosa PA01
gccguggcugugcuggccacccu

SEQ ID NO: 3461369 - RNA, 14 nt, Pseudomonas aeruginosa PA01
gccgugggccgccg

SEQ ID NO: 3461370 - RNA, 16 nt, Pseudomonas aeruginosa PA01
gccgugggccgccgaa

SEQ ID NO: 3461371 - RNA, 18 nt, Pseudomonas aeruginosa PA01
gccgugggccgccgaacg

SEQ ID NO: 3461372 - RNA, 15 nt, Pseudomonas aeruginosa PA01
gccgugggccggcgc

SEQ ID NO: 3461373 - RNA, 16 nt, Pseudomonas aeruginosa PA01
gccgugggccggcgcg

SEQ ID NO: 3461374 - RNA, 14 nt, Pseudomonas aeruginosa PA01
gccgugggcgccgc

SEQ ID NO: 3461375 - RNA, 16 nt, Pseudomonas aeruginosa PA01
gccgugggcgccgccg

SEQ ID NO: 3461376 - RNA, 15 nt, Pseudomonas aeruginosa PA01
gccgugggcguagag

SEQ ID NO: 3461377 - RNA, 16 nt, Pseudomonas aeruginosa PA01
gccgugggucgccucg

SEQ ID NO: 3461378 - RNA, 18 nt, Pseudomonas aeruginosa PA01
gccguggucgcgcaggcg

SEQ ID NO: 3461379 - RNA, 23 nt, Pseudomonas aeruginosa PA01
gccguggucgcgcaggcggugga

SEQ ID NO: 3461380 - RNA, 19 nt, Pseudomonas aeruginosa PA01
gccgugguggccguggcgc

SEQ ID NO: 3461381 - RNA, 22 nt, Pseudomonas aeruginosa PA01
gccgugguggccguggcgcccc

SEQ ID NO: 3461382 - RNA, 17 nt, Pseudomonas aeruginosa PA01
gccguguaaguuaaugc

SEQ ID NO: 3461383 - RNA, 19 nt, Pseudomonas aeruginosa PA01
gccguguugaugccgauca

SEQ ID NO: 3461384 - RNA, 19 nt, Pseudomonas aeruginosa PA01
gccguuaccuuggccacga

SEQ ID NO: 3461385 - RNA, 23 nt, Pseudomonas aeruginosa PA01
gccguuacgacaucgacgcccuc

SEQ ID NO: 3461386 - RNA, 15 nt, Pseudomonas aeruginosa PA01
gccguucacgccugg

SEQ ID NO: 3461387 - RNA, 17 nt, Pseudomonas aeruginosa PA01
gccguucacgccuggcg

SEQ ID NO: 3461388 - RNA, 19 nt, Pseudomonas aeruginosa PA01
gccguucacgccuggcggc

SEQ ID NO: 3461389 - RNA, 22 nt, Pseudomonas aeruginosa PA01
gccguucacgccuggcggcugg

SEQ ID NO: 3461390 - RNA, 15 nt, Pseudomonas aeruginosa PA01
gccuccaccagcgcc

SEQ ID NO: 3461391 - RNA, 18 nt, Pseudomonas aeruginosa PA01
gccuccaccagcgccggc

SEQ ID NO: 3461392 - RNA, 21 nt, Pseudomonas aeruginosa PA01
gccuccaccagcgccggcggc

SEQ ID NO: 3461393 - RNA, 22 nt, Pseudomonas aeruginosa PA01
gccuccacccgcgaagccugcu

SEQ ID NO: 3461394 - RNA, 15 nt, Pseudomonas aeruginosa PA01
gccuccacggcggcc

SEQ ID NO: 3461395 - RNA, 17 nt, Pseudomonas aeruginosa PA01
gccuccacggcggccuc

SEQ ID NO: 3461396 - RNA, 23 nt, Pseudomonas aeruginosa PA01
gccuccagcaacgccgcccccag

SEQ ID NO: 3461397 - RNA, 20 nt, Pseudomonas aeruginosa PA01
gccuccagcaccgggauggu

SEQ ID NO: 3461398 - RNA, 12 nt, Pseudomonas aeruginosa PA01
gccuccagcacu

SEQ ID NO: 3461399 - RNA, 22 nt, Pseudomonas aeruginosa PA01
gccuccagcacucgcuccuccg

SEQ ID NO: 3461400 - RNA, 13 nt, Pseudomonas aeruginosa PA01
gccuccagcgccg

SEQ ID NO: 3461401 - RNA, 16 nt, Pseudomonas aeruginosa PA01
gccuccagcgccgccu

SEQ ID NO: 3461402 - RNA, 16 nt, Pseudomonas aeruginosa PA01
gccuccagcgccuggc

SEQ ID NO: 3461403 - RNA, 15 nt, Pseudomonas aeruginosa PA01
gccuccagcgggccu

SEQ ID NO: 3461404 - RNA, 22 nt, Pseudomonas aeruginosa PA01
gccuccagcgucugccgcuggc

SEQ ID NO: 3461405 - RNA, 18 nt, Pseudomonas aeruginosa PA01
gccuccaggaauccuccg

SEQ ID NO: 3461406 - RNA, 18 nt, Pseudomonas aeruginosa PA01
gccuccaggaccuugucg

SEQ ID NO: 3461407 - RNA, 13 nt, Pseudomonas aeruginosa PA01
gccuccaggcgcg

SEQ ID NO: 3461408 - RNA, 15 nt, Pseudomonas aeruginosa PA01
gccuccaggcuggcc

SEQ ID NO: 3461409 - RNA, 17 nt, Pseudomonas aeruginosa PA01
gccucccagccgugggc

SEQ ID NO: 3461410 - RNA, 18 nt, Pseudomonas aeruginosa PA01
gccuccccggcccgcgcc

SEQ ID NO: 3461411 - RNA, 19 nt, Pseudomonas aeruginosa PA01
gccuccccggcccgcgccg

SEQ ID NO: 3461412 - RNA, 14 nt, Pseudomonas aeruginosa PA01
gccucccgccgcgg

SEQ ID NO: 3461413 - RNA, 15 nt, Pseudomonas aeruginosa PA01
gccucccgccgcggc

SEQ ID NO: 3461414 - RNA, 16 nt, Pseudomonas aeruginosa PA01
gccucccgccgcggcg

SEQ ID NO: 3461415 - RNA, 17 nt, Pseudomonas aeruginosa PA01
gccucccgccgcggcgu

SEQ ID NO: 3461416 - RNA, 22 nt, Pseudomonas aeruginosa PA01
gccucccggcucgccgacuucc

SEQ ID NO: 3461417 - RNA, 23 nt, Pseudomonas aeruginosa PA01
gccuccgccgcgccucgucgcgc

SEQ ID NO: 3461418 - RNA, 14 nt, Pseudomonas aeruginosa PA01
gccuccgcucugcu

SEQ ID NO: 3461419 - RNA, 19 nt, Pseudomonas aeruginosa PA01
gccuccgcucugcuggcca

SEQ ID NO: 3461420 - RNA, 20 nt, Pseudomonas aeruginosa PA01
gccuccgcucugcuggccac

SEQ ID NO: 3461421 - RNA, 23 nt, Pseudomonas aeruginosa PA01
gccuccgcucugcuggccacccu

SEQ ID NO: 3461422 - RNA, 13 nt, Pseudomonas aeruginosa PA01
gccuccggcagcg

SEQ ID NO: 3461423 - RNA, 20 nt, Pseudomonas aeruginosa PA01
gccuccgggcggaggcgagg

SEQ ID NO: 3461424 - RNA, 14 nt, Pseudomonas aeruginosa PA01
gccuccucggcggc

SEQ ID NO: 3461425 - RNA, 19 nt, Pseudomonas aeruginosa PA01
gccuccucuaccaggcggu

SEQ ID NO: 3461426 - RNA, 18 nt, Pseudomonas aeruginosa PA01
gccuccugcaacgccugg

SEQ ID NO: 3461427 - RNA, 13 nt, Pseudomonas aeruginosa PA01
gccuccuggcggc

SEQ ID NO: 3461428 - RNA, 21 nt, Pseudomonas aeruginosa PA01
gccuccuggcggcguggcacc

SEQ ID NO: 3461429 - RNA, 14 nt, Pseudomonas aeruginosa PA01
gccucgaacauggc

SEQ ID NO: 3461430 - RNA, 21 nt, Pseudomonas aeruginosa PA01
gccucgaagaaaaggcccggc

SEQ ID NO: 3461431 - RNA, 22 nt, Pseudomonas aeruginosa PA01
gccucgaagaaaaggcccggcg

SEQ ID NO: 3461432 - RNA, 23 nt, Pseudomonas aeruginosa PA01
gccucgaagaaaaggcccggcgu

SEQ ID NO: 3461433 - RNA, 21 nt, Pseudomonas aeruginosa PA01
gccucgaagaacuccaucucg

SEQ ID NO: 3461434 - RNA, 15 nt, Pseudomonas aeruginosa PA01
gccucgaagcggauc

SEQ ID NO: 3461435 - RNA, 22 nt, Pseudomonas aeruginosa PA01
gccucgaagcggaucucgucgc

SEQ ID NO: 3461436 - RNA, 15 nt, Pseudomonas aeruginosa PA01
gccucgaaggccggc

SEQ ID NO: 3461437 - RNA, 16 nt, Pseudomonas aeruginosa PA01
gccucgaaggccucgg

SEQ ID NO: 3461438 - RNA, 15 nt, Pseudomonas aeruginosa PA01
gccucgaaggucagc

SEQ ID NO: 3461439 - RNA, 16 nt, Pseudomonas aeruginosa PA01
gccucgaccagcgccg

SEQ ID NO: 3461440 - RNA, 17 nt, Pseudomonas aeruginosa PA01
gccucgaccagcgccgc

SEQ ID NO: 3461441 - RNA, 19 nt, Pseudomonas aeruginosa PA01
gccucgaccagcgccgcgg

SEQ ID NO: 3461442 - RNA, 21 nt, Pseudomonas aeruginosa PA01
gccucgaccagcgccgcggcg

SEQ ID NO: 3461443 - RNA, 18 nt, Pseudomonas aeruginosa PA01
gccucgaccaucggcggc

SEQ ID NO: 3461444 - RNA, 19 nt, Pseudomonas aeruginosa PA01
gccucgaccaucggcggcg

SEQ ID NO: 3461445 - RNA, 21 nt, Pseudomonas aeruginosa PA01
gccucgaccaucggcggcggc

SEQ ID NO: 3461446 - RNA, 23 nt, Pseudomonas aeruginosa PA01
gccucgaccaucggcggcggccc

SEQ ID NO: 3461447 - RNA, 16 nt, Pseudomonas aeruginosa PA01
gccucgaccucggccg

SEQ ID NO: 3461448 - RNA, 17 nt, Pseudomonas aeruginosa PA01
gccucgaccucggccgc

SEQ ID NO: 3461449 - RNA, 13 nt, Pseudomonas aeruginosa PA01
gccucgaccuggc

SEQ ID NO: 3461450 - RNA, 15 nt, Pseudomonas aeruginosa PA01
gccucgaccuggcca

SEQ ID NO: 3461451 - RNA, 19 nt, Pseudomonas aeruginosa PA01
gccucgaccuggccacgcc

SEQ ID NO: 3461452 - RNA, 21 nt, Pseudomonas aeruginosa PA01
gccucgaccuggccacgcccg

SEQ ID NO: 3461453 - RNA, 23 nt, Pseudomonas aeruginosa PA01
gccucgaccuggccacgcccggu

SEQ ID NO: 3461454 - RNA, 17 nt, Pseudomonas aeruginosa PA01
gccucgacgcagagcgc

SEQ ID NO: 3461455 - RNA, 14 nt, Pseudomonas aeruginosa PA01
gccucgacgcucuc

SEQ ID NO: 3461456 - RNA, 17 nt, Pseudomonas aeruginosa PA01
gccucgagcaucuccgg

SEQ ID NO: 3461457 - RNA, 19 nt, Pseudomonas aeruginosa PA01
gccucgagcaucuccggca

SEQ ID NO: 3461458 - RNA, 19 nt, Pseudomonas aeruginosa PA01
gccucgaggaacaggucga

SEQ ID NO: 3461459 - RNA, 20 nt, Pseudomonas aeruginosa PA01
gccucgaggaacaggucgac

SEQ ID NO: 3461460 - RNA, 13 nt, Pseudomonas aeruginosa PA01
gccucgaggucgg

SEQ ID NO: 3461461 - RNA, 20 nt, Pseudomonas aeruginosa PA01
gccucgagguucucgacccg

SEQ ID NO: 3461462 - RNA, 17 nt, Pseudomonas aeruginosa PA01
gccucgaucgccucggg

SEQ ID NO: 3461463 - RNA, 18 nt, Pseudomonas aeruginosa PA01
gccucgaucgccucgggc

SEQ ID NO: 3461464 - RNA, 20 nt, Pseudomonas aeruginosa PA01
gccucgaucgccucgggcga

SEQ ID NO: 3461465 - RNA, 14 nt, Pseudomonas aeruginosa PA01
gccucgaucucguc

SEQ ID NO: 3461466 - RNA, 16 nt, Pseudomonas aeruginosa PA01
gccucgaucucguccu

SEQ ID NO: 3461467 - RNA, 21 nt, Pseudomonas aeruginosa PA01
gccucgaucuucuuccccgcc

SEQ ID NO: 3461468 - RNA, 12 nt, Pseudomonas aeruginosa PA01
gccucgaugaau

SEQ ID NO: 3461469 - RNA, 16 nt, Pseudomonas aeruginosa PA01
gccucgaugaucgccg

SEQ ID NO: 3461470 - RNA, 14 nt, Pseudomonas aeruginosa PA01
gccucgaugauggu

SEQ ID NO: 3461471 - RNA, 14 nt, Pseudomonas aeruginosa PA01
gccucgauggcggc

SEQ ID NO: 3461472 - RNA, 18 nt, Pseudomonas aeruginosa PA01
gccucgcaaaggucggcg

SEQ ID NO: 3461473 - RNA, 22 nt, Pseudomonas aeruginosa PA01
gccucgcaauugaucauccagg

SEQ ID NO: 3461474 - RNA, 16 nt, Pseudomonas aeruginosa PA01
gccucgcagagcgcca

SEQ ID NO: 3461475 - RNA, 18 nt, Pseudomonas aeruginosa PA01
gccucgcagagcgccagc

SEQ ID NO: 3461476 - RNA, 20 nt, Pseudomonas aeruginosa PA01
gccucgcagagcgccagcca

SEQ ID NO: 3461477 - RNA, 23 nt, Pseudomonas aeruginosa PA01
gccucgcagagcgccagccagcg

SEQ ID NO: 3461478 - RNA, 15 nt, Pseudomonas aeruginosa PA01
gccucgccaaccagg

SEQ ID NO: 3461479 - RNA, 13 nt, Pseudomonas aeruginosa PA01
gccucgccccaga

SEQ ID NO: 3461480 - RNA, 15 nt, Pseudomonas aeruginosa PA01
gccucgccccagacc

SEQ ID NO: 3461481 - RNA, 16 nt, Pseudomonas aeruginosa PA01
gccucgccccagaccc

SEQ ID NO: 3461482 - RNA, 20 nt, Pseudomonas aeruginosa PA01
gccucgccccagacccaggu

SEQ ID NO: 3461483 - RNA, 18 nt, Pseudomonas aeruginosa PA01
gccucgccgagcauccag

SEQ ID NO: 3461484 - RNA, 12 nt, Pseudomonas aeruginosa PA01
gccucgccgagg

SEQ ID NO: 3461485 - RNA, 14 nt, Pseudomonas aeruginosa PA01
gccucgccgcccga

SEQ ID NO: 3461486 - RNA, 11 nt, Pseudomonas aeruginosa PA01
gccucgccgcg

SEQ ID NO: 3461487 - RNA, 14 nt, Pseudomonas aeruginosa PA01
gccucgccgcggca

SEQ ID NO: 3461488 - RNA, 15 nt, Pseudomonas aeruginosa PA01
gccucgccuucgucc

SEQ ID NO: 3461489 - RNA, 17 nt, Pseudomonas aeruginosa PA01
gccucgcgcaacgccga

SEQ ID NO: 3461490 - RNA, 19 nt, Pseudomonas aeruginosa PA01
gccucgcgcaacgccgacg

SEQ ID NO: 3461491 - RNA, 23 nt, Pseudomonas aeruginosa PA01
gccucgcgcaacgccgacggcgu

SEQ ID NO: 3461492 - RNA, 18 nt, Pseudomonas aeruginosa PA01
gccucgucguucagccca

SEQ ID NO: 3461493 - RNA, 22 nt, Pseudomonas aeruginosa PA01
gccucgucguucagcccacccc

SEQ ID NO: 3461494 - RNA, 19 nt, Pseudomonas aeruginosa PA01
gccucgugcagcaagccgc

SEQ ID NO: 3461495 - RNA, 20 nt, Pseudomonas aeruginosa PA01
gccucgugcagcaagccgca

SEQ ID NO: 3461496 - RNA, 22 nt, Pseudomonas aeruginosa PA01
gccucgugcagcaagccgcagc

SEQ ID NO: 3461497 - RNA, 18 nt, Pseudomonas aeruginosa PA01
gccucguggaacagcgcg

SEQ ID NO: 3461498 - RNA, 16 nt, Pseudomonas aeruginosa PA01
gccucguucagcagca

SEQ ID NO: 3461499 - RNA, 18 nt, Pseudomonas aeruginosa PA01
gccucguucagcagcaug

SEQ ID NO: 3461500 - RNA, 16 nt, Pseudomonas aeruginosa PA01
gccucguucgucgccg

SEQ ID NO: 3461501 - RNA, 17 nt, Pseudomonas aeruginosa PA01
gccucguucgucgccga

SEQ ID NO: 3461502 - RNA, 19 nt, Pseudomonas aeruginosa PA01
gccucguucgucgccgacu

SEQ ID NO: 3461503 - RNA, 21 nt, Pseudomonas aeruginosa PA01
gccucguucgucgccgacugc

SEQ ID NO: 3461504 - RNA, 15 nt, Pseudomonas aeruginosa PA01
gccucuaugaaccgg

SEQ ID NO: 3461505 - RNA, 18 nt, Pseudomonas aeruginosa PA01
gccucuccgagacgcugc

SEQ ID NO: 3461506 - RNA, 19 nt, Pseudomonas aeruginosa PA01
gccucuccgagacgcugca

SEQ ID NO: 3461507 - RNA, 12 nt, Pseudomonas aeruginosa PA01
gccucugaccgc

SEQ ID NO: 3461508 - RNA, 16 nt, Pseudomonas aeruginosa PA01
gccucugagacgcgaa

SEQ ID NO: 3461509 - RNA, 18 nt, Pseudomonas aeruginosa PA01
gccucugccucgacgcuc

SEQ ID NO: 3461510 - RNA, 14 nt, Pseudomonas aeruginosa PA01
gccucuucgucggc

SEQ ID NO: 3461511 - RNA, 20 nt, Pseudomonas aeruginosa PA01
gccucuugaaaacugucggc

SEQ ID NO: 3461512 - RNA, 22 nt, Pseudomonas aeruginosa PA01
gccugaaacugcggaugucacg

SEQ ID NO: 3461513 - RNA, 13 nt, Pseudomonas aeruginosa PA01
gccugaaggcggg

SEQ ID NO: 3461514 - RNA, 18 nt, Pseudomonas aeruginosa PA01
gccugaccgcugaugauc

SEQ ID NO: 3461515 - RNA, 19 nt, Pseudomonas aeruginosa PA01
gccugaccgcugaugaucg

SEQ ID NO: 3461516 - RNA, 19 nt, Pseudomonas aeruginosa PA01
gccugacgcaagcgcucgg

SEQ ID NO: 3461517 - RNA, 22 nt, Pseudomonas aeruginosa PA01
gccugacgcaagcgcucggccu

SEQ ID NO: 3461518 - RNA, 23 nt, Pseudomonas aeruginosa PA01
gccugacgcaagcgcucggccug

SEQ ID NO: 3461519 - RNA, 13 nt, Pseudomonas aeruginosa PA01
gccugacguugcc

SEQ ID NO: 3461520 - RNA, 16 nt, Pseudomonas aeruginosa PA01
gccugacguugccgcg

SEQ ID NO: 3461521 - RNA, 18 nt, Pseudomonas aeruginosa PA01
gccugacguugccgcgcg

SEQ ID NO: 3461522 - RNA, 19 nt, Pseudomonas aeruginosa PA01
gccugacguugccgcgcgg

SEQ ID NO: 3461523 - RNA, 16 nt, Pseudomonas aeruginosa PA01
gccugagcuggcccag

SEQ ID NO: 3461524 - RNA, 17 nt, Pseudomonas aeruginosa PA01
gccugagcuggcccagu

SEQ ID NO: 3461525 - RNA, 13 nt, Pseudomonas aeruginosa PA01
gccugagcuggcu

SEQ ID NO: 3461526 - RNA, 18 nt, Pseudomonas aeruginosa PA01
gccugagcuggcugucgu

SEQ ID NO: 3461527 - RNA, 18 nt, Pseudomonas aeruginosa PA01
gccugaucaucugggcca

SEQ ID NO: 3461528 - RNA, 13 nt, Pseudomonas aeruginosa PA01
gccugaugcagga

SEQ ID NO: 3461529 - RNA, 16 nt, Pseudomonas aeruginosa PA01
gccugcaaagaggcgc

SEQ ID NO: 3461530 - RNA, 23 nt, Pseudomonas aeruginosa PA01
gccugcaacacccaggccugggu

SEQ ID NO: 3461531 - RNA, 13 nt, Pseudomonas aeruginosa PA01
gccugcaacgcca

SEQ ID NO: 3461532 - RNA, 17 nt, Pseudomonas aeruginosa PA01
gccugcaacgccagcag

SEQ ID NO: 3461533 - RNA, 16 nt, Pseudomonas aeruginosa PA01
gccugcaacgccgcca

SEQ ID NO: 3461534 - RNA, 19 nt, Pseudomonas aeruginosa PA01
gccugcaacgccgccaacu

SEQ ID NO: 3461535 - RNA, 16 nt, Pseudomonas aeruginosa PA01
gccugcaacguccucg

SEQ ID NO: 3461536 - RNA, 15 nt, Pseudomonas aeruginosa PA01
gccugcaacucgucg

SEQ ID NO: 3461537 - RNA, 17 nt, Pseudomonas aeruginosa PA01
gccugcaacucgucguc

SEQ ID NO: 3461538 - RNA, 20 nt, Pseudomonas aeruginosa PA01
gccugcaacucgucguccag

SEQ ID NO: 3461539 - RNA, 24 nt, Pseudomonas aeruginosa PA01
gccugcaacucgucguccagcggc

SEQ ID NO: 3461540 - RNA, 22 nt, Pseudomonas aeruginosa PA01
gccugcaccacgcaggcgcguu

SEQ ID NO: 3461541 - RNA, 15 nt, Pseudomonas aeruginosa PA01
gccugcaccagccag

SEQ ID NO: 3461542 - RNA, 21 nt, Pseudomonas aeruginosa PA01
gccugcaccagccaguccggc

SEQ ID NO: 3461543 - RNA, 15 nt, Pseudomonas aeruginosa PA01
gccugcaccgggccg

SEQ ID NO: 3461544 - RNA, 16 nt, Pseudomonas aeruginosa PA01
gccugcaccgggccga

SEQ ID NO: 3461545 - RNA, 19 nt, Pseudomonas aeruginosa PA01
gccugcaccgggccgaccu

SEQ ID NO: 3461546 - RNA, 22 nt, Pseudomonas aeruginosa PA01
gccugcaccgggccgaccugcc

SEQ ID NO: 3461547 - RNA, 21 nt, Pseudomonas aeruginosa PA01
gccugcaccugcucggggccg

SEQ ID NO: 3461548 - RNA, 14 nt, Pseudomonas aeruginosa PA01
gccugcacgucggu

SEQ ID NO: 3461549 - RNA, 20 nt, Pseudomonas aeruginosa PA01
gccugcagcaccaccucgcc

SEQ ID NO: 3461550 - RNA, 16 nt, Pseudomonas aeruginosa PA01
gccugcagcaggucga

SEQ ID NO: 3461551 - RNA, 20 nt, Pseudomonas aeruginosa PA01
gccugcagcaggucgagcag

SEQ ID NO: 3461552 - RNA, 16 nt, Pseudomonas aeruginosa PA01
gccugcagccuggcgu

SEQ ID NO: 3461553 - RNA, 21 nt, Pseudomonas aeruginosa PA01
gccugcagcgacuccagccag

SEQ ID NO: 3461554 - RNA, 23 nt, Pseudomonas aeruginosa PA01
gccugcagcgacuccagccaggc

SEQ ID NO: 3461555 - RNA, 13 nt, Pseudomonas aeruginosa PA01
gccugcagcucgg

SEQ ID NO: 3461556 - RNA, 13 nt, Pseudomonas aeruginosa PA01
gccugcagggcgu

SEQ ID NO: 3461557 - RNA, 18 nt, Pseudomonas aeruginosa PA01
gccugcagguagcgcugc

SEQ ID NO: 3461558 - RNA, 20 nt, Pseudomonas aeruginosa PA01
gccugcagguagcgcugcgc

SEQ ID NO: 3461559 - RNA, 21 nt, Pseudomonas aeruginosa PA01
gccugcagguagcgcugcgcc

SEQ ID NO: 3461560 - RNA, 23 nt, Pseudomonas aeruginosa PA01
gccugcagguagcgcugcgcccg

SEQ ID NO: 3461561 - RNA, 18 nt, Pseudomonas aeruginosa PA01
gccugcaggucgaggcgc

SEQ ID NO: 3461562 - RNA, 12 nt, Pseudomonas aeruginosa PA01
gccugcagguug

SEQ ID NO: 3461563 - RNA, 21 nt, Pseudomonas aeruginosa PA01
gccugcagguuguccagggca

SEQ ID NO: 3461564 - RNA, 15 nt, Pseudomonas aeruginosa PA01
gccugccagaccgag

SEQ ID NO: 3461565 - RNA, 12 nt, Pseudomonas aeruginosa PA01
gccugccaggcg

SEQ ID NO: 3461566 - RNA, 18 nt, Pseudomonas aeruginosa PA01
gccugccccacuuccggc

SEQ ID NO: 3461567 - RNA, 12 nt, Pseudomonas aeruginosa PA01
gccugccgggca

SEQ ID NO: 3461568 - RNA, 22 nt, Pseudomonas aeruginosa PA01
gccugccgggcaagcucgacga

SEQ ID NO: 3461569 - RNA, 23 nt, Pseudomonas aeruginosa PA01
gccugccguuuuacucgucgcca

SEQ ID NO: 3461570 - RNA, 22 nt, Pseudomonas aeruginosa PA01
gccugccuuccuugaccacggc

SEQ ID NO: 3461571 - RNA, 13 nt, Pseudomonas aeruginosa PA01
gccugcgcagggc

SEQ ID NO: 3461572 - RNA, 20 nt, Pseudomonas aeruginosa PA01
gccugcgcagggcuuccuug

SEQ ID NO: 3461573 - RNA, 13 nt, Pseudomonas aeruginosa PA01
gccugcgcccuca

SEQ ID NO: 3461574 - RNA, 22 nt, Pseudomonas aeruginosa PA01
gccugcgccucggcccuggcgg

SEQ ID NO: 3461575 - RNA, 23 nt, Pseudomonas aeruginosa PA01
gccugcgccucggcccuggcggc

SEQ ID NO: 3461576 - RNA, 14 nt, Pseudomonas aeruginosa PA01
gccugcgcgcacca

SEQ ID NO: 3461577 - RNA, 16 nt, Pseudomonas aeruginosa PA01
gccugcgcgcaccagg

SEQ ID NO: 3461578 - RNA, 20 nt, Pseudomonas aeruginosa PA01
gccugcgcgcaccaggccuc

SEQ ID NO: 3461579 - RNA, 15 nt, Pseudomonas aeruginosa PA01
gccugcgcuuccggc

SEQ ID NO: 3461580 - RNA, 17 nt, Pseudomonas aeruginosa PA01
gccugcgcuuccggcag

SEQ ID NO: 3461581 - RNA, 18 nt, Pseudomonas aeruginosa PA01
gccugcgcuuccggcagc

SEQ ID NO: 3461582 - RNA, 20 nt, Pseudomonas aeruginosa PA01
gccugcgcuuccggcagcca

SEQ ID NO: 3461583 - RNA, 13 nt, Pseudomonas aeruginosa PA01
gccugcggccagc

SEQ ID NO: 3461584 - RNA, 14 nt, Pseudomonas aeruginosa PA01
gccugcggccagcg

SEQ ID NO: 3461585 - RNA, 16 nt, Pseudomonas aeruginosa PA01
gccugcggccagcgcc

SEQ ID NO: 3461586 - RNA, 19 nt, Pseudomonas aeruginosa PA01
gccugcggccagcgccagg

SEQ ID NO: 3461587 - RNA, 22 nt, Pseudomonas aeruginosa PA01
gccugcggccagcgccaggagc

SEQ ID NO: 3461588 - RNA, 12 nt, Pseudomonas aeruginosa PA01
gccugcggcgag

SEQ ID NO: 3461589 - RNA, 19 nt, Pseudomonas aeruginosa PA01
gccugcggcuugcccugcu

SEQ ID NO: 3461590 - RNA, 22 nt, Pseudomonas aeruginosa PA01
gccugcgggcggguaaagcgcc

SEQ ID NO: 3461591 - RNA, 21 nt, Pseudomonas aeruginosa PA01
gccugcggguucggcgagagg

SEQ ID NO: 3461592 - RNA, 18 nt, Pseudomonas aeruginosa PA01
gccugcgucagcgaggcg

SEQ ID NO: 3461593 - RNA, 20 nt, Pseudomonas aeruginosa PA01
gccugcgucgcauccaccag

SEQ ID NO: 3461594 - RNA, 13 nt, Pseudomonas aeruginosa PA01
gccuuccaccggc

SEQ ID NO: 3461595 - RNA, 15 nt, Pseudomonas aeruginosa PA01
gccuuccaccggcgu

SEQ ID NO: 3461596 - RNA, 18 nt, Pseudomonas aeruginosa PA01
gccuuccaccggcgucca

SEQ ID NO: 3461597 - RNA, 23 nt, Pseudomonas aeruginosa PA01
gccuuccaccgggaagcaggucu

SEQ ID NO: 3461598 - RNA, 20 nt, Pseudomonas aeruginosa PA01
gccuuccacgccuucgcggc

SEQ ID NO: 3461599 - RNA, 21 nt, Pseudomonas aeruginosa PA01
gccuuccacgccuucgcggcc

SEQ ID NO: 3461600 - RNA, 23 nt, Pseudomonas aeruginosa PA01
gccuuccacgccuucgcggccga

SEQ ID NO: 3461601 - RNA, 18 nt, Pseudomonas aeruginosa PA01
gccuuccagcaggucgag

SEQ ID NO: 3461602 - RNA, 13 nt, Pseudomonas aeruginosa PA01
gccuuccagcccu

SEQ ID NO: 3461603 - RNA, 12 nt, Pseudomonas aeruginosa PA01
gccuuccagcuu

SEQ ID NO: 3461604 - RNA, 14 nt, Pseudomonas aeruginosa PA01
gccuuccaggcgug

SEQ ID NO: 3461605 - RNA, 16 nt, Pseudomonas aeruginosa PA01
gccuuccaggcgugcc

SEQ ID NO: 3461606 - RNA, 22 nt, Pseudomonas aeruginosa PA01
gccuuccaggcuguagccggcg

SEQ ID NO: 3461607 - RNA, 23 nt, Pseudomonas aeruginosa PA01
gccuuccaggcuguagccggcga

SEQ ID NO: 3461608 - RNA, 18 nt, Pseudomonas aeruginosa PA01
gccuuccagguaguccag

SEQ ID NO: 3461609 - RNA, 17 nt, Pseudomonas aeruginosa PA01
gccuucccacuccgucc

SEQ ID NO: 3461610 - RNA, 10 nt, Pseudomonas aeruginosa PA01
gccuucccag

SEQ ID NO: 3461611 - RNA, 22 nt, Pseudomonas aeruginosa PA01
gccuucccagacguccagcgcc

SEQ ID NO: 3461612 - RNA, 23 nt, Pseudomonas aeruginosa PA01
gccuucccagacguccagcgcca

SEQ ID NO: 3461613 - RNA, 24 nt, Pseudomonas aeruginosa PA01
gccuucccagacguccagcgccac

SEQ ID NO: 3461614 - RNA, 20 nt, Pseudomonas aeruginosa PA01
gccuucccagauaccggcgu

SEQ ID NO: 3461615 - RNA, 15 nt, Pseudomonas aeruginosa PA01
gccuucccagccgag

SEQ ID NO: 3461616 - RNA, 16 nt, Pseudomonas aeruginosa PA01
gccuuccgcgcccagg

SEQ ID NO: 3461617 - RNA, 21 nt, Pseudomonas aeruginosa PA01
gccuuccgcgcccaggcugcc

SEQ ID NO: 3461618 - RNA, 19 nt, Pseudomonas aeruginosa PA01
gccuuccggcaccaccacc

SEQ ID NO: 3461619 - RNA, 12 nt, Pseudomonas aeruginosa PA01
gccuuccucggc

SEQ ID NO: 3461620 - RNA, 19 nt, Pseudomonas aeruginosa PA01
gccuuccucggccgccagg

SEQ ID NO: 3461621 - RNA, 14 nt, Pseudomonas aeruginosa PA01
gccuuccucggcga

SEQ ID NO: 3461622 - RNA, 23 nt, Pseudomonas aeruginosa PA01
gccuuccucggcgaacuccgcca

SEQ ID NO: 3461623 - RNA, 17 nt, Pseudomonas aeruginosa PA01
gccuuccugggcgugcu

SEQ ID NO: 3461624 - RNA, 17 nt, Pseudomonas aeruginosa PA01
gccuuccuucucgaagc

SEQ ID NO: 3461625 - RNA, 19 nt, Pseudomonas aeruginosa PA01
gccuuccuucucgaagccg

SEQ ID NO: 3461626 - RNA, 23 nt, Pseudomonas aeruginosa PA01
gccuuccuugaccacggcgagga

SEQ ID NO: 3461627 - RNA, 22 nt, Pseudomonas aeruginosa PA01
gccuucgacgguucgcgaacgg

SEQ ID NO: 3461628 - RNA, 17 nt, Pseudomonas aeruginosa PA01
gccuucgacuucgacga

SEQ ID NO: 3461629 - RNA, 16 nt, Pseudomonas aeruginosa PA01
gccuucgagccacucg

SEQ ID NO: 3461630 - RNA, 13 nt, Pseudomonas aeruginosa PA01
gccuucgcccagg

SEQ ID NO: 3461631 - RNA, 17 nt, Pseudomonas aeruginosa PA01
gccuucgccgaccaggu

SEQ ID NO: 3461632 - RNA, 14 nt, Pseudomonas aeruginosa PA01
gccuucgccgucga

SEQ ID NO: 3461633 - RNA, 15 nt, Pseudomonas aeruginosa PA01
gccuucgcgggccag

SEQ ID NO: 3461634 - RNA, 17 nt, Pseudomonas aeruginosa PA01
gccuucgcgggccaggc

SEQ ID NO: 3461635 - RNA, 20 nt, Pseudomonas aeruginosa PA01
gccuucgcgggccaggccga

SEQ ID NO: 3461636 - RNA, 18 nt, Pseudomonas aeruginosa PA01
gccuucgcguucgcuccg

SEQ ID NO: 3461637 - RNA, 19 nt, Pseudomonas aeruginosa PA01
gccuucggagaacagcgag

SEQ ID NO: 3461638 - RNA, 22 nt, Pseudomonas aeruginosa PA01
gccuucggagaacagcgagacc

SEQ ID NO: 3461639 - RNA, 15 nt, Pseudomonas aeruginosa PA01
gccuucggcaggacc

SEQ ID NO: 3461640 - RNA, 23 nt, Pseudomonas aeruginosa PA01
gccuucggcaggaccucgggcga

SEQ ID NO: 3461641 - RNA, 17 nt, Pseudomonas aeruginosa PA01
gccuucggcgacacaga

SEQ ID NO: 3461642 - RNA, 13 nt, Pseudomonas aeruginosa PA01
gccuucggcgccg

SEQ ID NO: 3461643 - RNA, 16 nt, Pseudomonas aeruginosa PA01
gccuucggcgccggag

SEQ ID NO: 3461644 - RNA, 15 nt, Pseudomonas aeruginosa PA01
gccuucggcgucgaa

SEQ ID NO: 3461645 - RNA, 18 nt, Pseudomonas aeruginosa PA01
gccuucggcgugcauggc

SEQ ID NO: 3461646 - RNA, 19 nt, Pseudomonas aeruginosa PA01
gccuucggcgugcauggcc

SEQ ID NO: 3461647 - RNA, 17 nt, Pseudomonas aeruginosa PA01
gccuucgggcgaugcgg

SEQ ID NO: 3461648 - RNA, 14 nt, Pseudomonas aeruginosa PA01
gccuucgggcgccu

SEQ ID NO: 3461649 - RNA, 12 nt, Pseudomonas aeruginosa PA01
gccuucguccau

SEQ ID NO: 3461650 - RNA, 22 nt, Pseudomonas aeruginosa PA01
gccuucgucgaugaacagcgac

SEQ ID NO: 3461651 - RNA, 20 nt, Pseudomonas aeruginosa PA01
gccuucguggccgcgggagg

SEQ ID NO: 3461652 - RNA, 18 nt, Pseudomonas aeruginosa PA01
gccuucucgucgccgccc

SEQ ID NO: 3461653 - RNA, 19 nt, Pseudomonas aeruginosa PA01
gccuucucgucgccgcccg

SEQ ID NO: 3461654 - RNA, 22 nt, Pseudomonas aeruginosa PA01
gccuucucgucgccgcccggca

SEQ ID NO: 3461655 - RNA, 23 nt, Pseudomonas aeruginosa PA01
gccuucugcaccuuggccacgcu

SEQ ID NO: 3461656 - RNA, 18 nt, Pseudomonas aeruginosa PA01
gccuucuugcugccggcg

SEQ ID NO: 3461657 - RNA, 19 nt, Pseudomonas aeruginosa PA01
gccuucuugcugccggcgu

SEQ ID NO: 3461658 - RNA, 17 nt, Pseudomonas aeruginosa PA01
gccuucuuuucuuccgc

SEQ ID NO: 3461659 - RNA, 15 nt, Pseudomonas aeruginosa PA01
gccuugaccaccgcc

SEQ ID NO: 3461660 - RNA, 22 nt, Pseudomonas aeruginosa PA01
gccuugaccaccgccaggcugg

SEQ ID NO: 3461661 - RNA, 15 nt, Pseudomonas aeruginosa PA01
gccuugaccagcggc

SEQ ID NO: 3461662 - RNA, 16 nt, Pseudomonas aeruginosa PA01
gccuugaccagcggcc

SEQ ID NO: 3461663 - RNA, 16 nt, Pseudomonas aeruginosa PA01
gccuugaccucgacgc

SEQ ID NO: 3461664 - RNA, 19 nt, Pseudomonas aeruginosa PA01
gccuugaccucgacgccga

SEQ ID NO: 3461665 - RNA, 15 nt, Pseudomonas aeruginosa PA01
gccuugaccugcugg

SEQ ID NO: 3461666 - RNA, 15 nt, Pseudomonas aeruginosa PA01
gccuugagcaggcgg

SEQ ID NO: 3461667 - RNA, 14 nt, Pseudomonas aeruginosa PA01
gccuugagcggcgc

SEQ ID NO: 3461668 - RNA, 19 nt, Pseudomonas aeruginosa PA01
gccuugagcggcgcccugg

SEQ ID NO: 3461669 - RNA, 20 nt, Pseudomonas aeruginosa PA01
gccuugagcggcgcccuggc

SEQ ID NO: 3461670 - RNA, 22 nt, Pseudomonas aeruginosa PA01
gccuugagcggcgcccuggcuc

SEQ ID NO: 3461671 - RNA, 14 nt, Pseudomonas aeruginosa PA01
gccuugaugccggc

SEQ ID NO: 3461672 - RNA, 15 nt, Pseudomonas aeruginosa PA01
gccuugaugccggcg

SEQ ID NO: 3461673 - RNA, 15 nt, Pseudomonas aeruginosa PA01
gccuugauggcgggc

SEQ ID NO: 3461674 - RNA, 19 nt, Pseudomonas aeruginosa PA01
gccuugcagcaacucgccg

SEQ ID NO: 3461675 - RNA, 18 nt, Pseudomonas aeruginosa PA01
gccuugcagcaccgccug

SEQ ID NO: 3461676 - RNA, 13 nt, Pseudomonas aeruginosa PA01
gccuugcagggcc

SEQ ID NO: 3461677 - RNA, 17 nt, Pseudomonas aeruginosa PA01
gccuugcagggccgcca

SEQ ID NO: 3461678 - RNA, 22 nt, Pseudomonas aeruginosa PA01
gccuugcagggccgccagccgc

SEQ ID NO: 3461679 - RNA, 20 nt, Pseudomonas aeruginosa PA01
gccuugcagggggcuuugcg

SEQ ID NO: 3461680 - RNA, 18 nt, Pseudomonas aeruginosa PA01
gccuugccaagguguggc

SEQ ID NO: 3461681 - RNA, 13 nt, Pseudomonas aeruginosa PA01
gccuugcccggcg

SEQ ID NO: 3461682 - RNA, 13 nt, Pseudomonas aeruginosa PA01
gccuugcccuggc

SEQ ID NO: 3461683 - RNA, 17 nt, Pseudomonas aeruginosa PA01
gccuugcccuggccggc

SEQ ID NO: 3461684 - RNA, 18 nt, Pseudomonas aeruginosa PA01
gccuugccguccagccgg

SEQ ID NO: 3461685 - RNA, 17 nt, Pseudomonas aeruginosa PA01
gccuugcgaccaggucc

SEQ ID NO: 3461686 - RNA, 15 nt, Pseudomonas aeruginosa PA01
gccuugcgccaggcc

SEQ ID NO: 3461687 - RNA, 16 nt, Pseudomonas aeruginosa PA01
gccuugcgccaggccu

SEQ ID NO: 3461688 - RNA, 20 nt, Pseudomonas aeruginosa PA01
gccuugcgccaggccuugca

SEQ ID NO: 3461689 - RNA, 16 nt, Pseudomonas aeruginosa PA01
gccuugcgcggcgccg

SEQ ID NO: 3461690 - RNA, 14 nt, Pseudomonas aeruginosa PA01
gccuugcggcgccg

SEQ ID NO: 3461691 - RNA, 15 nt, Pseudomonas aeruginosa PA01
gccuugcggcgccga

SEQ ID NO: 3461692 - RNA, 21 nt, Pseudomonas aeruginosa PA01
gccuugcggcgccgaggcccu

SEQ ID NO: 3461693 - RNA, 17 nt, Pseudomonas aeruginosa PA01
gccuugcggggcggcgc

SEQ ID NO: 3461694 - RNA, 23 nt, Pseudomonas aeruginosa PA01
gccuugcggggcggcgcaucggc

SEQ ID NO: 3461695 - RNA, 18 nt, Pseudomonas aeruginosa PA01
gccuugcguaccagcgcg

SEQ ID NO: 3461696 - RNA, 17 nt, Pseudomonas aeruginosa PA01
gcgaacgggcguugccg

SEQ ID NO: 3461697 - RNA, 19 nt, Pseudomonas aeruginosa PA01
gcgaacgggcguugccggc

SEQ ID NO: 3461698 - RNA, 20 nt, Pseudomonas aeruginosa PA01
gcgaacgggcguugccggca

SEQ ID NO: 3461699 - RNA, 15 nt, Pseudomonas aeruginosa PA01
gcgaacgguccugcg

SEQ ID NO: 3461700 - RNA, 21 nt, Pseudomonas aeruginosa PA01
gcgaacgguccugcggaucga

SEQ ID NO: 3461701 - RNA, 19 nt, Pseudomonas aeruginosa PA01
gcgaacuccgccagcuugu

SEQ ID NO: 3461702 - RNA, 22 nt, Pseudomonas aeruginosa PA01
gcgaacucggcgccgaucuccg

SEQ ID NO: 3461703 - RNA, 14 nt, Pseudomonas aeruginosa PA01
gcgaacugccgacg

SEQ ID NO: 3461704 - RNA, 16 nt, Pseudomonas aeruginosa PA01
gcgaacugccgacggc

SEQ ID NO: 3461705 - RNA, 23 nt, Pseudomonas aeruginosa PA01
gcgaacuucaggccggcgccgau

SEQ ID NO: 3461706 - RNA, 19 nt, Pseudomonas aeruginosa PA01
gcgaagaaagccccugccg

SEQ ID NO: 3461707 - RNA, 16 nt, Pseudomonas aeruginosa PA01
gcgaagaacacgcccc

SEQ ID NO: 3461708 - RNA, 19 nt, Pseudomonas aeruginosa PA01
gcgaagaacacgccccaga

SEQ ID NO: 3461709 - RNA, 20 nt, Pseudomonas aeruginosa PA01
gcgaagaacacgccccagaa

SEQ ID NO: 3461710 - RNA, 18 nt, Pseudomonas aeruginosa PA01
gcgaagaacagcgggucg

SEQ ID NO: 3461711 - RNA, 17 nt, Pseudomonas aeruginosa PA01
gcgaagaccggccggcu

SEQ ID NO: 3461712 - RNA, 16 nt, Pseudomonas aeruginosa PA01
gcgaagaucucgccau

SEQ ID NO: 3461713 - RNA, 21 nt, Pseudomonas aeruginosa PA01
gcgaagaucucgccauggcgg

SEQ ID NO: 3461714 - RNA, 16 nt, Pseudomonas aeruginosa PA01
gcgaagccaggaagcg

SEQ ID NO: 3461715 - RNA, 20 nt, Pseudomonas aeruginosa PA01
gcgaagccaggaagcggcgg

SEQ ID NO: 3461716 - RNA, 14 nt, Pseudomonas aeruginosa PA01
gcgaagcccagcgc

SEQ ID NO: 3461717 - RNA, 15 nt, Pseudomonas aeruginosa PA01
gcgaagcccagcgcc

SEQ ID NO: 3461718 - RNA, 18 nt, Pseudomonas aeruginosa PA01
gcgaagccgauacccugg

SEQ ID NO: 3461719 - RNA, 16 nt, Pseudomonas aeruginosa PA01
gcgaagccgcgcccgg

SEQ ID NO: 3461720 - RNA, 20 nt, Pseudomonas aeruginosa PA01
gcgaagccggcggcgcggca

SEQ ID NO: 3461721 - RNA, 23 nt, Pseudomonas aeruginosa PA01
gcgaagccguuguagaucggcag

SEQ ID NO: 3461722 - RNA, 18 nt, Pseudomonas aeruginosa PA01
gcgaagccugcggcgaga

SEQ ID NO: 3461723 - RNA, 14 nt, Pseudomonas aeruginosa PA01
gcgaagccugcucc

SEQ ID NO: 3461724 - RNA, 13 nt, Pseudomonas aeruginosa PA01
gcgaagcgacggc

SEQ ID NO: 3461725 - RNA, 17 nt, Pseudomonas aeruginosa PA01
gcgaagcgacggcgcaa

SEQ ID NO: 3461726 - RNA, 13 nt, Pseudomonas aeruginosa PA01
gcgaagcgcaggc

SEQ ID NO: 3461727 - RNA, 19 nt, Pseudomonas aeruginosa PA01
gcgaagcggaagcgcagcc

SEQ ID NO: 3461728 - RNA, 16 nt, Pseudomonas aeruginosa PA01
gcgaagcggcccuugu

SEQ ID NO: 3461729 - RNA, 17 nt, Pseudomonas aeruginosa PA01
gcgaagcggcucggcca

SEQ ID NO: 3461730 - RNA, 22 nt, Pseudomonas aeruginosa PA01
gcgaagcggcucggccagggcc

SEQ ID NO: 3461731 - RNA, 20 nt, Pseudomonas aeruginosa PA01
gcgaagcgguuagccggcga

SEQ ID NO: 3461732 - RNA, 22 nt, Pseudomonas aeruginosa PA01
gcgaagcgguuagccggcgauc

SEQ ID NO: 3461733 - RNA, 23 nt, Pseudomonas aeruginosa PA01
gcgaagcgguuagccggcgauca

SEQ ID NO: 3461734 - RNA, 20 nt, Pseudomonas aeruginosa PA01
gcgaagcguugcagcgucug

SEQ ID NO: 3461735 - RNA, 16 nt, Pseudomonas aeruginosa PA01
gcgaagcuccucgaua

SEQ ID NO: 3461736 - RNA, 19 nt, Pseudomonas aeruginosa PA01
gcgaagcucggccgcucga

SEQ ID NO: 3461737 - RNA, 13 nt, Pseudomonas aeruginosa PA01
gcgaagcuggcgc

SEQ ID NO: 3461738 - RNA, 17 nt, Pseudomonas aeruginosa PA01
gcgaagcuggcgcaacu

SEQ ID NO: 3461739 - RNA, 18 nt, Pseudomonas aeruginosa PA01
gcgaaggcaaugccgccc

SEQ ID NO: 3461740 - RNA, 15 nt, Pseudomonas aeruginosa PA01
gcgaaggccaccauc

SEQ ID NO: 3461741 - RNA, 18 nt, Pseudomonas aeruginosa PA01
gcgaaggccaccaucgcg

SEQ ID NO: 3461742 - RNA, 19 nt, Pseudomonas aeruginosa PA01
gcgaaggccaccaucgcgg

SEQ ID NO: 3461743 - RNA, 21 nt, Pseudomonas aeruginosa PA01
gcgaaggccaccaucgcggcg

SEQ ID NO: 3461744 - RNA, 18 nt, Pseudomonas aeruginosa PA01
gcgaaggccacgccgacg

SEQ ID NO: 3461745 - RNA, 21 nt, Pseudomonas aeruginosa PA01
gcgaaggcgaaccacaccagg

SEQ ID NO: 3461746 - RNA, 19 nt, Pseudomonas aeruginosa PA01
gcgaaggcgccuuccaggc

SEQ ID NO: 3461747 - RNA, 12 nt, Pseudomonas aeruginosa PA01
gcgaaggcgcuc

SEQ ID NO: 3461748 - RNA, 20 nt, Pseudomonas aeruginosa PA01
gcgaaggcuccgcugcucag

SEQ ID NO: 3461749 - RNA, 19 nt, Pseudomonas aeruginosa PA01
gcgaagggcaggccgauca

SEQ ID NO: 3461750 - RNA, 12 nt, Pseudomonas aeruginosa PA01
gcgaagggcgcu

SEQ ID NO: 3461751 - RNA, 21 nt, Pseudomonas aeruginosa PA01
gcgaaggucgaaggcgcggcg

SEQ ID NO: 3461752 - RNA, 19 nt, Pseudomonas aeruginosa PA01
gcgaaguagaagcgcgcgg

SEQ ID NO: 3461753 - RNA, 21 nt, Pseudomonas aeruginosa PA01
gcgaaguagaagcgcgcggua

SEQ ID NO: 3461754 - RNA, 21 nt, Pseudomonas aeruginosa PA01
gcgaaguccaccaggcgccgg

SEQ ID NO: 3461755 - RNA, 23 nt, Pseudomonas aeruginosa PA01
gcgaaguccaccaggcgccgggu

SEQ ID NO: 3461756 - RNA, 14 nt, Pseudomonas aeruginosa PA01
gcgaaguccggguu

SEQ ID NO: 3461757 - RNA, 11 nt, Pseudomonas aeruginosa PA01
gcgaagucgca

SEQ ID NO: 3461758 - RNA, 19 nt, Pseudomonas aeruginosa PA01
gcgaagucgccgucguccg

SEQ ID NO: 3461759 - RNA, 15 nt, Pseudomonas aeruginosa PA01
gcgaagucggcgcgc

SEQ ID NO: 3461760 - RNA, 17 nt, Pseudomonas aeruginosa PA01
gcgaagucggcgcgcca

SEQ ID NO: 3461761 - RNA, 23 nt, Pseudomonas aeruginosa PA01
gcgaagucggcgcgccagaagcg

SEQ ID NO: 3461762 - RNA, 19 nt, Pseudomonas aeruginosa PA01
gcgaagucggcuuggguca

SEQ ID NO: 3461763 - RNA, 14 nt, Pseudomonas aeruginosa PA01
gcgaagucugccug

SEQ ID NO: 3461764 - RNA, 22 nt, Pseudomonas aeruginosa PA01
gcgaagucugccuguccgcugc

SEQ ID NO: 3461765 - RNA, 14 nt, Pseudomonas aeruginosa PA01
gcgaagugcgcugc

SEQ ID NO: 3461766 - RNA, 14 nt, Pseudomonas aeruginosa PA01
gcgaagugggggca

SEQ ID NO: 3461767 - RNA, 15 nt, Pseudomonas aeruginosa PA01
gcgaaguucccgccg

SEQ ID NO: 3461768 - RNA, 18 nt, Pseudomonas aeruginosa PA01
gcgaaguucccgccgcuc

SEQ ID NO: 3461769 - RNA, 19 nt, Pseudomonas aeruginosa PA01
gcgaaguucccgccgcucu

SEQ ID NO: 3461770 - RNA, 15 nt, Pseudomonas aeruginosa PA01
gcgaaguugccgccg

SEQ ID NO: 3461771 - RNA, 16 nt, Pseudomonas aeruginosa PA01
gcgaaguugccgccgc

SEQ ID NO: 3461772 - RNA, 24 nt, Pseudomonas aeruginosa PA01
gcgaaguugccgccgcuggccugg

SEQ ID NO: 3461773 - RNA, 15 nt, Pseudomonas aeruginosa PA01
gcgaauaaccgcauc

SEQ ID NO: 3461774 - RNA, 17 nt, Pseudomonas aeruginosa PA01
gcgaauaaccgcaucgc

SEQ ID NO: 3461775 - RNA, 15 nt, Pseudomonas aeruginosa PA01
gcgaauaaccgcugc

SEQ ID NO: 3461776 - RNA, 14 nt, Pseudomonas aeruginosa PA01
gcgaauaacgccgc

SEQ ID NO: 3461777 - RNA, 15 nt, Pseudomonas aeruginosa PA01
gcgaauaccagugcc

SEQ ID NO: 3461778 - RNA, 20 nt, Pseudomonas aeruginosa PA01
gcgaauaccagugccgcggu

SEQ ID NO: 3461779 - RNA, 21 nt, Pseudomonas aeruginosa PA01
gcgaauaccagugccgcggug

SEQ ID NO: 3461780 - RNA, 17 nt, Pseudomonas aeruginosa PA01
gcgaauaccgcgcgcgc

SEQ ID NO: 3461781 - RNA, 14 nt, Pseudomonas aeruginosa PA01
gcgaauagacgccg

SEQ ID NO: 3461782 - RNA, 17 nt, Pseudomonas aeruginosa PA01
gcgaauagacgccgcug

SEQ ID NO: 3461783 - RNA, 15 nt, Pseudomonas aeruginosa PA01
gcgaauagcgccgca

SEQ ID NO: 3461784 - RNA, 16 nt, Pseudomonas aeruginosa PA01
gcgaauagcgccgcgg

SEQ ID NO: 3461785 - RNA, 16 nt, Pseudomonas aeruginosa PA01
gcgaauagggcggcgc

SEQ ID NO: 3461786 - RNA, 16 nt, Pseudomonas aeruginosa PA01
gcgaauccagcaacac

SEQ ID NO: 3461787 - RNA, 24 nt, Pseudomonas aeruginosa PA01
gcgaauccgcggcccugcucgccg

SEQ ID NO: 3461788 - RNA, 15 nt, Pseudomonas aeruginosa PA01
gcgaauccuguccgu

SEQ ID NO: 3461789 - RNA, 22 nt, Pseudomonas aeruginosa PA01
gcgaaucgucgaugaggucgca

SEQ ID NO: 3461790 - RNA, 14 nt, Pseudomonas aeruginosa PA01
gcgaaucgucgccg

SEQ ID NO: 3461791 - RNA, 15 nt, Pseudomonas aeruginosa PA01
gcgaaucgucgccgg

SEQ ID NO: 3461792 - RNA, 18 nt, Pseudomonas aeruginosa PA01
gcgaaucuucggcgcgcc

SEQ ID NO: 3461793 - RNA, 19 nt, Pseudomonas aeruginosa PA01
gcgaaucuucggcgcgccg

SEQ ID NO: 3461794 - RNA, 22 nt, Pseudomonas aeruginosa PA01
gcgaaucuucggcgcgccggug

SEQ ID NO: 3461795 - RNA, 17 nt, Pseudomonas aeruginosa PA01
gcgaaugcccggcagcg

SEQ ID NO: 3461796 - RNA, 23 nt, Pseudomonas aeruginosa PA01
gcgaaugcccggcagcgccgggc

SEQ ID NO: 3461797 - RNA, 14 nt, Pseudomonas aeruginosa PA01
gcgaaugccuucga

SEQ ID NO: 3461798 - RNA, 16 nt, Pseudomonas aeruginosa PA01
gcgaccgaagccgcgc

SEQ ID NO: 3461799 - RNA, 19 nt, Pseudomonas aeruginosa PA01
gcgaccgaagccgcgcagc

SEQ ID NO: 3461800 - RNA, 18 nt, Pseudomonas aeruginosa PA01
gcgaccgagaugcucgcg

SEQ ID NO: 3461801 - RNA, 21 nt, Pseudomonas aeruginosa PA01
gcgaccgagaugcucgcgcag

SEQ ID NO: 3461802 - RNA, 23 nt, Pseudomonas aeruginosa PA01
gcgaccgagaugcugccgaagcc

SEQ ID NO: 3461803 - RNA, 14 nt, Pseudomonas aeruginosa PA01
gcgaccgaucaugc

SEQ ID NO: 3461804 - RNA, 19 nt, Pseudomonas aeruginosa PA01
gcgaccgaucaugcccuug

SEQ ID NO: 3461805 - RNA, 23 nt, Pseudomonas aeruginosa PA01
gcgaccgcaucguuggcgccguc

SEQ ID NO: 3461806 - RNA, 13 nt, Pseudomonas aeruginosa PA01
gcgaccgccaggc

SEQ ID NO: 3461807 - RNA, 14 nt, Pseudomonas aeruginosa PA01
gcgaccgccaggcg

SEQ ID NO: 3461808 - RNA, 18 nt, Pseudomonas aeruginosa PA01
gcgaccgccaggcggccg

SEQ ID NO: 3461809 - RNA, 19 nt, Pseudomonas aeruginosa PA01
gcgaccgccaggcggccgc

SEQ ID NO: 3461810 - RNA, 20 nt, Pseudomonas aeruginosa PA01
gcgaccgccaggcggccgcu

SEQ ID NO: 3461811 - RNA, 23 nt, Pseudomonas aeruginosa PA01
gcgaccgcccgccucaggccggg

SEQ ID NO: 3461812 - RNA, 15 nt, Pseudomonas aeruginosa PA01
gcgaccgcuggacca

SEQ ID NO: 3461813 - RNA, 18 nt, Pseudomonas aeruginosa PA01
gcgaccggaugcuccagg

SEQ ID NO: 3461814 - RNA, 19 nt, Pseudomonas aeruginosa PA01
gcgaccggaugcuccaggu

SEQ ID NO: 3461815 - RNA, 13 nt, Pseudomonas aeruginosa PA01
gcgaccggauggc

SEQ ID NO: 3461816 - RNA, 18 nt, Pseudomonas aeruginosa PA01
gcgaccgggcaugccgug

SEQ ID NO: 3461817 - RNA, 19 nt, Pseudomonas aeruginosa PA01
gcgaccggguccugcagau

SEQ ID NO: 3461818 - RNA, 20 nt, Pseudomonas aeruginosa PA01
gcgaccgguaacuggccagg

SEQ ID NO: 3461819 - RNA, 18 nt, Pseudomonas aeruginosa PA01
gcgaccgucgaaccaggg

SEQ ID NO: 3461820 - RNA, 20 nt, Pseudomonas aeruginosa PA01
gcgaccgucgaaccagggac

SEQ ID NO: 3461821 - RNA, 15 nt, Pseudomonas aeruginosa PA01
gcgaccgucggccgg

SEQ ID NO: 3461822 - RNA, 16 nt, Pseudomonas aeruginosa PA01
gcgaccgucggccggg

SEQ ID NO: 3461823 - RNA, 17 nt, Pseudomonas aeruginosa PA01
gcgaccgucggccgggg

SEQ ID NO: 3461824 - RNA, 16 nt, Pseudomonas aeruginosa PA01
gcgaccgugaggcgca

SEQ ID NO: 3461825 - RNA, 20 nt, Pseudomonas aeruginosa PA01
gcgaccucagucgugcaggu

SEQ ID NO: 3461826 - RNA, 20 nt, Pseudomonas aeruginosa PA01
gcgaccuccggcgccaggcc

SEQ ID NO: 3461827 - RNA, 22 nt, Pseudomonas aeruginosa PA01
gcgaccuccggcgccaggcccu

SEQ ID NO: 3461828 - RNA, 13 nt, Pseudomonas aeruginosa PA01
gcgaccugcucga

SEQ ID NO: 3461829 - RNA, 14 nt, Pseudomonas aeruginosa PA01
gcgaccugcucgcg

SEQ ID NO: 3461830 - RNA, 15 nt, Pseudomonas aeruginosa PA01
gcgaccuggcgccga

SEQ ID NO: 3461831 - RNA, 17 nt, Pseudomonas aeruginosa PA01
gcgaccuggcgccgaaa

SEQ ID NO: 3461832 - RNA, 18 nt, Pseudomonas aeruginosa PA01
gcgaccugggcgucgcug

SEQ ID NO: 3461833 - RNA, 17 nt, Pseudomonas aeruginosa PA01
gcgaccugguggcgccg

SEQ ID NO: 3461834 - RNA, 19 nt, Pseudomonas aeruginosa PA01
gcgaccuguucgaaguucu

SEQ ID NO: 3461835 - RNA, 14 nt, Pseudomonas aeruginosa PA01
gcgaccuugacgaa

SEQ ID NO: 3461836 - RNA, 20 nt, Pseudomonas aeruginosa PA01
gcgaccuugacgaagccggc

SEQ ID NO: 3461837 - RNA, 22 nt, Pseudomonas aeruginosa PA01
gcgaccuugacgaagccggcga

SEQ ID NO: 3461838 - RNA, 22 nt, Pseudomonas aeruginosa PA01
gcgaccuugcgcaccagggcca

SEQ ID NO: 3461839 - RNA, 16 nt, Pseudomonas aeruginosa PA01
gcgaccuuggccagcc

SEQ ID NO: 3461840 - RNA, 22 nt, Pseudomonas aeruginosa PA01
gcgaccuuguccugcggccggg

SEQ ID NO: 3461841 - RNA, 15 nt, Pseudomonas aeruginosa PA01
gcgaccuugucgaug

SEQ ID NO: 3461842 - RNA, 18 nt, Pseudomonas aeruginosa PA01
gcgaccuugucgaugguc

SEQ ID NO: 3461843 - RNA, 15 nt, Pseudomonas aeruginosa PA01
gcgacgaagcccagg

SEQ ID NO: 3461844 - RNA, 16 nt, Pseudomonas aeruginosa PA01
gcgacgaagcccaggc

SEQ ID NO: 3461845 - RNA, 17 nt, Pseudomonas aeruginosa PA01
gcgacgaagcccaggcu

SEQ ID NO: 3461846 - RNA, 18 nt, Pseudomonas aeruginosa PA01
gcgacgaagcccaggcug

SEQ ID NO: 3461847 - RNA, 18 nt, Pseudomonas aeruginosa PA01
gcgacgaagcccucgcga

SEQ ID NO: 3461848 - RNA, 20 nt, Pseudomonas aeruginosa PA01
gcgacgaagcccucgcgacg

SEQ ID NO: 3461849 - RNA, 21 nt, Pseudomonas aeruginosa PA01
gcgacgaagcccucgcgacgg

SEQ ID NO: 3461850 - RNA, 22 nt, Pseudomonas aeruginosa PA01
gcgacgaagcccucgcgacggc

SEQ ID NO: 3461851 - RNA, 15 nt, Pseudomonas aeruginosa PA01
gcgacgaaggccugg

SEQ ID NO: 3461852 - RNA, 16 nt, Pseudomonas aeruginosa PA01
gcgacgaaggccuggu

SEQ ID NO: 3461853 - RNA, 19 nt, Pseudomonas aeruginosa PA01
gcgacgaaggccuggucga

SEQ ID NO: 3461854 - RNA, 20 nt, Pseudomonas aeruginosa PA01
gcgacgaagguaucgaaguc

SEQ ID NO: 3461855 - RNA, 14 nt, Pseudomonas aeruginosa PA01
gcgacgaaggucgg

SEQ ID NO: 3461856 - RNA, 17 nt, Pseudomonas aeruginosa PA01
gcgacgaaggucggcgg

SEQ ID NO: 3461857 - RNA, 18 nt, Pseudomonas aeruginosa PA01
gcgacgaaggucggcggc

SEQ ID NO: 3461858 - RNA, 20 nt, Pseudomonas aeruginosa PA01
gcgacgaaggucggcggcag

SEQ ID NO: 3461859 - RNA, 20 nt, Pseudomonas aeruginosa PA01
gcgacgacgaagaguaaaug

SEQ ID NO: 3461860 - RNA, 16 nt, Pseudomonas aeruginosa PA01
gcgacgacgaucccgg

SEQ ID NO: 3461861 - RNA, 20 nt, Pseudomonas aeruginosa PA01
gcgacgacgaucccggcggu

SEQ ID NO: 3461862 - RNA, 15 nt, Pseudomonas aeruginosa PA01
gcgacgacugcggca

SEQ ID NO: 3461863 - RNA, 17 nt, Pseudomonas aeruginosa PA01
gcgacgacugcggcagc

SEQ ID NO: 3461864 - RNA, 15 nt, Pseudomonas aeruginosa PA01
gcgacgacuugccca

SEQ ID NO: 3461865 - RNA, 21 nt, Pseudomonas aeruginosa PA01
gcgacgacuugcccaccccgg

SEQ ID NO: 3461866 - RNA, 18 nt, Pseudomonas aeruginosa PA01
gcgacgagaaaaagcccg

SEQ ID NO: 3461867 - RNA, 22 nt, Pseudomonas aeruginosa PA01
gcgacgagaaaaagcccggcau

SEQ ID NO: 3461868 - RNA, 16 nt, Pseudomonas aeruginosa PA01
gcgacgagccggacgg

SEQ ID NO: 3461869 - RNA, 20 nt, Pseudomonas aeruginosa PA01
gcgacgagccggacggcggc

SEQ ID NO: 3461870 - RNA, 12 nt, Pseudomonas aeruginosa PA01
gcgacgaggacg

SEQ ID NO: 3461871 - RNA, 16 nt, Pseudomonas aeruginosa PA01
gcgacgaggcgcggcg

SEQ ID NO: 3461872 - RNA, 17 nt, Pseudomonas aeruginosa PA01
gcgacgaggcgcggcgg

SEQ ID NO: 3461873 - RNA, 18 nt, Pseudomonas aeruginosa PA01
gcgacgaggcgcggcgga

SEQ ID NO: 3461874 - RNA, 21 nt, Pseudomonas aeruginosa PA01
gcgacgaucacccccagcgag

SEQ ID NO: 3461875 - RNA, 22 nt, Pseudomonas aeruginosa PA01
gcgacgaucacccccagcgagc

SEQ ID NO: 3461876 - RNA, 13 nt, Pseudomonas aeruginosa PA01
gcgacgaucagcc

SEQ ID NO: 3461877 - RNA, 14 nt, Pseudomonas aeruginosa PA01
gcgacgaucagccc

SEQ ID NO: 3461878 - RNA, 18 nt, Pseudomonas aeruginosa PA01
gcgacgaucagcccgccg

SEQ ID NO: 3461879 - RNA, 22 nt, Pseudomonas aeruginosa PA01
gcgacgaucagcccgccggcga

SEQ ID NO: 3461880 - RNA, 23 nt, Pseudomonas aeruginosa PA01
gcgacgaucucuucccggcucgg

SEQ ID NO: 3461881 - RNA, 15 nt, Pseudomonas aeruginosa PA01
gcgacgaugccgccg

SEQ ID NO: 3461882 - RNA, 18 nt, Pseudomonas aeruginosa PA01
gcgacgauguucuccacg

SEQ ID NO: 3461883 - RNA, 17 nt, Pseudomonas aeruginosa PA01
gcgacgcacaccgucga

SEQ ID NO: 3461884 - RNA, 15 nt, Pseudomonas aeruginosa PA01
gcgacgcagcacggc

SEQ ID NO: 3461885 - RNA, 16 nt, Pseudomonas aeruginosa PA01
gcgacgcagcacggcg

SEQ ID NO: 3461886 - RNA, 18 nt, Pseudomonas aeruginosa PA01
gcgacgcagcacggcggc

SEQ ID NO: 3461887 - RNA, 17 nt, Pseudomonas aeruginosa PA01
gcgacgcauggaucaug

SEQ ID NO: 3461888 - RNA, 23 nt, Pseudomonas aeruginosa PA01
gcgacgccacccgcaucgaggcc

SEQ ID NO: 3461889 - RNA, 19 nt, Pseudomonas aeruginosa PA01
gcgacgcccuguucggcgg

SEQ ID NO: 3461890 - RNA, 22 nt, Pseudomonas aeruginosa PA01
gcgacgcccuugcggcgcggcc

SEQ ID NO: 3461891 - RNA, 23 nt, Pseudomonas aeruginosa PA01
gcgacgcccuugcggcgcggccc

SEQ ID NO: 3461892 - RNA, 14 nt, Pseudomonas aeruginosa PA01
gcgacgccgcgcug

SEQ ID NO: 3461893 - RNA, 15 nt, Pseudomonas aeruginosa PA01
gcgacgccgcgcugc

SEQ ID NO: 3461894 - RNA, 13 nt, Pseudomonas aeruginosa PA01
gcgacgccggucg

SEQ ID NO: 3461895 - RNA, 15 nt, Pseudomonas aeruginosa PA01
gcgacgcgaccuccg

SEQ ID NO: 3461896 - RNA, 20 nt, Pseudomonas aeruginosa PA01
gcgacgcgaccuccggcgcc

SEQ ID NO: 3461897 - RNA, 15 nt, Pseudomonas aeruginosa PA01
gcgacgcgcaggccg

SEQ ID NO: 3461898 - RNA, 16 nt, Pseudomonas aeruginosa PA01
gcgacgcgcaggccgg

SEQ ID NO: 3461899 - RNA, 14 nt, Pseudomonas aeruginosa PA01
gcgacgcgcuggac

SEQ ID NO: 3461900 - RNA, 13 nt, Pseudomonas aeruginosa PA01
gcgagaggucggc

SEQ ID NO: 3461901 - RNA, 21 nt, Pseudomonas aeruginosa PA01
gcgagaggucggcgcgcccgg

SEQ ID NO: 3461902 - RNA, 21 nt, Pseudomonas aeruginosa PA01
gcgagagguucaccgaccagu

SEQ ID NO: 3461903 - RNA, 19 nt, Pseudomonas aeruginosa PA01
gcgagaucuucaggccgaa

SEQ ID NO: 3461904 - RNA, 22 nt, Pseudomonas aeruginosa PA01
gcgagaucuucaggccgaagcu

SEQ ID NO: 3461905 - RNA, 21 nt, Pseudomonas aeruginosa PA01
gcgagcaaugaaaaaggcgau

SEQ ID NO: 3461906 - RNA, 22 nt, Pseudomonas aeruginosa PA01
gcgagcaaugaaaaaggcgauc

SEQ ID NO: 3461907 - RNA, 12 nt, Pseudomonas aeruginosa PA01
gcgagcaccaug

SEQ ID NO: 3461908 - RNA, 13 nt, Pseudomonas aeruginosa PA01
gcgagcaccaugc

SEQ ID NO: 3461909 - RNA, 14 nt, Pseudomonas aeruginosa PA01
gcgagcaccgcgca

SEQ ID NO: 3461910 - RNA, 16 nt, Pseudomonas aeruginosa PA01
gcgagcaccgcgcaga

SEQ ID NO: 3461911 - RNA, 13 nt, Pseudomonas aeruginosa PA01
gcgagcacggcga

SEQ ID NO: 3461912 - RNA, 23 nt, Pseudomonas aeruginosa PA01
gcgagcacggcgaacaccgggcc

SEQ ID NO: 3461913 - RNA, 15 nt, Pseudomonas aeruginosa PA01
gcgagcagccgacga

SEQ ID NO: 3461914 - RNA, 16 nt, Pseudomonas aeruginosa PA01
gcgagcagggcgaugc

SEQ ID NO: 3461915 - RNA, 18 nt, Pseudomonas aeruginosa PA01
gcgagcagggcgaugccg

SEQ ID NO: 3461916 - RNA, 20 nt, Pseudomonas aeruginosa PA01
gcgagcagggcgaugccgau

SEQ ID NO: 3461917 - RNA, 14 nt, Pseudomonas aeruginosa PA01
gcgagcagggcgcu

SEQ ID NO: 3461918 - RNA, 24 nt, Pseudomonas aeruginosa PA01
gcgagcagggcgcugagcgcgguc

SEQ ID NO: 3461919 - RNA, 15 nt, Pseudomonas aeruginosa PA01
gcgagcagguccugu

SEQ ID NO: 3461920 - RNA, 20 nt, Pseudomonas aeruginosa PA01
gcgagcaucucggccaggcc

SEQ ID NO: 3461921 - RNA, 14 nt, Pseudomonas aeruginosa PA01
gcgagcaugcucac

SEQ ID NO: 3461922 - RNA, 21 nt, Pseudomonas aeruginosa PA01
gcgagcaugcucacugcgagc

SEQ ID NO: 3461923 - RNA, 17 nt, Pseudomonas aeruginosa PA01
gcgagcauuccucagcg

SEQ ID NO: 3461924 - RNA, 19 nt, Pseudomonas aeruginosa PA01
gcgagcauuccucagcgcc

SEQ ID NO: 3461925 - RNA, 20 nt, Pseudomonas aeruginosa PA01
gcgagcauuccucagcgccg

SEQ ID NO: 3461926 - RNA, 15 nt, Pseudomonas aeruginosa PA01
gcgagccacauccag

SEQ ID NO: 3461927 - RNA, 14 nt, Pseudomonas aeruginosa PA01
gcgagccagccgug

SEQ ID NO: 3461928 - RNA, 16 nt, Pseudomonas aeruginosa PA01
gcgagccagccguggc

SEQ ID NO: 3461929 - RNA, 22 nt, Pseudomonas aeruginosa PA01
gcgagccagccguggcaggcgc

SEQ ID NO: 3461930 - RNA, 22 nt, Pseudomonas aeruginosa PA01
gcgagccagguuuccggcagca

SEQ ID NO: 3461931 - RNA, 15 nt, Pseudomonas aeruginosa PA01
gcgagccgacuucca

SEQ ID NO: 3461932 - RNA, 16 nt, Pseudomonas aeruginosa PA01
gcgagccgaucaccag

SEQ ID NO: 3461933 - RNA, 17 nt, Pseudomonas aeruginosa PA01
gcgagccgaucaccagc

SEQ ID NO: 3461934 - RNA, 16 nt, Pseudomonas aeruginosa PA01
gcgagccgcagcggcu

SEQ ID NO: 3461935 - RNA, 14 nt, Pseudomonas aeruginosa PA01
gcgagccgccgggc

SEQ ID NO: 3461936 - RNA, 15 nt, Pseudomonas aeruginosa PA01
gcgagccgccgggcg

SEQ ID NO: 3461937 - RNA, 18 nt, Pseudomonas aeruginosa PA01
gcgagccgcgacggcugc

SEQ ID NO: 3461938 - RNA, 12 nt, Pseudomonas aeruginosa PA01
gcgagccgcgcu

SEQ ID NO: 3461939 - RNA, 14 nt, Pseudomonas aeruginosa PA01
gcgagccgcgcugc

SEQ ID NO: 3461940 - RNA, 15 nt, Pseudomonas aeruginosa PA01
gcgagccgcgcugcu

SEQ ID NO: 3461941 - RNA, 20 nt, Pseudomonas aeruginosa PA01
gcgagccggcgcaucagcgc

SEQ ID NO: 3461942 - RNA, 19 nt, Pseudomonas aeruginosa PA01
gcgagccuucagcacggcg

SEQ ID NO: 3461943 - RNA, 18 nt, Pseudomonas aeruginosa PA01
gcgagcgaaacggcgcug

SEQ ID NO: 3461944 - RNA, 20 nt, Pseudomonas aeruginosa PA01
gcgagcgaaacggcgcugaa

SEQ ID NO: 3461945 - RNA, 18 nt, Pseudomonas aeruginosa PA01
gcgagcgcacaacgccuu

SEQ ID NO: 3461946 - RNA, 12 nt, Pseudomonas aeruginosa PA01
gcgagcgcccgc

SEQ ID NO: 3461947 - RNA, 14 nt, Pseudomonas aeruginosa PA01
gcgagcgcccgccg

SEQ ID NO: 3461948 - RNA, 11 nt, Pseudomonas aeruginosa PA01
gcgagcgccgc

SEQ ID NO: 3461949 - RNA, 12 nt, Pseudomonas aeruginosa PA01
gcgagcgccgcc

SEQ ID NO: 3461950 - RNA, 13 nt, Pseudomonas aeruginosa PA01
gcgagcgccgccg

SEQ ID NO: 3461951 - RNA, 13 nt, Pseudomonas aeruginosa PA01
gcgagcgccgccu

SEQ ID NO: 3461952 - RNA, 22 nt, Pseudomonas aeruginosa PA01
gcgagcgccgccuugagcggcg

SEQ ID NO: 3461953 - RNA, 15 nt, Pseudomonas aeruginosa PA01
gcgagcgccgcggcg

SEQ ID NO: 3461954 - RNA, 12 nt, Pseudomonas aeruginosa PA01
gcgagcgccugg

SEQ ID NO: 3461955 - RNA, 13 nt, Pseudomonas aeruginosa PA01
gcgagcgcggccg

SEQ ID NO: 3461956 - RNA, 15 nt, Pseudomonas aeruginosa PA01
gcgagcgcggccggc

SEQ ID NO: 3461957 - RNA, 15 nt, Pseudomonas aeruginosa PA01
gcgagcggcagaucc

SEQ ID NO: 3461958 - RNA, 14 nt, Pseudomonas aeruginosa PA01
gcgagcgggcgagg

SEQ ID NO: 3461959 - RNA, 16 nt, Pseudomonas aeruginosa PA01
gcgagcgggcgagggc

SEQ ID NO: 3461960 - RNA, 20 nt, Pseudomonas aeruginosa PA01
gcgagcgggcgagggcggcg

SEQ ID NO: 3461961 - RNA, 21 nt, Pseudomonas aeruginosa PA01
gcgagcgggcgagggcggcgc

SEQ ID NO: 3461962 - RNA, 14 nt, Pseudomonas aeruginosa PA01
gcgagcgggucagc

SEQ ID NO: 3461963 - RNA, 17 nt, Pseudomonas aeruginosa PA01
gcgagcgggucagcagc

SEQ ID NO: 3461964 - RNA, 20 nt, Pseudomonas aeruginosa PA01
gcgagcgggucagcagcacc

SEQ ID NO: 3461965 - RNA, 15 nt, Pseudomonas aeruginosa PA01
gcgagcggucggcca

SEQ ID NO: 3461966 - RNA, 18 nt, Pseudomonas aeruginosa PA01
gcgagcgguuauucgccc

SEQ ID NO: 3461967 - RNA, 15 nt, Pseudomonas aeruginosa PA01
gcgagcgucgagucg

SEQ ID NO: 3461968 - RNA, 19 nt, Pseudomonas aeruginosa PA01
gcgagcgucgagucgcgca

SEQ ID NO: 3461969 - RNA, 23 nt, Pseudomonas aeruginosa PA01
gcgagcgucgagucgcgcagcca

SEQ ID NO: 3461970 - RNA, 16 nt, Pseudomonas aeruginosa PA01
gcgagcguuccaugaa

SEQ ID NO: 3461971 - RNA, 20 nt, Pseudomonas aeruginosa PA01
gcgagcugccccucguggcg

SEQ ID NO: 3461972 - RNA, 21 nt, Pseudomonas aeruginosa PA01
gcgagcuggaucggcaggcug

SEQ ID NO: 3461973 - RNA, 22 nt, Pseudomonas aeruginosa PA01
gcgagcuggaucggcaggcugg

SEQ ID NO: 3461974 - RNA, 13 nt, Pseudomonas aeruginosa PA01
gcgagcuggcgcc

SEQ ID NO: 3461975 - RNA, 13 nt, Pseudomonas aeruginosa PA01
gcgagcuucgccg

SEQ ID NO: 3461976 - RNA, 19 nt, Pseudomonas aeruginosa PA01
gcgagcuucgccgcgcaag

SEQ ID NO: 3461977 - RNA, 23 nt, Pseudomonas aeruginosa PA01
gcgagcuugcaauccgugcgccg

SEQ ID NO: 3461978 - RNA, 15 nt, Pseudomonas aeruginosa PA01
gcgagcuuggcccug

SEQ ID NO: 3461979 - RNA, 20 nt, Pseudomonas aeruginosa PA01
gcgaggaaaaggaucgccgc

SEQ ID NO: 3461980 - RNA, 19 nt, Pseudomonas aeruginosa PA01
gcgaggaacacccagaagc

SEQ ID NO: 3461981 - RNA, 17 nt, Pseudomonas aeruginosa PA01
gcgaggaacagcaccag

SEQ ID NO: 3461982 - RNA, 21 nt, Pseudomonas aeruginosa PA01
gcgaggaacagcgagaggggc

SEQ ID NO: 3461983 - RNA, 13 nt, Pseudomonas aeruginosa PA01
gcgaggacgccgg

SEQ ID NO: 3461984 - RNA, 14 nt, Pseudomonas aeruginosa PA01
gcgaggacgccggg

SEQ ID NO: 3461985 - RNA, 15 nt, Pseudomonas aeruginosa PA01
gcgaggacgccgggc

SEQ ID NO: 3461986 - RNA, 16 nt, Pseudomonas aeruginosa PA01
gcgaggacgccgggcu

SEQ ID NO: 3461987 - RNA, 20 nt, Pseudomonas aeruginosa PA01
gcgaggagccguagggcgca

SEQ ID NO: 3461988 - RNA, 21 nt, Pseudomonas aeruginosa PA01
gcgaggagguuggucugcucg

SEQ ID NO: 3461989 - RNA, 23 nt, Pseudomonas aeruginosa PA01
gcgaggagguuggucugcucggc

SEQ ID NO: 3461990 - RNA, 23 nt, Pseudomonas aeruginosa PA01
gcgaggaucacgcagcaggcgac

SEQ ID NO: 3461991 - RNA, 22 nt, Pseudomonas aeruginosa PA01
gcgaggaucagccacgggcgcc

SEQ ID NO: 3461992 - RNA, 23 nt, Pseudomonas aeruginosa PA01
gcgaggaucagucgcugcucggc

SEQ ID NO: 3461993 - RNA, 16 nt, Pseudomonas aeruginosa PA01
gcgaggaucgcgcugg

SEQ ID NO: 3461994 - RNA, 19 nt, Pseudomonas aeruginosa PA01
gcgaggaucgcgcuggcca

SEQ ID NO: 3461995 - RNA, 20 nt, Pseudomonas aeruginosa PA01
gcgaggaucgcgcuggccag

SEQ ID NO: 3461996 - RNA, 16 nt, Pseudomonas aeruginosa PA01
gcgaggauuuccggcu

SEQ ID NO: 3461997 - RNA, 16 nt, Pseudomonas aeruginosa PA01
gcgaggcauucucgcg

SEQ ID NO: 3461998 - RNA, 13 nt, Pseudomonas aeruginosa PA01
gcgaggcccgcgc

SEQ ID NO: 3461999 - RNA, 18 nt, Pseudomonas aeruginosa PA01
gcgaggcccgcgccgccg

SEQ ID NO: 3462000 - RNA, 22 nt, Pseudomonas aeruginosa PA01
gcgaggcccguauggcgggccu

SEQ ID NO: 3462001 - RNA, 13 nt, Pseudomonas aeruginosa PA01
gcgaggccgcucu

SEQ ID NO: 3462002 - RNA, 22 nt, Pseudomonas aeruginosa PA01
gcgaggccgcucuucugguagg

SEQ ID NO: 3462003 - RNA, 19 nt, Pseudomonas aeruginosa PA01
gcgaucaggcagcgcgcgg

SEQ ID NO: 3462004 - RNA, 15 nt, Pseudomonas aeruginosa PA01
gcgaucaggccgaug

SEQ ID NO: 3462005 - RNA, 16 nt, Pseudomonas aeruginosa PA01
gcgaucaggccgaugc

SEQ ID NO: 3462006 - RNA, 14 nt, Pseudomonas aeruginosa PA01
gcgaucagggccuc

SEQ ID NO: 3462007 - RNA, 15 nt, Pseudomonas aeruginosa PA01
gcgaucagggccucg

SEQ ID NO: 3462008 - RNA, 20 nt, Pseudomonas aeruginosa PA01
gcgaucagggccucgccacg

SEQ ID NO: 3462009 - RNA, 22 nt, Pseudomonas aeruginosa PA01
gcgaucagggccucgccacgcu

SEQ ID NO: 3462010 - RNA, 12 nt, Pseudomonas aeruginosa PA01
gcgaucauccag

SEQ ID NO: 3462011 - RNA, 18 nt, Pseudomonas aeruginosa PA01
gcgaucauccagccccca

SEQ ID NO: 3462012 - RNA, 12 nt, Pseudomonas aeruginosa PA01
gcgaucaucgcc

SEQ ID NO: 3462013 - RNA, 13 nt, Pseudomonas aeruginosa PA01
gcgaucaucgcgc

SEQ ID NO: 3462014 - RNA, 16 nt, Pseudomonas aeruginosa PA01
gcgaucaugccuucga

SEQ ID NO: 3462015 - RNA, 16 nt, Pseudomonas aeruginosa PA01
gcgauccacagcaggu

SEQ ID NO: 3462016 - RNA, 16 nt, Pseudomonas aeruginosa PA01
gcgauccaccgccagg

SEQ ID NO: 3462017 - RNA, 17 nt, Pseudomonas aeruginosa PA01
gcgauccaccgccaggg

SEQ ID NO: 3462018 - RNA, 19 nt, Pseudomonas aeruginosa PA01
gcgauccaccgccagggcg

SEQ ID NO: 3462019 - RNA, 21 nt, Pseudomonas aeruginosa PA01
gcgauccaccgccagggcgcu

SEQ ID NO: 3462020 - RNA, 19 nt, Pseudomonas aeruginosa PA01
gcgauccagaagaucagcg

SEQ ID NO: 3462021 - RNA, 20 nt, Pseudomonas aeruginosa PA01
gcgauccagaagaucagcgc

SEQ ID NO: 3462022 - RNA, 15 nt, Pseudomonas aeruginosa PA01
gcgauccaugcgcac

SEQ ID NO: 3462023 - RNA, 17 nt, Pseudomonas aeruginosa PA01
gcgaucccaggucggcg

SEQ ID NO: 3462024 - RNA, 20 nt, Pseudomonas aeruginosa PA01
gcgauccgcccgcaugccag

SEQ ID NO: 3462025 - RNA, 21 nt, Pseudomonas aeruginosa PA01
gcgauccugaccguccuggcc

SEQ ID NO: 3462026 - RNA, 14 nt, Pseudomonas aeruginosa PA01
gcgauccuggcggc

SEQ ID NO: 3462027 - RNA, 15 nt, Pseudomonas aeruginosa PA01
gcgauccuggcggca

SEQ ID NO: 3462028 - RNA, 19 nt, Pseudomonas aeruginosa PA01
gcgauccuucggaggucga

SEQ ID NO: 3462029 - RNA, 19 nt, Pseudomonas aeruginosa PA01
gcgaucgaaggaucgccuu

SEQ ID NO: 3462030 - RNA, 13 nt, Pseudomonas aeruginosa PA01
gcgaucgacgccu

SEQ ID NO: 3462031 - RNA, 14 nt, Pseudomonas aeruginosa PA01
gcgaucgacgccuc

SEQ ID NO: 3462032 - RNA, 22 nt, Pseudomonas aeruginosa PA01
gcgaucgaggaugaucggcucc

SEQ ID NO: 3462033 - RNA, 17 nt, Pseudomonas aeruginosa PA01
gcgaucgaggccuaccc

SEQ ID NO: 3462034 - RNA, 21 nt, Pseudomonas aeruginosa PA01
gcgaucgauguuuccgacccg

SEQ ID NO: 3462035 - RNA, 13 nt, Pseudomonas aeruginosa PA01
gcgaucgccaggu

SEQ ID NO: 3462036 - RNA, 12 nt, Pseudomonas aeruginosa PA01
gcgaucgccgcc

SEQ ID NO: 3462037 - RNA, 13 nt, Pseudomonas aeruginosa PA01
gcgaucgccgcgg

SEQ ID NO: 3462038 - RNA, 16 nt, Pseudomonas aeruginosa PA01
gcgaucgccuggucga

SEQ ID NO: 3462039 - RNA, 17 nt, Pseudomonas aeruginosa PA01
gcgaucgcggccagccg

SEQ ID NO: 3462040 - RNA, 19 nt, Pseudomonas aeruginosa PA01
gcgaucggaagaucgcccg

SEQ ID NO: 3462041 - RNA, 22 nt, Pseudomonas aeruginosa PA01
gcgaucggaagaucgcccgccu

SEQ ID NO: 3462042 - RNA, 13 nt, Pseudomonas aeruginosa PA01
gcgaucggcgucc

SEQ ID NO: 3462043 - RNA, 18 nt, Pseudomonas aeruginosa PA01
gcgaucggcguccgcggc

SEQ ID NO: 3462044 - RNA, 20 nt, Pseudomonas aeruginosa PA01
gcgaucggcguccgcggccu

SEQ ID NO: 3462045 - RNA, 22 nt, Pseudomonas aeruginosa PA01
gcgaucggguagagcgcggcgc

SEQ ID NO: 3462046 - RNA, 20 nt, Pseudomonas aeruginosa PA01
gcgaucgucgagaugcugcg

SEQ ID NO: 3462047 - RNA, 21 nt, Pseudomonas aeruginosa PA01
gcgaucgucgagaugcugcgg

SEQ ID NO: 3462048 - RNA, 18 nt, Pseudomonas aeruginosa PA01
gcgaucuaccugcgugcg

SEQ ID NO: 3462049 - RNA, 22 nt, Pseudomonas aeruginosa PA01
gcgaucuccgccaggcggccga

SEQ ID NO: 3462050 - RNA, 14 nt, Pseudomonas aeruginosa PA01
gcgaucuccgggag

SEQ ID NO: 3462051 - RNA, 16 nt, Pseudomonas aeruginosa PA01
gcgaucuccgggagca

SEQ ID NO: 3462052 - RNA, 18 nt, Pseudomonas aeruginosa PA01
gcgaucuccgggagcauc

SEQ ID NO: 3462053 - RNA, 20 nt, Pseudomonas aeruginosa PA01
gcgaucuccugccgcggcga

SEQ ID NO: 3462054 - RNA, 13 nt, Pseudomonas aeruginosa PA01
gcgaucucggcgc

SEQ ID NO: 3462055 - RNA, 16 nt, Pseudomonas aeruginosa PA01
gcgaucucggcgcggg

SEQ ID NO: 3462056 - RNA, 18 nt, Pseudomonas aeruginosa PA01
gcgaucucggcgcgggca

SEQ ID NO: 3462057 - RNA, 20 nt, Pseudomonas aeruginosa PA01
gcgaucucuacuaccgccag

SEQ ID NO: 3462058 - RNA, 24 nt, Pseudomonas aeruginosa PA01
gcgaucucuacuaccgccagcgca

SEQ ID NO: 3462059 - RNA, 12 nt, Pseudomonas aeruginosa PA01
gcgaucugugcg

SEQ ID NO: 3462060 - RNA, 24 nt, Pseudomonas aeruginosa PA01
gcgaucuucagguaggcgcgggcg

SEQ ID NO: 3462061 - RNA, 15 nt, Pseudomonas aeruginosa PA01
gcgaucuucuccgcc

SEQ ID NO: 3462062 - RNA, 16 nt, Pseudomonas aeruginosa PA01
gcgaucuucuccgccg

SEQ ID NO: 3462063 - RNA, 19 nt, Pseudomonas aeruginosa PA01
gcgaucuucuccgccgcgu

SEQ ID NO: 3462064 - RNA, 20 nt, Pseudomonas aeruginosa PA01
gcgaucuucuccgccgcgug

SEQ ID NO: 3462065 - RNA, 22 nt, Pseudomonas aeruginosa PA01
gcgaucuucuccgccgcgugcg

SEQ ID NO: 3462066 - RNA, 24 nt, Pseudomonas aeruginosa PA01
gcgaucuucuccgccgcgugcgcg

SEQ ID NO: 3462067 - RNA, 15 nt, Pseudomonas aeruginosa PA01
gcgaucuugaucgcc

SEQ ID NO: 3462068 - RNA, 24 nt, Pseudomonas aeruginosa PA01
gcgaugaccagcucggcgggacgg

SEQ ID NO: 3462069 - RNA, 15 nt, Pseudomonas aeruginosa PA01
gcgaugaccgccccg

SEQ ID NO: 3462070 - RNA, 17 nt, Pseudomonas aeruginosa PA01
gcgaugaccgccccggc

SEQ ID NO: 3462071 - RNA, 16 nt, Pseudomonas aeruginosa PA01
gcgaugaggcugucca

SEQ ID NO: 3462072 - RNA, 14 nt, Pseudomonas aeruginosa PA01
gcgaugaucggcag

SEQ ID NO: 3462073 - RNA, 18 nt, Pseudomonas aeruginosa PA01
gcgaugaucuggccaccc

SEQ ID NO: 3462074 - RNA, 13 nt, Pseudomonas aeruginosa PA01
gcgaugaugccgc

SEQ ID NO: 3462075 - RNA, 14 nt, Pseudomonas aeruginosa PA01
gcgaugaugccgcc

SEQ ID NO: 3462076 - RNA, 15 nt, Pseudomonas aeruginosa PA01
gcgaugaugccgccg

SEQ ID NO: 3462077 - RNA, 14 nt, Pseudomonas aeruginosa PA01
gcgaugcccaggcc

SEQ ID NO: 3462078 - RNA, 15 nt, Pseudomonas aeruginosa PA01
gcgaugcccaggccg

SEQ ID NO: 3462079 - RNA, 17 nt, Pseudomonas aeruginosa PA01
gcgaugcccaggccgcc

SEQ ID NO: 3462080 - RNA, 23 nt, Pseudomonas aeruginosa PA01
gcgaugccccauccgacgccggc

SEQ ID NO: 3462081 - RNA, 18 nt, Pseudomonas aeruginosa PA01
gcgaugcccuggccgcug

SEQ ID NO: 3462082 - RNA, 21 nt, Pseudomonas aeruginosa PA01
gcgaugcccuggccgcugccg

SEQ ID NO: 3462083 - RNA, 23 nt, Pseudomonas aeruginosa PA01
gcgaugcccuggccgcugccgcu

SEQ ID NO: 3462084 - RNA, 19 nt, Pseudomonas aeruginosa PA01
gcgaugcccuggcuuucca

SEQ ID NO: 3462085 - RNA, 20 nt, Pseudomonas aeruginosa PA01
gcgaugcccuggcuuuccag

SEQ ID NO: 3462086 - RNA, 21 nt, Pseudomonas aeruginosa PA01
gcgaugcccuuggccagcgcg

SEQ ID NO: 3462087 - RNA, 12 nt, Pseudomonas aeruginosa PA01
gcgaugccgccc

SEQ ID NO: 3462088 - RNA, 13 nt, Pseudomonas aeruginosa PA01
gcgaugccgccca

SEQ ID NO: 3462089 - RNA, 15 nt, Pseudomonas aeruginosa PA01
gcgaugccgcccagc

SEQ ID NO: 3462090 - RNA, 16 nt, Pseudomonas aeruginosa PA01
gcgaugccgcccagca

SEQ ID NO: 3462091 - RNA, 13 nt, Pseudomonas aeruginosa PA01
gcgaugccgccgg

SEQ ID NO: 3462092 - RNA, 15 nt, Pseudomonas aeruginosa PA01
gcgaugccgcgccag

SEQ ID NO: 3462093 - RNA, 17 nt, Pseudomonas aeruginosa PA01
gcgaugccgcgccaggc

SEQ ID NO: 3462094 - RNA, 20 nt, Pseudomonas aeruginosa PA01
gcgaugccgcgccaggcgca

SEQ ID NO: 3462095 - RNA, 20 nt, Pseudomonas aeruginosa PA01
gcgaugcgcaugcgcagcgc

SEQ ID NO: 3462096 - RNA, 15 nt, Pseudomonas aeruginosa PA01
gcgaugcgcuggaag

SEQ ID NO: 3462097 - RNA, 22 nt, Pseudomonas aeruginosa PA01
gcgaugcgguuccuggcuggag

SEQ ID NO: 3462098 - RNA, 20 nt, Pseudomonas aeruginosa PA01
gcgaugcguuugucgaccug

SEQ ID NO: 3462099 - RNA, 22 nt, Pseudomonas aeruginosa PA01
gcgaugcguuugucgaccugcc

SEQ ID NO: 3462100 - RNA, 17 nt, Pseudomonas aeruginosa PA01
gcgaugcucagcgccgg

SEQ ID NO: 3462101 - RNA, 21 nt, Pseudomonas aeruginosa PA01
gcgaugcucagcgccggccag

SEQ ID NO: 3462102 - RNA, 16 nt, Pseudomonas aeruginosa PA01
gcgaugcucccgagca

SEQ ID NO: 3462103 - RNA, 15 nt, Pseudomonas aeruginosa PA01
gcgaugcugacccag

SEQ ID NO: 3462104 - RNA, 17 nt, Pseudomonas aeruginosa PA01
gcgaugcugucagcgcc

SEQ ID NO: 3462105 - RNA, 19 nt, Pseudomonas aeruginosa PA01
gcgcaccaccgagagcggc

SEQ ID NO: 3462106 - RNA, 20 nt, Pseudomonas aeruginosa PA01
gcgcaccaccgagagcggcg

SEQ ID NO: 3462107 - RNA, 17 nt, Pseudomonas aeruginosa PA01
gcgcaccacucccggcg

SEQ ID NO: 3462108 - RNA, 12 nt, Pseudomonas aeruginosa PA01
gcgcaccacugc

SEQ ID NO: 3462109 - RNA, 14 nt, Pseudomonas aeruginosa PA01
gcgcaccacugcaa

SEQ ID NO: 3462110 - RNA, 22 nt, Pseudomonas aeruginosa PA01
gcgcaccagcacuuccggcgcg

SEQ ID NO: 3462111 - RNA, 14 nt, Pseudomonas aeruginosa PA01
gcgcaccagcaggc

SEQ ID NO: 3462112 - RNA, 15 nt, Pseudomonas aeruginosa PA01
gcgcaccagcggguc

SEQ ID NO: 3462113 - RNA, 13 nt, Pseudomonas aeruginosa PA01
gcgcaccaggcca

SEQ ID NO: 3462114 - RNA, 15 nt, Pseudomonas aeruginosa PA01
gcgcaccaggccagg

SEQ ID NO: 3462115 - RNA, 17 nt, Pseudomonas aeruginosa PA01
gcgcaccaggccaggcu

SEQ ID NO: 3462116 - RNA, 18 nt, Pseudomonas aeruginosa PA01
gcgcaccaggccaggcug

SEQ ID NO: 3462117 - RNA, 13 nt, Pseudomonas aeruginosa PA01
gcgcaccaggccu

SEQ ID NO: 3462118 - RNA, 17 nt, Pseudomonas aeruginosa PA01
gcgcaccaggccuccca

SEQ ID NO: 3462119 - RNA, 20 nt, Pseudomonas aeruginosa PA01
gcgcaccaggccucccagcc

SEQ ID NO: 3462120 - RNA, 21 nt, Pseudomonas aeruginosa PA01
gcgcaccaggccucccagccg

SEQ ID NO: 3462121 - RNA, 17 nt, Pseudomonas aeruginosa PA01
gcgcaccagggucgggc

SEQ ID NO: 3462122 - RNA, 14 nt, Pseudomonas aeruginosa PA01
gcgcaccaggucgc

SEQ ID NO: 3462123 - RNA, 16 nt, Pseudomonas aeruginosa PA01
gcgcaccaggucgcgc

SEQ ID NO: 3462124 - RNA, 17 nt, Pseudomonas aeruginosa PA01
gcgcaccaggucgcgcu

SEQ ID NO: 3462125 - RNA, 19 nt, Pseudomonas aeruginosa PA01
gcgcaccaggucgcgcuug

SEQ ID NO: 3462126 - RNA, 19 nt, Pseudomonas aeruginosa PA01
gcgcaccauagcgagccgc

SEQ ID NO: 3462127 - RNA, 22 nt, Pseudomonas aeruginosa PA01
gcgcaccauagcgagccgcgcu

SEQ ID NO: 3462128 - RNA, 18 nt, Pseudomonas aeruginosa PA01
gcgcaccauccucguagg

SEQ ID NO: 3462129 - RNA, 15 nt, Pseudomonas aeruginosa PA01
gcgcaccaugcccgc

SEQ ID NO: 3462130 - RNA, 16 nt, Pseudomonas aeruginosa PA01
gcgcaccaugcccgcu

SEQ ID NO: 3462131 - RNA, 17 nt, Pseudomonas aeruginosa PA01
gcgcacccgcucggccu

SEQ ID NO: 3462132 - RNA, 19 nt, Pseudomonas aeruginosa PA01
gcgcacccgcucggccuug

SEQ ID NO: 3462133 - RNA, 14 nt, Pseudomonas aeruginosa PA01
gcgcaccgacgccg

SEQ ID NO: 3462134 - RNA, 15 nt, Pseudomonas aeruginosa PA01
gcgcaccgccaagga

SEQ ID NO: 3462135 - RNA, 16 nt, Pseudomonas aeruginosa PA01
gcgcaccgccaaggau

SEQ ID NO: 3462136 - RNA, 20 nt, Pseudomonas aeruginosa PA01
gcgcaccgccucgaccccgg

SEQ ID NO: 3462137 - RNA, 13 nt, Pseudomonas aeruginosa PA01
gcgcaccgccugc

SEQ ID NO: 3462138 - RNA, 19 nt, Pseudomonas aeruginosa PA01
gcgcaccgccugcagcacc

SEQ ID NO: 3462139 - RNA, 20 nt, Pseudomonas aeruginosa PA01
gcgcaccgccugcagcacca

SEQ ID NO: 3462140 - RNA, 13 nt, Pseudomonas aeruginosa PA01
gcgcaccgcgccg

SEQ ID NO: 3462141 - RNA, 15 nt, Pseudomonas aeruginosa PA01
gcgcaccgcgccggg

SEQ ID NO: 3462142 - RNA, 16 nt, Pseudomonas aeruginosa PA01
gcgcaccgcgccggga

SEQ ID NO: 3462143 - RNA, 13 nt, Pseudomonas aeruginosa PA01
gcgcaccgcggcc

SEQ ID NO: 3462144 - RNA, 14 nt, Pseudomonas aeruginosa PA01
gcgcaccgcggcca

SEQ ID NO: 3462145 - RNA, 14 nt, Pseudomonas aeruginosa PA01
gcgcaccgcggcga

SEQ ID NO: 3462146 - RNA, 16 nt, Pseudomonas aeruginosa PA01
gcgcaccgcggcgagc

SEQ ID NO: 3462147 - RNA, 22 nt, Pseudomonas aeruginosa PA01
gcgcaccuccucgggcggaucg

SEQ ID NO: 3462148 - RNA, 21 nt, Pseudomonas aeruginosa PA01
gcgcaccucgaccgcgccggc

SEQ ID NO: 3462149 - RNA, 22 nt, Pseudomonas aeruginosa PA01
gcgcaccucgaccgcgccggcg

SEQ ID NO: 3462150 - RNA, 13 nt, Pseudomonas aeruginosa PA01
gcgcaccucgccc

SEQ ID NO: 3462151 - RNA, 15 nt, Pseudomonas aeruginosa PA01
gcgcaccucggccag

SEQ ID NO: 3462152 - RNA, 18 nt, Pseudomonas aeruginosa PA01
gcgcaccucggccaggcg

SEQ ID NO: 3462153 - RNA, 15 nt, Pseudomonas aeruginosa PA01
gcgcaccuggcgguc

SEQ ID NO: 3462154 - RNA, 18 nt, Pseudomonas aeruginosa PA01
gcgcaccuggcggucgcc

SEQ ID NO: 3462155 - RNA, 19 nt, Pseudomonas aeruginosa PA01
gcgcaccuggcggucgccg

SEQ ID NO: 3462156 - RNA, 22 nt, Pseudomonas aeruginosa PA01
gcgcaccuggcggucgccgccg

SEQ ID NO: 3462157 - RNA, 21 nt, Pseudomonas aeruginosa PA01
gcgcaccugggcguuggccag

SEQ ID NO: 3462158 - RNA, 18 nt, Pseudomonas aeruginosa PA01
gcgcaccuguuucagcgg

SEQ ID NO: 3462159 - RNA, 19 nt, Pseudomonas aeruginosa PA01
gcgcaccuguuucagcggg

SEQ ID NO: 3462160 - RNA, 13 nt, Pseudomonas aeruginosa PA01
gcgcaccuuggcu

SEQ ID NO: 3462161 - RNA, 22 nt, Pseudomonas aeruginosa PA01
gcgcacgaggauuuccgcgccc

SEQ ID NO: 3462162 - RNA, 22 nt, Pseudomonas aeruginosa PA01
gcgcacgcaauagugcagcucc

SEQ ID NO: 3462163 - RNA, 18 nt, Pseudomonas aeruginosa PA01
gcgcacgcaauggcgcag

SEQ ID NO: 3462164 - RNA, 19 nt, Pseudomonas aeruginosa PA01
gcgcacgcaauggcgcagc

SEQ ID NO: 3462165 - RNA, 22 nt, Pseudomonas aeruginosa PA01
gcgcacgcaauggcgcagccgc

SEQ ID NO: 3462166 - RNA, 23 nt, Pseudomonas aeruginosa PA01
gcgcacgcaauggcgcagccgcu

SEQ ID NO: 3462167 - RNA, 20 nt, Pseudomonas aeruginosa PA01
gcgcacgccguggaccagga

SEQ ID NO: 3462168 - RNA, 23 nt, Pseudomonas aeruginosa PA01
gcgcacgccguggaccaggauca

SEQ ID NO: 3462169 - RNA, 22 nt, Pseudomonas aeruginosa PA01
gcgcacgcucuguuucgggucg

SEQ ID NO: 3462170 - RNA, 14 nt, Pseudomonas aeruginosa PA01
gcgcacgcuguaga

SEQ ID NO: 3462171 - RNA, 19 nt, Pseudomonas aeruginosa PA01
gcgcacgcuucuccucggc

SEQ ID NO: 3462172 - RNA, 14 nt, Pseudomonas aeruginosa PA01
gcgcacggaggcgc

SEQ ID NO: 3462173 - RNA, 16 nt, Pseudomonas aeruginosa PA01
gcgcacggaggcgcuc

SEQ ID NO: 3462174 - RNA, 19 nt, Pseudomonas aeruginosa PA01
gcgcacggaggcgcucagg

SEQ ID NO: 3462175 - RNA, 14 nt, Pseudomonas aeruginosa PA01
gcgcacggaucgcg

SEQ ID NO: 3462176 - RNA, 21 nt, Pseudomonas aeruginosa PA01
gcgcacggaucgcgcugggcg

SEQ ID NO: 3462177 - RNA, 13 nt, Pseudomonas aeruginosa PA01
gcgcacggccugc

SEQ ID NO: 3462178 - RNA, 21 nt, Pseudomonas aeruginosa PA01
gcgcacgguucacaaagccuu

SEQ ID NO: 3462179 - RNA, 14 nt, Pseudomonas aeruginosa PA01
gcgcacgucgaggu

SEQ ID NO: 3462180 - RNA, 22 nt, Pseudomonas aeruginosa PA01
gcgcacuccgggcagaccagca

SEQ ID NO: 3462181 - RNA, 21 nt, Pseudomonas aeruginosa PA01
gcgcacugagggucagccgca

SEQ ID NO: 3462182 - RNA, 16 nt, Pseudomonas aeruginosa PA01
gcgcacugccaggagc

SEQ ID NO: 3462183 - RNA, 20 nt, Pseudomonas aeruginosa PA01
gcgcacugccaggagcacgc

SEQ ID NO: 3462184 - RNA, 23 nt, Pseudomonas aeruginosa PA01
gcgcacugcguggguagccaugg

SEQ ID NO: 3462185 - RNA, 18 nt, Pseudomonas aeruginosa PA01
gcgcacuuccggacugcc

SEQ ID NO: 3462186 - RNA, 17 nt, Pseudomonas aeruginosa PA01
gcgcagaacugccgggc

SEQ ID NO: 3462187 - RNA, 19 nt, Pseudomonas aeruginosa PA01
gcgcagaacugccgggcca

SEQ ID NO: 3462188 - RNA, 20 nt, Pseudomonas aeruginosa PA01
gcgcagaacugccgggccag

SEQ ID NO: 3462189 - RNA, 22 nt, Pseudomonas aeruginosa PA01
gcgcagaacugccgggccagcu

SEQ ID NO: 3462190 - RNA, 22 nt, Pseudomonas aeruginosa PA01
gcgcagacaggccuccagcaac

SEQ ID NO: 3462191 - RNA, 21 nt, Pseudomonas aeruginosa PA01
gcgcagacgauugaccucccg

SEQ ID NO: 3462192 - RNA, 22 nt, Pseudomonas aeruginosa PA01
gcgcagacgauugaccucccgc

SEQ ID NO: 3462193 - RNA, 15 nt, Pseudomonas aeruginosa PA01
gcgcagacgggugcu

SEQ ID NO: 3462194 - RNA, 17 nt, Pseudomonas aeruginosa PA01
gcgcagacgggugcuga

SEQ ID NO: 3462195 - RNA, 19 nt, Pseudomonas aeruginosa PA01
gcgcagacgggugcugaag

SEQ ID NO: 3462196 - RNA, 15 nt, Pseudomonas aeruginosa PA01
gcgcagagcggugaa

SEQ ID NO: 3462197 - RNA, 15 nt, Pseudomonas aeruginosa PA01
gcgcagaggcgcucc

SEQ ID NO: 3462198 - RNA, 16 nt, Pseudomonas aeruginosa PA01
gcgcagaggcgcucca

SEQ ID NO: 3462199 - RNA, 21 nt, Pseudomonas aeruginosa PA01
gcgcagaggcgcuccaccagg

SEQ ID NO: 3462200 - RNA, 22 nt, Pseudomonas aeruginosa PA01
gcgcagaggcgcuccaccaggg

SEQ ID NO: 3462201 - RNA, 14 nt, Pseudomonas aeruginosa PA01
gcgcagaucgccgc

SEQ ID NO: 3462202 - RNA, 16 nt, Pseudomonas aeruginosa PA01
gcgcagaucgcggcgc

SEQ ID NO: 3462203 - RNA, 20 nt, Pseudomonas aeruginosa PA01
gcgcagaucgcggcgcaggc

SEQ ID NO: 3462204 - RNA, 21 nt, Pseudomonas aeruginosa PA01
gcgcagaucgcggcgcaggcu

SEQ ID NO: 3462205 - RNA, 19 nt, Pseudomonas aeruginosa PA01
gcgcagaucgcguccaggg

SEQ ID NO: 3462206 - RNA, 19 nt, Pseudomonas aeruginosa PA01
gcgcagaugaucgccaccg

SEQ ID NO: 3462207 - RNA, 16 nt, Pseudomonas aeruginosa PA01
gcgcaggccgggcgga

SEQ ID NO: 3462208 - RNA, 23 nt, Pseudomonas aeruginosa PA01
gcgcaggccgggcggacgcuggg

SEQ ID NO: 3462209 - RNA, 14 nt, Pseudomonas aeruginosa PA01
gcgcaggccgguga

SEQ ID NO: 3462210 - RNA, 16 nt, Pseudomonas aeruginosa PA01
gcgcaggccggugauc

SEQ ID NO: 3462211 - RNA, 22 nt, Pseudomonas aeruginosa PA01
gcgcaggccuucgacuucgacg

SEQ ID NO: 3462212 - RNA, 16 nt, Pseudomonas aeruginosa PA01
gcgcaggcgaggaugg

SEQ ID NO: 3462213 - RNA, 20 nt, Pseudomonas aeruginosa PA01
gcgcaggcgaugaucagccc

SEQ ID NO: 3462214 - RNA, 15 nt, Pseudomonas aeruginosa PA01
gcgcaggcgcucgcg

SEQ ID NO: 3462215 - RNA, 16 nt, Pseudomonas aeruginosa PA01
gcgcaggcgcucgcgg

SEQ ID NO: 3462216 - RNA, 20 nt, Pseudomonas aeruginosa PA01
gcgcaggcgcucgcgggccg

SEQ ID NO: 3462217 - RNA, 22 nt, Pseudomonas aeruginosa PA01
gcgcaggcgcucgcgggccgcc

SEQ ID NO: 3462218 - RNA, 13 nt, Pseudomonas aeruginosa PA01
gcgcaggcgcugg

SEQ ID NO: 3462219 - RNA, 15 nt, Pseudomonas aeruginosa PA01
gcgcaggcgcuggcg

SEQ ID NO: 3462220 - RNA, 16 nt, Pseudomonas aeruginosa PA01
gcgcaggcgcuggcgg

SEQ ID NO: 3462221 - RNA, 17 nt, Pseudomonas aeruginosa PA01
gcgcaggcgcuggcggg

SEQ ID NO: 3462222 - RNA, 19 nt, Pseudomonas aeruginosa PA01
gcgcaggcgcuggcgggcg

SEQ ID NO: 3462223 - RNA, 20 nt, Pseudomonas aeruginosa PA01
gcgcaggcgcuggcgggcgc

SEQ ID NO: 3462224 - RNA, 14 nt, Pseudomonas aeruginosa PA01
gcgcaggcggaucg

SEQ ID NO: 3462225 - RNA, 17 nt, Pseudomonas aeruginosa PA01
gcgcaggcggaucgccc

SEQ ID NO: 3462226 - RNA, 20 nt, Pseudomonas aeruginosa PA01
gcgcaggcggaucgcccggc

SEQ ID NO: 3462227 - RNA, 14 nt, Pseudomonas aeruginosa PA01
gcgcaggcggcgcu

SEQ ID NO: 3462228 - RNA, 15 nt, Pseudomonas aeruginosa PA01
gcgcaggcggcgcug

SEQ ID NO: 3462229 - RNA, 12 nt, Pseudomonas aeruginosa PA01
gcgcaggcggcu

SEQ ID NO: 3462230 - RNA, 13 nt, Pseudomonas aeruginosa PA01
gcgcaggcggcug

SEQ ID NO: 3462231 - RNA, 15 nt, Pseudomonas aeruginosa PA01
gcgcaggcggcuggc

SEQ ID NO: 3462232 - RNA, 18 nt, Pseudomonas aeruginosa PA01
gcgcaggcggcuggcgcg

SEQ ID NO: 3462233 - RNA, 14 nt, Pseudomonas aeruginosa PA01
gcgcaggcgggcgg

SEQ ID NO: 3462234 - RNA, 17 nt, Pseudomonas aeruginosa PA01
gcgcaggcgggcggcgu

SEQ ID NO: 3462235 - RNA, 20 nt, Pseudomonas aeruginosa PA01
gcgcaggcgguaggugagcg

SEQ ID NO: 3462236 - RNA, 23 nt, Pseudomonas aeruginosa PA01
gcgcaggcgguaggugagcgacc

SEQ ID NO: 3462237 - RNA, 13 nt, Pseudomonas aeruginosa PA01
gcgcaggcggucg

SEQ ID NO: 3462238 - RNA, 17 nt, Pseudomonas aeruginosa PA01
gcgcaggcggucgccga

SEQ ID NO: 3462239 - RNA, 22 nt, Pseudomonas aeruginosa PA01
gcgcaggcggucgccgaacagc

SEQ ID NO: 3462240 - RNA, 17 nt, Pseudomonas aeruginosa PA01
gcgcaggcgguggagca

SEQ ID NO: 3462241 - RNA, 20 nt, Pseudomonas aeruginosa PA01
gcgcaggcguuccucgacga

SEQ ID NO: 3462242 - RNA, 22 nt, Pseudomonas aeruginosa PA01
gcgcaggcguuccucgacgaaa

SEQ ID NO: 3462243 - RNA, 23 nt, Pseudomonas aeruginosa PA01
gcgcaggcguuccucgacgaaau

SEQ ID NO: 3462244 - RNA, 13 nt, Pseudomonas aeruginosa PA01
gcgcaggcugccu

SEQ ID NO: 3462245 - RNA, 13 nt, Pseudomonas aeruginosa PA01
gcgcaggcuggcc

SEQ ID NO: 3462246 - RNA, 14 nt, Pseudomonas aeruginosa PA01
gcgcaggcuggccg

SEQ ID NO: 3462247 - RNA, 17 nt, Pseudomonas aeruginosa PA01
gcgcaggcuggccgagc

SEQ ID NO: 3462248 - RNA, 20 nt, Pseudomonas aeruginosa PA01
gcgcaggcuggccgagcgcc

SEQ ID NO: 3462249 - RNA, 20 nt, Pseudomonas aeruginosa PA01
gcgcaggcugguaugcagca

SEQ ID NO: 3462250 - RNA, 20 nt, Pseudomonas aeruginosa PA01
gcgcaggcugucggccagcc

SEQ ID NO: 3462251 - RNA, 14 nt, Pseudomonas aeruginosa PA01
gcgcagggcagcgc

SEQ ID NO: 3462252 - RNA, 15 nt, Pseudomonas aeruginosa PA01
gcgcagggcagcgcg

SEQ ID NO: 3462253 - RNA, 17 nt, Pseudomonas aeruginosa PA01
gcgcagggcagcgcgau

SEQ ID NO: 3462254 - RNA, 18 nt, Pseudomonas aeruginosa PA01
gcgcagggcaucgacgau

SEQ ID NO: 3462255 - RNA, 20 nt, Pseudomonas aeruginosa PA01
gcgcagggccagcaacaggc

SEQ ID NO: 3462256 - RNA, 13 nt, Pseudomonas aeruginosa PA01
gcgcagggccagg

SEQ ID NO: 3462257 - RNA, 15 nt, Pseudomonas aeruginosa PA01
gcgcagggccagggc

SEQ ID NO: 3462258 - RNA, 17 nt, Pseudomonas aeruginosa PA01
gcgcagggcgccgucgg

SEQ ID NO: 3462259 - RNA, 12 nt, Pseudomonas aeruginosa PA01
gcgcagggcggc

SEQ ID NO: 3462260 - RNA, 14 nt, Pseudomonas aeruginosa PA01
gcgcagggcggcga

SEQ ID NO: 3462261 - RNA, 16 nt, Pseudomonas aeruginosa PA01
gcgcagggcggcgagc

SEQ ID NO: 3462262 - RNA, 18 nt, Pseudomonas aeruginosa PA01
gcgcagggcgucgaaggc

SEQ ID NO: 3462263 - RNA, 22 nt, Pseudomonas aeruginosa PA01
gcgcagggcgucgaaggcggcg

SEQ ID NO: 3462264 - RNA, 17 nt, Pseudomonas aeruginosa PA01
gcgcaggggcgcgccgg

SEQ ID NO: 3462265 - RNA, 18 nt, Pseudomonas aeruginosa PA01
gcgcaggggcgcgccggc

SEQ ID NO: 3462266 - RNA, 15 nt, Pseudomonas aeruginosa PA01
gcgcaggggcgcggc

SEQ ID NO: 3462267 - RNA, 16 nt, Pseudomonas aeruginosa PA01
gcgcaggggcgcggcg

SEQ ID NO: 3462268 - RNA, 13 nt, Pseudomonas aeruginosa PA01
gcgcagggucagg

SEQ ID NO: 3462269 - RNA, 16 nt, Pseudomonas aeruginosa PA01
gcgcagggucaggccc

SEQ ID NO: 3462270 - RNA, 18 nt, Pseudomonas aeruginosa PA01
gcgcagggucgcguuggc

SEQ ID NO: 3462271 - RNA, 17 nt, Pseudomonas aeruginosa PA01
gcgcagggugagcaugg

SEQ ID NO: 3462272 - RNA, 16 nt, Pseudomonas aeruginosa PA01
gcgcagggugcccucg

SEQ ID NO: 3462273 - RNA, 18 nt, Pseudomonas aeruginosa PA01
gcgcagguacucgccggc

SEQ ID NO: 3462274 - RNA, 20 nt, Pseudomonas aeruginosa PA01
gcgcagguacucgccggcga

SEQ ID NO: 3462275 - RNA, 20 nt, Pseudomonas aeruginosa PA01
gcgcagguagaaggugccca

SEQ ID NO: 3462276 - RNA, 15 nt, Pseudomonas aeruginosa PA01
gcgcagguagcggcg

SEQ ID NO: 3462277 - RNA, 17 nt, Pseudomonas aeruginosa PA01
gcgcagguagucgcuca

SEQ ID NO: 3462278 - RNA, 23 nt, Pseudomonas aeruginosa PA01
gcgcagguagucgcucauggcgc

SEQ ID NO: 3462279 - RNA, 17 nt, Pseudomonas aeruginosa PA01
gcgcaggucgcuggcgu

SEQ ID NO: 3462280 - RNA, 20 nt, Pseudomonas aeruginosa PA01
gcgcaggucgcuggcgucga

SEQ ID NO: 3462281 - RNA, 23 nt, Pseudomonas aeruginosa PA01
gcgcaggucgcuggcgucgaccg

SEQ ID NO: 3462282 - RNA, 18 nt, Pseudomonas aeruginosa PA01
gcgcaggucgcugucgcg

SEQ ID NO: 3462283 - RNA, 19 nt, Pseudomonas aeruginosa PA01
gcgcaggucgcugucgcgu

SEQ ID NO: 3462284 - RNA, 14 nt, Pseudomonas aeruginosa PA01
gcgcaggucggccu

SEQ ID NO: 3462285 - RNA, 14 nt, Pseudomonas aeruginosa PA01
gcgcaggugcaccg

SEQ ID NO: 3462286 - RNA, 18 nt, Pseudomonas aeruginosa PA01
gcgcaggugcaccgcgcu

SEQ ID NO: 3462287 - RNA, 21 nt, Pseudomonas aeruginosa PA01
gcgcaggugcaccgcgcugga

SEQ ID NO: 3462288 - RNA, 22 nt, Pseudomonas aeruginosa PA01
gcgcaggugcaccgcgcuggag

SEQ ID NO: 3462289 - RNA, 13 nt, Pseudomonas aeruginosa PA01
gcgcagguucauc

SEQ ID NO: 3462290 - RNA, 20 nt, Pseudomonas aeruginosa PA01
gcgcagguucaucgccgcca

SEQ ID NO: 3462291 - RNA, 23 nt, Pseudomonas aeruginosa PA01
gcgcagguucaucgccgccaggc

SEQ ID NO: 3462292 - RNA, 22 nt, Pseudomonas aeruginosa PA01
gcgcagguugagggccgcgcug

SEQ ID NO: 3462293 - RNA, 20 nt, Pseudomonas aeruginosa PA01
gcgcagguugcgcuggcgca

SEQ ID NO: 3462294 - RNA, 22 nt, Pseudomonas aeruginosa PA01
gcgcagguugcgcuggcgcagc

SEQ ID NO: 3462295 - RNA, 15 nt, Pseudomonas aeruginosa PA01
gcgcaguacccggcc

SEQ ID NO: 3462296 - RNA, 16 nt, Pseudomonas aeruginosa PA01
gcgcaguacccggccg

SEQ ID NO: 3462297 - RNA, 20 nt, Pseudomonas aeruginosa PA01
gcgcaguacccggccgccuu

SEQ ID NO: 3462298 - RNA, 18 nt, Pseudomonas aeruginosa PA01
gcgcaguacgaucagcca

SEQ ID NO: 3462299 - RNA, 19 nt, Pseudomonas aeruginosa PA01
gcgcaguacgaucagccag

SEQ ID NO: 3462300 - RNA, 22 nt, Pseudomonas aeruginosa PA01
gcgcaguacgaucagccagggc

SEQ ID NO: 3462301 - RNA, 13 nt, Pseudomonas aeruginosa PA01
gcgcaguagcugg

SEQ ID NO: 3462302 - RNA, 21 nt, Pseudomonas aeruginosa PA01
gcgcaguagucgaccggaauc

SEQ ID NO: 3462303 - RNA, 20 nt, Pseudomonas aeruginosa PA01
gcgcaguccgguagcgcgcc

SEQ ID NO: 3462304 - RNA, 21 nt, Pseudomonas aeruginosa PA01
gcgcaguccgguagcgcgccu

SEQ ID NO: 3462305 - RNA, 20 nt, Pseudomonas aeruginosa PA01
gcgcagucgucaagcgcgga

SEQ ID NO: 3462306 - RNA, 14 nt, Pseudomonas aeruginosa PA01
gcgcagugccugcu

SEQ ID NO: 3462307 - RNA, 15 nt, Pseudomonas aeruginosa PA01
gcgcagugucgcgaa

SEQ ID NO: 3462308 - RNA, 15 nt, Pseudomonas aeruginosa PA01
gcgcaguucagggcg

SEQ ID NO: 3462309 - RNA, 19 nt, Pseudomonas aeruginosa PA01
gcgccacgcgcaucgugca

SEQ ID NO: 3462310 - RNA, 20 nt, Pseudomonas aeruginosa PA01
gcgccacgcgcaucgugcag

SEQ ID NO: 3462311 - RNA, 21 nt, Pseudomonas aeruginosa PA01
gcgccacgcgcaucgugcagc

SEQ ID NO: 3462312 - RNA, 17 nt, Pseudomonas aeruginosa PA01
gcgccacggaaggccac

SEQ ID NO: 3462313 - RNA, 21 nt, Pseudomonas aeruginosa PA01
gcgccacggaugcagucccgc

SEQ ID NO: 3462314 - RNA, 23 nt, Pseudomonas aeruginosa PA01
gcgccacggaugcagucccgcca

SEQ ID NO: 3462315 - RNA, 14 nt, Pseudomonas aeruginosa PA01
gcgccacggccagc

SEQ ID NO: 3462316 - RNA, 18 nt, Pseudomonas aeruginosa PA01
gcgccacggccagcagga

SEQ ID NO: 3462317 - RNA, 21 nt, Pseudomonas aeruginosa PA01
gcgccacggcgaucgccgggu

SEQ ID NO: 3462318 - RNA, 13 nt, Pseudomonas aeruginosa PA01
gcgccacgggcag

SEQ ID NO: 3462319 - RNA, 17 nt, Pseudomonas aeruginosa PA01
gcgccacgggcagaccu

SEQ ID NO: 3462320 - RNA, 14 nt, Pseudomonas aeruginosa PA01
gcgccacucggcgu

SEQ ID NO: 3462321 - RNA, 22 nt, Pseudomonas aeruginosa PA01
gcgccacucggcgugccgggcc

SEQ ID NO: 3462322 - RNA, 13 nt, Pseudomonas aeruginosa PA01
gcgccacuuccag

SEQ ID NO: 3462323 - RNA, 19 nt, Pseudomonas aeruginosa PA01
gcgccagaagcggccgacc

SEQ ID NO: 3462324 - RNA, 17 nt, Pseudomonas aeruginosa PA01
gcgccagagaucgccca

SEQ ID NO: 3462325 - RNA, 15 nt, Pseudomonas aeruginosa PA01
gcgccagcaacgccu

SEQ ID NO: 3462326 - RNA, 14 nt, Pseudomonas aeruginosa PA01
gcgccagcaccagc

SEQ ID NO: 3462327 - RNA, 15 nt, Pseudomonas aeruginosa PA01
gcgccagcaccagca

SEQ ID NO: 3462328 - RNA, 18 nt, Pseudomonas aeruginosa PA01
gcgccagcaccagcagga

SEQ ID NO: 3462329 - RNA, 16 nt, Pseudomonas aeruginosa PA01
gcgccagcacggcgca

SEQ ID NO: 3462330 - RNA, 17 nt, Pseudomonas aeruginosa PA01
gcgccagcacggcgcag

SEQ ID NO: 3462331 - RNA, 23 nt, Pseudomonas aeruginosa PA01
gcgccagcacggcgcagggcauc

SEQ ID NO: 3462332 - RNA, 11 nt, Pseudomonas aeruginosa PA01
gcgccagcagg

SEQ ID NO: 3462333 - RNA, 12 nt, Pseudomonas aeruginosa PA01
gcgccagcaggc

SEQ ID NO: 3462334 - RNA, 17 nt, Pseudomonas aeruginosa PA01
gcgccagcaggcgcagc

SEQ ID NO: 3462335 - RNA, 18 nt, Pseudomonas aeruginosa PA01
gcgccagcaggcgcagca

SEQ ID NO: 3462336 - RNA, 19 nt, Pseudomonas aeruginosa PA01
gcgccagcaggcgcagcag

SEQ ID NO: 3462337 - RNA, 21 nt, Pseudomonas aeruginosa PA01
gcgccagcaggcgcagcagcg

SEQ ID NO: 3462338 - RNA, 19 nt, Pseudomonas aeruginosa PA01
gcgccagcagguacagcag

SEQ ID NO: 3462339 - RNA, 15 nt, Pseudomonas aeruginosa PA01
gcgccagcaggucgc

SEQ ID NO: 3462340 - RNA, 20 nt, Pseudomonas aeruginosa PA01
gcgccagcaggucgcgcugg

SEQ ID NO: 3462341 - RNA, 21 nt, Pseudomonas aeruginosa PA01
gcgccagcagguggucgaugg

SEQ ID NO: 3462342 - RNA, 11 nt, Pseudomonas aeruginosa PA01
gcgccagcauc

SEQ ID NO: 3462343 - RNA, 19 nt, Pseudomonas aeruginosa PA01
gcgccagcaucgcaucggc

SEQ ID NO: 3462344 - RNA, 20 nt, Pseudomonas aeruginosa PA01
gcgccagcaucgcaucggcg

SEQ ID NO: 3462345 - RNA, 13 nt, Pseudomonas aeruginosa PA01
gcgccagccagcc

SEQ ID NO: 3462346 - RNA, 17 nt, Pseudomonas aeruginosa PA01
gcgccagccagcccggc

SEQ ID NO: 3462347 - RNA, 15 nt, Pseudomonas aeruginosa PA01
gcgccagccagcgcg

SEQ ID NO: 3462348 - RNA, 17 nt, Pseudomonas aeruginosa PA01
gcgccagccagcgcggc

SEQ ID NO: 3462349 - RNA, 12 nt, Pseudomonas aeruginosa PA01
gcgccagcccca

SEQ ID NO: 3462350 - RNA, 15 nt, Pseudomonas aeruginosa PA01
gcgccagccccaggc

SEQ ID NO: 3462351 - RNA, 17 nt, Pseudomonas aeruginosa PA01
gcgccagccccaggcgc

SEQ ID NO: 3462352 - RNA, 18 nt, Pseudomonas aeruginosa PA01
gcgccagccccaggcgcg

SEQ ID NO: 3462353 - RNA, 21 nt, Pseudomonas aeruginosa PA01
gcgccagccccaggcgcggcg

SEQ ID NO: 3462354 - RNA, 12 nt, Pseudomonas aeruginosa PA01
gcgccagccgac

SEQ ID NO: 3462355 - RNA, 16 nt, Pseudomonas aeruginosa PA01
gcgccagccgacuggc

SEQ ID NO: 3462356 - RNA, 13 nt, Pseudomonas aeruginosa PA01
gcgccagccgcca

SEQ ID NO: 3462357 - RNA, 15 nt, Pseudomonas aeruginosa PA01
gcgccagccgccauc

SEQ ID NO: 3462358 - RNA, 18 nt, Pseudomonas aeruginosa PA01
gcgccagccgccaucacc

SEQ ID NO: 3462359 - RNA, 22 nt, Pseudomonas aeruginosa PA01
gcgccagccuacugggcguggc

SEQ ID NO: 3462360 - RNA, 13 nt, Pseudomonas aeruginosa PA01
gcgccagcgagac

SEQ ID NO: 3462361 - RNA, 19 nt, Pseudomonas aeruginosa PA01
gcgccagcgagacgggcga

SEQ ID NO: 3462362 - RNA, 21 nt, Pseudomonas aeruginosa PA01
gcgccagcgagacgggcgagg

SEQ ID NO: 3462363 - RNA, 16 nt, Pseudomonas aeruginosa PA01
gcgccagcgccacggc

SEQ ID NO: 3462364 - RNA, 21 nt, Pseudomonas aeruginosa PA01
gcgccagcgccacggcgaucg

SEQ ID NO: 3462365 - RNA, 12 nt, Pseudomonas aeruginosa PA01
gcgccagcgccc

SEQ ID NO: 3462366 - RNA, 21 nt, Pseudomonas aeruginosa PA01
gcgccagcgccccaccaggcu

SEQ ID NO: 3462367 - RNA, 13 nt, Pseudomonas aeruginosa PA01
gcgccagcgccgc

SEQ ID NO: 3462368 - RNA, 14 nt, Pseudomonas aeruginosa PA01
gcgccagcggcagc

SEQ ID NO: 3462369 - RNA, 15 nt, Pseudomonas aeruginosa PA01
gcgccagcggcagcg

SEQ ID NO: 3462370 - RNA, 16 nt, Pseudomonas aeruginosa PA01
gcgccagcggcagcgg

SEQ ID NO: 3462371 - RNA, 19 nt, Pseudomonas aeruginosa PA01
gcgccagcggcagcgguuc

SEQ ID NO: 3462372 - RNA, 16 nt, Pseudomonas aeruginosa PA01
gcgccagcggcccggc

SEQ ID NO: 3462373 - RNA, 17 nt, Pseudomonas aeruginosa PA01
gcgccagcggcccggca

SEQ ID NO: 3462374 - RNA, 16 nt, Pseudomonas aeruginosa PA01
gcgccagcuccagcgc

SEQ ID NO: 3462375 - RNA, 18 nt, Pseudomonas aeruginosa PA01
gcgccagcuccagcgccc

SEQ ID NO: 3462376 - RNA, 20 nt, Pseudomonas aeruginosa PA01
gcgccagcucgaacagcacc

SEQ ID NO: 3462377 - RNA, 21 nt, Pseudomonas aeruginosa PA01
gcgccagcucgaacagcaccg

SEQ ID NO: 3462378 - RNA, 20 nt, Pseudomonas aeruginosa PA01
gcgccagcucggacaagggc

SEQ ID NO: 3462379 - RNA, 19 nt, Pseudomonas aeruginosa PA01
gcgccaggaacgccucugc

SEQ ID NO: 3462380 - RNA, 20 nt, Pseudomonas aeruginosa PA01
gcgccaggaacgccucugcg

SEQ ID NO: 3462381 - RNA, 23 nt, Pseudomonas aeruginosa PA01
gcgccaggaacgccucugcgcug

SEQ ID NO: 3462382 - RNA, 16 nt, Pseudomonas aeruginosa PA01
gcgccaggaagccgcg

SEQ ID NO: 3462383 - RNA, 19 nt, Pseudomonas aeruginosa PA01
gcgccaggaagccgcgccc

SEQ ID NO: 3462384 - RNA, 14 nt, Pseudomonas aeruginosa PA01
gcgccaggagcagg

SEQ ID NO: 3462385 - RNA, 20 nt, Pseudomonas aeruginosa PA01
gcgccaggagcagggcgccg

SEQ ID NO: 3462386 - RNA, 21 nt, Pseudomonas aeruginosa PA01
gcgccaggagcagggcgccga

SEQ ID NO: 3462387 - RNA, 10 nt, Pseudomonas aeruginosa PA01
gcgccaggcc

SEQ ID NO: 3462388 - RNA, 12 nt, Pseudomonas aeruginosa PA01
gcgccaggcccg

SEQ ID NO: 3462389 - RNA, 14 nt, Pseudomonas aeruginosa PA01
gcgccaggcccggc

SEQ ID NO: 3462390 - RNA, 18 nt, Pseudomonas aeruginosa PA01
gcgccaggcccggcgcug

SEQ ID NO: 3462391 - RNA, 21 nt, Pseudomonas aeruginosa PA01
gcgccaggccgaucagcgccu

SEQ ID NO: 3462392 - RNA, 12 nt, Pseudomonas aeruginosa PA01
gcgccaggccgc

SEQ ID NO: 3462393 - RNA, 14 nt, Pseudomonas aeruginosa PA01
gcgccaggccgccg

SEQ ID NO: 3462394 - RNA, 17 nt, Pseudomonas aeruginosa PA01
gcgccaggccgccgaag

SEQ ID NO: 3462395 - RNA, 14 nt, Pseudomonas aeruginosa PA01
gcgccaggccgcgu

SEQ ID NO: 3462396 - RNA, 18 nt, Pseudomonas aeruginosa PA01
gcgccaggccggagccgc

SEQ ID NO: 3462397 - RNA, 19 nt, Pseudomonas aeruginosa PA01
gcgccaggccggagccgcg

SEQ ID NO: 3462398 - RNA, 16 nt, Pseudomonas aeruginosa PA01
gcgccaggccggcgag

SEQ ID NO: 3462399 - RNA, 14 nt, Pseudomonas aeruginosa PA01
gcgccaggccucag

SEQ ID NO: 3462400 - RNA, 15 nt, Pseudomonas aeruginosa PA01
gcgccaggccucaga

SEQ ID NO: 3462401 - RNA, 14 nt, Pseudomonas aeruginosa PA01
gcgccaggccuugc

SEQ ID NO: 3462402 - RNA, 22 nt, Pseudomonas aeruginosa PA01
gcgccaggccuugcagcaacuc

SEQ ID NO: 3462403 - RNA, 23 nt, Pseudomonas aeruginosa PA01
gcgccaggcgaagaaagccccug

SEQ ID NO: 3462404 - RNA, 14 nt, Pseudomonas aeruginosa PA01
gcgccaggcgcggu

SEQ ID NO: 3462405 - RNA, 23 nt, Pseudomonas aeruginosa PA01
gcgccaggcgcgguugccgcugc

SEQ ID NO: 3462406 - RNA, 17 nt, Pseudomonas aeruginosa PA01
gcgccaggcugaccgcg

SEQ ID NO: 3462407 - RNA, 21 nt, Pseudomonas aeruginosa PA01
gcgccaggcuuuccgccgagc

SEQ ID NO: 3462408 - RNA, 17 nt, Pseudomonas aeruginosa PA01
gcgccagggacgcgcag

SEQ ID NO: 3462409 - RNA, 18 nt, Pseudomonas aeruginosa PA01
gcgccagggacgcgcagc

SEQ ID NO: 3462410 - RNA, 19 nt, Pseudomonas aeruginosa PA01
gcgccagggacgcgcagcg

SEQ ID NO: 3462411 - RNA, 21 nt, Pseudomonas aeruginosa PA01
gcgccagggacgcgcagcggc

SEQ ID NO: 3462412 - RNA, 16 nt, Pseudomonas aeruginosa PA01
gcgccccagcgccugg

SEQ ID NO: 3462413 - RNA, 20 nt, Pseudomonas aeruginosa PA01
gcgccccagcgccugggccg

SEQ ID NO: 3462414 - RNA, 22 nt, Pseudomonas aeruginosa PA01
gcgccccagcgccugggccgcg

SEQ ID NO: 3462415 - RNA, 14 nt, Pseudomonas aeruginosa PA01
gcgccccagcggca

SEQ ID NO: 3462416 - RNA, 17 nt, Pseudomonas aeruginosa PA01
gcgccccagcucagcag

SEQ ID NO: 3462417 - RNA, 19 nt, Pseudomonas aeruginosa PA01
gcgccccagcucagcaggu

SEQ ID NO: 3462418 - RNA, 22 nt, Pseudomonas aeruginosa PA01
gcgccccagcucagcaggucgc

SEQ ID NO: 3462419 - RNA, 14 nt, Pseudomonas aeruginosa PA01
gcgccccaggcgcc

SEQ ID NO: 3462420 - RNA, 20 nt, Pseudomonas aeruginosa PA01
gcgcccccacgacgcacuca

SEQ ID NO: 3462421 - RNA, 15 nt, Pseudomonas aeruginosa PA01
gcgcccccagcgccc

SEQ ID NO: 3462422 - RNA, 15 nt, Pseudomonas aeruginosa PA01
gcgcccccaucugca

SEQ ID NO: 3462423 - RNA, 16 nt, Pseudomonas aeruginosa PA01
gcgcccccaucugcac

SEQ ID NO: 3462424 - RNA, 13 nt, Pseudomonas aeruginosa PA01
gcgcccccuggcc

SEQ ID NO: 3462425 - RNA, 14 nt, Pseudomonas aeruginosa PA01
gcgccccgccagga

SEQ ID NO: 3462426 - RNA, 15 nt, Pseudomonas aeruginosa PA01
gcgccccggccgcgc

SEQ ID NO: 3462427 - RNA, 21 nt, Pseudomonas aeruginosa PA01
gcgccccggccgcgccagcca

SEQ ID NO: 3462428 - RNA, 22 nt, Pseudomonas aeruginosa PA01
gcgccccggccgcgccagccac

SEQ ID NO: 3462429 - RNA, 14 nt, Pseudomonas aeruginosa PA01
gcgccccgggacca

SEQ ID NO: 3462430 - RNA, 23 nt, Pseudomonas aeruginosa PA01
gcgccccggucucgcgcagcggc

SEQ ID NO: 3462431 - RNA, 17 nt, Pseudomonas aeruginosa PA01
gcgccccucccagccac

SEQ ID NO: 3462432 - RNA, 15 nt, Pseudomonas aeruginosa PA01
gcgccccugcggcgc

SEQ ID NO: 3462433 - RNA, 18 nt, Pseudomonas aeruginosa PA01
gcgccccugcggcgccgg

SEQ ID NO: 3462434 - RNA, 19 nt, Pseudomonas aeruginosa PA01
gcgccccuuggccagcacc

SEQ ID NO: 3462435 - RNA, 14 nt, Pseudomonas aeruginosa PA01
gcgcccgagggcgc

SEQ ID NO: 3462436 - RNA, 16 nt, Pseudomonas aeruginosa PA01
gcgcccgagggcgccg

SEQ ID NO: 3462437 - RNA, 18 nt, Pseudomonas aeruginosa PA01
gcgcccgauaggcgccgg

SEQ ID NO: 3462438 - RNA, 19 nt, Pseudomonas aeruginosa PA01
gcgcccgauaggcgccggc

SEQ ID NO: 3462439 - RNA, 21 nt, Pseudomonas aeruginosa PA01
gcgcccgauaggcgccggcgc

SEQ ID NO: 3462440 - RNA, 20 nt, Pseudomonas aeruginosa PA01
gcgcccgaugaucgagcgca

SEQ ID NO: 3462441 - RNA, 20 nt, Pseudomonas aeruginosa PA01
gcgcccgccaagggcgccgc

SEQ ID NO: 3462442 - RNA, 15 nt, Pseudomonas aeruginosa PA01
gcgcccgccaggucg

SEQ ID NO: 3462443 - RNA, 16 nt, Pseudomonas aeruginosa PA01
gcgcccgccaggucga

SEQ ID NO: 3462444 - RNA, 20 nt, Pseudomonas aeruginosa PA01
gcgcccgcccggaaccaccg

SEQ ID NO: 3462445 - RNA, 14 nt, Pseudomonas aeruginosa PA01
gcgcccgcccggca

SEQ ID NO: 3462446 - RNA, 17 nt, Pseudomonas aeruginosa PA01
gcgcccgccgcgagcgc

SEQ ID NO: 3462447 - RNA, 23 nt, Pseudomonas aeruginosa PA01
gcgcccgccgcgagcgccgccgg

SEQ ID NO: 3462448 - RNA, 13 nt, Pseudomonas aeruginosa PA01
gcgcccgccggcc

SEQ ID NO: 3462449 - RNA, 15 nt, Pseudomonas aeruginosa PA01
gcgcccgccggccgu

SEQ ID NO: 3462450 - RNA, 13 nt, Pseudomonas aeruginosa PA01
gcgcccgccguca

SEQ ID NO: 3462451 - RNA, 21 nt, Pseudomonas aeruginosa PA01
gcgcccgccuuguucgccagc

SEQ ID NO: 3462452 - RNA, 16 nt, Pseudomonas aeruginosa PA01
gcgcccgcgggcgccu

SEQ ID NO: 3462453 - RNA, 14 nt, Pseudomonas aeruginosa PA01
gcgcccgcucgacc

SEQ ID NO: 3462454 - RNA, 16 nt, Pseudomonas aeruginosa PA01
gcgcccgcucgacccg

SEQ ID NO: 3462455 - RNA, 19 nt, Pseudomonas aeruginosa PA01
gcgcccgcugugcggggaa

SEQ ID NO: 3462456 - RNA, 22 nt, Pseudomonas aeruginosa PA01
gcgcccggaaaaaaaagcccgc

SEQ ID NO: 3462457 - RNA, 20 nt, Pseudomonas aeruginosa PA01
gcgcccggcaaucaggcgcg

SEQ ID NO: 3462458 - RNA, 19 nt, Pseudomonas aeruginosa PA01
gcgcccggcacgcuccagg

SEQ ID NO: 3462459 - RNA, 13 nt, Pseudomonas aeruginosa PA01
gcgcccggccagg

SEQ ID NO: 3462460 - RNA, 14 nt, Pseudomonas aeruginosa PA01
gcgcccggccaggc

SEQ ID NO: 3462461 - RNA, 17 nt, Pseudomonas aeruginosa PA01
gcgcccggccaggccgc

SEQ ID NO: 3462462 - RNA, 12 nt, Pseudomonas aeruginosa PA01
gcgcccggccuc

SEQ ID NO: 3462463 - RNA, 17 nt, Pseudomonas aeruginosa PA01
gcgcccggccuccccgg

SEQ ID NO: 3462464 - RNA, 18 nt, Pseudomonas aeruginosa PA01
gcgcccggccuccccggc

SEQ ID NO: 3462465 - RNA, 18 nt, Pseudomonas aeruginosa PA01
gcgcccggccuucaccgc

SEQ ID NO: 3462466 - RNA, 21 nt, Pseudomonas aeruginosa PA01
gcgcccggccuucaccgcgcc

SEQ ID NO: 3462467 - RNA, 14 nt, Pseudomonas aeruginosa PA01
gcgcccggcgaaca

SEQ ID NO: 3462468 - RNA, 19 nt, Pseudomonas aeruginosa PA01
gcgcccggcgaacagcgcu

SEQ ID NO: 3462469 - RNA, 13 nt, Pseudomonas aeruginosa PA01
gcgcccggcgcau

SEQ ID NO: 3462470 - RNA, 19 nt, Pseudomonas aeruginosa PA01
gcgcccggcgcaugccgca

SEQ ID NO: 3462471 - RNA, 13 nt, Pseudomonas aeruginosa PA01
gcgcccggcgcca

SEQ ID NO: 3462472 - RNA, 14 nt, Pseudomonas aeruginosa PA01
gcgcccggcgccac

SEQ ID NO: 3462473 - RNA, 19 nt, Pseudomonas aeruginosa PA01
gcgcccggcgccaccccgc

SEQ ID NO: 3462474 - RNA, 21 nt, Pseudomonas aeruginosa PA01
gcgcccggcgccaccccgccg

SEQ ID NO: 3462475 - RNA, 22 nt, Pseudomonas aeruginosa PA01
gcgcccggcgccaccccgccgc

SEQ ID NO: 3462476 - RNA, 15 nt, Pseudomonas aeruginosa PA01
gcgcccggcgccagg

SEQ ID NO: 3462477 - RNA, 18 nt, Pseudomonas aeruginosa PA01
gcgcccggcgccaggcug

SEQ ID NO: 3462478 - RNA, 12 nt, Pseudomonas aeruginosa PA01
gcgcccggcgcg

SEQ ID NO: 3462479 - RNA, 15 nt, Pseudomonas aeruginosa PA01
gcgcccggcgcgacc

SEQ ID NO: 3462480 - RNA, 14 nt, Pseudomonas aeruginosa PA01
gcgcccggcuggcc

SEQ ID NO: 3462481 - RNA, 18 nt, Pseudomonas aeruginosa PA01
gcgcccggcuggccaucc

SEQ ID NO: 3462482 - RNA, 21 nt, Pseudomonas aeruginosa PA01
gcgcccggcuucggcggcgcg

SEQ ID NO: 3462483 - RNA, 20 nt, Pseudomonas aeruginosa PA01
gcgcccgguggaggucugcc

SEQ ID NO: 3462484 - RNA, 17 nt, Pseudomonas aeruginosa PA01
gcgcccguagcacaugg

SEQ ID NO: 3462485 - RNA, 22 nt, Pseudomonas aeruginosa PA01
gcgcccgucgucguggcgaacc

SEQ ID NO: 3462486 - RNA, 23 nt, Pseudomonas aeruginosa PA01
gcgcccgucgucguggcgaacca

SEQ ID NO: 3462487 - RNA, 18 nt, Pseudomonas aeruginosa PA01
gcgcccuacgccaccuga

SEQ ID NO: 3462488 - RNA, 20 nt, Pseudomonas aeruginosa PA01
gcgcccuacgccaccugagc

SEQ ID NO: 3462489 - RNA, 12 nt, Pseudomonas aeruginosa PA01
gcgcccucccgc

SEQ ID NO: 3462490 - RNA, 14 nt, Pseudomonas aeruginosa PA01
gcgcccucccgcga

SEQ ID NO: 3462491 - RNA, 16 nt, Pseudomonas aeruginosa PA01
gcgcccucgcugagca

SEQ ID NO: 3462492 - RNA, 17 nt, Pseudomonas aeruginosa PA01
gcgcccucgcugagcag

SEQ ID NO: 3462493 - RNA, 16 nt, Pseudomonas aeruginosa PA01
gcgcccucgggcgccg

SEQ ID NO: 3462494 - RNA, 23 nt, Pseudomonas aeruginosa PA01
gcgcccucggugauaccgccggc

SEQ ID NO: 3462495 - RNA, 17 nt, Pseudomonas aeruginosa PA01
gcgcccugacgaugcag

SEQ ID NO: 3462496 - RNA, 14 nt, Pseudomonas aeruginosa PA01
gcgcccugcaggcc

SEQ ID NO: 3462497 - RNA, 15 nt, Pseudomonas aeruginosa PA01
gcgcccugcaggccg

SEQ ID NO: 3462498 - RNA, 16 nt, Pseudomonas aeruginosa PA01
gcgcccugcaggccga

SEQ ID NO: 3462499 - RNA, 23 nt, Pseudomonas aeruginosa PA01
gcgcccugcucugguucggcguc

SEQ ID NO: 3462500 - RNA, 14 nt, Pseudomonas aeruginosa PA01
gcgcccuggccgcc

SEQ ID NO: 3462501 - RNA, 13 nt, Pseudomonas aeruginosa PA01
gcgcccuggccgu

SEQ ID NO: 3462502 - RNA, 14 nt, Pseudomonas aeruginosa PA01
gcgcccuggccguc

SEQ ID NO: 3462503 - RNA, 20 nt, Pseudomonas aeruginosa PA01
gcgcccuggcucuugccgcg

SEQ ID NO: 3462504 - RNA, 21 nt, Pseudomonas aeruginosa PA01
gcgcccuggcucuugccgcga

SEQ ID NO: 3462505 - RNA, 16 nt, Pseudomonas aeruginosa PA01
gcgcccuucagcgccu

SEQ ID NO: 3462506 - RNA, 17 nt, Pseudomonas aeruginosa PA01
gcgcccuucagcgccuc

SEQ ID NO: 3462507 - RNA, 14 nt, Pseudomonas aeruginosa PA01
gcgcccuucgagaa

SEQ ID NO: 3462508 - RNA, 20 nt, Pseudomonas aeruginosa PA01
gcgcccuucgguuucgcgcc

SEQ ID NO: 3462509 - RNA, 23 nt, Pseudomonas aeruginosa PA01
gcgcccuucgguuucgcgccaug

SEQ ID NO: 3462510 - RNA, 15 nt, Pseudomonas aeruginosa PA01
gcgcccuugacccgg

SEQ ID NO: 3462511 - RNA, 16 nt, Pseudomonas aeruginosa PA01
gcgcccuugacguuca

SEQ ID NO: 3462512 - RNA, 21 nt, Pseudomonas aeruginosa PA01
gcgcccuugacguucaggcug

SEQ ID NO: 3462513 - RNA, 16 nt, Pseudomonas aeruginosa PA01
gcgcccuugagcacgu

SEQ ID NO: 3462514 - RNA, 19 nt, Pseudomonas aeruginosa PA01
gcgcccuuguacucgaugg

SEQ ID NO: 3462515 - RNA, 15 nt, Pseudomonas aeruginosa PA01
gcgccgcccuggccg

SEQ ID NO: 3462516 - RNA, 21 nt, Pseudomonas aeruginosa PA01
gcgccgcccuggccgcccagu

SEQ ID NO: 3462517 - RNA, 15 nt, Pseudomonas aeruginosa PA01
gcgccgccgaggaua

SEQ ID NO: 3462518 - RNA, 14 nt, Pseudomonas aeruginosa PA01
gcgccgccgagggc

SEQ ID NO: 3462519 - RNA, 18 nt, Pseudomonas aeruginosa PA01
gcgccgccgagggcaccg

SEQ ID NO: 3462520 - RNA, 20 nt, Pseudomonas aeruginosa PA01
gcgccgccgagggcaccgac

SEQ ID NO: 3462521 - RNA, 22 nt, Pseudomonas aeruginosa PA01
gcgccgccgagggcaccgacga

SEQ ID NO: 3462522 - RNA, 21 nt, Pseudomonas aeruginosa PA01
gcgccgccgaggugcggcuug

SEQ ID NO: 3462523 - RNA, 21 nt, Pseudomonas aeruginosa PA01
gcgccgccgagguugcgcagg

SEQ ID NO: 3462524 - RNA, 12 nt, Pseudomonas aeruginosa PA01
gcgccgccgcgg

SEQ ID NO: 3462525 - RNA, 15 nt, Pseudomonas aeruginosa PA01
gcgccgccgcggcca

SEQ ID NO: 3462526 - RNA, 20 nt, Pseudomonas aeruginosa PA01
gcgccgccgcggccagcccc

SEQ ID NO: 3462527 - RNA, 16 nt, Pseudomonas aeruginosa PA01
gcgccgccgcuggcga

SEQ ID NO: 3462528 - RNA, 12 nt, Pseudomonas aeruginosa PA01
gcgccgccggcg

SEQ ID NO: 3462529 - RNA, 19 nt, Pseudomonas aeruginosa PA01
gcgccgccggcgaacggca

SEQ ID NO: 3462530 - RNA, 15 nt, Pseudomonas aeruginosa PA01
gcgccgccgggcgcc

SEQ ID NO: 3462531 - RNA, 16 nt, Pseudomonas aeruginosa PA01
gcgccgccgggcgccc

SEQ ID NO: 3462532 - RNA, 19 nt, Pseudomonas aeruginosa PA01
gcgccgccgggcgcccggc

SEQ ID NO: 3462533 - RNA, 12 nt, Pseudomonas aeruginosa PA01
gcgccgccggug

SEQ ID NO: 3462534 - RNA, 14 nt, Pseudomonas aeruginosa PA01
gcgccgccggugaa

SEQ ID NO: 3462535 - RNA, 19 nt, Pseudomonas aeruginosa PA01
gcgccgccggugaacaggu

SEQ ID NO: 3462536 - RNA, 13 nt, Pseudomonas aeruginosa PA01
gcgccgccggugc

SEQ ID NO: 3462537 - RNA, 16 nt, Pseudomonas aeruginosa PA01
gcgccgccucgaaggc

SEQ ID NO: 3462538 - RNA, 18 nt, Pseudomonas aeruginosa PA01
gcgccgccucgaaggccg

SEQ ID NO: 3462539 - RNA, 19 nt, Pseudomonas aeruginosa PA01
gcgccgccucgaaggccgg

SEQ ID NO: 3462540 - RNA, 20 nt, Pseudomonas aeruginosa PA01
gcgccgccucgaaggccggc

SEQ ID NO: 3462541 - RNA, 22 nt, Pseudomonas aeruginosa PA01
gcgccgccucgaaggccggcaa

SEQ ID NO: 3462542 - RNA, 14 nt, Pseudomonas aeruginosa PA01
gcgccgccucgaug

SEQ ID NO: 3462543 - RNA, 16 nt, Pseudomonas aeruginosa PA01
gcgccgccucgauggc

SEQ ID NO: 3462544 - RNA, 19 nt, Pseudomonas aeruginosa PA01
gcgccgccucgauggcggc

SEQ ID NO: 3462545 - RNA, 20 nt, Pseudomonas aeruginosa PA01
gcgccgccucgauggcggca

SEQ ID NO: 3462546 - RNA, 14 nt, Pseudomonas aeruginosa PA01
gcgccgccucgcgc

SEQ ID NO: 3462547 - RNA, 15 nt, Pseudomonas aeruginosa PA01
gcgccgccucgcgca

SEQ ID NO: 3462548 - RNA, 18 nt, Pseudomonas aeruginosa PA01
gcgccgccucgcugggcg

SEQ ID NO: 3462549 - RNA, 17 nt, Pseudomonas aeruginosa PA01
gcgccgccucgggcagc

SEQ ID NO: 3462550 - RNA, 14 nt, Pseudomonas aeruginosa PA01
gcgccgccugggcc

SEQ ID NO: 3462551 - RNA, 17 nt, Pseudomonas aeruginosa PA01
gcgccgccuugagcggc

SEQ ID NO: 3462552 - RNA, 21 nt, Pseudomonas aeruginosa PA01
gcgccgccuugagcggcgccc

SEQ ID NO: 3462553 - RNA, 20 nt, Pseudomonas aeruginosa PA01
gcgccgccuuucugcccggc

SEQ ID NO: 3462554 - RNA, 21 nt, Pseudomonas aeruginosa PA01
gcgccgccuuucugcccggcu

SEQ ID NO: 3462555 - RNA, 21 nt, Pseudomonas aeruginosa PA01
gcgccgcgaacacacccugcg

SEQ ID NO: 3462556 - RNA, 12 nt, Pseudomonas aeruginosa PA01
gcgccgcgcacc

SEQ ID NO: 3462557 - RNA, 16 nt, Pseudomonas aeruginosa PA01
gcgccgcgcagcgcgg

SEQ ID NO: 3462558 - RNA, 17 nt, Pseudomonas aeruginosa PA01
gcgccgcgcagcgcggc

SEQ ID NO: 3462559 - RNA, 20 nt, Pseudomonas aeruginosa PA01
gcgccgcgcauccucggcau

SEQ ID NO: 3462560 - RNA, 21 nt, Pseudomonas aeruginosa PA01
gcgccgcgcauccucggcauc

SEQ ID NO: 3462561 - RNA, 15 nt, Pseudomonas aeruginosa PA01
gcgccgcgccaacug

SEQ ID NO: 3462562 - RNA, 20 nt, Pseudomonas aeruginosa PA01
gcgccgcgccaacuggcgca

SEQ ID NO: 3462563 - RNA, 12 nt, Pseudomonas aeruginosa PA01
gcgccgcgccag

SEQ ID NO: 3462564 - RNA, 14 nt, Pseudomonas aeruginosa PA01
gcgccgcgccagca

SEQ ID NO: 3462565 - RNA, 16 nt, Pseudomonas aeruginosa PA01
gcgccgcgccagcagg

SEQ ID NO: 3462566 - RNA, 23 nt, Pseudomonas aeruginosa PA01
gcgccgcgccagcaggcgcagca

SEQ ID NO: 3462567 - RNA, 13 nt, Pseudomonas aeruginosa PA01
gcgccgcgccagg

SEQ ID NO: 3462568 - RNA, 14 nt, Pseudomonas aeruginosa PA01
gcgccgcgccaggu

SEQ ID NO: 3462569 - RNA, 14 nt, Pseudomonas aeruginosa PA01
gcgccgcgccugcu

SEQ ID NO: 3462570 - RNA, 12 nt, Pseudomonas aeruginosa PA01
gcgccgcgccuu

SEQ ID NO: 3462571 - RNA, 13 nt, Pseudomonas aeruginosa PA01
gcgccgcgccuuc

SEQ ID NO: 3462572 - RNA, 12 nt, Pseudomonas aeruginosa PA01
gcgccgcgcggc

SEQ ID NO: 3462573 - RNA, 16 nt, Pseudomonas aeruginosa PA01
gcgccgcgcggcgccc

SEQ ID NO: 3462574 - RNA, 21 nt, Pseudomonas aeruginosa PA01
gcgccgcgcguucgcgcgagg

SEQ ID NO: 3462575 - RNA, 21 nt, Pseudomonas aeruginosa PA01
gcgccgcgcuuggccuugccg

SEQ ID NO: 3462576 - RNA, 12 nt, Pseudomonas aeruginosa PA01
gcgccgcggccc

SEQ ID NO: 3462577 - RNA, 15 nt, Pseudomonas aeruginosa PA01
gcgccgcggcccggc

SEQ ID NO: 3462578 - RNA, 16 nt, Pseudomonas aeruginosa PA01
gcgccgcggcccggcg

SEQ ID NO: 3462579 - RNA, 19 nt, Pseudomonas aeruginosa PA01
gcgccgcggcgaccagcgc

SEQ ID NO: 3462580 - RNA, 20 nt, Pseudomonas aeruginosa PA01
gcgccgcggcggcggacagc

SEQ ID NO: 3462581 - RNA, 22 nt, Pseudomonas aeruginosa PA01
gcgccgcggcggcgugcaggcc

SEQ ID NO: 3462582 - RNA, 14 nt, Pseudomonas aeruginosa PA01
gcgccgcggcuggc

SEQ ID NO: 3462583 - RNA, 16 nt, Pseudomonas aeruginosa PA01
gcgccgcggcuggcca

SEQ ID NO: 3462584 - RNA, 17 nt, Pseudomonas aeruginosa PA01
gcgccgcggcuggccau

SEQ ID NO: 3462585 - RNA, 19 nt, Pseudomonas aeruginosa PA01
gcgccgcgggucaccagcg

SEQ ID NO: 3462586 - RNA, 21 nt, Pseudomonas aeruginosa PA01
gcgccgcgggucaccagcgcc

SEQ ID NO: 3462587 - RNA, 13 nt, Pseudomonas aeruginosa PA01
gcgccgcgggucu

SEQ ID NO: 3462588 - RNA, 20 nt, Pseudomonas aeruginosa PA01
gcgccgcgggucugcucggc

SEQ ID NO: 3462589 - RNA, 18 nt, Pseudomonas aeruginosa PA01
gcgccgcggucgaugucg

SEQ ID NO: 3462590 - RNA, 14 nt, Pseudomonas aeruginosa PA01
gcgccgcggugucg

SEQ ID NO: 3462591 - RNA, 22 nt, Pseudomonas aeruginosa PA01
gcgccgcguaguaggcacagga

SEQ ID NO: 3462592 - RNA, 16 nt, Pseudomonas aeruginosa PA01
gcgccgcuagggcgcc

SEQ ID NO: 3462593 - RNA, 17 nt, Pseudomonas aeruginosa PA01
gcgccgcuagggcgccc

SEQ ID NO: 3462594 - RNA, 19 nt, Pseudomonas aeruginosa PA01
gcgccgcuagggcgcccuc

SEQ ID NO: 3462595 - RNA, 21 nt, Pseudomonas aeruginosa PA01
gcgccgcuagggcgcccucgc

SEQ ID NO: 3462596 - RNA, 17 nt, Pseudomonas aeruginosa PA01
gcgccgcuaugggcacc

SEQ ID NO: 3462597 - RNA, 18 nt, Pseudomonas aeruginosa PA01
gcgccgcuaugggcaccg

SEQ ID NO: 3462598 - RNA, 21 nt, Pseudomonas aeruginosa PA01
gcgccgcuaugggcaccgcgc

SEQ ID NO: 3462599 - RNA, 22 nt, Pseudomonas aeruginosa PA01
gcgccgcuaugggcaccgcgcc

SEQ ID NO: 3462600 - RNA, 13 nt, Pseudomonas aeruginosa PA01
gcgccgcucaggc

SEQ ID NO: 3462601 - RNA, 20 nt, Pseudomonas aeruginosa PA01
gcgccgcucaggcgucccgc

SEQ ID NO: 3462602 - RNA, 15 nt, Pseudomonas aeruginosa PA01
gcgccgcuccuccuc

SEQ ID NO: 3462603 - RNA, 19 nt, Pseudomonas aeruginosa PA01
gcgccgcuccuccucgcuc

SEQ ID NO: 3462604 - RNA, 21 nt, Pseudomonas aeruginosa PA01
gcgccgcuccuggcaggcuca

SEQ ID NO: 3462605 - RNA, 16 nt, Pseudomonas aeruginosa PA01
gcgccgcucgaugccc

SEQ ID NO: 3462606 - RNA, 23 nt, Pseudomonas aeruginosa PA01
gcgccgcucgaugcccgccagca

SEQ ID NO: 3462607 - RNA, 15 nt, Pseudomonas aeruginosa PA01
gcgccgcucggcgag

SEQ ID NO: 3462608 - RNA, 18 nt, Pseudomonas aeruginosa PA01
gcgccgcugcccagaucc

SEQ ID NO: 3462609 - RNA, 13 nt, Pseudomonas aeruginosa PA01
gcgccgcugcggc

SEQ ID NO: 3462610 - RNA, 21 nt, Pseudomonas aeruginosa PA01
gcgccgcugcggcugcagggc

SEQ ID NO: 3462611 - RNA, 16 nt, Pseudomonas aeruginosa PA01
gcgccgcuggcguggu

SEQ ID NO: 3462612 - RNA, 18 nt, Pseudomonas aeruginosa PA01
gcgccgcuggcguggugg

SEQ ID NO: 3462613 - RNA, 19 nt, Pseudomonas aeruginosa PA01
gcgccgcuggcguggugga

SEQ ID NO: 3462614 - RNA, 21 nt, Pseudomonas aeruginosa PA01
gcgccggaaguggcagcgccg

SEQ ID NO: 3462615 - RNA, 24 nt, Pseudomonas aeruginosa PA01
gcgccggaaguggcagcgccguug

SEQ ID NO: 3462616 - RNA, 15 nt, Pseudomonas aeruginosa PA01
gcgccggacaggcca

SEQ ID NO: 3462617 - RNA, 16 nt, Pseudomonas aeruginosa PA01
gcgccggacaggccac

SEQ ID NO: 3462618 - RNA, 21 nt, Pseudomonas aeruginosa PA01
gcgccgucaccagcagccccg

SEQ ID NO: 3462619 - RNA, 15 nt, Pseudomonas aeruginosa PA01
gcgccgucaucgcug

SEQ ID NO: 3462620 - RNA, 21 nt, Pseudomonas aeruginosa PA01
gcgccgucaucgcugaccugg

SEQ ID NO: 3462621 - RNA, 13 nt, Pseudomonas aeruginosa PA01
gcgccguccugca

SEQ ID NO: 3462622 - RNA, 14 nt, Pseudomonas aeruginosa PA01
gcgccgucgcgacc

SEQ ID NO: 3462623 - RNA, 21 nt, Pseudomonas aeruginosa PA01
gcgccgucgcgaccuucggug

SEQ ID NO: 3462624 - RNA, 16 nt, Pseudomonas aeruginosa PA01
gcgccgucgcuggcga

SEQ ID NO: 3462625 - RNA, 18 nt, Pseudomonas aeruginosa PA01
gcgccgucgcuggcgaug

SEQ ID NO: 3462626 - RNA, 15 nt, Pseudomonas aeruginosa PA01
gcgccguggaucgcc

SEQ ID NO: 3462627 - RNA, 17 nt, Pseudomonas aeruginosa PA01
gcgccguggaucgcccg

SEQ ID NO: 3462628 - RNA, 19 nt, Pseudomonas aeruginosa PA01
gcgccguggaucgcccggc

SEQ ID NO: 3462629 - RNA, 20 nt, Pseudomonas aeruginosa PA01
gcgccguggaucgcccggcu

SEQ ID NO: 3462630 - RNA, 14 nt, Pseudomonas aeruginosa PA01
gcgccguggcacca

SEQ ID NO: 3462631 - RNA, 18 nt, Pseudomonas aeruginosa PA01
gcgccguucacgccuggc

SEQ ID NO: 3462632 - RNA, 19 nt, Pseudomonas aeruginosa PA01
gcgccguucacgccuggcg

SEQ ID NO: 3462633 - RNA, 20 nt, Pseudomonas aeruginosa PA01
gcgccguucacgccuggcgg

SEQ ID NO: 3462634 - RNA, 21 nt, Pseudomonas aeruginosa PA01
gcgccguucacgccuggcggc

SEQ ID NO: 3462635 - RNA, 23 nt, Pseudomonas aeruginosa PA01
gcgccguucacgccuggcggcug

SEQ ID NO: 3462636 - RNA, 14 nt, Pseudomonas aeruginosa PA01
gcgccguugccgau

SEQ ID NO: 3462637 - RNA, 15 nt, Pseudomonas aeruginosa PA01
gcgccguugcggcag

SEQ ID NO: 3462638 - RNA, 16 nt, Pseudomonas aeruginosa PA01
gcgccguugcggcagc

SEQ ID NO: 3462639 - RNA, 18 nt, Pseudomonas aeruginosa PA01
gcgccguugcggcagcau

SEQ ID NO: 3462640 - RNA, 15 nt, Pseudomonas aeruginosa PA01
gcgccguuucgacga

SEQ ID NO: 3462641 - RNA, 20 nt, Pseudomonas aeruginosa PA01
gcgccuagacccugggccaa

SEQ ID NO: 3462642 - RNA, 12 nt, Pseudomonas aeruginosa PA01
gcgccucagcgg

SEQ ID NO: 3462643 - RNA, 22 nt, Pseudomonas aeruginosa PA01
gcgccucagcggaacuugcgcc

SEQ ID NO: 3462644 - RNA, 14 nt, Pseudomonas aeruginosa PA01
gcgccucagcggcc

SEQ ID NO: 3462645 - RNA, 15 nt, Pseudomonas aeruginosa PA01
gcgccucagcggcug

SEQ ID NO: 3462646 - RNA, 18 nt, Pseudomonas aeruginosa PA01
gcgccucagcggcuggcg

SEQ ID NO: 3462647 - RNA, 20 nt, Pseudomonas aeruginosa PA01
gcgccucagcggcuggcgau

SEQ ID NO: 3462648 - RNA, 22 nt, Pseudomonas aeruginosa PA01
gcgccucagcggcuggcgaugc

SEQ ID NO: 3462649 - RNA, 12 nt, Pseudomonas aeruginosa PA01
gcgccuccagca

SEQ ID NO: 3462650 - RNA, 13 nt, Pseudomonas aeruginosa PA01
gcgccuccagcac

SEQ ID NO: 3462651 - RNA, 15 nt, Pseudomonas aeruginosa PA01
gcgccuccagcgggc

SEQ ID NO: 3462652 - RNA, 16 nt, Pseudomonas aeruginosa PA01
gcgccuccagcgggcc

SEQ ID NO: 3462653 - RNA, 23 nt, Pseudomonas aeruginosa PA01
gcgccuccagcgggccuucgcca

SEQ ID NO: 3462654 - RNA, 14 nt, Pseudomonas aeruginosa PA01
gcgccuccagcguc

SEQ ID NO: 3462655 - RNA, 12 nt, Pseudomonas aeruginosa PA01
gcgccuccagga

SEQ ID NO: 3462656 - RNA, 22 nt, Pseudomonas aeruginosa PA01
gcgccuccaggaauccuccgcc

SEQ ID NO: 3462657 - RNA, 16 nt, Pseudomonas aeruginosa PA01
gcgccuccaggaccuu

SEQ ID NO: 3462658 - RNA, 21 nt, Pseudomonas aeruginosa PA01
gcgccuccaggaccuugucgc

SEQ ID NO: 3462659 - RNA, 12 nt, Pseudomonas aeruginosa PA01
gcgccuccaggc

SEQ ID NO: 3462660 - RNA, 16 nt, Pseudomonas aeruginosa PA01
gcgccuccaggcgcgc

SEQ ID NO: 3462661 - RNA, 13 nt, Pseudomonas aeruginosa PA01
gcgccucccaggg

SEQ ID NO: 3462662 - RNA, 13 nt, Pseudomonas aeruginosa PA01
gcgccucccgcug

SEQ ID NO: 3462663 - RNA, 12 nt, Pseudomonas aeruginosa PA01
gcgccucccggg

SEQ ID NO: 3462664 - RNA, 16 nt, Pseudomonas aeruginosa PA01
gcgccucccgggccuc

SEQ ID NO: 3462665 - RNA, 15 nt, Pseudomonas aeruginosa PA01
gcgccuccggcagcg

SEQ ID NO: 3462666 - RNA, 14 nt, Pseudomonas aeruginosa PA01
gcgccuccucggcg

SEQ ID NO: 3462667 - RNA, 18 nt, Pseudomonas aeruginosa PA01
gcgccuccucggcggccu

SEQ ID NO: 3462668 - RNA, 17 nt, Pseudomonas aeruginosa PA01
gcgccuccucuaccagg

SEQ ID NO: 3462669 - RNA, 19 nt, Pseudomonas aeruginosa PA01
gcgccuccucuaccaggcg

SEQ ID NO: 3462670 - RNA, 14 nt, Pseudomonas aeruginosa PA01
gcgccucgaccugg

SEQ ID NO: 3462671 - RNA, 16 nt, Pseudomonas aeruginosa PA01
gcgccucgaccuggcc

SEQ ID NO: 3462672 - RNA, 21 nt, Pseudomonas aeruginosa PA01
gcgccucgaggaucuugcgcc

SEQ ID NO: 3462673 - RNA, 22 nt, Pseudomonas aeruginosa PA01
gcgccucgaucgccucgggcga

SEQ ID NO: 3462674 - RNA, 19 nt, Pseudomonas aeruginosa PA01
gcgccucgcaaaggucggc

SEQ ID NO: 3462675 - RNA, 23 nt, Pseudomonas aeruginosa PA01
gcgccucgcaaaggucggcgaag

SEQ ID NO: 3462676 - RNA, 13 nt, Pseudomonas aeruginosa PA01
gcgccucgcccca

SEQ ID NO: 3462677 - RNA, 19 nt, Pseudomonas aeruginosa PA01
gcgccucgccgagcaucca

SEQ ID NO: 3462678 - RNA, 15 nt, Pseudomonas aeruginosa PA01
gcgccucgccgcggc

SEQ ID NO: 3462679 - RNA, 21 nt, Pseudomonas aeruginosa PA01
gcgccucgccuucguccaugc

SEQ ID NO: 3462680 - RNA, 18 nt, Pseudomonas aeruginosa PA01
gcgccucgcgcaacgccg

SEQ ID NO: 3462681 - RNA, 19 nt, Pseudomonas aeruginosa PA01
gcgccucgcgcaacgccga

SEQ ID NO: 3462682 - RNA, 22 nt, Pseudomonas aeruginosa PA01
gcgccucgcgggucugcgccuc

SEQ ID NO: 3462683 - RNA, 20 nt, Pseudomonas aeruginosa PA01
gcgccucgcuagucuuccug

SEQ ID NO: 3462684 - RNA, 13 nt, Pseudomonas aeruginosa PA01
gcgccucggcauc

SEQ ID NO: 3462685 - RNA, 15 nt, Pseudomonas aeruginosa PA01
gcgccucggcccugg

SEQ ID NO: 3462686 - RNA, 13 nt, Pseudomonas aeruginosa PA01
gcgccucggcgca

SEQ ID NO: 3462687 - RNA, 14 nt, Pseudomonas aeruginosa PA01
gcgccucggcgcag

SEQ ID NO: 3462688 - RNA, 16 nt, Pseudomonas aeruginosa PA01
gcgccucgggccggag

SEQ ID NO: 3462689 - RNA, 19 nt, Pseudomonas aeruginosa PA01
gcgccucgggccggagcag

SEQ ID NO: 3462690 - RNA, 22 nt, Pseudomonas aeruginosa PA01
gcgccucgggccggagcaggcc

SEQ ID NO: 3462691 - RNA, 20 nt, Pseudomonas aeruginosa PA01
gcgccucgucgacgcccugg

SEQ ID NO: 3462692 - RNA, 16 nt, Pseudomonas aeruginosa PA01
gcgccucgucgcgcca

SEQ ID NO: 3462693 - RNA, 17 nt, Pseudomonas aeruginosa PA01
gcgccucguggaacagc

SEQ ID NO: 3462694 - RNA, 22 nt, Pseudomonas aeruginosa PA01
gcgccucguggaacagcgcguc

SEQ ID NO: 3462695 - RNA, 23 nt, Pseudomonas aeruginosa PA01
gcgccucguggaacagcgcgucg

SEQ ID NO: 3462696 - RNA, 23 nt, Pseudomonas aeruginosa PA01
gcgccucuucgcaggagucgacg

SEQ ID NO: 3462697 - RNA, 14 nt, Pseudomonas aeruginosa PA01
gcgccugagcagcg

SEQ ID NO: 3462698 - RNA, 16 nt, Pseudomonas aeruginosa PA01
gcgccugagcagcgcu

SEQ ID NO: 3462699 - RNA, 18 nt, Pseudomonas aeruginosa PA01
gcgccugagcagcgcuug

SEQ ID NO: 3462700 - RNA, 19 nt, Pseudomonas aeruginosa PA01
gcgccugcaacgccagcag

SEQ ID NO: 3462701 - RNA, 20 nt, Pseudomonas aeruginosa PA01
gcgccugcaacgccagcagg

SEQ ID NO: 3462702 - RNA, 16 nt, Pseudomonas aeruginosa PA01
gcgccugcaacguccu

SEQ ID NO: 3462703 - RNA, 21 nt, Pseudomonas aeruginosa PA01
gcgccugcaggucgaggcgcu

SEQ ID NO: 3462704 - RNA, 16 nt, Pseudomonas aeruginosa PA01
gcgccugcggaccaca

SEQ ID NO: 3462705 - RNA, 17 nt, Pseudomonas aeruginosa PA01
gcgccugcggaccacag

SEQ ID NO: 3462706 - RNA, 19 nt, Pseudomonas aeruginosa PA01
gcgccugcucuucggcggc

SEQ ID NO: 3462707 - RNA, 21 nt, Pseudomonas aeruginosa PA01
gcgccugcucuucggcggcca

SEQ ID NO: 3462708 - RNA, 22 nt, Pseudomonas aeruginosa PA01
gcgccugcucuucggcggccag

SEQ ID NO: 3462709 - RNA, 23 nt, Pseudomonas aeruginosa PA01
gcgccugcucuucggcggccagc

SEQ ID NO: 3462710 - RNA, 21 nt, Pseudomonas aeruginosa PA01
gcgccugcugcgcgggugucg

SEQ ID NO: 3462711 - RNA, 18 nt, Pseudomonas aeruginosa PA01
gcgccugcuucagcccgg

SEQ ID NO: 3462712 - RNA, 20 nt, Pseudomonas aeruginosa PA01
gcgccugcuucagcccggca

SEQ ID NO: 3462713 - RNA, 19 nt, Pseudomonas aeruginosa PA01
gcgccugcuuugggagcag

SEQ ID NO: 3462714 - RNA, 21 nt, Pseudomonas aeruginosa PA01
gcgccugcuuugggagcagga

SEQ ID NO: 3462715 - RNA, 13 nt, Pseudomonas aeruginosa PA01
gcgccuggagcag

SEQ ID NO: 3462716 - RNA, 22 nt, Pseudomonas aeruginosa PA01
gcgccuggagcagaaccgccag

SEQ ID NO: 3462717 - RNA, 18 nt, Pseudomonas aeruginosa PA01
gcgccuggaucagcgccu

SEQ ID NO: 3462718 - RNA, 19 nt, Pseudomonas aeruginosa PA01
gcgccuggaucagcgccuc

SEQ ID NO: 3462719 - RNA, 21 nt, Pseudomonas aeruginosa PA01
gcgccuggaucagcgccucga

SEQ ID NO: 3462720 - RNA, 19 nt, Pseudomonas aeruginosa PA01
gcgcgacgaggcgcggcgg

SEQ ID NO: 3462721 - RNA, 16 nt, Pseudomonas aeruginosa PA01
gcgcgacgcuccaggu

SEQ ID NO: 3462722 - RNA, 17 nt, Pseudomonas aeruginosa PA01
gcgcgacgcuccaggug

SEQ ID NO: 3462723 - RNA, 22 nt, Pseudomonas aeruginosa PA01
gcgcgacggaacaagccgccuu

SEQ ID NO: 3462724 - RNA, 22 nt, Pseudomonas aeruginosa PA01
gcgcgacucgguaaagcccagg

SEQ ID NO: 3462725 - RNA, 15 nt, Pseudomonas aeruginosa PA01
gcgcgacugucgagc

SEQ ID NO: 3462726 - RNA, 17 nt, Pseudomonas aeruginosa PA01
gcgcgacugucgagcag

SEQ ID NO: 3462727 - RNA, 19 nt, Pseudomonas aeruginosa PA01
gcgcgacugucgagcaggg

SEQ ID NO: 3462728 - RNA, 14 nt, Pseudomonas aeruginosa PA01
gcgcgacuuggaca

SEQ ID NO: 3462729 - RNA, 18 nt, Pseudomonas aeruginosa PA01
gcgcgagaagccagccag

SEQ ID NO: 3462730 - RNA, 18 nt, Pseudomonas aeruginosa PA01
gcgcgagaugaagcgccg

SEQ ID NO: 3462731 - RNA, 15 nt, Pseudomonas aeruginosa PA01
gcgcgagcaccgcgc

SEQ ID NO: 3462732 - RNA, 20 nt, Pseudomonas aeruginosa PA01
gcgcgagcaccgcgcagacc

SEQ ID NO: 3462733 - RNA, 13 nt, Pseudomonas aeruginosa PA01
gcgcgagcggcag

SEQ ID NO: 3462734 - RNA, 14 nt, Pseudomonas aeruginosa PA01
gcgcgagcggcaga

SEQ ID NO: 3462735 - RNA, 13 nt, Pseudomonas aeruginosa PA01
gcgcgagcguucc

SEQ ID NO: 3462736 - RNA, 12 nt, Pseudomonas aeruginosa PA01
gcgcgaggcgag

SEQ ID NO: 3462737 - RNA, 13 nt, Pseudomonas aeruginosa PA01
gcgcgaggcgcag

SEQ ID NO: 3462738 - RNA, 15 nt, Pseudomonas aeruginosa PA01
gcgcgaggcgcaggc

SEQ ID NO: 3462739 - RNA, 16 nt, Pseudomonas aeruginosa PA01
gcgcgaggcgcccgcc

SEQ ID NO: 3462740 - RNA, 17 nt, Pseudomonas aeruginosa PA01
gcgcgaggcgcccgccg

SEQ ID NO: 3462741 - RNA, 20 nt, Pseudomonas aeruginosa PA01
gcgcgaggcgcccgccggcc

SEQ ID NO: 3462742 - RNA, 18 nt, Pseudomonas aeruginosa PA01
gcgcgaggcguucgucga

SEQ ID NO: 3462743 - RNA, 13 nt, Pseudomonas aeruginosa PA01
gcgcgaggggcgg

SEQ ID NO: 3462744 - RNA, 16 nt, Pseudomonas aeruginosa PA01
gcgcgagggggccucg

SEQ ID NO: 3462745 - RNA, 17 nt, Pseudomonas aeruginosa PA01
gcgcgagggggccucgg

SEQ ID NO: 3462746 - RNA, 19 nt, Pseudomonas aeruginosa PA01
gcgcgagggggccucggcc

SEQ ID NO: 3462747 - RNA, 22 nt, Pseudomonas aeruginosa PA01
gcgcgagggggccucggccagc

SEQ ID NO: 3462748 - RNA, 18 nt, Pseudomonas aeruginosa PA01
gcgcgauacccuggccgg

SEQ ID NO: 3462749 - RNA, 19 nt, Pseudomonas aeruginosa PA01
gcgcgauacccuggccggc

SEQ ID NO: 3462750 - RNA, 22 nt, Pseudomonas aeruginosa PA01
gcgcgauacccuggccggccuc

SEQ ID NO: 3462751 - RNA, 15 nt, Pseudomonas aeruginosa PA01
gcgcgauauccgcca

SEQ ID NO: 3462752 - RNA, 14 nt, Pseudomonas aeruginosa PA01
gcgcgauaucgcag

SEQ ID NO: 3462753 - RNA, 16 nt, Pseudomonas aeruginosa PA01
gcgcgauaucgcaggc

SEQ ID NO: 3462754 - RNA, 20 nt, Pseudomonas aeruginosa PA01
gcgcgauaucgcaggccagg

SEQ ID NO: 3462755 - RNA, 23 nt, Pseudomonas aeruginosa PA01
gcgcgauaucgcaggccaggccc

SEQ ID NO: 3462756 - RNA, 16 nt, Pseudomonas aeruginosa PA01
gcgcgaucagccgcuc

SEQ ID NO: 3462757 - RNA, 22 nt, Pseudomonas aeruginosa PA01
gcgcgaucagccgcuccaggau

SEQ ID NO: 3462758 - RNA, 13 nt, Pseudomonas aeruginosa PA01
gcgcgaucccccg

SEQ ID NO: 3462759 - RNA, 16 nt, Pseudomonas aeruginosa PA01
gcgcgauccgcgcggc

SEQ ID NO: 3462760 - RNA, 17 nt, Pseudomonas aeruginosa PA01
gcgcgauccgcgcggca

SEQ ID NO: 3462761 - RNA, 20 nt, Pseudomonas aeruginosa PA01
gcgcgauccgcgcggcaacc

SEQ ID NO: 3462762 - RNA, 13 nt, Pseudomonas aeruginosa PA01
gcgcgauccuccg

SEQ ID NO: 3462763 - RNA, 22 nt, Pseudomonas aeruginosa PA01
gcgcgauccuccgccagcccca

SEQ ID NO: 3462764 - RNA, 16 nt, Pseudomonas aeruginosa PA01
gcgcgauccuggcggc

SEQ ID NO: 3462765 - RNA, 17 nt, Pseudomonas aeruginosa PA01
gcgcgauccuggcggca

SEQ ID NO: 3462766 - RNA, 20 nt, Pseudomonas aeruginosa PA01
gcgcgauccuggcggcacuc

SEQ ID NO: 3462767 - RNA, 21 nt, Pseudomonas aeruginosa PA01
gcgcgaucgcguuccagcaac

SEQ ID NO: 3462768 - RNA, 14 nt, Pseudomonas aeruginosa PA01
gcgcgaucggggca

SEQ ID NO: 3462769 - RNA, 22 nt, Pseudomonas aeruginosa PA01
gcgcgaucucuacuaccgccag

SEQ ID NO: 3462770 - RNA, 23 nt, Pseudomonas aeruginosa PA01
gcgcgaucucuacuaccgccagc

SEQ ID NO: 3462771 - RNA, 17 nt, Pseudomonas aeruginosa PA01
gcgcgaugaugccgccg

SEQ ID NO: 3462772 - RNA, 18 nt, Pseudomonas aeruginosa PA01
gcgcgaugaugccgccgu

SEQ ID NO: 3462773 - RNA, 20 nt, Pseudomonas aeruginosa PA01
gcgcgaugccccauccgacg

SEQ ID NO: 3462774 - RNA, 18 nt, Pseudomonas aeruginosa PA01
gcgcgaugcucccgagca

SEQ ID NO: 3462775 - RNA, 19 nt, Pseudomonas aeruginosa PA01
gcgcgaugcucccgagcaa

SEQ ID NO: 3462776 - RNA, 21 nt, Pseudomonas aeruginosa PA01
gcgcgauggaguaggcgucgu

SEQ ID NO: 3462777 - RNA, 14 nt, Pseudomonas aeruginosa PA01
gcgcgauggccggc

SEQ ID NO: 3462778 - RNA, 17 nt, Pseudomonas aeruginosa PA01
gcgcgauggccggcgga

SEQ ID NO: 3462779 - RNA, 17 nt, Pseudomonas aeruginosa PA01
gcgcgauuuugggcuca

SEQ ID NO: 3462780 - RNA, 17 nt, Pseudomonas aeruginosa PA01
gcgcgcaacgcuuccag

SEQ ID NO: 3462781 - RNA, 20 nt, Pseudomonas aeruginosa PA01
gcgcgcaacgcuuccagcac

SEQ ID NO: 3462782 - RNA, 22 nt, Pseudomonas aeruginosa PA01
gcgcgcaacuggucgcggcugc

SEQ ID NO: 3462783 - RNA, 17 nt, Pseudomonas aeruginosa PA01
gcgcgcaaggccgaaga

SEQ ID NO: 3462784 - RNA, 19 nt, Pseudomonas aeruginosa PA01
gcgcgcaccaccuggcagg

SEQ ID NO: 3462785 - RNA, 15 nt, Pseudomonas aeruginosa PA01
gcgcgcaccaggccu

SEQ ID NO: 3462786 - RNA, 16 nt, Pseudomonas aeruginosa PA01
gcgcgcaccaggccuc

SEQ ID NO: 3462787 - RNA, 17 nt, Pseudomonas aeruginosa PA01
gcgcgcaccaggccucc

SEQ ID NO: 3462788 - RNA, 16 nt, Pseudomonas aeruginosa PA01
gcgcgcacuuccucgg

SEQ ID NO: 3462789 - RNA, 17 nt, Pseudomonas aeruginosa PA01
gcgcgcacuuccucggc

SEQ ID NO: 3462790 - RNA, 19 nt, Pseudomonas aeruginosa PA01
gcgcgcacuuccucggcga

SEQ ID NO: 3462791 - RNA, 21 nt, Pseudomonas aeruginosa PA01
gcgcgcacuuccucggcgacc

SEQ ID NO: 3462792 - RNA, 19 nt, Pseudomonas aeruginosa PA01
gcgcgcagauaaggcgugc

SEQ ID NO: 3462793 - RNA, 13 nt, Pseudomonas aeruginosa PA01
gcgcgcagcaggu

SEQ ID NO: 3462794 - RNA, 12 nt, Pseudomonas aeruginosa PA01
gcgcgcagcggu

SEQ ID NO: 3462795 - RNA, 22 nt, Pseudomonas aeruginosa PA01
gcgcgcagcgguacaggcggau

SEQ ID NO: 3462796 - RNA, 14 nt, Pseudomonas aeruginosa PA01
gcgcgcaggaccag

SEQ ID NO: 3462797 - RNA, 13 nt, Pseudomonas aeruginosa PA01
gcgcgcagggcau

SEQ ID NO: 3462798 - RNA, 13 nt, Pseudomonas aeruginosa PA01
gcgcgcagggcca

SEQ ID NO: 3462799 - RNA, 13 nt, Pseudomonas aeruginosa PA01
gcgcgcagggccg

SEQ ID NO: 3462800 - RNA, 15 nt, Pseudomonas aeruginosa PA01
gcgcgcagggccgcg

SEQ ID NO: 3462801 - RNA, 16 nt, Pseudomonas aeruginosa PA01
gcgcgcagggccgcgg

SEQ ID NO: 3462802 - RNA, 17 nt, Pseudomonas aeruginosa PA01
gcgcgcagggccgcggc

SEQ ID NO: 3462803 - RNA, 18 nt, Pseudomonas aeruginosa PA01
gcgcgcagggccgcggcg

SEQ ID NO: 3462804 - RNA, 23 nt, Pseudomonas aeruginosa PA01
gcgcgcagggugagcauggcguu

SEQ ID NO: 3462805 - RNA, 16 nt, Pseudomonas aeruginosa PA01
gcgcgcauagcaggcc

SEQ ID NO: 3462806 - RNA, 23 nt, Pseudomonas aeruginosa PA01
gcgcgcaucggugccggcaggcc

SEQ ID NO: 3462807 - RNA, 15 nt, Pseudomonas aeruginosa PA01
gcgcgcaucuggugc

SEQ ID NO: 3462808 - RNA, 20 nt, Pseudomonas aeruginosa PA01
gcgcgcaugaaaaagcccgg

SEQ ID NO: 3462809 - RNA, 13 nt, Pseudomonas aeruginosa PA01
gcgcgccaaggcc

SEQ ID NO: 3462810 - RNA, 17 nt, Pseudomonas aeruginosa PA01
gcgcgccaaggccgcca

SEQ ID NO: 3462811 - RNA, 18 nt, Pseudomonas aeruginosa PA01
gcgcgccaaggccgccag

SEQ ID NO: 3462812 - RNA, 20 nt, Pseudomonas aeruginosa PA01
gcgcgccaaggccgccaggc

SEQ ID NO: 3462813 - RNA, 11 nt, Pseudomonas aeruginosa PA01
gcgcgccacca

SEQ ID NO: 3462814 - RNA, 14 nt, Pseudomonas aeruginosa PA01
gcgcgccaccagcg

SEQ ID NO: 3462815 - RNA, 17 nt, Pseudomonas aeruginosa PA01
gcgcgccaccagcgugg

SEQ ID NO: 3462816 - RNA, 18 nt, Pseudomonas aeruginosa PA01
gcgcgccaccagcguggc

SEQ ID NO: 3462817 - RNA, 20 nt, Pseudomonas aeruginosa PA01
gcgcgccaccagcguggcgc

SEQ ID NO: 3462818 - RNA, 14 nt, Pseudomonas aeruginosa PA01
gcgcgccaccgccu

SEQ ID NO: 3462819 - RNA, 24 nt, Pseudomonas aeruginosa PA01
gcgcgccaccgccuggucgccggg

SEQ ID NO: 3462820 - RNA, 13 nt, Pseudomonas aeruginosa PA01
gcgcgccaccugg

SEQ ID NO: 3462821 - RNA, 18 nt, Pseudomonas aeruginosa PA01
gcgcgccagaagcggccg

SEQ ID NO: 3462822 - RNA, 19 nt, Pseudomonas aeruginosa PA01
gcgcgccagaagcggccga

SEQ ID NO: 3462823 - RNA, 17 nt, Pseudomonas aeruginosa PA01
gcgcgcguuucagcgcu

SEQ ID NO: 3462824 - RNA, 12 nt, Pseudomonas aeruginosa PA01
gcgcgcuccggc

SEQ ID NO: 3462825 - RNA, 16 nt, Pseudomonas aeruginosa PA01
gcgcgcuccggcgcgc

SEQ ID NO: 3462826 - RNA, 16 nt, Pseudomonas aeruginosa PA01
gcgcgcucgaucaggu

SEQ ID NO: 3462827 - RNA, 15 nt, Pseudomonas aeruginosa PA01
gcgcgcucggccugg

SEQ ID NO: 3462828 - RNA, 20 nt, Pseudomonas aeruginosa PA01
gcgcgcucgggaucgccucg

SEQ ID NO: 3462829 - RNA, 14 nt, Pseudomonas aeruginosa PA01
gcgcgcucucgccg

SEQ ID NO: 3462830 - RNA, 16 nt, Pseudomonas aeruginosa PA01
gcgcgcucucgccggc

SEQ ID NO: 3462831 - RNA, 17 nt, Pseudomonas aeruginosa PA01
gcgcgcucucgccggcc

SEQ ID NO: 3462832 - RNA, 21 nt, Pseudomonas aeruginosa PA01
gcgcgcucucgccggccugga

SEQ ID NO: 3462833 - RNA, 18 nt, Pseudomonas aeruginosa PA01
gcgcgcucuucgccgcgg

SEQ ID NO: 3462834 - RNA, 19 nt, Pseudomonas aeruginosa PA01
gcgcgcucuucgccgcggc

SEQ ID NO: 3462835 - RNA, 15 nt, Pseudomonas aeruginosa PA01
gcgcgcugccugcga

SEQ ID NO: 3462836 - RNA, 18 nt, Pseudomonas aeruginosa PA01
gcgcgcugccugcgaugg

SEQ ID NO: 3462837 - RNA, 20 nt, Pseudomonas aeruginosa PA01
gcgcgcugccugcgauggaa

SEQ ID NO: 3462838 - RNA, 13 nt, Pseudomonas aeruginosa PA01
gcgcgcugcgggu

SEQ ID NO: 3462839 - RNA, 16 nt, Pseudomonas aeruginosa PA01
gcgcgcugcgggucau

SEQ ID NO: 3462840 - RNA, 15 nt, Pseudomonas aeruginosa PA01
gcgcgcugcgugcgc

SEQ ID NO: 3462841 - RNA, 13 nt, Pseudomonas aeruginosa PA01
gcgcgcuggcgca

SEQ ID NO: 3462842 - RNA, 15 nt, Pseudomonas aeruginosa PA01
gcgcgcuggcgcagc

SEQ ID NO: 3462843 - RNA, 16 nt, Pseudomonas aeruginosa PA01
gcgcgcuggcgcagcg

SEQ ID NO: 3462844 - RNA, 13 nt, Pseudomonas aeruginosa PA01
gcgcgcuggucga

SEQ ID NO: 3462845 - RNA, 16 nt, Pseudomonas aeruginosa PA01
gcgcgcuguagccggc

SEQ ID NO: 3462846 - RNA, 14 nt, Pseudomonas aeruginosa PA01
gcgcgcuuccaggc

SEQ ID NO: 3462847 - RNA, 19 nt, Pseudomonas aeruginosa PA01
gcgcgcuuccuccaguagc

SEQ ID NO: 3462848 - RNA, 16 nt, Pseudomonas aeruginosa PA01
gcgcgcuuuccggcgc

SEQ ID NO: 3462849 - RNA, 20 nt, Pseudomonas aeruginosa PA01
gcgcgcuuuccggcgcggcc

SEQ ID NO: 3462850 - RNA, 21 nt, Pseudomonas aeruginosa PA01
gcgcgcuuuccggcgcggccu

SEQ ID NO: 3462851 - RNA, 22 nt, Pseudomonas aeruginosa PA01
gcgcgcuuuccggcgcggccug

SEQ ID NO: 3462852 - RNA, 20 nt, Pseudomonas aeruginosa PA01
gcgcgcuuuuccggcgccgg

SEQ ID NO: 3462853 - RNA, 19 nt, Pseudomonas aeruginosa PA01
gcgcggaacaucgcccggc

SEQ ID NO: 3462854 - RNA, 20 nt, Pseudomonas aeruginosa PA01
gcgcggaacaucgcccggcg

SEQ ID NO: 3462855 - RNA, 21 nt, Pseudomonas aeruginosa PA01
gcgcggaacaucgcccggcgc

SEQ ID NO: 3462856 - RNA, 16 nt, Pseudomonas aeruginosa PA01
gcgcggaagcgccugc

SEQ ID NO: 3462857 - RNA, 22 nt, Pseudomonas aeruginosa PA01
gcgcggaauccuucgcggcggc

SEQ ID NO: 3462858 - RNA, 23 nt, Pseudomonas aeruginosa PA01
gcgcggaauccuucgcggcggcg

SEQ ID NO: 3462859 - RNA, 15 nt, Pseudomonas aeruginosa PA01
gcgcggacauggcgc

SEQ ID NO: 3462860 - RNA, 19 nt, Pseudomonas aeruginosa PA01
gcgcggacauggcgcucga

SEQ ID NO: 3462861 - RNA, 16 nt, Pseudomonas aeruginosa PA01
gcgcggaccgcaaccg

SEQ ID NO: 3462862 - RNA, 19 nt, Pseudomonas aeruginosa PA01
gcgcggaccgcaaccgguc

SEQ ID NO: 3462863 - RNA, 19 nt, Pseudomonas aeruginosa PA01
gcgcggaccuucgacggca

SEQ ID NO: 3462864 - RNA, 16 nt, Pseudomonas aeruginosa PA01
gcgcggacgaaccccg

SEQ ID NO: 3462865 - RNA, 24 nt, Pseudomonas aeruginosa PA01
gcgcggacgauggucgccgcgacc

SEQ ID NO: 3462866 - RNA, 14 nt, Pseudomonas aeruginosa PA01
gcgcggagcgucca

SEQ ID NO: 3462867 - RNA, 19 nt, Pseudomonas aeruginosa PA01
gcgcggagcguccaccagc

SEQ ID NO: 3462868 - RNA, 22 nt, Pseudomonas aeruginosa PA01
gcgcggagcguccaccagcgcc

SEQ ID NO: 3462869 - RNA, 17 nt, Pseudomonas aeruginosa PA01
gcgcggauauagcuggu

SEQ ID NO: 3462870 - RNA, 17 nt, Pseudomonas aeruginosa PA01
gcgcggaucagucagga

SEQ ID NO: 3462871 - RNA, 19 nt, Pseudomonas aeruginosa PA01
gcgcggaucagucaggauc

SEQ ID NO: 3462872 - RNA, 12 nt, Pseudomonas aeruginosa PA01
gcgcggaucccc

SEQ ID NO: 3462873 - RNA, 22 nt, Pseudomonas aeruginosa PA01
gcgcggauccccucccgcgcca

SEQ ID NO: 3462874 - RNA, 19 nt, Pseudomonas aeruginosa PA01
gcgcggauguucgccacgc

SEQ ID NO: 3462875 - RNA, 21 nt, Pseudomonas aeruginosa PA01
gcgcggauguucgccacgcug

SEQ ID NO: 3462876 - RNA, 14 nt, Pseudomonas aeruginosa PA01
gcgcggcaacacca

SEQ ID NO: 3462877 - RNA, 16 nt, Pseudomonas aeruginosa PA01
gcgcggcacaggcggc

SEQ ID NO: 3462878 - RNA, 19 nt, Pseudomonas aeruginosa PA01
gcgcggcacaggcggcugu

SEQ ID NO: 3462879 - RNA, 20 nt, Pseudomonas aeruginosa PA01
gcgcggcagcaccaggccau

SEQ ID NO: 3462880 - RNA, 13 nt, Pseudomonas aeruginosa PA01
gcgcggcagcagg

SEQ ID NO: 3462881 - RNA, 13 nt, Pseudomonas aeruginosa PA01
gcgcggcaggaaa

SEQ ID NO: 3462882 - RNA, 18 nt, Pseudomonas aeruginosa PA01
gcgcggcagguggcuggc

SEQ ID NO: 3462883 - RNA, 23 nt, Pseudomonas aeruginosa PA01
gcgcggcagguggcuggccauga

SEQ ID NO: 3462884 - RNA, 13 nt, Pseudomonas aeruginosa PA01
gcgcggcagugcu

SEQ ID NO: 3462885 - RNA, 21 nt, Pseudomonas aeruginosa PA01
gcgcggcagugcucgaucagg

SEQ ID NO: 3462886 - RNA, 19 nt, Pseudomonas aeruginosa PA01
gcgcggcauagaugccggc

SEQ ID NO: 3462887 - RNA, 23 nt, Pseudomonas aeruginosa PA01
gcgcggcauagaugccggccucg

SEQ ID NO: 3462888 - RNA, 19 nt, Pseudomonas aeruginosa PA01
gcgcggcauagcgcagccg

SEQ ID NO: 3462889 - RNA, 21 nt, Pseudomonas aeruginosa PA01
gcgcggcauagcgcagccgcu

SEQ ID NO: 3462890 - RNA, 23 nt, Pseudomonas aeruginosa PA01
gcgcggcauagcgcagccgcucg

SEQ ID NO: 3462891 - RNA, 21 nt, Pseudomonas aeruginosa PA01
gcgcggccacuucguccggcc

SEQ ID NO: 3462892 - RNA, 22 nt, Pseudomonas aeruginosa PA01
gcgcggccacuucguccggccg

SEQ ID NO: 3462893 - RNA, 23 nt, Pseudomonas aeruginosa PA01
gcgcggccacuucguccggccgc

SEQ ID NO: 3462894 - RNA, 12 nt, Pseudomonas aeruginosa PA01
gcgcggccagcg

SEQ ID NO: 3462895 - RNA, 13 nt, Pseudomonas aeruginosa PA01
gcgcggccagcgc

SEQ ID NO: 3462896 - RNA, 16 nt, Pseudomonas aeruginosa PA01
gcgcggccagcgcggc

SEQ ID NO: 3462897 - RNA, 17 nt, Pseudomonas aeruginosa PA01
gcgcggccagcgcggcc

SEQ ID NO: 3462898 - RNA, 19 nt, Pseudomonas aeruginosa PA01
gcgcggccagcgcggccgc

SEQ ID NO: 3462899 - RNA, 21 nt, Pseudomonas aeruginosa PA01
gcgcggccagcgcggccgccg

SEQ ID NO: 3462900 - RNA, 14 nt, Pseudomonas aeruginosa PA01
gcgcggccagcgug

SEQ ID NO: 3462901 - RNA, 19 nt, Pseudomonas aeruginosa PA01
gcgcggccagcucgccggu

SEQ ID NO: 3462902 - RNA, 18 nt, Pseudomonas aeruginosa PA01
gcgcggccaguucggggu

SEQ ID NO: 3462903 - RNA, 19 nt, Pseudomonas aeruginosa PA01
gcgcggcccguccgcgcca

SEQ ID NO: 3462904 - RNA, 16 nt, Pseudomonas aeruginosa PA01
gcgcggcccuucgacg

SEQ ID NO: 3462905 - RNA, 21 nt, Pseudomonas aeruginosa PA01
gcgcggccgaacucuggcggc

SEQ ID NO: 3462906 - RNA, 16 nt, Pseudomonas aeruginosa PA01
gcgcggccggccacgc

SEQ ID NO: 3462907 - RNA, 13 nt, Pseudomonas aeruginosa PA01
gcgcggccggcgc

SEQ ID NO: 3462908 - RNA, 13 nt, Pseudomonas aeruginosa PA01
gcgcggccugcgc

SEQ ID NO: 3462909 - RNA, 14 nt, Pseudomonas aeruginosa PA01
gcgcggccugcgcc

SEQ ID NO: 3462910 - RNA, 15 nt, Pseudomonas aeruginosa PA01
gcgcggccugcgccg

SEQ ID NO: 3462911 - RNA, 15 nt, Pseudomonas aeruginosa PA01
gcgcggccuguucgg

SEQ ID NO: 3462912 - RNA, 15 nt, Pseudomonas aeruginosa PA01
gcgcggccuucagcg

SEQ ID NO: 3462913 - RNA, 23 nt, Pseudomonas aeruginosa PA01
gcgcggcgaagguggcgaccugg

SEQ ID NO: 3462914 - RNA, 13 nt, Pseudomonas aeruginosa PA01
gcgcggcgacgau

SEQ ID NO: 3462915 - RNA, 16 nt, Pseudomonas aeruginosa PA01
gcgcggcgagccgcga

SEQ ID NO: 3462916 - RNA, 15 nt, Pseudomonas aeruginosa PA01
gcgcggcgagggcgc

SEQ ID NO: 3462917 - RNA, 17 nt, Pseudomonas aeruginosa PA01
gcgcggcgagggcgccg

SEQ ID NO: 3462918 - RNA, 13 nt, Pseudomonas aeruginosa PA01
gcgcggcgcaauc

SEQ ID NO: 3462919 - RNA, 15 nt, Pseudomonas aeruginosa PA01
gcgcggcgcacugag

SEQ ID NO: 3462920 - RNA, 15 nt, Pseudomonas aeruginosa PA01
gcgcggcgcagccag

SEQ ID NO: 3462921 - RNA, 13 nt, Pseudomonas aeruginosa PA01
gcgcggcgcaggc

SEQ ID NO: 3462922 - RNA, 13 nt, Pseudomonas aeruginosa PA01
gcgcggcgccagc

SEQ ID NO: 3462923 - RNA, 14 nt, Pseudomonas aeruginosa PA01
gcgcggcgccagcg

SEQ ID NO: 3462924 - RNA, 13 nt, Pseudomonas aeruginosa PA01
gcgcggcgcccca

SEQ ID NO: 3462925 - RNA, 18 nt, Pseudomonas aeruginosa PA01
gcgcggcgccccaggcgc

SEQ ID NO: 3462926 - RNA, 20 nt, Pseudomonas aeruginosa PA01
gcgcguacaucccgccgaua

SEQ ID NO: 3462927 - RNA, 13 nt, Pseudomonas aeruginosa PA01
gcgcguacgcccg

SEQ ID NO: 3462928 - RNA, 15 nt, Pseudomonas aeruginosa PA01
gcgcguacgcccgca

SEQ ID NO: 3462929 - RNA, 18 nt, Pseudomonas aeruginosa PA01
gcgcguacgcccgcagcc

SEQ ID NO: 3462930 - RNA, 20 nt, Pseudomonas aeruginosa PA01
gcgcguacgcccgcagccac

SEQ ID NO: 3462931 - RNA, 20 nt, Pseudomonas aeruginosa PA01
gcgcguacucaggccgggcg

SEQ ID NO: 3462932 - RNA, 18 nt, Pseudomonas aeruginosa PA01
gcgcguacuugccagggc

SEQ ID NO: 3462933 - RNA, 19 nt, Pseudomonas aeruginosa PA01
gcgcguacuugccagggca

SEQ ID NO: 3462934 - RNA, 21 nt, Pseudomonas aeruginosa PA01
gcgcguacuugccagggcagg

SEQ ID NO: 3462935 - RNA, 22 nt, Pseudomonas aeruginosa PA01
gcgcguagaccaccucgacggc

SEQ ID NO: 3462936 - RNA, 19 nt, Pseudomonas aeruginosa PA01
gcgcguagaggaugccggc

SEQ ID NO: 3462937 - RNA, 13 nt, Pseudomonas aeruginosa PA01
gcgcguagcgguc

SEQ ID NO: 3462938 - RNA, 20 nt, Pseudomonas aeruginosa PA01
gcgcguagcuuuccgcggcg

SEQ ID NO: 3462939 - RNA, 22 nt, Pseudomonas aeruginosa PA01
gcgcguaggcgaacacgucggc

SEQ ID NO: 3462940 - RNA, 14 nt, Pseudomonas aeruginosa PA01
gcgcgucaucaggc

SEQ ID NO: 3462941 - RNA, 13 nt, Pseudomonas aeruginosa PA01
gcgcgucaugccg

SEQ ID NO: 3462942 - RNA, 14 nt, Pseudomonas aeruginosa PA01
gcgcgucaugccgc

SEQ ID NO: 3462943 - RNA, 16 nt, Pseudomonas aeruginosa PA01
gcgcgucaugccgccg

SEQ ID NO: 3462944 - RNA, 12 nt, Pseudomonas aeruginosa PA01
gcgcguccaccu

SEQ ID NO: 3462945 - RNA, 14 nt, Pseudomonas aeruginosa PA01
gcgcguccaccugg

SEQ ID NO: 3462946 - RNA, 14 nt, Pseudomonas aeruginosa PA01
gcgcguccagccgg

SEQ ID NO: 3462947 - RNA, 15 nt, Pseudomonas aeruginosa PA01
gcgcguccagccggu

SEQ ID NO: 3462948 - RNA, 20 nt, Pseudomonas aeruginosa PA01
gcgcguccagcuccaccagg

SEQ ID NO: 3462949 - RNA, 15 nt, Pseudomonas aeruginosa PA01
gcgcguccaucccug

SEQ ID NO: 3462950 - RNA, 19 nt, Pseudomonas aeruginosa PA01
gcgcgucccugggcgcagg

SEQ ID NO: 3462951 - RNA, 21 nt, Pseudomonas aeruginosa PA01
gcgcguccggagugaugccga

SEQ ID NO: 3462952 - RNA, 22 nt, Pseudomonas aeruginosa PA01
gcgcguccggagugaugccgau

SEQ ID NO: 3462953 - RNA, 17 nt, Pseudomonas aeruginosa PA01
gcgcgucgaccacgaag

SEQ ID NO: 3462954 - RNA, 13 nt, Pseudomonas aeruginosa PA01
gcgcgucgccgaa

SEQ ID NO: 3462955 - RNA, 15 nt, Pseudomonas aeruginosa PA01
gcgcgucgcggccuc

SEQ ID NO: 3462956 - RNA, 13 nt, Pseudomonas aeruginosa PA01
gcgcgucgcgguc

SEQ ID NO: 3462957 - RNA, 22 nt, Pseudomonas aeruginosa PA01
gcgcgucgcugccgccgcgccc

SEQ ID NO: 3462958 - RNA, 12 nt, Pseudomonas aeruginosa PA01
gcgcgucggccg

SEQ ID NO: 3462959 - RNA, 13 nt, Pseudomonas aeruginosa PA01
gcgcgucggccgc

SEQ ID NO: 3462960 - RNA, 21 nt, Pseudomonas aeruginosa PA01
gcgcgucggccgcucggccuu

SEQ ID NO: 3462961 - RNA, 22 nt, Pseudomonas aeruginosa PA01
gcgcgucggccgcucggccuug

SEQ ID NO: 3462962 - RNA, 16 nt, Pseudomonas aeruginosa PA01
gcgcgucggugccgcc

SEQ ID NO: 3462963 - RNA, 21 nt, Pseudomonas aeruginosa PA01
gcgcgucggugccgcccggcg

SEQ ID NO: 3462964 - RNA, 19 nt, Pseudomonas aeruginosa PA01
gcgcgucgguggcaggaaa

SEQ ID NO: 3462965 - RNA, 17 nt, Pseudomonas aeruginosa PA01
gcgcgucguccagggcg

SEQ ID NO: 3462966 - RNA, 16 nt, Pseudomonas aeruginosa PA01
gcgcgugcaggcgccc

SEQ ID NO: 3462967 - RNA, 22 nt, Pseudomonas aeruginosa PA01
gcgcgugccccguggcgggcca

SEQ ID NO: 3462968 - RNA, 23 nt, Pseudomonas aeruginosa PA01
gcgcgugccccguggcgggccag

SEQ ID NO: 3462969 - RNA, 14 nt, Pseudomonas aeruginosa PA01
gcgcgugcuggugc

SEQ ID NO: 3462970 - RNA, 12 nt, Pseudomonas aeruginosa PA01
gcgcguggcacg

SEQ ID NO: 3462971 - RNA, 17 nt, Pseudomonas aeruginosa PA01
gcgcguggccgccaggg

SEQ ID NO: 3462972 - RNA, 14 nt, Pseudomonas aeruginosa PA01
gcgcguggcgucgg

SEQ ID NO: 3462973 - RNA, 18 nt, Pseudomonas aeruginosa PA01
gcgcguggcuucguccag

SEQ ID NO: 3462974 - RNA, 13 nt, Pseudomonas aeruginosa PA01
gcgcgugguaucg

SEQ ID NO: 3462975 - RNA, 21 nt, Pseudomonas aeruginosa PA01
gcgcguguacccccaccgggc

SEQ ID NO: 3462976 - RNA, 22 nt, Pseudomonas aeruginosa PA01
gcgcguguacccccaccgggcc

SEQ ID NO: 3462977 - RNA, 18 nt, Pseudomonas aeruginosa PA01
gcgcguucacuccacgag

SEQ ID NO: 3462978 - RNA, 16 nt, Pseudomonas aeruginosa PA01
gcgcguucagccacgg

SEQ ID NO: 3462979 - RNA, 21 nt, Pseudomonas aeruginosa PA01
gcgcguucagccacggacgcg

SEQ ID NO: 3462980 - RNA, 23 nt, Pseudomonas aeruginosa PA01
gcgcguuccgggucgcugcccau

SEQ ID NO: 3462981 - RNA, 16 nt, Pseudomonas aeruginosa PA01
gcgcguucgcgcgagg

SEQ ID NO: 3462982 - RNA, 17 nt, Pseudomonas aeruginosa PA01
gcgcguugcagcgccug

SEQ ID NO: 3462983 - RNA, 18 nt, Pseudomonas aeruginosa PA01
gcgcguugcagcgccugu

SEQ ID NO: 3462984 - RNA, 14 nt, Pseudomonas aeruginosa PA01
gcgcguugcccagc

SEQ ID NO: 3462985 - RNA, 15 nt, Pseudomonas aeruginosa PA01
gcgcguugcgaccaa

SEQ ID NO: 3462986 - RNA, 17 nt, Pseudomonas aeruginosa PA01
gcgcguugcuuccaggc

SEQ ID NO: 3462987 - RNA, 21 nt, Pseudomonas aeruginosa PA01
gcgcguugcuuccaggcaccg

SEQ ID NO: 3462988 - RNA, 14 nt, Pseudomonas aeruginosa PA01
gcgcguuggcuggc

SEQ ID NO: 3462989 - RNA, 15 nt, Pseudomonas aeruginosa PA01
gcgcguugugccgcc

SEQ ID NO: 3462990 - RNA, 17 nt, Pseudomonas aeruginosa PA01
gcgcguugugccgccac

SEQ ID NO: 3462991 - RNA, 19 nt, Pseudomonas aeruginosa PA01
gcgcguugugccgccaccu

SEQ ID NO: 3462992 - RNA, 14 nt, Pseudomonas aeruginosa PA01
gcgcguuucagcgc

SEQ ID NO: 3462993 - RNA, 19 nt, Pseudomonas aeruginosa PA01
gcgcguuucucagcgccgu

SEQ ID NO: 3462994 - RNA, 15 nt, Pseudomonas aeruginosa PA01
gcgcuacgcucgccg

SEQ ID NO: 3462995 - RNA, 20 nt, Pseudomonas aeruginosa PA01
gcgcuacgcucgccgacggc

SEQ ID NO: 3462996 - RNA, 19 nt, Pseudomonas aeruginosa PA01
gcgcuacggcaucaccggc

SEQ ID NO: 3462997 - RNA, 17 nt, Pseudomonas aeruginosa PA01
gcgcuacucaggugaug

SEQ ID NO: 3462998 - RNA, 23 nt, Pseudomonas aeruginosa PA01
gcgcuacucaggugauggcgauc

SEQ ID NO: 3462999 - RNA, 16 nt, Pseudomonas aeruginosa PA01
gcgcuauccgccgcua

SEQ ID NO: 3463000 - RNA, 23 nt, Pseudomonas aeruginosa PA01
gcgcuauccgccguuacgccggg

SEQ ID NO: 3463001 - RNA, 18 nt, Pseudomonas aeruginosa PA01
gcgcuaucggcccggggc

SEQ ID NO: 3463002 - RNA, 19 nt, Pseudomonas aeruginosa PA01
gcgcuaucggcccggggcu

SEQ ID NO: 3463003 - RNA, 19 nt, Pseudomonas aeruginosa PA01
gcgcucaacgccucgcggc

SEQ ID NO: 3463004 - RNA, 16 nt, Pseudomonas aeruginosa PA01
gcgcucaccgaggcga

SEQ ID NO: 3463005 - RNA, 17 nt, Pseudomonas aeruginosa PA01
gcgcucaccgaggcgaa

SEQ ID NO: 3463006 - RNA, 21 nt, Pseudomonas aeruginosa PA01
gcgcucaccgaggcgaacggc

SEQ ID NO: 3463007 - RNA, 14 nt, Pseudomonas aeruginosa PA01
gcgcucacgcaccu

SEQ ID NO: 3463008 - RNA, 13 nt, Pseudomonas aeruginosa PA01
gcgcucacgcucg

SEQ ID NO: 3463009 - RNA, 23 nt, Pseudomonas aeruginosa PA01
gcgcucagccgaggucgccgcca

SEQ ID NO: 3463010 - RNA, 21 nt, Pseudomonas aeruginosa PA01
gcgcucagcgccgcuucuucc

SEQ ID NO: 3463011 - RNA, 22 nt, Pseudomonas aeruginosa PA01
gcgcucagcgcuucucggcagc

SEQ ID NO: 3463012 - RNA, 15 nt, Pseudomonas aeruginosa PA01
gcgcucaggcgcagc

SEQ ID NO: 3463013 - RNA, 20 nt, Pseudomonas aeruginosa PA01
gcgcucaggcgcagcguccu

SEQ ID NO: 3463014 - RNA, 14 nt, Pseudomonas aeruginosa PA01
gcgcucagggacac

SEQ ID NO: 3463015 - RNA, 20 nt, Pseudomonas aeruginosa PA01
gcgcucaugaaaaagccccu

SEQ ID NO: 3463016 - RNA, 14 nt, Pseudomonas aeruginosa PA01
gcgcuccaacagca

SEQ ID NO: 3463017 - RNA, 17 nt, Pseudomonas aeruginosa PA01
gcgcuccaacagcaggu

SEQ ID NO: 3463018 - RNA, 18 nt, Pseudomonas aeruginosa PA01
gcgcuccacagcugccag

SEQ ID NO: 3463019 - RNA, 19 nt, Pseudomonas aeruginosa PA01
gcgcuccacagcugccagc

SEQ ID NO: 3463020 - RNA, 15 nt, Pseudomonas aeruginosa PA01
gcgcuccaccagggc

SEQ ID NO: 3463021 - RNA, 17 nt, Pseudomonas aeruginosa PA01
gcgcuccaccagggccu

SEQ ID NO: 3463022 - RNA, 18 nt, Pseudomonas aeruginosa PA01
gcgcuccaccagggccuc

SEQ ID NO: 3463023 - RNA, 16 nt, Pseudomonas aeruginosa PA01
gcgcuccacccaggcg

SEQ ID NO: 3463024 - RNA, 20 nt, Pseudomonas aeruginosa PA01
gcgcuccacccaggcgccga

SEQ ID NO: 3463025 - RNA, 19 nt, Pseudomonas aeruginosa PA01
gcgcuccaccgcccccggc

SEQ ID NO: 3463026 - RNA, 20 nt, Pseudomonas aeruginosa PA01
gcgcuccagaugcuggagcu

SEQ ID NO: 3463027 - RNA, 18 nt, Pseudomonas aeruginosa PA01
gcgcuccaggcccggcag

SEQ ID NO: 3463028 - RNA, 20 nt, Pseudomonas aeruginosa PA01
gcgcugaccgcucccaggca

SEQ ID NO: 3463029 - RNA, 21 nt, Pseudomonas aeruginosa PA01
gcgcugaccgcucccaggcaa

SEQ ID NO: 3463030 - RNA, 23 nt, Pseudomonas aeruginosa PA01
gcgcugaccgcucccaggcaacg

SEQ ID NO: 3463031 - RNA, 21 nt, Pseudomonas aeruginosa PA01
gcgcugaccuggucguugcgc

SEQ ID NO: 3463032 - RNA, 15 nt, Pseudomonas aeruginosa PA01
gcgcugagcgccucg

SEQ ID NO: 3463033 - RNA, 23 nt, Pseudomonas aeruginosa PA01
gcgcugagcgccucgaucgccuc

SEQ ID NO: 3463034 - RNA, 14 nt, Pseudomonas aeruginosa PA01
gcgcugagcggaaa

SEQ ID NO: 3463035 - RNA, 21 nt, Pseudomonas aeruginosa PA01
gcgcugaggaagagcagcgcg

SEQ ID NO: 3463036 - RNA, 23 nt, Pseudomonas aeruginosa PA01
gcgcugaggaagagcagcgcggc

SEQ ID NO: 3463037 - RNA, 20 nt, Pseudomonas aeruginosa PA01
gcgcugaggaucagccagcc

SEQ ID NO: 3463038 - RNA, 21 nt, Pseudomonas aeruginosa PA01
gcgcugaggaucagccagccg

SEQ ID NO: 3463039 - RNA, 20 nt, Pseudomonas aeruginosa PA01
gcgcugaucacgaucggcac

SEQ ID NO: 3463040 - RNA, 21 nt, Pseudomonas aeruginosa PA01
gcgcugaucacgaucggcacc

SEQ ID NO: 3463041 - RNA, 22 nt, Pseudomonas aeruginosa PA01
gcgcugaucacgaucggcacca

SEQ ID NO: 3463042 - RNA, 16 nt, Pseudomonas aeruginosa PA01
gcgcugcaaucgcugc

SEQ ID NO: 3463043 - RNA, 19 nt, Pseudomonas aeruginosa PA01
gcgcugcaaucgcugccgg

SEQ ID NO: 3463044 - RNA, 12 nt, Pseudomonas aeruginosa PA01
gcgcugcaggcg

SEQ ID NO: 3463045 - RNA, 15 nt, Pseudomonas aeruginosa PA01
gcgcugcaucggcgc

SEQ ID NO: 3463046 - RNA, 16 nt, Pseudomonas aeruginosa PA01
gcgcugcaucggcgcg

SEQ ID NO: 3463047 - RNA, 20 nt, Pseudomonas aeruginosa PA01
gcgcugcaucggcgcgccga

SEQ ID NO: 3463048 - RNA, 19 nt, Pseudomonas aeruginosa PA01
gcgcugcaugggcucgcgc

SEQ ID NO: 3463049 - RNA, 14 nt, Pseudomonas aeruginosa PA01
gcgcugccagcgcc

SEQ ID NO: 3463050 - RNA, 15 nt, Pseudomonas aeruginosa PA01
gcgcugccagcgccg

SEQ ID NO: 3463051 - RNA, 23 nt, Pseudomonas aeruginosa PA01
gcgcugccagcgccgccgcgugg

SEQ ID NO: 3463052 - RNA, 16 nt, Pseudomonas aeruginosa PA01
gcgcugccaguggcgg

SEQ ID NO: 3463053 - RNA, 21 nt, Pseudomonas aeruginosa PA01
gcgcugccccuggcucaggca

SEQ ID NO: 3463054 - RNA, 22 nt, Pseudomonas aeruginosa PA01
gcgcugccccuggcucaggcac

SEQ ID NO: 3463055 - RNA, 21 nt, Pseudomonas aeruginosa PA01
gcgcugcccggcgcgacgcuc

SEQ ID NO: 3463056 - RNA, 19 nt, Pseudomonas aeruginosa PA01
gcgcugcccggguugaggu

SEQ ID NO: 3463057 - RNA, 19 nt, Pseudomonas aeruginosa PA01
gcgcugccgaacagcaggg

SEQ ID NO: 3463058 - RNA, 19 nt, Pseudomonas aeruginosa PA01
gcgcugccgcaugcagugg

SEQ ID NO: 3463059 - RNA, 14 nt, Pseudomonas aeruginosa PA01
gcgcugccggccag

SEQ ID NO: 3463060 - RNA, 15 nt, Pseudomonas aeruginosa PA01
gcgcugccggccagg

SEQ ID NO: 3463061 - RNA, 16 nt, Pseudomonas aeruginosa PA01
gcgcugccggccaggg

SEQ ID NO: 3463062 - RNA, 17 nt, Pseudomonas aeruginosa PA01
gcgcugccggccagggu

SEQ ID NO: 3463063 - RNA, 12 nt, Pseudomonas aeruginosa PA01
gcgcugccucgg

SEQ ID NO: 3463064 - RNA, 12 nt, Pseudomonas aeruginosa PA01
gcgcugccugca

SEQ ID NO: 3463065 - RNA, 16 nt, Pseudomonas aeruginosa PA01
gcgcugccugcaccgg

SEQ ID NO: 3463066 - RNA, 22 nt, Pseudomonas aeruginosa PA01
gcgcugccuucgaagccggcac

SEQ ID NO: 3463067 - RNA, 17 nt, Pseudomonas aeruginosa PA01
gcgcugcgaaucgucgc

SEQ ID NO: 3463068 - RNA, 18 nt, Pseudomonas aeruginosa PA01
gcgcugcgaaucgucgcc

SEQ ID NO: 3463069 - RNA, 21 nt, Pseudomonas aeruginosa PA01
gcgcugcgaaucgucgccgga

SEQ ID NO: 3463070 - RNA, 13 nt, Pseudomonas aeruginosa PA01
gcgcugcgccagg

SEQ ID NO: 3463071 - RNA, 12 nt, Pseudomonas aeruginosa PA01
gcgcugcgcggc

SEQ ID NO: 3463072 - RNA, 14 nt, Pseudomonas aeruginosa PA01
gcgcugcgcggccu

SEQ ID NO: 3463073 - RNA, 15 nt, Pseudomonas aeruginosa PA01
gcgcugcgcggccug

SEQ ID NO: 3463074 - RNA, 20 nt, Pseudomonas aeruginosa PA01
gcgcugcgcggccugcgccg

SEQ ID NO: 3463075 - RNA, 21 nt, Pseudomonas aeruginosa PA01
gcgcugcgcggccugcgccgg

SEQ ID NO: 3463076 - RNA, 20 nt, Pseudomonas aeruginosa PA01
gcgcugcgcggcgucggcga

SEQ ID NO: 3463077 - RNA, 22 nt, Pseudomonas aeruginosa PA01
gcgcugcggaagaaacugcggu

SEQ ID NO: 3463078 - RNA, 21 nt, Pseudomonas aeruginosa PA01
gcgcugcggcaggguggcgca

SEQ ID NO: 3463079 - RNA, 20 nt, Pseudomonas aeruginosa PA01
gcgcugcgggucauuggcga

SEQ ID NO: 3463080 - RNA, 21 nt, Pseudomonas aeruginosa PA01
gcgcugcguaguugagcccca

SEQ ID NO: 3463081 - RNA, 18 nt, Pseudomonas aeruginosa PA01
gcgcugcgugcgccgcuc

SEQ ID NO: 3463082 - RNA, 21 nt, Pseudomonas aeruginosa PA01
gcgcugcguggguagccgccc

SEQ ID NO: 3463083 - RNA, 22 nt, Pseudomonas aeruginosa PA01
gcgcugcguggguagccgccca

SEQ ID NO: 3463084 - RNA, 16 nt, Pseudomonas aeruginosa PA01
gcgcugcucgaccacc

SEQ ID NO: 3463085 - RNA, 16 nt, Pseudomonas aeruginosa PA01
gcgcugcucgauggcc

SEQ ID NO: 3463086 - RNA, 19 nt, Pseudomonas aeruginosa PA01
gcgcugcucgauggccuug

SEQ ID NO: 3463087 - RNA, 21 nt, Pseudomonas aeruginosa PA01
gcgcugcugccauccgcgccg

SEQ ID NO: 3463088 - RNA, 16 nt, Pseudomonas aeruginosa PA01
gcgcugcugggcggcg

SEQ ID NO: 3463089 - RNA, 21 nt, Pseudomonas aeruginosa PA01
gcgcugcugguagugcuggcg

SEQ ID NO: 3463090 - RNA, 20 nt, Pseudomonas aeruginosa PA01
gcgcuggaccauggccggcg

SEQ ID NO: 3463091 - RNA, 21 nt, Pseudomonas aeruginosa PA01
gcgcuggaccauggccggcgu

SEQ ID NO: 3463092 - RNA, 13 nt, Pseudomonas aeruginosa PA01
gcgcuggacccgc

SEQ ID NO: 3463093 - RNA, 14 nt, Pseudomonas aeruginosa PA01
gcgcuggaccuggc

SEQ ID NO: 3463094 - RNA, 16 nt, Pseudomonas aeruginosa PA01
gcgcuggaccuggccg

SEQ ID NO: 3463095 - RNA, 18 nt, Pseudomonas aeruginosa PA01
gcgcuggaccuggccggc

SEQ ID NO: 3463096 - RNA, 23 nt, Pseudomonas aeruginosa PA01
gcgcuggagagauagagcuucuc

SEQ ID NO: 3463097 - RNA, 21 nt, Pseudomonas aeruginosa PA01
gcgcuggaguaucgcccuggc

SEQ ID NO: 3463098 - RNA, 19 nt, Pseudomonas aeruginosa PA01
gcgcuggaugcccuccugg

SEQ ID NO: 3463099 - RNA, 18 nt, Pseudomonas aeruginosa PA01
gcgcuggauuucgccgag

SEQ ID NO: 3463100 - RNA, 19 nt, Pseudomonas aeruginosa PA01
gcgcuggauuucgccgagu

SEQ ID NO: 3463101 - RNA, 12 nt, Pseudomonas aeruginosa PA01
gcgcuggccagc

SEQ ID NO: 3463102 - RNA, 15 nt, Pseudomonas aeruginosa PA01
gcgcuggccagcgcu

SEQ ID NO: 3463103 - RNA, 16 nt, Pseudomonas aeruginosa PA01
gcgcuggccagcgcuu

SEQ ID NO: 3463104 - RNA, 14 nt, Pseudomonas aeruginosa PA01
gcgcuggccaggua

SEQ ID NO: 3463105 - RNA, 15 nt, Pseudomonas aeruginosa PA01
gcgcuggccagguag

SEQ ID NO: 3463106 - RNA, 15 nt, Pseudomonas aeruginosa PA01
gcgcuggccaguucc

SEQ ID NO: 3463107 - RNA, 16 nt, Pseudomonas aeruginosa PA01
gcgcuggccaguucca

SEQ ID NO: 3463108 - RNA, 15 nt, Pseudomonas aeruginosa PA01
gcgcuggccgagcug

SEQ ID NO: 3463109 - RNA, 19 nt, Pseudomonas aeruginosa PA01
gcgcuggccgagcugccgc

SEQ ID NO: 3463110 - RNA, 15 nt, Pseudomonas aeruginosa PA01
gcgcuggccgcgcga

SEQ ID NO: 3463111 - RNA, 22 nt, Pseudomonas aeruginosa PA01
gcgcuggccgcgcgaccgcggc

SEQ ID NO: 3463112 - RNA, 12 nt, Pseudomonas aeruginosa PA01
gcgcuggccggc

SEQ ID NO: 3463113 - RNA, 13 nt, Pseudomonas aeruginosa PA01
gcgcuggcgauca

SEQ ID NO: 3463114 - RNA, 19 nt, Pseudomonas aeruginosa PA01
gcgcuggcgaucaccaggg

SEQ ID NO: 3463115 - RNA, 23 nt, Pseudomonas aeruginosa PA01
gcgcuggcgaucaccagggugcg

SEQ ID NO: 3463116 - RNA, 13 nt, Pseudomonas aeruginosa PA01
gcgcuggcgcagc

SEQ ID NO: 3463117 - RNA, 14 nt, Pseudomonas aeruginosa PA01
gcgcuggcgcagca

SEQ ID NO: 3463118 - RNA, 15 nt, Pseudomonas aeruginosa PA01
gcgcuggcgcagcag

SEQ ID NO: 3463119 - RNA, 20 nt, Pseudomonas aeruginosa PA01
gcgcuggcgcagcggguccu

SEQ ID NO: 3463120 - RNA, 14 nt, Pseudomonas aeruginosa PA01
gcgcuggcgcggau

SEQ ID NO: 3463121 - RNA, 21 nt, Pseudomonas aeruginosa PA01
gcgcuggcgcuguaggcgagc

SEQ ID NO: 3463122 - RNA, 20 nt, Pseudomonas aeruginosa PA01
gcgcugggccuugagcaggc

SEQ ID NO: 3463123 - RNA, 21 nt, Pseudomonas aeruginosa PA01
gcgcugggccuugagcaggcg

SEQ ID NO: 3463124 - RNA, 13 nt, Pseudomonas aeruginosa PA01
gcgcugggcgcag

SEQ ID NO: 3463125 - RNA, 14 nt, Pseudomonas aeruginosa PA01
gcgcugggcgcagc

SEQ ID NO: 3463126 - RNA, 16 nt, Pseudomonas aeruginosa PA01
gcgcugggcgcagccc

SEQ ID NO: 3463127 - RNA, 15 nt, Pseudomonas aeruginosa PA01
gcgcugggcgccgau

SEQ ID NO: 3463128 - RNA, 16 nt, Pseudomonas aeruginosa PA01
gcgcugggcgccgauu

SEQ ID NO: 3463129 - RNA, 16 nt, Pseudomonas aeruginosa PA01
gcgcugggcggcuggc

SEQ ID NO: 3463130 - RNA, 15 nt, Pseudomonas aeruginosa PA01
gcggaaaccgcggcc

SEQ ID NO: 3463131 - RNA, 19 nt, Pseudomonas aeruginosa PA01
gcggaaaccgcggccggcu

SEQ ID NO: 3463132 - RNA, 16 nt, Pseudomonas aeruginosa PA01
gcggaaaccugcaacu

SEQ ID NO: 3463133 - RNA, 18 nt, Pseudomonas aeruginosa PA01
gcggaaacggaccccaug

SEQ ID NO: 3463134 - RNA, 15 nt, Pseudomonas aeruginosa PA01
gcggaaagcgacgcc

SEQ ID NO: 3463135 - RNA, 17 nt, Pseudomonas aeruginosa PA01
gcggaaagcgacgccgc

SEQ ID NO: 3463136 - RNA, 19 nt, Pseudomonas aeruginosa PA01
gcggaaagcgacgccgcga

SEQ ID NO: 3463137 - RNA, 15 nt, Pseudomonas aeruginosa PA01
gcggaaauacggcuc

SEQ ID NO: 3463138 - RNA, 16 nt, Pseudomonas aeruginosa PA01
gcggaaaugcucgccg

SEQ ID NO: 3463139 - RNA, 16 nt, Pseudomonas aeruginosa PA01
gcggaacaccgccugg

SEQ ID NO: 3463140 - RNA, 15 nt, Pseudomonas aeruginosa PA01
gcggaacaucgcccg

SEQ ID NO: 3463141 - RNA, 17 nt, Pseudomonas aeruginosa PA01
gcggaacaucgcccggc

SEQ ID NO: 3463142 - RNA, 19 nt, Pseudomonas aeruginosa PA01
gcggaaccagugcgcgguc

SEQ ID NO: 3463143 - RNA, 22 nt, Pseudomonas aeruginosa PA01
gcggaacgcggcuucggucagg

SEQ ID NO: 3463144 - RNA, 20 nt, Pseudomonas aeruginosa PA01
gcggaacggcucgcgaccga

SEQ ID NO: 3463145 - RNA, 18 nt, Pseudomonas aeruginosa PA01
gcggaacggcucgcgggu

SEQ ID NO: 3463146 - RNA, 20 nt, Pseudomonas aeruginosa PA01
gcggaacggcucgcggguca

SEQ ID NO: 3463147 - RNA, 22 nt, Pseudomonas aeruginosa PA01
gcggaacucauucaucucgccg

SEQ ID NO: 3463148 - RNA, 22 nt, Pseudomonas aeruginosa PA01
gcggaacuugcgccgaccgcgc

SEQ ID NO: 3463149 - RNA, 15 nt, Pseudomonas aeruginosa PA01
gcggaacuugucgcc

SEQ ID NO: 3463150 - RNA, 16 nt, Pseudomonas aeruginosa PA01
gcggaacuugucgccg

SEQ ID NO: 3463151 - RNA, 17 nt, Pseudomonas aeruginosa PA01
gcggaacuugucgccgc

SEQ ID NO: 3463152 - RNA, 20 nt, Pseudomonas aeruginosa PA01
gcggaagaauaccgccagcu

SEQ ID NO: 3463153 - RNA, 20 nt, Pseudomonas aeruginosa PA01
gcggaagaaucgcagccaug

SEQ ID NO: 3463154 - RNA, 23 nt, Pseudomonas aeruginosa PA01
gcggaagcacggcucggcgagga

SEQ ID NO: 3463155 - RNA, 14 nt, Pseudomonas aeruginosa PA01
gcggaagcagccau

SEQ ID NO: 3463156 - RNA, 22 nt, Pseudomonas aeruginosa PA01
gcggaagccgucggcgaucgcc

SEQ ID NO: 3463157 - RNA, 17 nt, Pseudomonas aeruginosa PA01
gcggaagccgugcaacu

SEQ ID NO: 3463158 - RNA, 20 nt, Pseudomonas aeruginosa PA01
gcggaagccgugcaacuggg

SEQ ID NO: 3463159 - RNA, 19 nt, Pseudomonas aeruginosa PA01
gcggaagcguugcucgagc

SEQ ID NO: 3463160 - RNA, 14 nt, Pseudomonas aeruginosa PA01
gcggaaggcccgcg

SEQ ID NO: 3463161 - RNA, 20 nt, Pseudomonas aeruginosa PA01
gcggaaggcccgcgagccgc

SEQ ID NO: 3463162 - RNA, 14 nt, Pseudomonas aeruginosa PA01
gcggaaggccucgg

SEQ ID NO: 3463163 - RNA, 14 nt, Pseudomonas aeruginosa PA01
gcggaaggcggcgu

SEQ ID NO: 3463164 - RNA, 17 nt, Pseudomonas aeruginosa PA01
gcggaaguaggcggcgg

SEQ ID NO: 3463165 - RNA, 20 nt, Pseudomonas aeruginosa PA01
gcggaaguaggcggcggagu

SEQ ID NO: 3463166 - RNA, 14 nt, Pseudomonas aeruginosa PA01
gcggaagucggcgg

SEQ ID NO: 3463167 - RNA, 15 nt, Pseudomonas aeruginosa PA01
gcggaagugcgccgg

SEQ ID NO: 3463168 - RNA, 16 nt, Pseudomonas aeruginosa PA01
gcggaagugcgccggu

SEQ ID NO: 3463169 - RNA, 20 nt, Pseudomonas aeruginosa PA01
gcggaagugcggggugaucu

SEQ ID NO: 3463170 - RNA, 23 nt, Pseudomonas aeruginosa PA01
gcggaagugcggggugaucuuuu

SEQ ID NO: 3463171 - RNA, 19 nt, Pseudomonas aeruginosa PA01
gcggaauaacucagcauca

SEQ ID NO: 3463172 - RNA, 20 nt, Pseudomonas aeruginosa PA01
gcggaauccuucgcggcggc

SEQ ID NO: 3463173 - RNA, 22 nt, Pseudomonas aeruginosa PA01
gcggaauccuucgcggcggcgc

SEQ ID NO: 3463174 - RNA, 16 nt, Pseudomonas aeruginosa PA01
gcggaauuccugcucg

SEQ ID NO: 3463175 - RNA, 17 nt, Pseudomonas aeruginosa PA01
gcggaauuccugcucga

SEQ ID NO: 3463176 - RNA, 17 nt, Pseudomonas aeruginosa PA01
gcggacaaccaccaugc

SEQ ID NO: 3463177 - RNA, 23 nt, Pseudomonas aeruginosa PA01
gcggacaacccggcgcuggccgc

SEQ ID NO: 3463178 - RNA, 14 nt, Pseudomonas aeruginosa PA01
gcggacaaccgccg

SEQ ID NO: 3463179 - RNA, 16 nt, Pseudomonas aeruginosa PA01
gcggacaagcccagcu

SEQ ID NO: 3463180 - RNA, 13 nt, Pseudomonas aeruginosa PA01
gcggacaccgcgg

SEQ ID NO: 3463181 - RNA, 14 nt, Pseudomonas aeruginosa PA01
gcggacaccgcggu

SEQ ID NO: 3463182 - RNA, 20 nt, Pseudomonas aeruginosa PA01
gcggacaccgcggugucggu

SEQ ID NO: 3463183 - RNA, 23 nt, Pseudomonas aeruginosa PA01
gcggacaccgcggugucggugcc

SEQ ID NO: 3463184 - RNA, 14 nt, Pseudomonas aeruginosa PA01
gcggacacgcaggc

SEQ ID NO: 3463185 - RNA, 16 nt, Pseudomonas aeruginosa PA01
gcggacacgcaggcgc

SEQ ID NO: 3463186 - RNA, 19 nt, Pseudomonas aeruginosa PA01
gcggacacgcaggcgccga

SEQ ID NO: 3463187 - RNA, 13 nt, Pseudomonas aeruginosa PA01
gcggacagcccgc

SEQ ID NO: 3463188 - RNA, 16 nt, Pseudomonas aeruginosa PA01
gcggacagcccgcgcu

SEQ ID NO: 3463189 - RNA, 15 nt, Pseudomonas aeruginosa PA01
gcggacaggcagccg

SEQ ID NO: 3463190 - RNA, 17 nt, Pseudomonas aeruginosa PA01
gcggacaggcagccggc

SEQ ID NO: 3463191 - RNA, 23 nt, Pseudomonas aeruginosa PA01
gcggacaggcagccggccaugcu

SEQ ID NO: 3463192 - RNA, 21 nt, Pseudomonas aeruginosa PA01
gcggacaugaaaaagccggag

SEQ ID NO: 3463193 - RNA, 23 nt, Pseudomonas aeruginosa PA01
gcggacauguugcagggucgccg

SEQ ID NO: 3463194 - RNA, 14 nt, Pseudomonas aeruginosa PA01
gcggaccacagggc

SEQ ID NO: 3463195 - RNA, 12 nt, Pseudomonas aeruginosa PA01
gcggaccagcuc

SEQ ID NO: 3463196 - RNA, 14 nt, Pseudomonas aeruginosa PA01
gcggaccagcuccg

SEQ ID NO: 3463197 - RNA, 20 nt, Pseudomonas aeruginosa PA01
gcggacccaguugggccagg

SEQ ID NO: 3463198 - RNA, 18 nt, Pseudomonas aeruginosa PA01
gcggaccccggccuccag

SEQ ID NO: 3463199 - RNA, 23 nt, Pseudomonas aeruginosa PA01
gcggaccccggccuccaggcugg

SEQ ID NO: 3463200 - RNA, 15 nt, Pseudomonas aeruginosa PA01
gcggacccgcgccgg

SEQ ID NO: 3463201 - RNA, 16 nt, Pseudomonas aeruginosa PA01
gcggacccgcgccggc

SEQ ID NO: 3463202 - RNA, 20 nt, Pseudomonas aeruginosa PA01
gcggacccgcgccggcagcu

SEQ ID NO: 3463203 - RNA, 16 nt, Pseudomonas aeruginosa PA01
gcggaccgcaaccggu

SEQ ID NO: 3463204 - RNA, 22 nt, Pseudomonas aeruginosa PA01
gcggaccgcagaaccagacgcu

SEQ ID NO: 3463205 - RNA, 14 nt, Pseudomonas aeruginosa PA01
gcggaccgccucga

SEQ ID NO: 3463206 - RNA, 18 nt, Pseudomonas aeruginosa PA01
gcggaccgccucgaccau

SEQ ID NO: 3463207 - RNA, 21 nt, Pseudomonas aeruginosa PA01
gcggaccgccucgaccaucgg

SEQ ID NO: 3463208 - RNA, 23 nt, Pseudomonas aeruginosa PA01
gcggaccgccucgaccaucggcg

SEQ ID NO: 3463209 - RNA, 16 nt, Pseudomonas aeruginosa PA01
gcggaccgggcggcgc

SEQ ID NO: 3463210 - RNA, 20 nt, Pseudomonas aeruginosa PA01
gcggaccgggcggcgcggcg

SEQ ID NO: 3463211 - RNA, 22 nt, Pseudomonas aeruginosa PA01
gcggaccgggcggcgcggcgca

SEQ ID NO: 3463212 - RNA, 14 nt, Pseudomonas aeruginosa PA01
gcggaccgucgggc

SEQ ID NO: 3463213 - RNA, 15 nt, Pseudomonas aeruginosa PA01
gcggaccuccagccg

SEQ ID NO: 3463214 - RNA, 18 nt, Pseudomonas aeruginosa PA01
gcggaccuccagccggcc

SEQ ID NO: 3463215 - RNA, 22 nt, Pseudomonas aeruginosa PA01
gcggaccuccagccggccaucc

SEQ ID NO: 3463216 - RNA, 23 nt, Pseudomonas aeruginosa PA01
gcggaccuccagccggccaucca

SEQ ID NO: 3463217 - RNA, 12 nt, Pseudomonas aeruginosa PA01
gcggaccuccgc

SEQ ID NO: 3463218 - RNA, 13 nt, Pseudomonas aeruginosa PA01
gcggaccuccgcc

SEQ ID NO: 3463219 - RNA, 16 nt, Pseudomonas aeruginosa PA01
gcggaccuccgccagg

SEQ ID NO: 3463220 - RNA, 17 nt, Pseudomonas aeruginosa PA01
gcggaccuccgccaggu

SEQ ID NO: 3463221 - RNA, 23 nt, Pseudomonas aeruginosa PA01
gcggaccuccgccaggucgaucc

SEQ ID NO: 3463222 - RNA, 20 nt, Pseudomonas aeruginosa PA01
gcggaccucugcguucugcu

SEQ ID NO: 3463223 - RNA, 21 nt, Pseudomonas aeruginosa PA01
gcggaccucugcguucugcug

SEQ ID NO: 3463224 - RNA, 16 nt, Pseudomonas aeruginosa PA01
gcggaccuucgacggc

SEQ ID NO: 3463225 - RNA, 17 nt, Pseudomonas aeruginosa PA01
gcggaccuucgacggca

SEQ ID NO: 3463226 - RNA, 20 nt, Pseudomonas aeruginosa PA01
gcggaccuugucgccgguga

SEQ ID NO: 3463227 - RNA, 21 nt, Pseudomonas aeruginosa PA01
gcggacgacgaagugaccgcg

SEQ ID NO: 3463228 - RNA, 20 nt, Pseudomonas aeruginosa PA01
gcggacgaggauggucaggc

SEQ ID NO: 3463229 - RNA, 17 nt, Pseudomonas aeruginosa PA01
gcggacgauggucgccg

SEQ ID NO: 3463230 - RNA, 18 nt, Pseudomonas aeruginosa PA01
gcggacgauggucgccgc

SEQ ID NO: 3463231 - RNA, 22 nt, Pseudomonas aeruginosa PA01
gcggacgauggucgccgcgacc

SEQ ID NO: 3463232 - RNA, 20 nt, Pseudomonas aeruginosa PA01
gcggacgcaggccgaccucg

SEQ ID NO: 3463233 - RNA, 13 nt, Pseudomonas aeruginosa PA01
gcggacgccgaag

SEQ ID NO: 3463234 - RNA, 14 nt, Pseudomonas aeruginosa PA01
gcggacgcuggcga

SEQ ID NO: 3463235 - RNA, 17 nt, Pseudomonas aeruginosa PA01
gcggacgcuggcgauca

SEQ ID NO: 3463236 - RNA, 14 nt, Pseudomonas aeruginosa PA01
gcggacggccggcu

SEQ ID NO: 3463237 - RNA, 15 nt, Pseudomonas aeruginosa PA01
gcggacgggccgcgc

SEQ ID NO: 3463238 - RNA, 17 nt, Pseudomonas aeruginosa PA01
gcggacgggccgcgccg

SEQ ID NO: 3463239 - RNA, 21 nt, Pseudomonas aeruginosa PA01
gcggacgggccgcgccgcaag

SEQ ID NO: 3463240 - RNA, 21 nt, Pseudomonas aeruginosa PA01
gcggacuaccuucgaucaccc

SEQ ID NO: 3463241 - RNA, 17 nt, Pseudomonas aeruginosa PA01
gcggacuccggaggcgc

SEQ ID NO: 3463242 - RNA, 18 nt, Pseudomonas aeruginosa PA01
gcggacuccggaggcgca

SEQ ID NO: 3463243 - RNA, 22 nt, Pseudomonas aeruginosa PA01
gcggacuccggaggcgcacagg

SEQ ID NO: 3463244 - RNA, 18 nt, Pseudomonas aeruginosa PA01
gcggacugcucgccgccg

SEQ ID NO: 3463245 - RNA, 19 nt, Pseudomonas aeruginosa PA01
gcggacugcucgccgccgg

SEQ ID NO: 3463246 - RNA, 20 nt, Pseudomonas aeruginosa PA01
gcggacugcucgccgccggc

SEQ ID NO: 3463247 - RNA, 22 nt, Pseudomonas aeruginosa PA01
gcggacugcucgccgccggcga

SEQ ID NO: 3463248 - RNA, 21 nt, Pseudomonas aeruginosa PA01
gcggagaagccgcugaccucg

SEQ ID NO: 3463249 - RNA, 17 nt, Pseudomonas aeruginosa PA01
gcggagaggaucagcga

SEQ ID NO: 3463250 - RNA, 20 nt, Pseudomonas aeruginosa PA01
gcggagaggaucagcgaacc

SEQ ID NO: 3463251 - RNA, 23 nt, Pseudomonas aeruginosa PA01
gcggagaggaucagcgaacccgg

SEQ ID NO: 3463252 - RNA, 14 nt, Pseudomonas aeruginosa PA01
gcggagagguggcc

SEQ ID NO: 3463253 - RNA, 17 nt, Pseudomonas aeruginosa PA01
gcggagagguggccgag

SEQ ID NO: 3463254 - RNA, 13 nt, Pseudomonas aeruginosa PA01
gcggagcagccuc

SEQ ID NO: 3463255 - RNA, 16 nt, Pseudomonas aeruginosa PA01
gcggagcagccucagu

SEQ ID NO: 3463256 - RNA, 19 nt, Pseudomonas aeruginosa PA01
gcggagccgucggcuccgc

SEQ ID NO: 3463257 - RNA, 18 nt, Pseudomonas aeruginosa PA01
gcggagcguccaccagcg

SEQ ID NO: 3463258 - RNA, 20 nt, Pseudomonas aeruginosa PA01
gcggagcguccaccagcgcc

SEQ ID NO: 3463259 - RNA, 23 nt, Pseudomonas aeruginosa PA01
gcggagcguccaccagcgcccgu

SEQ ID NO: 3463260 - RNA, 17 nt, Pseudomonas aeruginosa PA01
gcggagcgucggaagcg

SEQ ID NO: 3463261 - RNA, 15 nt, Pseudomonas aeruginosa PA01
gcggagcgucgggcg

SEQ ID NO: 3463262 - RNA, 12 nt, Pseudomonas aeruginosa PA01
gcggagcuggaa

SEQ ID NO: 3463263 - RNA, 19 nt, Pseudomonas aeruginosa PA01
gcggagcuggaaauggcgg

SEQ ID NO: 3463264 - RNA, 21 nt, Pseudomonas aeruginosa PA01
gcggagcuggaaauggcgguc

SEQ ID NO: 3463265 - RNA, 23 nt, Pseudomonas aeruginosa PA01
gcggagcuggaaauggcggucgc

SEQ ID NO: 3463266 - RNA, 16 nt, Pseudomonas aeruginosa PA01
gcggaggauucagcag

SEQ ID NO: 3463267 - RNA, 17 nt, Pseudomonas aeruginosa PA01
gcggaggauucagcagg

SEQ ID NO: 3463268 - RNA, 17 nt, Pseudomonas aeruginosa PA01
gcggaggcgaggucgcc

SEQ ID NO: 3463269 - RNA, 22 nt, Pseudomonas aeruginosa PA01
gcggaggcgaggucgccggggc

SEQ ID NO: 3463270 - RNA, 21 nt, Pseudomonas aeruginosa PA01
gcggaggguaaacgcgaaugc

SEQ ID NO: 3463271 - RNA, 17 nt, Pseudomonas aeruginosa PA01
gcggagggucaggccga

SEQ ID NO: 3463272 - RNA, 19 nt, Pseudomonas aeruginosa PA01
gcggagggucaggccgagg

SEQ ID NO: 3463273 - RNA, 23 nt, Pseudomonas aeruginosa PA01
gcggaguagccggcggcgaacag

SEQ ID NO: 3463274 - RNA, 13 nt, Pseudomonas aeruginosa PA01
gcggagucgccgg

SEQ ID NO: 3463275 - RNA, 15 nt, Pseudomonas aeruginosa PA01
gcggagucgccgguu

SEQ ID NO: 3463276 - RNA, 16 nt, Pseudomonas aeruginosa PA01
gcggagucgccgguuc

SEQ ID NO: 3463277 - RNA, 15 nt, Pseudomonas aeruginosa PA01
gcggagucguagcgc

SEQ ID NO: 3463278 - RNA, 17 nt, Pseudomonas aeruginosa PA01
gcggauaacgccacagg

SEQ ID NO: 3463279 - RNA, 14 nt, Pseudomonas aeruginosa PA01
gcggauaacgccag

SEQ ID NO: 3463280 - RNA, 15 nt, Pseudomonas aeruginosa PA01
gcggauaacgccagg

SEQ ID NO: 3463281 - RNA, 17 nt, Pseudomonas aeruginosa PA01
gcggauaacgccaggac

SEQ ID NO: 3463282 - RNA, 14 nt, Pseudomonas aeruginosa PA01
gcggauaacgccga

SEQ ID NO: 3463283 - RNA, 20 nt, Pseudomonas aeruginosa PA01
gcggauaacgccgcuggcgu

SEQ ID NO: 3463284 - RNA, 14 nt, Pseudomonas aeruginosa PA01
gcggauaacgccgg

SEQ ID NO: 3463285 - RNA, 19 nt, Pseudomonas aeruginosa PA01
gcggauaacgccugcggcg

SEQ ID NO: 3463286 - RNA, 16 nt, Pseudomonas aeruginosa PA01
gcggauaacgcuaccc

SEQ ID NO: 3463287 - RNA, 19 nt, Pseudomonas aeruginosa PA01
gcggauaacgcuucgcagc

SEQ ID NO: 3463288 - RNA, 20 nt, Pseudomonas aeruginosa PA01
gcggauaacgcuucgcagca

SEQ ID NO: 3463289 - RNA, 20 nt, Pseudomonas aeruginosa PA01
gcggauaagcaagcgcaacg

SEQ ID NO: 3463290 - RNA, 21 nt, Pseudomonas aeruginosa PA01
gcggauaaucgcagcgcgguc

SEQ ID NO: 3463291 - RNA, 17 nt, Pseudomonas aeruginosa PA01
gcggauacaggcgcagc

SEQ ID NO: 3463292 - RNA, 18 nt, Pseudomonas aeruginosa PA01
gcggauacaggcgcagca

SEQ ID NO: 3463293 - RNA, 21 nt, Pseudomonas aeruginosa PA01
gcggauagagcuucccgcaug

SEQ ID NO: 3463294 - RNA, 15 nt, Pseudomonas aeruginosa PA01
gcggauagccaacca

SEQ ID NO: 3463295 - RNA, 18 nt, Pseudomonas aeruginosa PA01
gcggauagcgcgcaggcg

SEQ ID NO: 3463296 - RNA, 17 nt, Pseudomonas aeruginosa PA01
gcggauauagcugguca

SEQ ID NO: 3463297 - RNA, 15 nt, Pseudomonas aeruginosa PA01
gcggauaucgcgccg

SEQ ID NO: 3463298 - RNA, 14 nt, Pseudomonas aeruginosa PA01
gcggauaucgcgug

SEQ ID NO: 3463299 - RNA, 20 nt, Pseudomonas aeruginosa PA01
gcggauaucgcguggugaug

SEQ ID NO: 3463300 - RNA, 20 nt, Pseudomonas aeruginosa PA01
gcggauaucgcuggcgccca

SEQ ID NO: 3463301 - RNA, 23 nt, Pseudomonas aeruginosa PA01
gcggauaucggccucggucaggu

SEQ ID NO: 3463302 - RNA, 23 nt, Pseudomonas aeruginosa PA01
gcggauauucgacgcgcggcugc

SEQ ID NO: 3463303 - RNA, 15 nt, Pseudomonas aeruginosa PA01
gcggaucaacgccgg

SEQ ID NO: 3463304 - RNA, 21 nt, Pseudomonas aeruginosa PA01
gcggaucaacuccgccaggcg

SEQ ID NO: 3463305 - RNA, 23 nt, Pseudomonas aeruginosa PA01
gcggaucaacuccgccaggcgcu

SEQ ID NO: 3463306 - RNA, 13 nt, Pseudomonas aeruginosa PA01
gcggaucacaggc

SEQ ID NO: 3463307 - RNA, 19 nt, Pseudomonas aeruginosa PA01
gcggaucacaggcucuucu

SEQ ID NO: 3463308 - RNA, 13 nt, Pseudomonas aeruginosa PA01
gcggaucaccggc

SEQ ID NO: 3463309 - RNA, 19 nt, Pseudomonas aeruginosa PA01
gcggaucaccggcuggccc

SEQ ID NO: 3463310 - RNA, 13 nt, Pseudomonas aeruginosa PA01
gcggaucaccugg

SEQ ID NO: 3463311 - RNA, 14 nt, Pseudomonas aeruginosa PA01
gcggaucaccuggc

SEQ ID NO: 3463312 - RNA, 17 nt, Pseudomonas aeruginosa PA01
gcggaucaccuggccgu

SEQ ID NO: 3463313 - RNA, 16 nt, Pseudomonas aeruginosa PA01
gcggaucagcccgcug

SEQ ID NO: 3463314 - RNA, 13 nt, Pseudomonas aeruginosa PA01
gcggaucagccgg

SEQ ID NO: 3463315 - RNA, 14 nt, Pseudomonas aeruginosa PA01
gcggaucagccggc

SEQ ID NO: 3463316 - RNA, 17 nt, Pseudomonas aeruginosa PA01
gcggaucagccggccca

SEQ ID NO: 3463317 - RNA, 19 nt, Pseudomonas aeruginosa PA01
gcggaucagcucgaucagc

SEQ ID NO: 3463318 - RNA, 20 nt, Pseudomonas aeruginosa PA01
gcggaucagcucgaucagcc

SEQ ID NO: 3463319 - RNA, 21 nt, Pseudomonas aeruginosa PA01
gcggaucagucaggaucggcg

SEQ ID NO: 3463320 - RNA, 20 nt, Pseudomonas aeruginosa PA01
gcggauccccucccgcgcca

SEQ ID NO: 3463321 - RNA, 22 nt, Pseudomonas aeruginosa PA01
gcggauccccucccgcgccagc

SEQ ID NO: 3463322 - RNA, 17 nt, Pseudomonas aeruginosa PA01
gcggauccggguggaga

SEQ ID NO: 3463323 - RNA, 20 nt, Pseudomonas aeruginosa PA01
gcggauccggguggagaggc

SEQ ID NO: 3463324 - RNA, 15 nt, Pseudomonas aeruginosa PA01
gcggaucgagcagcg

SEQ ID NO: 3463325 - RNA, 20 nt, Pseudomonas aeruginosa PA01
gcggaucgagcagcggcgcc

SEQ ID NO: 3463326 - RNA, 21 nt, Pseudomonas aeruginosa PA01
gcggaucgagcagcggcgcca

SEQ ID NO: 3463327 - RNA, 13 nt, Pseudomonas aeruginosa PA01
gcggaucgaggaa

SEQ ID NO: 3463328 - RNA, 18 nt, Pseudomonas aeruginosa PA01
gcggaucgaucagcagca

SEQ ID NO: 3463329 - RNA, 15 nt, Pseudomonas aeruginosa PA01
gcggaucgaucagcg

SEQ ID NO: 3463330 - RNA, 19 nt, Pseudomonas aeruginosa PA01
gcggaucgaucgaucagcc

SEQ ID NO: 3463331 - RNA, 21 nt, Pseudomonas aeruginosa PA01
gcggaucgaucgaucagccgu

SEQ ID NO: 3463332 - RNA, 15 nt, Pseudomonas aeruginosa PA01
gcggaucgccaacca

SEQ ID NO: 3463333 - RNA, 15 nt, Pseudomonas aeruginosa PA01
gcggaucgcccggcg

SEQ ID NO: 3463334 - RNA, 19 nt, Pseudomonas aeruginosa PA01
gcggcagcgccaucaggcc

SEQ ID NO: 3463335 - RNA, 20 nt, Pseudomonas aeruginosa PA01
gcggcagcgccaucaggccc

SEQ ID NO: 3463336 - RNA, 21 nt, Pseudomonas aeruginosa PA01
gcggcagcggugaagguccgc

SEQ ID NO: 3463337 - RNA, 14 nt, Pseudomonas aeruginosa PA01
gcggcagcgguucg

SEQ ID NO: 3463338 - RNA, 18 nt, Pseudomonas aeruginosa PA01
gcggcagcgucucggcug

SEQ ID NO: 3463339 - RNA, 21 nt, Pseudomonas aeruginosa PA01
gcggcagcgucucggcugccg

SEQ ID NO: 3463340 - RNA, 22 nt, Pseudomonas aeruginosa PA01
gcggcagcgucucggcugccgc

SEQ ID NO: 3463341 - RNA, 16 nt, Pseudomonas aeruginosa PA01
gcggcagcgugcucac

SEQ ID NO: 3463342 - RNA, 13 nt, Pseudomonas aeruginosa PA01
gcggcagcucggc

SEQ ID NO: 3463343 - RNA, 13 nt, Pseudomonas aeruginosa PA01
gcggcagcugcgg

SEQ ID NO: 3463344 - RNA, 17 nt, Pseudomonas aeruginosa PA01
gcggcagcugcggcggc

SEQ ID NO: 3463345 - RNA, 18 nt, Pseudomonas aeruginosa PA01
gcggcagcugcggcggca

SEQ ID NO: 3463346 - RNA, 21 nt, Pseudomonas aeruginosa PA01
gcggcagcugcggcggcacca

SEQ ID NO: 3463347 - RNA, 15 nt, Pseudomonas aeruginosa PA01
gcggcagcuuggcga

SEQ ID NO: 3463348 - RNA, 21 nt, Pseudomonas aeruginosa PA01
gcggcaggaaauccgccgcgc

SEQ ID NO: 3463349 - RNA, 22 nt, Pseudomonas aeruginosa PA01
gcggcaggaaauccgccgcgca

SEQ ID NO: 3463350 - RNA, 15 nt, Pseudomonas aeruginosa PA01
gcggcaggacccaga

SEQ ID NO: 3463351 - RNA, 18 nt, Pseudomonas aeruginosa PA01
gcggcaggacccagaaac

SEQ ID NO: 3463352 - RNA, 16 nt, Pseudomonas aeruginosa PA01
gcggcaggaucaggcu

SEQ ID NO: 3463353 - RNA, 22 nt, Pseudomonas aeruginosa PA01
gcggcaggaucaggcucgagcc

SEQ ID NO: 3463354 - RNA, 20 nt, Pseudomonas aeruginosa PA01
gcggcaggcacgcugccagc

SEQ ID NO: 3463355 - RNA, 22 nt, Pseudomonas aeruginosa PA01
gcggcaggcacgcugccagcag

SEQ ID NO: 3463356 - RNA, 13 nt, Pseudomonas aeruginosa PA01
gcggcaggccagc

SEQ ID NO: 3463357 - RNA, 14 nt, Pseudomonas aeruginosa PA01
gcggcaggccagcu

SEQ ID NO: 3463358 - RNA, 12 nt, Pseudomonas aeruginosa PA01
gcggcaggccga

SEQ ID NO: 3463359 - RNA, 12 nt, Pseudomonas aeruginosa PA01
gcggcaggcgca

SEQ ID NO: 3463360 - RNA, 20 nt, Pseudomonas aeruginosa PA01
gcggcaggcgccaaccgggc

SEQ ID NO: 3463361 - RNA, 14 nt, Pseudomonas aeruginosa PA01
gcggcaggcgccgg

SEQ ID NO: 3463362 - RNA, 16 nt, Pseudomonas aeruginosa PA01
gcggcaggcgccggcc

SEQ ID NO: 3463363 - RNA, 20 nt, Pseudomonas aeruginosa PA01
gcggcaggcgccggccgggc

SEQ ID NO: 3463364 - RNA, 21 nt, Pseudomonas aeruginosa PA01
gcggcaggcgccggccgggcu

SEQ ID NO: 3463365 - RNA, 12 nt, Pseudomonas aeruginosa PA01
gcggcaggcggc

SEQ ID NO: 3463366 - RNA, 17 nt, Pseudomonas aeruginosa PA01
gcggcaggcggcggcgu

SEQ ID NO: 3463367 - RNA, 13 nt, Pseudomonas aeruginosa PA01
gcggcaggcugcg

SEQ ID NO: 3463368 - RNA, 15 nt, Pseudomonas aeruginosa PA01
gcggcaggcugcgcc

SEQ ID NO: 3463369 - RNA, 16 nt, Pseudomonas aeruginosa PA01
gcggcaggcugcgccg

SEQ ID NO: 3463370 - RNA, 15 nt, Pseudomonas aeruginosa PA01
gcggcagggcggcga

SEQ ID NO: 3463371 - RNA, 14 nt, Pseudomonas aeruginosa PA01
gcggcaggguacgg

SEQ ID NO: 3463372 - RNA, 13 nt, Pseudomonas aeruginosa PA01
gcggcagguagcc

SEQ ID NO: 3463373 - RNA, 17 nt, Pseudomonas aeruginosa PA01
gcggcagguagccgccu

SEQ ID NO: 3463374 - RNA, 12 nt, Pseudomonas aeruginosa PA01
gcggcagguccu

SEQ ID NO: 3463375 - RNA, 12 nt, Pseudomonas aeruginosa PA01
gcggcaggucgg

SEQ ID NO: 3463376 - RNA, 21 nt, Pseudomonas aeruginosa PA01
gcggcaggucguugacgaucu

SEQ ID NO: 3463377 - RNA, 21 nt, Pseudomonas aeruginosa PA01
gcggcaggugguaagcgagca

SEQ ID NO: 3463378 - RNA, 17 nt, Pseudomonas aeruginosa PA01
gcggcaguccucgccgu

SEQ ID NO: 3463379 - RNA, 22 nt, Pseudomonas aeruginosa PA01
gcggcaguccucgccguuggcg

SEQ ID NO: 3463380 - RNA, 19 nt, Pseudomonas aeruginosa PA01
gcggcauagaugccggccu

SEQ ID NO: 3463381 - RNA, 20 nt, Pseudomonas aeruginosa PA01
gcggcauagaugccggccuc

SEQ ID NO: 3463382 - RNA, 23 nt, Pseudomonas aeruginosa PA01
gcggcauagaugccggccucgac

SEQ ID NO: 3463383 - RNA, 18 nt, Pseudomonas aeruginosa PA01
gcggcauagcgcagccgc

SEQ ID NO: 3463384 - RNA, 14 nt, Pseudomonas aeruginosa PA01
gcggcauccaguuc

SEQ ID NO: 3463385 - RNA, 18 nt, Pseudomonas aeruginosa PA01
gcggcaucccuuuuucau

SEQ ID NO: 3463386 - RNA, 13 nt, Pseudomonas aeruginosa PA01
gcggcaucgcgua

SEQ ID NO: 3463387 - RNA, 13 nt, Pseudomonas aeruginosa PA01
gcggcaucggccu

SEQ ID NO: 3463388 - RNA, 14 nt, Pseudomonas aeruginosa PA01
gcggcaucggccug

SEQ ID NO: 3463389 - RNA, 15 nt, Pseudomonas aeruginosa PA01
gcggcaucggccugg

SEQ ID NO: 3463390 - RNA, 13 nt, Pseudomonas aeruginosa PA01
gcggcaucggcgc

SEQ ID NO: 3463391 - RNA, 14 nt, Pseudomonas aeruginosa PA01
gcggcaucggcgcc

SEQ ID NO: 3463392 - RNA, 15 nt, Pseudomonas aeruginosa PA01
gcggcaucggcgccg

SEQ ID NO: 3463393 - RNA, 16 nt, Pseudomonas aeruginosa PA01
gcggcaucggcgccgc

SEQ ID NO: 3463394 - RNA, 18 nt, Pseudomonas aeruginosa PA01
gcggcaucggcgccgcgc

SEQ ID NO: 3463395 - RNA, 19 nt, Pseudomonas aeruginosa PA01
gcggcaucggcgccgcgca

SEQ ID NO: 3463396 - RNA, 20 nt, Pseudomonas aeruginosa PA01
gcggcaugaugcgcccgucc

SEQ ID NO: 3463397 - RNA, 14 nt, Pseudomonas aeruginosa PA01
gcggcaugcccugc

SEQ ID NO: 3463398 - RNA, 15 nt, Pseudomonas aeruginosa PA01
gcggcaugcccugcc

SEQ ID NO: 3463399 - RNA, 18 nt, Pseudomonas aeruginosa PA01
gcggcaugcccugccggc

SEQ ID NO: 3463400 - RNA, 11 nt, Pseudomonas aeruginosa PA01
gcggcaugccg

SEQ ID NO: 3463401 - RNA, 15 nt, Pseudomonas aeruginosa PA01
gcggcaugccguaga

SEQ ID NO: 3463402 - RNA, 14 nt, Pseudomonas aeruginosa PA01
gcggcaugccguug

SEQ ID NO: 3463403 - RNA, 21 nt, Pseudomonas aeruginosa PA01
gcggcaugccguugggccagg

SEQ ID NO: 3463404 - RNA, 23 nt, Pseudomonas aeruginosa PA01
gcggcaugccguugggccagggc

SEQ ID NO: 3463405 - RNA, 14 nt, Pseudomonas aeruginosa PA01
gcggcauggucagc

SEQ ID NO: 3463406 - RNA, 15 nt, Pseudomonas aeruginosa PA01
gcggcauucgcgcug

SEQ ID NO: 3463407 - RNA, 18 nt, Pseudomonas aeruginosa PA01
gcggcauugagcgccagc

SEQ ID NO: 3463408 - RNA, 20 nt, Pseudomonas aeruginosa PA01
gcggcauugagcgccagcag

SEQ ID NO: 3463409 - RNA, 21 nt, Pseudomonas aeruginosa PA01
gcggcauugagcgccagcagg

SEQ ID NO: 3463410 - RNA, 15 nt, Pseudomonas aeruginosa PA01
gcggccaaccucucc

SEQ ID NO: 3463411 - RNA, 21 nt, Pseudomonas aeruginosa PA01
gcggccaaccucuccccagac

SEQ ID NO: 3463412 - RNA, 17 nt, Pseudomonas aeruginosa PA01
gcggccaccaccgugac

SEQ ID NO: 3463413 - RNA, 15 nt, Pseudomonas aeruginosa PA01
gcggccacggcggau

SEQ ID NO: 3463414 - RNA, 18 nt, Pseudomonas aeruginosa PA01
gcggccacuucguccggc

SEQ ID NO: 3463415 - RNA, 15 nt, Pseudomonas aeruginosa PA01
gcggccagcagcacg

SEQ ID NO: 3463416 - RNA, 16 nt, Pseudomonas aeruginosa PA01
gcggccagcagcacgc

SEQ ID NO: 3463417 - RNA, 22 nt, Pseudomonas aeruginosa PA01
gcggccagcagcacgcccuggg

SEQ ID NO: 3463418 - RNA, 19 nt, Pseudomonas aeruginosa PA01
gcggccagcagcacggcga

SEQ ID NO: 3463419 - RNA, 22 nt, Pseudomonas aeruginosa PA01
gcggccagcagcacggcgacga

SEQ ID NO: 3463420 - RNA, 21 nt, Pseudomonas aeruginosa PA01
gcggccagcauuuugcggaaa

SEQ ID NO: 3463421 - RNA, 15 nt, Pseudomonas aeruginosa PA01
gcggccagcccccuc

SEQ ID NO: 3463422 - RNA, 12 nt, Pseudomonas aeruginosa PA01
gcggccagcgcc

SEQ ID NO: 3463423 - RNA, 13 nt, Pseudomonas aeruginosa PA01
gcggccagcgcca

SEQ ID NO: 3463424 - RNA, 19 nt, Pseudomonas aeruginosa PA01
gcggccagcgccaggagca

SEQ ID NO: 3463425 - RNA, 14 nt, Pseudomonas aeruginosa PA01
gcggccagcgcggc

SEQ ID NO: 3463426 - RNA, 20 nt, Pseudomonas aeruginosa PA01
gcggccagcgcggccgccgc

SEQ ID NO: 3463427 - RNA, 24 nt, Pseudomonas aeruginosa PA01
gcggccagcgcggccgccgccgac

SEQ ID NO: 3463428 - RNA, 21 nt, Pseudomonas aeruginosa PA01
gcggccagcggaugcuggcgg

SEQ ID NO: 3463429 - RNA, 19 nt, Pseudomonas aeruginosa PA01
gcggccagcgugaagaccu

SEQ ID NO: 3463430 - RNA, 21 nt, Pseudomonas aeruginosa PA01
gcggccagcgugaagaccugg

SEQ ID NO: 3463431 - RNA, 16 nt, Pseudomonas aeruginosa PA01
gcggccagcucgccgg

SEQ ID NO: 3463432 - RNA, 14 nt, Pseudomonas aeruginosa PA01
gcggccagcuucuc

SEQ ID NO: 3463433 - RNA, 11 nt, Pseudomonas aeruginosa PA01
gcggccaggcg

SEQ ID NO: 3463434 - RNA, 14 nt, Pseudomonas aeruginosa PA01
gcggccagggcgag

SEQ ID NO: 3463435 - RNA, 17 nt, Pseudomonas aeruginosa PA01
gcggccaguucgggguc

SEQ ID NO: 3463436 - RNA, 20 nt, Pseudomonas aeruginosa PA01
gcggccaguucggggucggc

SEQ ID NO: 3463437 - RNA, 15 nt, Pseudomonas aeruginosa PA01
gcggccguucgcccu

SEQ ID NO: 3463438 - RNA, 13 nt, Pseudomonas aeruginosa PA01
gcggccguucucc

SEQ ID NO: 3463439 - RNA, 15 nt, Pseudomonas aeruginosa PA01
gcggccguuguccag

SEQ ID NO: 3463440 - RNA, 18 nt, Pseudomonas aeruginosa PA01
gcggccguuguccagggu

SEQ ID NO: 3463441 - RNA, 22 nt, Pseudomonas aeruginosa PA01
gcggccuacgguacaguucagg

SEQ ID NO: 3463442 - RNA, 15 nt, Pseudomonas aeruginosa PA01
gcggccuacuugauc

SEQ ID NO: 3463443 - RNA, 21 nt, Pseudomonas aeruginosa PA01
gcggccuacuugaucagccgc

SEQ ID NO: 3463444 - RNA, 14 nt, Pseudomonas aeruginosa PA01
gcggccucaggccu

SEQ ID NO: 3463445 - RNA, 20 nt, Pseudomonas aeruginosa PA01
gcggccucaggccuggcgca

SEQ ID NO: 3463446 - RNA, 17 nt, Pseudomonas aeruginosa PA01
gcggccucgaggucggc

SEQ ID NO: 3463447 - RNA, 23 nt, Pseudomonas aeruginosa PA01
gcggccucgaggucggccuggcu

SEQ ID NO: 3463448 - RNA, 14 nt, Pseudomonas aeruginosa PA01
gcggccucgauggc

SEQ ID NO: 3463449 - RNA, 16 nt, Pseudomonas aeruginosa PA01
gcggccucgcuggcga

SEQ ID NO: 3463450 - RNA, 15 nt, Pseudomonas aeruginosa PA01
gcggccucggccucg

SEQ ID NO: 3463451 - RNA, 21 nt, Pseudomonas aeruginosa PA01
gcggccucggccucgucgagc

SEQ ID NO: 3463452 - RNA, 22 nt, Pseudomonas aeruginosa PA01
gcggccucggccucgucgagca

SEQ ID NO: 3463453 - RNA, 18 nt, Pseudomonas aeruginosa PA01
gcggccucguaggcggcg

SEQ ID NO: 3463454 - RNA, 14 nt, Pseudomonas aeruginosa PA01
gcggccucuucguc

SEQ ID NO: 3463455 - RNA, 17 nt, Pseudomonas aeruginosa PA01
gcggccucuucgucggc

SEQ ID NO: 3463456 - RNA, 20 nt, Pseudomonas aeruginosa PA01
gcggccucuucgucggcgaa

SEQ ID NO: 3463457 - RNA, 14 nt, Pseudomonas aeruginosa PA01
gcggccugagccgg

SEQ ID NO: 3463458 - RNA, 19 nt, Pseudomonas aeruginosa PA01
gcggccugagcugccgcuu

SEQ ID NO: 3463459 - RNA, 21 nt, Pseudomonas aeruginosa PA01
gcggccugagcugccgcuucg

SEQ ID NO: 3463460 - RNA, 23 nt, Pseudomonas aeruginosa PA01
gcggccugagcugccgcuucggc

SEQ ID NO: 3463461 - RNA, 17 nt, Pseudomonas aeruginosa PA01
gcggccugcaacgccgc

SEQ ID NO: 3463462 - RNA, 14 nt, Pseudomonas aeruginosa PA01
gcggccugcgccgg

SEQ ID NO: 3463463 - RNA, 21 nt, Pseudomonas aeruginosa PA01
gcggccugcucgcgcagccag

SEQ ID NO: 3463464 - RNA, 13 nt, Pseudomonas aeruginosa PA01
gcggccugcucgg

SEQ ID NO: 3463465 - RNA, 14 nt, Pseudomonas aeruginosa PA01
gcggccugcucggc

SEQ ID NO: 3463466 - RNA, 17 nt, Pseudomonas aeruginosa PA01
gcggccugcucggcucg

SEQ ID NO: 3463467 - RNA, 13 nt, Pseudomonas aeruginosa PA01
gcggccugggccg

SEQ ID NO: 3463468 - RNA, 22 nt, Pseudomonas aeruginosa PA01
gcggccugggccgaaggccagg

SEQ ID NO: 3463469 - RNA, 19 nt, Pseudomonas aeruginosa PA01
gcggccugguagucgccgg

SEQ ID NO: 3463470 - RNA, 19 nt, Pseudomonas aeruginosa PA01
gcggccuguucggccuugc

SEQ ID NO: 3463471 - RNA, 15 nt, Pseudomonas aeruginosa PA01
gcggccuucggcguc

SEQ ID NO: 3463472 - RNA, 19 nt, Pseudomonas aeruginosa PA01
gcggccuucggcgucgaag

SEQ ID NO: 3463473 - RNA, 18 nt, Pseudomonas aeruginosa PA01
gcggccuucucgucgccg

SEQ ID NO: 3463474 - RNA, 15 nt, Pseudomonas aeruginosa PA01
gcggccuucuugcug

SEQ ID NO: 3463475 - RNA, 20 nt, Pseudomonas aeruginosa PA01
gcggccuucuugcugccggc

SEQ ID NO: 3463476 - RNA, 19 nt, Pseudomonas aeruginosa PA01
gcggccuuuucggcggcca

SEQ ID NO: 3463477 - RNA, 22 nt, Pseudomonas aeruginosa PA01
gcggccuuuucggcggccaggc

SEQ ID NO: 3463478 - RNA, 15 nt, Pseudomonas aeruginosa PA01
gcggcgaaacggcgg

SEQ ID NO: 3463479 - RNA, 20 nt, Pseudomonas aeruginosa PA01
gcggcgaaauggguucccag

SEQ ID NO: 3463480 - RNA, 21 nt, Pseudomonas aeruginosa PA01
gcggcgaacaucauccacagc

SEQ ID NO: 3463481 - RNA, 19 nt, Pseudomonas aeruginosa PA01
gcggcgaacccucggugcg

SEQ ID NO: 3463482 - RNA, 23 nt, Pseudomonas aeruginosa PA01
gcggcgaacccucggugcggccg

SEQ ID NO: 3463483 - RNA, 15 nt, Pseudomonas aeruginosa PA01
gcggcgaagcgcagg

SEQ ID NO: 3463484 - RNA, 16 nt, Pseudomonas aeruginosa PA01
gcggcgaagcgcaggc

SEQ ID NO: 3463485 - RNA, 15 nt, Pseudomonas aeruginosa PA01
gcggcgaagcgcucg

SEQ ID NO: 3463486 - RNA, 20 nt, Pseudomonas aeruginosa PA01
gcggcgaagcguugcagcgu

SEQ ID NO: 3463487 - RNA, 13 nt, Pseudomonas aeruginosa PA01
gcggcgaaggccg

SEQ ID NO: 3463488 - RNA, 22 nt, Pseudomonas aeruginosa PA01
gcggcgaagggcgcuucggcgg

SEQ ID NO: 3463489 - RNA, 19 nt, Pseudomonas aeruginosa PA01
gcggcgaagguggcgaccu

SEQ ID NO: 3463490 - RNA, 23 nt, Pseudomonas aeruginosa PA01
gcggcgaagguggcgaccuggua

SEQ ID NO: 3463491 - RNA, 16 nt, Pseudomonas aeruginosa PA01
gcggcgacaccgccag

SEQ ID NO: 3463492 - RNA, 17 nt, Pseudomonas aeruginosa PA01
gcggcgacaccgccagc

SEQ ID NO: 3463493 - RNA, 18 nt, Pseudomonas aeruginosa PA01
gcggcgacaccgccagca

SEQ ID NO: 3463494 - RNA, 19 nt, Pseudomonas aeruginosa PA01
gcggcgacaccgccagcac

SEQ ID NO: 3463495 - RNA, 20 nt, Pseudomonas aeruginosa PA01
gcggcgacaccgccagcacc

SEQ ID NO: 3463496 - RNA, 17 nt, Pseudomonas aeruginosa PA01
gcggcgacagcaccacg

SEQ ID NO: 3463497 - RNA, 17 nt, Pseudomonas aeruginosa PA01
gcggcgaccagcgcggu

SEQ ID NO: 3463498 - RNA, 15 nt, Pseudomonas aeruginosa PA01
gcggcgaccauccag

SEQ ID NO: 3463499 - RNA, 19 nt, Pseudomonas aeruginosa PA01
gcggcgaccauccagccug

SEQ ID NO: 3463500 - RNA, 22 nt, Pseudomonas aeruginosa PA01
gcggcgaccauccagccugcgc

SEQ ID NO: 3463501 - RNA, 23 nt, Pseudomonas aeruginosa PA01
gcggcgaccauccagccugcgcu

SEQ ID NO: 3463502 - RNA, 21 nt, Pseudomonas aeruginosa PA01
gcggcgaccauguucaccagc

SEQ ID NO: 3463503 - RNA, 24 nt, Pseudomonas aeruginosa PA01
gcggcgaccauguucaccagcgcu

SEQ ID NO: 3463504 - RNA, 20 nt, Pseudomonas aeruginosa PA01
gcggcgaccccgaucaccgg

SEQ ID NO: 3463505 - RNA, 20 nt, Pseudomonas aeruginosa PA01
gcggcgaccgaacagcgcgc

SEQ ID NO: 3463506 - RNA, 20 nt, Pseudomonas aeruginosa PA01
gcggcgaccgcaucguuggc

SEQ ID NO: 3463507 - RNA, 23 nt, Pseudomonas aeruginosa PA01
gcggcgaccgcaucguuggcgcc

SEQ ID NO: 3463508 - RNA, 20 nt, Pseudomonas aeruginosa PA01
gcggcgaccugggcgucgcu

SEQ ID NO: 3463509 - RNA, 17 nt, Pseudomonas aeruginosa PA01
gcggcgacgaagcccag

SEQ ID NO: 3463510 - RNA, 18 nt, Pseudomonas aeruginosa PA01
gcggcgacgaagcccagg

SEQ ID NO: 3463511 - RNA, 18 nt, Pseudomonas aeruginosa PA01
gcggcgacgaagguaucg

SEQ ID NO: 3463512 - RNA, 18 nt, Pseudomonas aeruginosa PA01
gcggcgacgaaggucggc

SEQ ID NO: 3463513 - RNA, 21 nt, Pseudomonas aeruginosa PA01
gcggcgacgaaggucggcggc

SEQ ID NO: 3463514 - RNA, 22 nt, Pseudomonas aeruginosa PA01
gcggcgacgaaggucggcggca

SEQ ID NO: 3463515 - RNA, 17 nt, Pseudomonas aeruginosa PA01
gcggcgacgaucacccc

SEQ ID NO: 3463516 - RNA, 13 nt, Pseudomonas aeruginosa PA01
gcggcgacgccac

SEQ ID NO: 3463517 - RNA, 17 nt, Pseudomonas aeruginosa PA01
gcggcgacgccacccgc

SEQ ID NO: 3463518 - RNA, 14 nt, Pseudomonas aeruginosa PA01
gcggcgacgcuggc

SEQ ID NO: 3463519 - RNA, 16 nt, Pseudomonas aeruginosa PA01
gcggcgacgcuggcgg

SEQ ID NO: 3463520 - RNA, 18 nt, Pseudomonas aeruginosa PA01
gcggcgacgcuggcggug

SEQ ID NO: 3463521 - RNA, 13 nt, Pseudomonas aeruginosa PA01
gcggcgacggcuc

SEQ ID NO: 3463522 - RNA, 13 nt, Pseudomonas aeruginosa PA01
gcggcgagaacuc

SEQ ID NO: 3463523 - RNA, 19 nt, Pseudomonas aeruginosa PA01
gcggcgagaucuucaggcc

SEQ ID NO: 3463524 - RNA, 21 nt, Pseudomonas aeruginosa PA01
gcggcgagaucuucaggccga

SEQ ID NO: 3463525 - RNA, 17 nt, Pseudomonas aeruginosa PA01
gcggcgagcagcggcgc

SEQ ID NO: 3463526 - RNA, 19 nt, Pseudomonas aeruginosa PA01
gcggcgagcaucucggcca

SEQ ID NO: 3463527 - RNA, 21 nt, Pseudomonas aeruginosa PA01
gcggcgagcaucucggccagg

SEQ ID NO: 3463528 - RNA, 23 nt, Pseudomonas aeruginosa PA01
gcggcgagcauuccucagcgccg

SEQ ID NO: 3463529 - RNA, 14 nt, Pseudomonas aeruginosa PA01
gcggcgagccgcga

SEQ ID NO: 3463530 - RNA, 14 nt, Pseudomonas aeruginosa PA01
gcggcgagcgccgc

SEQ ID NO: 3463531 - RNA, 17 nt, Pseudomonas aeruginosa PA01
gcggcgagcgccgcggc

SEQ ID NO: 3463532 - RNA, 20 nt, Pseudomonas aeruginosa PA01
gcggcgagcgggucgauggc

SEQ ID NO: 3463533 - RNA, 14 nt, Pseudomonas aeruginosa PA01
gcggcgagcguucg

SEQ ID NO: 3463534 - RNA, 17 nt, Pseudomonas aeruginosa PA01
gcggcgagcguucggau

SEQ ID NO: 3463535 - RNA, 13 nt, Pseudomonas aeruginosa PA01
gcggcgagcugga

SEQ ID NO: 3463536 - RNA, 22 nt, Pseudomonas aeruginosa PA01
gcggcgagcuggaucggcaggc

SEQ ID NO: 3463537 - RNA, 23 nt, Pseudomonas aeruginosa PA01
gcggcgagcuggaucggcaggcu

SEQ ID NO: 3463538 - RNA, 17 nt, Pseudomonas aeruginosa PA01
gcggcgaggccgaccuu

SEQ ID NO: 3463539 - RNA, 16 nt, Pseudomonas aeruginosa PA01
gcggcggaaggcggcg

SEQ ID NO: 3463540 - RNA, 17 nt, Pseudomonas aeruginosa PA01
gcggcggaaggcggcgu

SEQ ID NO: 3463541 - RNA, 15 nt, Pseudomonas aeruginosa PA01
gcggcggacagcgga

SEQ ID NO: 3463542 - RNA, 18 nt, Pseudomonas aeruginosa PA01
gcggcggacaggcagccg

SEQ ID NO: 3463543 - RNA, 19 nt, Pseudomonas aeruginosa PA01
gcggcggacaggcagccgg

SEQ ID NO: 3463544 - RNA, 14 nt, Pseudomonas aeruginosa PA01
gcggcggaccuccg

SEQ ID NO: 3463545 - RNA, 20 nt, Pseudomonas aeruginosa PA01
gcggcggaccuccgccaggu

SEQ ID NO: 3463546 - RNA, 14 nt, Pseudomonas aeruginosa PA01
gcggcggacgacga

SEQ ID NO: 3463547 - RNA, 15 nt, Pseudomonas aeruginosa PA01
gcggcggacgcaggc

SEQ ID NO: 3463548 - RNA, 16 nt, Pseudomonas aeruginosa PA01
gcggcggacgcaggcc

SEQ ID NO: 3463549 - RNA, 22 nt, Pseudomonas aeruginosa PA01
gcggcggacgcaggccgaccuc

SEQ ID NO: 3463550 - RNA, 13 nt, Pseudomonas aeruginosa PA01
gcggcggaggccu

SEQ ID NO: 3463551 - RNA, 14 nt, Pseudomonas aeruginosa PA01
gcggcggaggccua

SEQ ID NO: 3463552 - RNA, 17 nt, Pseudomonas aeruginosa PA01
gcggcggauaaccgcga

SEQ ID NO: 3463553 - RNA, 19 nt, Pseudomonas aeruginosa PA01
gcggcggauaaccgcgagc

SEQ ID NO: 3463554 - RNA, 22 nt, Pseudomonas aeruginosa PA01
gcggcggauaaccgcgagcggu

SEQ ID NO: 3463555 - RNA, 21 nt, Pseudomonas aeruginosa PA01
gcggcggauaacgcccgcggc

SEQ ID NO: 3463556 - RNA, 20 nt, Pseudomonas aeruginosa PA01
gcggcggauaacgccuaugg

SEQ ID NO: 3463557 - RNA, 17 nt, Pseudomonas aeruginosa PA01
gcggcggauaacgccug

SEQ ID NO: 3463558 - RNA, 21 nt, Pseudomonas aeruginosa PA01
gcggcggauaacgccuguggc

SEQ ID NO: 3463559 - RNA, 17 nt, Pseudomonas aeruginosa PA01
gcggcggauacaggcgc

SEQ ID NO: 3463560 - RNA, 21 nt, Pseudomonas aeruginosa PA01
gcggcggauacaggcgcagca

SEQ ID NO: 3463561 - RNA, 23 nt, Pseudomonas aeruginosa PA01
gcggcggauacaggcgcagcagc

SEQ ID NO: 3463562 - RNA, 14 nt, Pseudomonas aeruginosa PA01
gcggcggaugccgg

SEQ ID NO: 3463563 - RNA, 15 nt, Pseudomonas aeruginosa PA01
gcggcggaugccggc

SEQ ID NO: 3463564 - RNA, 17 nt, Pseudomonas aeruginosa PA01
gcggcggaugccggcgc

SEQ ID NO: 3463565 - RNA, 15 nt, Pseudomonas aeruginosa PA01
gcggcggcaccacgu

SEQ ID NO: 3463566 - RNA, 22 nt, Pseudomonas aeruginosa PA01
gcggcggcaccacgugcagcag

SEQ ID NO: 3463567 - RNA, 18 nt, Pseudomonas aeruginosa PA01
gcggcggcaggccagcuu

SEQ ID NO: 3463568 - RNA, 15 nt, Pseudomonas aeruginosa PA01
gcggcggcaggucgg

SEQ ID NO: 3463569 - RNA, 12 nt, Pseudomonas aeruginosa PA01
gcggcggcccgc

SEQ ID NO: 3463570 - RNA, 20 nt, Pseudomonas aeruginosa PA01
gcggcggccgcaugccgggg

SEQ ID NO: 3463571 - RNA, 13 nt, Pseudomonas aeruginosa PA01
gcggcggccgucg

SEQ ID NO: 3463572 - RNA, 13 nt, Pseudomonas aeruginosa PA01
gcggcggcgacgc

SEQ ID NO: 3463573 - RNA, 12 nt, Pseudomonas aeruginosa PA01
gcggcggcgccg

SEQ ID NO: 3463574 - RNA, 15 nt, Pseudomonas aeruginosa PA01
gcggcggcgccggca

SEQ ID NO: 3463575 - RNA, 11 nt, Pseudomonas aeruginosa PA01
gcggcggcgcg

SEQ ID NO: 3463576 - RNA, 16 nt, Pseudomonas aeruginosa PA01
gcggcggcgcggagau

SEQ ID NO: 3463577 - RNA, 14 nt, Pseudomonas aeruginosa PA01
gcggcggcgcgggu

SEQ ID NO: 3463578 - RNA, 13 nt, Pseudomonas aeruginosa PA01
gcggcggcgcguc

SEQ ID NO: 3463579 - RNA, 17 nt, Pseudomonas aeruginosa PA01
gcggcggcgcgucggug

SEQ ID NO: 3463580 - RNA, 14 nt, Pseudomonas aeruginosa PA01
gcggcggcggacag

SEQ ID NO: 3463581 - RNA, 16 nt, Pseudomonas aeruginosa PA01
gcggcggcggaccucc

SEQ ID NO: 3463582 - RNA, 13 nt, Pseudomonas aeruginosa PA01
gcggcggcggcca

SEQ ID NO: 3463583 - RNA, 16 nt, Pseudomonas aeruginosa PA01
gcggcggcggccagca

SEQ ID NO: 3463584 - RNA, 13 nt, Pseudomonas aeruginosa PA01
gcggcggcggccg

SEQ ID NO: 3463585 - RNA, 14 nt, Pseudomonas aeruginosa PA01
gcggcggcggccgc

SEQ ID NO: 3463586 - RNA, 15 nt, Pseudomonas aeruginosa PA01
gcggcggcggccgca

SEQ ID NO: 3463587 - RNA, 16 nt, Pseudomonas aeruginosa PA01
gcggcggcggccgcau

SEQ ID NO: 3463588 - RNA, 14 nt, Pseudomonas aeruginosa PA01
gcggcggcgugcag

SEQ ID NO: 3463589 - RNA, 13 nt, Pseudomonas aeruginosa PA01
gcggcggcucagg

SEQ ID NO: 3463590 - RNA, 18 nt, Pseudomonas aeruginosa PA01
gcggcggcucaggccgcc

SEQ ID NO: 3463591 - RNA, 21 nt, Pseudomonas aeruginosa PA01
gcggcggcuccggcgccaggc

SEQ ID NO: 3463592 - RNA, 22 nt, Pseudomonas aeruginosa PA01
gcggcggcuccggcgccaggcc

SEQ ID NO: 3463593 - RNA, 17 nt, Pseudomonas aeruginosa PA01
gcggcgggacuggggca

SEQ ID NO: 3463594 - RNA, 20 nt, Pseudomonas aeruginosa PA01
gcggcgggacuggggcaugg

SEQ ID NO: 3463595 - RNA, 20 nt, Pseudomonas aeruginosa PA01
gcggcgggaggucacaccga

SEQ ID NO: 3463596 - RNA, 12 nt, Pseudomonas aeruginosa PA01
gcggcgggcgcc

SEQ ID NO: 3463597 - RNA, 21 nt, Pseudomonas aeruginosa PA01
gcggcggggaaggcgucggcu

SEQ ID NO: 3463598 - RNA, 22 nt, Pseudomonas aeruginosa PA01
gcggcggguagagucgcucgcg

SEQ ID NO: 3463599 - RNA, 23 nt, Pseudomonas aeruginosa PA01
gcggcggguaguguuugcgcagg

SEQ ID NO: 3463600 - RNA, 15 nt, Pseudomonas aeruginosa PA01
gcggcgggucacgcc

SEQ ID NO: 3463601 - RNA, 15 nt, Pseudomonas aeruginosa PA01
gcggcggguggcgcu

SEQ ID NO: 3463602 - RNA, 14 nt, Pseudomonas aeruginosa PA01
gcggcgguagccga

SEQ ID NO: 3463603 - RNA, 21 nt, Pseudomonas aeruginosa PA01
gcggcgguagccgaggcggcc

SEQ ID NO: 3463604 - RNA, 17 nt, Pseudomonas aeruginosa PA01
gcggcgguagcuccagg

SEQ ID NO: 3463605 - RNA, 18 nt, Pseudomonas aeruginosa PA01
gcggcgguagcuccaggc

SEQ ID NO: 3463606 - RNA, 23 nt, Pseudomonas aeruginosa PA01
gcggcgguagcuccaggccgaag

SEQ ID NO: 3463607 - RNA, 17 nt, Pseudomonas aeruginosa PA01
gcggcggucaucgcgcc

SEQ ID NO: 3463608 - RNA, 22 nt, Pseudomonas aeruginosa PA01
gcggcggucaucgcgccgccga

SEQ ID NO: 3463609 - RNA, 23 nt, Pseudomonas aeruginosa PA01
gcggcggucaucgcgccgccgaa

SEQ ID NO: 3463610 - RNA, 18 nt, Pseudomonas aeruginosa PA01
gcggcggucccagaccag

SEQ ID NO: 3463611 - RNA, 20 nt, Pseudomonas aeruginosa PA01
gcggcggucccagaccagca

SEQ ID NO: 3463612 - RNA, 17 nt, Pseudomonas aeruginosa PA01
gcggcggucccaucagc

SEQ ID NO: 3463613 - RNA, 23 nt, Pseudomonas aeruginosa PA01
gcggcggucccuucgugggccug

SEQ ID NO: 3463614 - RNA, 16 nt, Pseudomonas aeruginosa PA01
gcggcggugcgccggc

SEQ ID NO: 3463615 - RNA, 16 nt, Pseudomonas aeruginosa PA01
gcggcgguucgccgag

SEQ ID NO: 3463616 - RNA, 17 nt, Pseudomonas aeruginosa PA01
gcggcguaaucgcgcca

SEQ ID NO: 3463617 - RNA, 23 nt, Pseudomonas aeruginosa PA01
gcggcguaaucgcgccaggccgc

SEQ ID NO: 3463618 - RNA, 18 nt, Pseudomonas aeruginosa PA01
gcggcguaccuucgagca

SEQ ID NO: 3463619 - RNA, 20 nt, Pseudomonas aeruginosa PA01
gcggcguaccuucgagcagg

SEQ ID NO: 3463620 - RNA, 15 nt, Pseudomonas aeruginosa PA01
gcggcguaggcgcgc

SEQ ID NO: 3463621 - RNA, 16 nt, Pseudomonas aeruginosa PA01
gcggcguaggcggugc

SEQ ID NO: 3463622 - RNA, 21 nt, Pseudomonas aeruginosa PA01
gcggcguaggcggugcguucg

SEQ ID NO: 3463623 - RNA, 19 nt, Pseudomonas aeruginosa PA01
gcggcguauucgccgaaga

SEQ ID NO: 3463624 - RNA, 14 nt, Pseudomonas aeruginosa PA01
gcggcgucaggguc

SEQ ID NO: 3463625 - RNA, 15 nt, Pseudomonas aeruginosa PA01
gcggcgucccggcgc

SEQ ID NO: 3463626 - RNA, 16 nt, Pseudomonas aeruginosa PA01
gcggcgucccggcgcc

SEQ ID NO: 3463627 - RNA, 17 nt, Pseudomonas aeruginosa PA01
gcggcgucccggcgccg

SEQ ID NO: 3463628 - RNA, 22 nt, Pseudomonas aeruginosa PA01
gcggcgucgaaaugcucgugca

SEQ ID NO: 3463629 - RNA, 15 nt, Pseudomonas aeruginosa PA01
gcggcgucggcgaag

SEQ ID NO: 3463630 - RNA, 13 nt, Pseudomonas aeruginosa PA01
gcggcgucgggcg

SEQ ID NO: 3463631 - RNA, 13 nt, Pseudomonas aeruginosa PA01
gcggcgucgucgc

SEQ ID NO: 3463632 - RNA, 17 nt, Pseudomonas aeruginosa PA01
gcggcgucugccgcucg

SEQ ID NO: 3463633 - RNA, 17 nt, Pseudomonas aeruginosa PA01
gcggcgugaagccgccg

SEQ ID NO: 3463634 - RNA, 17 nt, Pseudomonas aeruginosa PA01
gcggcguggaaggccac

SEQ ID NO: 3463635 - RNA, 23 nt, Pseudomonas aeruginosa PA01
gcggcguggcgaucaggcagcgc

SEQ ID NO: 3463636 - RNA, 17 nt, Pseudomonas aeruginosa PA01
gcggcguuagccgccug

SEQ ID NO: 3463637 - RNA, 19 nt, Pseudomonas aeruginosa PA01
gcggcguuauccgcccugc

SEQ ID NO: 3463638 - RNA, 14 nt, Pseudomonas aeruginosa PA01
gcggcguucaucgc

SEQ ID NO: 3463639 - RNA, 14 nt, Pseudomonas aeruginosa PA01
gcggcguucgcccu

SEQ ID NO: 3463640 - RNA, 16 nt, Pseudomonas aeruginosa PA01
gcggcguucgcccugc

SEQ ID NO: 3463641 - RNA, 15 nt, Pseudomonas aeruginosa PA01
gcggcguucgccgag

SEQ ID NO: 3463642 - RNA, 17 nt, Pseudomonas aeruginosa PA01
gcggcuucagagcugga

SEQ ID NO: 3463643 - RNA, 18 nt, Pseudomonas aeruginosa PA01
gcggcuucagagcuggac

SEQ ID NO: 3463644 - RNA, 19 nt, Pseudomonas aeruginosa PA01
gcggcuucagagcuggacg

SEQ ID NO: 3463645 - RNA, 20 nt, Pseudomonas aeruginosa PA01
gcggcuucagagcuggacga

SEQ ID NO: 3463646 - RNA, 12 nt, Pseudomonas aeruginosa PA01
gcggcuucagcc

SEQ ID NO: 3463647 - RNA, 14 nt, Pseudomonas aeruginosa PA01
gcggcuucagccag

SEQ ID NO: 3463648 - RNA, 15 nt, Pseudomonas aeruginosa PA01
gcggcuucagccaga

SEQ ID NO: 3463649 - RNA, 20 nt, Pseudomonas aeruginosa PA01
gcggcuucagccagaccggc

SEQ ID NO: 3463650 - RNA, 21 nt, Pseudomonas aeruginosa PA01
gcggcuucagccagaccggca

SEQ ID NO: 3463651 - RNA, 22 nt, Pseudomonas aeruginosa PA01
gcggcuucagccagaccggcag

SEQ ID NO: 3463652 - RNA, 16 nt, Pseudomonas aeruginosa PA01
gcggcuuccagguacg

SEQ ID NO: 3463653 - RNA, 17 nt, Pseudomonas aeruginosa PA01
gcggcuuccugcugguu

SEQ ID NO: 3463654 - RNA, 14 nt, Pseudomonas aeruginosa PA01
gcggcuucgcgcuc

SEQ ID NO: 3463655 - RNA, 20 nt, Pseudomonas aeruginosa PA01
gcggcuucgcgcuccaggcc

SEQ ID NO: 3463656 - RNA, 14 nt, Pseudomonas aeruginosa PA01
gcggcuucggucag

SEQ ID NO: 3463657 - RNA, 17 nt, Pseudomonas aeruginosa PA01
gcggcuugccggcgcgc

SEQ ID NO: 3463658 - RNA, 19 nt, Pseudomonas aeruginosa PA01
gcggcuugccggcgcgcgg

SEQ ID NO: 3463659 - RNA, 15 nt, Pseudomonas aeruginosa PA01
gcggcuuguccuggc

SEQ ID NO: 3463660 - RNA, 16 nt, Pseudomonas aeruginosa PA01
gcggcuuguccuggcg

SEQ ID NO: 3463661 - RNA, 17 nt, Pseudomonas aeruginosa PA01
gcggcuuguccuggcgc

SEQ ID NO: 3463662 - RNA, 21 nt, Pseudomonas aeruginosa PA01
gcggcuuucgguuugcgccga

SEQ ID NO: 3463663 - RNA, 22 nt, Pseudomonas aeruginosa PA01
gcggcuuucgguuugcgccgaa

SEQ ID NO: 3463664 - RNA, 15 nt, Pseudomonas aeruginosa PA01
gcggcuuucuuccag

SEQ ID NO: 3463665 - RNA, 16 nt, Pseudomonas aeruginosa PA01
gcggcuuucuuccagc

SEQ ID NO: 3463666 - RNA, 22 nt, Pseudomonas aeruginosa PA01
gcggcuuuuuucauggcgguca

SEQ ID NO: 3463667 - RNA, 22 nt, Pseudomonas aeruginosa PA01
gcggcuuuuuucguugcgccug

SEQ ID NO: 3463668 - RNA, 23 nt, Pseudomonas aeruginosa PA01
gcggcuuuuuucguugcgccugc

SEQ ID NO: 3463669 - RNA, 19 nt, Pseudomonas aeruginosa PA01
gcgggaacgaugccgcagg

SEQ ID NO: 3463670 - RNA, 15 nt, Pseudomonas aeruginosa PA01
gcgggaacgccgggc

SEQ ID NO: 3463671 - RNA, 19 nt, Pseudomonas aeruginosa PA01
gcgggaacggcguaccagg

SEQ ID NO: 3463672 - RNA, 14 nt, Pseudomonas aeruginosa PA01
gcgggaacuuggcg

SEQ ID NO: 3463673 - RNA, 21 nt, Pseudomonas aeruginosa PA01
gcgggaacuuggcgcgcaggg

SEQ ID NO: 3463674 - RNA, 15 nt, Pseudomonas aeruginosa PA01
gcgggaaggucggca

SEQ ID NO: 3463675 - RNA, 17 nt, Pseudomonas aeruginosa PA01
gcgggaaggucggcagc

SEQ ID NO: 3463676 - RNA, 18 nt, Pseudomonas aeruginosa PA01
gcgggaaggucggcagca

SEQ ID NO: 3463677 - RNA, 20 nt, Pseudomonas aeruginosa PA01
gcgggaaggucggcagcagc

SEQ ID NO: 3463678 - RNA, 23 nt, Pseudomonas aeruginosa PA01
gcgggaaggucggcagcagcuug

SEQ ID NO: 3463679 - RNA, 14 nt, Pseudomonas aeruginosa PA01
gcgggaauucuucc

SEQ ID NO: 3463680 - RNA, 16 nt, Pseudomonas aeruginosa PA01
gcgggacaggaacgcc

SEQ ID NO: 3463681 - RNA, 16 nt, Pseudomonas aeruginosa PA01
gcgggacgaugccgau

SEQ ID NO: 3463682 - RNA, 14 nt, Pseudomonas aeruginosa PA01
gcgggacgccgcag

SEQ ID NO: 3463683 - RNA, 13 nt, Pseudomonas aeruginosa PA01
gcgggacgcggcg

SEQ ID NO: 3463684 - RNA, 22 nt, Pseudomonas aeruginosa PA01
gcgggacgcguucccccguggc

SEQ ID NO: 3463685 - RNA, 19 nt, Pseudomonas aeruginosa PA01
gcgggacuuguacucgccg

SEQ ID NO: 3463686 - RNA, 24 nt, Pseudomonas aeruginosa PA01
gcgggacuuguacucgccggugcg

SEQ ID NO: 3463687 - RNA, 17 nt, Pseudomonas aeruginosa PA01
gcgggagagggcggcga

SEQ ID NO: 3463688 - RNA, 20 nt, Pseudomonas aeruginosa PA01
gcgggagagggcggcgaccg

SEQ ID NO: 3463689 - RNA, 22 nt, Pseudomonas aeruginosa PA01
gcgggagagggcggcgaccggc

SEQ ID NO: 3463690 - RNA, 14 nt, Pseudomonas aeruginosa PA01
gcgggagcacuggg

SEQ ID NO: 3463691 - RNA, 17 nt, Pseudomonas aeruginosa PA01
gcgggaggccgccucga

SEQ ID NO: 3463692 - RNA, 18 nt, Pseudomonas aeruginosa PA01
gcgggaggcuacagccug

SEQ ID NO: 3463693 - RNA, 22 nt, Pseudomonas aeruginosa PA01
gcgggaucagccgcgacucggc

SEQ ID NO: 3463694 - RNA, 14 nt, Pseudomonas aeruginosa PA01
gcgggaucaggucg

SEQ ID NO: 3463695 - RNA, 18 nt, Pseudomonas aeruginosa PA01
gcgggaucaggucgccag

SEQ ID NO: 3463696 - RNA, 14 nt, Pseudomonas aeruginosa PA01
gcgggaucgacgcc

SEQ ID NO: 3463697 - RNA, 16 nt, Pseudomonas aeruginosa PA01
gcgggaucgacgccgc

SEQ ID NO: 3463698 - RNA, 23 nt, Pseudomonas aeruginosa PA01
gcgggaucuccgcgccacgcgca

SEQ ID NO: 3463699 - RNA, 20 nt, Pseudomonas aeruginosa PA01
gcgggaucuucuaccuggcg

SEQ ID NO: 3463700 - RNA, 17 nt, Pseudomonas aeruginosa PA01
gcgggauguacgccagg

SEQ ID NO: 3463701 - RNA, 21 nt, Pseudomonas aeruginosa PA01
gcgggauguacgccagggugc

SEQ ID NO: 3463702 - RNA, 16 nt, Pseudomonas aeruginosa PA01
gcgggaugugcaccag

SEQ ID NO: 3463703 - RNA, 18 nt, Pseudomonas aeruginosa PA01
gcgggaugugcaccagca

SEQ ID NO: 3463704 - RNA, 18 nt, Pseudomonas aeruginosa PA01
gcgggauugucgccgccg

SEQ ID NO: 3463705 - RNA, 16 nt, Pseudomonas aeruginosa PA01
gcgggcaaccgcggcg

SEQ ID NO: 3463706 - RNA, 20 nt, Pseudomonas aeruginosa PA01
gcgggcaaccgcggcggccu

SEQ ID NO: 3463707 - RNA, 20 nt, Pseudomonas aeruginosa PA01
gcgggcaccgccagcccgcc

SEQ ID NO: 3463708 - RNA, 16 nt, Pseudomonas aeruginosa PA01
gcgggcagacaccacc

SEQ ID NO: 3463709 - RNA, 19 nt, Pseudomonas aeruginosa PA01
gcgggcagacaccaccagg

SEQ ID NO: 3463710 - RNA, 16 nt, Pseudomonas aeruginosa PA01
gcgggcaggucgaugu

SEQ ID NO: 3463711 - RNA, 13 nt, Pseudomonas aeruginosa PA01
gcgggcauccagc

SEQ ID NO: 3463712 - RNA, 16 nt, Pseudomonas aeruginosa PA01
gcgggcaugcaccuac

SEQ ID NO: 3463713 - RNA, 18 nt, Pseudomonas aeruginosa PA01
gcgggcaugcaccuacca

SEQ ID NO: 3463714 - RNA, 13 nt, Pseudomonas aeruginosa PA01
gcgggcaugcugc

SEQ ID NO: 3463715 - RNA, 17 nt, Pseudomonas aeruginosa PA01
gcgggcaugcugcucgg

SEQ ID NO: 3463716 - RNA, 15 nt, Pseudomonas aeruginosa PA01
gcgggcauggaucuc

SEQ ID NO: 3463717 - RNA, 17 nt, Pseudomonas aeruginosa PA01
gcgggcauggaucuccc

SEQ ID NO: 3463718 - RNA, 12 nt, Pseudomonas aeruginosa PA01
gcgggccagcag

SEQ ID NO: 3463719 - RNA, 14 nt, Pseudomonas aeruginosa PA01
gcgggccagcagcu

SEQ ID NO: 3463720 - RNA, 16 nt, Pseudomonas aeruginosa PA01
gcgggccagcagcucc

SEQ ID NO: 3463721 - RNA, 13 nt, Pseudomonas aeruginosa PA01
gcgggccagcagg

SEQ ID NO: 3463722 - RNA, 18 nt, Pseudomonas aeruginosa PA01
gcgggccagcaggcgcuc

SEQ ID NO: 3463723 - RNA, 14 nt, Pseudomonas aeruginosa PA01
gcgggccagcaggg

SEQ ID NO: 3463724 - RNA, 23 nt, Pseudomonas aeruginosa PA01
gcgggccagcaggguggccaggg

SEQ ID NO: 3463725 - RNA, 16 nt, Pseudomonas aeruginosa PA01
gcgggccagccguucg

SEQ ID NO: 3463726 - RNA, 16 nt, Pseudomonas aeruginosa PA01
gcgggccagcuggcga

SEQ ID NO: 3463727 - RNA, 12 nt, Pseudomonas aeruginosa PA01
gcgggccaggcc

SEQ ID NO: 3463728 - RNA, 13 nt, Pseudomonas aeruginosa PA01
gcgggccaggccc

SEQ ID NO: 3463729 - RNA, 14 nt, Pseudomonas aeruginosa PA01
gcgggccaggcccu

SEQ ID NO: 3463730 - RNA, 23 nt, Pseudomonas aeruginosa PA01
gcgggccaggcccuuggucaggc

SEQ ID NO: 3463731 - RNA, 14 nt, Pseudomonas aeruginosa PA01
gcgggccaggccga

SEQ ID NO: 3463732 - RNA, 18 nt, Pseudomonas aeruginosa PA01
gcgggccaggccgagcgu

SEQ ID NO: 3463733 - RNA, 13 nt, Pseudomonas aeruginosa PA01
gcgggccaggcgg

SEQ ID NO: 3463734 - RNA, 21 nt, Pseudomonas aeruginosa PA01
gcgggccaucagguccaccag

SEQ ID NO: 3463735 - RNA, 15 nt, Pseudomonas aeruginosa PA01
gcgggccauugcagg

SEQ ID NO: 3463736 - RNA, 16 nt, Pseudomonas aeruginosa PA01
gcgggcccguggcagg

SEQ ID NO: 3463737 - RNA, 12 nt, Pseudomonas aeruginosa PA01
gcgggccgacgg

SEQ ID NO: 3463738 - RNA, 13 nt, Pseudomonas aeruginosa PA01
gcgggccgagguc

SEQ ID NO: 3463739 - RNA, 21 nt, Pseudomonas aeruginosa PA01
gcgggccgaggucgcgggcca

SEQ ID NO: 3463740 - RNA, 23 nt, Pseudomonas aeruginosa PA01
gcgggccgaggucgcgggccagg

SEQ ID NO: 3463741 - RNA, 16 nt, Pseudomonas aeruginosa PA01
gcgggccgcggcgacc

SEQ ID NO: 3463742 - RNA, 19 nt, Pseudomonas aeruginosa PA01
gcgggccgcucaggaugcg

SEQ ID NO: 3463743 - RNA, 22 nt, Pseudomonas aeruginosa PA01
gcgggccgcucaggaugcgaug

SEQ ID NO: 3463744 - RNA, 16 nt, Pseudomonas aeruginosa PA01
gcgggccgcucgcgcg

SEQ ID NO: 3463745 - RNA, 17 nt, Pseudomonas aeruginosa PA01
gcggggaggaagcuccc

SEQ ID NO: 3463746 - RNA, 16 nt, Pseudomonas aeruginosa PA01
gcggggaugaccgucc

SEQ ID NO: 3463747 - RNA, 15 nt, Pseudomonas aeruginosa PA01
gcggggauggcgggc

SEQ ID NO: 3463748 - RNA, 14 nt, Pseudomonas aeruginosa PA01
gcggggccaucagu

SEQ ID NO: 3463749 - RNA, 12 nt, Pseudomonas aeruginosa PA01
gcggggccccgg

SEQ ID NO: 3463750 - RNA, 13 nt, Pseudomonas aeruginosa PA01
gcggggccggacg

SEQ ID NO: 3463751 - RNA, 19 nt, Pseudomonas aeruginosa PA01
gcggggccugcugcgggcg

SEQ ID NO: 3463752 - RNA, 14 nt, Pseudomonas aeruginosa PA01
gcggggcgaccagc

SEQ ID NO: 3463753 - RNA, 17 nt, Pseudomonas aeruginosa PA01
gcggggcgaccagcauc

SEQ ID NO: 3463754 - RNA, 14 nt, Pseudomonas aeruginosa PA01
gcggggcgaggucg

SEQ ID NO: 3463755 - RNA, 13 nt, Pseudomonas aeruginosa PA01
gcggggcgcaccg

SEQ ID NO: 3463756 - RNA, 20 nt, Pseudomonas aeruginosa PA01
gcggggcgcaccgccucgac

SEQ ID NO: 3463757 - RNA, 22 nt, Pseudomonas aeruginosa PA01
gcggggcgcaccgccucgaccc

SEQ ID NO: 3463758 - RNA, 12 nt, Pseudomonas aeruginosa PA01
gcggggcgcagc

SEQ ID NO: 3463759 - RNA, 16 nt, Pseudomonas aeruginosa PA01
gcggggcgcagcagga

SEQ ID NO: 3463760 - RNA, 15 nt, Pseudomonas aeruginosa PA01
gcggggcgcgcugcg

SEQ ID NO: 3463761 - RNA, 15 nt, Pseudomonas aeruginosa PA01
gcggggcguucugcu

SEQ ID NO: 3463762 - RNA, 21 nt, Pseudomonas aeruginosa PA01
gcggggcguucuuuuucgcag

SEQ ID NO: 3463763 - RNA, 23 nt, Pseudomonas aeruginosa PA01
gcggggcuuuuuuucgccugcga

SEQ ID NO: 3463764 - RNA, 22 nt, Pseudomonas aeruginosa PA01
gcgggguaauaccccgccccuu

SEQ ID NO: 3463765 - RNA, 14 nt, Pseudomonas aeruginosa PA01
gcggggucgcgccg

SEQ ID NO: 3463766 - RNA, 15 nt, Pseudomonas aeruginosa PA01
gcggggucgcgccgg

SEQ ID NO: 3463767 - RNA, 14 nt, Pseudomonas aeruginosa PA01
gcggggucgggcag

SEQ ID NO: 3463768 - RNA, 22 nt, Pseudomonas aeruginosa PA01
gcggggucuggccggcgaucag

SEQ ID NO: 3463769 - RNA, 22 nt, Pseudomonas aeruginosa PA01
gcggggugagcaguucgucgau

SEQ ID NO: 3463770 - RNA, 16 nt, Pseudomonas aeruginosa PA01
gcggggugaucaccca

SEQ ID NO: 3463771 - RNA, 15 nt, Pseudomonas aeruginosa PA01
gcggggugcgcugga

SEQ ID NO: 3463772 - RNA, 18 nt, Pseudomonas aeruginosa PA01
gcgggguggcgcggacga

SEQ ID NO: 3463773 - RNA, 17 nt, Pseudomonas aeruginosa PA01
gcgggguucgacgcgcc

SEQ ID NO: 3463774 - RNA, 18 nt, Pseudomonas aeruginosa PA01
gcgggguucgacgcgcca

SEQ ID NO: 3463775 - RNA, 17 nt, Pseudomonas aeruginosa PA01
gcggguaaagcgcccgc

SEQ ID NO: 3463776 - RNA, 20 nt, Pseudomonas aeruginosa PA01
gcggguaaagcgcccgcgca

SEQ ID NO: 3463777 - RNA, 21 nt, Pseudomonas aeruginosa PA01
gcggguaaagcgcccgcgcau

SEQ ID NO: 3463778 - RNA, 22 nt, Pseudomonas aeruginosa PA01
gcggguaaagcgcccgcgcaug

SEQ ID NO: 3463779 - RNA, 15 nt, Pseudomonas aeruginosa PA01
gcggguacgcgggcc

SEQ ID NO: 3463780 - RNA, 20 nt, Pseudomonas aeruginosa PA01
gcggguagagucgcucgcgc

SEQ ID NO: 3463781 - RNA, 15 nt, Pseudomonas aeruginosa PA01
gcggguagcugcugg

SEQ ID NO: 3463782 - RNA, 19 nt, Pseudomonas aeruginosa PA01
gcggguaguguuugcgcag

SEQ ID NO: 3463783 - RNA, 20 nt, Pseudomonas aeruginosa PA01
gcggguaguguuugcgcagg

SEQ ID NO: 3463784 - RNA, 23 nt, Pseudomonas aeruginosa PA01
gcggguaguguuugcgcagggcg

SEQ ID NO: 3463785 - RNA, 15 nt, Pseudomonas aeruginosa PA01
gcggguauccgccgg

SEQ ID NO: 3463786 - RNA, 22 nt, Pseudomonas aeruginosa PA01
gcggguauccgccgggccgccu

SEQ ID NO: 3463787 - RNA, 16 nt, Pseudomonas aeruginosa PA01
gcggguauugcagacg

SEQ ID NO: 3463788 - RNA, 14 nt, Pseudomonas aeruginosa PA01
gcgggucaccaccg

SEQ ID NO: 3463789 - RNA, 13 nt, Pseudomonas aeruginosa PA01
gcgggucaccagc

SEQ ID NO: 3463790 - RNA, 16 nt, Pseudomonas aeruginosa PA01
gcgggucaccagcgcc

SEQ ID NO: 3463791 - RNA, 18 nt, Pseudomonas aeruginosa PA01
gcgggucaccagcgccgg

SEQ ID NO: 3463792 - RNA, 16 nt, Pseudomonas aeruginosa PA01
gcgggucaccagcggg

SEQ ID NO: 3463793 - RNA, 15 nt, Pseudomonas aeruginosa PA01
gcgggucacgccgaa

SEQ ID NO: 3463794 - RNA, 16 nt, Pseudomonas aeruginosa PA01
gcgggucacgccgagg

SEQ ID NO: 3463795 - RNA, 23 nt, Pseudomonas aeruginosa PA01
gcgggucacgccgagggcgcggc

SEQ ID NO: 3463796 - RNA, 18 nt, Pseudomonas aeruginosa PA01
gcgggucagaccacgaag

SEQ ID NO: 3463797 - RNA, 21 nt, Pseudomonas aeruginosa PA01
gcgggucagcagugcggggcg

SEQ ID NO: 3463798 - RNA, 20 nt, Pseudomonas aeruginosa PA01
gcgggucauagucggugacc

SEQ ID NO: 3463799 - RNA, 16 nt, Pseudomonas aeruginosa PA01
gcgggucaucggcccg

SEQ ID NO: 3463800 - RNA, 22 nt, Pseudomonas aeruginosa PA01
gcggguccgcgucacggacccg

SEQ ID NO: 3463801 - RNA, 19 nt, Pseudomonas aeruginosa PA01
gcggguccuggguggcgac

SEQ ID NO: 3463802 - RNA, 21 nt, Pseudomonas aeruginosa PA01
gcggguccuggguggcgacgc

SEQ ID NO: 3463803 - RNA, 24 nt, Pseudomonas aeruginosa PA01
gcggguccuggguggcgacgccgg

SEQ ID NO: 3463804 - RNA, 15 nt, Pseudomonas aeruginosa PA01
gcgggucgagccagg

SEQ ID NO: 3463805 - RNA, 16 nt, Pseudomonas aeruginosa PA01
gcgggucgagccaggc

SEQ ID NO: 3463806 - RNA, 17 nt, Pseudomonas aeruginosa PA01
gcgggucgagccaggcg

SEQ ID NO: 3463807 - RNA, 16 nt, Pseudomonas aeruginosa PA01
gcgggucgaggccgaa

SEQ ID NO: 3463808 - RNA, 15 nt, Pseudomonas aeruginosa PA01
gcgggucgcggcugg

SEQ ID NO: 3463809 - RNA, 19 nt, Pseudomonas aeruginosa PA01
gcgggucgcggcuggccgc

SEQ ID NO: 3463810 - RNA, 18 nt, Pseudomonas aeruginosa PA01
gcgggucguacaccgcgc

SEQ ID NO: 3463811 - RNA, 13 nt, Pseudomonas aeruginosa PA01
gcgggucguccuc

SEQ ID NO: 3463812 - RNA, 17 nt, Pseudomonas aeruginosa PA01
gcgggucguccuccacc

SEQ ID NO: 3463813 - RNA, 14 nt, Pseudomonas aeruginosa PA01
gcgggucgucgaag

SEQ ID NO: 3463814 - RNA, 14 nt, Pseudomonas aeruginosa PA01
gcgggucgucgaug

SEQ ID NO: 3463815 - RNA, 18 nt, Pseudomonas aeruginosa PA01
gcgggucucgaucagcgc

SEQ ID NO: 3463816 - RNA, 19 nt, Pseudomonas aeruginosa PA01
gcgggucucgaucagcgcc

SEQ ID NO: 3463817 - RNA, 20 nt, Pseudomonas aeruginosa PA01
gcgggucucgaucagcgccg

SEQ ID NO: 3463818 - RNA, 22 nt, Pseudomonas aeruginosa PA01
gcgggucugcgccucgcuggcg

SEQ ID NO: 3463819 - RNA, 13 nt, Pseudomonas aeruginosa PA01
gcgggucugcucg

SEQ ID NO: 3463820 - RNA, 17 nt, Pseudomonas aeruginosa PA01
gcgggucugcucgcgcu

SEQ ID NO: 3463821 - RNA, 15 nt, Pseudomonas aeruginosa PA01
gcgggucugcucggc

SEQ ID NO: 3463822 - RNA, 19 nt, Pseudomonas aeruginosa PA01
gcgggucugcucggcgccc

SEQ ID NO: 3463823 - RNA, 18 nt, Pseudomonas aeruginosa PA01
gcgggucuucaggccgca

SEQ ID NO: 3463824 - RNA, 16 nt, Pseudomonas aeruginosa PA01
gcgggucuugcgcagg

SEQ ID NO: 3463825 - RNA, 19 nt, Pseudomonas aeruginosa PA01
gcgggucuugcgcagggcg

SEQ ID NO: 3463826 - RNA, 22 nt, Pseudomonas aeruginosa PA01
gcgggucuugcgcagggcggcg

SEQ ID NO: 3463827 - RNA, 17 nt, Pseudomonas aeruginosa PA01
gcgggugaagcgguggg

SEQ ID NO: 3463828 - RNA, 17 nt, Pseudomonas aeruginosa PA01
gcgggugaccuggccgc

SEQ ID NO: 3463829 - RNA, 19 nt, Pseudomonas aeruginosa PA01
gcgggugaccuggccgccg

SEQ ID NO: 3463830 - RNA, 17 nt, Pseudomonas aeruginosa PA01
gcgggugauacggcucu

SEQ ID NO: 3463831 - RNA, 14 nt, Pseudomonas aeruginosa PA01
gcgggugccgaaga

SEQ ID NO: 3463832 - RNA, 22 nt, Pseudomonas aeruginosa PA01
gcgggugccgaagaccaccaug

SEQ ID NO: 3463833 - RNA, 13 nt, Pseudomonas aeruginosa PA01
gcgggugcgcagg

SEQ ID NO: 3463834 - RNA, 21 nt, Pseudomonas aeruginosa PA01
gcgggugcggcuggcgcgcgc

SEQ ID NO: 3463835 - RNA, 14 nt, Pseudomonas aeruginosa PA01
gcgggugcguggug

SEQ ID NO: 3463836 - RNA, 22 nt, Pseudomonas aeruginosa PA01
gcgggugcguggugcauccgcc

SEQ ID NO: 3463837 - RNA, 15 nt, Pseudomonas aeruginosa PA01
gcggguggcaaccga

SEQ ID NO: 3463838 - RNA, 18 nt, Pseudomonas aeruginosa PA01
gcggguggcaaccgacga

SEQ ID NO: 3463839 - RNA, 20 nt, Pseudomonas aeruginosa PA01
gcggguggcaaccgacgaga

SEQ ID NO: 3463840 - RNA, 15 nt, Pseudomonas aeruginosa PA01
gcggguggcaacugc

SEQ ID NO: 3463841 - RNA, 14 nt, Pseudomonas aeruginosa PA01
gcggguggcgcugu

SEQ ID NO: 3463842 - RNA, 21 nt, Pseudomonas aeruginosa PA01
gcggguggucgccgcccacgc

SEQ ID NO: 3463843 - RNA, 14 nt, Pseudomonas aeruginosa PA01
gcggguguggggaa

SEQ ID NO: 3463844 - RNA, 20 nt, Pseudomonas aeruginosa PA01
gcggguguggggaaaucggu

SEQ ID NO: 3463845 - RNA, 18 nt, Pseudomonas aeruginosa PA01
gcggguuacuucgccgau

SEQ ID NO: 3463846 - RNA, 20 nt, Pseudomonas aeruginosa PA01
gcggguucagcccgccgugc

SEQ ID NO: 3463847 - RNA, 16 nt, Pseudomonas aeruginosa PA01
gcggucgagcagcgcc

SEQ ID NO: 3463848 - RNA, 18 nt, Pseudomonas aeruginosa PA01
gcggucgagcagcgccgc

SEQ ID NO: 3463849 - RNA, 15 nt, Pseudomonas aeruginosa PA01
gcggucgagcucggc

SEQ ID NO: 3463850 - RNA, 21 nt, Pseudomonas aeruginosa PA01
gcggucgagcucggccaggca

SEQ ID NO: 3463851 - RNA, 14 nt, Pseudomonas aeruginosa PA01
gcggucgaggcccu

SEQ ID NO: 3463852 - RNA, 18 nt, Pseudomonas aeruginosa PA01
gcggucgaggcccucggc

SEQ ID NO: 3463853 - RNA, 18 nt, Pseudomonas aeruginosa PA01
gcggucgauccgaccugg

SEQ ID NO: 3463854 - RNA, 14 nt, Pseudomonas aeruginosa PA01
gcggucgauguccu

SEQ ID NO: 3463855 - RNA, 22 nt, Pseudomonas aeruginosa PA01
gcggucgauguccugggccacc

SEQ ID NO: 3463856 - RNA, 16 nt, Pseudomonas aeruginosa PA01
gcggucgccgaacagc

SEQ ID NO: 3463857 - RNA, 20 nt, Pseudomonas aeruginosa PA01
gcggucgccgaacagccgcc

SEQ ID NO: 3463858 - RNA, 12 nt, Pseudomonas aeruginosa PA01
gcggucgccgac

SEQ ID NO: 3463859 - RNA, 18 nt, Pseudomonas aeruginosa PA01
gcggucgccgacccagag

SEQ ID NO: 3463860 - RNA, 14 nt, Pseudomonas aeruginosa PA01
gcggucgccgccgg

SEQ ID NO: 3463861 - RNA, 17 nt, Pseudomonas aeruginosa PA01
gcggucgccgccggcga

SEQ ID NO: 3463862 - RNA, 13 nt, Pseudomonas aeruginosa PA01
gcggucgccggcg

SEQ ID NO: 3463863 - RNA, 14 nt, Pseudomonas aeruginosa PA01
gcggucgccggcgc

SEQ ID NO: 3463864 - RNA, 15 nt, Pseudomonas aeruginosa PA01
gcggucgcgaucugc

SEQ ID NO: 3463865 - RNA, 14 nt, Pseudomonas aeruginosa PA01
gcggucgcggaccu

SEQ ID NO: 3463866 - RNA, 22 nt, Pseudomonas aeruginosa PA01
gcggucgcggaccuccagccgg

SEQ ID NO: 3463867 - RNA, 20 nt, Pseudomonas aeruginosa PA01
gcggucggaaagcagggcga

SEQ ID NO: 3463868 - RNA, 13 nt, Pseudomonas aeruginosa PA01
gcggucggccagg

SEQ ID NO: 3463869 - RNA, 18 nt, Pseudomonas aeruginosa PA01
gcggucggccaggcggcc

SEQ ID NO: 3463870 - RNA, 23 nt, Pseudomonas aeruginosa PA01
gcggucggccaggcggccgacga

SEQ ID NO: 3463871 - RNA, 20 nt, Pseudomonas aeruginosa PA01
gcggucggccaucuggcugc

SEQ ID NO: 3463872 - RNA, 15 nt, Pseudomonas aeruginosa PA01
gcggucggccauggc

SEQ ID NO: 3463873 - RNA, 22 nt, Pseudomonas aeruginosa PA01
gcggucggcucagccgaccacc

SEQ ID NO: 3463874 - RNA, 17 nt, Pseudomonas aeruginosa PA01
gcggucggguccgggcc

SEQ ID NO: 3463875 - RNA, 21 nt, Pseudomonas aeruginosa PA01
gcggucggguccgggcccugc

SEQ ID NO: 3463876 - RNA, 22 nt, Pseudomonas aeruginosa PA01
gcggucggguucuugcugacgu

SEQ ID NO: 3463877 - RNA, 22 nt, Pseudomonas aeruginosa PA01
gcggucggugagcacgccgcga

SEQ ID NO: 3463878 - RNA, 14 nt, Pseudomonas aeruginosa PA01
gcggucgucgccau

SEQ ID NO: 3463879 - RNA, 14 nt, Pseudomonas aeruginosa PA01
gcggucgugcagca

SEQ ID NO: 3463880 - RNA, 16 nt, Pseudomonas aeruginosa PA01
gcggucgugcagcagc

SEQ ID NO: 3463881 - RNA, 18 nt, Pseudomonas aeruginosa PA01
gcggucgugcagcagcgc

SEQ ID NO: 3463882 - RNA, 22 nt, Pseudomonas aeruginosa PA01
gcggucguugaucacgaacagc

SEQ ID NO: 3463883 - RNA, 14 nt, Pseudomonas aeruginosa PA01
gcggucucgaacgc

SEQ ID NO: 3463884 - RNA, 18 nt, Pseudomonas aeruginosa PA01
gcggucucgaacgccagg

SEQ ID NO: 3463885 - RNA, 23 nt, Pseudomonas aeruginosa PA01
gcggucucgcguucaucgucggc

SEQ ID NO: 3463886 - RNA, 14 nt, Pseudomonas aeruginosa PA01
gcggucucggcggg

SEQ ID NO: 3463887 - RNA, 17 nt, Pseudomonas aeruginosa PA01
gcggucucggcgggugc

SEQ ID NO: 3463888 - RNA, 17 nt, Pseudomonas aeruginosa PA01
gcggucuuccgccgacu

SEQ ID NO: 3463889 - RNA, 22 nt, Pseudomonas aeruginosa PA01
gcggucuuccgccgacugcaac

SEQ ID NO: 3463890 - RNA, 22 nt, Pseudomonas aeruginosa PA01
gcggucuugaucacguccaggu

SEQ ID NO: 3463891 - RNA, 20 nt, Pseudomonas aeruginosa PA01
gcggucuuucacgguaaaac

SEQ ID NO: 3463892 - RNA, 19 nt, Pseudomonas aeruginosa PA01
gcggucuuuuuccaggcaa

SEQ ID NO: 3463893 - RNA, 18 nt, Pseudomonas aeruginosa PA01
gcggugaaaccggcaagc

SEQ ID NO: 3463894 - RNA, 13 nt, Pseudomonas aeruginosa PA01
gcggugaaggcga

SEQ ID NO: 3463895 - RNA, 23 nt, Pseudomonas aeruginosa PA01
gcggugaagguccgcgccaugcc

SEQ ID NO: 3463896 - RNA, 15 nt, Pseudomonas aeruginosa PA01
gcggugaccagcggc

SEQ ID NO: 3463897 - RNA, 17 nt, Pseudomonas aeruginosa PA01
gcggugagguugccgcc

SEQ ID NO: 3463898 - RNA, 15 nt, Pseudomonas aeruginosa PA01
gcggugcagaacgcg

SEQ ID NO: 3463899 - RNA, 21 nt, Pseudomonas aeruginosa PA01
gcggugcagcggaagcccugc

SEQ ID NO: 3463900 - RNA, 17 nt, Pseudomonas aeruginosa PA01
gcggugcaguucgccgu

SEQ ID NO: 3463901 - RNA, 20 nt, Pseudomonas aeruginosa PA01
gcggugcaguucgccguuca

SEQ ID NO: 3463902 - RNA, 20 nt, Pseudomonas aeruginosa PA01
gcggugccauggaucaccag

SEQ ID NO: 3463903 - RNA, 13 nt, Pseudomonas aeruginosa PA01
gcggugccgcaga

SEQ ID NO: 3463904 - RNA, 15 nt, Pseudomonas aeruginosa PA01
gcggugccgcgcagc

SEQ ID NO: 3463905 - RNA, 19 nt, Pseudomonas aeruginosa PA01
gcggugccgugggucgccu

SEQ ID NO: 3463906 - RNA, 14 nt, Pseudomonas aeruginosa PA01
gcggugcgccggcg

SEQ ID NO: 3463907 - RNA, 15 nt, Pseudomonas aeruginosa PA01
gcggugcgccggcgg

SEQ ID NO: 3463908 - RNA, 21 nt, Pseudomonas aeruginosa PA01
gcggugcguucgcgggcgccg

SEQ ID NO: 3463909 - RNA, 20 nt, Pseudomonas aeruginosa PA01
gcgguggagcacgucgagca

SEQ ID NO: 3463910 - RNA, 13 nt, Pseudomonas aeruginosa PA01
gcgguggaggcgg

SEQ ID NO: 3463911 - RNA, 16 nt, Pseudomonas aeruginosa PA01
gcgguggaggcggcgg

SEQ ID NO: 3463912 - RNA, 14 nt, Pseudomonas aeruginosa PA01
gcgguggaugccgg

SEQ ID NO: 3463913 - RNA, 13 nt, Pseudomonas aeruginosa PA01
gcgguggccacgu

SEQ ID NO: 3463914 - RNA, 22 nt, Pseudomonas aeruginosa PA01
gcgguggccacgucgccccagg

SEQ ID NO: 3463915 - RNA, 19 nt, Pseudomonas aeruginosa PA01
gcgguggccgcguaccagu

SEQ ID NO: 3463916 - RNA, 19 nt, Pseudomonas aeruginosa PA01
gcggugggcgagggcgcgc

SEQ ID NO: 3463917 - RNA, 15 nt, Pseudomonas aeruginosa PA01
gcggugggcuccagc

SEQ ID NO: 3463918 - RNA, 16 nt, Pseudomonas aeruginosa PA01
gcgguggggccgccga

SEQ ID NO: 3463919 - RNA, 22 nt, Pseudomonas aeruginosa PA01
gcgguggggccgccgaugccga

SEQ ID NO: 3463920 - RNA, 19 nt, Pseudomonas aeruginosa PA01
gcggugggucacggugacg

SEQ ID NO: 3463921 - RNA, 15 nt, Pseudomonas aeruginosa PA01
gcgguguagaccacc

SEQ ID NO: 3463922 - RNA, 20 nt, Pseudomonas aeruginosa PA01
gcgguguagaccaccagcag

SEQ ID NO: 3463923 - RNA, 18 nt, Pseudomonas aeruginosa PA01
gcgguuaccaggucugug

SEQ ID NO: 3463924 - RNA, 14 nt, Pseudomonas aeruginosa PA01
gcgguuagccggcg

SEQ ID NO: 3463925 - RNA, 15 nt, Pseudomonas aeruginosa PA01
gcgguuagccggcga

SEQ ID NO: 3463926 - RNA, 18 nt, Pseudomonas aeruginosa PA01
gcgguuagccggcgauca

SEQ ID NO: 3463927 - RNA, 13 nt, Pseudomonas aeruginosa PA01
gcgguuauccgcc

SEQ ID NO: 3463928 - RNA, 21 nt, Pseudomonas aeruginosa PA01
gcgguuauccgccgccgggcu

SEQ ID NO: 3463929 - RNA, 15 nt, Pseudomonas aeruginosa PA01
gcgguuauccgccgg

SEQ ID NO: 3463930 - RNA, 22 nt, Pseudomonas aeruginosa PA01
gcgguuauccgccggugcgcga

SEQ ID NO: 3463931 - RNA, 23 nt, Pseudomonas aeruginosa PA01
gcgguuauccgccggugcgcgau

SEQ ID NO: 3463932 - RNA, 18 nt, Pseudomonas aeruginosa PA01
gcgguuauccgccgugga

SEQ ID NO: 3463933 - RNA, 13 nt, Pseudomonas aeruginosa PA01
gcgguuauucgcc

SEQ ID NO: 3463934 - RNA, 20 nt, Pseudomonas aeruginosa PA01
gcgguuauucgccccagcgg

SEQ ID NO: 3463935 - RNA, 21 nt, Pseudomonas aeruginosa PA01
gcgguuauucgccccagcggu

SEQ ID NO: 3463936 - RNA, 19 nt, Pseudomonas aeruginosa PA01
gcgguuauucgcccuaccc

SEQ ID NO: 3463937 - RNA, 20 nt, Pseudomonas aeruginosa PA01
gcgguuauucgcccuacggc

SEQ ID NO: 3463938 - RNA, 20 nt, Pseudomonas aeruginosa PA01
gcgguucaggucgaggccgc

SEQ ID NO: 3463939 - RNA, 14 nt, Pseudomonas aeruginosa PA01
gcgguuccuggcug

SEQ ID NO: 3463940 - RNA, 15 nt, Pseudomonas aeruginosa PA01
gcgguucgccgagcg

SEQ ID NO: 3463941 - RNA, 12 nt, Pseudomonas aeruginosa PA01
gcgguucggcac

SEQ ID NO: 3463942 - RNA, 17 nt, Pseudomonas aeruginosa PA01
gcgguucucguccaggu

SEQ ID NO: 3463943 - RNA, 17 nt, Pseudomonas aeruginosa PA01
gcgguugaaacugcgca

SEQ ID NO: 3463944 - RNA, 19 nt, Pseudomonas aeruginosa PA01
gcgguugaaacugcgcagg

SEQ ID NO: 3463945 - RNA, 21 nt, Pseudomonas aeruginosa PA01
gcgguugaaacugcgcaggcu

SEQ ID NO: 3463946 - RNA, 13 nt, Pseudomonas aeruginosa PA01
gcgguugccgaag

SEQ ID NO: 3463947 - RNA, 15 nt, Pseudomonas aeruginosa PA01
gcgguugccgcugcg

SEQ ID NO: 3463948 - RNA, 20 nt, Pseudomonas aeruginosa PA01
gcgguugccgcugcggcggu

SEQ ID NO: 3463949 - RNA, 16 nt, Pseudomonas aeruginosa PA01
gcguccaguagcgccu

SEQ ID NO: 3463950 - RNA, 18 nt, Pseudomonas aeruginosa PA01
gcguccaguagcgccugg

SEQ ID NO: 3463951 - RNA, 13 nt, Pseudomonas aeruginosa PA01
gcguccauccagg

SEQ ID NO: 3463952 - RNA, 20 nt, Pseudomonas aeruginosa PA01
gcguccauccaggcuuucca

SEQ ID NO: 3463953 - RNA, 15 nt, Pseudomonas aeruginosa PA01
gcguccauccccgcc

SEQ ID NO: 3463954 - RNA, 16 nt, Pseudomonas aeruginosa PA01
gcguccauccccgccu

SEQ ID NO: 3463955 - RNA, 19 nt, Pseudomonas aeruginosa PA01
gcguccauccccgccucga

SEQ ID NO: 3463956 - RNA, 14 nt, Pseudomonas aeruginosa PA01
gcguccauggcggc

SEQ ID NO: 3463957 - RNA, 21 nt, Pseudomonas aeruginosa PA01
gcguccauggcggcgauggac

SEQ ID NO: 3463958 - RNA, 18 nt, Pseudomonas aeruginosa PA01
gcgucccauggcgccacg

SEQ ID NO: 3463959 - RNA, 13 nt, Pseudomonas aeruginosa PA01
gcgucccgcagua

SEQ ID NO: 3463960 - RNA, 15 nt, Pseudomonas aeruginosa PA01
gcgucccgcuccagc

SEQ ID NO: 3463961 - RNA, 19 nt, Pseudomonas aeruginosa PA01
gcgucccgcuccagccggc

SEQ ID NO: 3463962 - RNA, 20 nt, Pseudomonas aeruginosa PA01
gcgucccgcuccagccggca

SEQ ID NO: 3463963 - RNA, 19 nt, Pseudomonas aeruginosa PA01
gcgucccguuccggcgcag

SEQ ID NO: 3463964 - RNA, 19 nt, Pseudomonas aeruginosa PA01
gcgucccugcccgcgccuc

SEQ ID NO: 3463965 - RNA, 17 nt, Pseudomonas aeruginosa PA01
gcgucccuggagcaggg

SEQ ID NO: 3463966 - RNA, 21 nt, Pseudomonas aeruginosa PA01
gcgucccuggagcagggcgau

SEQ ID NO: 3463967 - RNA, 13 nt, Pseudomonas aeruginosa PA01
gcgucccugggcc

SEQ ID NO: 3463968 - RNA, 17 nt, Pseudomonas aeruginosa PA01
gcgucccuuggcgucgc

SEQ ID NO: 3463969 - RNA, 19 nt, Pseudomonas aeruginosa PA01
gcgucccuuggcgucgcgg

SEQ ID NO: 3463970 - RNA, 21 nt, Pseudomonas aeruginosa PA01
gcgucccuuguuuuccuggcc

SEQ ID NO: 3463971 - RNA, 20 nt, Pseudomonas aeruginosa PA01
gcguccgaacgcgcugacgg

SEQ ID NO: 3463972 - RNA, 19 nt, Pseudomonas aeruginosa PA01
gcguccgagagcagggccu

SEQ ID NO: 3463973 - RNA, 20 nt, Pseudomonas aeruginosa PA01
gcguccgagguggcugaagc

SEQ ID NO: 3463974 - RNA, 12 nt, Pseudomonas aeruginosa PA01
gcguccgauguc

SEQ ID NO: 3463975 - RNA, 13 nt, Pseudomonas aeruginosa PA01
gcguccgaugucg

SEQ ID NO: 3463976 - RNA, 23 nt, Pseudomonas aeruginosa PA01
gcguccgcaguucgccccgccgc

SEQ ID NO: 3463977 - RNA, 14 nt, Pseudomonas aeruginosa PA01
gcguccgcgcaggc

SEQ ID NO: 3463978 - RNA, 18 nt, Pseudomonas aeruginosa PA01
gcguccgcgcaggcgguc

SEQ ID NO: 3463979 - RNA, 15 nt, Pseudomonas aeruginosa PA01
gcguccgcggccugc

SEQ ID NO: 3463980 - RNA, 16 nt, Pseudomonas aeruginosa PA01
gcguccgcggccugcu

SEQ ID NO: 3463981 - RNA, 14 nt, Pseudomonas aeruginosa PA01
gcguccgcuggccu

SEQ ID NO: 3463982 - RNA, 15 nt, Pseudomonas aeruginosa PA01
gcguccgcuggccug

SEQ ID NO: 3463983 - RNA, 16 nt, Pseudomonas aeruginosa PA01
gcguccgcuggccugc

SEQ ID NO: 3463984 - RNA, 19 nt, Pseudomonas aeruginosa PA01
gcguccgcuggccugcagc

SEQ ID NO: 3463985 - RNA, 20 nt, Pseudomonas aeruginosa PA01
gcguccgcuggccugcagca

SEQ ID NO: 3463986 - RNA, 23 nt, Pseudomonas aeruginosa PA01
gcguccgcuggccugcagcaggu

SEQ ID NO: 3463987 - RNA, 18 nt, Pseudomonas aeruginosa PA01
gcguccggagugaugccg

SEQ ID NO: 3463988 - RNA, 14 nt, Pseudomonas aeruginosa PA01
gcguccggcagggc

SEQ ID NO: 3463989 - RNA, 15 nt, Pseudomonas aeruginosa PA01
gcguccggcagggcc

SEQ ID NO: 3463990 - RNA, 16 nt, Pseudomonas aeruginosa PA01
gcguccggcagggccu

SEQ ID NO: 3463991 - RNA, 22 nt, Pseudomonas aeruginosa PA01
gcguccggccagccuggccagc

SEQ ID NO: 3463992 - RNA, 18 nt, Pseudomonas aeruginosa PA01
gcguccgggugccccagg

SEQ ID NO: 3463993 - RNA, 19 nt, Pseudomonas aeruginosa PA01
gcguccgggugccccaggc

SEQ ID NO: 3463994 - RNA, 23 nt, Pseudomonas aeruginosa PA01
gcguccgguaugccgaucaugcu

SEQ ID NO: 3463995 - RNA, 20 nt, Pseudomonas aeruginosa PA01
gcguccguaaugcaacccgc

SEQ ID NO: 3463996 - RNA, 21 nt, Pseudomonas aeruginosa PA01
gcguccguaaugcaacccgcc

SEQ ID NO: 3463997 - RNA, 23 nt, Pseudomonas aeruginosa PA01
gcguccguaaugcaacccgccgc

SEQ ID NO: 3463998 - RNA, 21 nt, Pseudomonas aeruginosa PA01
gcguccucagccucacccugc

SEQ ID NO: 3463999 - RNA, 22 nt, Pseudomonas aeruginosa PA01
gcguccucagccucacccugcu

SEQ ID NO: 3464000 - RNA, 15 nt, Pseudomonas aeruginosa PA01
gcguccuccuggagg

SEQ ID NO: 3464001 - RNA, 16 nt, Pseudomonas aeruginosa PA01
gcguccucgcgacacc

SEQ ID NO: 3464002 - RNA, 17 nt, Pseudomonas aeruginosa PA01
gcguccugcccuccugc

SEQ ID NO: 3464003 - RNA, 22 nt, Pseudomonas aeruginosa PA01
gcguccugcccuccugcucgau

SEQ ID NO: 3464004 - RNA, 18 nt, Pseudomonas aeruginosa PA01
gcguccugccucggaggc

SEQ ID NO: 3464005 - RNA, 17 nt, Pseudomonas aeruginosa PA01
gcguccugcucccuggc

SEQ ID NO: 3464006 - RNA, 19 nt, Pseudomonas aeruginosa PA01
gcguccugcucccuggcgg

SEQ ID NO: 3464007 - RNA, 14 nt, Pseudomonas aeruginosa PA01
gcguccugcuucca

SEQ ID NO: 3464008 - RNA, 14 nt, Pseudomonas aeruginosa PA01
gcguccuucggcgc

SEQ ID NO: 3464009 - RNA, 15 nt, Pseudomonas aeruginosa PA01
gcguccuucggcgcu

SEQ ID NO: 3464010 - RNA, 16 nt, Pseudomonas aeruginosa PA01
gcguccuucggcgcuc

SEQ ID NO: 3464011 - RNA, 20 nt, Pseudomonas aeruginosa PA01
gcguccuugcccggcgccag

SEQ ID NO: 3464012 - RNA, 14 nt, Pseudomonas aeruginosa PA01
gcgucgaaacgggc

SEQ ID NO: 3464013 - RNA, 23 nt, Pseudomonas aeruginosa PA01
gcgucgaaacgggcgcucuggcc

SEQ ID NO: 3464014 - RNA, 19 nt, Pseudomonas aeruginosa PA01
gcgucgaaaugcucgugca

SEQ ID NO: 3464015 - RNA, 22 nt, Pseudomonas aeruginosa PA01
gcgucgaaaugcucgugcaggu

SEQ ID NO: 3464016 - RNA, 19 nt, Pseudomonas aeruginosa PA01
gcgucgaacaccggcgccg

SEQ ID NO: 3464017 - RNA, 21 nt, Pseudomonas aeruginosa PA01
gcgucgaagccggauucgcgc

SEQ ID NO: 3464018 - RNA, 19 nt, Pseudomonas aeruginosa PA01
gcgucgaagcugucggccc

SEQ ID NO: 3464019 - RNA, 13 nt, Pseudomonas aeruginosa PA01
gcgucgaaggcgg

SEQ ID NO: 3464020 - RNA, 16 nt, Pseudomonas aeruginosa PA01
gcgucgaaggcggcgc

SEQ ID NO: 3464021 - RNA, 17 nt, Pseudomonas aeruginosa PA01
gcgucgaaggcggcgcg

SEQ ID NO: 3464022 - RNA, 20 nt, Pseudomonas aeruginosa PA01
gcgucgaccaccgcguggug

SEQ ID NO: 3464023 - RNA, 16 nt, Pseudomonas aeruginosa PA01
gcgucgaccacggccu

SEQ ID NO: 3464024 - RNA, 14 nt, Pseudomonas aeruginosa PA01
gcgucgaccgccug

SEQ ID NO: 3464025 - RNA, 21 nt, Pseudomonas aeruginosa PA01
gcgucgaccgccugccagacc

SEQ ID NO: 3464026 - RNA, 19 nt, Pseudomonas aeruginosa PA01
gcgucgacgccgaagccgc

SEQ ID NO: 3464027 - RNA, 23 nt, Pseudomonas aeruginosa PA01
gcgucgacgccgaagccgcuggc

SEQ ID NO: 3464028 - RNA, 17 nt, Pseudomonas aeruginosa PA01
gcgucgagcuggcgcag

SEQ ID NO: 3464029 - RNA, 21 nt, Pseudomonas aeruginosa PA01
gcgucgagcuggcgcaggccu

SEQ ID NO: 3464030 - RNA, 17 nt, Pseudomonas aeruginosa PA01
gcgucgaguaccgcugc

SEQ ID NO: 3464031 - RNA, 18 nt, Pseudomonas aeruginosa PA01
gcgucgaguaccgcugcg

SEQ ID NO: 3464032 - RNA, 20 nt, Pseudomonas aeruginosa PA01
gcgucgaguaccgcugcggc

SEQ ID NO: 3464033 - RNA, 23 nt, Pseudomonas aeruginosa PA01
gcgucgaguaccgcugcggccgg

SEQ ID NO: 3464034 - RNA, 13 nt, Pseudomonas aeruginosa PA01
gcgucgagucgcg

SEQ ID NO: 3464035 - RNA, 14 nt, Pseudomonas aeruginosa PA01
gcgucgagucgcgc

SEQ ID NO: 3464036 - RNA, 18 nt, Pseudomonas aeruginosa PA01
gcgucgagucgcgcagcc

SEQ ID NO: 3464037 - RNA, 15 nt, Pseudomonas aeruginosa PA01
gcgucgaucaggcgg

SEQ ID NO: 3464038 - RNA, 20 nt, Pseudomonas aeruginosa PA01
gcgucgaucaucugcugcag

SEQ ID NO: 3464039 - RNA, 14 nt, Pseudomonas aeruginosa PA01
gcgucgaucccgau

SEQ ID NO: 3464040 - RNA, 17 nt, Pseudomonas aeruginosa PA01
gcgucgaugaucccgau

SEQ ID NO: 3464041 - RNA, 21 nt, Pseudomonas aeruginosa PA01
gcgucgaugccgaauccgcug

SEQ ID NO: 3464042 - RNA, 14 nt, Pseudomonas aeruginosa PA01
gcgucgaugcgccu

SEQ ID NO: 3464043 - RNA, 14 nt, Pseudomonas aeruginosa PA01
gcgucgcaccaggu

SEQ ID NO: 3464044 - RNA, 16 nt, Pseudomonas aeruginosa PA01
gcgucgcacccggccc

SEQ ID NO: 3464045 - RNA, 21 nt, Pseudomonas aeruginosa PA01
gcgucgcacccggcccauggc

SEQ ID NO: 3464046 - RNA, 16 nt, Pseudomonas aeruginosa PA01
gcgucgcacugcugcu

SEQ ID NO: 3464047 - RNA, 18 nt, Pseudomonas aeruginosa PA01
gcgucgcaggcgaugccg

SEQ ID NO: 3464048 - RNA, 20 nt, Pseudomonas aeruginosa PA01
gcgucgcaggcgaugccgac

SEQ ID NO: 3464049 - RNA, 16 nt, Pseudomonas aeruginosa PA01
gcgucgcauccaccag

SEQ ID NO: 3464050 - RNA, 20 nt, Pseudomonas aeruginosa PA01
gcgucgccaacgcgccgucg

SEQ ID NO: 3464051 - RNA, 22 nt, Pseudomonas aeruginosa PA01
gcgucugggacggcagccuggg

SEQ ID NO: 3464052 - RNA, 16 nt, Pseudomonas aeruginosa PA01
gcgucuggggugaggc

SEQ ID NO: 3464053 - RNA, 17 nt, Pseudomonas aeruginosa PA01
gcgucuggggugaggcc

SEQ ID NO: 3464054 - RNA, 17 nt, Pseudomonas aeruginosa PA01
gcgucuucgccgaugcg

SEQ ID NO: 3464055 - RNA, 21 nt, Pseudomonas aeruginosa PA01
gcgucuucgccgaugcgccga

SEQ ID NO: 3464056 - RNA, 15 nt, Pseudomonas aeruginosa PA01
gcgucuugucgaagc

SEQ ID NO: 3464057 - RNA, 11 nt, Pseudomonas aeruginosa PA01
gcgugaaaaca

SEQ ID NO: 3464058 - RNA, 23 nt, Pseudomonas aeruginosa PA01
gcgugaaaacaagaagccccgcu

SEQ ID NO: 3464059 - RNA, 16 nt, Pseudomonas aeruginosa PA01
gcgugaacgcggcgag

SEQ ID NO: 3464060 - RNA, 21 nt, Pseudomonas aeruginosa PA01
gcgugaagaccugguccaacg

SEQ ID NO: 3464061 - RNA, 14 nt, Pseudomonas aeruginosa PA01
gcgugaagccgccg

SEQ ID NO: 3464062 - RNA, 20 nt, Pseudomonas aeruginosa PA01
gcgugaagccgccgcccagc

SEQ ID NO: 3464063 - RNA, 16 nt, Pseudomonas aeruginosa PA01
gcgugaagcuggagca

SEQ ID NO: 3464064 - RNA, 17 nt, Pseudomonas aeruginosa PA01
gcgugaaguagccgccg

SEQ ID NO: 3464065 - RNA, 18 nt, Pseudomonas aeruginosa PA01
gcgugaaguagccgccgg

SEQ ID NO: 3464066 - RNA, 20 nt, Pseudomonas aeruginosa PA01
gcgugaaguagccgccggga

SEQ ID NO: 3464067 - RNA, 21 nt, Pseudomonas aeruginosa PA01
gcgugaaguagccgccgggac

SEQ ID NO: 3464068 - RNA, 22 nt, Pseudomonas aeruginosa PA01
gcgugagcagggccgagcgcag

SEQ ID NO: 3464069 - RNA, 23 nt, Pseudomonas aeruginosa PA01
gcgugagcagggccgagcgcagc

SEQ ID NO: 3464070 - RNA, 13 nt, Pseudomonas aeruginosa PA01
gcgugaggaucac

SEQ ID NO: 3464071 - RNA, 19 nt, Pseudomonas aeruginosa PA01
gcgugaguaucaucgcgau

SEQ ID NO: 3464072 - RNA, 17 nt, Pseudomonas aeruginosa PA01
gcgugauacagcucgcu

SEQ ID NO: 3464073 - RNA, 18 nt, Pseudomonas aeruginosa PA01
gcgugauccgcagguagc

SEQ ID NO: 3464074 - RNA, 13 nt, Pseudomonas aeruginosa PA01
gcgugcaccagca

SEQ ID NO: 3464075 - RNA, 16 nt, Pseudomonas aeruginosa PA01
gcgugcaccagcaggc

SEQ ID NO: 3464076 - RNA, 16 nt, Pseudomonas aeruginosa PA01
gcgugcaggccgauca

SEQ ID NO: 3464077 - RNA, 13 nt, Pseudomonas aeruginosa PA01
gcgugcaggccgc

SEQ ID NO: 3464078 - RNA, 14 nt, Pseudomonas aeruginosa PA01
gcgugcaggccgcc

SEQ ID NO: 3464079 - RNA, 15 nt, Pseudomonas aeruginosa PA01
gcgugcaggccgccg

SEQ ID NO: 3464080 - RNA, 18 nt, Pseudomonas aeruginosa PA01
gcgugcaggccgccgagu

SEQ ID NO: 3464081 - RNA, 15 nt, Pseudomonas aeruginosa PA01
gcgugcaggcgcccu

SEQ ID NO: 3464082 - RNA, 18 nt, Pseudomonas aeruginosa PA01
gcgugcaggcgcccuggc

SEQ ID NO: 3464083 - RNA, 19 nt, Pseudomonas aeruginosa PA01
gcgugcaggcgcccuggcc

SEQ ID NO: 3464084 - RNA, 20 nt, Pseudomonas aeruginosa PA01
gcgugcagguagcagccguc

SEQ ID NO: 3464085 - RNA, 23 nt, Pseudomonas aeruginosa PA01
gcgugcaguacuuggccagcagc

SEQ ID NO: 3464086 - RNA, 15 nt, Pseudomonas aeruginosa PA01
gcgugcauggccggg

SEQ ID NO: 3464087 - RNA, 16 nt, Pseudomonas aeruginosa PA01
gcgugcauggccgggc

SEQ ID NO: 3464088 - RNA, 17 nt, Pseudomonas aeruginosa PA01
gcgugcauggccgggcc

SEQ ID NO: 3464089 - RNA, 13 nt, Pseudomonas aeruginosa PA01
gcgugccagcacc

SEQ ID NO: 3464090 - RNA, 14 nt, Pseudomonas aeruginosa PA01
gcgugccagcaccu

SEQ ID NO: 3464091 - RNA, 13 nt, Pseudomonas aeruginosa PA01
gcgugccaggagc

SEQ ID NO: 3464092 - RNA, 19 nt, Pseudomonas aeruginosa PA01
gcgugccaggagcuugccg

SEQ ID NO: 3464093 - RNA, 19 nt, Pseudomonas aeruginosa PA01
gcgugcccauccgcucggc

SEQ ID NO: 3464094 - RNA, 22 nt, Pseudomonas aeruginosa PA01
gcgugcccauccgcucggcgag

SEQ ID NO: 3464095 - RNA, 23 nt, Pseudomonas aeruginosa PA01
gcgugcccauccgcucggcgagu

SEQ ID NO: 3464096 - RNA, 22 nt, Pseudomonas aeruginosa PA01
gcgugccccguggcgggccagc

SEQ ID NO: 3464097 - RNA, 14 nt, Pseudomonas aeruginosa PA01
gcgugcccgcugca

SEQ ID NO: 3464098 - RNA, 15 nt, Pseudomonas aeruginosa PA01
gcgugccgcaggccg

SEQ ID NO: 3464099 - RNA, 16 nt, Pseudomonas aeruginosa PA01
gcgugccgcaggccgc

SEQ ID NO: 3464100 - RNA, 20 nt, Pseudomonas aeruginosa PA01
gcgugccgcaggccgcggcc

SEQ ID NO: 3464101 - RNA, 21 nt, Pseudomonas aeruginosa PA01
gcgugccgcaggccgcggccg

SEQ ID NO: 3464102 - RNA, 13 nt, Pseudomonas aeruginosa PA01
gcgugccgccgga

SEQ ID NO: 3464103 - RNA, 14 nt, Pseudomonas aeruginosa PA01
gcgugccgcuggcc

SEQ ID NO: 3464104 - RNA, 15 nt, Pseudomonas aeruginosa PA01
gcgugccgggccggc

SEQ ID NO: 3464105 - RNA, 19 nt, Pseudomonas aeruginosa PA01
gcgugccgggccggccagg

SEQ ID NO: 3464106 - RNA, 22 nt, Pseudomonas aeruginosa PA01
gcgugccguggcucggcggcag

SEQ ID NO: 3464107 - RNA, 23 nt, Pseudomonas aeruginosa PA01
gcgugccguggcucggcggcagg

SEQ ID NO: 3464108 - RNA, 22 nt, Pseudomonas aeruginosa PA01
gcgugccuguuccuccgccagg

SEQ ID NO: 3464109 - RNA, 23 nt, Pseudomonas aeruginosa PA01
gcgugccuguuccuccgccaggu

SEQ ID NO: 3464110 - RNA, 16 nt, Pseudomonas aeruginosa PA01
gcgugcgagggcggcg

SEQ ID NO: 3464111 - RNA, 17 nt, Pseudomonas aeruginosa PA01
gcgugcgcaugcccgcg

SEQ ID NO: 3464112 - RNA, 16 nt, Pseudomonas aeruginosa PA01
gcgugcgcgcccucgg

SEQ ID NO: 3464113 - RNA, 18 nt, Pseudomonas aeruginosa PA01
gcgugcgcgcccucggug

SEQ ID NO: 3464114 - RNA, 12 nt, Pseudomonas aeruginosa PA01
gcgugcgcgccg

SEQ ID NO: 3464115 - RNA, 15 nt, Pseudomonas aeruginosa PA01
gcgugcgcgccgccg

SEQ ID NO: 3464116 - RNA, 15 nt, Pseudomonas aeruginosa PA01
gcgugcggccgauca

SEQ ID NO: 3464117 - RNA, 17 nt, Pseudomonas aeruginosa PA01
gcgugcguugcgcggca

SEQ ID NO: 3464118 - RNA, 13 nt, Pseudomonas aeruginosa PA01
gcgugcuccagca

SEQ ID NO: 3464119 - RNA, 18 nt, Pseudomonas aeruginosa PA01
gcgugcuccagcaccgug

SEQ ID NO: 3464120 - RNA, 19 nt, Pseudomonas aeruginosa PA01
gcgugcuccagcaccgugg

SEQ ID NO: 3464121 - RNA, 21 nt, Pseudomonas aeruginosa PA01
gcgugcucgcgcaugaucgcc

SEQ ID NO: 3464122 - RNA, 16 nt, Pseudomonas aeruginosa PA01
gcgugcucggcgaucu

SEQ ID NO: 3464123 - RNA, 21 nt, Pseudomonas aeruginosa PA01
gcgugcucggcgaucucgccc

SEQ ID NO: 3464124 - RNA, 21 nt, Pseudomonas aeruginosa PA01
gcgugcucuuuucccgcaccg

SEQ ID NO: 3464125 - RNA, 23 nt, Pseudomonas aeruginosa PA01
gcgugcucuuuucccgcaccggc

SEQ ID NO: 3464126 - RNA, 17 nt, Pseudomonas aeruginosa PA01
gcgugcuggugccgauc

SEQ ID NO: 3464127 - RNA, 22 nt, Pseudomonas aeruginosa PA01
gcgugcuggugccgaucagccc

SEQ ID NO: 3464128 - RNA, 18 nt, Pseudomonas aeruginosa PA01
gcgugcuuggcgaggcgc

SEQ ID NO: 3464129 - RNA, 20 nt, Pseudomonas aeruginosa PA01
gcgugcuuggcgaggcgcgc

SEQ ID NO: 3464130 - RNA, 15 nt, Pseudomonas aeruginosa PA01
gcguggaaccgcggc

SEQ ID NO: 3464131 - RNA, 17 nt, Pseudomonas aeruginosa PA01
gcguggaaccgcggcgc

SEQ ID NO: 3464132 - RNA, 21 nt, Pseudomonas aeruginosa PA01
gcguggcaaaaaugcccuugg

SEQ ID NO: 3464133 - RNA, 14 nt, Pseudomonas aeruginosa PA01
gcguggcaccgcuu

SEQ ID NO: 3464134 - RNA, 22 nt, Pseudomonas aeruginosa PA01
gcguggcacguacguccagggc

SEQ ID NO: 3464135 - RNA, 21 nt, Pseudomonas aeruginosa PA01
gcguggccagcgaacccaggc

SEQ ID NO: 3464136 - RNA, 17 nt, Pseudomonas aeruginosa PA01
gcguggcccggcgcggc

SEQ ID NO: 3464137 - RNA, 19 nt, Pseudomonas aeruginosa PA01
gcguggcccggcgcggcgg

SEQ ID NO: 3464138 - RNA, 14 nt, Pseudomonas aeruginosa PA01
gcguggccgccagg

SEQ ID NO: 3464139 - RNA, 15 nt, Pseudomonas aeruginosa PA01
gcguggccgccaggg

SEQ ID NO: 3464140 - RNA, 18 nt, Pseudomonas aeruginosa PA01
gcguggcgaacgcccggc

SEQ ID NO: 3464141 - RNA, 22 nt, Pseudomonas aeruginosa PA01
gcguggcgaucaggcagcgcgc

SEQ ID NO: 3464142 - RNA, 14 nt, Pseudomonas aeruginosa PA01
gcguggcgaugccc

SEQ ID NO: 3464143 - RNA, 18 nt, Pseudomonas aeruginosa PA01
gcguggcgcgcaucggug

SEQ ID NO: 3464144 - RNA, 13 nt, Pseudomonas aeruginosa PA01
gcguggcggacaa

SEQ ID NO: 3464145 - RNA, 18 nt, Pseudomonas aeruginosa PA01
gcguggcggacaacccgg

SEQ ID NO: 3464146 - RNA, 23 nt, Pseudomonas aeruginosa PA01
gcguggcggacaacccggcgcug

SEQ ID NO: 3464147 - RNA, 16 nt, Pseudomonas aeruginosa PA01
gcguggcggccgccgg

SEQ ID NO: 3464148 - RNA, 17 nt, Pseudomonas aeruginosa PA01
gcguggcggccgccggc

SEQ ID NO: 3464149 - RNA, 15 nt, Pseudomonas aeruginosa PA01
gcguggcggucaggg

SEQ ID NO: 3464150 - RNA, 17 nt, Pseudomonas aeruginosa PA01
gcguggcuacggaugcu

SEQ ID NO: 3464151 - RNA, 14 nt, Pseudomonas aeruginosa PA01
gcguggcugccgga

SEQ ID NO: 3464152 - RNA, 18 nt, Pseudomonas aeruginosa PA01
gcguggcuucguccagcg

SEQ ID NO: 3464153 - RNA, 14 nt, Pseudomonas aeruginosa PA01
gcguucggcgcugg

SEQ ID NO: 3464154 - RNA, 15 nt, Pseudomonas aeruginosa PA01
gcguucggcgcuggc

SEQ ID NO: 3464155 - RNA, 16 nt, Pseudomonas aeruginosa PA01
gcguucggcgcuggcg

SEQ ID NO: 3464156 - RNA, 21 nt, Pseudomonas aeruginosa PA01
gcguucggggcccuccaggcg

SEQ ID NO: 3464157 - RNA, 13 nt, Pseudomonas aeruginosa PA01
gcguucggucagg

SEQ ID NO: 3464158 - RNA, 16 nt, Pseudomonas aeruginosa PA01
gcguucggucaggcug

SEQ ID NO: 3464159 - RNA, 22 nt, Pseudomonas aeruginosa PA01
gcguucgucguggccauagagc

SEQ ID NO: 3464160 - RNA, 18 nt, Pseudomonas aeruginosa PA01
gcguucucccugagccug

SEQ ID NO: 3464161 - RNA, 22 nt, Pseudomonas aeruginosa PA01
gcguucucgaucaucgccagcg

SEQ ID NO: 3464162 - RNA, 13 nt, Pseudomonas aeruginosa PA01
gcguucugcugcu

SEQ ID NO: 3464163 - RNA, 16 nt, Pseudomonas aeruginosa PA01
gcguucugcugcuugc

SEQ ID NO: 3464164 - RNA, 13 nt, Pseudomonas aeruginosa PA01
gcguucuucaccc

SEQ ID NO: 3464165 - RNA, 22 nt, Pseudomonas aeruginosa PA01
gcguucuucacccgcagcggca

SEQ ID NO: 3464166 - RNA, 23 nt, Pseudomonas aeruginosa PA01
gcguucuucacccgcagcggcag

SEQ ID NO: 3464167 - RNA, 15 nt, Pseudomonas aeruginosa PA01
gcguucuucagcacu

SEQ ID NO: 3464168 - RNA, 19 nt, Pseudomonas aeruginosa PA01
gcguugaacugcccgcagg

SEQ ID NO: 3464169 - RNA, 21 nt, Pseudomonas aeruginosa PA01
gcguugaccgugaugcccagc

SEQ ID NO: 3464170 - RNA, 17 nt, Pseudomonas aeruginosa PA01
gcguugacgcggaugcc

SEQ ID NO: 3464171 - RNA, 12 nt, Pseudomonas aeruginosa PA01
gcguugauccgg

SEQ ID NO: 3464172 - RNA, 12 nt, Pseudomonas aeruginosa PA01
gcguugcaggcg

SEQ ID NO: 3464173 - RNA, 16 nt, Pseudomonas aeruginosa PA01
gcguugcagugcgccg

SEQ ID NO: 3464174 - RNA, 19 nt, Pseudomonas aeruginosa PA01
gcguugcagugcgccgcag

SEQ ID NO: 3464175 - RNA, 18 nt, Pseudomonas aeruginosa PA01
gcguugcauguccucggc

SEQ ID NO: 3464176 - RNA, 22 nt, Pseudomonas aeruginosa PA01
gcguugcauguccucggcgccg

SEQ ID NO: 3464177 - RNA, 22 nt, Pseudomonas aeruginosa PA01
gcguugcccaugaucgccaccg

SEQ ID NO: 3464178 - RNA, 14 nt, Pseudomonas aeruginosa PA01
gcguugcgccagac

SEQ ID NO: 3464179 - RNA, 18 nt, Pseudomonas aeruginosa PA01
gcguugcgccagaccagc

SEQ ID NO: 3464180 - RNA, 15 nt, Pseudomonas aeruginosa PA01
gcguugcgcggcagg

SEQ ID NO: 3464181 - RNA, 13 nt, Pseudomonas aeruginosa PA01
gcguugcgggcag

SEQ ID NO: 3464182 - RNA, 15 nt, Pseudomonas aeruginosa PA01
gcguugcuuccaggc

SEQ ID NO: 3464183 - RNA, 19 nt, Pseudomonas aeruginosa PA01
gcguugcuuccaggcaccg

SEQ ID NO: 3464184 - RNA, 18 nt, Pseudomonas aeruginosa PA01
gcguugcuuguguccgcc

SEQ ID NO: 3464185 - RNA, 20 nt, Pseudomonas aeruginosa PA01
gcguugcuuguguccgccga

SEQ ID NO: 3464186 - RNA, 24 nt, Pseudomonas aeruginosa PA01
gcguuggaauaguggaucgcccga

SEQ ID NO: 3464187 - RNA, 17 nt, Pseudomonas aeruginosa PA01
gcguuggaucaccgggg

SEQ ID NO: 3464188 - RNA, 15 nt, Pseudomonas aeruginosa PA01
gcguuggccagcgcc

SEQ ID NO: 3464189 - RNA, 16 nt, Pseudomonas aeruginosa PA01
gcguuggccagcgcca

SEQ ID NO: 3464190 - RNA, 17 nt, Pseudomonas aeruginosa PA01
gcguuggccagcgccac

SEQ ID NO: 3464191 - RNA, 13 nt, Pseudomonas aeruginosa PA01
gcguuggccugga

SEQ ID NO: 3464192 - RNA, 17 nt, Pseudomonas aeruginosa PA01
gcguuggcggugccgca

SEQ ID NO: 3464193 - RNA, 16 nt, Pseudomonas aeruginosa PA01
gcguuggcgucgcugc

SEQ ID NO: 3464194 - RNA, 18 nt, Pseudomonas aeruginosa PA01
gcguuggcgucgcugccg

SEQ ID NO: 3464195 - RNA, 15 nt, Pseudomonas aeruginosa PA01
gcguuggcuggcggg

SEQ ID NO: 3464196 - RNA, 21 nt, Pseudomonas aeruginosa PA01
gcguuguagaucugcaccgcc

SEQ ID NO: 3464197 - RNA, 13 nt, Pseudomonas aeruginosa PA01
gcguuguccaggc

SEQ ID NO: 3464198 - RNA, 18 nt, Pseudomonas aeruginosa PA01
gcguugucccugucccgc

SEQ ID NO: 3464199 - RNA, 19 nt, Pseudomonas aeruginosa PA01
gcguugucccugucccgcc

SEQ ID NO: 3464200 - RNA, 23 nt, Pseudomonas aeruginosa PA01
gcguugucccugucccgccgcgc

SEQ ID NO: 3464201 - RNA, 21 nt, Pseudomonas aeruginosa PA01
gcguugucggcaaccgggcgg

SEQ ID NO: 3464202 - RNA, 14 nt, Pseudomonas aeruginosa PA01
gcguugucggccag

SEQ ID NO: 3464203 - RNA, 18 nt, Pseudomonas aeruginosa PA01
gcguugugccgccaccuc

SEQ ID NO: 3464204 - RNA, 16 nt, Pseudomonas aeruginosa PA01
gcguuguucuucgacg

SEQ ID NO: 3464205 - RNA, 15 nt, Pseudomonas aeruginosa PA01
gcguuguuggucagg

SEQ ID NO: 3464206 - RNA, 14 nt, Pseudomonas aeruginosa PA01
gcguuuagcgcccg

SEQ ID NO: 3464207 - RNA, 21 nt, Pseudomonas aeruginosa PA01
gcguuuccggucacgcaggcg

SEQ ID NO: 3464208 - RNA, 19 nt, Pseudomonas aeruginosa PA01
gcguuugcgucauccgccu

SEQ ID NO: 3464209 - RNA, 19 nt, Pseudomonas aeruginosa PA01
gcguuuuucauugggcagc

SEQ ID NO: 3464210 - RNA, 18 nt, Pseudomonas aeruginosa PA01
gcguuuuucauuuccgcc

SEQ ID NO: 3464211 - RNA, 16 nt, Pseudomonas aeruginosa PA01
gcguuuuuucuuucca

SEQ ID NO: 3464212 - RNA, 23 nt, Pseudomonas aeruginosa PA01
gcguuuuuucuuuccagcgccgu

SEQ ID NO: 3464213 - RNA, 12 nt, Pseudomonas aeruginosa PA01
gcuacagcaauu

SEQ ID NO: 3464214 - RNA, 14 nt, Pseudomonas aeruginosa PA01
gcuacagcaauuac

SEQ ID NO: 3464215 - RNA, 21 nt, Pseudomonas aeruginosa PA01
gcuacaggccguagcgcucga

SEQ ID NO: 3464216 - RNA, 19 nt, Pseudomonas aeruginosa PA01
gcuacaucgucugcgcggc

SEQ ID NO: 3464217 - RNA, 13 nt, Pseudomonas aeruginosa PA01
gcuaccagcaauu

SEQ ID NO: 3464218 - RNA, 14 nt, Pseudomonas aeruginosa PA01
gcuaccagcaauuc

SEQ ID NO: 3464219 - RNA, 18 nt, Pseudomonas aeruginosa PA01
gcuaccagcgcuucggcg

SEQ ID NO: 3464220 - RNA, 22 nt, Pseudomonas aeruginosa PA01
gcuaccaggaagcucggcagca

SEQ ID NO: 3464221 - RNA, 17 nt, Pseudomonas aeruginosa PA01
gcuacccagguggucga

SEQ ID NO: 3464222 - RNA, 15 nt, Pseudomonas aeruginosa PA01
gcuacccgcagggcu

SEQ ID NO: 3464223 - RNA, 15 nt, Pseudomonas aeruginosa PA01
gcuacccgcgccuuc

SEQ ID NO: 3464224 - RNA, 22 nt, Pseudomonas aeruginosa PA01
gcuacccucaggggugcagccc

SEQ ID NO: 3464225 - RNA, 23 nt, Pseudomonas aeruginosa PA01
gcuacccucaggggugcagcccu

SEQ ID NO: 3464226 - RNA, 15 nt, Pseudomonas aeruginosa PA01
gcuacccucucccca

SEQ ID NO: 3464227 - RNA, 13 nt, Pseudomonas aeruginosa PA01
gcuacccugcccc

SEQ ID NO: 3464228 - RNA, 17 nt, Pseudomonas aeruginosa PA01
gcuaccgcgcauggcgg

SEQ ID NO: 3464229 - RNA, 14 nt, Pseudomonas aeruginosa PA01
gcuaccgucggccu

SEQ ID NO: 3464230 - RNA, 15 nt, Pseudomonas aeruginosa PA01
gcuaccgucggccug

SEQ ID NO: 3464231 - RNA, 16 nt, Pseudomonas aeruginosa PA01
gcuaccgucggccugc

SEQ ID NO: 3464232 - RNA, 13 nt, Pseudomonas aeruginosa PA01
gcuacgaaccgag

SEQ ID NO: 3464233 - RNA, 18 nt, Pseudomonas aeruginosa PA01
gcuacgaaccgagcgguc

SEQ ID NO: 3464234 - RNA, 20 nt, Pseudomonas aeruginosa PA01
gcuacgaaggcgugccgcug

SEQ ID NO: 3464235 - RNA, 13 nt, Pseudomonas aeruginosa PA01
gcuacgcggcggg

SEQ ID NO: 3464236 - RNA, 13 nt, Pseudomonas aeruginosa PA01
gcuacgcucgccg

SEQ ID NO: 3464237 - RNA, 14 nt, Pseudomonas aeruginosa PA01
gcuacgcucgccga

SEQ ID NO: 3464238 - RNA, 16 nt, Pseudomonas aeruginosa PA01
gcuacgcucgccgacg

SEQ ID NO: 3464239 - RNA, 14 nt, Pseudomonas aeruginosa PA01
gcuacggcaucacc

SEQ ID NO: 3464240 - RNA, 19 nt, Pseudomonas aeruginosa PA01
gcuacggcaucaccggcgg

SEQ ID NO: 3464241 - RNA, 17 nt, Pseudomonas aeruginosa PA01
gcuagcgcauggcgacc

SEQ ID NO: 3464242 - RNA, 21 nt, Pseudomonas aeruginosa PA01
gcuagcgcauggcgaccuggu

SEQ ID NO: 3464243 - RNA, 19 nt, Pseudomonas aeruginosa PA01
gcuaggcuggaagccgcgc

SEQ ID NO: 3464244 - RNA, 13 nt, Pseudomonas aeruginosa PA01
gcuagggcgcccu

SEQ ID NO: 3464245 - RNA, 20 nt, Pseudomonas aeruginosa PA01
gcuagguuuccccguggcgc

SEQ ID NO: 3464246 - RNA, 21 nt, Pseudomonas aeruginosa PA01
gcuagguuuccccguggcgcc

SEQ ID NO: 3464247 - RNA, 19 nt, Pseudomonas aeruginosa PA01
gcuagucgcgcagcgccuc

SEQ ID NO: 3464248 - RNA, 21 nt, Pseudomonas aeruginosa PA01
gcuagucuuccugcacgcugc

SEQ ID NO: 3464249 - RNA, 24 nt, Pseudomonas aeruginosa PA01
gcuagucuuccugcacgcugcgcc

SEQ ID NO: 3464250 - RNA, 16 nt, Pseudomonas aeruginosa PA01
gcuaguuauugaagug

SEQ ID NO: 3464251 - RNA, 19 nt, Pseudomonas aeruginosa PA01
gcuaucaggugagggcgac

SEQ ID NO: 3464252 - RNA, 17 nt, Pseudomonas aeruginosa PA01
gcuaucccccggccgau

SEQ ID NO: 3464253 - RNA, 16 nt, Pseudomonas aeruginosa PA01
gcuauccgccgcuacu

SEQ ID NO: 3464254 - RNA, 16 nt, Pseudomonas aeruginosa PA01
gcuauccuccaggccg

SEQ ID NO: 3464255 - RNA, 19 nt, Pseudomonas aeruginosa PA01
gcuauccuccaggccgccg

SEQ ID NO: 3464256 - RNA, 13 nt, Pseudomonas aeruginosa PA01
gcucaggccgggc

SEQ ID NO: 3464257 - RNA, 15 nt, Pseudomonas aeruginosa PA01
gcucaggccuuggcu

SEQ ID NO: 3464258 - RNA, 16 nt, Pseudomonas aeruginosa PA01
gcucaggccuuggcuu

SEQ ID NO: 3464259 - RNA, 17 nt, Pseudomonas aeruginosa PA01
gcucaggcgcagcgucc

SEQ ID NO: 3464260 - RNA, 16 nt, Pseudomonas aeruginosa PA01
gcucaggcgcugcugg

SEQ ID NO: 3464261 - RNA, 13 nt, Pseudomonas aeruginosa PA01
gcucaggcggccg

SEQ ID NO: 3464262 - RNA, 16 nt, Pseudomonas aeruginosa PA01
gcucaggcugugcagg

SEQ ID NO: 3464263 - RNA, 17 nt, Pseudomonas aeruginosa PA01
gcucaggcugugcagga

SEQ ID NO: 3464264 - RNA, 19 nt, Pseudomonas aeruginosa PA01
gcucaggcugugcaggaag

SEQ ID NO: 3464265 - RNA, 14 nt, Pseudomonas aeruginosa PA01
gcucagggaaugga

SEQ ID NO: 3464266 - RNA, 22 nt, Pseudomonas aeruginosa PA01
gcucagggaauggaugcgcggc

SEQ ID NO: 3464267 - RNA, 22 nt, Pseudomonas aeruginosa PA01
gcucaggguggcguuuucccag

SEQ ID NO: 3464268 - RNA, 23 nt, Pseudomonas aeruginosa PA01
gcucaggucggucgaacugacca

SEQ ID NO: 3464269 - RNA, 18 nt, Pseudomonas aeruginosa PA01
gcucaggucguagggcgu

SEQ ID NO: 3464270 - RNA, 16 nt, Pseudomonas aeruginosa PA01
gcucaggucgucgagg

SEQ ID NO: 3464271 - RNA, 16 nt, Pseudomonas aeruginosa PA01
gcucagucgaccgucg

SEQ ID NO: 3464272 - RNA, 18 nt, Pseudomonas aeruginosa PA01
gcucagucgaccgucgcc

SEQ ID NO: 3464273 - RNA, 13 nt, Pseudomonas aeruginosa PA01
gcucagucgagca

SEQ ID NO: 3464274 - RNA, 19 nt, Pseudomonas aeruginosa PA01
gcucagucgguagagcagu

SEQ ID NO: 3464275 - RNA, 22 nt, Pseudomonas aeruginosa PA01
gcucagucgguagagcaguugg

SEQ ID NO: 3464276 - RNA, 15 nt, Pseudomonas aeruginosa PA01
gcucaguucggccag

SEQ ID NO: 3464277 - RNA, 18 nt, Pseudomonas aeruginosa PA01
gcucaguucggccagcgg

SEQ ID NO: 3464278 - RNA, 19 nt, Pseudomonas aeruginosa PA01
gcucaguucggccagcggc

SEQ ID NO: 3464279 - RNA, 16 nt, Pseudomonas aeruginosa PA01
gcucaguugcugauca

SEQ ID NO: 3464280 - RNA, 21 nt, Pseudomonas aeruginosa PA01
gcucaguugcugaucaggccg

SEQ ID NO: 3464281 - RNA, 17 nt, Pseudomonas aeruginosa PA01
gcucaucauugaaauca

SEQ ID NO: 3464282 - RNA, 22 nt, Pseudomonas aeruginosa PA01
gcucauccgcugguagcccagg

SEQ ID NO: 3464283 - RNA, 15 nt, Pseudomonas aeruginosa PA01
gcucaucgcccgccc

SEQ ID NO: 3464284 - RNA, 23 nt, Pseudomonas aeruginosa PA01
gcucaucgcguagguggcgccgc

SEQ ID NO: 3464285 - RNA, 14 nt, Pseudomonas aeruginosa PA01
gcucaucucguuga

SEQ ID NO: 3464286 - RNA, 23 nt, Pseudomonas aeruginosa PA01
gcucaucucguugagggucagcg

SEQ ID NO: 3464287 - RNA, 16 nt, Pseudomonas aeruginosa PA01
gcucaucuucucguuc

SEQ ID NO: 3464288 - RNA, 23 nt, Pseudomonas aeruginosa PA01
gcucaugaacacgguguagaccu

SEQ ID NO: 3464289 - RNA, 16 nt, Pseudomonas aeruginosa PA01
gcucaugagauccgcc

SEQ ID NO: 3464290 - RNA, 17 nt, Pseudomonas aeruginosa PA01
gcucaugagauccgcca

SEQ ID NO: 3464291 - RNA, 15 nt, Pseudomonas aeruginosa PA01
gcucaugccuugucg

SEQ ID NO: 3464292 - RNA, 16 nt, Pseudomonas aeruginosa PA01
gcucauggagcaacag

SEQ ID NO: 3464293 - RNA, 22 nt, Pseudomonas aeruginosa PA01
gcucauggagcaacagcgucgc

SEQ ID NO: 3464294 - RNA, 16 nt, Pseudomonas aeruginosa PA01
gcucauggcauggcca

SEQ ID NO: 3464295 - RNA, 13 nt, Pseudomonas aeruginosa PA01
gcucauggccggg

SEQ ID NO: 3464296 - RNA, 17 nt, Pseudomonas aeruginosa PA01
gcucauucggccagcgc

SEQ ID NO: 3464297 - RNA, 20 nt, Pseudomonas aeruginosa PA01
gcucauuggcggaugagccg

SEQ ID NO: 3464298 - RNA, 14 nt, Pseudomonas aeruginosa PA01
gcuccaacagcagg

SEQ ID NO: 3464299 - RNA, 15 nt, Pseudomonas aeruginosa PA01
gcuccaacagcaggu

SEQ ID NO: 3464300 - RNA, 16 nt, Pseudomonas aeruginosa PA01
gcuccaacagcaggua

SEQ ID NO: 3464301 - RNA, 22 nt, Pseudomonas aeruginosa PA01
gcuccaacaggcauugccgucc

SEQ ID NO: 3464302 - RNA, 22 nt, Pseudomonas aeruginosa PA01
gcuccaacggcccuuccacuuc

SEQ ID NO: 3464303 - RNA, 24 nt, Pseudomonas aeruginosa PA01
gcuccaauccgauuccgcgcagga

SEQ ID NO: 3464304 - RNA, 20 nt, Pseudomonas aeruginosa PA01
gcuccaaugcaccugcgccc

SEQ ID NO: 3464305 - RNA, 18 nt, Pseudomonas aeruginosa PA01
gcuccaauucgacgccga

SEQ ID NO: 3464306 - RNA, 14 nt, Pseudomonas aeruginosa PA01
gcuccacagcugcc

SEQ ID NO: 3464307 - RNA, 17 nt, Pseudomonas aeruginosa PA01
gcuccacagcugccagc

SEQ ID NO: 3464308 - RNA, 18 nt, Pseudomonas aeruginosa PA01
gcuccacagcugccagcc

SEQ ID NO: 3464309 - RNA, 20 nt, Pseudomonas aeruginosa PA01
gcuccacagcugccagcccc

SEQ ID NO: 3464310 - RNA, 22 nt, Pseudomonas aeruginosa PA01
gcuccacagcugccagccccgc

SEQ ID NO: 3464311 - RNA, 14 nt, Pseudomonas aeruginosa PA01
gcuccaccaggcca

SEQ ID NO: 3464312 - RNA, 15 nt, Pseudomonas aeruginosa PA01
gcuccacccaggcgc

SEQ ID NO: 3464313 - RNA, 14 nt, Pseudomonas aeruginosa PA01
gcuccacccgcagc

SEQ ID NO: 3464314 - RNA, 19 nt, Pseudomonas aeruginosa PA01
gcuccacccgcagccgcgu

SEQ ID NO: 3464315 - RNA, 19 nt, Pseudomonas aeruginosa PA01
gcuccaccgauggcgcgcu

SEQ ID NO: 3464316 - RNA, 18 nt, Pseudomonas aeruginosa PA01
gcuccaccgcccccggcg

SEQ ID NO: 3464317 - RNA, 22 nt, Pseudomonas aeruginosa PA01
gcuccaccgcccccggcgccac

SEQ ID NO: 3464318 - RNA, 17 nt, Pseudomonas aeruginosa PA01
gcuccaccgcgcuccgc

SEQ ID NO: 3464319 - RNA, 22 nt, Pseudomonas aeruginosa PA01
gcuccaccucggaccagaggcu

SEQ ID NO: 3464320 - RNA, 16 nt, Pseudomonas aeruginosa PA01
gcuccacgucggcccg

SEQ ID NO: 3464321 - RNA, 14 nt, Pseudomonas aeruginosa PA01
gcuccacugcuugg

SEQ ID NO: 3464322 - RNA, 18 nt, Pseudomonas aeruginosa PA01
gcuccacugcuuggccag

SEQ ID NO: 3464323 - RNA, 18 nt, Pseudomonas aeruginosa PA01
gcuccagaccuccaggua

SEQ ID NO: 3464324 - RNA, 21 nt, Pseudomonas aeruginosa PA01
gcuccagaccuccagguaggc

SEQ ID NO: 3464325 - RNA, 22 nt, Pseudomonas aeruginosa PA01
gcuccagacucuccaggucggu

SEQ ID NO: 3464326 - RNA, 18 nt, Pseudomonas aeruginosa PA01
gcuccagaugcuggagcu

SEQ ID NO: 3464327 - RNA, 15 nt, Pseudomonas aeruginosa PA01
gcuccagcaaugcca

SEQ ID NO: 3464328 - RNA, 14 nt, Pseudomonas aeruginosa PA01
gcuccagcaccagc

SEQ ID NO: 3464329 - RNA, 21 nt, Pseudomonas aeruginosa PA01
gcuccagcaccagcacgcccu

SEQ ID NO: 3464330 - RNA, 18 nt, Pseudomonas aeruginosa PA01
gcuccagcaccggcggcg

SEQ ID NO: 3464331 - RNA, 19 nt, Pseudomonas aeruginosa PA01
gcuccagcaccggcggcgc

SEQ ID NO: 3464332 - RNA, 21 nt, Pseudomonas aeruginosa PA01
gcuccagcaccggcggcgcca

SEQ ID NO: 3464333 - RNA, 11 nt, Pseudomonas aeruginosa PA01
gcuccagcagg

SEQ ID NO: 3464334 - RNA, 12 nt, Pseudomonas aeruginosa PA01
gcuccagcaggg

SEQ ID NO: 3464335 - RNA, 20 nt, Pseudomonas aeruginosa PA01
gcuccagcagggccagcgcc

SEQ ID NO: 3464336 - RNA, 11 nt, Pseudomonas aeruginosa PA01
gcuccagcagu

SEQ ID NO: 3464337 - RNA, 21 nt, Pseudomonas aeruginosa PA01
gcuccagcagucgcacagcca

SEQ ID NO: 3464338 - RNA, 23 nt, Pseudomonas aeruginosa PA01
gcuccagcaucaccuugcggaac

SEQ ID NO: 3464339 - RNA, 13 nt, Pseudomonas aeruginosa PA01
gcuccagccaggc

SEQ ID NO: 3464340 - RNA, 15 nt, Pseudomonas aeruginosa PA01
gcuccagccaggccc

SEQ ID NO: 3464341 - RNA, 18 nt, Pseudomonas aeruginosa PA01
gcuccagccaggcccggu

SEQ ID NO: 3464342 - RNA, 14 nt, Pseudomonas aeruginosa PA01
gcuccagcccggcu

SEQ ID NO: 3464343 - RNA, 17 nt, Pseudomonas aeruginosa PA01
gcuccagcccggcucgg

SEQ ID NO: 3464344 - RNA, 22 nt, Pseudomonas aeruginosa PA01
gcuccagccgcugcagggcggc

SEQ ID NO: 3464345 - RNA, 13 nt, Pseudomonas aeruginosa PA01
gcuccagccggca

SEQ ID NO: 3464346 - RNA, 15 nt, Pseudomonas aeruginosa PA01
gcuccagccggcaag

SEQ ID NO: 3464347 - RNA, 13 nt, Pseudomonas aeruginosa PA01
gcuccagccgggc

SEQ ID NO: 3464348 - RNA, 18 nt, Pseudomonas aeruginosa PA01
gcuccagccgggcuccgc

SEQ ID NO: 3464349 - RNA, 23 nt, Pseudomonas aeruginosa PA01
gcuccagccgggcuccgccgcga

SEQ ID NO: 3464350 - RNA, 24 nt, Pseudomonas aeruginosa PA01
gcuccagcgaauggacaggcgccc

SEQ ID NO: 3464351 - RNA, 12 nt, Pseudomonas aeruginosa PA01
gcuccagcgccu

SEQ ID NO: 3464352 - RNA, 13 nt, Pseudomonas aeruginosa PA01
gcuccagcgccuc

SEQ ID NO: 3464353 - RNA, 15 nt, Pseudomonas aeruginosa PA01
gcuccagcgccucga

SEQ ID NO: 3464354 - RNA, 20 nt, Pseudomonas aeruginosa PA01
gcuccagcgccucgaccaga

SEQ ID NO: 3464355 - RNA, 20 nt, Pseudomonas aeruginosa PA01
gcuccagcggaaucgcgccc

SEQ ID NO: 3464356 - RNA, 18 nt, Pseudomonas aeruginosa PA01
gcuccagcggcagcucgg

SEQ ID NO: 3464357 - RNA, 19 nt, Pseudomonas aeruginosa PA01
gcuccagcggcagcucggc

SEQ ID NO: 3464358 - RNA, 23 nt, Pseudomonas aeruginosa PA01
gcuccggcgggcgguagcgggcc

SEQ ID NO: 3464359 - RNA, 13 nt, Pseudomonas aeruginosa PA01
gcuccggcuccgc

SEQ ID NO: 3464360 - RNA, 14 nt, Pseudomonas aeruginosa PA01
gcuccggcuccgcg

SEQ ID NO: 3464361 - RNA, 19 nt, Pseudomonas aeruginosa PA01
gcuccggcucuccccgcuc

SEQ ID NO: 3464362 - RNA, 14 nt, Pseudomonas aeruginosa PA01
gcuccgggcuccac

SEQ ID NO: 3464363 - RNA, 17 nt, Pseudomonas aeruginosa PA01
gcuccgggcuccaccag

SEQ ID NO: 3464364 - RNA, 20 nt, Pseudomonas aeruginosa PA01
gcuccgggcuggccaccagc

SEQ ID NO: 3464365 - RNA, 22 nt, Pseudomonas aeruginosa PA01
gcuccgggcuggccaccagcac

SEQ ID NO: 3464366 - RNA, 23 nt, Pseudomonas aeruginosa PA01
gcuccgggcuggccaccagcacc

SEQ ID NO: 3464367 - RNA, 17 nt, Pseudomonas aeruginosa PA01
gcuccggggucaguucc

SEQ ID NO: 3464368 - RNA, 20 nt, Pseudomonas aeruginosa PA01
gcuccggguacuggcgcugc

SEQ ID NO: 3464369 - RNA, 21 nt, Pseudomonas aeruginosa PA01
gcuccggguacuggcgcugcg

SEQ ID NO: 3464370 - RNA, 18 nt, Pseudomonas aeruginosa PA01
gcuccggguugucgucgu

SEQ ID NO: 3464371 - RNA, 19 nt, Pseudomonas aeruginosa PA01
gcuccggugccagggcggu

SEQ ID NO: 3464372 - RNA, 14 nt, Pseudomonas aeruginosa PA01
gcuccgguggcgga

SEQ ID NO: 3464373 - RNA, 17 nt, Pseudomonas aeruginosa PA01
gcuccgguggcggacug

SEQ ID NO: 3464374 - RNA, 16 nt, Pseudomonas aeruginosa PA01
gcuccgucgcuucgcc

SEQ ID NO: 3464375 - RNA, 20 nt, Pseudomonas aeruginosa PA01
gcuccgucgcuucgcccgcc

SEQ ID NO: 3464376 - RNA, 19 nt, Pseudomonas aeruginosa PA01
gcuccgucuguucggccag

SEQ ID NO: 3464377 - RNA, 20 nt, Pseudomonas aeruginosa PA01
gcuccgucuguucggccagg

SEQ ID NO: 3464378 - RNA, 22 nt, Pseudomonas aeruginosa PA01
gcuccgucuguucggccaggga

SEQ ID NO: 3464379 - RNA, 16 nt, Pseudomonas aeruginosa PA01
gcuccgugucggcggc

SEQ ID NO: 3464380 - RNA, 21 nt, Pseudomonas aeruginosa PA01
gcuccgugucggcggcgccuu

SEQ ID NO: 3464381 - RNA, 19 nt, Pseudomonas aeruginosa PA01
gcuccguugaacucggcgc

SEQ ID NO: 3464382 - RNA, 22 nt, Pseudomonas aeruginosa PA01
gcuccucagaggcgaccagccg

SEQ ID NO: 3464383 - RNA, 23 nt, Pseudomonas aeruginosa PA01
gcuccucagaggcgaccagccgg

SEQ ID NO: 3464384 - RNA, 22 nt, Pseudomonas aeruginosa PA01
gcuccuccagcaggaccuggcc

SEQ ID NO: 3464385 - RNA, 17 nt, Pseudomonas aeruginosa PA01
gcuccuccagccgcggg

SEQ ID NO: 3464386 - RNA, 12 nt, Pseudomonas aeruginosa PA01
gcuccuccagcg

SEQ ID NO: 3464387 - RNA, 14 nt, Pseudomonas aeruginosa PA01
gcuccuccagcgcc

SEQ ID NO: 3464388 - RNA, 18 nt, Pseudomonas aeruginosa PA01
gcuccuccagcgccgcca

SEQ ID NO: 3464389 - RNA, 19 nt, Pseudomonas aeruginosa PA01
gcuccuccagcgccgccag

SEQ ID NO: 3464390 - RNA, 18 nt, Pseudomonas aeruginosa PA01
gcuccuccagcguggcgg

SEQ ID NO: 3464391 - RNA, 17 nt, Pseudomonas aeruginosa PA01
gcuccuccgacgccccc

SEQ ID NO: 3464392 - RNA, 20 nt, Pseudomonas aeruginosa PA01
gcuccuccucgcucugcgcc

SEQ ID NO: 3464393 - RNA, 16 nt, Pseudomonas aeruginosa PA01
gcuccucgauccgcuc

SEQ ID NO: 3464394 - RNA, 21 nt, Pseudomonas aeruginosa PA01
gcuccucgccguacagcaggc

SEQ ID NO: 3464395 - RNA, 19 nt, Pseudomonas aeruginosa PA01
gcuccucggcagcgcuggc

SEQ ID NO: 3464396 - RNA, 21 nt, Pseudomonas aeruginosa PA01
gcuccucggcagcgcuggcga

SEQ ID NO: 3464397 - RNA, 12 nt, Pseudomonas aeruginosa PA01
gcuccucggccu

SEQ ID NO: 3464398 - RNA, 21 nt, Pseudomonas aeruginosa PA01
gcuccucggccugggcgcagg

SEQ ID NO: 3464399 - RNA, 17 nt, Pseudomonas aeruginosa PA01
gcuccucggccuugcug

SEQ ID NO: 3464400 - RNA, 20 nt, Pseudomonas aeruginosa PA01
gcuccucggccuugcuggcg

SEQ ID NO: 3464401 - RNA, 20 nt, Pseudomonas aeruginosa PA01
gcuccucgucguacuggcgg

SEQ ID NO: 3464402 - RNA, 18 nt, Pseudomonas aeruginosa PA01
gcuccucugccugcgccc

SEQ ID NO: 3464403 - RNA, 14 nt, Pseudomonas aeruginosa PA01
gcuccugcaggccc

SEQ ID NO: 3464404 - RNA, 20 nt, Pseudomonas aeruginosa PA01
gcuccugcaggcccugccag

SEQ ID NO: 3464405 - RNA, 14 nt, Pseudomonas aeruginosa PA01
gcuccugcgccggc

SEQ ID NO: 3464406 - RNA, 15 nt, Pseudomonas aeruginosa PA01
gcuccugcgccggcu

SEQ ID NO: 3464407 - RNA, 21 nt, Pseudomonas aeruginosa PA01
gcuccugcgccggcucgugcg

SEQ ID NO: 3464408 - RNA, 16 nt, Pseudomonas aeruginosa PA01
gcuccugcggcuggcg

SEQ ID NO: 3464409 - RNA, 22 nt, Pseudomonas aeruginosa PA01
gcuccuggaugcuccgcgccuc

SEQ ID NO: 3464410 - RNA, 23 nt, Pseudomonas aeruginosa PA01
gcuccuggaugcuccgcgccuca

SEQ ID NO: 3464411 - RNA, 15 nt, Pseudomonas aeruginosa PA01
gcuccuggcaggcuc

SEQ ID NO: 3464412 - RNA, 16 nt, Pseudomonas aeruginosa PA01
gcuccuggcaggcuca

SEQ ID NO: 3464413 - RNA, 18 nt, Pseudomonas aeruginosa PA01
gcuccuggugcggcacca

SEQ ID NO: 3464414 - RNA, 19 nt, Pseudomonas aeruginosa PA01
gcuccuggugcggcaccag

SEQ ID NO: 3464415 - RNA, 20 nt, Pseudomonas aeruginosa PA01
gcuccuggugcggcaccagc

SEQ ID NO: 3464416 - RNA, 16 nt, Pseudomonas aeruginosa PA01
gcuccuguugcuggcc

SEQ ID NO: 3464417 - RNA, 17 nt, Pseudomonas aeruginosa PA01
gcuccuguugcuggccg

SEQ ID NO: 3464418 - RNA, 18 nt, Pseudomonas aeruginosa PA01
gcuccuguugcuggccgg

SEQ ID NO: 3464419 - RNA, 22 nt, Pseudomonas aeruginosa PA01
gcuccuucuccggggcccggca

SEQ ID NO: 3464420 - RNA, 23 nt, Pseudomonas aeruginosa PA01
gcuccuucuccggggcccggcag

SEQ ID NO: 3464421 - RNA, 23 nt, Pseudomonas aeruginosa PA01
gcuccuugaaggcuuccuggaag

SEQ ID NO: 3464422 - RNA, 15 nt, Pseudomonas aeruginosa PA01
gcuccuugagcagcu

SEQ ID NO: 3464423 - RNA, 17 nt, Pseudomonas aeruginosa PA01
gcuccuugcgccaggcc

SEQ ID NO: 3464424 - RNA, 15 nt, Pseudomonas aeruginosa PA01
gcuccuugcgcuccu

SEQ ID NO: 3464425 - RNA, 18 nt, Pseudomonas aeruginosa PA01
gcuccuuggcuggccagc

SEQ ID NO: 3464426 - RNA, 23 nt, Pseudomonas aeruginosa PA01
gcuccuuggcuggccagcccugg

SEQ ID NO: 3464427 - RNA, 22 nt, Pseudomonas aeruginosa PA01
gcuccuuucggaacagcgccuu

SEQ ID NO: 3464428 - RNA, 18 nt, Pseudomonas aeruginosa PA01
gcucgaaagccuccagca

SEQ ID NO: 3464429 - RNA, 16 nt, Pseudomonas aeruginosa PA01
gcucgaacaucagcag

SEQ ID NO: 3464430 - RNA, 22 nt, Pseudomonas aeruginosa PA01
gcucgaacgccgcccgucgcgc

SEQ ID NO: 3464431 - RNA, 19 nt, Pseudomonas aeruginosa PA01
gcucgaacggcggaucgau

SEQ ID NO: 3464432 - RNA, 15 nt, Pseudomonas aeruginosa PA01
gcucgaacgggcacu

SEQ ID NO: 3464433 - RNA, 12 nt, Pseudomonas aeruginosa PA01
gcucgaagccgc

SEQ ID NO: 3464434 - RNA, 16 nt, Pseudomonas aeruginosa PA01
gcucgaagcuccagcg

SEQ ID NO: 3464435 - RNA, 21 nt, Pseudomonas aeruginosa PA01
gcucgaauaaaaaaccggcca

SEQ ID NO: 3464436 - RNA, 14 nt, Pseudomonas aeruginosa PA01
gcucgaaugcuguu

SEQ ID NO: 3464437 - RNA, 21 nt, Pseudomonas aeruginosa PA01
gcucgaaugcuguuccucguc

SEQ ID NO: 3464438 - RNA, 14 nt, Pseudomonas aeruginosa PA01
gcucgacaggucgg

SEQ ID NO: 3464439 - RNA, 15 nt, Pseudomonas aeruginosa PA01
gcucgacauugcugc

SEQ ID NO: 3464440 - RNA, 18 nt, Pseudomonas aeruginosa PA01
gcucgacauugcugccga

SEQ ID NO: 3464441 - RNA, 16 nt, Pseudomonas aeruginosa PA01
gcucgaccaccucggc

SEQ ID NO: 3464442 - RNA, 19 nt, Pseudomonas aeruginosa PA01
gcucgaccaccucggcguc

SEQ ID NO: 3464443 - RNA, 13 nt, Pseudomonas aeruginosa PA01
gcucgacccgccc

SEQ ID NO: 3464444 - RNA, 15 nt, Pseudomonas aeruginosa PA01
gcucgaccgccugcu

SEQ ID NO: 3464445 - RNA, 20 nt, Pseudomonas aeruginosa PA01
gcucgaccgccugcucgcgg

SEQ ID NO: 3464446 - RNA, 24 nt, Pseudomonas aeruginosa PA01
gcucgaccgccugcucgcggcugg

SEQ ID NO: 3464447 - RNA, 15 nt, Pseudomonas aeruginosa PA01
gcucgaccuugccga

SEQ ID NO: 3464448 - RNA, 18 nt, Pseudomonas aeruginosa PA01
gcucgaccuugccgagcg

SEQ ID NO: 3464449 - RNA, 16 nt, Pseudomonas aeruginosa PA01
gcucgacgagccgcga

SEQ ID NO: 3464450 - RNA, 17 nt, Pseudomonas aeruginosa PA01
gcucgacgagccgcgac

SEQ ID NO: 3464451 - RNA, 21 nt, Pseudomonas aeruginosa PA01
gcucgacgaggaacgccucgc

SEQ ID NO: 3464452 - RNA, 22 nt, Pseudomonas aeruginosa PA01
gcucgacgaggaacgccucgca

SEQ ID NO: 3464453 - RNA, 16 nt, Pseudomonas aeruginosa PA01
gcucgacgaucugucg

SEQ ID NO: 3464454 - RNA, 18 nt, Pseudomonas aeruginosa PA01
gcucgacgaucugucgau

SEQ ID NO: 3464455 - RNA, 17 nt, Pseudomonas aeruginosa PA01
gcucgacggucagcgga

SEQ ID NO: 3464456 - RNA, 18 nt, Pseudomonas aeruginosa PA01
gcucgacggucagcggac

SEQ ID NO: 3464457 - RNA, 15 nt, Pseudomonas aeruginosa PA01
gcucgacgucgucga

SEQ ID NO: 3464458 - RNA, 13 nt, Pseudomonas aeruginosa PA01
gcucgagccggcu

SEQ ID NO: 3464459 - RNA, 15 nt, Pseudomonas aeruginosa PA01
gcucgagccggcuga

SEQ ID NO: 3464460 - RNA, 14 nt, Pseudomonas aeruginosa PA01
gcucgcgggucacc

SEQ ID NO: 3464461 - RNA, 17 nt, Pseudomonas aeruginosa PA01
gcucgcgggucaccacc

SEQ ID NO: 3464462 - RNA, 18 nt, Pseudomonas aeruginosa PA01
gcucgcgggucaccaccg

SEQ ID NO: 3464463 - RNA, 17 nt, Pseudomonas aeruginosa PA01
gcucgcgggucaccagc

SEQ ID NO: 3464464 - RNA, 21 nt, Pseudomonas aeruginosa PA01
gcucgcgguaggccagcuccu

SEQ ID NO: 3464465 - RNA, 18 nt, Pseudomonas aeruginosa PA01
gcucgcgguuauccgccg

SEQ ID NO: 3464466 - RNA, 19 nt, Pseudomonas aeruginosa PA01
gcucgcgguuauccgccgc

SEQ ID NO: 3464467 - RNA, 22 nt, Pseudomonas aeruginosa PA01
gcucgcgguuauccgccgccgg

SEQ ID NO: 3464468 - RNA, 20 nt, Pseudomonas aeruginosa PA01
gcucgcgguuauccgccgga

SEQ ID NO: 3464469 - RNA, 21 nt, Pseudomonas aeruginosa PA01
gcucgcgguuauccgccggaa

SEQ ID NO: 3464470 - RNA, 18 nt, Pseudomonas aeruginosa PA01
gcucgcuacagccgggau

SEQ ID NO: 3464471 - RNA, 16 nt, Pseudomonas aeruginosa PA01
gcucgcuaugcagcag

SEQ ID NO: 3464472 - RNA, 17 nt, Pseudomonas aeruginosa PA01
gcucgcuaugcagcagg

SEQ ID NO: 3464473 - RNA, 15 nt, Pseudomonas aeruginosa PA01
gcucgcuccgagcag

SEQ ID NO: 3464474 - RNA, 16 nt, Pseudomonas aeruginosa PA01
gcucgcucucgaacac

SEQ ID NO: 3464475 - RNA, 19 nt, Pseudomonas aeruginosa PA01
gcucgcugaaauccaccag

SEQ ID NO: 3464476 - RNA, 12 nt, Pseudomonas aeruginosa PA01
gcucgcugcccg

SEQ ID NO: 3464477 - RNA, 16 nt, Pseudomonas aeruginosa PA01
gcucgcuguccagcac

SEQ ID NO: 3464478 - RNA, 13 nt, Pseudomonas aeruginosa PA01
gcucgcugucgcc

SEQ ID NO: 3464479 - RNA, 16 nt, Pseudomonas aeruginosa PA01
gcucgcugucgccgag

SEQ ID NO: 3464480 - RNA, 17 nt, Pseudomonas aeruginosa PA01
gcucgcugucgccgagc

SEQ ID NO: 3464481 - RNA, 18 nt, Pseudomonas aeruginosa PA01
gcucgcugucgccgagca

SEQ ID NO: 3464482 - RNA, 19 nt, Pseudomonas aeruginosa PA01
gcucgcugucgcucagcgg

SEQ ID NO: 3464483 - RNA, 16 nt, Pseudomonas aeruginosa PA01
gcucgcuucagcgagc

SEQ ID NO: 3464484 - RNA, 19 nt, Pseudomonas aeruginosa PA01
gcucggaaaccucgccggu

SEQ ID NO: 3464485 - RNA, 21 nt, Pseudomonas aeruginosa PA01
gcucggaaaccucgccgguca

SEQ ID NO: 3464486 - RNA, 21 nt, Pseudomonas aeruginosa PA01
gcucggacaagggccagagca

SEQ ID NO: 3464487 - RNA, 12 nt, Pseudomonas aeruginosa PA01
gcucggacgaca

SEQ ID NO: 3464488 - RNA, 21 nt, Pseudomonas aeruginosa PA01
gcucggacugaaaccccacca

SEQ ID NO: 3464489 - RNA, 19 nt, Pseudomonas aeruginosa PA01
gcucggaucaggcgggcuc

SEQ ID NO: 3464490 - RNA, 24 nt, Pseudomonas aeruginosa PA01
gcucggaucaggcgggcuccgccg

SEQ ID NO: 3464491 - RNA, 15 nt, Pseudomonas aeruginosa PA01
gcucggauuccagcg

SEQ ID NO: 3464492 - RNA, 14 nt, Pseudomonas aeruginosa PA01
gcucggcaagcgaa

SEQ ID NO: 3464493 - RNA, 16 nt, Pseudomonas aeruginosa PA01
gcucggcaagcgaacc

SEQ ID NO: 3464494 - RNA, 19 nt, Pseudomonas aeruginosa PA01
gcucggcaagcgaaccgag

SEQ ID NO: 3464495 - RNA, 15 nt, Pseudomonas aeruginosa PA01
gcucggcacgcagca

SEQ ID NO: 3464496 - RNA, 17 nt, Pseudomonas aeruginosa PA01
gcucggcacgcguggcg

SEQ ID NO: 3464497 - RNA, 18 nt, Pseudomonas aeruginosa PA01
gcucggcauucgacccgc

SEQ ID NO: 3464498 - RNA, 21 nt, Pseudomonas aeruginosa PA01
gcucggcauucgacccgccga

SEQ ID NO: 3464499 - RNA, 23 nt, Pseudomonas aeruginosa PA01
gcucggcauucgacccgccgacc

SEQ ID NO: 3464500 - RNA, 19 nt, Pseudomonas aeruginosa PA01
gcucggccagcgccacggc

SEQ ID NO: 3464501 - RNA, 15 nt, Pseudomonas aeruginosa PA01
gcucggccagcgucc

SEQ ID NO: 3464502 - RNA, 22 nt, Pseudomonas aeruginosa PA01
gcucggccagcguccuucggcg

SEQ ID NO: 3464503 - RNA, 15 nt, Pseudomonas aeruginosa PA01
gcucggccagcucgc

SEQ ID NO: 3464504 - RNA, 16 nt, Pseudomonas aeruginosa PA01
gcucggccagcucgcc

SEQ ID NO: 3464505 - RNA, 17 nt, Pseudomonas aeruginosa PA01
gcucggccagcucgccg

SEQ ID NO: 3464506 - RNA, 13 nt, Pseudomonas aeruginosa PA01
gcucggccaggca

SEQ ID NO: 3464507 - RNA, 15 nt, Pseudomonas aeruginosa PA01
gcucggccaggcaca

SEQ ID NO: 3464508 - RNA, 15 nt, Pseudomonas aeruginosa PA01
gcucggccaggucgc

SEQ ID NO: 3464509 - RNA, 16 nt, Pseudomonas aeruginosa PA01
gcucggccaggucgcg

SEQ ID NO: 3464510 - RNA, 19 nt, Pseudomonas aeruginosa PA01
gcucggccaggucgcgacu

SEQ ID NO: 3464511 - RNA, 22 nt, Pseudomonas aeruginosa PA01
gcucggccaguucgcggcgcag

SEQ ID NO: 3464512 - RNA, 23 nt, Pseudomonas aeruginosa PA01
gcucggccaguucgcggcgcagu

SEQ ID NO: 3464513 - RNA, 18 nt, Pseudomonas aeruginosa PA01
gcucggccaguucgucga

SEQ ID NO: 3464514 - RNA, 17 nt, Pseudomonas aeruginosa PA01
gcucggccaucagcgcc

SEQ ID NO: 3464515 - RNA, 20 nt, Pseudomonas aeruginosa PA01
gcucggccaucagcgccagg

SEQ ID NO: 3464516 - RNA, 21 nt, Pseudomonas aeruginosa PA01
gcucggccaucagcgccaggg

SEQ ID NO: 3464517 - RNA, 22 nt, Pseudomonas aeruginosa PA01
gcucggccaucagcgccagggc

SEQ ID NO: 3464518 - RNA, 17 nt, Pseudomonas aeruginosa PA01
gcucggccgagggcagc

SEQ ID NO: 3464519 - RNA, 17 nt, Pseudomonas aeruginosa PA01
gcucggccgccuggcgu

SEQ ID NO: 3464520 - RNA, 13 nt, Pseudomonas aeruginosa PA01
gcucggccgcucg

SEQ ID NO: 3464521 - RNA, 14 nt, Pseudomonas aeruginosa PA01
gcucggccucgauc

SEQ ID NO: 3464522 - RNA, 18 nt, Pseudomonas aeruginosa PA01
gcucggccugcugcgccg

SEQ ID NO: 3464523 - RNA, 20 nt, Pseudomonas aeruginosa PA01
gcucggccugcugcgccggc

SEQ ID NO: 3464524 - RNA, 21 nt, Pseudomonas aeruginosa PA01
gcucggccugcugcgccggca

SEQ ID NO: 3464525 - RNA, 12 nt, Pseudomonas aeruginosa PA01
gcucggccuggu

SEQ ID NO: 3464526 - RNA, 17 nt, Pseudomonas aeruginosa PA01
gcucggccugguccggc

SEQ ID NO: 3464527 - RNA, 18 nt, Pseudomonas aeruginosa PA01
gcucggccugguccggca

SEQ ID NO: 3464528 - RNA, 15 nt, Pseudomonas aeruginosa PA01
gcucggccuggugca

SEQ ID NO: 3464529 - RNA, 22 nt, Pseudomonas aeruginosa PA01
gcucggccuggugcaccuggcg

SEQ ID NO: 3464530 - RNA, 12 nt, Pseudomonas aeruginosa PA01
gcucggccuuga

SEQ ID NO: 3464531 - RNA, 19 nt, Pseudomonas aeruginosa PA01
gcucggccuugagcgccga

SEQ ID NO: 3464532 - RNA, 20 nt, Pseudomonas aeruginosa PA01
gcucggccuuguccgcgcgc

SEQ ID NO: 3464533 - RNA, 17 nt, Pseudomonas aeruginosa PA01
gcucggccuuguccggc

SEQ ID NO: 3464534 - RNA, 18 nt, Pseudomonas aeruginosa PA01
gcucggccuuguccggca

SEQ ID NO: 3464535 - RNA, 19 nt, Pseudomonas aeruginosa PA01
gcucggccuuguccggcac

SEQ ID NO: 3464536 - RNA, 21 nt, Pseudomonas aeruginosa PA01
gcucggccuuguccggcacca

SEQ ID NO: 3464537 - RNA, 18 nt, Pseudomonas aeruginosa PA01
gcucggcgaccuugcgca

SEQ ID NO: 3464538 - RNA, 22 nt, Pseudomonas aeruginosa PA01
gcucggcgaccuugcgcaccag

SEQ ID NO: 3464539 - RNA, 12 nt, Pseudomonas aeruginosa PA01
gcucggcgagcc

SEQ ID NO: 3464540 - RNA, 17 nt, Pseudomonas aeruginosa PA01
gcucggcgagccgccgg

SEQ ID NO: 3464541 - RNA, 19 nt, Pseudomonas aeruginosa PA01
gcucggcgagccgccgggc

SEQ ID NO: 3464542 - RNA, 20 nt, Pseudomonas aeruginosa PA01
gcucggcgagccgccgggcg

SEQ ID NO: 3464543 - RNA, 18 nt, Pseudomonas aeruginosa PA01
gcucggcgaggccggcga

SEQ ID NO: 3464544 - RNA, 20 nt, Pseudomonas aeruginosa PA01
gcucggcgaggccggcgauc

SEQ ID NO: 3464545 - RNA, 19 nt, Pseudomonas aeruginosa PA01
gcucggcgaguucgcgcag

SEQ ID NO: 3464546 - RNA, 18 nt, Pseudomonas aeruginosa PA01
gcucggcgaucucgccca

SEQ ID NO: 3464547 - RNA, 20 nt, Pseudomonas aeruginosa PA01
gcucggcgaucucgcccagg

SEQ ID NO: 3464548 - RNA, 17 nt, Pseudomonas aeruginosa PA01
gcucggcgaugccgccg

SEQ ID NO: 3464549 - RNA, 18 nt, Pseudomonas aeruginosa PA01
gcucggcgaugccgccgg

SEQ ID NO: 3464550 - RNA, 15 nt, Pseudomonas aeruginosa PA01
gcucggcgauggcgc

SEQ ID NO: 3464551 - RNA, 17 nt, Pseudomonas aeruginosa PA01
gcucggcgauggcgcgc

SEQ ID NO: 3464552 - RNA, 19 nt, Pseudomonas aeruginosa PA01
gcucggcgauggcgcgcgg

SEQ ID NO: 3464553 - RNA, 23 nt, Pseudomonas aeruginosa PA01
gcucggcgauggcgcgcgggccu

SEQ ID NO: 3464554 - RNA, 14 nt, Pseudomonas aeruginosa PA01
gcucggcgcccugg

SEQ ID NO: 3464555 - RNA, 15 nt, Pseudomonas aeruginosa PA01
gcucggcgcccuggc

SEQ ID NO: 3464556 - RNA, 17 nt, Pseudomonas aeruginosa PA01
gcucggcgcccuggccg

SEQ ID NO: 3464557 - RNA, 20 nt, Pseudomonas aeruginosa PA01
gcucggcgcccuggccgcca

SEQ ID NO: 3464558 - RNA, 23 nt, Pseudomonas aeruginosa PA01
gcucggcggcaggcugcgccgcu

SEQ ID NO: 3464559 - RNA, 21 nt, Pseudomonas aeruginosa PA01
gcucggcggccauugccgcgg

SEQ ID NO: 3464560 - RNA, 18 nt, Pseudomonas aeruginosa PA01
gcucggcggccucgcggg

SEQ ID NO: 3464561 - RNA, 14 nt, Pseudomonas aeruginosa PA01
gcucggcggcgcgc

SEQ ID NO: 3464562 - RNA, 17 nt, Pseudomonas aeruginosa PA01
gcucucggugaccacca

SEQ ID NO: 3464563 - RNA, 18 nt, Pseudomonas aeruginosa PA01
gcucucggugaccaccag

SEQ ID NO: 3464564 - RNA, 13 nt, Pseudomonas aeruginosa PA01
gcucucguugugg

SEQ ID NO: 3464565 - RNA, 13 nt, Pseudomonas aeruginosa PA01
gcucucuucggcc

SEQ ID NO: 3464566 - RNA, 19 nt, Pseudomonas aeruginosa PA01
gcucugcacaaacucaggg

SEQ ID NO: 3464567 - RNA, 20 nt, Pseudomonas aeruginosa PA01
gcucugcaccgucauggugc

SEQ ID NO: 3464568 - RNA, 20 nt, Pseudomonas aeruginosa PA01
gcucugccagaaggccugcg

SEQ ID NO: 3464569 - RNA, 15 nt, Pseudomonas aeruginosa PA01
gcucugccggugugc

SEQ ID NO: 3464570 - RNA, 17 nt, Pseudomonas aeruginosa PA01
gcucugccggugugccg

SEQ ID NO: 3464571 - RNA, 23 nt, Pseudomonas aeruginosa PA01
gcucugcgacuggaugcagccga

SEQ ID NO: 3464572 - RNA, 22 nt, Pseudomonas aeruginosa PA01
gcucugcgaucagggccucgcc

SEQ ID NO: 3464573 - RNA, 14 nt, Pseudomonas aeruginosa PA01
gcucugcgccaggc

SEQ ID NO: 3464574 - RNA, 14 nt, Pseudomonas aeruginosa PA01
gcucugcgccgcgg

SEQ ID NO: 3464575 - RNA, 15 nt, Pseudomonas aeruginosa PA01
gcucugcgccgcggc

SEQ ID NO: 3464576 - RNA, 14 nt, Pseudomonas aeruginosa PA01
gcucugcuccagca

SEQ ID NO: 3464577 - RNA, 20 nt, Pseudomonas aeruginosa PA01
gcucugcuccagcaaugcca

SEQ ID NO: 3464578 - RNA, 22 nt, Pseudomonas aeruginosa PA01
gcucugcuccagcaaugccagc

SEQ ID NO: 3464579 - RNA, 19 nt, Pseudomonas aeruginosa PA01
gcucugcugaauucccgcu

SEQ ID NO: 3464580 - RNA, 23 nt, Pseudomonas aeruginosa PA01
gcucugcugaauucccgcuccag

SEQ ID NO: 3464581 - RNA, 17 nt, Pseudomonas aeruginosa PA01
gcucugcuggccacccu

SEQ ID NO: 3464582 - RNA, 18 nt, Pseudomonas aeruginosa PA01
gcucugcuggccacccuu

SEQ ID NO: 3464583 - RNA, 14 nt, Pseudomonas aeruginosa PA01
gcucugcuggccgc

SEQ ID NO: 3464584 - RNA, 17 nt, Pseudomonas aeruginosa PA01
gcucugcuggccgcccu

SEQ ID NO: 3464585 - RNA, 16 nt, Pseudomonas aeruginosa PA01
gcucugcuucuguccc

SEQ ID NO: 3464586 - RNA, 18 nt, Pseudomonas aeruginosa PA01
gcucugcuucugucccug

SEQ ID NO: 3464587 - RNA, 14 nt, Pseudomonas aeruginosa PA01
gcucuggaagaagu

SEQ ID NO: 3464588 - RNA, 19 nt, Pseudomonas aeruginosa PA01
gcucuggaugcggcgcugc

SEQ ID NO: 3464589 - RNA, 13 nt, Pseudomonas aeruginosa PA01
gcucuggccgcgc

SEQ ID NO: 3464590 - RNA, 15 nt, Pseudomonas aeruginosa PA01
gcucuggccgcgcuc

SEQ ID NO: 3464591 - RNA, 14 nt, Pseudomonas aeruginosa PA01
gcucuggcgcaggg

SEQ ID NO: 3464592 - RNA, 11 nt, Pseudomonas aeruginosa PA01
gcucuggcugc

SEQ ID NO: 3464593 - RNA, 16 nt, Pseudomonas aeruginosa PA01
gcucuggcugcuggcg

SEQ ID NO: 3464594 - RNA, 17 nt, Pseudomonas aeruginosa PA01
gcucugguagccgcagu

SEQ ID NO: 3464595 - RNA, 20 nt, Pseudomonas aeruginosa PA01
gcucugguagccgcagucca

SEQ ID NO: 3464596 - RNA, 18 nt, Pseudomonas aeruginosa PA01
gcucugguucggcgucuu

SEQ ID NO: 3464597 - RNA, 18 nt, Pseudomonas aeruginosa PA01
gcucuguagggucgcagc

SEQ ID NO: 3464598 - RNA, 19 nt, Pseudomonas aeruginosa PA01
gcucuguagggucgcagca

SEQ ID NO: 3464599 - RNA, 18 nt, Pseudomonas aeruginosa PA01
gcucugucuccugugccu

SEQ ID NO: 3464600 - RNA, 20 nt, Pseudomonas aeruginosa PA01
gcucuguuccucggcggcgg

SEQ ID NO: 3464601 - RNA, 21 nt, Pseudomonas aeruginosa PA01
gcucuguuccucggcggcggu

SEQ ID NO: 3464602 - RNA, 23 nt, Pseudomonas aeruginosa PA01
gcucuucacauggugggcgccgc

SEQ ID NO: 3464603 - RNA, 17 nt, Pseudomonas aeruginosa PA01
gcucuucaggcugucgg

SEQ ID NO: 3464604 - RNA, 17 nt, Pseudomonas aeruginosa PA01
gcucuuccagcgggcgg

SEQ ID NO: 3464605 - RNA, 19 nt, Pseudomonas aeruginosa PA01
gcucuuccaggugauccau

SEQ ID NO: 3464606 - RNA, 19 nt, Pseudomonas aeruginosa PA01
gcucuucgauugucuccag

SEQ ID NO: 3464607 - RNA, 14 nt, Pseudomonas aeruginosa PA01
gcucuucgccaguu

SEQ ID NO: 3464608 - RNA, 17 nt, Pseudomonas aeruginosa PA01
gcucuucugguaggcca

SEQ ID NO: 3464609 - RNA, 23 nt, Pseudomonas aeruginosa PA01
gcucuugauacccaccggcucgc

SEQ ID NO: 3464610 - RNA, 20 nt, Pseudomonas aeruginosa PA01
gcucuugcccugccagcggg

SEQ ID NO: 3464611 - RNA, 17 nt, Pseudomonas aeruginosa PA01
gcucuugccgcgagcuu

SEQ ID NO: 3464612 - RNA, 19 nt, Pseudomonas aeruginosa PA01
gcucuuggucgcggucugg

SEQ ID NO: 3464613 - RNA, 22 nt, Pseudomonas aeruginosa PA01
gcucuuuccgggucauuggcga

SEQ ID NO: 3464614 - RNA, 19 nt, Pseudomonas aeruginosa PA01
gcucuuugcgacugacgcu

SEQ ID NO: 3464615 - RNA, 17 nt, Pseudomonas aeruginosa PA01
gcugaaaaacgccuggg

SEQ ID NO: 3464616 - RNA, 20 nt, Pseudomonas aeruginosa PA01
gcugaaaaacgccugggcgu

SEQ ID NO: 3464617 - RNA, 20 nt, Pseudomonas aeruginosa PA01
gcugaaauggaaacgccagc

SEQ ID NO: 3464618 - RNA, 17 nt, Pseudomonas aeruginosa PA01
gcugaacaagcccuggu

SEQ ID NO: 3464619 - RNA, 18 nt, Pseudomonas aeruginosa PA01
gcugaacaagcccuggug

SEQ ID NO: 3464620 - RNA, 22 nt, Pseudomonas aeruginosa PA01
gcugaacaagcccuggugguga

SEQ ID NO: 3464621 - RNA, 19 nt, Pseudomonas aeruginosa PA01
gcugaacagcgccaccagc

SEQ ID NO: 3464622 - RNA, 20 nt, Pseudomonas aeruginosa PA01
gcugaacagcgccaccagca

SEQ ID NO: 3464623 - RNA, 23 nt, Pseudomonas aeruginosa PA01
gcugaacagcgccaccagcaugc

SEQ ID NO: 3464624 - RNA, 14 nt, Pseudomonas aeruginosa PA01
gcugaacagcuggc

SEQ ID NO: 3464625 - RNA, 23 nt, Pseudomonas aeruginosa PA01
gcugaacagcuggcgcgucgcug

SEQ ID NO: 3464626 - RNA, 14 nt, Pseudomonas aeruginosa PA01
gcugaagacccugc

SEQ ID NO: 3464627 - RNA, 17 nt, Pseudomonas aeruginosa PA01
gcugaagacccugcaca

SEQ ID NO: 3464628 - RNA, 22 nt, Pseudomonas aeruginosa PA01
gcugaagauaucgccuuccucg

SEQ ID NO: 3464629 - RNA, 15 nt, Pseudomonas aeruginosa PA01
gcugaagcccaggcg

SEQ ID NO: 3464630 - RNA, 17 nt, Pseudomonas aeruginosa PA01
gcugaagcccaggcguc

SEQ ID NO: 3464631 - RNA, 19 nt, Pseudomonas aeruginosa PA01
gcugaagcccaggcgucgc

SEQ ID NO: 3464632 - RNA, 20 nt, Pseudomonas aeruginosa PA01
gcugaagcccaggcgucgcg

SEQ ID NO: 3464633 - RNA, 13 nt, Pseudomonas aeruginosa PA01
gcugaagccccag

SEQ ID NO: 3464634 - RNA, 14 nt, Pseudomonas aeruginosa PA01
gcugaagccgggca

SEQ ID NO: 3464635 - RNA, 13 nt, Pseudomonas aeruginosa PA01
gcugaagcgccgc

SEQ ID NO: 3464636 - RNA, 14 nt, Pseudomonas aeruginosa PA01
gcugaagcggccgc

SEQ ID NO: 3464637 - RNA, 15 nt, Pseudomonas aeruginosa PA01
gcugaagcggccgcc

SEQ ID NO: 3464638 - RNA, 17 nt, Pseudomonas aeruginosa PA01
gcugaagcggccgccga

SEQ ID NO: 3464639 - RNA, 17 nt, Pseudomonas aeruginosa PA01
gcugaagcugucgcccu

SEQ ID NO: 3464640 - RNA, 13 nt, Pseudomonas aeruginosa PA01
gcugaaggucgcc

SEQ ID NO: 3464641 - RNA, 15 nt, Pseudomonas aeruginosa PA01
gcugaaggucgccgc

SEQ ID NO: 3464642 - RNA, 20 nt, Pseudomonas aeruginosa PA01
gcugaaggucgccgcgcuga

SEQ ID NO: 3464643 - RNA, 16 nt, Pseudomonas aeruginosa PA01
gcugaaggugagaugg

SEQ ID NO: 3464644 - RNA, 23 nt, Pseudomonas aeruginosa PA01
gcugaaguccuggccgagcauca

SEQ ID NO: 3464645 - RNA, 21 nt, Pseudomonas aeruginosa PA01
gcugaauaccaccgggccguc

SEQ ID NO: 3464646 - RNA, 19 nt, Pseudomonas aeruginosa PA01
gcugaauaccacguggccg

SEQ ID NO: 3464647 - RNA, 14 nt, Pseudomonas aeruginosa PA01
gcugaauucccgcu

SEQ ID NO: 3464648 - RNA, 15 nt, Pseudomonas aeruginosa PA01
gcugaauucccgcuc

SEQ ID NO: 3464649 - RNA, 21 nt, Pseudomonas aeruginosa PA01
gcugaauucccgcuccaggcc

SEQ ID NO: 3464650 - RNA, 18 nt, Pseudomonas aeruginosa PA01
gcugacauccaccagggu

SEQ ID NO: 3464651 - RNA, 17 nt, Pseudomonas aeruginosa PA01
gcugaccaccagggcga

SEQ ID NO: 3464652 - RNA, 20 nt, Pseudomonas aeruginosa PA01
gcugaccaggucguggaagg

SEQ ID NO: 3464653 - RNA, 13 nt, Pseudomonas aeruginosa PA01
gcugacccaggcu

SEQ ID NO: 3464654 - RNA, 20 nt, Pseudomonas aeruginosa PA01
gcugacccaggcuucggcgc

SEQ ID NO: 3464655 - RNA, 23 nt, Pseudomonas aeruginosa PA01
gcugacccaggcuucggcgcgcu

SEQ ID NO: 3464656 - RNA, 19 nt, Pseudomonas aeruginosa PA01
gcugacccaguagggcccg

SEQ ID NO: 3464657 - RNA, 16 nt, Pseudomonas aeruginosa PA01
gcugacccgcugcugg

SEQ ID NO: 3464658 - RNA, 16 nt, Pseudomonas aeruginosa PA01
gcugacccgcuguccg

SEQ ID NO: 3464659 - RNA, 17 nt, Pseudomonas aeruginosa PA01
gcugacccgcuguccgc

SEQ ID NO: 3464660 - RNA, 21 nt, Pseudomonas aeruginosa PA01
gcugacccgcuguccgccggc

SEQ ID NO: 3464661 - RNA, 20 nt, Pseudomonas aeruginosa PA01
gcugaccgcgugggccggca

SEQ ID NO: 3464662 - RNA, 17 nt, Pseudomonas aeruginosa PA01
gcugaccgcucccaggc

SEQ ID NO: 3464663 - RNA, 19 nt, Pseudomonas aeruginosa PA01
gcugaccggcaucgaccag

SEQ ID NO: 3464664 - RNA, 15 nt, Pseudomonas aeruginosa PA01
gcugcaacuccgccu

SEQ ID NO: 3464665 - RNA, 16 nt, Pseudomonas aeruginosa PA01
gcugcaacuccgccug

SEQ ID NO: 3464666 - RNA, 20 nt, Pseudomonas aeruginosa PA01
gcugcaaggcuucggcgguc

SEQ ID NO: 3464667 - RNA, 15 nt, Pseudomonas aeruginosa PA01
gcugcaaucgcugcc

SEQ ID NO: 3464668 - RNA, 20 nt, Pseudomonas aeruginosa PA01
gcugcaauucgcagagaucg

SEQ ID NO: 3464669 - RNA, 16 nt, Pseudomonas aeruginosa PA01
gcugcaauucgucggc

SEQ ID NO: 3464670 - RNA, 18 nt, Pseudomonas aeruginosa PA01
gcugcaauucgucggccu

SEQ ID NO: 3464671 - RNA, 20 nt, Pseudomonas aeruginosa PA01
gcugcaauucgucggccugc

SEQ ID NO: 3464672 - RNA, 21 nt, Pseudomonas aeruginosa PA01
gcugcacagccauagcgccgg

SEQ ID NO: 3464673 - RNA, 22 nt, Pseudomonas aeruginosa PA01
gcugcacagccauagcgccggc

SEQ ID NO: 3464674 - RNA, 13 nt, Pseudomonas aeruginosa PA01
gcugcaccagcag

SEQ ID NO: 3464675 - RNA, 14 nt, Pseudomonas aeruginosa PA01
gcugcaccagcagg

SEQ ID NO: 3464676 - RNA, 12 nt, Pseudomonas aeruginosa PA01
gcugcaccgcgc

SEQ ID NO: 3464677 - RNA, 15 nt, Pseudomonas aeruginosa PA01
gcugcaccgcgcgga

SEQ ID NO: 3464678 - RNA, 21 nt, Pseudomonas aeruginosa PA01
gcugcacggagugggccgcgu

SEQ ID NO: 3464679 - RNA, 13 nt, Pseudomonas aeruginosa PA01
gcugcacggcgac

SEQ ID NO: 3464680 - RNA, 15 nt, Pseudomonas aeruginosa PA01
gcugcacggcgaccc

SEQ ID NO: 3464681 - RNA, 16 nt, Pseudomonas aeruginosa PA01
gcugcacggcgacccg

SEQ ID NO: 3464682 - RNA, 21 nt, Pseudomonas aeruginosa PA01
gcugcacggcgacccgcacgu

SEQ ID NO: 3464683 - RNA, 23 nt, Pseudomonas aeruginosa PA01
gcugcacguuguucaccgugauc

SEQ ID NO: 3464684 - RNA, 23 nt, Pseudomonas aeruginosa PA01
gcugcacguuguugcccaccucc

SEQ ID NO: 3464685 - RNA, 16 nt, Pseudomonas aeruginosa PA01
gcugcagcaucaggcg

SEQ ID NO: 3464686 - RNA, 18 nt, Pseudomonas aeruginosa PA01
gcugcagcaucaggcgcu

SEQ ID NO: 3464687 - RNA, 19 nt, Pseudomonas aeruginosa PA01
gcugcagcaucaggcgcuc

SEQ ID NO: 3464688 - RNA, 14 nt, Pseudomonas aeruginosa PA01
gcugcagccacugu

SEQ ID NO: 3464689 - RNA, 22 nt, Pseudomonas aeruginosa PA01
gcugcagccacuguccaugaau

SEQ ID NO: 3464690 - RNA, 12 nt, Pseudomonas aeruginosa PA01
gcugcagcgccc

SEQ ID NO: 3464691 - RNA, 17 nt, Pseudomonas aeruginosa PA01
gcugcagcgccccagca

SEQ ID NO: 3464692 - RNA, 16 nt, Pseudomonas aeruginosa PA01
gcugcaggccaccgga

SEQ ID NO: 3464693 - RNA, 14 nt, Pseudomonas aeruginosa PA01
gcugcaggccgaga

SEQ ID NO: 3464694 - RNA, 18 nt, Pseudomonas aeruginosa PA01
gcugcaggccgagaccgc

SEQ ID NO: 3464695 - RNA, 15 nt, Pseudomonas aeruginosa PA01
gcugcagggccaggg

SEQ ID NO: 3464696 - RNA, 15 nt, Pseudomonas aeruginosa PA01
gcugcagguaggcgg

SEQ ID NO: 3464697 - RNA, 17 nt, Pseudomonas aeruginosa PA01
gcugcaucggcgcgccg

SEQ ID NO: 3464698 - RNA, 13 nt, Pseudomonas aeruginosa PA01
gcugcaucggcuc

SEQ ID NO: 3464699 - RNA, 19 nt, Pseudomonas aeruginosa PA01
gcugcaucggcucggcaag

SEQ ID NO: 3464700 - RNA, 20 nt, Pseudomonas aeruginosa PA01
gcugcaucggcucggcaagc

SEQ ID NO: 3464701 - RNA, 20 nt, Pseudomonas aeruginosa PA01
gcugcaugaaaaagcccggc

SEQ ID NO: 3464702 - RNA, 21 nt, Pseudomonas aeruginosa PA01
gcugcaugaaaaagcccggcc

SEQ ID NO: 3464703 - RNA, 22 nt, Pseudomonas aeruginosa PA01
gcugcaugaaaaagcccggccg

SEQ ID NO: 3464704 - RNA, 17 nt, Pseudomonas aeruginosa PA01
gcugcaugagugucgcc

SEQ ID NO: 3464705 - RNA, 22 nt, Pseudomonas aeruginosa PA01
gcugcaugccgggguccgccgg

SEQ ID NO: 3464706 - RNA, 22 nt, Pseudomonas aeruginosa PA01
gcugcauggggauggucgagag

SEQ ID NO: 3464707 - RNA, 13 nt, Pseudomonas aeruginosa PA01
gcugcauguccgc

SEQ ID NO: 3464708 - RNA, 15 nt, Pseudomonas aeruginosa PA01
gcugcauguccgcag

SEQ ID NO: 3464709 - RNA, 17 nt, Pseudomonas aeruginosa PA01
gcugcauguccgccagu

SEQ ID NO: 3464710 - RNA, 17 nt, Pseudomonas aeruginosa PA01
gcugcaugugccaggcc

SEQ ID NO: 3464711 - RNA, 21 nt, Pseudomonas aeruginosa PA01
gcugcaugugccaggccuggg

SEQ ID NO: 3464712 - RNA, 15 nt, Pseudomonas aeruginosa PA01
gcugccacucggugc

SEQ ID NO: 3464713 - RNA, 12 nt, Pseudomonas aeruginosa PA01
gcugccagcagg

SEQ ID NO: 3464714 - RNA, 13 nt, Pseudomonas aeruginosa PA01
gcugccagcaggc

SEQ ID NO: 3464715 - RNA, 15 nt, Pseudomonas aeruginosa PA01
gcugccagcaggccg

SEQ ID NO: 3464716 - RNA, 16 nt, Pseudomonas aeruginosa PA01
gcugccagcaggccga

SEQ ID NO: 3464717 - RNA, 18 nt, Pseudomonas aeruginosa PA01
gcugccagcaggccgagc

SEQ ID NO: 3464718 - RNA, 18 nt, Pseudomonas aeruginosa PA01
gcugccagcauaaccccu

SEQ ID NO: 3464719 - RNA, 23 nt, Pseudomonas aeruginosa PA01
gcugccagcauaaccccuuugcc

SEQ ID NO: 3464720 - RNA, 12 nt, Pseudomonas aeruginosa PA01
gcugccagcccc

SEQ ID NO: 3464721 - RNA, 14 nt, Pseudomonas aeruginosa PA01
gcugccagcgccgc

SEQ ID NO: 3464722 - RNA, 16 nt, Pseudomonas aeruginosa PA01
gcugccagcgccgccg

SEQ ID NO: 3464723 - RNA, 19 nt, Pseudomonas aeruginosa PA01
gcugccagcgccgccgcgu

SEQ ID NO: 3464724 - RNA, 17 nt, Pseudomonas aeruginosa PA01
gcugccagugcucgaac

SEQ ID NO: 3464725 - RNA, 13 nt, Pseudomonas aeruginosa PA01
gcugccaguggcg

SEQ ID NO: 3464726 - RNA, 12 nt, Pseudomonas aeruginosa PA01
gcugccauccgc

SEQ ID NO: 3464727 - RNA, 16 nt, Pseudomonas aeruginosa PA01
gcugccauccgcgccg

SEQ ID NO: 3464728 - RNA, 15 nt, Pseudomonas aeruginosa PA01
gcugccauggcggcg

SEQ ID NO: 3464729 - RNA, 17 nt, Pseudomonas aeruginosa PA01
gcugccauggcggcgga

SEQ ID NO: 3464730 - RNA, 16 nt, Pseudomonas aeruginosa PA01
gcugcccagcccgccu

SEQ ID NO: 3464731 - RNA, 17 nt, Pseudomonas aeruginosa PA01
gcugcccagcccgccuu

SEQ ID NO: 3464732 - RNA, 13 nt, Pseudomonas aeruginosa PA01
gcugcccaggcug

SEQ ID NO: 3464733 - RNA, 14 nt, Pseudomonas aeruginosa PA01
gcugcccagggccc

SEQ ID NO: 3464734 - RNA, 15 nt, Pseudomonas aeruginosa PA01
gcugcccagggccca

SEQ ID NO: 3464735 - RNA, 19 nt, Pseudomonas aeruginosa PA01
gcugcccagggcccagagc

SEQ ID NO: 3464736 - RNA, 19 nt, Pseudomonas aeruginosa PA01
gcugcccagguagccggcg

SEQ ID NO: 3464737 - RNA, 22 nt, Pseudomonas aeruginosa PA01
gcugcccagguagccggcgagc

SEQ ID NO: 3464738 - RNA, 17 nt, Pseudomonas aeruginosa PA01
gcugcccaguacccgcu

SEQ ID NO: 3464739 - RNA, 22 nt, Pseudomonas aeruginosa PA01
gcugcccaguugcgcggcgagu

SEQ ID NO: 3464740 - RNA, 21 nt, Pseudomonas aeruginosa PA01
gcugccccucacaccaccagc

SEQ ID NO: 3464741 - RNA, 14 nt, Pseudomonas aeruginosa PA01
gcugcccgacggcu

SEQ ID NO: 3464742 - RNA, 13 nt, Pseudomonas aeruginosa PA01
gcugcccggcgcg

SEQ ID NO: 3464743 - RNA, 23 nt, Pseudomonas aeruginosa PA01
gcugcccggcgcgacgcuccagg

SEQ ID NO: 3464744 - RNA, 23 nt, Pseudomonas aeruginosa PA01
gcugcccucgacgauauccacgc

SEQ ID NO: 3464745 - RNA, 12 nt, Pseudomonas aeruginosa PA01
gcugcccuggcg

SEQ ID NO: 3464746 - RNA, 13 nt, Pseudomonas aeruginosa PA01
gcugcccuggcgc

SEQ ID NO: 3464747 - RNA, 14 nt, Pseudomonas aeruginosa PA01
gcugcccuggcgcg

SEQ ID NO: 3464748 - RNA, 18 nt, Pseudomonas aeruginosa PA01
gcugcccuggcgcgcgcc

SEQ ID NO: 3464749 - RNA, 20 nt, Pseudomonas aeruginosa PA01
gcugccgaacagacgggaca

SEQ ID NO: 3464750 - RNA, 14 nt, Pseudomonas aeruginosa PA01
gcugccgaacagca

SEQ ID NO: 3464751 - RNA, 20 nt, Pseudomonas aeruginosa PA01
gcugccgaacaggcguccca

SEQ ID NO: 3464752 - RNA, 19 nt, Pseudomonas aeruginosa PA01
gcugccgaagccuucgucg

SEQ ID NO: 3464753 - RNA, 21 nt, Pseudomonas aeruginosa PA01
gcugccgaagccuucgucgau

SEQ ID NO: 3464754 - RNA, 21 nt, Pseudomonas aeruginosa PA01
gcugccgaauugggucugcug

SEQ ID NO: 3464755 - RNA, 21 nt, Pseudomonas aeruginosa PA01
gcugccgagaaucugcccggc

SEQ ID NO: 3464756 - RNA, 15 nt, Pseudomonas aeruginosa PA01
gcugccgagcagggu

SEQ ID NO: 3464757 - RNA, 16 nt, Pseudomonas aeruginosa PA01
gcugccgagcaggugc

SEQ ID NO: 3464758 - RNA, 17 nt, Pseudomonas aeruginosa PA01
gcugccgagcuuccagc

SEQ ID NO: 3464759 - RNA, 22 nt, Pseudomonas aeruginosa PA01
gcugccgaggaacucgcggucc

SEQ ID NO: 3464760 - RNA, 15 nt, Pseudomonas aeruginosa PA01
gcugccgaucagcca

SEQ ID NO: 3464761 - RNA, 15 nt, Pseudomonas aeruginosa PA01
gcugccgcaccgccu

SEQ ID NO: 3464762 - RNA, 14 nt, Pseudomonas aeruginosa PA01
gcugccgcagauca

SEQ ID NO: 3464763 - RNA, 13 nt, Pseudomonas aeruginosa PA01
gcugccgccagcu

SEQ ID NO: 3464764 - RNA, 15 nt, Pseudomonas aeruginosa PA01
gcugccgccagcuca

SEQ ID NO: 3464765 - RNA, 11 nt, Pseudomonas aeruginosa PA01
gcugccgcccg

SEQ ID NO: 3464766 - RNA, 23 nt, Pseudomonas aeruginosa PA01
gcugccgccgcagagccagccgc

SEQ ID NO: 3464767 - RNA, 16 nt, Pseudomonas aeruginosa PA01
gcugcggaaaccggga

SEQ ID NO: 3464768 - RNA, 21 nt, Pseudomonas aeruginosa PA01
gcugcggaagagguacggccu

SEQ ID NO: 3464769 - RNA, 22 nt, Pseudomonas aeruginosa PA01
gcugcggaagagguacggccuu

SEQ ID NO: 3464770 - RNA, 15 nt, Pseudomonas aeruginosa PA01
gcugcggagcgucgg

SEQ ID NO: 3464771 - RNA, 22 nt, Pseudomonas aeruginosa PA01
gcugcggaucaacuccgccagg

SEQ ID NO: 3464772 - RNA, 21 nt, Pseudomonas aeruginosa PA01
gcugcggcagguaguggcccu

SEQ ID NO: 3464773 - RNA, 17 nt, Pseudomonas aeruginosa PA01
gcugcggcauucgcgcu

SEQ ID NO: 3464774 - RNA, 12 nt, Pseudomonas aeruginosa PA01
gcugcggccgag

SEQ ID NO: 3464775 - RNA, 13 nt, Pseudomonas aeruginosa PA01
gcugcggccggcg

SEQ ID NO: 3464776 - RNA, 14 nt, Pseudomonas aeruginosa PA01
gcugcggccggcgc

SEQ ID NO: 3464777 - RNA, 14 nt, Pseudomonas aeruginosa PA01
gcugcggcggaagg

SEQ ID NO: 3464778 - RNA, 17 nt, Pseudomonas aeruginosa PA01
gcugcggcggcaccacg

SEQ ID NO: 3464779 - RNA, 21 nt, Pseudomonas aeruginosa PA01
gcugcggcgguuggagcgagc

SEQ ID NO: 3464780 - RNA, 16 nt, Pseudomonas aeruginosa PA01
gcugcggcuucgcgug

SEQ ID NO: 3464781 - RNA, 14 nt, Pseudomonas aeruginosa PA01
gcugcgggcgccgc

SEQ ID NO: 3464782 - RNA, 17 nt, Pseudomonas aeruginosa PA01
gcugcgggcgccgccgc

SEQ ID NO: 3464783 - RNA, 14 nt, Pseudomonas aeruginosa PA01
gcugcggggugagc

SEQ ID NO: 3464784 - RNA, 22 nt, Pseudomonas aeruginosa PA01
gcugcggguucagucggccagg

SEQ ID NO: 3464785 - RNA, 17 nt, Pseudomonas aeruginosa PA01
gcugcguagggcgagua

SEQ ID NO: 3464786 - RNA, 15 nt, Pseudomonas aeruginosa PA01
gcugcgucgucgcgg

SEQ ID NO: 3464787 - RNA, 21 nt, Pseudomonas aeruginosa PA01
gcugcgucgucgcggcgccug

SEQ ID NO: 3464788 - RNA, 16 nt, Pseudomonas aeruginosa PA01
gcugcgucguuggccg

SEQ ID NO: 3464789 - RNA, 19 nt, Pseudomonas aeruginosa PA01
gcugcgucguuggccggcu

SEQ ID NO: 3464790 - RNA, 15 nt, Pseudomonas aeruginosa PA01
gcugcgugaggauca

SEQ ID NO: 3464791 - RNA, 17 nt, Pseudomonas aeruginosa PA01
gcugcgugccagcaccu

SEQ ID NO: 3464792 - RNA, 15 nt, Pseudomonas aeruginosa PA01
gcugcgugccagggc

SEQ ID NO: 3464793 - RNA, 16 nt, Pseudomonas aeruginosa PA01
gcugcgugccagggcu

SEQ ID NO: 3464794 - RNA, 17 nt, Pseudomonas aeruginosa PA01
gcugcgugccagggcuu

SEQ ID NO: 3464795 - RNA, 22 nt, Pseudomonas aeruginosa PA01
gcugcgugccagggcuucccag

SEQ ID NO: 3464796 - RNA, 15 nt, Pseudomonas aeruginosa PA01
gcugcgugcgccgcu

SEQ ID NO: 3464797 - RNA, 19 nt, Pseudomonas aeruginosa PA01
gcugcgugcguugcgcggc

SEQ ID NO: 3464798 - RNA, 20 nt, Pseudomonas aeruginosa PA01
gcugcgugcguugcgcggca

SEQ ID NO: 3464799 - RNA, 21 nt, Pseudomonas aeruginosa PA01
gcugcgugcguugcgcggcag

SEQ ID NO: 3464800 - RNA, 23 nt, Pseudomonas aeruginosa PA01
gcugcguggguagccgcccaccg

SEQ ID NO: 3464801 - RNA, 15 nt, Pseudomonas aeruginosa PA01
gcugcguucuucccc

SEQ ID NO: 3464802 - RNA, 24 nt, Pseudomonas aeruginosa PA01
gcugcguucuuccccugcaugccg

SEQ ID NO: 3464803 - RNA, 17 nt, Pseudomonas aeruginosa PA01
gcugcuaggcuggaagc

SEQ ID NO: 3464804 - RNA, 23 nt, Pseudomonas aeruginosa PA01
gcugcuaggcuggaagccgcgcu

SEQ ID NO: 3464805 - RNA, 23 nt, Pseudomonas aeruginosa PA01
gcugcuagguucuaucgacagga

SEQ ID NO: 3464806 - RNA, 15 nt, Pseudomonas aeruginosa PA01
gcugcucagcgcgcu

SEQ ID NO: 3464807 - RNA, 16 nt, Pseudomonas aeruginosa PA01
gcugcucagcgcgcuc

SEQ ID NO: 3464808 - RNA, 20 nt, Pseudomonas aeruginosa PA01
gcugcucagcgcgcucggcc

SEQ ID NO: 3464809 - RNA, 22 nt, Pseudomonas aeruginosa PA01
gcugcucagcgcgcucggccug

SEQ ID NO: 3464810 - RNA, 15 nt, Pseudomonas aeruginosa PA01
gcugcucagggccgc

SEQ ID NO: 3464811 - RNA, 19 nt, Pseudomonas aeruginosa PA01
gcugcucagggccgcgccg

SEQ ID NO: 3464812 - RNA, 21 nt, Pseudomonas aeruginosa PA01
gcugcucagggccgcgccgag

SEQ ID NO: 3464813 - RNA, 12 nt, Pseudomonas aeruginosa PA01
gcugcucaugcc

SEQ ID NO: 3464814 - RNA, 16 nt, Pseudomonas aeruginosa PA01
gcugcucaugccguug

SEQ ID NO: 3464815 - RNA, 16 nt, Pseudomonas aeruginosa PA01
gcugcuccagcccggc

SEQ ID NO: 3464816 - RNA, 21 nt, Pseudomonas aeruginosa PA01
gcugcuccagcccggcucggc

SEQ ID NO: 3464817 - RNA, 13 nt, Pseudomonas aeruginosa PA01
gcugcuccaucag

SEQ ID NO: 3464818 - RNA, 21 nt, Pseudomonas aeruginosa PA01
gcugcuccaucaguugcgcgc

SEQ ID NO: 3464819 - RNA, 22 nt, Pseudomonas aeruginosa PA01
gcugcuccaucaguugcgcgcg

SEQ ID NO: 3464820 - RNA, 15 nt, Pseudomonas aeruginosa PA01
gcugcuccggaucgc

SEQ ID NO: 3464821 - RNA, 21 nt, Pseudomonas aeruginosa PA01
gcugcuccuccccguccuggc

SEQ ID NO: 3464822 - RNA, 13 nt, Pseudomonas aeruginosa PA01
gcugcucgaagca

SEQ ID NO: 3464823 - RNA, 14 nt, Pseudomonas aeruginosa PA01
gcugcucgaagcaa

SEQ ID NO: 3464824 - RNA, 22 nt, Pseudomonas aeruginosa PA01
gcugcucgaccaccucggcguc

SEQ ID NO: 3464825 - RNA, 15 nt, Pseudomonas aeruginosa PA01
gcugcucgaccgccu

SEQ ID NO: 3464826 - RNA, 17 nt, Pseudomonas aeruginosa PA01
gcugcucgaccgccugc

SEQ ID NO: 3464827 - RNA, 22 nt, Pseudomonas aeruginosa PA01
gcugcucgacggcaccagcgcg

SEQ ID NO: 3464828 - RNA, 14 nt, Pseudomonas aeruginosa PA01
gcugcucgauggcg

SEQ ID NO: 3464829 - RNA, 16 nt, Pseudomonas aeruginosa PA01
gcugcucgauggcggc

SEQ ID NO: 3464830 - RNA, 22 nt, Pseudomonas aeruginosa PA01
gcugcucgauggcggccuggua

SEQ ID NO: 3464831 - RNA, 16 nt, Pseudomonas aeruginosa PA01
gcugcucgccucgggc

SEQ ID NO: 3464832 - RNA, 18 nt, Pseudomonas aeruginosa PA01
gcugcucgccucgggcca

SEQ ID NO: 3464833 - RNA, 23 nt, Pseudomonas aeruginosa PA01
gcugcucgccucgggccaugagc

SEQ ID NO: 3464834 - RNA, 19 nt, Pseudomonas aeruginosa PA01
gcugcugaaaaacgccugg

SEQ ID NO: 3464835 - RNA, 23 nt, Pseudomonas aeruginosa PA01
gcugcugaaaaacgccugggcgu

SEQ ID NO: 3464836 - RNA, 17 nt, Pseudomonas aeruginosa PA01
gcugcugaucaggagga

SEQ ID NO: 3464837 - RNA, 23 nt, Pseudomonas aeruginosa PA01
gcugcugccauccgcgccgacca

SEQ ID NO: 3464838 - RNA, 13 nt, Pseudomonas aeruginosa PA01
gcugcugccgcgu

SEQ ID NO: 3464839 - RNA, 20 nt, Pseudomonas aeruginosa PA01
gcugcugccgcguuccuugu

SEQ ID NO: 3464840 - RNA, 17 nt, Pseudomonas aeruginosa PA01
gcugcugccggcuugcu

SEQ ID NO: 3464841 - RNA, 16 nt, Pseudomonas aeruginosa PA01
gcugcugcggggccug

SEQ ID NO: 3464842 - RNA, 12 nt, Pseudomonas aeruginosa PA01
gcugcugcucag

SEQ ID NO: 3464843 - RNA, 13 nt, Pseudomonas aeruginosa PA01
gcugcugcucagc

SEQ ID NO: 3464844 - RNA, 18 nt, Pseudomonas aeruginosa PA01
gcugcugcucagcgcgcu

SEQ ID NO: 3464845 - RNA, 16 nt, Pseudomonas aeruginosa PA01
gcugcugcugcggcgg

SEQ ID NO: 3464846 - RNA, 22 nt, Pseudomonas aeruginosa PA01
gcugcuggccuucgucggcuuc

SEQ ID NO: 3464847 - RNA, 13 nt, Pseudomonas aeruginosa PA01
gcugcuggcgccg

SEQ ID NO: 3464848 - RNA, 18 nt, Pseudomonas aeruginosa PA01
gcugcuggcgccgcuggc

SEQ ID NO: 3464849 - RNA, 20 nt, Pseudomonas aeruginosa PA01
gcugcuggcgccgcuggcgu

SEQ ID NO: 3464850 - RNA, 12 nt, Pseudomonas aeruginosa PA01
gcugcugggcgg

SEQ ID NO: 3464851 - RNA, 18 nt, Pseudomonas aeruginosa PA01
gcugcugggcggcgaccg

SEQ ID NO: 3464852 - RNA, 21 nt, Pseudomonas aeruginosa PA01
gcugcuggggaacugggcgag

SEQ ID NO: 3464853 - RNA, 20 nt, Pseudomonas aeruginosa PA01
gcugcugguagugcuggcgc

SEQ ID NO: 3464854 - RNA, 21 nt, Pseudomonas aeruginosa PA01
gcugcugguagugcuggcgca

SEQ ID NO: 3464855 - RNA, 16 nt, Pseudomonas aeruginosa PA01
gcugcuguccagcgcu

SEQ ID NO: 3464856 - RNA, 17 nt, Pseudomonas aeruginosa PA01
gcugcuguccagcgcuc

SEQ ID NO: 3464857 - RNA, 19 nt, Pseudomonas aeruginosa PA01
gcugcugucgagggucugc

SEQ ID NO: 3464858 - RNA, 12 nt, Pseudomonas aeruginosa PA01
gcugcuucggca

SEQ ID NO: 3464859 - RNA, 15 nt, Pseudomonas aeruginosa PA01
gcugcuucggcagcc

SEQ ID NO: 3464860 - RNA, 14 nt, Pseudomonas aeruginosa PA01
gcugcuugaacacc

SEQ ID NO: 3464861 - RNA, 15 nt, Pseudomonas aeruginosa PA01
gcugcuugaacaccu

SEQ ID NO: 3464862 - RNA, 14 nt, Pseudomonas aeruginosa PA01
gcugcuugccgcuc

SEQ ID NO: 3464863 - RNA, 20 nt, Pseudomonas aeruginosa PA01
gcugcuugccgcucaggcug

SEQ ID NO: 3464864 - RNA, 19 nt, Pseudomonas aeruginosa PA01
gcugcuugcgcgcggcguc

SEQ ID NO: 3464865 - RNA, 16 nt, Pseudomonas aeruginosa PA01
gcuggaaauggcgguc

SEQ ID NO: 3464866 - RNA, 19 nt, Pseudomonas aeruginosa PA01
gcuggaaauggcggucgcc

SEQ ID NO: 3464867 - RNA, 20 nt, Pseudomonas aeruginosa PA01
gcuggaaauggcggucgccg

SEQ ID NO: 3464868 - RNA, 16 nt, Pseudomonas aeruginosa PA01
gcuggaaccggccggc

SEQ ID NO: 3464869 - RNA, 20 nt, Pseudomonas aeruginosa PA01
gcuggccauccgcccugcgg

SEQ ID NO: 3464870 - RNA, 19 nt, Pseudomonas aeruginosa PA01
gcuggccaugauccggugc

SEQ ID NO: 3464871 - RNA, 18 nt, Pseudomonas aeruginosa PA01
gcuggcccaacagcggug

SEQ ID NO: 3464872 - RNA, 19 nt, Pseudomonas aeruginosa PA01
gcuggcccaguugcccggc

SEQ ID NO: 3464873 - RNA, 20 nt, Pseudomonas aeruginosa PA01
gcuggcccaguugcccggcc

SEQ ID NO: 3464874 - RNA, 14 nt, Pseudomonas aeruginosa PA01
gcuggcccuccauc

SEQ ID NO: 3464875 - RNA, 15 nt, Pseudomonas aeruginosa PA01
gcuggcccuccaucc

SEQ ID NO: 3464876 - RNA, 15 nt, Pseudomonas aeruginosa PA01
gcuggccgagcgccg

SEQ ID NO: 3464877 - RNA, 16 nt, Pseudomonas aeruginosa PA01
gcuggccgaggacccg

SEQ ID NO: 3464878 - RNA, 17 nt, Pseudomonas aeruginosa PA01
gcuggccgagggcgcgc

SEQ ID NO: 3464879 - RNA, 19 nt, Pseudomonas aeruginosa PA01
gcuggccgagggcgcgcag

SEQ ID NO: 3464880 - RNA, 22 nt, Pseudomonas aeruginosa PA01
gcuggccgcccuugcggcccgc

SEQ ID NO: 3464881 - RNA, 16 nt, Pseudomonas aeruginosa PA01
gcuggccgccuggccg

SEQ ID NO: 3464882 - RNA, 11 nt, Pseudomonas aeruginosa PA01
gcuggccgcgc

SEQ ID NO: 3464883 - RNA, 12 nt, Pseudomonas aeruginosa PA01
gcuggccgcgca

SEQ ID NO: 3464884 - RNA, 14 nt, Pseudomonas aeruginosa PA01
gcuggccgcgcagg

SEQ ID NO: 3464885 - RNA, 21 nt, Pseudomonas aeruginosa PA01
gcuggccgcgcgaccgcggcg

SEQ ID NO: 3464886 - RNA, 15 nt, Pseudomonas aeruginosa PA01
gcuggccggcagcag

SEQ ID NO: 3464887 - RNA, 13 nt, Pseudomonas aeruginosa PA01
gcuggccggucug

SEQ ID NO: 3464888 - RNA, 15 nt, Pseudomonas aeruginosa PA01
gcuggccggucugcu

SEQ ID NO: 3464889 - RNA, 20 nt, Pseudomonas aeruginosa PA01
gcuggccggugccauacagc

SEQ ID NO: 3464890 - RNA, 21 nt, Pseudomonas aeruginosa PA01
gcuggccggugccauacagcg

SEQ ID NO: 3464891 - RNA, 15 nt, Pseudomonas aeruginosa PA01
gcuggccggugccgc

SEQ ID NO: 3464892 - RNA, 19 nt, Pseudomonas aeruginosa PA01
gcuggccggugccgcccug

SEQ ID NO: 3464893 - RNA, 19 nt, Pseudomonas aeruginosa PA01
gcuggccgucgacccgccu

SEQ ID NO: 3464894 - RNA, 22 nt, Pseudomonas aeruginosa PA01
gcuggccgucgaggucggcgau

SEQ ID NO: 3464895 - RNA, 16 nt, Pseudomonas aeruginosa PA01
gcuggccucagggcgc

SEQ ID NO: 3464896 - RNA, 17 nt, Pseudomonas aeruginosa PA01
gcuggccucagggcgcg

SEQ ID NO: 3464897 - RNA, 20 nt, Pseudomonas aeruginosa PA01
gcuggccucagggcgcgaag

SEQ ID NO: 3464898 - RNA, 13 nt, Pseudomonas aeruginosa PA01
gcuggccucggcg

SEQ ID NO: 3464899 - RNA, 14 nt, Pseudomonas aeruginosa PA01
gcuggccucggcga

SEQ ID NO: 3464900 - RNA, 16 nt, Pseudomonas aeruginosa PA01
gcuggccucggcgauc

SEQ ID NO: 3464901 - RNA, 18 nt, Pseudomonas aeruginosa PA01
gcuggccucggcgaucgc

SEQ ID NO: 3464902 - RNA, 14 nt, Pseudomonas aeruginosa PA01
gcuggccugcagca

SEQ ID NO: 3464903 - RNA, 16 nt, Pseudomonas aeruginosa PA01
gcuggccugcagcagg

SEQ ID NO: 3464904 - RNA, 20 nt, Pseudomonas aeruginosa PA01
gcuggccugcagcaggucga

SEQ ID NO: 3464905 - RNA, 22 nt, Pseudomonas aeruginosa PA01
gcuggccugcagcaggucgagc

SEQ ID NO: 3464906 - RNA, 14 nt, Pseudomonas aeruginosa PA01
gcuggccugcaggu

SEQ ID NO: 3464907 - RNA, 12 nt, Pseudomonas aeruginosa PA01
gcuggccugccg

SEQ ID NO: 3464908 - RNA, 15 nt, Pseudomonas aeruginosa PA01
gcuggccugccgaug

SEQ ID NO: 3464909 - RNA, 14 nt, Pseudomonas aeruginosa PA01
gcuggccuggccac

SEQ ID NO: 3464910 - RNA, 18 nt, Pseudomonas aeruginosa PA01
gcuggccugggacggcgu

SEQ ID NO: 3464911 - RNA, 18 nt, Pseudomonas aeruginosa PA01
gcuggccuucgucggcuu

SEQ ID NO: 3464912 - RNA, 18 nt, Pseudomonas aeruginosa PA01
gcuggccuuggccaugcc

SEQ ID NO: 3464913 - RNA, 21 nt, Pseudomonas aeruginosa PA01
gcuggccuuguacagggcgcg

SEQ ID NO: 3464914 - RNA, 15 nt, Pseudomonas aeruginosa PA01
gcuggcgaaccaguc

SEQ ID NO: 3464915 - RNA, 17 nt, Pseudomonas aeruginosa PA01
gcuggcgaaccagucca

SEQ ID NO: 3464916 - RNA, 21 nt, Pseudomonas aeruginosa PA01
gcuggcgaaccaguccagcac

SEQ ID NO: 3464917 - RNA, 22 nt, Pseudomonas aeruginosa PA01
gcuggcgaacggcuggucggcu

SEQ ID NO: 3464918 - RNA, 23 nt, Pseudomonas aeruginosa PA01
gcuggcgaacggcuggucggcuu

SEQ ID NO: 3464919 - RNA, 17 nt, Pseudomonas aeruginosa PA01
gcuggcgaagcuggggc

SEQ ID NO: 3464920 - RNA, 18 nt, Pseudomonas aeruginosa PA01
gcuggcgaagcuggggcu

SEQ ID NO: 3464921 - RNA, 19 nt, Pseudomonas aeruginosa PA01
gcuggcgaagcuggggcug

SEQ ID NO: 3464922 - RNA, 15 nt, Pseudomonas aeruginosa PA01
gcuggcgaaggcgcu

SEQ ID NO: 3464923 - RNA, 19 nt, Pseudomonas aeruginosa PA01
gcuggcgaauauccucguc

SEQ ID NO: 3464924 - RNA, 22 nt, Pseudomonas aeruginosa PA01
gcuggcgaauauccucgucgau

SEQ ID NO: 3464925 - RNA, 21 nt, Pseudomonas aeruginosa PA01
gcuggcgaccggguccugcag

SEQ ID NO: 3464926 - RNA, 22 nt, Pseudomonas aeruginosa PA01
gcuggcgaggaacacccagaag

SEQ ID NO: 3464927 - RNA, 15 nt, Pseudomonas aeruginosa PA01
gcuggcgaggacgcc

SEQ ID NO: 3464928 - RNA, 17 nt, Pseudomonas aeruginosa PA01
gcuggcgaggacgccgg

SEQ ID NO: 3464929 - RNA, 19 nt, Pseudomonas aeruginosa PA01
gcuggcgaggacgccgggc

SEQ ID NO: 3464930 - RNA, 16 nt, Pseudomonas aeruginosa PA01
gcuggcgaucaccagg

SEQ ID NO: 3464931 - RNA, 22 nt, Pseudomonas aeruginosa PA01
gcuggcgaucaccagggugcgc

SEQ ID NO: 3464932 - RNA, 16 nt, Pseudomonas aeruginosa PA01
gcuggcgaucaucgcg

SEQ ID NO: 3464933 - RNA, 18 nt, Pseudomonas aeruginosa PA01
gcuggcgaucaucgcgca

SEQ ID NO: 3464934 - RNA, 19 nt, Pseudomonas aeruginosa PA01
gcuggcgaucaucgcgcac

SEQ ID NO: 3464935 - RNA, 22 nt, Pseudomonas aeruginosa PA01
gcuggcgaucaugccuucgauc

SEQ ID NO: 3464936 - RNA, 16 nt, Pseudomonas aeruginosa PA01
gcuggcgaucgaccug

SEQ ID NO: 3464937 - RNA, 17 nt, Pseudomonas aeruginosa PA01
gcuggcgaucgaccugc

SEQ ID NO: 3464938 - RNA, 16 nt, Pseudomonas aeruginosa PA01
gcuggcgaucucggcg

SEQ ID NO: 3464939 - RNA, 20 nt, Pseudomonas aeruginosa PA01
gcuggcgaucucggcgcggg

SEQ ID NO: 3464940 - RNA, 21 nt, Pseudomonas aeruginosa PA01
gcuggcgaucucggcgcgggc

SEQ ID NO: 3464941 - RNA, 22 nt, Pseudomonas aeruginosa PA01
gcuggcgaucucggcgcgggca

SEQ ID NO: 3464942 - RNA, 17 nt, Pseudomonas aeruginosa PA01
gcuggcgaugcugaccc

SEQ ID NO: 3464943 - RNA, 20 nt, Pseudomonas aeruginosa PA01
gcuggcgauguagcugccgg

SEQ ID NO: 3464944 - RNA, 22 nt, Pseudomonas aeruginosa PA01
gcuggcgauguagcugccggcg

SEQ ID NO: 3464945 - RNA, 18 nt, Pseudomonas aeruginosa PA01
gcuggcgauuuccucgcu

SEQ ID NO: 3464946 - RNA, 22 nt, Pseudomonas aeruginosa PA01
gcuggcgauuuccucgcugcgg

SEQ ID NO: 3464947 - RNA, 21 nt, Pseudomonas aeruginosa PA01
gcuggcgcaacagaucuuccu

SEQ ID NO: 3464948 - RNA, 22 nt, Pseudomonas aeruginosa PA01
gcuggcgcaacagaucuuccuc

SEQ ID NO: 3464949 - RNA, 20 nt, Pseudomonas aeruginosa PA01
gcuggcgcaacugcgccagc

SEQ ID NO: 3464950 - RNA, 17 nt, Pseudomonas aeruginosa PA01
gcuggcgcacacggucg

SEQ ID NO: 3464951 - RNA, 15 nt, Pseudomonas aeruginosa PA01
gcuggcgcagcagca

SEQ ID NO: 3464952 - RNA, 16 nt, Pseudomonas aeruginosa PA01
gcuggcgcagccaggc

SEQ ID NO: 3464953 - RNA, 17 nt, Pseudomonas aeruginosa PA01
gcuggcgcagccaggcg

SEQ ID NO: 3464954 - RNA, 13 nt, Pseudomonas aeruginosa PA01
gcuggcgcagccg

SEQ ID NO: 3464955 - RNA, 16 nt, Pseudomonas aeruginosa PA01
gcuggcgcagccgcug

SEQ ID NO: 3464956 - RNA, 17 nt, Pseudomonas aeruginosa PA01
gcuggcgcagccgcugc

SEQ ID NO: 3464957 - RNA, 17 nt, Pseudomonas aeruginosa PA01
gcuggcgcagccguucc

SEQ ID NO: 3464958 - RNA, 23 nt, Pseudomonas aeruginosa PA01
gcuggcgcaggaccgccauggcg

SEQ ID NO: 3464959 - RNA, 23 nt, Pseudomonas aeruginosa PA01
gcuggcgcaggccuucgacuucg

SEQ ID NO: 3464960 - RNA, 13 nt, Pseudomonas aeruginosa PA01
gcuggcgccgaug

SEQ ID NO: 3464961 - RNA, 15 nt, Pseudomonas aeruginosa PA01
gcuggcgccgcuggc

SEQ ID NO: 3464962 - RNA, 13 nt, Pseudomonas aeruginosa PA01
gcuggcgccggug

SEQ ID NO: 3464963 - RNA, 14 nt, Pseudomonas aeruginosa PA01
gcuggcgccggugc

SEQ ID NO: 3464964 - RNA, 21 nt, Pseudomonas aeruginosa PA01
gcuggcgcgauccgcgcggca

SEQ ID NO: 3464965 - RNA, 20 nt, Pseudomonas aeruginosa PA01
gcuggcgcgaucggggcaga

SEQ ID NO: 3464966 - RNA, 19 nt, Pseudomonas aeruginosa PA01
gcuggcgcgcgcgcugcca

SEQ ID NO: 3464967 - RNA, 19 nt, Pseudomonas aeruginosa PA01
gcuggcgcggaugucgggc

SEQ ID NO: 3464968 - RNA, 21 nt, Pseudomonas aeruginosa PA01
gcuggcgcgucgcugccgccg

SEQ ID NO: 3464969 - RNA, 22 nt, Pseudomonas aeruginosa PA01
gcuggcgcgucgcugccgccgc

SEQ ID NO: 3464970 - RNA, 20 nt, Pseudomonas aeruginosa PA01
gcuggcgcguugugccgcca

SEQ ID NO: 3464971 - RNA, 23 nt, Pseudomonas aeruginosa PA01
gcuggucgacguaggcggcgagg

SEQ ID NO: 3464972 - RNA, 17 nt, Pseudomonas aeruginosa PA01
gcuggucggcuuccgcc

SEQ ID NO: 3464973 - RNA, 21 nt, Pseudomonas aeruginosa PA01
gcuggucguagcgacccuuca

SEQ ID NO: 3464974 - RNA, 15 nt, Pseudomonas aeruginosa PA01
gcuggucguggucca

SEQ ID NO: 3464975 - RNA, 16 nt, Pseudomonas aeruginosa PA01
gcuggucguucagugc

SEQ ID NO: 3464976 - RNA, 22 nt, Pseudomonas aeruginosa PA01
gcuggucguucagugccagcag

SEQ ID NO: 3464977 - RNA, 16 nt, Pseudomonas aeruginosa PA01
gcuggucucuuccagc

SEQ ID NO: 3464978 - RNA, 19 nt, Pseudomonas aeruginosa PA01
gcuggucucuuccagcaug

SEQ ID NO: 3464979 - RNA, 13 nt, Pseudomonas aeruginosa PA01
gcuggugaucgac

SEQ ID NO: 3464980 - RNA, 18 nt, Pseudomonas aeruginosa PA01
gcuggugcccugggcggc

SEQ ID NO: 3464981 - RNA, 13 nt, Pseudomonas aeruginosa PA01
gcuggugccgacg

SEQ ID NO: 3464982 - RNA, 14 nt, Pseudomonas aeruginosa PA01
gcuggugccgacgc

SEQ ID NO: 3464983 - RNA, 12 nt, Pseudomonas aeruginosa PA01
gcuggugccgau

SEQ ID NO: 3464984 - RNA, 23 nt, Pseudomonas aeruginosa PA01
gcuggugccgaucagcccgucgg

SEQ ID NO: 3464985 - RNA, 14 nt, Pseudomonas aeruginosa PA01
gcuggugccgcugu

SEQ ID NO: 3464986 - RNA, 17 nt, Pseudomonas aeruginosa PA01
gcuggugcggccgauga

SEQ ID NO: 3464987 - RNA, 24 nt, Pseudomonas aeruginosa PA01
gcuggugcugcuccaucaguugcg

SEQ ID NO: 3464988 - RNA, 21 nt, Pseudomonas aeruginosa PA01
gcugguggacgucgucggcga

SEQ ID NO: 3464989 - RNA, 13 nt, Pseudomonas aeruginosa PA01
gcugguggcccug

SEQ ID NO: 3464990 - RNA, 20 nt, Pseudomonas aeruginosa PA01
gcugguggcccugggcggcg

SEQ ID NO: 3464991 - RNA, 21 nt, Pseudomonas aeruginosa PA01
gcugguggcccugggcggcga

SEQ ID NO: 3464992 - RNA, 12 nt, Pseudomonas aeruginosa PA01
gcugguggccgu

SEQ ID NO: 3464993 - RNA, 15 nt, Pseudomonas aeruginosa PA01
gcuggugggcgucgc

SEQ ID NO: 3464994 - RNA, 13 nt, Pseudomonas aeruginosa PA01
gcuggugggugau

SEQ ID NO: 3464995 - RNA, 16 nt, Pseudomonas aeruginosa PA01
gcugguguagaggcuc

SEQ ID NO: 3464996 - RNA, 16 nt, Pseudomonas aeruginosa PA01
gcugguugaccaggcc

SEQ ID NO: 3464997 - RNA, 15 nt, Pseudomonas aeruginosa PA01
gcugguugccagcag

SEQ ID NO: 3464998 - RNA, 18 nt, Pseudomonas aeruginosa PA01
gcugguugccagcagcgc

SEQ ID NO: 3464999 - RNA, 22 nt, Pseudomonas aeruginosa PA01
gcugguugccagcagcgcugau

SEQ ID NO: 3465000 - RNA, 17 nt, Pseudomonas aeruginosa PA01
gcugguugcccagggug

SEQ ID NO: 3465001 - RNA, 19 nt, Pseudomonas aeruginosa PA01
gcugguugcccaggguggc

SEQ ID NO: 3465002 - RNA, 18 nt, Pseudomonas aeruginosa PA01
gcugguuuagcucggcga

SEQ ID NO: 3465003 - RNA, 19 nt, Pseudomonas aeruginosa PA01
gcugguuuagcucggcgau

SEQ ID NO: 3465004 - RNA, 16 nt, Pseudomonas aeruginosa PA01
gcuguaaucgccgcuu

SEQ ID NO: 3465005 - RNA, 14 nt, Pseudomonas aeruginosa PA01
gcuguacaagcgca

SEQ ID NO: 3465006 - RNA, 14 nt, Pseudomonas aeruginosa PA01
gcuguacagcagga

SEQ ID NO: 3465007 - RNA, 16 nt, Pseudomonas aeruginosa PA01
gcuguacagcaggagc

SEQ ID NO: 3465008 - RNA, 15 nt, Pseudomonas aeruginosa PA01
gcuguagccggcgau

SEQ ID NO: 3465009 - RNA, 14 nt, Pseudomonas aeruginosa PA01
gcuguagccggcgc

SEQ ID NO: 3465010 - RNA, 21 nt, Pseudomonas aeruginosa PA01
gcuguagccucccgccgcggc

SEQ ID NO: 3465011 - RNA, 13 nt, Pseudomonas aeruginosa PA01
gcuguagcggcuc

SEQ ID NO: 3465012 - RNA, 18 nt, Pseudomonas aeruginosa PA01
gcuguagcggcucgccga

SEQ ID NO: 3465013 - RNA, 13 nt, Pseudomonas aeruginosa PA01
gcuguagcggcuu

SEQ ID NO: 3465014 - RNA, 20 nt, Pseudomonas aeruginosa PA01
gcuguagcucugcuggcugu

SEQ ID NO: 3465015 - RNA, 15 nt, Pseudomonas aeruginosa PA01
gcuguaggacagguu

SEQ ID NO: 3465016 - RNA, 14 nt, Pseudomonas aeruginosa PA01
gcuguaggcgagca

SEQ ID NO: 3465017 - RNA, 19 nt, Pseudomonas aeruginosa PA01
gcuguaggcgagcagcggc

SEQ ID NO: 3465018 - RNA, 20 nt, Pseudomonas aeruginosa PA01
gcuguaggcgagcagcggca

SEQ ID NO: 3465019 - RNA, 17 nt, Pseudomonas aeruginosa PA01
gcuguaggugcccggcg

SEQ ID NO: 3465020 - RNA, 20 nt, Pseudomonas aeruginosa PA01
gcuguaguugacgucgccga

SEQ ID NO: 3465021 - RNA, 21 nt, Pseudomonas aeruginosa PA01
gcuguaguugacgucgccgau

SEQ ID NO: 3465022 - RNA, 18 nt, Pseudomonas aeruginosa PA01
gcugucaaucgcgcaacg

SEQ ID NO: 3465023 - RNA, 23 nt, Pseudomonas aeruginosa PA01
gcugucaaucgcgcaacggcagc

SEQ ID NO: 3465024 - RNA, 13 nt, Pseudomonas aeruginosa PA01
gcugucagcgccc

SEQ ID NO: 3465025 - RNA, 17 nt, Pseudomonas aeruginosa PA01
gcugucagcgcccggcu

SEQ ID NO: 3465026 - RNA, 21 nt, Pseudomonas aeruginosa PA01
gcugucagcgcccggcugugc

SEQ ID NO: 3465027 - RNA, 19 nt, Pseudomonas aeruginosa PA01
gcugucagggcuugcgcgc

SEQ ID NO: 3465028 - RNA, 16 nt, Pseudomonas aeruginosa PA01
gcuguccacgccgaag

SEQ ID NO: 3465029 - RNA, 23 nt, Pseudomonas aeruginosa PA01
gcuguccacgccgaagucggcga

SEQ ID NO: 3465030 - RNA, 12 nt, Pseudomonas aeruginosa PA01
gcuguccagcag

SEQ ID NO: 3465031 - RNA, 13 nt, Pseudomonas aeruginosa PA01
gcuguccagcagg

SEQ ID NO: 3465032 - RNA, 16 nt, Pseudomonas aeruginosa PA01
gcuguccagcaggcgu

SEQ ID NO: 3465033 - RNA, 21 nt, Pseudomonas aeruginosa PA01
gcuguccagcgcuccuugcgc

SEQ ID NO: 3465034 - RNA, 15 nt, Pseudomonas aeruginosa PA01
gcuguccaugaagac

SEQ ID NO: 3465035 - RNA, 13 nt, Pseudomonas aeruginosa PA01
gcugucccggcca

SEQ ID NO: 3465036 - RNA, 21 nt, Pseudomonas aeruginosa PA01
gcugucccggccauuccuucc

SEQ ID NO: 3465037 - RNA, 23 nt, Pseudomonas aeruginosa PA01
gcuguccgccgccgcggcgcgga

SEQ ID NO: 3465038 - RNA, 17 nt, Pseudomonas aeruginosa PA01
gcugucgacgcagccgg

SEQ ID NO: 3465039 - RNA, 15 nt, Pseudomonas aeruginosa PA01
gcugucgagcgaagc

SEQ ID NO: 3465040 - RNA, 14 nt, Pseudomonas aeruginosa PA01
gcugucgcccgggc

SEQ ID NO: 3465041 - RNA, 20 nt, Pseudomonas aeruginosa PA01
gcugucgcccgggcgccacc

SEQ ID NO: 3465042 - RNA, 16 nt, Pseudomonas aeruginosa PA01
gcugucgcccucgcgg

SEQ ID NO: 3465043 - RNA, 14 nt, Pseudomonas aeruginosa PA01
gcugucgccgagca

SEQ ID NO: 3465044 - RNA, 16 nt, Pseudomonas aeruginosa PA01
gcugucgccguuggcc

SEQ ID NO: 3465045 - RNA, 19 nt, Pseudomonas aeruginosa PA01
gcugucgccguuggccuuc

SEQ ID NO: 3465046 - RNA, 20 nt, Pseudomonas aeruginosa PA01
gcugucgcggacccgcgccg

SEQ ID NO: 3465047 - RNA, 21 nt, Pseudomonas aeruginosa PA01
gcugucgcggacccgcgccgg

SEQ ID NO: 3465048 - RNA, 15 nt, Pseudomonas aeruginosa PA01
gcugucggccagccc

SEQ ID NO: 3465049 - RNA, 17 nt, Pseudomonas aeruginosa PA01
gcugucggccagccccu

SEQ ID NO: 3465050 - RNA, 19 nt, Pseudomonas aeruginosa PA01
gcugucggccagccccugc

SEQ ID NO: 3465051 - RNA, 20 nt, Pseudomonas aeruginosa PA01
gcugucggccagccccugcg

SEQ ID NO: 3465052 - RNA, 22 nt, Pseudomonas aeruginosa PA01
gcugucggccagccccugcgga

SEQ ID NO: 3465053 - RNA, 21 nt, Pseudomonas aeruginosa PA01
gcugucggccaucgccgucuc

SEQ ID NO: 3465054 - RNA, 15 nt, Pseudomonas aeruginosa PA01
gcugucggccucgac

SEQ ID NO: 3465055 - RNA, 17 nt, Pseudomonas aeruginosa PA01
gcugucggccucgacga

SEQ ID NO: 3465056 - RNA, 13 nt, Pseudomonas aeruginosa PA01
gcugucguccagc

SEQ ID NO: 3465057 - RNA, 14 nt, Pseudomonas aeruginosa PA01
gcugucguccagcg

SEQ ID NO: 3465058 - RNA, 14 nt, Pseudomonas aeruginosa PA01
gcugucguccuggg

SEQ ID NO: 3465059 - RNA, 22 nt, Pseudomonas aeruginosa PA01
gcugucgucgaggguggcgccg

SEQ ID NO: 3465060 - RNA, 17 nt, Pseudomonas aeruginosa PA01
gcugucgucggcgcggc

SEQ ID NO: 3465061 - RNA, 19 nt, Pseudomonas aeruginosa PA01
gcugucgucggcgcggccg

SEQ ID NO: 3465062 - RNA, 20 nt, Pseudomonas aeruginosa PA01
gcugucgucggcgcggccgg

SEQ ID NO: 3465063 - RNA, 22 nt, Pseudomonas aeruginosa PA01
gcugucgucggcgcggccggcg

SEQ ID NO: 3465064 - RNA, 15 nt, Pseudomonas aeruginosa PA01
gcugucguggacgcc

SEQ ID NO: 3465065 - RNA, 16 nt, Pseudomonas aeruginosa PA01
gcugucguggacgccg

SEQ ID NO: 3465066 - RNA, 20 nt, Pseudomonas aeruginosa PA01
gcugucguggacgccgguga

SEQ ID NO: 3465067 - RNA, 22 nt, Pseudomonas aeruginosa PA01
gcugucuaucccgugccgggcc

SEQ ID NO: 3465068 - RNA, 17 nt, Pseudomonas aeruginosa PA01
gcugucuaucugcgccg

SEQ ID NO: 3465069 - RNA, 19 nt, Pseudomonas aeruginosa PA01
gcugucucgccagcccggc

SEQ ID NO: 3465070 - RNA, 23 nt, Pseudomonas aeruginosa PA01
gcugugcacccagaccuuccagc

SEQ ID NO: 3465071 - RNA, 20 nt, Pseudomonas aeruginosa PA01
gcugugcacggucugcucgg

SEQ ID NO: 3465072 - RNA, 12 nt, Pseudomonas aeruginosa PA01
gcugugcagggc

SEQ ID NO: 3465073 - RNA, 19 nt, Pseudomonas aeruginosa PA01
gcuuccgccggcgccgccu

SEQ ID NO: 3465074 - RNA, 20 nt, Pseudomonas aeruginosa PA01
gcuuccgccggcgccgccuc

SEQ ID NO: 3465075 - RNA, 18 nt, Pseudomonas aeruginosa PA01
gcuuccgcgcggcgcccu

SEQ ID NO: 3465076 - RNA, 13 nt, Pseudomonas aeruginosa PA01
gcuuccggcagcc

SEQ ID NO: 3465077 - RNA, 17 nt, Pseudomonas aeruginosa PA01
gcuuccggcagccagcc

SEQ ID NO: 3465078 - RNA, 20 nt, Pseudomonas aeruginosa PA01
gcuuccggcagccagccgcc

SEQ ID NO: 3465079 - RNA, 21 nt, Pseudomonas aeruginosa PA01
gcuuccggcagccagccgccg

SEQ ID NO: 3465080 - RNA, 14 nt, Pseudomonas aeruginosa PA01
gcuuccggcccggc

SEQ ID NO: 3465081 - RNA, 16 nt, Pseudomonas aeruginosa PA01
gcuuccggcccggcca

SEQ ID NO: 3465082 - RNA, 18 nt, Pseudomonas aeruginosa PA01
gcuuccggcccggccagg

SEQ ID NO: 3465083 - RNA, 13 nt, Pseudomonas aeruginosa PA01
gcuuccggcgcca

SEQ ID NO: 3465084 - RNA, 24 nt, Pseudomonas aeruginosa PA01
gcuuccggcgcuccacagcugcca

SEQ ID NO: 3465085 - RNA, 18 nt, Pseudomonas aeruginosa PA01
gcuuccggcuccaguugc

SEQ ID NO: 3465086 - RNA, 16 nt, Pseudomonas aeruginosa PA01
gcuuccucgcccucau

SEQ ID NO: 3465087 - RNA, 13 nt, Pseudomonas aeruginosa PA01
gcuuccuggcgcc

SEQ ID NO: 3465088 - RNA, 17 nt, Pseudomonas aeruginosa PA01
gcuuccuggcgccggua

SEQ ID NO: 3465089 - RNA, 18 nt, Pseudomonas aeruginosa PA01
gcuuccugggcuucgucc

SEQ ID NO: 3465090 - RNA, 21 nt, Pseudomonas aeruginosa PA01
gcuuccugguggaacagccgc

SEQ ID NO: 3465091 - RNA, 19 nt, Pseudomonas aeruginosa PA01
gcuuccuguuguuccacgu

SEQ ID NO: 3465092 - RNA, 16 nt, Pseudomonas aeruginosa PA01
gcuucgaacgugcgcg

SEQ ID NO: 3465093 - RNA, 17 nt, Pseudomonas aeruginosa PA01
gcuucgaacgugcgcgc

SEQ ID NO: 3465094 - RNA, 19 nt, Pseudomonas aeruginosa PA01
gcuucgaacgugcgcgcaa

SEQ ID NO: 3465095 - RNA, 20 nt, Pseudomonas aeruginosa PA01
gcuucgaagcucucgccgcg

SEQ ID NO: 3465096 - RNA, 21 nt, Pseudomonas aeruginosa PA01
gcuucgaagcucucgccgcgc

SEQ ID NO: 3465097 - RNA, 22 nt, Pseudomonas aeruginosa PA01
gcuucgaagcucucgccgcgcu

SEQ ID NO: 3465098 - RNA, 15 nt, Pseudomonas aeruginosa PA01
gcuucgaccagggca

SEQ ID NO: 3465099 - RNA, 21 nt, Pseudomonas aeruginosa PA01
gcuucgaggcgggcgucggcg

SEQ ID NO: 3465100 - RNA, 16 nt, Pseudomonas aeruginosa PA01
gcuucgcccauggcac

SEQ ID NO: 3465101 - RNA, 15 nt, Pseudomonas aeruginosa PA01
gcuucgcccgccgcc

SEQ ID NO: 3465102 - RNA, 17 nt, Pseudomonas aeruginosa PA01
gcuucgcccgccgccug

SEQ ID NO: 3465103 - RNA, 14 nt, Pseudomonas aeruginosa PA01
gcuucgcccuacgc

SEQ ID NO: 3465104 - RNA, 19 nt, Pseudomonas aeruginosa PA01
gcuucgcccuacgcggcac

SEQ ID NO: 3465105 - RNA, 12 nt, Pseudomonas aeruginosa PA01
gcuucgccgccc

SEQ ID NO: 3465106 - RNA, 13 nt, Pseudomonas aeruginosa PA01
gcuucgccgcccu

SEQ ID NO: 3465107 - RNA, 15 nt, Pseudomonas aeruginosa PA01
gcuucgccgcccugg

SEQ ID NO: 3465108 - RNA, 13 nt, Pseudomonas aeruginosa PA01
gcuucgccgccgc

SEQ ID NO: 3465109 - RNA, 15 nt, Pseudomonas aeruginosa PA01
gcuucgccgccgcgc

SEQ ID NO: 3465110 - RNA, 19 nt, Pseudomonas aeruginosa PA01
gcuucgccgccgcgcgcgc

SEQ ID NO: 3465111 - RNA, 21 nt, Pseudomonas aeruginosa PA01
gcuucgccgccgcgcgcgcgg

SEQ ID NO: 3465112 - RNA, 23 nt, Pseudomonas aeruginosa PA01
gcuucgccggguguuuuuccucg

SEQ ID NO: 3465113 - RNA, 19 nt, Pseudomonas aeruginosa PA01
gcuucgcgcagcucggcca

SEQ ID NO: 3465114 - RNA, 18 nt, Pseudomonas aeruginosa PA01
gcuucgcgcuccaggccc

SEQ ID NO: 3465115 - RNA, 15 nt, Pseudomonas aeruginosa PA01
gcuucgcggaucuca

SEQ ID NO: 3465116 - RNA, 20 nt, Pseudomonas aeruginosa PA01
gcuucgcggaucucaggacc

SEQ ID NO: 3465117 - RNA, 20 nt, Pseudomonas aeruginosa PA01
gcuucgcgggugaccuggcc

SEQ ID NO: 3465118 - RNA, 17 nt, Pseudomonas aeruginosa PA01
gcuucgcgugccagacg

SEQ ID NO: 3465119 - RNA, 18 nt, Pseudomonas aeruginosa PA01
gcuucgcguugcaggcga

SEQ ID NO: 3465120 - RNA, 16 nt, Pseudomonas aeruginosa PA01
gcuucgcuggguuuuc

SEQ ID NO: 3465121 - RNA, 11 nt, Pseudomonas aeruginosa PA01
gcuucgcuggu

SEQ ID NO: 3465122 - RNA, 14 nt, Pseudomonas aeruginosa PA01
gcuucggcagccuu

SEQ ID NO: 3465123 - RNA, 15 nt, Pseudomonas aeruginosa PA01
gcuucggcggauaac

SEQ ID NO: 3465124 - RNA, 16 nt, Pseudomonas aeruginosa PA01
gcuucggcggcgcgcu

SEQ ID NO: 3465125 - RNA, 13 nt, Pseudomonas aeruginosa PA01
gcuucggcggcuu

SEQ ID NO: 3465126 - RNA, 14 nt, Pseudomonas aeruginosa PA01
gcuucggcggucag

SEQ ID NO: 3465127 - RNA, 19 nt, Pseudomonas aeruginosa PA01
gcuucggcggucaggcuca

SEQ ID NO: 3465128 - RNA, 21 nt, Pseudomonas aeruginosa PA01
gcuucggcggucaggcucagc

SEQ ID NO: 3465129 - RNA, 19 nt, Pseudomonas aeruginosa PA01
gcuucggcugcugcugcgg

SEQ ID NO: 3465130 - RNA, 22 nt, Pseudomonas aeruginosa PA01
gcuucgggagucaacgccuggc

SEQ ID NO: 3465131 - RNA, 23 nt, Pseudomonas aeruginosa PA01
gcuucgggagucaacgccuggcc

SEQ ID NO: 3465132 - RNA, 21 nt, Pseudomonas aeruginosa PA01
gcuucgggaucguaggcgcgc

SEQ ID NO: 3465133 - RNA, 23 nt, Pseudomonas aeruginosa PA01
gcuucgggaucguaggcgcgcac

SEQ ID NO: 3465134 - RNA, 18 nt, Pseudomonas aeruginosa PA01
gcuucgguguaucggcgg

SEQ ID NO: 3465135 - RNA, 23 nt, Pseudomonas aeruginosa PA01
gcuucgguguaucggcggauaac

SEQ ID NO: 3465136 - RNA, 21 nt, Pseudomonas aeruginosa PA01
gcuucguccagcgaggcgugg

SEQ ID NO: 3465137 - RNA, 15 nt, Pseudomonas aeruginosa PA01
gcuucgucccaugac

SEQ ID NO: 3465138 - RNA, 15 nt, Pseudomonas aeruginosa PA01
gcuucguccgccugg

SEQ ID NO: 3465139 - RNA, 17 nt, Pseudomonas aeruginosa PA01
gcuucguccgccuggga

SEQ ID NO: 3465140 - RNA, 15 nt, Pseudomonas aeruginosa PA01
gcuucguccugcugc

SEQ ID NO: 3465141 - RNA, 17 nt, Pseudomonas aeruginosa PA01
gcuucguccugcugcug

SEQ ID NO: 3465142 - RNA, 18 nt, Pseudomonas aeruginosa PA01
gcuucguccugcugcugg

SEQ ID NO: 3465143 - RNA, 19 nt, Pseudomonas aeruginosa PA01
gcuucguccugcugcuggc

SEQ ID NO: 3465144 - RNA, 20 nt, Pseudomonas aeruginosa PA01
gcuucguccugcugcuggcc

SEQ ID NO: 3465145 - RNA, 15 nt, Pseudomonas aeruginosa PA01
gcuucgucgcgcagg

SEQ ID NO: 3465146 - RNA, 17 nt, Pseudomonas aeruginosa PA01
gcuucguugcuccugcg

SEQ ID NO: 3465147 - RNA, 18 nt, Pseudomonas aeruginosa PA01
gcuucguuggcgacgacg

SEQ ID NO: 3465148 - RNA, 22 nt, Pseudomonas aeruginosa PA01
gcuucuacgccuugcggcgccg

SEQ ID NO: 3465149 - RNA, 23 nt, Pseudomonas aeruginosa PA01
gcuucuacgccuugcggcgccga

SEQ ID NO: 3465150 - RNA, 19 nt, Pseudomonas aeruginosa PA01
gcuucucgacguaggcggc

SEQ ID NO: 3465151 - RNA, 21 nt, Pseudomonas aeruginosa PA01
gcuucucgacguaggcggcga

SEQ ID NO: 3465152 - RNA, 13 nt, Pseudomonas aeruginosa PA01
gcuucucggcagc

SEQ ID NO: 3465153 - RNA, 14 nt, Pseudomonas aeruginosa PA01
gcuucucggcagcg

SEQ ID NO: 3465154 - RNA, 17 nt, Pseudomonas aeruginosa PA01
gcuucucgucgccgccg

SEQ ID NO: 3465155 - RNA, 21 nt, Pseudomonas aeruginosa PA01
gcuucucuuucaccuggucgc

SEQ ID NO: 3465156 - RNA, 15 nt, Pseudomonas aeruginosa PA01
gcuucugcuggccgc

SEQ ID NO: 3465157 - RNA, 18 nt, Pseudomonas aeruginosa PA01
gcuucugcuggccgcgca

SEQ ID NO: 3465158 - RNA, 19 nt, Pseudomonas aeruginosa PA01
gcuucugcuggccgcgcag

SEQ ID NO: 3465159 - RNA, 19 nt, Pseudomonas aeruginosa PA01
gcuucugguucguccgcgc

SEQ ID NO: 3465160 - RNA, 18 nt, Pseudomonas aeruginosa PA01
gcuucugucccugggcca

SEQ ID NO: 3465161 - RNA, 20 nt, Pseudomonas aeruginosa PA01
gcuucugucccugggccaug

SEQ ID NO: 3465162 - RNA, 17 nt, Pseudomonas aeruginosa PA01
gcuucugugggcagcgg

SEQ ID NO: 3465163 - RNA, 16 nt, Pseudomonas aeruginosa PA01
gcuucuucaccaggcc

SEQ ID NO: 3465164 - RNA, 16 nt, Pseudomonas aeruginosa PA01
gcuucuucagcagcgg

SEQ ID NO: 3465165 - RNA, 19 nt, Pseudomonas aeruginosa PA01
gcuucuucagcagcgggcg

SEQ ID NO: 3465166 - RNA, 22 nt, Pseudomonas aeruginosa PA01
gcuucuucagcagcgggcgucc

SEQ ID NO: 3465167 - RNA, 12 nt, Pseudomonas aeruginosa PA01
gcuucuuccugg

SEQ ID NO: 3465168 - RNA, 12 nt, Pseudomonas aeruginosa PA01
gcuucuucggca

SEQ ID NO: 3465169 - RNA, 21 nt, Pseudomonas aeruginosa PA01
gcuucuuucauuuucgcgcuc

SEQ ID NO: 3465170 - RNA, 21 nt, Pseudomonas aeruginosa PA01
gcuugaaccgcgagaccccgg

SEQ ID NO: 3465171 - RNA, 18 nt, Pseudomonas aeruginosa PA01
gcuugaacgcgcgccuga

SEQ ID NO: 3465172 - RNA, 16 nt, Pseudomonas aeruginosa PA01
gcuugacccguugcgc

SEQ ID NO: 3465173 - RNA, 19 nt, Pseudomonas aeruginosa PA01
gcuugacccguugcgccuc

SEQ ID NO: 3465174 - RNA, 15 nt, Pseudomonas aeruginosa PA01
gcuugaccgccgccg

SEQ ID NO: 3465175 - RNA, 15 nt, Pseudomonas aeruginosa PA01
gcuuggucgggcgcc

SEQ ID NO: 3465176 - RNA, 16 nt, Pseudomonas aeruginosa PA01
gcuuggucgggcgccg

SEQ ID NO: 3465177 - RNA, 17 nt, Pseudomonas aeruginosa PA01
gcuuggucgggcgccgc

SEQ ID NO: 3465178 - RNA, 21 nt, Pseudomonas aeruginosa PA01
gcuuggucgggcgccgcgccu

SEQ ID NO: 3465179 - RNA, 22 nt, Pseudomonas aeruginosa PA01
gcuuggucgggcgccgcgccuu

SEQ ID NO: 3465180 - RNA, 14 nt, Pseudomonas aeruginosa PA01
gcuugguguagaga

SEQ ID NO: 3465181 - RNA, 18 nt, Pseudomonas aeruginosa PA01
gcuuguagcagccgcagg

SEQ ID NO: 3465182 - RNA, 18 nt, Pseudomonas aeruginosa PA01
gcuuguagcccaggggca

SEQ ID NO: 3465183 - RNA, 21 nt, Pseudomonas aeruginosa PA01
gcuuguaguagcgcccgacga

SEQ ID NO: 3465184 - RNA, 17 nt, Pseudomonas aeruginosa PA01
gcuugucacgcucggca

SEQ ID NO: 3465185 - RNA, 15 nt, Pseudomonas aeruginosa PA01
gcuuguccagggcgc

SEQ ID NO: 3465186 - RNA, 16 nt, Pseudomonas aeruginosa PA01
gcuuguccagggcgcc

SEQ ID NO: 3465187 - RNA, 17 nt, Pseudomonas aeruginosa PA01
gcuuguccagggcgccc

SEQ ID NO: 3465188 - RNA, 15 nt, Pseudomonas aeruginosa PA01
gcuuguccaucggcu

SEQ ID NO: 3465189 - RNA, 20 nt, Pseudomonas aeruginosa PA01
gcuuguccgagaccggcagc

SEQ ID NO: 3465190 - RNA, 15 nt, Pseudomonas aeruginosa PA01
gcuuguccgccggaa

SEQ ID NO: 3465191 - RNA, 21 nt, Pseudomonas aeruginosa PA01
gcuuguccgccggaauguugc

SEQ ID NO: 3465192 - RNA, 14 nt, Pseudomonas aeruginosa PA01
gcuuguccuccagc

SEQ ID NO: 3465193 - RNA, 16 nt, Pseudomonas aeruginosa PA01
gcuuguccuccagcug

SEQ ID NO: 3465194 - RNA, 22 nt, Pseudomonas aeruginosa PA01
gcuuguccuccagcugcgccug

SEQ ID NO: 3465195 - RNA, 15 nt, Pseudomonas aeruginosa PA01
gcuuguccuggcgca

SEQ ID NO: 3465196 - RNA, 22 nt, Pseudomonas aeruginosa PA01
gcuuguccuggcgcaugucgcg

SEQ ID NO: 3465197 - RNA, 15 nt, Pseudomonas aeruginosa PA01
gcuuguccuucggcc

SEQ ID NO: 3465198 - RNA, 22 nt, Pseudomonas aeruginosa PA01
gcuugucgauggucaggaucac

SEQ ID NO: 3465199 - RNA, 21 nt, Pseudomonas aeruginosa PA01
gcuugucgccuuccucggcga

SEQ ID NO: 3465200 - RNA, 15 nt, Pseudomonas aeruginosa PA01
gcuugucgucggccu

SEQ ID NO: 3465201 - RNA, 23 nt, Pseudomonas aeruginosa PA01
gcuugucguggcgggcucugugc

SEQ ID NO: 3465202 - RNA, 15 nt, Pseudomonas aeruginosa PA01
gcuuguggccggucu

SEQ ID NO: 3465203 - RNA, 17 nt, Pseudomonas aeruginosa PA01
gcuuguguccgccgagg

SEQ ID NO: 3465204 - RNA, 21 nt, Pseudomonas aeruginosa PA01
gcuuguugaugguuucuuccc

SEQ ID NO: 3465205 - RNA, 23 nt, Pseudomonas aeruginosa PA01
gcuuguuggccagcagccaggcc

SEQ ID NO: 3465206 - RNA, 13 nt, Pseudomonas aeruginosa PA01
gcuuucagcgccg

SEQ ID NO: 3465207 - RNA, 15 nt, Pseudomonas aeruginosa PA01
gcuuucaggcgcucg

SEQ ID NO: 3465208 - RNA, 20 nt, Pseudomonas aeruginosa PA01
gcuuuccaccgccagcaccc

SEQ ID NO: 3465209 - RNA, 16 nt, Pseudomonas aeruginosa PA01
gcuuuccagcaggcgc

SEQ ID NO: 3465210 - RNA, 17 nt, Pseudomonas aeruginosa PA01
gcuuuccagcccggcgu

SEQ ID NO: 3465211 - RNA, 16 nt, Pseudomonas aeruginosa PA01
gcuuuccaggcgccgc

SEQ ID NO: 3465212 - RNA, 22 nt, Pseudomonas aeruginosa PA01
gcuuuccagggcaaacagcucc

SEQ ID NO: 3465213 - RNA, 17 nt, Pseudomonas aeruginosa PA01
gcuuuccagggccuggc

SEQ ID NO: 3465214 - RNA, 20 nt, Pseudomonas aeruginosa PA01
gcuuuccagggccuggcgca

SEQ ID NO: 3465215 - RNA, 15 nt, Pseudomonas aeruginosa PA01
gcuuuccccggcggc

SEQ ID NO: 3465216 - RNA, 16 nt, Pseudomonas aeruginosa PA01
gcuuucccugcugcgg

SEQ ID NO: 3465217 - RNA, 14 nt, Pseudomonas aeruginosa PA01
gcuuucccuguagc

SEQ ID NO: 3465218 - RNA, 14 nt, Pseudomonas aeruginosa PA01
gcuuuccgccgagc

SEQ ID NO: 3465219 - RNA, 19 nt, Pseudomonas aeruginosa PA01
gcuuuccggcgcggccugc

SEQ ID NO: 3465220 - RNA, 22 nt, Pseudomonas aeruginosa PA01
gcuuuccggcgcggccugcagc

SEQ ID NO: 3465221 - RNA, 19 nt, Pseudomonas aeruginosa PA01
gcuuuccgucucaggcgcc

SEQ ID NO: 3465222 - RNA, 14 nt, Pseudomonas aeruginosa PA01
gcuuuccucggcca

SEQ ID NO: 3465223 - RNA, 21 nt, Pseudomonas aeruginosa PA01
gcuuuccucggccaugccggc

SEQ ID NO: 3465224 - RNA, 23 nt, Pseudomonas aeruginosa PA01
gcuuuccucggccaugccggcca

SEQ ID NO: 3465225 - RNA, 15 nt, Pseudomonas aeruginosa PA01
gcuuuccugcuccag

SEQ ID NO: 3465226 - RNA, 16 nt, Pseudomonas aeruginosa PA01
gcuuuccugcuccagc

SEQ ID NO: 3465227 - RNA, 23 nt, Pseudomonas aeruginosa PA01
gcuuuccugcuccagcagggcca

SEQ ID NO: 3465228 - RNA, 18 nt, Pseudomonas aeruginosa PA01
gcuuuccuggccgacccg

SEQ ID NO: 3465229 - RNA, 16 nt, Pseudomonas aeruginosa PA01
gcuuucgaagcgcucc

SEQ ID NO: 3465230 - RNA, 17 nt, Pseudomonas aeruginosa PA01
gcuuucgaagcgcuccc

SEQ ID NO: 3465231 - RNA, 18 nt, Pseudomonas aeruginosa PA01
gcuuucgagaaagcgcag

SEQ ID NO: 3465232 - RNA, 21 nt, Pseudomonas aeruginosa PA01
gcuuucguaggcaggcgcggc

SEQ ID NO: 3465233 - RNA, 22 nt, Pseudomonas aeruginosa PA01
gcuuucguaggcaggcgcggca

SEQ ID NO: 3465234 - RNA, 23 nt, Pseudomonas aeruginosa PA01
gcuuucguaggcaggcgcggcau

SEQ ID NO: 3465235 - RNA, 13 nt, Pseudomonas aeruginosa PA01
gcuuucuuccagc

SEQ ID NO: 3465236 - RNA, 22 nt, Pseudomonas aeruginosa PA01
gcuuugcccgucuagcgcaggc

SEQ ID NO: 3465237 - RNA, 20 nt, Pseudomonas aeruginosa PA01
gcuuugcgcagccacccgcu

SEQ ID NO: 3465238 - RNA, 21 nt, Pseudomonas aeruginosa PA01
gcuuugcgcagccacccgcuc

SEQ ID NO: 3465239 - RNA, 12 nt, Pseudomonas aeruginosa PA01
gcuuugcgcgca

SEQ ID NO: 3465240 - RNA, 15 nt, Pseudomonas aeruginosa PA01
gcuuugcggcaaggc

SEQ ID NO: 3465241 - RNA, 14 nt, Pseudomonas aeruginosa PA01
gcuuugggagcagg

SEQ ID NO: 3465242 - RNA, 14 nt, Pseudomonas aeruginosa PA01
gcuuuuccagcgca

SEQ ID NO: 3465243 - RNA, 22 nt, Pseudomonas aeruginosa PA01
gcuuuucccuauucgcugucag

SEQ ID NO: 3465244 - RNA, 15 nt, Pseudomonas aeruginosa PA01
gcuuuuccggcgccg

SEQ ID NO: 3465245 - RNA, 16 nt, Pseudomonas aeruginosa PA01
gcuuuuucaugagcgc

SEQ ID NO: 3465246 - RNA, 19 nt, Pseudomonas aeruginosa PA01
gcuuuuucaugagcgcccg

SEQ ID NO: 3465247 - RNA, 19 nt, Pseudomonas aeruginosa PA01
gcuuuuucaugggcgcgcg

SEQ ID NO: 3465248 - RNA, 16 nt, Pseudomonas aeruginosa PA01
gcuuuuucguuggcca

SEQ ID NO: 3465249 - RNA, 16 nt, Pseudomonas aeruginosa PA01
gcuuuuuuaugcgcag

SEQ ID NO: 3465250 - RNA, 23 nt, Pseudomonas aeruginosa PA01
gcuuuuuucauucauggcgccac

SEQ ID NO: 3465251 - RNA, 21 nt, Pseudomonas aeruginosa PA01
ggaaaaacccggcccaggccg

SEQ ID NO: 3465252 - RNA, 22 nt, Pseudomonas aeruginosa PA01
ggaaaaacccggcccaggccgg

SEQ ID NO: 3465253 - RNA, 21 nt, Pseudomonas aeruginosa PA01
ggaaaacgcucaggccaagca

SEQ ID NO: 3465254 - RNA, 13 nt, Pseudomonas aeruginosa PA01
ggaaaagccccgc

SEQ ID NO: 3465255 - RNA, 20 nt, Pseudomonas aeruginosa PA01
ggaaaagccccgcuucggcg

SEQ ID NO: 3465256 - RNA, 16 nt, Pseudomonas aeruginosa PA01
ggaaacaagcucuucg

SEQ ID NO: 3465257 - RNA, 15 nt, Pseudomonas aeruginosa PA01
ggaaacaccaggccg

SEQ ID NO: 3465258 - RNA, 19 nt, Pseudomonas aeruginosa PA01
ggaaacaccaggccgauga

SEQ ID NO: 3465259 - RNA, 15 nt, Pseudomonas aeruginosa PA01
ggaaacacgucgauc

SEQ ID NO: 3465260 - RNA, 20 nt, Pseudomonas aeruginosa PA01
ggaaacccaugcccgccccg

SEQ ID NO: 3465261 - RNA, 21 nt, Pseudomonas aeruginosa PA01
ggaaacccaugcccgccccgc

SEQ ID NO: 3465262 - RNA, 16 nt, Pseudomonas aeruginosa PA01
ggaaaccccggccugg

SEQ ID NO: 3465263 - RNA, 17 nt, Pseudomonas aeruginosa PA01
ggaaaccccggccuggc

SEQ ID NO: 3465264 - RNA, 18 nt, Pseudomonas aeruginosa PA01
ggaaaccccggccuggcg

SEQ ID NO: 3465265 - RNA, 23 nt, Pseudomonas aeruginosa PA01
ggaaaccccggccuggcgccggg

SEQ ID NO: 3465266 - RNA, 19 nt, Pseudomonas aeruginosa PA01
ggaaacccucaggucggcg

SEQ ID NO: 3465267 - RNA, 23 nt, Pseudomonas aeruginosa PA01
ggaaacccucaggucggcgccug

SEQ ID NO: 3465268 - RNA, 15 nt, Pseudomonas aeruginosa PA01
ggaaaccgcggccgg

SEQ ID NO: 3465269 - RNA, 16 nt, Pseudomonas aeruginosa PA01
ggaaaccgcggccggc

SEQ ID NO: 3465270 - RNA, 17 nt, Pseudomonas aeruginosa PA01
ggaaaccgcggccggcu

SEQ ID NO: 3465271 - RNA, 13 nt, Pseudomonas aeruginosa PA01
ggaaaccggccag

SEQ ID NO: 3465272 - RNA, 14 nt, Pseudomonas aeruginosa PA01
ggaaaccggccagc

SEQ ID NO: 3465273 - RNA, 15 nt, Pseudomonas aeruginosa PA01
ggaaaccggccagcg

SEQ ID NO: 3465274 - RNA, 21 nt, Pseudomonas aeruginosa PA01
ggaaaccgggaugaagaucau

SEQ ID NO: 3465275 - RNA, 17 nt, Pseudomonas aeruginosa PA01
ggaaaccucgccgguca

SEQ ID NO: 3465276 - RNA, 17 nt, Pseudomonas aeruginosa PA01
ggaaaccuucgguggcg

SEQ ID NO: 3465277 - RNA, 18 nt, Pseudomonas aeruginosa PA01
ggaagccgcgcucgcgga

SEQ ID NO: 3465278 - RNA, 21 nt, Pseudomonas aeruginosa PA01
ggaagccgcucggcguagccg

SEQ ID NO: 3465279 - RNA, 15 nt, Pseudomonas aeruginosa PA01
ggaagccgggaagcc

SEQ ID NO: 3465280 - RNA, 16 nt, Pseudomonas aeruginosa PA01
ggaagccgucggcgau

SEQ ID NO: 3465281 - RNA, 18 nt, Pseudomonas aeruginosa PA01
ggaagccguggcgggcca

SEQ ID NO: 3465282 - RNA, 17 nt, Pseudomonas aeruginosa PA01
ggaagcgaucuccugcc

SEQ ID NO: 3465283 - RNA, 18 nt, Pseudomonas aeruginosa PA01
ggaagcgaucuccugccg

SEQ ID NO: 3465284 - RNA, 15 nt, Pseudomonas aeruginosa PA01
ggaagcgcgcgccag

SEQ ID NO: 3465285 - RNA, 18 nt, Pseudomonas aeruginosa PA01
ggaagcgcugcucgacca

SEQ ID NO: 3465286 - RNA, 17 nt, Pseudomonas aeruginosa PA01
ggaagcggccgagcacc

SEQ ID NO: 3465287 - RNA, 15 nt, Pseudomonas aeruginosa PA01
ggaagcggucguagc

SEQ ID NO: 3465288 - RNA, 20 nt, Pseudomonas aeruginosa PA01
ggaagcggucguagcccaug

SEQ ID NO: 3465289 - RNA, 22 nt, Pseudomonas aeruginosa PA01
ggaagcgucagccgcggccggg

SEQ ID NO: 3465290 - RNA, 17 nt, Pseudomonas aeruginosa PA01
ggaagcgucgugcgccg

SEQ ID NO: 3465291 - RNA, 19 nt, Pseudomonas aeruginosa PA01
ggaagcgucgugcgccggc

SEQ ID NO: 3465292 - RNA, 17 nt, Pseudomonas aeruginosa PA01
ggaagcguugcucgagc

SEQ ID NO: 3465293 - RNA, 14 nt, Pseudomonas aeruginosa PA01
ggaagcucggcagc

SEQ ID NO: 3465294 - RNA, 17 nt, Pseudomonas aeruginosa PA01
ggaagcucggcagcacg

SEQ ID NO: 3465295 - RNA, 19 nt, Pseudomonas aeruginosa PA01
ggaagcucggcagcacgcu

SEQ ID NO: 3465296 - RNA, 20 nt, Pseudomonas aeruginosa PA01
ggaagcucugcacaaacuca

SEQ ID NO: 3465297 - RNA, 21 nt, Pseudomonas aeruginosa PA01
ggaagcugccuuccagcaggu

SEQ ID NO: 3465298 - RNA, 13 nt, Pseudomonas aeruginosa PA01
ggaaggaucgagc

SEQ ID NO: 3465299 - RNA, 22 nt, Pseudomonas aeruginosa PA01
ggaaggaucgagccagcgcucg

SEQ ID NO: 3465300 - RNA, 12 nt, Pseudomonas aeruginosa PA01
ggaaggccagca

SEQ ID NO: 3465301 - RNA, 14 nt, Pseudomonas aeruginosa PA01
ggaaggccaggucg

SEQ ID NO: 3465302 - RNA, 16 nt, Pseudomonas aeruginosa PA01
ggaaggccaggucgcc

SEQ ID NO: 3465303 - RNA, 13 nt, Pseudomonas aeruginosa PA01
ggaaggccgggcc

SEQ ID NO: 3465304 - RNA, 14 nt, Pseudomonas aeruginosa PA01
ggaaggccucggug

SEQ ID NO: 3465305 - RNA, 12 nt, Pseudomonas aeruginosa PA01
ggaaggccugga

SEQ ID NO: 3465306 - RNA, 12 nt, Pseudomonas aeruginosa PA01
ggaaggcgacga

SEQ ID NO: 3465307 - RNA, 23 nt, Pseudomonas aeruginosa PA01
ggaaggcgacgauguucuccacg

SEQ ID NO: 3465308 - RNA, 11 nt, Pseudomonas aeruginosa PA01
ggaaggcgcgc

SEQ ID NO: 3465309 - RNA, 16 nt, Pseudomonas aeruginosa PA01
ggaaggcgcgcaccag

SEQ ID NO: 3465310 - RNA, 17 nt, Pseudomonas aeruginosa PA01
ggaaggcgcuggcgcug

SEQ ID NO: 3465311 - RNA, 21 nt, Pseudomonas aeruginosa PA01
ggaaggcgcugggcggcuggc

SEQ ID NO: 3465312 - RNA, 17 nt, Pseudomonas aeruginosa PA01
ggaaggcuucgcgguug

SEQ ID NO: 3465313 - RNA, 19 nt, Pseudomonas aeruginosa PA01
ggaagggaaaaaagggagc

SEQ ID NO: 3465314 - RNA, 23 nt, Pseudomonas aeruginosa PA01
ggaagggaaaaaagggagccagg

SEQ ID NO: 3465315 - RNA, 22 nt, Pseudomonas aeruginosa PA01
ggaagggacgucgccagggagg

SEQ ID NO: 3465316 - RNA, 14 nt, Pseudomonas aeruginosa PA01
ggaaggucggcagc

SEQ ID NO: 3465317 - RNA, 15 nt, Pseudomonas aeruginosa PA01
ggaaggucggcagca

SEQ ID NO: 3465318 - RNA, 17 nt, Pseudomonas aeruginosa PA01
ggaaggucucgccgccg

SEQ ID NO: 3465319 - RNA, 19 nt, Pseudomonas aeruginosa PA01
ggaagguugucgaagcgau

SEQ ID NO: 3465320 - RNA, 18 nt, Pseudomonas aeruginosa PA01
ggaaguagugcagcugcg

SEQ ID NO: 3465321 - RNA, 19 nt, Pseudomonas aeruginosa PA01
ggaaguagugcagcugcga

SEQ ID NO: 3465322 - RNA, 13 nt, Pseudomonas aeruginosa PA01
ggaaguaucggcg

SEQ ID NO: 3465323 - RNA, 14 nt, Pseudomonas aeruginosa PA01
ggaaguaucggcgu

SEQ ID NO: 3465324 - RNA, 16 nt, Pseudomonas aeruginosa PA01
ggaaguauucggcggg

SEQ ID NO: 3465325 - RNA, 16 nt, Pseudomonas aeruginosa PA01
ggaaguccgggcgcgg

SEQ ID NO: 3465326 - RNA, 13 nt, Pseudomonas aeruginosa PA01
ggaagucgagcug

SEQ ID NO: 3465327 - RNA, 13 nt, Pseudomonas aeruginosa PA01
ggaagucgcccug

SEQ ID NO: 3465328 - RNA, 15 nt, Pseudomonas aeruginosa PA01
ggaagucguccagca

SEQ ID NO: 3465329 - RNA, 17 nt, Pseudomonas aeruginosa PA01
ggaagucguccagcagg

SEQ ID NO: 3465330 - RNA, 18 nt, Pseudomonas aeruginosa PA01
ggaagucguccagcaggu

SEQ ID NO: 3465331 - RNA, 19 nt, Pseudomonas aeruginosa PA01
ggaagugcagggcguccag

SEQ ID NO: 3465332 - RNA, 14 nt, Pseudomonas aeruginosa PA01
ggaaguggaucggc

SEQ ID NO: 3465333 - RNA, 17 nt, Pseudomonas aeruginosa PA01
ggaaguggcagcgccgu

SEQ ID NO: 3465334 - RNA, 16 nt, Pseudomonas aeruginosa PA01
ggaaguuaucggggcc

SEQ ID NO: 3465335 - RNA, 21 nt, Pseudomonas aeruginosa PA01
ggaaguucacauuggcuuccg

SEQ ID NO: 3465336 - RNA, 15 nt, Pseudomonas aeruginosa PA01
ggaaguugcgcaccc

SEQ ID NO: 3465337 - RNA, 18 nt, Pseudomonas aeruginosa PA01
ggaaucaccacucgccag

SEQ ID NO: 3465338 - RNA, 21 nt, Pseudomonas aeruginosa PA01
ggaaucaccacucgccagcgc

SEQ ID NO: 3465339 - RNA, 22 nt, Pseudomonas aeruginosa PA01
ggaaucaccacucgccagcgcg

SEQ ID NO: 3465340 - RNA, 18 nt, Pseudomonas aeruginosa PA01
ggaauccagggccgagca

SEQ ID NO: 3465341 - RNA, 17 nt, Pseudomonas aeruginosa PA01
ggaauccuccgccagcg

SEQ ID NO: 3465342 - RNA, 15 nt, Pseudomonas aeruginosa PA01
ggaaucugcgccagg

SEQ ID NO: 3465343 - RNA, 16 nt, Pseudomonas aeruginosa PA01
ggaaucuuuccuccag

SEQ ID NO: 3465344 - RNA, 16 nt, Pseudomonas aeruginosa PA01
ggaaugacgagccgca

SEQ ID NO: 3465345 - RNA, 21 nt, Pseudomonas aeruginosa PA01
ggaaugccggccggggccggc

SEQ ID NO: 3465346 - RNA, 13 nt, Pseudomonas aeruginosa PA01
ggaaugcucagca

SEQ ID NO: 3465347 - RNA, 21 nt, Pseudomonas aeruginosa PA01
ggaaugcucagcacggcgacg

SEQ ID NO: 3465348 - RNA, 22 nt, Pseudomonas aeruginosa PA01
ggaauggaugcgcggcagcagg

SEQ ID NO: 3465349 - RNA, 23 nt, Pseudomonas aeruginosa PA01
ggaauggaugcgcggcagcaggc

SEQ ID NO: 3465350 - RNA, 22 nt, Pseudomonas aeruginosa PA01
ggaauggcgaugccgaggagga

SEQ ID NO: 3465351 - RNA, 12 nt, Pseudomonas aeruginosa PA01
ggacaacaggcc

SEQ ID NO: 3465352 - RNA, 15 nt, Pseudomonas aeruginosa PA01
ggacaacaggccggg

SEQ ID NO: 3465353 - RNA, 18 nt, Pseudomonas aeruginosa PA01
ggacaacccggcgcuggc

SEQ ID NO: 3465354 - RNA, 23 nt, Pseudomonas aeruginosa PA01
ggacaacccggcgcuggccgcgc

SEQ ID NO: 3465355 - RNA, 12 nt, Pseudomonas aeruginosa PA01
ggacaaccgccg

SEQ ID NO: 3465356 - RNA, 22 nt, Pseudomonas aeruginosa PA01
ggacaagguuugcgccgccgug

SEQ ID NO: 3465357 - RNA, 11 nt, Pseudomonas aeruginosa PA01
ggacaccccga

SEQ ID NO: 3465358 - RNA, 12 nt, Pseudomonas aeruginosa PA01
ggacacccugcu

SEQ ID NO: 3465359 - RNA, 22 nt, Pseudomonas aeruginosa PA01
ggacacccugcugcugcucagc

SEQ ID NO: 3465360 - RNA, 17 nt, Pseudomonas aeruginosa PA01
ggacaccgaugccgaag

SEQ ID NO: 3465361 - RNA, 20 nt, Pseudomonas aeruginosa PA01
ggacaccucccgggccagcu

SEQ ID NO: 3465362 - RNA, 23 nt, Pseudomonas aeruginosa PA01
ggacaccucccgggccagcuccg

SEQ ID NO: 3465363 - RNA, 14 nt, Pseudomonas aeruginosa PA01
ggacacggcgaccu

SEQ ID NO: 3465364 - RNA, 17 nt, Pseudomonas aeruginosa PA01
ggacacgguccaggauc

SEQ ID NO: 3465365 - RNA, 18 nt, Pseudomonas aeruginosa PA01
ggacacgguccaggauca

SEQ ID NO: 3465366 - RNA, 18 nt, Pseudomonas aeruginosa PA01
ggacagcacgcucaggca

SEQ ID NO: 3465367 - RNA, 21 nt, Pseudomonas aeruginosa PA01
ggacagcacgcucaggcagcg

SEQ ID NO: 3465368 - RNA, 14 nt, Pseudomonas aeruginosa PA01
ggacagcagggucg

SEQ ID NO: 3465369 - RNA, 16 nt, Pseudomonas aeruginosa PA01
ggacagcagggucgcg

SEQ ID NO: 3465370 - RNA, 17 nt, Pseudomonas aeruginosa PA01
ggacagcccgcgcucgg

SEQ ID NO: 3465371 - RNA, 18 nt, Pseudomonas aeruginosa PA01
ggacagcccgcgcucggc

SEQ ID NO: 3465372 - RNA, 20 nt, Pseudomonas aeruginosa PA01
ggacagcccgcgcucggccg

SEQ ID NO: 3465373 - RNA, 17 nt, Pseudomonas aeruginosa PA01
ggacagcgugcggcccu

SEQ ID NO: 3465374 - RNA, 22 nt, Pseudomonas aeruginosa PA01
ggacagcucgcgggacagcuug

SEQ ID NO: 3465375 - RNA, 18 nt, Pseudomonas aeruginosa PA01
ggacagcuugccguccag

SEQ ID NO: 3465376 - RNA, 19 nt, Pseudomonas aeruginosa PA01
ggacagcuuggccagcagg

SEQ ID NO: 3465377 - RNA, 22 nt, Pseudomonas aeruginosa PA01
ggacagcuuggccagcaggccg

SEQ ID NO: 3465378 - RNA, 18 nt, Pseudomonas aeruginosa PA01
ggacaggaaaaagcccgc

SEQ ID NO: 3465379 - RNA, 23 nt, Pseudomonas aeruginosa PA01
ggacaggcagccggccaugcugg

SEQ ID NO: 3465380 - RNA, 22 nt, Pseudomonas aeruginosa PA01
ggacgaggauggucaggccggc

SEQ ID NO: 3465381 - RNA, 22 nt, Pseudomonas aeruginosa PA01
ggacgauauugguguagcugca

SEQ ID NO: 3465382 - RNA, 20 nt, Pseudomonas aeruginosa PA01
ggacgaugaucaccaggacc

SEQ ID NO: 3465383 - RNA, 17 nt, Pseudomonas aeruginosa PA01
ggacgauggucgccgcg

SEQ ID NO: 3465384 - RNA, 18 nt, Pseudomonas aeruginosa PA01
ggacgauggucgccgcga

SEQ ID NO: 3465385 - RNA, 13 nt, Pseudomonas aeruginosa PA01
ggacgcaccagca

SEQ ID NO: 3465386 - RNA, 16 nt, Pseudomonas aeruginosa PA01
ggacgcaccagcaggc

SEQ ID NO: 3465387 - RNA, 20 nt, Pseudomonas aeruginosa PA01
ggacgcaccagcaggccgau

SEQ ID NO: 3465388 - RNA, 21 nt, Pseudomonas aeruginosa PA01
ggacgcaccagcaggccgauc

SEQ ID NO: 3465389 - RNA, 16 nt, Pseudomonas aeruginosa PA01
ggacgcagcgggucga

SEQ ID NO: 3465390 - RNA, 12 nt, Pseudomonas aeruginosa PA01
ggacgcaggccg

SEQ ID NO: 3465391 - RNA, 16 nt, Pseudomonas aeruginosa PA01
ggacgcaggccgaccu

SEQ ID NO: 3465392 - RNA, 19 nt, Pseudomonas aeruginosa PA01
ggacgcauaaccgcuugcg

SEQ ID NO: 3465393 - RNA, 17 nt, Pseudomonas aeruginosa PA01
ggacgccaccaggccgc

SEQ ID NO: 3465394 - RNA, 12 nt, Pseudomonas aeruginosa PA01
ggacgccaggcg

SEQ ID NO: 3465395 - RNA, 12 nt, Pseudomonas aeruginosa PA01
ggacgccgaacg

SEQ ID NO: 3465396 - RNA, 14 nt, Pseudomonas aeruginosa PA01
ggacgccgccgguc

SEQ ID NO: 3465397 - RNA, 15 nt, Pseudomonas aeruginosa PA01
ggacgccgccgguca

SEQ ID NO: 3465398 - RNA, 22 nt, Pseudomonas aeruginosa PA01
ggacgccucgucggaggcgagg

SEQ ID NO: 3465399 - RNA, 17 nt, Pseudomonas aeruginosa PA01
ggacgcgacugcugcug

SEQ ID NO: 3465400 - RNA, 17 nt, Pseudomonas aeruginosa PA01
ggacgcgcagcggcgcc

SEQ ID NO: 3465401 - RNA, 14 nt, Pseudomonas aeruginosa PA01
ggacgcgcaggguc

SEQ ID NO: 3465402 - RNA, 23 nt, Pseudomonas aeruginosa PA01
ggacgcgcagggucaggcccuug

SEQ ID NO: 3465403 - RNA, 13 nt, Pseudomonas aeruginosa PA01
ggacgcgccggcg

SEQ ID NO: 3465404 - RNA, 14 nt, Pseudomonas aeruginosa PA01
ggacgcgccggcgg

SEQ ID NO: 3465405 - RNA, 22 nt, Pseudomonas aeruginosa PA01
ggacgcgcuuguccuccagcug

SEQ ID NO: 3465406 - RNA, 14 nt, Pseudomonas aeruginosa PA01
ggacgcggccuggg

SEQ ID NO: 3465407 - RNA, 24 nt, Pseudomonas aeruginosa PA01
ggacgcggcguggucuccgugcug

SEQ ID NO: 3465408 - RNA, 20 nt, Pseudomonas aeruginosa PA01
ggacgcggcuggcgcaggac

SEQ ID NO: 3465409 - RNA, 22 nt, Pseudomonas aeruginosa PA01
ggacgcuacgcucggggugcgc

SEQ ID NO: 3465410 - RNA, 18 nt, Pseudomonas aeruginosa PA01
ggacgcuccugcgccggc

SEQ ID NO: 3465411 - RNA, 21 nt, Pseudomonas aeruginosa PA01
ggacgcuccugcgccggcucg

SEQ ID NO: 3465412 - RNA, 15 nt, Pseudomonas aeruginosa PA01
ggacgcuggcgauca

SEQ ID NO: 3465413 - RNA, 16 nt, Pseudomonas aeruginosa PA01
ggacgcugggcugggu

SEQ ID NO: 3465414 - RNA, 19 nt, Pseudomonas aeruginosa PA01
ggacgcugggcugggucgg

SEQ ID NO: 3465415 - RNA, 19 nt, Pseudomonas aeruginosa PA01
ggacgcuuguccuucggcc

SEQ ID NO: 3465416 - RNA, 21 nt, Pseudomonas aeruginosa PA01
ggacgcuuguccuucggccag

SEQ ID NO: 3465417 - RNA, 14 nt, Pseudomonas aeruginosa PA01
ggacggcagccugg

SEQ ID NO: 3465418 - RNA, 19 nt, Pseudomonas aeruginosa PA01
ggacggcagccuggggguc

SEQ ID NO: 3465419 - RNA, 14 nt, Pseudomonas aeruginosa PA01
ggacggcaggcccc

SEQ ID NO: 3465420 - RNA, 20 nt, Pseudomonas aeruginosa PA01
ggacggcagggucagccgau

SEQ ID NO: 3465421 - RNA, 17 nt, Pseudomonas aeruginosa PA01
ggacggccgcgccggcu

SEQ ID NO: 3465422 - RNA, 20 nt, Pseudomonas aeruginosa PA01
ggacggcggacugcucgccg

SEQ ID NO: 3465423 - RNA, 21 nt, Pseudomonas aeruginosa PA01
ggacggcucgcgcagcggcgc

SEQ ID NO: 3465424 - RNA, 13 nt, Pseudomonas aeruginosa PA01
ggacggcugaggc

SEQ ID NO: 3465425 - RNA, 18 nt, Pseudomonas aeruginosa PA01
ggacggcugaggcuggcg

SEQ ID NO: 3465426 - RNA, 16 nt, Pseudomonas aeruginosa PA01
ggacggucucgccgcc

SEQ ID NO: 3465427 - RNA, 16 nt, Pseudomonas aeruginosa PA01
ggacggugcaggccga

SEQ ID NO: 3465428 - RNA, 14 nt, Pseudomonas aeruginosa PA01
ggacgguucccaga

SEQ ID NO: 3465429 - RNA, 14 nt, Pseudomonas aeruginosa PA01
ggacguaacggcuu

SEQ ID NO: 3465430 - RNA, 23 nt, Pseudomonas aeruginosa PA01
ggacguccuggccgagccgcuug

SEQ ID NO: 3465431 - RNA, 16 nt, Pseudomonas aeruginosa PA01
ggacgucgaggucgac

SEQ ID NO: 3465432 - RNA, 17 nt, Pseudomonas aeruginosa PA01
ggacgucgccagggagg

SEQ ID NO: 3465433 - RNA, 19 nt, Pseudomonas aeruginosa PA01
ggacgucgccagggaggcg

SEQ ID NO: 3465434 - RNA, 21 nt, Pseudomonas aeruginosa PA01
ggacgucguagccaggcacca

SEQ ID NO: 3465435 - RNA, 17 nt, Pseudomonas aeruginosa PA01
ggacgucgucggcgacc

SEQ ID NO: 3465436 - RNA, 20 nt, Pseudomonas aeruginosa PA01
ggacgugggaaaucaccgcc

SEQ ID NO: 3465437 - RNA, 21 nt, Pseudomonas aeruginosa PA01
ggacgugggaaaucaccgcca

SEQ ID NO: 3465438 - RNA, 22 nt, Pseudomonas aeruginosa PA01
ggacgugggaaaucaccgccac

SEQ ID NO: 3465439 - RNA, 15 nt, Pseudomonas aeruginosa PA01
ggacguuuccagcgg

SEQ ID NO: 3465440 - RNA, 19 nt, Pseudomonas aeruginosa PA01
ggacuagagguaccagucu

SEQ ID NO: 3465441 - RNA, 22 nt, Pseudomonas aeruginosa PA01
ggacuccgacgcgucguccgag

SEQ ID NO: 3465442 - RNA, 23 nt, Pseudomonas aeruginosa PA01
ggacuccgcccaguucuucgccg

SEQ ID NO: 3465443 - RNA, 16 nt, Pseudomonas aeruginosa PA01
ggacuccggaggcgca

SEQ ID NO: 3465444 - RNA, 21 nt, Pseudomonas aeruginosa PA01
ggacucgacgucauaggccuu

SEQ ID NO: 3465445 - RNA, 17 nt, Pseudomonas aeruginosa PA01
ggacugaaaccccacca

SEQ ID NO: 3465446 - RNA, 15 nt, Pseudomonas aeruginosa PA01
ggacugccaacuggc

SEQ ID NO: 3465447 - RNA, 17 nt, Pseudomonas aeruginosa PA01
ggacugcccagcgccgc

SEQ ID NO: 3465448 - RNA, 22 nt, Pseudomonas aeruginosa PA01
ggacugcccagcgccgccagca

SEQ ID NO: 3465449 - RNA, 20 nt, Pseudomonas aeruginosa PA01
ggacugccgauggugauacg

SEQ ID NO: 3465450 - RNA, 19 nt, Pseudomonas aeruginosa PA01
ggacugcgaggcggugcag

SEQ ID NO: 3465451 - RNA, 16 nt, Pseudomonas aeruginosa PA01
ggacugguaggacagg

SEQ ID NO: 3465452 - RNA, 20 nt, Pseudomonas aeruginosa PA01
ggacugguaggacagggcca

SEQ ID NO: 3465453 - RNA, 20 nt, Pseudomonas aeruginosa PA01
ggacugguugaccugcagcg

SEQ ID NO: 3465454 - RNA, 23 nt, Pseudomonas aeruginosa PA01
ggacugguugaccugcagcgccu

SEQ ID NO: 3465455 - RNA, 17 nt, Pseudomonas aeruginosa PA01
ggacuuccuugcacuug

SEQ ID NO: 3465456 - RNA, 23 nt, Pseudomonas aeruginosa PA01
ggacuugaugaccguccacggcg

SEQ ID NO: 3465457 - RNA, 13 nt, Pseudomonas aeruginosa PA01
ggacuuuucgcuu

SEQ ID NO: 3465458 - RNA, 16 nt, Pseudomonas aeruginosa PA01
ggagaaacgcuuggcg

SEQ ID NO: 3465459 - RNA, 18 nt, Pseudomonas aeruginosa PA01
ggagaaacuuucuucgcc

SEQ ID NO: 3465460 - RNA, 18 nt, Pseudomonas aeruginosa PA01
ggagaacagcagcggcac

SEQ ID NO: 3465461 - RNA, 13 nt, Pseudomonas aeruginosa PA01
ggagaacagcagg

SEQ ID NO: 3465462 - RNA, 23 nt, Pseudomonas aeruginosa PA01
ggagaacaguugcaggguggcga

SEQ ID NO: 3465463 - RNA, 18 nt, Pseudomonas aeruginosa PA01
ggagaacgacaugcucau

SEQ ID NO: 3465464 - RNA, 22 nt, Pseudomonas aeruginosa PA01
ggagaacgccgccacgccgaua

SEQ ID NO: 3465465 - RNA, 13 nt, Pseudomonas aeruginosa PA01
ggagaagcgccuc

SEQ ID NO: 3465466 - RNA, 16 nt, Pseudomonas aeruginosa PA01
ggagaaggagaacgac

SEQ ID NO: 3465467 - RNA, 20 nt, Pseudomonas aeruginosa PA01
ggagaaggagaacgacaugc

SEQ ID NO: 3465468 - RNA, 16 nt, Pseudomonas aeruginosa PA01
ggagaccgugccgccg

SEQ ID NO: 3465469 - RNA, 12 nt, Pseudomonas aeruginosa PA01
ggagacgcggca

SEQ ID NO: 3465470 - RNA, 14 nt, Pseudomonas aeruginosa PA01
ggagacggcccgcc

SEQ ID NO: 3465471 - RNA, 15 nt, Pseudomonas aeruginosa PA01
ggagagacccgccag

SEQ ID NO: 3465472 - RNA, 19 nt, Pseudomonas aeruginosa PA01
ggagagacccgccagcggc

SEQ ID NO: 3465473 - RNA, 20 nt, Pseudomonas aeruginosa PA01
ggagagacccgccagcggca

SEQ ID NO: 3465474 - RNA, 22 nt, Pseudomonas aeruginosa PA01
ggagagauagagcuucucgucg

SEQ ID NO: 3465475 - RNA, 15 nt, Pseudomonas aeruginosa PA01
ggagagcagcagcuc

SEQ ID NO: 3465476 - RNA, 21 nt, Pseudomonas aeruginosa PA01
ggagagcagccaagccaccag

SEQ ID NO: 3465477 - RNA, 13 nt, Pseudomonas aeruginosa PA01
ggagaggcgugcu

SEQ ID NO: 3465478 - RNA, 13 nt, Pseudomonas aeruginosa PA01
ggagagggcggcg

SEQ ID NO: 3465479 - RNA, 23 nt, Pseudomonas aeruginosa PA01
ggagaggggcuacuucgccgggu

SEQ ID NO: 3465480 - RNA, 13 nt, Pseudomonas aeruginosa PA01
ggagagggucagc

SEQ ID NO: 3465481 - RNA, 16 nt, Pseudomonas aeruginosa PA01
ggagagggucagcagg

SEQ ID NO: 3465482 - RNA, 20 nt, Pseudomonas aeruginosa PA01
ggauaccgagggugcagagc

SEQ ID NO: 3465483 - RNA, 15 nt, Pseudomonas aeruginosa PA01
ggauaccgcacggcc

SEQ ID NO: 3465484 - RNA, 17 nt, Pseudomonas aeruginosa PA01
ggauaccggccaucagc

SEQ ID NO: 3465485 - RNA, 20 nt, Pseudomonas aeruginosa PA01
ggauacgcuuggccaggucg

SEQ ID NO: 3465486 - RNA, 20 nt, Pseudomonas aeruginosa PA01
ggauacggcaggguagccac

SEQ ID NO: 3465487 - RNA, 17 nt, Pseudomonas aeruginosa PA01
ggauacgggcgccaggg

SEQ ID NO: 3465488 - RNA, 11 nt, Pseudomonas aeruginosa PA01
ggauacuccuu

SEQ ID NO: 3465489 - RNA, 22 nt, Pseudomonas aeruginosa PA01
ggauacuccuucaaccacucca

SEQ ID NO: 3465490 - RNA, 23 nt, Pseudomonas aeruginosa PA01
ggauagcaccgauuuccccaagg

SEQ ID NO: 3465491 - RNA, 12 nt, Pseudomonas aeruginosa PA01
ggauagccaacc

SEQ ID NO: 3465492 - RNA, 13 nt, Pseudomonas aeruginosa PA01
ggauagccggcgc

SEQ ID NO: 3465493 - RNA, 18 nt, Pseudomonas aeruginosa PA01
ggauagcgauaggccuug

SEQ ID NO: 3465494 - RNA, 18 nt, Pseudomonas aeruginosa PA01
ggauagcgcgcaggcgcu

SEQ ID NO: 3465495 - RNA, 16 nt, Pseudomonas aeruginosa PA01
ggauagcguccagcuc

SEQ ID NO: 3465496 - RNA, 22 nt, Pseudomonas aeruginosa PA01
ggauagcguccagcucgucgug

SEQ ID NO: 3465497 - RNA, 13 nt, Pseudomonas aeruginosa PA01
ggauaggcggcgg

SEQ ID NO: 3465498 - RNA, 14 nt, Pseudomonas aeruginosa PA01
ggauaggcggcgga

SEQ ID NO: 3465499 - RNA, 13 nt, Pseudomonas aeruginosa PA01
ggauauaggucgg

SEQ ID NO: 3465500 - RNA, 20 nt, Pseudomonas aeruginosa PA01
ggauaucaccuccuguucgc

SEQ ID NO: 3465501 - RNA, 17 nt, Pseudomonas aeruginosa PA01
ggauauccccccacccg

SEQ ID NO: 3465502 - RNA, 16 nt, Pseudomonas aeruginosa PA01
ggauaucgcuggcgcc

SEQ ID NO: 3465503 - RNA, 19 nt, Pseudomonas aeruginosa PA01
ggauaugccgcucagcgga

SEQ ID NO: 3465504 - RNA, 19 nt, Pseudomonas aeruginosa PA01
ggaucaacuccgccaggcg

SEQ ID NO: 3465505 - RNA, 15 nt, Pseudomonas aeruginosa PA01
ggaucacaucgcccg

SEQ ID NO: 3465506 - RNA, 21 nt, Pseudomonas aeruginosa PA01
ggaucacaucgcccggcagca

SEQ ID NO: 3465507 - RNA, 19 nt, Pseudomonas aeruginosa PA01
ggaucaccagggucggcac

SEQ ID NO: 3465508 - RNA, 20 nt, Pseudomonas aeruginosa PA01
ggaucaccagggucggcacc

SEQ ID NO: 3465509 - RNA, 15 nt, Pseudomonas aeruginosa PA01
ggaucaccgcggcgc

SEQ ID NO: 3465510 - RNA, 16 nt, Pseudomonas aeruginosa PA01
ggaucaccgcggcgcu

SEQ ID NO: 3465511 - RNA, 18 nt, Pseudomonas aeruginosa PA01
ggaucaccgcggcgcuga

SEQ ID NO: 3465512 - RNA, 16 nt, Pseudomonas aeruginosa PA01
ggaucaccggcuggcc

SEQ ID NO: 3465513 - RNA, 22 nt, Pseudomonas aeruginosa PA01
ggaucaccucgaaccccuggcg

SEQ ID NO: 3465514 - RNA, 12 nt, Pseudomonas aeruginosa PA01
ggaucaccuggc

SEQ ID NO: 3465515 - RNA, 14 nt, Pseudomonas aeruginosa PA01
ggaucaccuucucg

SEQ ID NO: 3465516 - RNA, 18 nt, Pseudomonas aeruginosa PA01
ggaucacgaucgcggcga

SEQ ID NO: 3465517 - RNA, 18 nt, Pseudomonas aeruginosa PA01
ggaucacgauggccggca

SEQ ID NO: 3465518 - RNA, 19 nt, Pseudomonas aeruginosa PA01
ggaucacgauggccggcag

SEQ ID NO: 3465519 - RNA, 21 nt, Pseudomonas aeruginosa PA01
ggaucacgauggccggcagca

SEQ ID NO: 3465520 - RNA, 21 nt, Pseudomonas aeruginosa PA01
ggaucacguaggacaggucgg

SEQ ID NO: 3465521 - RNA, 20 nt, Pseudomonas aeruginosa PA01
ggaucacucgccgccguccu

SEQ ID NO: 3465522 - RNA, 12 nt, Pseudomonas aeruginosa PA01
ggaucagccacg

SEQ ID NO: 3465523 - RNA, 21 nt, Pseudomonas aeruginosa PA01
ggaucagccacgggcgccagc

SEQ ID NO: 3465524 - RNA, 17 nt, Pseudomonas aeruginosa PA01
ggaucagcgaacccggg

SEQ ID NO: 3465525 - RNA, 23 nt, Pseudomonas aeruginosa PA01
ggaucagcgcauaggccugggcg

SEQ ID NO: 3465526 - RNA, 13 nt, Pseudomonas aeruginosa PA01
ggaucagcggcgg

SEQ ID NO: 3465527 - RNA, 16 nt, Pseudomonas aeruginosa PA01
ggaucagcggcggggc

SEQ ID NO: 3465528 - RNA, 21 nt, Pseudomonas aeruginosa PA01
ggaucagcucgaucagcccgc

SEQ ID NO: 3465529 - RNA, 13 nt, Pseudomonas aeruginosa PA01
ggaucagcucgcg

SEQ ID NO: 3465530 - RNA, 13 nt, Pseudomonas aeruginosa PA01
ggaucaggcgggc

SEQ ID NO: 3465531 - RNA, 22 nt, Pseudomonas aeruginosa PA01
ggaucaggcucgagccgaacuc

SEQ ID NO: 3465532 - RNA, 15 nt, Pseudomonas aeruginosa PA01
ggaucaggucgccag

SEQ ID NO: 3465533 - RNA, 17 nt, Pseudomonas aeruginosa PA01
ggaucaggucgccagcg

SEQ ID NO: 3465534 - RNA, 18 nt, Pseudomonas aeruginosa PA01
ggaucaggucgccagcgc

SEQ ID NO: 3465535 - RNA, 23 nt, Pseudomonas aeruginosa PA01
ggaucagguugaagagcagcacc

SEQ ID NO: 3465536 - RNA, 21 nt, Pseudomonas aeruginosa PA01
ggaucagucaggaucggcgcc

SEQ ID NO: 3465537 - RNA, 17 nt, Pseudomonas aeruginosa PA01
ggaucagucgcugcucg

SEQ ID NO: 3465538 - RNA, 15 nt, Pseudomonas aeruginosa PA01
ggaucauccgcacca

SEQ ID NO: 3465539 - RNA, 22 nt, Pseudomonas aeruginosa PA01
ggaucauccgcaccauccgccg

SEQ ID NO: 3465540 - RNA, 21 nt, Pseudomonas aeruginosa PA01
ggaucaugggugaagaccagu

SEQ ID NO: 3465541 - RNA, 16 nt, Pseudomonas aeruginosa PA01
ggauccacgccuggcc

SEQ ID NO: 3465542 - RNA, 13 nt, Pseudomonas aeruginosa PA01
ggauccaggugcg

SEQ ID NO: 3465543 - RNA, 14 nt, Pseudomonas aeruginosa PA01
ggauccccucccgc

SEQ ID NO: 3465544 - RNA, 17 nt, Pseudomonas aeruginosa PA01
ggauccccucccgcgcc

SEQ ID NO: 3465545 - RNA, 18 nt, Pseudomonas aeruginosa PA01
ggauccccucccgcgcca

SEQ ID NO: 3465546 - RNA, 20 nt, Pseudomonas aeruginosa PA01
ggauccccucccgcgccagc

SEQ ID NO: 3465547 - RNA, 23 nt, Pseudomonas aeruginosa PA01
ggauccccucccgcgccagcgcc

SEQ ID NO: 3465548 - RNA, 20 nt, Pseudomonas aeruginosa PA01
ggauccggacuggauucggc

SEQ ID NO: 3465549 - RNA, 16 nt, Pseudomonas aeruginosa PA01
ggauccgugccaggcg

SEQ ID NO: 3465550 - RNA, 17 nt, Pseudomonas aeruginosa PA01
ggauccgugccaggcgc

SEQ ID NO: 3465551 - RNA, 21 nt, Pseudomonas aeruginosa PA01
ggauccgugccaggcgcucgc

SEQ ID NO: 3465552 - RNA, 19 nt, Pseudomonas aeruginosa PA01
ggauccucgccucgcgcca

SEQ ID NO: 3465553 - RNA, 23 nt, Pseudomonas aeruginosa PA01
ggauccucgccucgcgccagaga

SEQ ID NO: 3465554 - RNA, 15 nt, Pseudomonas aeruginosa PA01
ggaucgaacuggcca

SEQ ID NO: 3465555 - RNA, 20 nt, Pseudomonas aeruginosa PA01
ggaucgaacuggccagcacc

SEQ ID NO: 3465556 - RNA, 15 nt, Pseudomonas aeruginosa PA01
ggaucgacagcagcg

SEQ ID NO: 3465557 - RNA, 16 nt, Pseudomonas aeruginosa PA01
ggaucgaccccgccgg

SEQ ID NO: 3465558 - RNA, 13 nt, Pseudomonas aeruginosa PA01
ggaucgacgccgc

SEQ ID NO: 3465559 - RNA, 16 nt, Pseudomonas aeruginosa PA01
ggaucgagccagcgcu

SEQ ID NO: 3465560 - RNA, 17 nt, Pseudomonas aeruginosa PA01
ggaucgagccagcgcuc

SEQ ID NO: 3465561 - RNA, 22 nt, Pseudomonas aeruginosa PA01
ggaucgaggaauuccggcagcg

SEQ ID NO: 3465562 - RNA, 18 nt, Pseudomonas aeruginosa PA01
ggaucgaucagcagcacc

SEQ ID NO: 3465563 - RNA, 16 nt, Pseudomonas aeruginosa PA01
ggaucgaucucgucgg

SEQ ID NO: 3465564 - RNA, 22 nt, Pseudomonas aeruginosa PA01
ggaucgaucucgucggcggggc

SEQ ID NO: 3465565 - RNA, 13 nt, Pseudomonas aeruginosa PA01
ggaucgccacgcc

SEQ ID NO: 3465566 - RNA, 20 nt, Pseudomonas aeruginosa PA01
ggaucgccacgccggcgcuc

SEQ ID NO: 3465567 - RNA, 12 nt, Pseudomonas aeruginosa PA01
ggaucgccagca

SEQ ID NO: 3465568 - RNA, 12 nt, Pseudomonas aeruginosa PA01
ggaucgccagga

SEQ ID NO: 3465569 - RNA, 13 nt, Pseudomonas aeruginosa PA01
ggaucgccaggac

SEQ ID NO: 3465570 - RNA, 15 nt, Pseudomonas aeruginosa PA01
ggaucgccaggacgc

SEQ ID NO: 3465571 - RNA, 15 nt, Pseudomonas aeruginosa PA01
ggaucgccaggcuga

SEQ ID NO: 3465572 - RNA, 16 nt, Pseudomonas aeruginosa PA01
ggaucgccaggcugau

SEQ ID NO: 3465573 - RNA, 13 nt, Pseudomonas aeruginosa PA01
ggaucgcccuggc

SEQ ID NO: 3465574 - RNA, 15 nt, Pseudomonas aeruginosa PA01
ggaucgcccuggcgc

SEQ ID NO: 3465575 - RNA, 19 nt, Pseudomonas aeruginosa PA01
ggaucgcccuggcgccagc

SEQ ID NO: 3465576 - RNA, 23 nt, Pseudomonas aeruginosa PA01
ggaucgcccuggcgccagcguug

SEQ ID NO: 3465577 - RNA, 12 nt, Pseudomonas aeruginosa PA01
ggaucgccgcga

SEQ ID NO: 3465578 - RNA, 15 nt, Pseudomonas aeruginosa PA01
ggaucgccgcgaccu

SEQ ID NO: 3465579 - RNA, 20 nt, Pseudomonas aeruginosa PA01
ggaucgccgcgaccugcucg

SEQ ID NO: 3465580 - RNA, 13 nt, Pseudomonas aeruginosa PA01
ggaucgccgggcu

SEQ ID NO: 3465581 - RNA, 15 nt, Pseudomonas aeruginosa PA01
ggaucgccuccacca

SEQ ID NO: 3465582 - RNA, 22 nt, Pseudomonas aeruginosa PA01
ggaucgccuccaccagcgccgg

SEQ ID NO: 3465583 - RNA, 17 nt, Pseudomonas aeruginosa PA01
ggaucgccuccggcacg

SEQ ID NO: 3465584 - RNA, 21 nt, Pseudomonas aeruginosa PA01
ggaucgccuccggcacgcugc

SEQ ID NO: 3465585 - RNA, 12 nt, Pseudomonas aeruginosa PA01
ggcacaggaccc

SEQ ID NO: 3465586 - RNA, 12 nt, Pseudomonas aeruginosa PA01
ggcacagggcga

SEQ ID NO: 3465587 - RNA, 18 nt, Pseudomonas aeruginosa PA01
ggcaccaccagcgcgcgc

SEQ ID NO: 3465588 - RNA, 11 nt, Pseudomonas aeruginosa PA01
ggcaccaccgc

SEQ ID NO: 3465589 - RNA, 15 nt, Pseudomonas aeruginosa PA01
ggcaccaccgccgcc

SEQ ID NO: 3465590 - RNA, 20 nt, Pseudomonas aeruginosa PA01
ggcaccaccgccgccagcaa

SEQ ID NO: 3465591 - RNA, 13 nt, Pseudomonas aeruginosa PA01
ggcaccagcgcgu

SEQ ID NO: 3465592 - RNA, 20 nt, Pseudomonas aeruginosa PA01
ggcaccaguggcgccgccau

SEQ ID NO: 3465593 - RNA, 20 nt, Pseudomonas aeruginosa PA01
ggcaccccuugcagccagcc

SEQ ID NO: 3465594 - RNA, 14 nt, Pseudomonas aeruginosa PA01
ggcacccggcuggg

SEQ ID NO: 3465595 - RNA, 12 nt, Pseudomonas aeruginosa PA01
ggcacccugacc

SEQ ID NO: 3465596 - RNA, 15 nt, Pseudomonas aeruginosa PA01
ggcacccugaccgcg

SEQ ID NO: 3465597 - RNA, 18 nt, Pseudomonas aeruginosa PA01
ggcacccugaccgcgagc

SEQ ID NO: 3465598 - RNA, 23 nt, Pseudomonas aeruginosa PA01
ggcacccugaccgcgagcgccgc

SEQ ID NO: 3465599 - RNA, 14 nt, Pseudomonas aeruginosa PA01
ggcacccuggaccc

SEQ ID NO: 3465600 - RNA, 23 nt, Pseudomonas aeruginosa PA01
ggcaccgagccguugugcaggua

SEQ ID NO: 3465601 - RNA, 16 nt, Pseudomonas aeruginosa PA01
ggcaccgaucgcccgc

SEQ ID NO: 3465602 - RNA, 23 nt, Pseudomonas aeruginosa PA01
ggcaccgaucgcccgcgccucga

SEQ ID NO: 3465603 - RNA, 22 nt, Pseudomonas aeruginosa PA01
ggcaccgccgaggaacauccgc

SEQ ID NO: 3465604 - RNA, 14 nt, Pseudomonas aeruginosa PA01
ggcaccgcgccggc

SEQ ID NO: 3465605 - RNA, 15 nt, Pseudomonas aeruginosa PA01
ggcaccgcgccggcg

SEQ ID NO: 3465606 - RNA, 21 nt, Pseudomonas aeruginosa PA01
ggcaccgcuuucguagggcga

SEQ ID NO: 3465607 - RNA, 13 nt, Pseudomonas aeruginosa PA01
ggcaccggccagg

SEQ ID NO: 3465608 - RNA, 14 nt, Pseudomonas aeruginosa PA01
ggcaccggccaggc

SEQ ID NO: 3465609 - RNA, 15 nt, Pseudomonas aeruginosa PA01
ggcaccggccaggcg

SEQ ID NO: 3465610 - RNA, 17 nt, Pseudomonas aeruginosa PA01
ggcaccggccaggcgcu

SEQ ID NO: 3465611 - RNA, 16 nt, Pseudomonas aeruginosa PA01
ggcaccguaggccagg

SEQ ID NO: 3465612 - RNA, 19 nt, Pseudomonas aeruginosa PA01
ggcaccguaggccaggcag

SEQ ID NO: 3465613 - RNA, 19 nt, Pseudomonas aeruginosa PA01
ggcaccgucaccuguucgg

SEQ ID NO: 3465614 - RNA, 19 nt, Pseudomonas aeruginosa PA01
ggcaccgucgagcaccagg

SEQ ID NO: 3465615 - RNA, 13 nt, Pseudomonas aeruginosa PA01
ggcaccucgaugg

SEQ ID NO: 3465616 - RNA, 21 nt, Pseudomonas aeruginosa PA01
ggcaccucgauggcggcggcg

SEQ ID NO: 3465617 - RNA, 12 nt, Pseudomonas aeruginosa PA01
ggcaccugcaga

SEQ ID NO: 3465618 - RNA, 18 nt, Pseudomonas aeruginosa PA01
ggcacgaacccaggcgcu

SEQ ID NO: 3465619 - RNA, 20 nt, Pseudomonas aeruginosa PA01
ggcacgaacccaggcgcugc

SEQ ID NO: 3465620 - RNA, 17 nt, Pseudomonas aeruginosa PA01
ggcacgaaccguccgca

SEQ ID NO: 3465621 - RNA, 19 nt, Pseudomonas aeruginosa PA01
ggcacgaaccguccgcagc

SEQ ID NO: 3465622 - RNA, 21 nt, Pseudomonas aeruginosa PA01
ggcacgaauuuccuggcgcgu

SEQ ID NO: 3465623 - RNA, 17 nt, Pseudomonas aeruginosa PA01
ggcacgacaccaaauga

SEQ ID NO: 3465624 - RNA, 20 nt, Pseudomonas aeruginosa PA01
ggcacgacgccggugccagg

SEQ ID NO: 3465625 - RNA, 19 nt, Pseudomonas aeruginosa PA01
ggcacgacgcucggacagc

SEQ ID NO: 3465626 - RNA, 14 nt, Pseudomonas aeruginosa PA01
ggcacgaucugcgc

SEQ ID NO: 3465627 - RNA, 20 nt, Pseudomonas aeruginosa PA01
ggcacgaucugcgccgcaag

SEQ ID NO: 3465628 - RNA, 18 nt, Pseudomonas aeruginosa PA01
ggcacgaugucgaccugg

SEQ ID NO: 3465629 - RNA, 13 nt, Pseudomonas aeruginosa PA01
ggcacgcagcagc

SEQ ID NO: 3465630 - RNA, 12 nt, Pseudomonas aeruginosa PA01
ggcacgccccau

SEQ ID NO: 3465631 - RNA, 17 nt, Pseudomonas aeruginosa PA01
ggcacgccgcucugccc

SEQ ID NO: 3465632 - RNA, 19 nt, Pseudomonas aeruginosa PA01
ggcacgccgcucugcccga

SEQ ID NO: 3465633 - RNA, 18 nt, Pseudomonas aeruginosa PA01
ggcacgccgguggccagg

SEQ ID NO: 3465634 - RNA, 20 nt, Pseudomonas aeruginosa PA01
ggcacgccgguggccaggcu

SEQ ID NO: 3465635 - RNA, 22 nt, Pseudomonas aeruginosa PA01
ggcacgccgguggccaggcucu

SEQ ID NO: 3465636 - RNA, 16 nt, Pseudomonas aeruginosa PA01
ggcacgcggaucuggc

SEQ ID NO: 3465637 - RNA, 18 nt, Pseudomonas aeruginosa PA01
ggcacgcuccagggcggc

SEQ ID NO: 3465638 - RNA, 15 nt, Pseudomonas aeruginosa PA01
ggcacgcucuggccg

SEQ ID NO: 3465639 - RNA, 15 nt, Pseudomonas aeruginosa PA01
ggcacgcugccagca

SEQ ID NO: 3465640 - RNA, 17 nt, Pseudomonas aeruginosa PA01
ggcacgcugccagcagg

SEQ ID NO: 3465641 - RNA, 14 nt, Pseudomonas aeruginosa PA01
ggcacgcugccgcc

SEQ ID NO: 3465642 - RNA, 15 nt, Pseudomonas aeruginosa PA01
ggcacgcugccgccg

SEQ ID NO: 3465643 - RNA, 18 nt, Pseudomonas aeruginosa PA01
ggcacgcugccgccgaug

SEQ ID NO: 3465644 - RNA, 20 nt, Pseudomonas aeruginosa PA01
ggcacgcugccgccgaugcu

SEQ ID NO: 3465645 - RNA, 19 nt, Pseudomonas aeruginosa PA01
ggcacgcuggcgagaaugg

SEQ ID NO: 3465646 - RNA, 20 nt, Pseudomonas aeruginosa PA01
ggcacgcuggcgagaauggc

SEQ ID NO: 3465647 - RNA, 18 nt, Pseudomonas aeruginosa PA01
ggcacggcaucgauccgc

SEQ ID NO: 3465648 - RNA, 19 nt, Pseudomonas aeruginosa PA01
ggcacggcuucagcgccag

SEQ ID NO: 3465649 - RNA, 23 nt, Pseudomonas aeruginosa PA01
ggcacggucaggacgagcguccg

SEQ ID NO: 3465650 - RNA, 22 nt, Pseudomonas aeruginosa PA01
ggcacgguggaccaacgggcug

SEQ ID NO: 3465651 - RNA, 23 nt, Pseudomonas aeruginosa PA01
ggcacguacguccagggcaccac

SEQ ID NO: 3465652 - RNA, 19 nt, Pseudomonas aeruginosa PA01
ggcacgugcagcggcagcg

SEQ ID NO: 3465653 - RNA, 19 nt, Pseudomonas aeruginosa PA01
ggcacguugggaucgcuga

SEQ ID NO: 3465654 - RNA, 15 nt, Pseudomonas aeruginosa PA01
ggcacucagccagcg

SEQ ID NO: 3465655 - RNA, 18 nt, Pseudomonas aeruginosa PA01
ggcacucagccagcggcg

SEQ ID NO: 3465656 - RNA, 19 nt, Pseudomonas aeruginosa PA01
ggcacucagccagcggcgc

SEQ ID NO: 3465657 - RNA, 23 nt, Pseudomonas aeruginosa PA01
ggcacucagccagcggcgcuugc

SEQ ID NO: 3465658 - RNA, 21 nt, Pseudomonas aeruginosa PA01
ggcacucaggaaaaaacgccg

SEQ ID NO: 3465659 - RNA, 23 nt, Pseudomonas aeruginosa PA01
ggcacuccggcauaccgcccguc

SEQ ID NO: 3465660 - RNA, 20 nt, Pseudomonas aeruginosa PA01
ggcacucgaugaacagcgcg

SEQ ID NO: 3465661 - RNA, 21 nt, Pseudomonas aeruginosa PA01
ggcacucgaugaacagcgcga

SEQ ID NO: 3465662 - RNA, 17 nt, Pseudomonas aeruginosa PA01
ggcacucggcgaccacc

SEQ ID NO: 3465663 - RNA, 19 nt, Pseudomonas aeruginosa PA01
ggcacucggcgaccacccg

SEQ ID NO: 3465664 - RNA, 22 nt, Pseudomonas aeruginosa PA01
ggcacuuccuuggugaucaccg

SEQ ID NO: 3465665 - RNA, 13 nt, Pseudomonas aeruginosa PA01
ggcacuucgucca

SEQ ID NO: 3465666 - RNA, 21 nt, Pseudomonas aeruginosa PA01
ggcacuucguccaggccgccu

SEQ ID NO: 3465667 - RNA, 12 nt, Pseudomonas aeruginosa PA01
ggcacuucucga

SEQ ID NO: 3465668 - RNA, 21 nt, Pseudomonas aeruginosa PA01
ggcacuucucgaacagcuccu

SEQ ID NO: 3465669 - RNA, 18 nt, Pseudomonas aeruginosa PA01
ggcagaaaaacccagcgu

SEQ ID NO: 3465670 - RNA, 14 nt, Pseudomonas aeruginosa PA01
ggcagaacacccgg

SEQ ID NO: 3465671 - RNA, 16 nt, Pseudomonas aeruginosa PA01
ggcagaacaucgccca

SEQ ID NO: 3465672 - RNA, 17 nt, Pseudomonas aeruginosa PA01
ggcagaacaucgcccau

SEQ ID NO: 3465673 - RNA, 22 nt, Pseudomonas aeruginosa PA01
ggcagaacaucgcccauugccg

SEQ ID NO: 3465674 - RNA, 14 nt, Pseudomonas aeruginosa PA01
ggcagacaccacca

SEQ ID NO: 3465675 - RNA, 14 nt, Pseudomonas aeruginosa PA01
ggcagaccagcagc

SEQ ID NO: 3465676 - RNA, 17 nt, Pseudomonas aeruginosa PA01
ggcagaccagcagcgca

SEQ ID NO: 3465677 - RNA, 20 nt, Pseudomonas aeruginosa PA01
ggcagaccagcagcgcacca

SEQ ID NO: 3465678 - RNA, 14 nt, Pseudomonas aeruginosa PA01
ggcagaccaggccg

SEQ ID NO: 3465679 - RNA, 22 nt, Pseudomonas aeruginosa PA01
ggcagaccaggccgagcaggaa

SEQ ID NO: 3465680 - RNA, 16 nt, Pseudomonas aeruginosa PA01
ggcagaccugcagcag

SEQ ID NO: 3465681 - RNA, 18 nt, Pseudomonas aeruginosa PA01
ggcagaccuggugggcgg

SEQ ID NO: 3465682 - RNA, 19 nt, Pseudomonas aeruginosa PA01
ggcagaccuggugggcggc

SEQ ID NO: 3465683 - RNA, 20 nt, Pseudomonas aeruginosa PA01
ggcagaccuggugggcggcg

SEQ ID NO: 3465684 - RNA, 20 nt, Pseudomonas aeruginosa PA01
ggcagacgaucuggcagucg

SEQ ID NO: 3465685 - RNA, 12 nt, Pseudomonas aeruginosa PA01
ggcagacgcugc

SEQ ID NO: 3465686 - RNA, 18 nt, Pseudomonas aeruginosa PA01
ggcagaguggcgcggcug

SEQ ID NO: 3465687 - RNA, 15 nt, Pseudomonas aeruginosa PA01
ggcagcucggccgag

SEQ ID NO: 3465688 - RNA, 13 nt, Pseudomonas aeruginosa PA01
ggcagcucggcga

SEQ ID NO: 3465689 - RNA, 21 nt, Pseudomonas aeruginosa PA01
ggcagcucggcgacauagccg

SEQ ID NO: 3465690 - RNA, 20 nt, Pseudomonas aeruginosa PA01
ggcagcucguugcacagcgc

SEQ ID NO: 3465691 - RNA, 22 nt, Pseudomonas aeruginosa PA01
ggcagcucguugcacagcgccc

SEQ ID NO: 3465692 - RNA, 18 nt, Pseudomonas aeruginosa PA01
ggcagcuuggcgacgucc

SEQ ID NO: 3465693 - RNA, 16 nt, Pseudomonas aeruginosa PA01
ggcaggaaauccgccg

SEQ ID NO: 3465694 - RNA, 17 nt, Pseudomonas aeruginosa PA01
ggcaggaaauccgccgc

SEQ ID NO: 3465695 - RNA, 13 nt, Pseudomonas aeruginosa PA01
ggcaggaacgccc

SEQ ID NO: 3465696 - RNA, 17 nt, Pseudomonas aeruginosa PA01
ggcaggaacgcccgcgg

SEQ ID NO: 3465697 - RNA, 21 nt, Pseudomonas aeruginosa PA01
ggcaggaacgcccgcggcagc

SEQ ID NO: 3465698 - RNA, 22 nt, Pseudomonas aeruginosa PA01
ggcaggaacgcccgcggcagca

SEQ ID NO: 3465699 - RNA, 17 nt, Pseudomonas aeruginosa PA01
ggcaggaaggccuggaa

SEQ ID NO: 3465700 - RNA, 23 nt, Pseudomonas aeruginosa PA01
ggcaggacgaugaucaccaggac

SEQ ID NO: 3465701 - RNA, 19 nt, Pseudomonas aeruginosa PA01
ggcaggagcguugcgggca

SEQ ID NO: 3465702 - RNA, 22 nt, Pseudomonas aeruginosa PA01
ggcaggauaucgcccagggcca

SEQ ID NO: 3465703 - RNA, 13 nt, Pseudomonas aeruginosa PA01
ggcaggaucaggc

SEQ ID NO: 3465704 - RNA, 19 nt, Pseudomonas aeruginosa PA01
ggcaggaucaggcucgagc

SEQ ID NO: 3465705 - RNA, 21 nt, Pseudomonas aeruginosa PA01
ggcaggaucaggcucgagccg

SEQ ID NO: 3465706 - RNA, 14 nt, Pseudomonas aeruginosa PA01
ggcaggaucggcgc

SEQ ID NO: 3465707 - RNA, 17 nt, Pseudomonas aeruginosa PA01
ggcaggaucggcgcggu

SEQ ID NO: 3465708 - RNA, 15 nt, Pseudomonas aeruginosa PA01
ggcaggcaaaaaaaa

SEQ ID NO: 3465709 - RNA, 20 nt, Pseudomonas aeruginosa PA01
ggcaggcacgcugccagcag

SEQ ID NO: 3465710 - RNA, 22 nt, Pseudomonas aeruginosa PA01
ggcaggcacgcugccagcaggc

SEQ ID NO: 3465711 - RNA, 20 nt, Pseudomonas aeruginosa PA01
ggcaggcagugccgggcguc

SEQ ID NO: 3465712 - RNA, 20 nt, Pseudomonas aeruginosa PA01
ggcaggcaugcggccccggc

SEQ ID NO: 3465713 - RNA, 15 nt, Pseudomonas aeruginosa PA01
ggcaggccacggccg

SEQ ID NO: 3465714 - RNA, 16 nt, Pseudomonas aeruginosa PA01
ggcaggccacggccgc

SEQ ID NO: 3465715 - RNA, 18 nt, Pseudomonas aeruginosa PA01
ggcaggccacggccgcug

SEQ ID NO: 3465716 - RNA, 19 nt, Pseudomonas aeruginosa PA01
ggcaggccacggccgcugc

SEQ ID NO: 3465717 - RNA, 20 nt, Pseudomonas aeruginosa PA01
ggcaggccacggccgcugcg

SEQ ID NO: 3465718 - RNA, 13 nt, Pseudomonas aeruginosa PA01
ggcaggccagcag

SEQ ID NO: 3465719 - RNA, 23 nt, Pseudomonas aeruginosa PA01
ggcaggccagcuuccaggcgcgc

SEQ ID NO: 3465720 - RNA, 17 nt, Pseudomonas aeruginosa PA01
ggcaggccgaggccggc

SEQ ID NO: 3465721 - RNA, 18 nt, Pseudomonas aeruginosa PA01
ggcaggccgaggccggcg

SEQ ID NO: 3465722 - RNA, 14 nt, Pseudomonas aeruginosa PA01
ggcaggccgauggc

SEQ ID NO: 3465723 - RNA, 20 nt, Pseudomonas aeruginosa PA01
ggcaggccgauggccccggc

SEQ ID NO: 3465724 - RNA, 13 nt, Pseudomonas aeruginosa PA01
ggcaggccgaugu

SEQ ID NO: 3465725 - RNA, 12 nt, Pseudomonas aeruginosa PA01
ggcaggccgccg

SEQ ID NO: 3465726 - RNA, 15 nt, Pseudomonas aeruginosa PA01
ggcaggccgggcugg

SEQ ID NO: 3465727 - RNA, 12 nt, Pseudomonas aeruginosa PA01
ggcaggccugga

SEQ ID NO: 3465728 - RNA, 14 nt, Pseudomonas aeruginosa PA01
ggcaggccugggca

SEQ ID NO: 3465729 - RNA, 18 nt, Pseudomonas aeruginosa PA01
ggcaggccuuccacgccu

SEQ ID NO: 3465730 - RNA, 24 nt, Pseudomonas aeruginosa PA01
ggcaggccuucccacuccguccag

SEQ ID NO: 3465731 - RNA, 17 nt, Pseudomonas aeruginosa PA01
ggcaggccuucggcgcc

SEQ ID NO: 3465732 - RNA, 22 nt, Pseudomonas aeruginosa PA01
ggcaggccuucggcgccggagc

SEQ ID NO: 3465733 - RNA, 15 nt, Pseudomonas aeruginosa PA01
ggcaggcgaugaccg

SEQ ID NO: 3465734 - RNA, 16 nt, Pseudomonas aeruginosa PA01
ggcaggcgcaggcgaa

SEQ ID NO: 3465735 - RNA, 23 nt, Pseudomonas aeruginosa PA01
ggcaggcgccaaccgggcagcag

SEQ ID NO: 3465736 - RNA, 19 nt, Pseudomonas aeruginosa PA01
ggcaggcgcccggucaggu

SEQ ID NO: 3465737 - RNA, 11 nt, Pseudomonas aeruginosa PA01
ggcaggcgcgg

SEQ ID NO: 3465738 - RNA, 12 nt, Pseudomonas aeruginosa PA01
ggcaggcgcggc

SEQ ID NO: 3465739 - RNA, 13 nt, Pseudomonas aeruginosa PA01
ggcaggcggcggc

SEQ ID NO: 3465740 - RNA, 18 nt, Pseudomonas aeruginosa PA01
ggcaggcggucagcgcgu

SEQ ID NO: 3465741 - RNA, 14 nt, Pseudomonas aeruginosa PA01
ggcaggcucagcgc

SEQ ID NO: 3465742 - RNA, 15 nt, Pseudomonas aeruginosa PA01
ggcaggcucagcgca

SEQ ID NO: 3465743 - RNA, 15 nt, Pseudomonas aeruginosa PA01
ggcaggcugcaucgg

SEQ ID NO: 3465744 - RNA, 17 nt, Pseudomonas aeruginosa PA01
ggcaggcugcaucggcu

SEQ ID NO: 3465745 - RNA, 16 nt, Pseudomonas aeruginosa PA01
ggcaggcugcgccgcu

SEQ ID NO: 3465746 - RNA, 12 nt, Pseudomonas aeruginosa PA01
ggcaggcuggcg

SEQ ID NO: 3465747 - RNA, 24 nt, Pseudomonas aeruginosa PA01
ggcaggcuggcguugacugccugc

SEQ ID NO: 3465748 - RNA, 14 nt, Pseudomonas aeruginosa PA01
ggcaggcugugcca

SEQ ID NO: 3465749 - RNA, 17 nt, Pseudomonas aeruginosa PA01
ggcaggcuguuuuuccu

SEQ ID NO: 3465750 - RNA, 17 nt, Pseudomonas aeruginosa PA01
ggcagggaguccgccag

SEQ ID NO: 3465751 - RNA, 21 nt, Pseudomonas aeruginosa PA01
ggcagggaguccgccagccgg

SEQ ID NO: 3465752 - RNA, 13 nt, Pseudomonas aeruginosa PA01
ggcagggaucacg

SEQ ID NO: 3465753 - RNA, 14 nt, Pseudomonas aeruginosa PA01
ggcagggcagccgc

SEQ ID NO: 3465754 - RNA, 16 nt, Pseudomonas aeruginosa PA01
ggcagggcagccgccg

SEQ ID NO: 3465755 - RNA, 13 nt, Pseudomonas aeruginosa PA01
ggcagggccagcg

SEQ ID NO: 3465756 - RNA, 14 nt, Pseudomonas aeruginosa PA01
ggcagggccucggg

SEQ ID NO: 3465757 - RNA, 15 nt, Pseudomonas aeruginosa PA01
ggcagggcgauccgc

SEQ ID NO: 3465758 - RNA, 13 nt, Pseudomonas aeruginosa PA01
ggcagggcgccga

SEQ ID NO: 3465759 - RNA, 16 nt, Pseudomonas aeruginosa PA01
ggcagggcgcguccag

SEQ ID NO: 3465760 - RNA, 14 nt, Pseudomonas aeruginosa PA01
ggcaggggcuuucu

SEQ ID NO: 3465761 - RNA, 21 nt, Pseudomonas aeruginosa PA01
ggcaggggcuuucuucgccug

SEQ ID NO: 3465762 - RNA, 15 nt, Pseudomonas aeruginosa PA01
ggcagggggucuucg

SEQ ID NO: 3465763 - RNA, 21 nt, Pseudomonas aeruginosa PA01
ggcagggggucuucgaagguc

SEQ ID NO: 3465764 - RNA, 13 nt, Pseudomonas aeruginosa PA01
ggcagggucagcc

SEQ ID NO: 3465765 - RNA, 16 nt, Pseudomonas aeruginosa PA01
ggcaggguggcgcaug

SEQ ID NO: 3465766 - RNA, 15 nt, Pseudomonas aeruginosa PA01
ggcagggugucgacg

SEQ ID NO: 3465767 - RNA, 17 nt, Pseudomonas aeruginosa PA01
ggcagggugucgacgac

SEQ ID NO: 3465768 - RNA, 20 nt, Pseudomonas aeruginosa PA01
ggcagggugucgacgacagu

SEQ ID NO: 3465769 - RNA, 21 nt, Pseudomonas aeruginosa PA01
ggcagguagaccucgaugucc

SEQ ID NO: 3465770 - RNA, 15 nt, Pseudomonas aeruginosa PA01
ggcagguagccgccu

SEQ ID NO: 3465771 - RNA, 12 nt, Pseudomonas aeruginosa PA01
ggcagguagugg

SEQ ID NO: 3465772 - RNA, 19 nt, Pseudomonas aeruginosa PA01
ggcaggucguuacgugucg

SEQ ID NO: 3465773 - RNA, 17 nt, Pseudomonas aeruginosa PA01
ggcaggugacgcagggc

SEQ ID NO: 3465774 - RNA, 15 nt, Pseudomonas aeruginosa PA01
ggcaggugccgcucg

SEQ ID NO: 3465775 - RNA, 20 nt, Pseudomonas aeruginosa PA01
ggcaggugccgcucguccag

SEQ ID NO: 3465776 - RNA, 15 nt, Pseudomonas aeruginosa PA01
ggcagguggcgcagc

SEQ ID NO: 3465777 - RNA, 13 nt, Pseudomonas aeruginosa PA01
ggcagguggcggg

SEQ ID NO: 3465778 - RNA, 16 nt, Pseudomonas aeruginosa PA01
ggcagguggcuggcca

SEQ ID NO: 3465779 - RNA, 19 nt, Pseudomonas aeruginosa PA01
ggcaggugguaagcgagca

SEQ ID NO: 3465780 - RNA, 21 nt, Pseudomonas aeruginosa PA01
ggcaggugguaagcgagcaga

SEQ ID NO: 3465781 - RNA, 12 nt, Pseudomonas aeruginosa PA01
ggcagguggucg

SEQ ID NO: 3465782 - RNA, 18 nt, Pseudomonas aeruginosa PA01
ggcagguggucguugcgc

SEQ ID NO: 3465783 - RNA, 22 nt, Pseudomonas aeruginosa PA01
ggcagguggucguugcgcgcca

SEQ ID NO: 3465784 - RNA, 16 nt, Pseudomonas aeruginosa PA01
ggcagguucagcaggu

SEQ ID NO: 3465785 - RNA, 16 nt, Pseudomonas aeruginosa PA01
ggcagguugcacggcc

SEQ ID NO: 3465786 - RNA, 17 nt, Pseudomonas aeruginosa PA01
ggcagguugcgggagca

SEQ ID NO: 3465787 - RNA, 20 nt, Pseudomonas aeruginosa PA01
ggcagguugcgggagcacug

SEQ ID NO: 3465788 - RNA, 16 nt, Pseudomonas aeruginosa PA01
ggcagguugcucgccu

SEQ ID NO: 3465789 - RNA, 15 nt, Pseudomonas aeruginosa PA01
ggcagguugugcggg

SEQ ID NO: 3465790 - RNA, 21 nt, Pseudomonas aeruginosa PA01
ggcauggccgaccgccaggcc

SEQ ID NO: 3465791 - RNA, 22 nt, Pseudomonas aeruginosa PA01
ggcauggcgaucuccgggagca

SEQ ID NO: 3465792 - RNA, 20 nt, Pseudomonas aeruginosa PA01
ggcauggcuuuccaggcgcc

SEQ ID NO: 3465793 - RNA, 21 nt, Pseudomonas aeruginosa PA01
ggcauggcuuuccaggcgccg

SEQ ID NO: 3465794 - RNA, 12 nt, Pseudomonas aeruginosa PA01
ggcaugggccag

SEQ ID NO: 3465795 - RNA, 13 nt, Pseudomonas aeruginosa PA01
ggcaugggccagu

SEQ ID NO: 3465796 - RNA, 15 nt, Pseudomonas aeruginosa PA01
ggcaugggucagcgc

SEQ ID NO: 3465797 - RNA, 20 nt, Pseudomonas aeruginosa PA01
ggcaugggucagcgccagca

SEQ ID NO: 3465798 - RNA, 20 nt, Pseudomonas aeruginosa PA01
ggcaugguguccggcggcga

SEQ ID NO: 3465799 - RNA, 21 nt, Pseudomonas aeruginosa PA01
ggcaugguugguguccacgcu

SEQ ID NO: 3465800 - RNA, 16 nt, Pseudomonas aeruginosa PA01
ggcauguagcgcgccg

SEQ ID NO: 3465801 - RNA, 15 nt, Pseudomonas aeruginosa PA01
ggcauguccaccgcc

SEQ ID NO: 3465802 - RNA, 20 nt, Pseudomonas aeruginosa PA01
ggcauuacuugcccacgcag

SEQ ID NO: 3465803 - RNA, 18 nt, Pseudomonas aeruginosa PA01
ggcauucaccagcgacga

SEQ ID NO: 3465804 - RNA, 19 nt, Pseudomonas aeruginosa PA01
ggcauucaccagcgacgac

SEQ ID NO: 3465805 - RNA, 17 nt, Pseudomonas aeruginosa PA01
ggcauucaucaccagcu

SEQ ID NO: 3465806 - RNA, 14 nt, Pseudomonas aeruginosa PA01
ggcauuccgggcga

SEQ ID NO: 3465807 - RNA, 14 nt, Pseudomonas aeruginosa PA01
ggcauuccuggucc

SEQ ID NO: 3465808 - RNA, 16 nt, Pseudomonas aeruginosa PA01
ggcauucgcagcggcc

SEQ ID NO: 3465809 - RNA, 15 nt, Pseudomonas aeruginosa PA01
ggcauucgucgccgc

SEQ ID NO: 3465810 - RNA, 17 nt, Pseudomonas aeruginosa PA01
ggcauucgucgccgcug

SEQ ID NO: 3465811 - RNA, 20 nt, Pseudomonas aeruginosa PA01
ggcauucucgcgacccuggc

SEQ ID NO: 3465812 - RNA, 21 nt, Pseudomonas aeruginosa PA01
ggcauucucucuucagcaggg

SEQ ID NO: 3465813 - RNA, 21 nt, Pseudomonas aeruginosa PA01
ggcauuggccaucagcgccgc

SEQ ID NO: 3465814 - RNA, 18 nt, Pseudomonas aeruginosa PA01
ggcauuggugcugccgau

SEQ ID NO: 3465815 - RNA, 17 nt, Pseudomonas aeruginosa PA01
ggcauuggugcugcgcg

SEQ ID NO: 3465816 - RNA, 23 nt, Pseudomonas aeruginosa PA01
ggcauuggugcugcgcgcggccc

SEQ ID NO: 3465817 - RNA, 16 nt, Pseudomonas aeruginosa PA01
ggcauuuccugggugc

SEQ ID NO: 3465818 - RNA, 21 nt, Pseudomonas aeruginosa PA01
ggcauuuccugggugccgcga

SEQ ID NO: 3465819 - RNA, 20 nt, Pseudomonas aeruginosa PA01
ggccaaaccgggaaagucug

SEQ ID NO: 3465820 - RNA, 17 nt, Pseudomonas aeruginosa PA01
ggccaaccaccggcgca

SEQ ID NO: 3465821 - RNA, 16 nt, Pseudomonas aeruginosa PA01
ggccaaccucucccca

SEQ ID NO: 3465822 - RNA, 22 nt, Pseudomonas aeruginosa PA01
ggccaaccucuccccagacccu

SEQ ID NO: 3465823 - RNA, 12 nt, Pseudomonas aeruginosa PA01
ggccaacugagc

SEQ ID NO: 3465824 - RNA, 16 nt, Pseudomonas aeruginosa PA01
ggccaacugagcggcg

SEQ ID NO: 3465825 - RNA, 22 nt, Pseudomonas aeruginosa PA01
ggccaagcuguugcuccaacca

SEQ ID NO: 3465826 - RNA, 18 nt, Pseudomonas aeruginosa PA01
ggccaagcuuguugcgca

SEQ ID NO: 3465827 - RNA, 21 nt, Pseudomonas aeruginosa PA01
ggccaagcuuguugcgcaggc

SEQ ID NO: 3465828 - RNA, 22 nt, Pseudomonas aeruginosa PA01
ggccaagcuuguugcgcaggcg

SEQ ID NO: 3465829 - RNA, 16 nt, Pseudomonas aeruginosa PA01
ggccaagucggccgcc

SEQ ID NO: 3465830 - RNA, 22 nt, Pseudomonas aeruginosa PA01
ggccaagucggccgcccagcgg

SEQ ID NO: 3465831 - RNA, 16 nt, Pseudomonas aeruginosa PA01
ggccaaugcccggacc

SEQ ID NO: 3465832 - RNA, 16 nt, Pseudomonas aeruginosa PA01
ggccaauugcuccggu

SEQ ID NO: 3465833 - RNA, 19 nt, Pseudomonas aeruginosa PA01
ggccaccaccgugaccagc

SEQ ID NO: 3465834 - RNA, 20 nt, Pseudomonas aeruginosa PA01
ggccaccagagccagccgcg

SEQ ID NO: 3465835 - RNA, 22 nt, Pseudomonas aeruginosa PA01
ggccaccagagccagccgcgag

SEQ ID NO: 3465836 - RNA, 21 nt, Pseudomonas aeruginosa PA01
ggccaccaggcuuacccgcga

SEQ ID NO: 3465837 - RNA, 17 nt, Pseudomonas aeruginosa PA01
ggccaccaucgcggcga

SEQ ID NO: 3465838 - RNA, 18 nt, Pseudomonas aeruginosa PA01
ggccaccaucgcggcgau

SEQ ID NO: 3465839 - RNA, 20 nt, Pseudomonas aeruginosa PA01
ggccaccaucgcggcgaugg

SEQ ID NO: 3465840 - RNA, 23 nt, Pseudomonas aeruginosa PA01
ggccaccaucgcggcgauggccg

SEQ ID NO: 3465841 - RNA, 16 nt, Pseudomonas aeruginosa PA01
ggccacccgccucguc

SEQ ID NO: 3465842 - RNA, 13 nt, Pseudomonas aeruginosa PA01
ggccacccuugcg

SEQ ID NO: 3465843 - RNA, 20 nt, Pseudomonas aeruginosa PA01
ggccacccuuggagccgccc

SEQ ID NO: 3465844 - RNA, 21 nt, Pseudomonas aeruginosa PA01
ggccacccuuggagccgcccu

SEQ ID NO: 3465845 - RNA, 13 nt, Pseudomonas aeruginosa PA01
ggccacccuugug

SEQ ID NO: 3465846 - RNA, 17 nt, Pseudomonas aeruginosa PA01
ggccaccgaaucgaugc

SEQ ID NO: 3465847 - RNA, 23 nt, Pseudomonas aeruginosa PA01
ggccaccgaaucggacagguugg

SEQ ID NO: 3465848 - RNA, 15 nt, Pseudomonas aeruginosa PA01
ggccaccgccaggac

SEQ ID NO: 3465849 - RNA, 20 nt, Pseudomonas aeruginosa PA01
ggccaccgccaggaccucga

SEQ ID NO: 3465850 - RNA, 13 nt, Pseudomonas aeruginosa PA01
ggccaccgcggcg

SEQ ID NO: 3465851 - RNA, 14 nt, Pseudomonas aeruginosa PA01
ggccaccgcggcgu

SEQ ID NO: 3465852 - RNA, 20 nt, Pseudomonas aeruginosa PA01
ggccaccgggaucagcggcg

SEQ ID NO: 3465853 - RNA, 22 nt, Pseudomonas aeruginosa PA01
ggccaccgggaucagcggcggg

SEQ ID NO: 3465854 - RNA, 23 nt, Pseudomonas aeruginosa PA01
ggccaccgucggauggccgucca

SEQ ID NO: 3465855 - RNA, 17 nt, Pseudomonas aeruginosa PA01
ggccaccugcggguggc

SEQ ID NO: 3465856 - RNA, 22 nt, Pseudomonas aeruginosa PA01
ggccaccuucgcccgcugcgcu

SEQ ID NO: 3465857 - RNA, 16 nt, Pseudomonas aeruginosa PA01
ggccacgacccugcug

SEQ ID NO: 3465858 - RNA, 17 nt, Pseudomonas aeruginosa PA01
ggccacgacccugcugg

SEQ ID NO: 3465859 - RNA, 20 nt, Pseudomonas aeruginosa PA01
ggccacgacccugcuggccg

SEQ ID NO: 3465860 - RNA, 21 nt, Pseudomonas aeruginosa PA01
ggccacgacccugcuggccgg

SEQ ID NO: 3465861 - RNA, 15 nt, Pseudomonas aeruginosa PA01
ggccacgcaccagcu

SEQ ID NO: 3465862 - RNA, 18 nt, Pseudomonas aeruginosa PA01
ggccacgcaccagcuccc

SEQ ID NO: 3465863 - RNA, 22 nt, Pseudomonas aeruginosa PA01
ggccacgcaccagcucccggcu

SEQ ID NO: 3465864 - RNA, 21 nt, Pseudomonas aeruginosa PA01
ggccacgcccggugucgacga

SEQ ID NO: 3465865 - RNA, 17 nt, Pseudomonas aeruginosa PA01
ggccacgccgacgccga

SEQ ID NO: 3465866 - RNA, 19 nt, Pseudomonas aeruginosa PA01
ggccacgccgacgccgagu

SEQ ID NO: 3465867 - RNA, 13 nt, Pseudomonas aeruginosa PA01
ggccacgccgccg

SEQ ID NO: 3465868 - RNA, 22 nt, Pseudomonas aeruginosa PA01
ggccacgccuucgggcgaugcg

SEQ ID NO: 3465869 - RNA, 14 nt, Pseudomonas aeruginosa PA01
ggccacgcgaccag

SEQ ID NO: 3465870 - RNA, 15 nt, Pseudomonas aeruginosa PA01
ggccacgcgaccagc

SEQ ID NO: 3465871 - RNA, 17 nt, Pseudomonas aeruginosa PA01
ggccacgcgaccagcgc

SEQ ID NO: 3465872 - RNA, 20 nt, Pseudomonas aeruginosa PA01
ggccacgcgaccagcgccag

SEQ ID NO: 3465873 - RNA, 22 nt, Pseudomonas aeruginosa PA01
ggccacgcgaccagcgccaggc

SEQ ID NO: 3465874 - RNA, 20 nt, Pseudomonas aeruginosa PA01
ggccacgcucucgaacagca

SEQ ID NO: 3465875 - RNA, 21 nt, Pseudomonas aeruginosa PA01
ggccacgcucucgaacagcag

SEQ ID NO: 3465876 - RNA, 22 nt, Pseudomonas aeruginosa PA01
ggccacgcucucgaacagcagc

SEQ ID NO: 3465877 - RNA, 19 nt, Pseudomonas aeruginosa PA01
ggccacgcugcggaucaac

SEQ ID NO: 3465878 - RNA, 16 nt, Pseudomonas aeruginosa PA01
ggccacggccgcugcg

SEQ ID NO: 3465879 - RNA, 21 nt, Pseudomonas aeruginosa PA01
ggccacggccgcugcgcaggc

SEQ ID NO: 3465880 - RNA, 14 nt, Pseudomonas aeruginosa PA01
ggccacggccggcg

SEQ ID NO: 3465881 - RNA, 15 nt, Pseudomonas aeruginosa PA01
ggccacggccggcga

SEQ ID NO: 3465882 - RNA, 12 nt, Pseudomonas aeruginosa PA01
ggccacggcgga

SEQ ID NO: 3465883 - RNA, 15 nt, Pseudomonas aeruginosa PA01
ggccacguagggcgu

SEQ ID NO: 3465884 - RNA, 17 nt, Pseudomonas aeruginosa PA01
ggccacguagggcgugg

SEQ ID NO: 3465885 - RNA, 20 nt, Pseudomonas aeruginosa PA01
ggccacguagggcguggugu

SEQ ID NO: 3465886 - RNA, 16 nt, Pseudomonas aeruginosa PA01
ggccacguccagcggc

SEQ ID NO: 3465887 - RNA, 16 nt, Pseudomonas aeruginosa PA01
ggccacgucgccccag

SEQ ID NO: 3465888 - RNA, 17 nt, Pseudomonas aeruginosa PA01
ggccacguucugcagga

SEQ ID NO: 3465889 - RNA, 19 nt, Pseudomonas aeruginosa PA01
ggccacuauuccuugcgcc

SEQ ID NO: 3465890 - RNA, 22 nt, Pseudomonas aeruginosa PA01
ggccacuauuccuugcgccaug

SEQ ID NO: 3465891 - RNA, 15 nt, Pseudomonas aeruginosa PA01
ggccagcgcggcgga

SEQ ID NO: 3465892 - RNA, 13 nt, Pseudomonas aeruginosa PA01
ggccagcgcggug

SEQ ID NO: 3465893 - RNA, 18 nt, Pseudomonas aeruginosa PA01
ggccagcgcggugcgcgc

SEQ ID NO: 3465894 - RNA, 14 nt, Pseudomonas aeruginosa PA01
ggccagcgcuucca

SEQ ID NO: 3465895 - RNA, 19 nt, Pseudomonas aeruginosa PA01
ggccagcgcuuccaccgcc

SEQ ID NO: 3465896 - RNA, 20 nt, Pseudomonas aeruginosa PA01
ggccagcgcuuccaccgccu

SEQ ID NO: 3465897 - RNA, 21 nt, Pseudomonas aeruginosa PA01
ggccagcgcuuccaccgccug

SEQ ID NO: 3465898 - RNA, 22 nt, Pseudomonas aeruginosa PA01
ggccagcgcuuccaccgccugc

SEQ ID NO: 3465899 - RNA, 15 nt, Pseudomonas aeruginosa PA01
ggccagcgcuucgcg

SEQ ID NO: 3465900 - RNA, 20 nt, Pseudomonas aeruginosa PA01
ggccagcggaugcuggcgga

SEQ ID NO: 3465901 - RNA, 23 nt, Pseudomonas aeruginosa PA01
ggccagcggcauccgccgcuggg

SEQ ID NO: 3465902 - RNA, 17 nt, Pseudomonas aeruginosa PA01
ggccagcggcuccucgg

SEQ ID NO: 3465903 - RNA, 17 nt, Pseudomonas aeruginosa PA01
ggccagcgggcugucgu

SEQ ID NO: 3465904 - RNA, 13 nt, Pseudomonas aeruginosa PA01
ggccagcgucgcc

SEQ ID NO: 3465905 - RNA, 18 nt, Pseudomonas aeruginosa PA01
ggccagcgugaagaccug

SEQ ID NO: 3465906 - RNA, 17 nt, Pseudomonas aeruginosa PA01
ggccagcuccagcaccg

SEQ ID NO: 3465907 - RNA, 20 nt, Pseudomonas aeruginosa PA01
ggccagcuccagcaccggcg

SEQ ID NO: 3465908 - RNA, 22 nt, Pseudomonas aeruginosa PA01
ggccagcuccagcaccggcggc

SEQ ID NO: 3465909 - RNA, 23 nt, Pseudomonas aeruginosa PA01
ggccagcuccagcaccggcggcg

SEQ ID NO: 3465910 - RNA, 14 nt, Pseudomonas aeruginosa PA01
ggccagcuccgccu

SEQ ID NO: 3465911 - RNA, 17 nt, Pseudomonas aeruginosa PA01
ggccagcuccgccugac

SEQ ID NO: 3465912 - RNA, 17 nt, Pseudomonas aeruginosa PA01
ggccagcucgaccuugc

SEQ ID NO: 3465913 - RNA, 18 nt, Pseudomonas aeruginosa PA01
ggccagcucgaccuugcc

SEQ ID NO: 3465914 - RNA, 15 nt, Pseudomonas aeruginosa PA01
ggccagcucgcccgc

SEQ ID NO: 3465915 - RNA, 16 nt, Pseudomonas aeruginosa PA01
ggccagcucgcccgcc

SEQ ID NO: 3465916 - RNA, 13 nt, Pseudomonas aeruginosa PA01
ggccagcucgccg

SEQ ID NO: 3465917 - RNA, 14 nt, Pseudomonas aeruginosa PA01
ggccagcucgccga

SEQ ID NO: 3465918 - RNA, 16 nt, Pseudomonas aeruginosa PA01
ggccagcucgccgaac

SEQ ID NO: 3465919 - RNA, 17 nt, Pseudomonas aeruginosa PA01
ggccagcucgccgaaca

SEQ ID NO: 3465920 - RNA, 14 nt, Pseudomonas aeruginosa PA01
ggccagcucgccgg

SEQ ID NO: 3465921 - RNA, 13 nt, Pseudomonas aeruginosa PA01
ggccagcucgucg

SEQ ID NO: 3465922 - RNA, 21 nt, Pseudomonas aeruginosa PA01
ggccagcuuccaggcgcgcug

SEQ ID NO: 3465923 - RNA, 17 nt, Pseudomonas aeruginosa PA01
ggccagcuucuccagca

SEQ ID NO: 3465924 - RNA, 23 nt, Pseudomonas aeruginosa PA01
ggccagcuucuccagcagggucg

SEQ ID NO: 3465925 - RNA, 22 nt, Pseudomonas aeruginosa PA01
ggccagcuuguaguagcgcccg

SEQ ID NO: 3465926 - RNA, 18 nt, Pseudomonas aeruginosa PA01
ggccagcuugucggccuu

SEQ ID NO: 3465927 - RNA, 20 nt, Pseudomonas aeruginosa PA01
ggccagcuugucggccuugg

SEQ ID NO: 3465928 - RNA, 18 nt, Pseudomonas aeruginosa PA01
ggccaggaaaucgagcgc

SEQ ID NO: 3465929 - RNA, 15 nt, Pseudomonas aeruginosa PA01
ggccaggaagcgggc

SEQ ID NO: 3465930 - RNA, 23 nt, Pseudomonas aeruginosa PA01
ggccaggaagcgggccucggcgg

SEQ ID NO: 3465931 - RNA, 22 nt, Pseudomonas aeruginosa PA01
ggccaggaccagggcgggccgc

SEQ ID NO: 3465932 - RNA, 18 nt, Pseudomonas aeruginosa PA01
ggccaggaccaucggcac

SEQ ID NO: 3465933 - RNA, 16 nt, Pseudomonas aeruginosa PA01
ggccaggaccgcgaug

SEQ ID NO: 3465934 - RNA, 22 nt, Pseudomonas aeruginosa PA01
ggccaggacgccaccaggccgc

SEQ ID NO: 3465935 - RNA, 16 nt, Pseudomonas aeruginosa PA01
ggccaggacgcuggcg

SEQ ID NO: 3465936 - RNA, 17 nt, Pseudomonas aeruginosa PA01
ggccaggacgcuggcga

SEQ ID NO: 3465937 - RNA, 18 nt, Pseudomonas aeruginosa PA01
ggccaggagcaucggcgc

SEQ ID NO: 3465938 - RNA, 19 nt, Pseudomonas aeruginosa PA01
ggccaggagcaucggcgcg

SEQ ID NO: 3465939 - RNA, 22 nt, Pseudomonas aeruginosa PA01
ggccaggagcaucggcgcggcc

SEQ ID NO: 3465940 - RNA, 13 nt, Pseudomonas aeruginosa PA01
ggccaggaggccc

SEQ ID NO: 3465941 - RNA, 11 nt, Pseudomonas aeruginosa PA01
ggccaggaucg

SEQ ID NO: 3465942 - RNA, 17 nt, Pseudomonas aeruginosa PA01
ggccaggaucgucggcc

SEQ ID NO: 3465943 - RNA, 19 nt, Pseudomonas aeruginosa PA01
ggccaggaucgucggcccg

SEQ ID NO: 3465944 - RNA, 21 nt, Pseudomonas aeruginosa PA01
ggccaggaucgucggcccgca

SEQ ID NO: 3465945 - RNA, 13 nt, Pseudomonas aeruginosa PA01
ggccaggaugacc

SEQ ID NO: 3465946 - RNA, 18 nt, Pseudomonas aeruginosa PA01
ggccaggaugaccaggcu

SEQ ID NO: 3465947 - RNA, 20 nt, Pseudomonas aeruginosa PA01
ggccaggaugaccaggcuga

SEQ ID NO: 3465948 - RNA, 17 nt, Pseudomonas aeruginosa PA01
ggccaggauguucgccg

SEQ ID NO: 3465949 - RNA, 20 nt, Pseudomonas aeruginosa PA01
ggccaggauguucgccgagg

SEQ ID NO: 3465950 - RNA, 12 nt, Pseudomonas aeruginosa PA01
ggccaggcagac

SEQ ID NO: 3465951 - RNA, 17 nt, Pseudomonas aeruginosa PA01
ggccaggcagaccagcg

SEQ ID NO: 3465952 - RNA, 18 nt, Pseudomonas aeruginosa PA01
ggccaggcagaccagcgc

SEQ ID NO: 3465953 - RNA, 14 nt, Pseudomonas aeruginosa PA01
ggccaggcauccag

SEQ ID NO: 3465954 - RNA, 21 nt, Pseudomonas aeruginosa PA01
ggccaggcauuccuccagggu

SEQ ID NO: 3465955 - RNA, 11 nt, Pseudomonas aeruginosa PA01
ggccaggccac

SEQ ID NO: 3465956 - RNA, 14 nt, Pseudomonas aeruginosa PA01
ggccaggccacggc

SEQ ID NO: 3465957 - RNA, 17 nt, Pseudomonas aeruginosa PA01
ggccaggccacggcgga

SEQ ID NO: 3465958 - RNA, 13 nt, Pseudomonas aeruginosa PA01
ggccaggcccacg

SEQ ID NO: 3465959 - RNA, 13 nt, Pseudomonas aeruginosa PA01
ggccaggccccag

SEQ ID NO: 3465960 - RNA, 17 nt, Pseudomonas aeruginosa PA01
ggccaggccccaggccg

SEQ ID NO: 3465961 - RNA, 18 nt, Pseudomonas aeruginosa PA01
ggccaggccccaggccgc

SEQ ID NO: 3465962 - RNA, 21 nt, Pseudomonas aeruginosa PA01
ggccaggccccaggccgccgc

SEQ ID NO: 3465963 - RNA, 18 nt, Pseudomonas aeruginosa PA01
ggccaggccccagggccg

SEQ ID NO: 3465964 - RNA, 21 nt, Pseudomonas aeruginosa PA01
ggccaggccccagggccggcg

SEQ ID NO: 3465965 - RNA, 22 nt, Pseudomonas aeruginosa PA01
ggccaggcccucagcggcggug

SEQ ID NO: 3465966 - RNA, 14 nt, Pseudomonas aeruginosa PA01
ggccaggcccuugg

SEQ ID NO: 3465967 - RNA, 17 nt, Pseudomonas aeruginosa PA01
ggccaggcccuugguca

SEQ ID NO: 3465968 - RNA, 18 nt, Pseudomonas aeruginosa PA01
ggccaggcccuuggucag

SEQ ID NO: 3465969 - RNA, 12 nt, Pseudomonas aeruginosa PA01
ggccaggccgag

SEQ ID NO: 3465970 - RNA, 14 nt, Pseudomonas aeruginosa PA01
ggccaggccgagca

SEQ ID NO: 3465971 - RNA, 14 nt, Pseudomonas aeruginosa PA01
ggccaggccgagcg

SEQ ID NO: 3465972 - RNA, 17 nt, Pseudomonas aeruginosa PA01
ggccaggccgagcgcca

SEQ ID NO: 3465973 - RNA, 18 nt, Pseudomonas aeruginosa PA01
ggccaggccgagcgccag

SEQ ID NO: 3465974 - RNA, 16 nt, Pseudomonas aeruginosa PA01
ggccaggccgagcgcg

SEQ ID NO: 3465975 - RNA, 18 nt, Pseudomonas aeruginosa PA01
ggccaggccgagcgcgcc

SEQ ID NO: 3465976 - RNA, 23 nt, Pseudomonas aeruginosa PA01
ggccaggccgagcgcgccgccga

SEQ ID NO: 3465977 - RNA, 14 nt, Pseudomonas aeruginosa PA01
ggccaggccgccca

SEQ ID NO: 3465978 - RNA, 16 nt, Pseudomonas aeruginosa PA01
ggccaggccggcgccu

SEQ ID NO: 3465979 - RNA, 19 nt, Pseudomonas aeruginosa PA01
ggccaggcgcaccagcagg

SEQ ID NO: 3465980 - RNA, 20 nt, Pseudomonas aeruginosa PA01
ggccaggcgcaccagcaggc

SEQ ID NO: 3465981 - RNA, 15 nt, Pseudomonas aeruginosa PA01
ggccaggcgccaggg

SEQ ID NO: 3465982 - RNA, 15 nt, Pseudomonas aeruginosa PA01
ggccaggcgccaggu

SEQ ID NO: 3465983 - RNA, 23 nt, Pseudomonas aeruginosa PA01
ggccaggcgccagguagugccgc

SEQ ID NO: 3465984 - RNA, 13 nt, Pseudomonas aeruginosa PA01
ggccaggcgcgac

SEQ ID NO: 3465985 - RNA, 13 nt, Pseudomonas aeruginosa PA01
ggccaggcgcggc

SEQ ID NO: 3465986 - RNA, 16 nt, Pseudomonas aeruginosa PA01
ggccaggcgcggcgcc

SEQ ID NO: 3465987 - RNA, 11 nt, Pseudomonas aeruginosa PA01
ggccaggcgcu

SEQ ID NO: 3465988 - RNA, 23 nt, Pseudomonas aeruginosa PA01
ggccaggcgcuccuccagcgccg

SEQ ID NO: 3465989 - RNA, 13 nt, Pseudomonas aeruginosa PA01
ggccaggcgcugg

SEQ ID NO: 3465990 - RNA, 16 nt, Pseudomonas aeruginosa PA01
ggccaggcggccgacg

SEQ ID NO: 3465991 - RNA, 13 nt, Pseudomonas aeruginosa PA01
ggccaggcucgcg

SEQ ID NO: 3465992 - RNA, 21 nt, Pseudomonas aeruginosa PA01
ggccaggcucgguucugcgca

SEQ ID NO: 3465993 - RNA, 17 nt, Pseudomonas aeruginosa PA01
ggccaggcucuucuucg

SEQ ID NO: 3465994 - RNA, 16 nt, Pseudomonas aeruginosa PA01
ggccaugaucuggcug

SEQ ID NO: 3465995 - RNA, 23 nt, Pseudomonas aeruginosa PA01
ggccaugaucuggcugucgccga

SEQ ID NO: 3465996 - RNA, 17 nt, Pseudomonas aeruginosa PA01
ggccaugaugugcgcag

SEQ ID NO: 3465997 - RNA, 21 nt, Pseudomonas aeruginosa PA01
ggccaugaugugcgcaggcug

SEQ ID NO: 3465998 - RNA, 22 nt, Pseudomonas aeruginosa PA01
ggccaugaugugcgcaggcugg

SEQ ID NO: 3465999 - RNA, 14 nt, Pseudomonas aeruginosa PA01
ggccaugcaggcca

SEQ ID NO: 3466000 - RNA, 15 nt, Pseudomonas aeruginosa PA01
ggccaugcaggccag

SEQ ID NO: 3466001 - RNA, 18 nt, Pseudomonas aeruginosa PA01
ggccaugcaggccagggc

SEQ ID NO: 3466002 - RNA, 17 nt, Pseudomonas aeruginosa PA01
ggccaugccggccagga

SEQ ID NO: 3466003 - RNA, 20 nt, Pseudomonas aeruginosa PA01
ggccaugccggccaggaagg

SEQ ID NO: 3466004 - RNA, 18 nt, Pseudomonas aeruginosa PA01
ggccauggcagagcugga

SEQ ID NO: 3466005 - RNA, 18 nt, Pseudomonas aeruginosa PA01
ggccauggccgagcccag

SEQ ID NO: 3466006 - RNA, 20 nt, Pseudomonas aeruginosa PA01
ggccauggccgagcccagcg

SEQ ID NO: 3466007 - RNA, 21 nt, Pseudomonas aeruginosa PA01
ggccauggcgcuugcgcagca

SEQ ID NO: 3466008 - RNA, 15 nt, Pseudomonas aeruginosa PA01
ggccaugggugucgg

SEQ ID NO: 3466009 - RNA, 15 nt, Pseudomonas aeruginosa PA01
ggccauuacgccgag

SEQ ID NO: 3466010 - RNA, 16 nt, Pseudomonas aeruginosa PA01
ggccauuacgccgagc

SEQ ID NO: 3466011 - RNA, 21 nt, Pseudomonas aeruginosa PA01
ggccauucgcugucgagcagg

SEQ ID NO: 3466012 - RNA, 23 nt, Pseudomonas aeruginosa PA01
ggccauucgcuucggccaccagc

SEQ ID NO: 3466013 - RNA, 17 nt, Pseudomonas aeruginosa PA01
ggccauucggccuggca

SEQ ID NO: 3466014 - RNA, 13 nt, Pseudomonas aeruginosa PA01
ggccauucuucuc

SEQ ID NO: 3466015 - RNA, 22 nt, Pseudomonas aeruginosa PA01
ggccauuguucuuuggccaauu

SEQ ID NO: 3466016 - RNA, 22 nt, Pseudomonas aeruginosa PA01
ggccauuuuucaugggcggggu

SEQ ID NO: 3466017 - RNA, 23 nt, Pseudomonas aeruginosa PA01
ggcccaacagcggugugcucagg

SEQ ID NO: 3466018 - RNA, 13 nt, Pseudomonas aeruginosa PA01
ggcccaagccgag

SEQ ID NO: 3466019 - RNA, 14 nt, Pseudomonas aeruginosa PA01
ggcccaagccgagc

SEQ ID NO: 3466020 - RNA, 18 nt, Pseudomonas aeruginosa PA01
ggcccaagccgagcggca

SEQ ID NO: 3466021 - RNA, 14 nt, Pseudomonas aeruginosa PA01
ggcccaauccgcgc

SEQ ID NO: 3466022 - RNA, 15 nt, Pseudomonas aeruginosa PA01
ggcccaauccgcgcc

SEQ ID NO: 3466023 - RNA, 19 nt, Pseudomonas aeruginosa PA01
ggcccaauccgcgccggug

SEQ ID NO: 3466024 - RNA, 22 nt, Pseudomonas aeruginosa PA01
ggcccaauccgcgccgguggcc

SEQ ID NO: 3466025 - RNA, 15 nt, Pseudomonas aeruginosa PA01
ggcccacagugccag

SEQ ID NO: 3466026 - RNA, 19 nt, Pseudomonas aeruginosa PA01
ggcccacagugccaggcuc

SEQ ID NO: 3466027 - RNA, 21 nt, Pseudomonas aeruginosa PA01
ggcccacagugccaggcucgc

SEQ ID NO: 3466028 - RNA, 23 nt, Pseudomonas aeruginosa PA01
ggcccacagugccaggcucgccg

SEQ ID NO: 3466029 - RNA, 18 nt, Pseudomonas aeruginosa PA01
ggcccacgggcggccgac

SEQ ID NO: 3466030 - RNA, 23 nt, Pseudomonas aeruginosa PA01
ggcccacgggcggccgacgugca

SEQ ID NO: 3466031 - RNA, 16 nt, Pseudomonas aeruginosa PA01
ggcccagagcagcacc

SEQ ID NO: 3466032 - RNA, 17 nt, Pseudomonas aeruginosa PA01
ggcccagagcagcacca

SEQ ID NO: 3466033 - RNA, 21 nt, Pseudomonas aeruginosa PA01
ggcccagauauccagggccag

SEQ ID NO: 3466034 - RNA, 22 nt, Pseudomonas aeruginosa PA01
ggcccagauauccagggccagg

SEQ ID NO: 3466035 - RNA, 20 nt, Pseudomonas aeruginosa PA01
ggcccagaugaucaggccga

SEQ ID NO: 3466036 - RNA, 21 nt, Pseudomonas aeruginosa PA01
ggcccagaugaucaggccgag

SEQ ID NO: 3466037 - RNA, 16 nt, Pseudomonas aeruginosa PA01
ggcccagcagcgcuca

SEQ ID NO: 3466038 - RNA, 14 nt, Pseudomonas aeruginosa PA01
ggcccagcaggccg

SEQ ID NO: 3466039 - RNA, 16 nt, Pseudomonas aeruginosa PA01
ggcccagcaggccggc

SEQ ID NO: 3466040 - RNA, 17 nt, Pseudomonas aeruginosa PA01
ggcccagcaggccggcc

SEQ ID NO: 3466041 - RNA, 20 nt, Pseudomonas aeruginosa PA01
ggcccagcaggccggccagc

SEQ ID NO: 3466042 - RNA, 21 nt, Pseudomonas aeruginosa PA01
ggcccagccgcggcgccacgc

SEQ ID NO: 3466043 - RNA, 12 nt, Pseudomonas aeruginosa PA01
ggcccagcgccc

SEQ ID NO: 3466044 - RNA, 13 nt, Pseudomonas aeruginosa PA01
ggcccagcgcccc

SEQ ID NO: 3466045 - RNA, 20 nt, Pseudomonas aeruginosa PA01
ggcccagcgccccgccuacc

SEQ ID NO: 3466046 - RNA, 14 nt, Pseudomonas aeruginosa PA01
ggcccagcgcggcg

SEQ ID NO: 3466047 - RNA, 16 nt, Pseudomonas aeruginosa PA01
ggcccagcgcggcgcc

SEQ ID NO: 3466048 - RNA, 18 nt, Pseudomonas aeruginosa PA01
ggcccagcgcggcgcccc

SEQ ID NO: 3466049 - RNA, 12 nt, Pseudomonas aeruginosa PA01
ggcccagcggca

SEQ ID NO: 3466050 - RNA, 18 nt, Pseudomonas aeruginosa PA01
ggcccagcguucggcgcu

SEQ ID NO: 3466051 - RNA, 21 nt, Pseudomonas aeruginosa PA01
ggcccagcguucggcgcuggc

SEQ ID NO: 3466052 - RNA, 14 nt, Pseudomonas aeruginosa PA01
ggcccaggccgggu

SEQ ID NO: 3466053 - RNA, 13 nt, Pseudomonas aeruginosa PA01
ggcccaggcuggc

SEQ ID NO: 3466054 - RNA, 14 nt, Pseudomonas aeruginosa PA01
ggcccaggcuggcg

SEQ ID NO: 3466055 - RNA, 15 nt, Pseudomonas aeruginosa PA01
ggcccaggcuggcgg

SEQ ID NO: 3466056 - RNA, 16 nt, Pseudomonas aeruginosa PA01
ggcccaggcuggcggc

SEQ ID NO: 3466057 - RNA, 17 nt, Pseudomonas aeruginosa PA01
ggcccaggcuggcggcc

SEQ ID NO: 3466058 - RNA, 22 nt, Pseudomonas aeruginosa PA01
ggcccaggcuggcggccagggc

SEQ ID NO: 3466059 - RNA, 19 nt, Pseudomonas aeruginosa PA01
ggcccaguucgcugccgcc

SEQ ID NO: 3466060 - RNA, 20 nt, Pseudomonas aeruginosa PA01
ggcccaguucgcugccgccg

SEQ ID NO: 3466061 - RNA, 20 nt, Pseudomonas aeruginosa PA01
ggcccaguugcccggccugg

SEQ ID NO: 3466062 - RNA, 21 nt, Pseudomonas aeruginosa PA01
ggcccaguugcccggccuggu

SEQ ID NO: 3466063 - RNA, 16 nt, Pseudomonas aeruginosa PA01
ggcccaugauggucgg

SEQ ID NO: 3466064 - RNA, 19 nt, Pseudomonas aeruginosa PA01
ggcccaugauggucggcac

SEQ ID NO: 3466065 - RNA, 12 nt, Pseudomonas aeruginosa PA01
ggcccauggcga

SEQ ID NO: 3466066 - RNA, 17 nt, Pseudomonas aeruginosa PA01
ggccccaaggggccgcg

SEQ ID NO: 3466067 - RNA, 12 nt, Pseudomonas aeruginosa PA01
ggccccaccagc

SEQ ID NO: 3466068 - RNA, 15 nt, Pseudomonas aeruginosa PA01
ggccccaccgcacug

SEQ ID NO: 3466069 - RNA, 19 nt, Pseudomonas aeruginosa PA01
ggccccaccgcacuggugg

SEQ ID NO: 3466070 - RNA, 23 nt, Pseudomonas aeruginosa PA01
ggccccaccuggcgacaggcgau

SEQ ID NO: 3466071 - RNA, 17 nt, Pseudomonas aeruginosa PA01
ggccccagcacuggugg

SEQ ID NO: 3466072 - RNA, 12 nt, Pseudomonas aeruginosa PA01
ggccccagcgcg

SEQ ID NO: 3466073 - RNA, 16 nt, Pseudomonas aeruginosa PA01
ggccccagcgcgagcg

SEQ ID NO: 3466074 - RNA, 18 nt, Pseudomonas aeruginosa PA01
ggccccaggccgccgccu

SEQ ID NO: 3466075 - RNA, 16 nt, Pseudomonas aeruginosa PA01
ggccccaggcgaucca

SEQ ID NO: 3466076 - RNA, 19 nt, Pseudomonas aeruginosa PA01
ggccccaggcugcccaggu

SEQ ID NO: 3466077 - RNA, 16 nt, Pseudomonas aeruginosa PA01
ggccccagggccggcg

SEQ ID NO: 3466078 - RNA, 17 nt, Pseudomonas aeruginosa PA01
ggcccccacggaggccu

SEQ ID NO: 3466079 - RNA, 18 nt, Pseudomonas aeruginosa PA01
ggcccccacggaggccuu

SEQ ID NO: 3466080 - RNA, 14 nt, Pseudomonas aeruginosa PA01
ggccccgagaaaac

SEQ ID NO: 3466081 - RNA, 18 nt, Pseudomonas aeruginosa PA01
ggccccggcaagggccug

SEQ ID NO: 3466082 - RNA, 20 nt, Pseudomonas aeruginosa PA01
ggccccggcaagggccugcu

SEQ ID NO: 3466083 - RNA, 13 nt, Pseudomonas aeruginosa PA01
ggccccggccagg

SEQ ID NO: 3466084 - RNA, 23 nt, Pseudomonas aeruginosa PA01
ggccccggccagguaccggccag

SEQ ID NO: 3466085 - RNA, 22 nt, Pseudomonas aeruginosa PA01
ggccccggccagguacuggcga

SEQ ID NO: 3466086 - RNA, 23 nt, Pseudomonas aeruginosa PA01
ggccccggccagguacuggcgau

SEQ ID NO: 3466087 - RNA, 12 nt, Pseudomonas aeruginosa PA01
ggccccggccgg

SEQ ID NO: 3466088 - RNA, 19 nt, Pseudomonas aeruginosa PA01
ggccccggcgauccgcgca

SEQ ID NO: 3466089 - RNA, 15 nt, Pseudomonas aeruginosa PA01
ggccccggcgcucgc

SEQ ID NO: 3466090 - RNA, 17 nt, Pseudomonas aeruginosa PA01
ggccccggcgcucgcug

SEQ ID NO: 3466091 - RNA, 22 nt, Pseudomonas aeruginosa PA01
ggccccggugauguaggccgcu

SEQ ID NO: 3466092 - RNA, 23 nt, Pseudomonas aeruginosa PA01
ggccccggugauguaggccgcuu

SEQ ID NO: 3466093 - RNA, 16 nt, Pseudomonas aeruginosa PA01
ggccccugggccggcu

SEQ ID NO: 3466094 - RNA, 20 nt, Pseudomonas aeruginosa PA01
ggccccuucagcuccagcag

SEQ ID NO: 3466095 - RNA, 21 nt, Pseudomonas aeruginosa PA01
ggccccuucagcuccagcagu

SEQ ID NO: 3466096 - RNA, 13 nt, Pseudomonas aeruginosa PA01
ggcccugcgccgc

SEQ ID NO: 3466097 - RNA, 20 nt, Pseudomonas aeruginosa PA01
ggcccugcgccgcagcggcc

SEQ ID NO: 3466098 - RNA, 21 nt, Pseudomonas aeruginosa PA01
ggcccugcgccgcagcggcca

SEQ ID NO: 3466099 - RNA, 14 nt, Pseudomonas aeruginosa PA01
ggcccugcgcgcgc

SEQ ID NO: 3466100 - RNA, 17 nt, Pseudomonas aeruginosa PA01
ggcccugcuccuccagg

SEQ ID NO: 3466101 - RNA, 14 nt, Pseudomonas aeruginosa PA01
ggcccugcucgccg

SEQ ID NO: 3466102 - RNA, 15 nt, Pseudomonas aeruginosa PA01
ggcccugcucgccgg

SEQ ID NO: 3466103 - RNA, 17 nt, Pseudomonas aeruginosa PA01
ggcccugcucgccggcg

SEQ ID NO: 3466104 - RNA, 22 nt, Pseudomonas aeruginosa PA01
ggcccugcucgccggcgcgggc

SEQ ID NO: 3466105 - RNA, 11 nt, Pseudomonas aeruginosa PA01
ggcccugcugc

SEQ ID NO: 3466106 - RNA, 18 nt, Pseudomonas aeruginosa PA01
ggcccuggauaucugggc

SEQ ID NO: 3466107 - RNA, 12 nt, Pseudomonas aeruginosa PA01
ggcccuggauca

SEQ ID NO: 3466108 - RNA, 13 nt, Pseudomonas aeruginosa PA01
ggcccuggccuug

SEQ ID NO: 3466109 - RNA, 15 nt, Pseudomonas aeruginosa PA01
ggcccuggccuuggc

SEQ ID NO: 3466110 - RNA, 17 nt, Pseudomonas aeruginosa PA01
ggcccuggccuuggcca

SEQ ID NO: 3466111 - RNA, 19 nt, Pseudomonas aeruginosa PA01
ggcccuggccuuggccacg

SEQ ID NO: 3466112 - RNA, 12 nt, Pseudomonas aeruginosa PA01
ggcccuggcgca

SEQ ID NO: 3466113 - RNA, 13 nt, Pseudomonas aeruginosa PA01
ggcccuggcggcg

SEQ ID NO: 3466114 - RNA, 14 nt, Pseudomonas aeruginosa PA01
ggcccuggcggcga

SEQ ID NO: 3466115 - RNA, 12 nt, Pseudomonas aeruginosa PA01
ggcccugggccc

SEQ ID NO: 3466116 - RNA, 15 nt, Pseudomonas aeruginosa PA01
ggcccugggcggcga

SEQ ID NO: 3466117 - RNA, 18 nt, Pseudomonas aeruginosa PA01
ggcccugggcggcgaccu

SEQ ID NO: 3466118 - RNA, 15 nt, Pseudomonas aeruginosa PA01
ggcccugggcggcgg

SEQ ID NO: 3466119 - RNA, 17 nt, Pseudomonas aeruginosa PA01
ggcccugggcggcgggc

SEQ ID NO: 3466120 - RNA, 18 nt, Pseudomonas aeruginosa PA01
ggcccugggcggcgggcc

SEQ ID NO: 3466121 - RNA, 17 nt, Pseudomonas aeruginosa PA01
ggcccugguacagcgcc

SEQ ID NO: 3466122 - RNA, 20 nt, Pseudomonas aeruginosa PA01
ggcccuucacgagaccaccg

SEQ ID NO: 3466123 - RNA, 16 nt, Pseudomonas aeruginosa PA01
ggcccuucgcccugcg

SEQ ID NO: 3466124 - RNA, 20 nt, Pseudomonas aeruginosa PA01
ggcccuugaacaggcuggcg

SEQ ID NO: 3466125 - RNA, 17 nt, Pseudomonas aeruginosa PA01
ggcccuugagcauggcg

SEQ ID NO: 3466126 - RNA, 23 nt, Pseudomonas aeruginosa PA01
ggcccuugaggaaguugcgcagc

SEQ ID NO: 3466127 - RNA, 20 nt, Pseudomonas aeruginosa PA01
ggcccuugagggccucggcg

SEQ ID NO: 3466128 - RNA, 21 nt, Pseudomonas aeruginosa PA01
ggcccuugagggccucggcga

SEQ ID NO: 3466129 - RNA, 13 nt, Pseudomonas aeruginosa PA01
ggcccuugucgcc

SEQ ID NO: 3466130 - RNA, 17 nt, Pseudomonas aeruginosa PA01
ggcccuugucgccgcug

SEQ ID NO: 3466131 - RNA, 21 nt, Pseudomonas aeruginosa PA01
ggcccuugugaaagggcggca

SEQ ID NO: 3466132 - RNA, 17 nt, Pseudomonas aeruginosa PA01
ggcccuuuuccaccggc

SEQ ID NO: 3466133 - RNA, 15 nt, Pseudomonas aeruginosa PA01
ggcccuuuuccucgg

SEQ ID NO: 3466134 - RNA, 16 nt, Pseudomonas aeruginosa PA01
ggccgaaagcacugcg

SEQ ID NO: 3466135 - RNA, 18 nt, Pseudomonas aeruginosa PA01
ggccgaaagcacugcggc

SEQ ID NO: 3466136 - RNA, 19 nt, Pseudomonas aeruginosa PA01
ggccgaaagcacugcggcg

SEQ ID NO: 3466137 - RNA, 20 nt, Pseudomonas aeruginosa PA01
ggccgaaagcacugcggcgg

SEQ ID NO: 3466138 - RNA, 19 nt, Pseudomonas aeruginosa PA01
ggccgaaauggcgguggcc

SEQ ID NO: 3466139 - RNA, 23 nt, Pseudomonas aeruginosa PA01
ggccgaaauggcgguggccgugg

SEQ ID NO: 3466140 - RNA, 19 nt, Pseudomonas aeruginosa PA01
ggccgaacagacgcaggca

SEQ ID NO: 3466141 - RNA, 15 nt, Pseudomonas aeruginosa PA01
ggccgaaccggggcg

SEQ ID NO: 3466142 - RNA, 20 nt, Pseudomonas aeruginosa PA01
ggccgaacucacggaugccg

SEQ ID NO: 3466143 - RNA, 22 nt, Pseudomonas aeruginosa PA01
ggccgaacucaugcccagcuug

SEQ ID NO: 3466144 - RNA, 22 nt, Pseudomonas aeruginosa PA01
ggccgaagaggcccucggcgcc

SEQ ID NO: 3466145 - RNA, 23 nt, Pseudomonas aeruginosa PA01
ggccgaagaggcccucggcgccg

SEQ ID NO: 3466146 - RNA, 12 nt, Pseudomonas aeruginosa PA01
ggccgaagccgc

SEQ ID NO: 3466147 - RNA, 18 nt, Pseudomonas aeruginosa PA01
ggccgaagcgugggcggc

SEQ ID NO: 3466148 - RNA, 19 nt, Pseudomonas aeruginosa PA01
ggccgaagcgugggcggcc

SEQ ID NO: 3466149 - RNA, 23 nt, Pseudomonas aeruginosa PA01
ggccgaagcgugggcggccggcc

SEQ ID NO: 3466150 - RNA, 22 nt, Pseudomonas aeruginosa PA01
ggccgaagcugucgagcacggc

SEQ ID NO: 3466151 - RNA, 20 nt, Pseudomonas aeruginosa PA01
ggccgaaggccaggaccgcg

SEQ ID NO: 3466152 - RNA, 18 nt, Pseudomonas aeruginosa PA01
ggccgaaggccaggccgg

SEQ ID NO: 3466153 - RNA, 19 nt, Pseudomonas aeruginosa PA01
ggccgaaggccaggccggc

SEQ ID NO: 3466154 - RNA, 20 nt, Pseudomonas aeruginosa PA01
ggccgaaggccaggccggcg

SEQ ID NO: 3466155 - RNA, 13 nt, Pseudomonas aeruginosa PA01
ggccgaaggccug

SEQ ID NO: 3466156 - RNA, 18 nt, Pseudomonas aeruginosa PA01
ggccgaaggccuggccgu

SEQ ID NO: 3466157 - RNA, 19 nt, Pseudomonas aeruginosa PA01
ggccgaaggcgcuccccug

SEQ ID NO: 3466158 - RNA, 22 nt, Pseudomonas aeruginosa PA01
ggccgaauaggcgaucuccggc

SEQ ID NO: 3466159 - RNA, 15 nt, Pseudomonas aeruginosa PA01
ggccgaauccgccgg

SEQ ID NO: 3466160 - RNA, 16 nt, Pseudomonas aeruginosa PA01
ggccgaauccgccggc

SEQ ID NO: 3466161 - RNA, 17 nt, Pseudomonas aeruginosa PA01
ggccgaauccgccggcg

SEQ ID NO: 3466162 - RNA, 19 nt, Pseudomonas aeruginosa PA01
ggccgaauccgccggcgau

SEQ ID NO: 3466163 - RNA, 21 nt, Pseudomonas aeruginosa PA01
ggccgaauccuccagccggcg

SEQ ID NO: 3466164 - RNA, 22 nt, Pseudomonas aeruginosa PA01
ggccgaauccuccagccggcga

SEQ ID NO: 3466165 - RNA, 23 nt, Pseudomonas aeruginosa PA01
ggccgaauccuccagccggcgac

SEQ ID NO: 3466166 - RNA, 16 nt, Pseudomonas aeruginosa PA01
ggccgacaccucgauc

SEQ ID NO: 3466167 - RNA, 16 nt, Pseudomonas aeruginosa PA01
ggccgacagagcggcc

SEQ ID NO: 3466168 - RNA, 18 nt, Pseudomonas aeruginosa PA01
ggccgacagagcggccgg

SEQ ID NO: 3466169 - RNA, 13 nt, Pseudomonas aeruginosa PA01
ggccgacagcggc

SEQ ID NO: 3466170 - RNA, 17 nt, Pseudomonas aeruginosa PA01
ggccgacagcggcuggc

SEQ ID NO: 3466171 - RNA, 18 nt, Pseudomonas aeruginosa PA01
ggccgacagcggcuggcg

SEQ ID NO: 3466172 - RNA, 20 nt, Pseudomonas aeruginosa PA01
ggccgacagcggcuggcgcu

SEQ ID NO: 3466173 - RNA, 13 nt, Pseudomonas aeruginosa PA01
ggccgacaggcug

SEQ ID NO: 3466174 - RNA, 12 nt, Pseudomonas aeruginosa PA01
ggccgaccagca

SEQ ID NO: 3466175 - RNA, 13 nt, Pseudomonas aeruginosa PA01
ggccgaccagcag

SEQ ID NO: 3466176 - RNA, 14 nt, Pseudomonas aeruginosa PA01
ggccgaccagcagg

SEQ ID NO: 3466177 - RNA, 18 nt, Pseudomonas aeruginosa PA01
ggccgaccagcagggcca

SEQ ID NO: 3466178 - RNA, 23 nt, Pseudomonas aeruginosa PA01
ggccgaccagcagggccagcagc

SEQ ID NO: 3466179 - RNA, 13 nt, Pseudomonas aeruginosa PA01
ggccgaccagcgc

SEQ ID NO: 3466180 - RNA, 14 nt, Pseudomonas aeruginosa PA01
ggccgaccagcgcc

SEQ ID NO: 3466181 - RNA, 16 nt, Pseudomonas aeruginosa PA01
ggccgaccagcgccga

SEQ ID NO: 3466182 - RNA, 17 nt, Pseudomonas aeruginosa PA01
ggccgaccagcgccgac

SEQ ID NO: 3466183 - RNA, 19 nt, Pseudomonas aeruginosa PA01
ggccgaccagcgccgacuu

SEQ ID NO: 3466184 - RNA, 12 nt, Pseudomonas aeruginosa PA01
ggccgaccaggu

SEQ ID NO: 3466185 - RNA, 17 nt, Pseudomonas aeruginosa PA01
ggccgaccaggugcugg

SEQ ID NO: 3466186 - RNA, 13 nt, Pseudomonas aeruginosa PA01
ggccgacccgcag

SEQ ID NO: 3466187 - RNA, 19 nt, Pseudomonas aeruginosa PA01
ggccgacccgcagcggcgc

SEQ ID NO: 3466188 - RNA, 15 nt, Pseudomonas aeruginosa PA01
ggccgacccgcaggc

SEQ ID NO: 3466189 - RNA, 18 nt, Pseudomonas aeruginosa PA01
ggccgacccgcaggccgg

SEQ ID NO: 3466190 - RNA, 20 nt, Pseudomonas aeruginosa PA01
ggccgacccgcaggccggcc

SEQ ID NO: 3466191 - RNA, 22 nt, Pseudomonas aeruginosa PA01
ggccgacccgcaggccggccag

SEQ ID NO: 3466192 - RNA, 16 nt, Pseudomonas aeruginosa PA01
ggccgacccgugcgcc

SEQ ID NO: 3466193 - RNA, 18 nt, Pseudomonas aeruginosa PA01
ggccgacccgugcgccgc

SEQ ID NO: 3466194 - RNA, 16 nt, Pseudomonas aeruginosa PA01
ggccgaccgccaggcc

SEQ ID NO: 3466195 - RNA, 16 nt, Pseudomonas aeruginosa PA01
ggccgaccucggcggu

SEQ ID NO: 3466196 - RNA, 18 nt, Pseudomonas aeruginosa PA01
ggccgaccucggcgguca

SEQ ID NO: 3466197 - RNA, 16 nt, Pseudomonas aeruginosa PA01
ggccgaccugcccgcu

SEQ ID NO: 3466198 - RNA, 14 nt, Pseudomonas aeruginosa PA01
ggccgaccuugucc

SEQ ID NO: 3466199 - RNA, 16 nt, Pseudomonas aeruginosa PA01
ggccgaucagcgccuc

SEQ ID NO: 3466200 - RNA, 15 nt, Pseudomonas aeruginosa PA01
ggccgaucagcggcg

SEQ ID NO: 3466201 - RNA, 17 nt, Pseudomonas aeruginosa PA01
ggccgaucagcggcggu

SEQ ID NO: 3466202 - RNA, 14 nt, Pseudomonas aeruginosa PA01
ggccgaucagcuug

SEQ ID NO: 3466203 - RNA, 19 nt, Pseudomonas aeruginosa PA01
ggccgaucaucaucaggua

SEQ ID NO: 3466204 - RNA, 16 nt, Pseudomonas aeruginosa PA01
ggccgaucaucggcug

SEQ ID NO: 3466205 - RNA, 17 nt, Pseudomonas aeruginosa PA01
ggccgaucaucggcugg

SEQ ID NO: 3466206 - RNA, 16 nt, Pseudomonas aeruginosa PA01
ggccgaucgagcggcc

SEQ ID NO: 3466207 - RNA, 19 nt, Pseudomonas aeruginosa PA01
ggccgaucgagcggcccgc

SEQ ID NO: 3466208 - RNA, 15 nt, Pseudomonas aeruginosa PA01
ggccgaucuccuggc

SEQ ID NO: 3466209 - RNA, 21 nt, Pseudomonas aeruginosa PA01
ggccgaucucgugggccagca

SEQ ID NO: 3466210 - RNA, 23 nt, Pseudomonas aeruginosa PA01
ggccgaucucgugggccagcagg

SEQ ID NO: 3466211 - RNA, 16 nt, Pseudomonas aeruginosa PA01
ggccgaucuucagcag

SEQ ID NO: 3466212 - RNA, 20 nt, Pseudomonas aeruginosa PA01
ggccgaucuucagcagcagg

SEQ ID NO: 3466213 - RNA, 18 nt, Pseudomonas aeruginosa PA01
ggccgaucuucgccgaca

SEQ ID NO: 3466214 - RNA, 21 nt, Pseudomonas aeruginosa PA01
ggccgaugaucuccgcgccgg

SEQ ID NO: 3466215 - RNA, 19 nt, Pseudomonas aeruginosa PA01
ggccgaugccgaccuugcc

SEQ ID NO: 3466216 - RNA, 15 nt, Pseudomonas aeruginosa PA01
ggccgaugcgcaacg

SEQ ID NO: 3466217 - RNA, 21 nt, Pseudomonas aeruginosa PA01
ggccgaugcgcaacgggcggc

SEQ ID NO: 3466218 - RNA, 22 nt, Pseudomonas aeruginosa PA01
ggccgaugcgcaacgggcggcg

SEQ ID NO: 3466219 - RNA, 18 nt, Pseudomonas aeruginosa PA01
ggccgaugcuaucgcgug

SEQ ID NO: 3466220 - RNA, 20 nt, Pseudomonas aeruginosa PA01
ggccgauggaaaucggccac

SEQ ID NO: 3466221 - RNA, 14 nt, Pseudomonas aeruginosa PA01
ggccgauggccccg

SEQ ID NO: 3466222 - RNA, 16 nt, Pseudomonas aeruginosa PA01
ggccgauggccccggc

SEQ ID NO: 3466223 - RNA, 13 nt, Pseudomonas aeruginosa PA01
ggccgauguccuc

SEQ ID NO: 3466224 - RNA, 22 nt, Pseudomonas aeruginosa PA01
ggccgaugugaaaacggcgcau

SEQ ID NO: 3466225 - RNA, 18 nt, Pseudomonas aeruginosa PA01
ggccgauguucaggccgg

SEQ ID NO: 3466226 - RNA, 17 nt, Pseudomonas aeruginosa PA01
ggccgauuucgaugacg

SEQ ID NO: 3466227 - RNA, 13 nt, Pseudomonas aeruginosa PA01
ggccgcaaccagc

SEQ ID NO: 3466228 - RNA, 15 nt, Pseudomonas aeruginosa PA01
ggccgcaaccagccc

SEQ ID NO: 3466229 - RNA, 20 nt, Pseudomonas aeruginosa PA01
ggccgcaaccagcccuggcg

SEQ ID NO: 3466230 - RNA, 22 nt, Pseudomonas aeruginosa PA01
ggccgcaaccagcccuggcgca

SEQ ID NO: 3466231 - RNA, 21 nt, Pseudomonas aeruginosa PA01
ggccgcaagcgguauugucga

SEQ ID NO: 3466232 - RNA, 19 nt, Pseudomonas aeruginosa PA01
ggccgcaaguaccgccggc

SEQ ID NO: 3466233 - RNA, 20 nt, Pseudomonas aeruginosa PA01
ggccgcaaguaccgccggca

SEQ ID NO: 3466234 - RNA, 21 nt, Pseudomonas aeruginosa PA01
ggccgcaaguaccgccggcag

SEQ ID NO: 3466235 - RNA, 13 nt, Pseudomonas aeruginosa PA01
ggccgcaccagga

SEQ ID NO: 3466236 - RNA, 14 nt, Pseudomonas aeruginosa PA01
ggccgcagcagcgg

SEQ ID NO: 3466237 - RNA, 16 nt, Pseudomonas aeruginosa PA01
ggccgcagcagcggca

SEQ ID NO: 3466238 - RNA, 12 nt, Pseudomonas aeruginosa PA01
ggccgcagcgca

SEQ ID NO: 3466239 - RNA, 15 nt, Pseudomonas aeruginosa PA01
ggccgcagcgcagcc

SEQ ID NO: 3466240 - RNA, 16 nt, Pseudomonas aeruginosa PA01
ggccgcagcgcagccg

SEQ ID NO: 3466241 - RNA, 14 nt, Pseudomonas aeruginosa PA01
ggccgcagcggcug

SEQ ID NO: 3466242 - RNA, 15 nt, Pseudomonas aeruginosa PA01
ggccgcaggcagcac

SEQ ID NO: 3466243 - RNA, 20 nt, Pseudomonas aeruginosa PA01
ggccgcagguuggccccgcc

SEQ ID NO: 3466244 - RNA, 15 nt, Pseudomonas aeruginosa PA01
ggccgcauccgcggc

SEQ ID NO: 3466245 - RNA, 16 nt, Pseudomonas aeruginosa PA01
ggccgcaucgcgggcg

SEQ ID NO: 3466246 - RNA, 17 nt, Pseudomonas aeruginosa PA01
ggccgccagcaggccga

SEQ ID NO: 3466247 - RNA, 21 nt, Pseudomonas aeruginosa PA01
ggccgccagcaggccgaaggc

SEQ ID NO: 3466248 - RNA, 19 nt, Pseudomonas aeruginosa PA01
ggccgccagcagguagacg

SEQ ID NO: 3466249 - RNA, 15 nt, Pseudomonas aeruginosa PA01
ggccgccagccgcca

SEQ ID NO: 3466250 - RNA, 16 nt, Pseudomonas aeruginosa PA01
ggccgccagccgccag

SEQ ID NO: 3466251 - RNA, 18 nt, Pseudomonas aeruginosa PA01
ggccgccaggccucggcg

SEQ ID NO: 3466252 - RNA, 20 nt, Pseudomonas aeruginosa PA01
ggccgccaggccucggcgcg

SEQ ID NO: 3466253 - RNA, 22 nt, Pseudomonas aeruginosa PA01
ggccgccaggccucggcgcggg

SEQ ID NO: 3466254 - RNA, 12 nt, Pseudomonas aeruginosa PA01
ggccgccaggcg

SEQ ID NO: 3466255 - RNA, 16 nt, Pseudomonas aeruginosa PA01
ggccgccaggcgcguc

SEQ ID NO: 3466256 - RNA, 20 nt, Pseudomonas aeruginosa PA01
ggccgccaggcgcgucgcgg

SEQ ID NO: 3466257 - RNA, 12 nt, Pseudomonas aeruginosa PA01
ggccgccaggcu

SEQ ID NO: 3466258 - RNA, 14 nt, Pseudomonas aeruginosa PA01
ggccgccaggcugg

SEQ ID NO: 3466259 - RNA, 11 nt, Pseudomonas aeruginosa PA01
ggccgccaggg

SEQ ID NO: 3466260 - RNA, 12 nt, Pseudomonas aeruginosa PA01
ggccgccagggc

SEQ ID NO: 3466261 - RNA, 14 nt, Pseudomonas aeruginosa PA01
ggccgccagggcgu

SEQ ID NO: 3466262 - RNA, 16 nt, Pseudomonas aeruginosa PA01
ggccgccagggcgucg

SEQ ID NO: 3466263 - RNA, 14 nt, Pseudomonas aeruginosa PA01
ggccgccaggguca

SEQ ID NO: 3466264 - RNA, 16 nt, Pseudomonas aeruginosa PA01
ggccgccaucgcccgg

SEQ ID NO: 3466265 - RNA, 16 nt, Pseudomonas aeruginosa PA01
ggccgccaugcucggc

SEQ ID NO: 3466266 - RNA, 19 nt, Pseudomonas aeruginosa PA01
ggccgccaugcucggccag

SEQ ID NO: 3466267 - RNA, 21 nt, Pseudomonas aeruginosa PA01
ggccgccaugcucggccagcu

SEQ ID NO: 3466268 - RNA, 23 nt, Pseudomonas aeruginosa PA01
ggccgccaugcucggccagcucg

SEQ ID NO: 3466269 - RNA, 13 nt, Pseudomonas aeruginosa PA01
ggccgcccagcgc

SEQ ID NO: 3466270 - RNA, 14 nt, Pseudomonas aeruginosa PA01
ggccgcccagcgca

SEQ ID NO: 3466271 - RNA, 18 nt, Pseudomonas aeruginosa PA01
ggccgcccagcgcagccu

SEQ ID NO: 3466272 - RNA, 20 nt, Pseudomonas aeruginosa PA01
ggccgcccagcgcagccugc

SEQ ID NO: 3466273 - RNA, 23 nt, Pseudomonas aeruginosa PA01
ggccgcccaggacaacgacagcc

SEQ ID NO: 3466274 - RNA, 15 nt, Pseudomonas aeruginosa PA01
ggccgcccgagccgc

SEQ ID NO: 3466275 - RNA, 18 nt, Pseudomonas aeruginosa PA01
ggccgcccgagccgcugc

SEQ ID NO: 3466276 - RNA, 19 nt, Pseudomonas aeruginosa PA01
ggccgcccgagccgcugca

SEQ ID NO: 3466277 - RNA, 15 nt, Pseudomonas aeruginosa PA01
ggccgcccuggccga

SEQ ID NO: 3466278 - RNA, 16 nt, Pseudomonas aeruginosa PA01
ggccgcccuggccgag

SEQ ID NO: 3466279 - RNA, 16 nt, Pseudomonas aeruginosa PA01
ggccgcccuugcggcc

SEQ ID NO: 3466280 - RNA, 17 nt, Pseudomonas aeruginosa PA01
ggccgcccuugcggccc

SEQ ID NO: 3466281 - RNA, 19 nt, Pseudomonas aeruginosa PA01
ggccgcccuugcggcccgc

SEQ ID NO: 3466282 - RNA, 20 nt, Pseudomonas aeruginosa PA01
ggccgccgaaaugcugcagg

SEQ ID NO: 3466283 - RNA, 14 nt, Pseudomonas aeruginosa PA01
ggccgccgaagaac

SEQ ID NO: 3466284 - RNA, 15 nt, Pseudomonas aeruginosa PA01
ggccgccgaggucag

SEQ ID NO: 3466285 - RNA, 17 nt, Pseudomonas aeruginosa PA01
ggccgccgagugugccg

SEQ ID NO: 3466286 - RNA, 17 nt, Pseudomonas aeruginosa PA01
ggccgccgaugccgacg

SEQ ID NO: 3466287 - RNA, 21 nt, Pseudomonas aeruginosa PA01
ggccgccgccgacaggucgcu

SEQ ID NO: 3466288 - RNA, 17 nt, Pseudomonas aeruginosa PA01
ggccgccgccgccgucg

SEQ ID NO: 3466289 - RNA, 19 nt, Pseudomonas aeruginosa PA01
ggccgccgccugcucgccg

SEQ ID NO: 3466290 - RNA, 13 nt, Pseudomonas aeruginosa PA01
ggccgccgcgcag

SEQ ID NO: 3466291 - RNA, 12 nt, Pseudomonas aeruginosa PA01
ggccgccgcggg

SEQ ID NO: 3466292 - RNA, 13 nt, Pseudomonas aeruginosa PA01
ggccgccgcgggc

SEQ ID NO: 3466293 - RNA, 14 nt, Pseudomonas aeruginosa PA01
ggccgccgcgggca

SEQ ID NO: 3466294 - RNA, 15 nt, Pseudomonas aeruginosa PA01
ggccgccgcgugccg

SEQ ID NO: 3466295 - RNA, 16 nt, Pseudomonas aeruginosa PA01
ggccgccgcgugccgc

SEQ ID NO: 3466296 - RNA, 22 nt, Pseudomonas aeruginosa PA01
ggccgccgcgugccgccggacc

SEQ ID NO: 3466297 - RNA, 12 nt, Pseudomonas aeruginosa PA01
ggccgccggcga

SEQ ID NO: 3466298 - RNA, 13 nt, Pseudomonas aeruginosa PA01
ggccgccggcgac

SEQ ID NO: 3466299 - RNA, 14 nt, Pseudomonas aeruginosa PA01
ggccgccggcgacc

SEQ ID NO: 3466300 - RNA, 15 nt, Pseudomonas aeruginosa PA01
ggccgccggcgaccg

SEQ ID NO: 3466301 - RNA, 16 nt, Pseudomonas aeruginosa PA01
ggccgccggcgaccgc

SEQ ID NO: 3466302 - RNA, 15 nt, Pseudomonas aeruginosa PA01
ggccgcugccgcucu

SEQ ID NO: 3466303 - RNA, 18 nt, Pseudomonas aeruginosa PA01
ggccgcugccgcucuggc

SEQ ID NO: 3466304 - RNA, 12 nt, Pseudomonas aeruginosa PA01
ggccgcugccgg

SEQ ID NO: 3466305 - RNA, 14 nt, Pseudomonas aeruginosa PA01
ggccgcugccguug

SEQ ID NO: 3466306 - RNA, 21 nt, Pseudomonas aeruginosa PA01
ggccgcugccguugcaggccc

SEQ ID NO: 3466307 - RNA, 13 nt, Pseudomonas aeruginosa PA01
ggccgcugccugu

SEQ ID NO: 3466308 - RNA, 14 nt, Pseudomonas aeruginosa PA01
ggccgcugcgcagg

SEQ ID NO: 3466309 - RNA, 15 nt, Pseudomonas aeruginosa PA01
ggccgcugcgcaggc

SEQ ID NO: 3466310 - RNA, 18 nt, Pseudomonas aeruginosa PA01
ggccgcugcgcaggccga

SEQ ID NO: 3466311 - RNA, 17 nt, Pseudomonas aeruginosa PA01
ggccgcuggaugccgac

SEQ ID NO: 3466312 - RNA, 12 nt, Pseudomonas aeruginosa PA01
ggccgcuggcga

SEQ ID NO: 3466313 - RNA, 13 nt, Pseudomonas aeruginosa PA01
ggccgcuggcgau

SEQ ID NO: 3466314 - RNA, 13 nt, Pseudomonas aeruginosa PA01
ggccgcuggcggc

SEQ ID NO: 3466315 - RNA, 14 nt, Pseudomonas aeruginosa PA01
ggccgcuggcggcg

SEQ ID NO: 3466316 - RNA, 18 nt, Pseudomonas aeruginosa PA01
ggccgcuggcggcgacga

SEQ ID NO: 3466317 - RNA, 17 nt, Pseudomonas aeruginosa PA01
ggccgcugucgucuucg

SEQ ID NO: 3466318 - RNA, 23 nt, Pseudomonas aeruginosa PA01
ggccgcugucgucuucggccagu

SEQ ID NO: 3466319 - RNA, 18 nt, Pseudomonas aeruginosa PA01
ggccgcuuacgcggccuu

SEQ ID NO: 3466320 - RNA, 18 nt, Pseudomonas aeruginosa PA01
ggccgcuucaagcggcca

SEQ ID NO: 3466321 - RNA, 16 nt, Pseudomonas aeruginosa PA01
ggccgcuuccggcccg

SEQ ID NO: 3466322 - RNA, 21 nt, Pseudomonas aeruginosa PA01
ggccgcuuccggcccggccag

SEQ ID NO: 3466323 - RNA, 22 nt, Pseudomonas aeruginosa PA01
ggccgcuuccggcccggccagg

SEQ ID NO: 3466324 - RNA, 17 nt, Pseudomonas aeruginosa PA01
ggccgcuucgccgcccu

SEQ ID NO: 3466325 - RNA, 17 nt, Pseudomonas aeruginosa PA01
ggccgcuugaagcggcc

SEQ ID NO: 3466326 - RNA, 19 nt, Pseudomonas aeruginosa PA01
ggccgcuugaagcggccau

SEQ ID NO: 3466327 - RNA, 16 nt, Pseudomonas aeruginosa PA01
ggccgcuuuccacccg

SEQ ID NO: 3466328 - RNA, 17 nt, Pseudomonas aeruginosa PA01
ggccgcuuuccacccga

SEQ ID NO: 3466329 - RNA, 21 nt, Pseudomonas aeruginosa PA01
ggccggaacggcuugcugaca

SEQ ID NO: 3466330 - RNA, 22 nt, Pseudomonas aeruginosa PA01
ggccggaacggcuugcugacau

SEQ ID NO: 3466331 - RNA, 22 nt, Pseudomonas aeruginosa PA01
ggccggacaggaaaaagcccgc

SEQ ID NO: 3466332 - RNA, 14 nt, Pseudomonas aeruginosa PA01
ggccggagcaggcc

SEQ ID NO: 3466333 - RNA, 15 nt, Pseudomonas aeruginosa PA01
ggccggagcaggcca

SEQ ID NO: 3466334 - RNA, 14 nt, Pseudomonas aeruginosa PA01
ggccggaucggccu

SEQ ID NO: 3466335 - RNA, 20 nt, Pseudomonas aeruginosa PA01
ggccggaucggccuuggcga

SEQ ID NO: 3466336 - RNA, 16 nt, Pseudomonas aeruginosa PA01
ggccggauuggccgag

SEQ ID NO: 3466337 - RNA, 17 nt, Pseudomonas aeruginosa PA01
ggccggauuggccgagg

SEQ ID NO: 3466338 - RNA, 14 nt, Pseudomonas aeruginosa PA01
ggccggcaacgaac

SEQ ID NO: 3466339 - RNA, 22 nt, Pseudomonas aeruginosa PA01
ggccggcaacgaacuucagggc

SEQ ID NO: 3466340 - RNA, 14 nt, Pseudomonas aeruginosa PA01
ggccggcaccagca

SEQ ID NO: 3466341 - RNA, 14 nt, Pseudomonas aeruginosa PA01
ggccggcagcagcg

SEQ ID NO: 3466342 - RNA, 17 nt, Pseudomonas aeruginosa PA01
ggccggcagcagcgcca

SEQ ID NO: 3466343 - RNA, 18 nt, Pseudomonas aeruginosa PA01
ggccggcagcagcgccag

SEQ ID NO: 3466344 - RNA, 15 nt, Pseudomonas aeruginosa PA01
ggccggcagcgagcg

SEQ ID NO: 3466345 - RNA, 17 nt, Pseudomonas aeruginosa PA01
ggccggcagcgagcggg

SEQ ID NO: 3466346 - RNA, 18 nt, Pseudomonas aeruginosa PA01
ggccggcagcgagcgggu

SEQ ID NO: 3466347 - RNA, 23 nt, Pseudomonas aeruginosa PA01
ggccggcagcgagcgggucagca

SEQ ID NO: 3466348 - RNA, 13 nt, Pseudomonas aeruginosa PA01
ggccggcagcucc

SEQ ID NO: 3466349 - RNA, 15 nt, Pseudomonas aeruginosa PA01
ggccggcagcuccgg

SEQ ID NO: 3466350 - RNA, 16 nt, Pseudomonas aeruginosa PA01
ggccggcagcuccggc

SEQ ID NO: 3466351 - RNA, 21 nt, Pseudomonas aeruginosa PA01
ggccggcaggaggaucgcggc

SEQ ID NO: 3466352 - RNA, 14 nt, Pseudomonas aeruginosa PA01
ggccggcaggccga

SEQ ID NO: 3466353 - RNA, 16 nt, Pseudomonas aeruginosa PA01
ggccggcaggccgaug

SEQ ID NO: 3466354 - RNA, 14 nt, Pseudomonas aeruginosa PA01
ggccggcaggcugu

SEQ ID NO: 3466355 - RNA, 17 nt, Pseudomonas aeruginosa PA01
ggccggcaugcaggugg

SEQ ID NO: 3466356 - RNA, 21 nt, Pseudomonas aeruginosa PA01
ggccggcaugcagguggcgcu

SEQ ID NO: 3466357 - RNA, 18 nt, Pseudomonas aeruginosa PA01
ggccggcaugcucagccg

SEQ ID NO: 3466358 - RNA, 19 nt, Pseudomonas aeruginosa PA01
ggccggccacgcgaccagc

SEQ ID NO: 3466359 - RNA, 22 nt, Pseudomonas aeruginosa PA01
ggccggccacgcgaccagcgcc

SEQ ID NO: 3466360 - RNA, 23 nt, Pseudomonas aeruginosa PA01
ggccggccacgcgaccagcgcca

SEQ ID NO: 3466361 - RNA, 23 nt, Pseudomonas aeruginosa PA01
ggccggccagccuucccggcgcu

SEQ ID NO: 3466362 - RNA, 17 nt, Pseudomonas aeruginosa PA01
ggccggccagggagcgc

SEQ ID NO: 3466363 - RNA, 18 nt, Pseudomonas aeruginosa PA01
ggccggccagggcgaaca

SEQ ID NO: 3466364 - RNA, 17 nt, Pseudomonas aeruginosa PA01
ggccggccccaccagca

SEQ ID NO: 3466365 - RNA, 23 nt, Pseudomonas aeruginosa PA01
ggccggccuccagcgccucgccg

SEQ ID NO: 3466366 - RNA, 17 nt, Pseudomonas aeruginosa PA01
ggccggccucggcggcg

SEQ ID NO: 3466367 - RNA, 12 nt, Pseudomonas aeruginosa PA01
ggccggccuggg

SEQ ID NO: 3466368 - RNA, 15 nt, Pseudomonas aeruginosa PA01
ggccggccugggccc

SEQ ID NO: 3466369 - RNA, 14 nt, Pseudomonas aeruginosa PA01
ggccggcgaagucg

SEQ ID NO: 3466370 - RNA, 14 nt, Pseudomonas aeruginosa PA01
ggccggcgaccagc

SEQ ID NO: 3466371 - RNA, 15 nt, Pseudomonas aeruginosa PA01
ggccggcgaccagcg

SEQ ID NO: 3466372 - RNA, 18 nt, Pseudomonas aeruginosa PA01
ggccggcgaccagcucga

SEQ ID NO: 3466373 - RNA, 17 nt, Pseudomonas aeruginosa PA01
ggccggcgaccuugucc

SEQ ID NO: 3466374 - RNA, 13 nt, Pseudomonas aeruginosa PA01
ggccggcgagggc

SEQ ID NO: 3466375 - RNA, 17 nt, Pseudomonas aeruginosa PA01
ggccggcgagggcggcg

SEQ ID NO: 3466376 - RNA, 20 nt, Pseudomonas aeruginosa PA01
ggccggcgagggcggcgacc

SEQ ID NO: 3466377 - RNA, 14 nt, Pseudomonas aeruginosa PA01
ggccggcgaucagc

SEQ ID NO: 3466378 - RNA, 13 nt, Pseudomonas aeruginosa PA01
ggccggcgaugcg

SEQ ID NO: 3466379 - RNA, 13 nt, Pseudomonas aeruginosa PA01
ggccggcgauggc

SEQ ID NO: 3466380 - RNA, 14 nt, Pseudomonas aeruginosa PA01
ggccggcgauggcc

SEQ ID NO: 3466381 - RNA, 15 nt, Pseudomonas aeruginosa PA01
ggccggcgauggccg

SEQ ID NO: 3466382 - RNA, 17 nt, Pseudomonas aeruginosa PA01
ggccggcgauggccgcc

SEQ ID NO: 3466383 - RNA, 17 nt, Pseudomonas aeruginosa PA01
ggccggcgcaucgucga

SEQ ID NO: 3466384 - RNA, 18 nt, Pseudomonas aeruginosa PA01
ggccggcgcaucgucgaa

SEQ ID NO: 3466385 - RNA, 14 nt, Pseudomonas aeruginosa PA01
ggccggcgccagca

SEQ ID NO: 3466386 - RNA, 15 nt, Pseudomonas aeruginosa PA01
ggccggcgccagcag

SEQ ID NO: 3466387 - RNA, 20 nt, Pseudomonas aeruginosa PA01
ggccggcgcccuucgagaaa

SEQ ID NO: 3466388 - RNA, 11 nt, Pseudomonas aeruginosa PA01
ggccggcgccg

SEQ ID NO: 3466389 - RNA, 14 nt, Pseudomonas aeruginosa PA01
ggccggcgccgaug

SEQ ID NO: 3466390 - RNA, 15 nt, Pseudomonas aeruginosa PA01
ggccggcgccgaugc

SEQ ID NO: 3466391 - RNA, 12 nt, Pseudomonas aeruginosa PA01
ggccggcgccgc

SEQ ID NO: 3466392 - RNA, 13 nt, Pseudomonas aeruginosa PA01
ggccggcgccgcc

SEQ ID NO: 3466393 - RNA, 14 nt, Pseudomonas aeruginosa PA01
ggccggcgccgccg

SEQ ID NO: 3466394 - RNA, 12 nt, Pseudomonas aeruginosa PA01
ggccggcgccuu

SEQ ID NO: 3466395 - RNA, 17 nt, Pseudomonas aeruginosa PA01
ggccggcgccuugcgcc

SEQ ID NO: 3466396 - RNA, 15 nt, Pseudomonas aeruginosa PA01
ggccggcgcgauccu

SEQ ID NO: 3466397 - RNA, 19 nt, Pseudomonas aeruginosa PA01
ggccggcgcgauccuggcg

SEQ ID NO: 3466398 - RNA, 12 nt, Pseudomonas aeruginosa PA01
ggccggcgcgcc

SEQ ID NO: 3466399 - RNA, 13 nt, Pseudomonas aeruginosa PA01
ggccggcgcgccg

SEQ ID NO: 3466400 - RNA, 16 nt, Pseudomonas aeruginosa PA01
ggccggcgcggacggc

SEQ ID NO: 3466401 - RNA, 15 nt, Pseudomonas aeruginosa PA01
ggccggcgcggcgcg

SEQ ID NO: 3466402 - RNA, 22 nt, Pseudomonas aeruginosa PA01
ggccggcgcggcguucaucgcu

SEQ ID NO: 3466403 - RNA, 11 nt, Pseudomonas aeruginosa PA01
ggccggcggcc

SEQ ID NO: 3466404 - RNA, 17 nt, Pseudomonas aeruginosa PA01
ggccggcggccgaggcu

SEQ ID NO: 3466405 - RNA, 13 nt, Pseudomonas aeruginosa PA01
ggccggcggccug

SEQ ID NO: 3466406 - RNA, 15 nt, Pseudomonas aeruginosa PA01
ggccgucggccuggc

SEQ ID NO: 3466407 - RNA, 17 nt, Pseudomonas aeruginosa PA01
ggccgucggccuggcgg

SEQ ID NO: 3466408 - RNA, 18 nt, Pseudomonas aeruginosa PA01
ggccgucggccuggcggu

SEQ ID NO: 3466409 - RNA, 15 nt, Pseudomonas aeruginosa PA01
ggccgucgggcaugg

SEQ ID NO: 3466410 - RNA, 19 nt, Pseudomonas aeruginosa PA01
ggccgucgggcauggcgau

SEQ ID NO: 3466411 - RNA, 23 nt, Pseudomonas aeruginosa PA01
ggccgucguuuuguccggcggcu

SEQ ID NO: 3466412 - RNA, 16 nt, Pseudomonas aeruginosa PA01
ggccgucuccaggcgc

SEQ ID NO: 3466413 - RNA, 18 nt, Pseudomonas aeruginosa PA01
ggccgucuccaggcgcgc

SEQ ID NO: 3466414 - RNA, 17 nt, Pseudomonas aeruginosa PA01
ggccgucuuccagggcg

SEQ ID NO: 3466415 - RNA, 20 nt, Pseudomonas aeruginosa PA01
ggccgucuuccagggcggcg

SEQ ID NO: 3466416 - RNA, 22 nt, Pseudomonas aeruginosa PA01
ggccgucuuccagggcggcgcg

SEQ ID NO: 3466417 - RNA, 15 nt, Pseudomonas aeruginosa PA01
ggccgugcagcccuc

SEQ ID NO: 3466418 - RNA, 20 nt, Pseudomonas aeruginosa PA01
ggccgugcaugccgacgagc

SEQ ID NO: 3466419 - RNA, 23 nt, Pseudomonas aeruginosa PA01
ggccgugcaugccgacgagcagc

SEQ ID NO: 3466420 - RNA, 14 nt, Pseudomonas aeruginosa PA01
ggccgugccagagc

SEQ ID NO: 3466421 - RNA, 20 nt, Pseudomonas aeruginosa PA01
ggccgugccucagagucgca

SEQ ID NO: 3466422 - RNA, 23 nt, Pseudomonas aeruginosa PA01
ggccgugcggagggucaggccga

SEQ ID NO: 3466423 - RNA, 15 nt, Pseudomonas aeruginosa PA01
ggccgugcucgauga

SEQ ID NO: 3466424 - RNA, 19 nt, Pseudomonas aeruginosa PA01
ggccgugcucgaugaucga

SEQ ID NO: 3466425 - RNA, 15 nt, Pseudomonas aeruginosa PA01
ggccguggcgcccca

SEQ ID NO: 3466426 - RNA, 17 nt, Pseudomonas aeruginosa PA01
ggccguggcgccccagg

SEQ ID NO: 3466427 - RNA, 22 nt, Pseudomonas aeruginosa PA01
ggccguggcgccccaggcgggc

SEQ ID NO: 3466428 - RNA, 15 nt, Pseudomonas aeruginosa PA01
ggccgugggccgccg

SEQ ID NO: 3466429 - RNA, 18 nt, Pseudomonas aeruginosa PA01
ggccgugggccgccgaac

SEQ ID NO: 3466430 - RNA, 19 nt, Pseudomonas aeruginosa PA01
ggccgugggccgccgaacg

SEQ ID NO: 3466431 - RNA, 14 nt, Pseudomonas aeruginosa PA01
ggccgugggccggc

SEQ ID NO: 3466432 - RNA, 18 nt, Pseudomonas aeruginosa PA01
ggccguucuccgggucgg

SEQ ID NO: 3466433 - RNA, 19 nt, Pseudomonas aeruginosa PA01
ggccguucucgaagagcug

SEQ ID NO: 3466434 - RNA, 14 nt, Pseudomonas aeruginosa PA01
ggccguugaccagc

SEQ ID NO: 3466435 - RNA, 17 nt, Pseudomonas aeruginosa PA01
ggccguugaccagcgcg

SEQ ID NO: 3466436 - RNA, 19 nt, Pseudomonas aeruginosa PA01
ggccguugaccagcgcguc

SEQ ID NO: 3466437 - RNA, 22 nt, Pseudomonas aeruginosa PA01
ggccguugagcaccucgaccug

SEQ ID NO: 3466438 - RNA, 15 nt, Pseudomonas aeruginosa PA01
ggccguugcgcaggc

SEQ ID NO: 3466439 - RNA, 18 nt, Pseudomonas aeruginosa PA01
ggccguugcgcaggcggu

SEQ ID NO: 3466440 - RNA, 15 nt, Pseudomonas aeruginosa PA01
ggccguugcgggcga

SEQ ID NO: 3466441 - RNA, 15 nt, Pseudomonas aeruginosa PA01
ggccguuggcgaacu

SEQ ID NO: 3466442 - RNA, 16 nt, Pseudomonas aeruginosa PA01
ggccguuggcgaacuu

SEQ ID NO: 3466443 - RNA, 22 nt, Pseudomonas aeruginosa PA01
ggccguuggcgaacuucaggcc

SEQ ID NO: 3466444 - RNA, 14 nt, Pseudomonas aeruginosa PA01
ggccguuguagaga

SEQ ID NO: 3466445 - RNA, 18 nt, Pseudomonas aeruginosa PA01
ggccguuguagagacaga

SEQ ID NO: 3466446 - RNA, 17 nt, Pseudomonas aeruginosa PA01
ggccguuuugccgcucg

SEQ ID NO: 3466447 - RNA, 22 nt, Pseudomonas aeruginosa PA01
ggccguuuuuuaugccgaggcg

SEQ ID NO: 3466448 - RNA, 13 nt, Pseudomonas aeruginosa PA01
ggccuacccgcgc

SEQ ID NO: 3466449 - RNA, 21 nt, Pseudomonas aeruginosa PA01
ggccuacccgcgcuucuucga

SEQ ID NO: 3466450 - RNA, 21 nt, Pseudomonas aeruginosa PA01
ggccuacuucucgacgaaggc

SEQ ID NO: 3466451 - RNA, 17 nt, Pseudomonas aeruginosa PA01
ggccuacuugaucagcc

SEQ ID NO: 3466452 - RNA, 24 nt, Pseudomonas aeruginosa PA01
ggccuacuugaucagccgcaggca

SEQ ID NO: 3466453 - RNA, 14 nt, Pseudomonas aeruginosa PA01
ggccuaggacaccg

SEQ ID NO: 3466454 - RNA, 15 nt, Pseudomonas aeruginosa PA01
ggccucaacgaccgc

SEQ ID NO: 3466455 - RNA, 16 nt, Pseudomonas aeruginosa PA01
ggccucaacgaccgcc

SEQ ID NO: 3466456 - RNA, 21 nt, Pseudomonas aeruginosa PA01
ggccucaacgaccgcccaggc

SEQ ID NO: 3466457 - RNA, 18 nt, Pseudomonas aeruginosa PA01
ggccucaggccuggcgca

SEQ ID NO: 3466458 - RNA, 14 nt, Pseudomonas aeruginosa PA01
ggccucagggcgcg

SEQ ID NO: 3466459 - RNA, 15 nt, Pseudomonas aeruginosa PA01
ggccucagggcgcga

SEQ ID NO: 3466460 - RNA, 17 nt, Pseudomonas aeruginosa PA01
ggccuccagcaacgccg

SEQ ID NO: 3466461 - RNA, 19 nt, Pseudomonas aeruginosa PA01
ggccuccagcaacgccgcc

SEQ ID NO: 3466462 - RNA, 22 nt, Pseudomonas aeruginosa PA01
ggccuccagcaacgccgccccc

SEQ ID NO: 3466463 - RNA, 14 nt, Pseudomonas aeruginosa PA01
ggccuccagcgccu

SEQ ID NO: 3466464 - RNA, 23 nt, Pseudomonas aeruginosa PA01
ggccuccagcgccucgccgagca

SEQ ID NO: 3466465 - RNA, 22 nt, Pseudomonas aeruginosa PA01
ggccuccaggcuggccuuggcc

SEQ ID NO: 3466466 - RNA, 13 nt, Pseudomonas aeruginosa PA01
ggccucccagccg

SEQ ID NO: 3466467 - RNA, 17 nt, Pseudomonas aeruginosa PA01
ggccuccccggcccgcg

SEQ ID NO: 3466468 - RNA, 17 nt, Pseudomonas aeruginosa PA01
ggccuccggacgcugca

SEQ ID NO: 3466469 - RNA, 19 nt, Pseudomonas aeruginosa PA01
ggccuccggacgcugcaug

SEQ ID NO: 3466470 - RNA, 20 nt, Pseudomonas aeruginosa PA01
ggccuccggacgcugcaugc

SEQ ID NO: 3466471 - RNA, 23 nt, Pseudomonas aeruginosa PA01
ggccuccucguaggcguccuggc

SEQ ID NO: 3466472 - RNA, 15 nt, Pseudomonas aeruginosa PA01
ggccuccuggcggcg

SEQ ID NO: 3466473 - RNA, 21 nt, Pseudomonas aeruginosa PA01
ggccucgacaucgucucgcga

SEQ ID NO: 3466474 - RNA, 19 nt, Pseudomonas aeruginosa PA01
ggccucgacgcagagcgcc

SEQ ID NO: 3466475 - RNA, 12 nt, Pseudomonas aeruginosa PA01
ggccucgagcau

SEQ ID NO: 3466476 - RNA, 20 nt, Pseudomonas aeruginosa PA01
ggccucgaggucggccuggc

SEQ ID NO: 3466477 - RNA, 21 nt, Pseudomonas aeruginosa PA01
ggccucgaggucggccuggcu

SEQ ID NO: 3466478 - RNA, 16 nt, Pseudomonas aeruginosa PA01
ggccucgaugaucgcc

SEQ ID NO: 3466479 - RNA, 13 nt, Pseudomonas aeruginosa PA01
ggccucgauggcg

SEQ ID NO: 3466480 - RNA, 16 nt, Pseudomonas aeruginosa PA01
ggccucgccgaugucg

SEQ ID NO: 3466481 - RNA, 13 nt, Pseudomonas aeruginosa PA01
ggccucgccgguc

SEQ ID NO: 3466482 - RNA, 14 nt, Pseudomonas aeruginosa PA01
ggccucgccggucg

SEQ ID NO: 3466483 - RNA, 15 nt, Pseudomonas aeruginosa PA01
ggccucgcgcaacug

SEQ ID NO: 3466484 - RNA, 14 nt, Pseudomonas aeruginosa PA01
ggccucgcggcgcu

SEQ ID NO: 3466485 - RNA, 16 nt, Pseudomonas aeruginosa PA01
ggccucgcggcgcucg

SEQ ID NO: 3466486 - RNA, 22 nt, Pseudomonas aeruginosa PA01
ggccucgcggguaucgauccag

SEQ ID NO: 3466487 - RNA, 13 nt, Pseudomonas aeruginosa PA01
ggccucgcgugcg

SEQ ID NO: 3466488 - RNA, 15 nt, Pseudomonas aeruginosa PA01
ggccucgcugccgcc

SEQ ID NO: 3466489 - RNA, 16 nt, Pseudomonas aeruginosa PA01
ggccucgcugccgccg

SEQ ID NO: 3466490 - RNA, 19 nt, Pseudomonas aeruginosa PA01
ggccucgcugccgccgcag

SEQ ID NO: 3466491 - RNA, 20 nt, Pseudomonas aeruginosa PA01
ggccucgcugccgccgcaga

SEQ ID NO: 3466492 - RNA, 14 nt, Pseudomonas aeruginosa PA01
ggccucgcugcgca

SEQ ID NO: 3466493 - RNA, 13 nt, Pseudomonas aeruginosa PA01
ggccucgcuggcg

SEQ ID NO: 3466494 - RNA, 15 nt, Pseudomonas aeruginosa PA01
ggccucggccagcgc

SEQ ID NO: 3466495 - RNA, 16 nt, Pseudomonas aeruginosa PA01
ggccucggccagcgcc

SEQ ID NO: 3466496 - RNA, 23 nt, Pseudomonas aeruginosa PA01
ggccucggcccgguuuuccgcuu

SEQ ID NO: 3466497 - RNA, 11 nt, Pseudomonas aeruginosa PA01
ggccucggccu

SEQ ID NO: 3466498 - RNA, 13 nt, Pseudomonas aeruginosa PA01
ggccucggccugg

SEQ ID NO: 3466499 - RNA, 17 nt, Pseudomonas aeruginosa PA01
ggccucggccuggucgu

SEQ ID NO: 3466500 - RNA, 14 nt, Pseudomonas aeruginosa PA01
ggccucggcgcggg

SEQ ID NO: 3466501 - RNA, 18 nt, Pseudomonas aeruginosa PA01
ggccucggcgcgggccuu

SEQ ID NO: 3466502 - RNA, 14 nt, Pseudomonas aeruginosa PA01
ggccucggcggcgc

SEQ ID NO: 3466503 - RNA, 15 nt, Pseudomonas aeruginosa PA01
ggccucggcggcgcg

SEQ ID NO: 3466504 - RNA, 22 nt, Pseudomonas aeruginosa PA01
ggccucggcgucgcgcaggcuu

SEQ ID NO: 3466505 - RNA, 17 nt, Pseudomonas aeruginosa PA01
ggccucggucaggcgcu

SEQ ID NO: 3466506 - RNA, 21 nt, Pseudomonas aeruginosa PA01
ggccucggucagguauucgcc

SEQ ID NO: 3466507 - RNA, 21 nt, Pseudomonas aeruginosa PA01
ggccucguaccuuucuccccu

SEQ ID NO: 3466508 - RNA, 21 nt, Pseudomonas aeruginosa PA01
ggccugggguagccggccgau

SEQ ID NO: 3466509 - RNA, 14 nt, Pseudomonas aeruginosa PA01
ggccuggguacgca

SEQ ID NO: 3466510 - RNA, 19 nt, Pseudomonas aeruginosa PA01
ggccugggucaccagcacc

SEQ ID NO: 3466511 - RNA, 19 nt, Pseudomonas aeruginosa PA01
ggccugggugaacagcggc

SEQ ID NO: 3466512 - RNA, 20 nt, Pseudomonas aeruginosa PA01
ggccugggugaacagcggcc

SEQ ID NO: 3466513 - RNA, 20 nt, Pseudomonas aeruginosa PA01
ggccugguaggcgucgucga

SEQ ID NO: 3466514 - RNA, 19 nt, Pseudomonas aeruginosa PA01
ggccugguagucgccgguc

SEQ ID NO: 3466515 - RNA, 14 nt, Pseudomonas aeruginosa PA01
ggccuggucggcgc

SEQ ID NO: 3466516 - RNA, 13 nt, Pseudomonas aeruginosa PA01
ggccuggugcacg

SEQ ID NO: 3466517 - RNA, 16 nt, Pseudomonas aeruginosa PA01
ggccuggugcacgccg

SEQ ID NO: 3466518 - RNA, 15 nt, Pseudomonas aeruginosa PA01
ggccuggugccgggc

SEQ ID NO: 3466519 - RNA, 15 nt, Pseudomonas aeruginosa PA01
ggccugucacgccgg

SEQ ID NO: 3466520 - RNA, 23 nt, Pseudomonas aeruginosa PA01
ggccugucacgccgggggucgcg

SEQ ID NO: 3466521 - RNA, 20 nt, Pseudomonas aeruginosa PA01
ggccugucgggggcugcgca

SEQ ID NO: 3466522 - RNA, 14 nt, Pseudomonas aeruginosa PA01
ggccuguggauaga

SEQ ID NO: 3466523 - RNA, 16 nt, Pseudomonas aeruginosa PA01
ggccuguggauagaaa

SEQ ID NO: 3466524 - RNA, 14 nt, Pseudomonas aeruginosa PA01
ggccuguucgccca

SEQ ID NO: 3466525 - RNA, 15 nt, Pseudomonas aeruginosa PA01
ggccuguucgcccaa

SEQ ID NO: 3466526 - RNA, 14 nt, Pseudomonas aeruginosa PA01
ggccuguucggccu

SEQ ID NO: 3466527 - RNA, 18 nt, Pseudomonas aeruginosa PA01
ggccuucaccgcgccgcg

SEQ ID NO: 3466528 - RNA, 20 nt, Pseudomonas aeruginosa PA01
ggccuucacgcagcucugcg

SEQ ID NO: 3466529 - RNA, 17 nt, Pseudomonas aeruginosa PA01
ggccuucaggcgcuccu

SEQ ID NO: 3466530 - RNA, 15 nt, Pseudomonas aeruginosa PA01
ggccuucaggcugcg

SEQ ID NO: 3466531 - RNA, 16 nt, Pseudomonas aeruginosa PA01
ggccuucaggcugcgc

SEQ ID NO: 3466532 - RNA, 19 nt, Pseudomonas aeruginosa PA01
ggccuuccacgccuucgcg

SEQ ID NO: 3466533 - RNA, 16 nt, Pseudomonas aeruginosa PA01
ggccuucgacgaugcg

SEQ ID NO: 3466534 - RNA, 15 nt, Pseudomonas aeruginosa PA01
ggccuucgccagcgg

SEQ ID NO: 3466535 - RNA, 18 nt, Pseudomonas aeruginosa PA01
ggccuucgccagcggcca

SEQ ID NO: 3466536 - RNA, 18 nt, Pseudomonas aeruginosa PA01
ggccuucgccgaccaggu

SEQ ID NO: 3466537 - RNA, 13 nt, Pseudomonas aeruginosa PA01
ggccuucgcugaa

SEQ ID NO: 3466538 - RNA, 21 nt, Pseudomonas aeruginosa PA01
ggccuucggcgccggagcugg

SEQ ID NO: 3466539 - RNA, 14 nt, Pseudomonas aeruginosa PA01
ggccuucggcgucg

SEQ ID NO: 3466540 - RNA, 12 nt, Pseudomonas aeruginosa PA01
ggccuucgucgg

SEQ ID NO: 3466541 - RNA, 17 nt, Pseudomonas aeruginosa PA01
ggccuucucgucgccgc

SEQ ID NO: 3466542 - RNA, 18 nt, Pseudomonas aeruginosa PA01
ggccuucucgucgccgcc

SEQ ID NO: 3466543 - RNA, 20 nt, Pseudomonas aeruginosa PA01
ggccuucucgucgccgcccg

SEQ ID NO: 3466544 - RNA, 19 nt, Pseudomonas aeruginosa PA01
ggccuucuugcugccggcg

SEQ ID NO: 3466545 - RNA, 16 nt, Pseudomonas aeruginosa PA01
ggccuugaccaccgcc

SEQ ID NO: 3466546 - RNA, 17 nt, Pseudomonas aeruginosa PA01
ggccuugaccaccgcca

SEQ ID NO: 3466547 - RNA, 20 nt, Pseudomonas aeruginosa PA01
ggccuugaccaccgccaggc

SEQ ID NO: 3466548 - RNA, 21 nt, Pseudomonas aeruginosa PA01
ggccuugaccaccgccaggcu

SEQ ID NO: 3466549 - RNA, 23 nt, Pseudomonas aeruginosa PA01
ggccuugaccaccgccaggcugg

SEQ ID NO: 3466550 - RNA, 16 nt, Pseudomonas aeruginosa PA01
ggccuugacgcgggac

SEQ ID NO: 3466551 - RNA, 20 nt, Pseudomonas aeruginosa PA01
ggccuugagcacgguccgcg

SEQ ID NO: 3466552 - RNA, 12 nt, Pseudomonas aeruginosa PA01
ggccuugagcag

SEQ ID NO: 3466553 - RNA, 14 nt, Pseudomonas aeruginosa PA01
ggccuugagcaggc

SEQ ID NO: 3466554 - RNA, 19 nt, Pseudomonas aeruginosa PA01
ggccuugagcaggcggccg

SEQ ID NO: 3466555 - RNA, 20 nt, Pseudomonas aeruginosa PA01
ggccuugagcaggcggccgu

SEQ ID NO: 3466556 - RNA, 22 nt, Pseudomonas aeruginosa PA01
ggccuugagcaugauggugccg

SEQ ID NO: 3466557 - RNA, 15 nt, Pseudomonas aeruginosa PA01
ggccuugagcgccga

SEQ ID NO: 3466558 - RNA, 20 nt, Pseudomonas aeruginosa PA01
ggccuugagcgccgaaggcg

SEQ ID NO: 3466559 - RNA, 16 nt, Pseudomonas aeruginosa PA01
ggccuugaggcgggcc

SEQ ID NO: 3466560 - RNA, 16 nt, Pseudomonas aeruginosa PA01
ggccuugaucaccacc

SEQ ID NO: 3466561 - RNA, 22 nt, Pseudomonas aeruginosa PA01
ggccuugaucaccaccacgccg

SEQ ID NO: 3466562 - RNA, 17 nt, Pseudomonas aeruginosa PA01
ggccuugaugccggcga

SEQ ID NO: 3466563 - RNA, 13 nt, Pseudomonas aeruginosa PA01
ggccuugcagcaa

SEQ ID NO: 3466564 - RNA, 23 nt, Pseudomonas aeruginosa PA01
ggccuugccguccagccggcgcu

SEQ ID NO: 3466565 - RNA, 13 nt, Pseudomonas aeruginosa PA01
ggccuugccuucg

SEQ ID NO: 3466566 - RNA, 13 nt, Pseudomonas aeruginosa PA01
ggccuugcuggcg

SEQ ID NO: 3466567 - RNA, 18 nt, Pseudomonas aeruginosa PA01
ggccuugcuuugcgccuc

SEQ ID NO: 3466568 - RNA, 13 nt, Pseudomonas aeruginosa PA01
ggccuuggccucc

SEQ ID NO: 3466569 - RNA, 14 nt, Pseudomonas aeruginosa PA01
ggccuuggcgaucu

SEQ ID NO: 3466570 - RNA, 17 nt, Pseudomonas aeruginosa PA01
ggccuuggucucgcggg

SEQ ID NO: 3466571 - RNA, 20 nt, Pseudomonas aeruginosa PA01
ggccuugugacuaucgucga

SEQ ID NO: 3466572 - RNA, 19 nt, Pseudomonas aeruginosa PA01
ggccuugugcgccagcucg

SEQ ID NO: 3466573 - RNA, 22 nt, Pseudomonas aeruginosa PA01
ggccuuuuccguuguggcggcg

SEQ ID NO: 3466574 - RNA, 17 nt, Pseudomonas aeruginosa PA01
ggccuuuucucugcauc

SEQ ID NO: 3466575 - RNA, 22 nt, Pseudomonas aeruginosa PA01
ggccuuuugguuuucgcuccuc

SEQ ID NO: 3466576 - RNA, 15 nt, Pseudomonas aeruginosa PA01
ggccuuuuucauggg

SEQ ID NO: 3466577 - RNA, 19 nt, Pseudomonas aeruginosa PA01
ggccuuuuucaugggugcu

SEQ ID NO: 3466578 - RNA, 21 nt, Pseudomonas aeruginosa PA01
ggccuuuuucaugggugcugu

SEQ ID NO: 3466579 - RNA, 23 nt, Pseudomonas aeruginosa PA01
ggccuuuuucucguucgggcgcu

SEQ ID NO: 3466580 - RNA, 15 nt, Pseudomonas aeruginosa PA01
ggcgaaaccggccag

SEQ ID NO: 3466581 - RNA, 17 nt, Pseudomonas aeruginosa PA01
ggcgaaaccggccagcg

SEQ ID NO: 3466582 - RNA, 18 nt, Pseudomonas aeruginosa PA01
ggcgaaaccggccagcgc

SEQ ID NO: 3466583 - RNA, 17 nt, Pseudomonas aeruginosa PA01
ggcgaaacggcaggcca

SEQ ID NO: 3466584 - RNA, 18 nt, Pseudomonas aeruginosa PA01
ggcgaaacggcaggccag

SEQ ID NO: 3466585 - RNA, 15 nt, Pseudomonas aeruginosa PA01
ggcgaaacggcggau

SEQ ID NO: 3466586 - RNA, 16 nt, Pseudomonas aeruginosa PA01
ggcgaaacguccggcg

SEQ ID NO: 3466587 - RNA, 21 nt, Pseudomonas aeruginosa PA01
ggcgaaagcgguaccgggcca

SEQ ID NO: 3466588 - RNA, 20 nt, Pseudomonas aeruginosa PA01
ggcgaaagucggcgcgacug

SEQ ID NO: 3466589 - RNA, 17 nt, Pseudomonas aeruginosa PA01
ggcgaaauccucgcgca

SEQ ID NO: 3466590 - RNA, 23 nt, Pseudomonas aeruginosa PA01
ggcgaaauccucgcgcaccgccu

SEQ ID NO: 3466591 - RNA, 20 nt, Pseudomonas aeruginosa PA01
ggcgaaaucgagcugcucga

SEQ ID NO: 3466592 - RNA, 18 nt, Pseudomonas aeruginosa PA01
ggcgaaaugcaggccggu

SEQ ID NO: 3466593 - RNA, 23 nt, Pseudomonas aeruginosa PA01
ggcgaaauggguucccagcagca

SEQ ID NO: 3466594 - RNA, 16 nt, Pseudomonas aeruginosa PA01
ggcgaacaacgccgcc

SEQ ID NO: 3466595 - RNA, 17 nt, Pseudomonas aeruginosa PA01
ggcgaacaacgccgccg

SEQ ID NO: 3466596 - RNA, 20 nt, Pseudomonas aeruginosa PA01
ggcgaacaacgccgccggcg

SEQ ID NO: 3466597 - RNA, 17 nt, Pseudomonas aeruginosa PA01
ggcgaacaccgggccgc

SEQ ID NO: 3466598 - RNA, 22 nt, Pseudomonas aeruginosa PA01
ggcgaacaccgggccgccggcg

SEQ ID NO: 3466599 - RNA, 17 nt, Pseudomonas aeruginosa PA01
ggcgaacacgucggcgc

SEQ ID NO: 3466600 - RNA, 19 nt, Pseudomonas aeruginosa PA01
ggcgaacacgucggcgcgc

SEQ ID NO: 3466601 - RNA, 12 nt, Pseudomonas aeruginosa PA01
ggcgaacagcac

SEQ ID NO: 3466602 - RNA, 13 nt, Pseudomonas aeruginosa PA01
ggcgaacagcacc

SEQ ID NO: 3466603 - RNA, 22 nt, Pseudomonas aeruginosa PA01
ggcgaacagcaccuuggccaug

SEQ ID NO: 3466604 - RNA, 12 nt, Pseudomonas aeruginosa PA01
ggcgaacagcca

SEQ ID NO: 3466605 - RNA, 15 nt, Pseudomonas aeruginosa PA01
ggcgaacagccagcg

SEQ ID NO: 3466606 - RNA, 18 nt, Pseudomonas aeruginosa PA01
ggcgaacagccagcgguu

SEQ ID NO: 3466607 - RNA, 14 nt, Pseudomonas aeruginosa PA01
ggcgaacagcgccg

SEQ ID NO: 3466608 - RNA, 15 nt, Pseudomonas aeruginosa PA01
ggcgaacagcgccgc

SEQ ID NO: 3466609 - RNA, 16 nt, Pseudomonas aeruginosa PA01
ggcgaacagcgccgcg

SEQ ID NO: 3466610 - RNA, 18 nt, Pseudomonas aeruginosa PA01
ggcgaauaccagugccgc

SEQ ID NO: 3466611 - RNA, 14 nt, Pseudomonas aeruginosa PA01
ggcgaauagcgccg

SEQ ID NO: 3466612 - RNA, 20 nt, Pseudomonas aeruginosa PA01
ggcgaauagcgccgcaggcg

SEQ ID NO: 3466613 - RNA, 20 nt, Pseudomonas aeruginosa PA01
ggcgaauauccucgucgauc

SEQ ID NO: 3466614 - RNA, 12 nt, Pseudomonas aeruginosa PA01
ggcgaaugccuu

SEQ ID NO: 3466615 - RNA, 23 nt, Pseudomonas aeruginosa PA01
ggcgaauggagggaucgcgcggc

SEQ ID NO: 3466616 - RNA, 15 nt, Pseudomonas aeruginosa PA01
ggcgaauucggggcu

SEQ ID NO: 3466617 - RNA, 14 nt, Pseudomonas aeruginosa PA01
ggcgaauucgucgc

SEQ ID NO: 3466618 - RNA, 16 nt, Pseudomonas aeruginosa PA01
ggcgaauucgucgccg

SEQ ID NO: 3466619 - RNA, 17 nt, Pseudomonas aeruginosa PA01
ggcgaauucgucgccgc

SEQ ID NO: 3466620 - RNA, 18 nt, Pseudomonas aeruginosa PA01
ggcgaauucgucgccgcc

SEQ ID NO: 3466621 - RNA, 22 nt, Pseudomonas aeruginosa PA01
ggcgaauuuccugcuggcgagc

SEQ ID NO: 3466622 - RNA, 17 nt, Pseudomonas aeruginosa PA01
ggcgacaaaucggcauc

SEQ ID NO: 3466623 - RNA, 22 nt, Pseudomonas aeruginosa PA01
ggcgacaaggcugaggccgacg

SEQ ID NO: 3466624 - RNA, 18 nt, Pseudomonas aeruginosa PA01
ggcgacacagacgcagcc

SEQ ID NO: 3466625 - RNA, 19 nt, Pseudomonas aeruginosa PA01
ggcgacaccgccagcaccu

SEQ ID NO: 3466626 - RNA, 22 nt, Pseudomonas aeruginosa PA01
ggcgacagcaccacgccgcugg

SEQ ID NO: 3466627 - RNA, 16 nt, Pseudomonas aeruginosa PA01
ggcgacagccgggcag

SEQ ID NO: 3466628 - RNA, 18 nt, Pseudomonas aeruginosa PA01
ggcgacagcuuccagugc

SEQ ID NO: 3466629 - RNA, 19 nt, Pseudomonas aeruginosa PA01
ggcgacagcuuccagugcu

SEQ ID NO: 3466630 - RNA, 17 nt, Pseudomonas aeruginosa PA01
ggcgacaggcgaucgac

SEQ ID NO: 3466631 - RNA, 22 nt, Pseudomonas aeruginosa PA01
ggcgacauagcggcugcugucg

SEQ ID NO: 3466632 - RNA, 16 nt, Pseudomonas aeruginosa PA01
ggcgaccaacagggcg

SEQ ID NO: 3466633 - RNA, 17 nt, Pseudomonas aeruginosa PA01
ggcgaccaccacgucga

SEQ ID NO: 3466634 - RNA, 20 nt, Pseudomonas aeruginosa PA01
ggcgaccaccacgucgaugc

SEQ ID NO: 3466635 - RNA, 18 nt, Pseudomonas aeruginosa PA01
ggcgaccacccggcgguc

SEQ ID NO: 3466636 - RNA, 21 nt, Pseudomonas aeruginosa PA01
ggcgaccacccggcgguccgc

SEQ ID NO: 3466637 - RNA, 20 nt, Pseudomonas aeruginosa PA01
ggcgaccaccgcgaauccgc

SEQ ID NO: 3466638 - RNA, 13 nt, Pseudomonas aeruginosa PA01
ggcgaccagcccg

SEQ ID NO: 3466639 - RNA, 15 nt, Pseudomonas aeruginosa PA01
ggcgaccagcccgcg

SEQ ID NO: 3466640 - RNA, 13 nt, Pseudomonas aeruginosa PA01
ggcgaccagccgg

SEQ ID NO: 3466641 - RNA, 14 nt, Pseudomonas aeruginosa PA01
ggcgaccagccggg

SEQ ID NO: 3466642 - RNA, 14 nt, Pseudomonas aeruginosa PA01
ggcgaccagcgcgg

SEQ ID NO: 3466643 - RNA, 22 nt, Pseudomonas aeruginosa PA01
ggcgaccagcgcggucucuucg

SEQ ID NO: 3466644 - RNA, 15 nt, Pseudomonas aeruginosa PA01
ggcgaccagcgucgc

SEQ ID NO: 3466645 - RNA, 14 nt, Pseudomonas aeruginosa PA01
ggcgaccagcucga

SEQ ID NO: 3466646 - RNA, 23 nt, Pseudomonas aeruginosa PA01
ggcgaccagcucgaagccgccgu

SEQ ID NO: 3466647 - RNA, 22 nt, Pseudomonas aeruginosa PA01
ggcgaccauguucaccagcgcu

SEQ ID NO: 3466648 - RNA, 22 nt, Pseudomonas aeruginosa PA01
ggcgacccagaccugccgcccg

SEQ ID NO: 3466649 - RNA, 23 nt, Pseudomonas aeruginosa PA01
ggcgacccagaccugccgcccgg

SEQ ID NO: 3466650 - RNA, 14 nt, Pseudomonas aeruginosa PA01
ggcgacccagcgcu

SEQ ID NO: 3466651 - RNA, 23 nt, Pseudomonas aeruginosa PA01
ggcgacccaggccgacagcggcu

SEQ ID NO: 3466652 - RNA, 17 nt, Pseudomonas aeruginosa PA01
ggcgacccgaaggucgc

SEQ ID NO: 3466653 - RNA, 12 nt, Pseudomonas aeruginosa PA01
ggcgacccgccg

SEQ ID NO: 3466654 - RNA, 17 nt, Pseudomonas aeruginosa PA01
ggcgacccgccguucgc

SEQ ID NO: 3466655 - RNA, 22 nt, Pseudomonas aeruginosa PA01
ggcgacccgccguucgcccgcc

SEQ ID NO: 3466656 - RNA, 15 nt, Pseudomonas aeruginosa PA01
ggcgacccggcauua

SEQ ID NO: 3466657 - RNA, 16 nt, Pseudomonas aeruginosa PA01
ggcgacccgggucagg

SEQ ID NO: 3466658 - RNA, 19 nt, Pseudomonas aeruginosa PA01
ggcgacccuggggucgccg

SEQ ID NO: 3466659 - RNA, 16 nt, Pseudomonas aeruginosa PA01
ggcgaccgaacagcgc

SEQ ID NO: 3466660 - RNA, 17 nt, Pseudomonas aeruginosa PA01
ggcgaccgaacagcgcg

SEQ ID NO: 3466661 - RNA, 19 nt, Pseudomonas aeruginosa PA01
ggcgaccgcaucguuggcg

SEQ ID NO: 3466662 - RNA, 19 nt, Pseudomonas aeruginosa PA01
ggcgaccgccaggcggccg

SEQ ID NO: 3466663 - RNA, 20 nt, Pseudomonas aeruginosa PA01
ggcgaccgccaggcggccgc

SEQ ID NO: 3466664 - RNA, 17 nt, Pseudomonas aeruginosa PA01
ggcgaccgcgcgcaugg

SEQ ID NO: 3466665 - RNA, 12 nt, Pseudomonas aeruginosa PA01
ggcgaccgcugg

SEQ ID NO: 3466666 - RNA, 16 nt, Pseudomonas aeruginosa PA01
ggcgaccgcuggacca

SEQ ID NO: 3466667 - RNA, 19 nt, Pseudomonas aeruginosa PA01
ggcgaccggaugcuccagg

SEQ ID NO: 3466668 - RNA, 18 nt, Pseudomonas aeruginosa PA01
ggcgaccucagucgugca

SEQ ID NO: 3466669 - RNA, 22 nt, Pseudomonas aeruginosa PA01
ggcgaccucagucgugcaggug

SEQ ID NO: 3466670 - RNA, 11 nt, Pseudomonas aeruginosa PA01
ggcgaccugcu

SEQ ID NO: 3466671 - RNA, 15 nt, Pseudomonas aeruginosa PA01
ggcgaccugcucgcg

SEQ ID NO: 3466672 - RNA, 16 nt, Pseudomonas aeruginosa PA01
ggcgaccugcucgcgc

SEQ ID NO: 3466673 - RNA, 21 nt, Pseudomonas aeruginosa PA01
ggcgaccugcucgcgcaccgc

SEQ ID NO: 3466674 - RNA, 16 nt, Pseudomonas aeruginosa PA01
ggcgaccugggcgucg

SEQ ID NO: 3466675 - RNA, 14 nt, Pseudomonas aeruginosa PA01
ggcgaccuguucga

SEQ ID NO: 3466676 - RNA, 16 nt, Pseudomonas aeruginosa PA01
ggcgaccuucagcggg

SEQ ID NO: 3466677 - RNA, 22 nt, Pseudomonas aeruginosa PA01
ggcgaccuucagcgggucgagc

SEQ ID NO: 3466678 - RNA, 22 nt, Pseudomonas aeruginosa PA01
ggcgaccuugacgaagccggcg

SEQ ID NO: 3466679 - RNA, 23 nt, Pseudomonas aeruginosa PA01
ggcgaccuugacgaagccggcga

SEQ ID NO: 3466680 - RNA, 24 nt, Pseudomonas aeruginosa PA01
ggcgaccuugacgaagccggcgau

SEQ ID NO: 3466681 - RNA, 19 nt, Pseudomonas aeruginosa PA01
ggcgaccuugcgcaccagg

SEQ ID NO: 3466682 - RNA, 23 nt, Pseudomonas aeruginosa PA01
ggcgaccuugcgcaccagggcca

SEQ ID NO: 3466683 - RNA, 20 nt, Pseudomonas aeruginosa PA01
ggcgaccuuguccaggcgcu

SEQ ID NO: 3466684 - RNA, 23 nt, Pseudomonas aeruginosa PA01
ggcgaccuuguccaggcgcugcu

SEQ ID NO: 3466685 - RNA, 21 nt, Pseudomonas aeruginosa PA01
ggcgaccuuguccugcggccg

SEQ ID NO: 3466686 - RNA, 22 nt, Pseudomonas aeruginosa PA01
ggcgaccuuguccugcggccgg

SEQ ID NO: 3466687 - RNA, 20 nt, Pseudomonas aeruginosa PA01
ggcgaccuugucgauggucu

SEQ ID NO: 3466688 - RNA, 20 nt, Pseudomonas aeruginosa PA01
ggcgacgaaacggcucugcu

SEQ ID NO: 3466689 - RNA, 19 nt, Pseudomonas aeruginosa PA01
ggcgacgaaagacgcugcg

SEQ ID NO: 3466690 - RNA, 20 nt, Pseudomonas aeruginosa PA01
ggcgacgaagacgcugcgca

SEQ ID NO: 3466691 - RNA, 19 nt, Pseudomonas aeruginosa PA01
ggcgacgaagcccaggcug

SEQ ID NO: 3466692 - RNA, 19 nt, Pseudomonas aeruginosa PA01
ggcgacgaagcccucgcga

SEQ ID NO: 3466693 - RNA, 17 nt, Pseudomonas aeruginosa PA01
ggcgacgaagcuggcga

SEQ ID NO: 3466694 - RNA, 16 nt, Pseudomonas aeruginosa PA01
ggcgacgaaggccugg

SEQ ID NO: 3466695 - RNA, 17 nt, Pseudomonas aeruginosa PA01
ggcgacgaaggccuggu

SEQ ID NO: 3466696 - RNA, 16 nt, Pseudomonas aeruginosa PA01
ggcgacgaaggucggc

SEQ ID NO: 3466697 - RNA, 17 nt, Pseudomonas aeruginosa PA01
ggcgacgaaggucggcg

SEQ ID NO: 3466698 - RNA, 23 nt, Pseudomonas aeruginosa PA01
ggcgacgaaggucggcggcagcu

SEQ ID NO: 3466699 - RNA, 21 nt, Pseudomonas aeruginosa PA01
ggcgacgacgaucccggcggu

SEQ ID NO: 3466700 - RNA, 16 nt, Pseudomonas aeruginosa PA01
ggcgacgacgggagcg

SEQ ID NO: 3466701 - RNA, 22 nt, Pseudomonas aeruginosa PA01
ggcgacgacgggagcgcgaggc

SEQ ID NO: 3466702 - RNA, 11 nt, Pseudomonas aeruginosa PA01
ggcgacgagga

SEQ ID NO: 3466703 - RNA, 11 nt, Pseudomonas aeruginosa PA01
ggcgacgauca

SEQ ID NO: 3466704 - RNA, 13 nt, Pseudomonas aeruginosa PA01
ggcgacgaucagc

SEQ ID NO: 3466705 - RNA, 14 nt, Pseudomonas aeruginosa PA01
ggcgacgaucagcc

SEQ ID NO: 3466706 - RNA, 17 nt, Pseudomonas aeruginosa PA01
ggcgacgaucagcccgc

SEQ ID NO: 3466707 - RNA, 18 nt, Pseudomonas aeruginosa PA01
ggcgacgaugccgccgcc

SEQ ID NO: 3466708 - RNA, 12 nt, Pseudomonas aeruginosa PA01
ggcgacgaugcg

SEQ ID NO: 3466709 - RNA, 16 nt, Pseudomonas aeruginosa PA01
ggcgacgaugcgcccc

SEQ ID NO: 3466710 - RNA, 22 nt, Pseudomonas aeruginosa PA01
ggcgacgaugcgccccagcgcc

SEQ ID NO: 3466711 - RNA, 23 nt, Pseudomonas aeruginosa PA01
ggcgacgaugcgccccagcgccu

SEQ ID NO: 3466712 - RNA, 14 nt, Pseudomonas aeruginosa PA01
ggcgaggcgcgccu

SEQ ID NO: 3466713 - RNA, 15 nt, Pseudomonas aeruginosa PA01
ggcgaggcgcgccug

SEQ ID NO: 3466714 - RNA, 16 nt, Pseudomonas aeruginosa PA01
ggcgaggcgcgccugg

SEQ ID NO: 3466715 - RNA, 16 nt, Pseudomonas aeruginosa PA01
ggcgaggcgcucgacg

SEQ ID NO: 3466716 - RNA, 19 nt, Pseudomonas aeruginosa PA01
ggcgaggcuaacgccgagg

SEQ ID NO: 3466717 - RNA, 16 nt, Pseudomonas aeruginosa PA01
ggcgagggcggcgacc

SEQ ID NO: 3466718 - RNA, 19 nt, Pseudomonas aeruginosa PA01
ggcgagggcggcgaccugg

SEQ ID NO: 3466719 - RNA, 17 nt, Pseudomonas aeruginosa PA01
ggcgagggcggcgcggg

SEQ ID NO: 3466720 - RNA, 21 nt, Pseudomonas aeruginosa PA01
ggcgagggcggcgcgggcgcg

SEQ ID NO: 3466721 - RNA, 16 nt, Pseudomonas aeruginosa PA01
ggcgaggguggcgccc

SEQ ID NO: 3466722 - RNA, 14 nt, Pseudomonas aeruginosa PA01
ggcgaggucgccgg

SEQ ID NO: 3466723 - RNA, 16 nt, Pseudomonas aeruginosa PA01
ggcgaggucggccugc

SEQ ID NO: 3466724 - RNA, 17 nt, Pseudomonas aeruginosa PA01
ggcgaggucggccugcg

SEQ ID NO: 3466725 - RNA, 18 nt, Pseudomonas aeruginosa PA01
ggcgaggugaucgagggc

SEQ ID NO: 3466726 - RNA, 21 nt, Pseudomonas aeruginosa PA01
ggcgaggugaucgagggccac

SEQ ID NO: 3466727 - RNA, 16 nt, Pseudomonas aeruginosa PA01
ggcgagguugcccacg

SEQ ID NO: 3466728 - RNA, 21 nt, Pseudomonas aeruginosa PA01
ggcgagguugcccacggccag

SEQ ID NO: 3466729 - RNA, 22 nt, Pseudomonas aeruginosa PA01
ggcgaguaaccaccgcucucga

SEQ ID NO: 3466730 - RNA, 22 nt, Pseudomonas aeruginosa PA01
ggcgaguaccaccgugcccgcc

SEQ ID NO: 3466731 - RNA, 15 nt, Pseudomonas aeruginosa PA01
ggcgagucgaucagg

SEQ ID NO: 3466732 - RNA, 16 nt, Pseudomonas aeruginosa PA01
ggcgaguuccauuugu

SEQ ID NO: 3466733 - RNA, 16 nt, Pseudomonas aeruginosa PA01
ggcgaguucgcgcagg

SEQ ID NO: 3466734 - RNA, 19 nt, Pseudomonas aeruginosa PA01
ggcgaguucggcgagcagg

SEQ ID NO: 3466735 - RNA, 14 nt, Pseudomonas aeruginosa PA01
ggcgaguucggcgu

SEQ ID NO: 3466736 - RNA, 20 nt, Pseudomonas aeruginosa PA01
ggcgaguuuguugcgcgagg

SEQ ID NO: 3466737 - RNA, 22 nt, Pseudomonas aeruginosa PA01
ggcgauacccaggccgucgagg

SEQ ID NO: 3466738 - RNA, 15 nt, Pseudomonas aeruginosa PA01
ggcgauacgcggccc

SEQ ID NO: 3466739 - RNA, 13 nt, Pseudomonas aeruginosa PA01
ggcgauagccgac

SEQ ID NO: 3466740 - RNA, 14 nt, Pseudomonas aeruginosa PA01
ggcgauagccgacc

SEQ ID NO: 3466741 - RNA, 14 nt, Pseudomonas aeruginosa PA01
ggcgauaggcgcgc

SEQ ID NO: 3466742 - RNA, 15 nt, Pseudomonas aeruginosa PA01
ggcgauaggcgcgca

SEQ ID NO: 3466743 - RNA, 18 nt, Pseudomonas aeruginosa PA01
ggcgauaucccgccgccg

SEQ ID NO: 3466744 - RNA, 23 nt, Pseudomonas aeruginosa PA01
ggcgauaucccgccgccgcgccu

SEQ ID NO: 3466745 - RNA, 15 nt, Pseudomonas aeruginosa PA01
ggcgauauggccgau

SEQ ID NO: 3466746 - RNA, 18 nt, Pseudomonas aeruginosa PA01
ggcgaucaccagggugcg

SEQ ID NO: 3466747 - RNA, 20 nt, Pseudomonas aeruginosa PA01
ggcgaucaccagggugcgcu

SEQ ID NO: 3466748 - RNA, 23 nt, Pseudomonas aeruginosa PA01
ggcgaucaccagggugcgcucgu

SEQ ID NO: 3466749 - RNA, 21 nt, Pseudomonas aeruginosa PA01
ggcgaucacccggcgaagcuc

SEQ ID NO: 3466750 - RNA, 16 nt, Pseudomonas aeruginosa PA01
ggcgaucacggcgccc

SEQ ID NO: 3466751 - RNA, 17 nt, Pseudomonas aeruginosa PA01
ggcgaucacggcgcccc

SEQ ID NO: 3466752 - RNA, 18 nt, Pseudomonas aeruginosa PA01
ggcgaucacggcgccccg

SEQ ID NO: 3466753 - RNA, 17 nt, Pseudomonas aeruginosa PA01
ggcgaucagaacgaugc

SEQ ID NO: 3466754 - RNA, 12 nt, Pseudomonas aeruginosa PA01
ggcgaucagcga

SEQ ID NO: 3466755 - RNA, 12 nt, Pseudomonas aeruginosa PA01
ggcgaucagcgg

SEQ ID NO: 3466756 - RNA, 15 nt, Pseudomonas aeruginosa PA01
ggcgaucagcgggcg

SEQ ID NO: 3466757 - RNA, 13 nt, Pseudomonas aeruginosa PA01
ggcgaucaggcag

SEQ ID NO: 3466758 - RNA, 15 nt, Pseudomonas aeruginosa PA01
ggcgaucaggcagcg

SEQ ID NO: 3466759 - RNA, 16 nt, Pseudomonas aeruginosa PA01
ggcgaucaggcagcgc

SEQ ID NO: 3466760 - RNA, 18 nt, Pseudomonas aeruginosa PA01
ggcgaucaggcagcgcgc

SEQ ID NO: 3466761 - RNA, 20 nt, Pseudomonas aeruginosa PA01
ggcgaucaggcagcgcgcgg

SEQ ID NO: 3466762 - RNA, 21 nt, Pseudomonas aeruginosa PA01
ggcgaucaggcagcgcgcggc

SEQ ID NO: 3466763 - RNA, 23 nt, Pseudomonas aeruginosa PA01
ggcgaucaggcagcgcgcggcca

SEQ ID NO: 3466764 - RNA, 15 nt, Pseudomonas aeruginosa PA01
ggcgaucaggccaag

SEQ ID NO: 3466765 - RNA, 17 nt, Pseudomonas aeruginosa PA01
ggcgaucaggccaagcu

SEQ ID NO: 3466766 - RNA, 15 nt, Pseudomonas aeruginosa PA01
ggcgaucauccagcc

SEQ ID NO: 3466767 - RNA, 17 nt, Pseudomonas aeruginosa PA01
ggcgaucaucgccaccg

SEQ ID NO: 3466768 - RNA, 13 nt, Pseudomonas aeruginosa PA01
ggcgaucaucgcg

SEQ ID NO: 3466769 - RNA, 15 nt, Pseudomonas aeruginosa PA01
ggcgaucaucgcgca

SEQ ID NO: 3466770 - RNA, 17 nt, Pseudomonas aeruginosa PA01
ggcgauccacagcaggu

SEQ ID NO: 3466771 - RNA, 22 nt, Pseudomonas aeruginosa PA01
ggcgauccacagcagguugcug

SEQ ID NO: 3466772 - RNA, 19 nt, Pseudomonas aeruginosa PA01
ggcgauccagaagaucagc

SEQ ID NO: 3466773 - RNA, 22 nt, Pseudomonas aeruginosa PA01
ggcgauccagaagaucagcgcg

SEQ ID NO: 3466774 - RNA, 13 nt, Pseudomonas aeruginosa PA01
ggcgaucccggcg

SEQ ID NO: 3466775 - RNA, 14 nt, Pseudomonas aeruginosa PA01
ggcgaucccggcgu

SEQ ID NO: 3466776 - RNA, 22 nt, Pseudomonas aeruginosa PA01
ggcgaucccguagaccggcucc

SEQ ID NO: 3466777 - RNA, 13 nt, Pseudomonas aeruginosa PA01
ggcgauccgcccg

SEQ ID NO: 3466778 - RNA, 20 nt, Pseudomonas aeruginosa PA01
ggcgauccgcccgcaugcca

SEQ ID NO: 3466779 - RNA, 13 nt, Pseudomonas aeruginosa PA01
ggcgauccgcgca

SEQ ID NO: 3466780 - RNA, 12 nt, Pseudomonas aeruginosa PA01
ggcgauccgcug

SEQ ID NO: 3466781 - RNA, 18 nt, Pseudomonas aeruginosa PA01
ggcgaucgaaggaucgcc

SEQ ID NO: 3466782 - RNA, 19 nt, Pseudomonas aeruginosa PA01
ggcgaucgaaggaucgccu

SEQ ID NO: 3466783 - RNA, 14 nt, Pseudomonas aeruginosa PA01
ggcgaucgaccugc

SEQ ID NO: 3466784 - RNA, 13 nt, Pseudomonas aeruginosa PA01
ggcgaucgacgcc

SEQ ID NO: 3466785 - RNA, 20 nt, Pseudomonas aeruginosa PA01
ggcgaucgacgccucggcgc

SEQ ID NO: 3466786 - RNA, 15 nt, Pseudomonas aeruginosa PA01
ggcgaucgagcuguc

SEQ ID NO: 3466787 - RNA, 13 nt, Pseudomonas aeruginosa PA01
ggcgaucgccagg

SEQ ID NO: 3466788 - RNA, 15 nt, Pseudomonas aeruginosa PA01
ggcgaucgccaggcg

SEQ ID NO: 3466789 - RNA, 14 nt, Pseudomonas aeruginosa PA01
ggcgaucgccaguu

SEQ ID NO: 3466790 - RNA, 13 nt, Pseudomonas aeruginosa PA01
ggcgaucgccccg

SEQ ID NO: 3466791 - RNA, 14 nt, Pseudomonas aeruginosa PA01
ggcgaucgccgcgg

SEQ ID NO: 3466792 - RNA, 15 nt, Pseudomonas aeruginosa PA01
ggcgaucgccgcggc

SEQ ID NO: 3466793 - RNA, 16 nt, Pseudomonas aeruginosa PA01
ggcgaucgccgcggcg

SEQ ID NO: 3466794 - RNA, 17 nt, Pseudomonas aeruginosa PA01
ggcgaucgccgcggcga

SEQ ID NO: 3466795 - RNA, 22 nt, Pseudomonas aeruginosa PA01
ggcgaucgccggguugccgcug

SEQ ID NO: 3466796 - RNA, 13 nt, Pseudomonas aeruginosa PA01
ggcgaucgccugg

SEQ ID NO: 3466797 - RNA, 19 nt, Pseudomonas aeruginosa PA01
ggcgaucggguagagcgcg

SEQ ID NO: 3466798 - RNA, 21 nt, Pseudomonas aeruginosa PA01
ggcgaucggguagagcgcggc

SEQ ID NO: 3466799 - RNA, 22 nt, Pseudomonas aeruginosa PA01
ggcgaucggguagagcgcggcg

SEQ ID NO: 3466800 - RNA, 24 nt, Pseudomonas aeruginosa PA01
ggcgaucggguagagcgcggcgca

SEQ ID NO: 3466801 - RNA, 16 nt, Pseudomonas aeruginosa PA01
ggcgaucuccgccagg

SEQ ID NO: 3466802 - RNA, 22 nt, Pseudomonas aeruginosa PA01
ggcgaucuccgccaggcggccg

SEQ ID NO: 3466803 - RNA, 23 nt, Pseudomonas aeruginosa PA01
ggcgaucuccgccaggcggccga

SEQ ID NO: 3466804 - RNA, 17 nt, Pseudomonas aeruginosa PA01
ggcgaucuccgggagca

SEQ ID NO: 3466805 - RNA, 19 nt, Pseudomonas aeruginosa PA01
ggcgaucuccucgauccgc

SEQ ID NO: 3466806 - RNA, 15 nt, Pseudomonas aeruginosa PA01
ggcgaucucggcgcg

SEQ ID NO: 3466807 - RNA, 16 nt, Pseudomonas aeruginosa PA01
ggcgaucucggcgcgg

SEQ ID NO: 3466808 - RNA, 17 nt, Pseudomonas aeruginosa PA01
ggcgaucucggcgcggg

SEQ ID NO: 3466809 - RNA, 18 nt, Pseudomonas aeruginosa PA01
ggcgaucucggcgcgggc

SEQ ID NO: 3466810 - RNA, 22 nt, Pseudomonas aeruginosa PA01
ggcgaucucggcgcgggcaugg

SEQ ID NO: 3466811 - RNA, 13 nt, Pseudomonas aeruginosa PA01
ggcgaucuggcga

SEQ ID NO: 3466812 - RNA, 17 nt, Pseudomonas aeruginosa PA01
ggcgaucugugcgagcg

SEQ ID NO: 3466813 - RNA, 21 nt, Pseudomonas aeruginosa PA01
ggcgaucugugcgagcgcgug

SEQ ID NO: 3466814 - RNA, 23 nt, Pseudomonas aeruginosa PA01
ggcgaucuucagguaggcgcggg

SEQ ID NO: 3466815 - RNA, 19 nt, Pseudomonas aeruginosa PA01
ggcgcaauacaccgcugcg

SEQ ID NO: 3466816 - RNA, 22 nt, Pseudomonas aeruginosa PA01
ggcgcaauacaccgcugcgccg

SEQ ID NO: 3466817 - RNA, 18 nt, Pseudomonas aeruginosa PA01
ggcgcaaucagggcuggg

SEQ ID NO: 3466818 - RNA, 17 nt, Pseudomonas aeruginosa PA01
ggcgcaauugcaccgcu

SEQ ID NO: 3466819 - RNA, 13 nt, Pseudomonas aeruginosa PA01
ggcgcaccagcag

SEQ ID NO: 3466820 - RNA, 13 nt, Pseudomonas aeruginosa PA01
ggcgcaccaggcc

SEQ ID NO: 3466821 - RNA, 16 nt, Pseudomonas aeruginosa PA01
ggcgcaccaggccagg

SEQ ID NO: 3466822 - RNA, 17 nt, Pseudomonas aeruginosa PA01
ggcgcaccaggccaggc

SEQ ID NO: 3466823 - RNA, 20 nt, Pseudomonas aeruginosa PA01
ggcgcaccaggccaggcugc

SEQ ID NO: 3466824 - RNA, 16 nt, Pseudomonas aeruginosa PA01
ggcgcaccgacgccgc

SEQ ID NO: 3466825 - RNA, 17 nt, Pseudomonas aeruginosa PA01
ggcgcaccgacgccgcc

SEQ ID NO: 3466826 - RNA, 20 nt, Pseudomonas aeruginosa PA01
ggcgcaccgacgccgccugc

SEQ ID NO: 3466827 - RNA, 16 nt, Pseudomonas aeruginosa PA01
ggcgcaccgccucgac

SEQ ID NO: 3466828 - RNA, 15 nt, Pseudomonas aeruginosa PA01
ggcgcaccuccucgg

SEQ ID NO: 3466829 - RNA, 13 nt, Pseudomonas aeruginosa PA01
ggcgcaccuggcg

SEQ ID NO: 3466830 - RNA, 15 nt, Pseudomonas aeruginosa PA01
ggcgcaccuggcggu

SEQ ID NO: 3466831 - RNA, 13 nt, Pseudomonas aeruginosa PA01
ggcgcacgccggc

SEQ ID NO: 3466832 - RNA, 15 nt, Pseudomonas aeruginosa PA01
ggcgcacgccggccu

SEQ ID NO: 3466833 - RNA, 16 nt, Pseudomonas aeruginosa PA01
ggcgcacgccggccuc

SEQ ID NO: 3466834 - RNA, 18 nt, Pseudomonas aeruginosa PA01
ggcgcacgccggccucgc

SEQ ID NO: 3466835 - RNA, 12 nt, Pseudomonas aeruginosa PA01
ggcgcacgcgca

SEQ ID NO: 3466836 - RNA, 23 nt, Pseudomonas aeruginosa PA01
ggcgcacugagggucagccgcag

SEQ ID NO: 3466837 - RNA, 17 nt, Pseudomonas aeruginosa PA01
ggcgcacugccaggagc

SEQ ID NO: 3466838 - RNA, 23 nt, Pseudomonas aeruginosa PA01
ggcgcacugccaggagcacgccg

SEQ ID NO: 3466839 - RNA, 15 nt, Pseudomonas aeruginosa PA01
ggcgcacugcguggg

SEQ ID NO: 3466840 - RNA, 14 nt, Pseudomonas aeruginosa PA01
ggcgcagacaggcc

SEQ ID NO: 3466841 - RNA, 16 nt, Pseudomonas aeruginosa PA01
ggcgcagacaggccuc

SEQ ID NO: 3466842 - RNA, 20 nt, Pseudomonas aeruginosa PA01
ggcgcagacaggccuccagc

SEQ ID NO: 3466843 - RNA, 17 nt, Pseudomonas aeruginosa PA01
ggcgcagacgaucuccu

SEQ ID NO: 3466844 - RNA, 20 nt, Pseudomonas aeruginosa PA01
ggcgcagacgucuuccggga

SEQ ID NO: 3466845 - RNA, 12 nt, Pseudomonas aeruginosa PA01
ggcgcagcagca

SEQ ID NO: 3466846 - RNA, 22 nt, Pseudomonas aeruginosa PA01
ggcgcagcagcagguugacccc

SEQ ID NO: 3466847 - RNA, 16 nt, Pseudomonas aeruginosa PA01
ggcgcagcagcgacuc

SEQ ID NO: 3466848 - RNA, 21 nt, Pseudomonas aeruginosa PA01
ggcgcagcagcgacucgcugg

SEQ ID NO: 3466849 - RNA, 22 nt, Pseudomonas aeruginosa PA01
ggcgcagcagcgacucgcuggg

SEQ ID NO: 3466850 - RNA, 15 nt, Pseudomonas aeruginosa PA01
ggcgcagcagcgcca

SEQ ID NO: 3466851 - RNA, 16 nt, Pseudomonas aeruginosa PA01
ggcgcagcagcgccag

SEQ ID NO: 3466852 - RNA, 12 nt, Pseudomonas aeruginosa PA01
ggcgcagcagga

SEQ ID NO: 3466853 - RNA, 13 nt, Pseudomonas aeruginosa PA01
ggcgcagcaggau

SEQ ID NO: 3466854 - RNA, 14 nt, Pseudomonas aeruginosa PA01
ggcgcagcagggcg

SEQ ID NO: 3466855 - RNA, 19 nt, Pseudomonas aeruginosa PA01
ggcgcagcagggcgucggc

SEQ ID NO: 3466856 - RNA, 20 nt, Pseudomonas aeruginosa PA01
ggcgcagcagggcgucggcg

SEQ ID NO: 3466857 - RNA, 23 nt, Pseudomonas aeruginosa PA01
ggcgcagcaucaucuccgcggag

SEQ ID NO: 3466858 - RNA, 20 nt, Pseudomonas aeruginosa PA01
ggcgcagccagagcuccagg

SEQ ID NO: 3466859 - RNA, 14 nt, Pseudomonas aeruginosa PA01
ggcgcagccagcac

SEQ ID NO: 3466860 - RNA, 13 nt, Pseudomonas aeruginosa PA01
ggcgcagcccagc

SEQ ID NO: 3466861 - RNA, 19 nt, Pseudomonas aeruginosa PA01
ggcgcagcccagccgcucg

SEQ ID NO: 3466862 - RNA, 19 nt, Pseudomonas aeruginosa PA01
ggcgcagcccuugcaaccg

SEQ ID NO: 3466863 - RNA, 20 nt, Pseudomonas aeruginosa PA01
ggcgcagccgcaaggccagg

SEQ ID NO: 3466864 - RNA, 22 nt, Pseudomonas aeruginosa PA01
ggcgcagccgcaaggccagggc

SEQ ID NO: 3466865 - RNA, 13 nt, Pseudomonas aeruginosa PA01
ggcgcagccgcug

SEQ ID NO: 3466866 - RNA, 16 nt, Pseudomonas aeruginosa PA01
ggcgcagccgcugcug

SEQ ID NO: 3466867 - RNA, 13 nt, Pseudomonas aeruginosa PA01
ggcgcagcggcag

SEQ ID NO: 3466868 - RNA, 21 nt, Pseudomonas aeruginosa PA01
ggcgcagcggcagcgccaggu

SEQ ID NO: 3466869 - RNA, 23 nt, Pseudomonas aeruginosa PA01
ggcgcagcggcgaacccucggug

SEQ ID NO: 3466870 - RNA, 13 nt, Pseudomonas aeruginosa PA01
ggcgcagcggguc

SEQ ID NO: 3466871 - RNA, 13 nt, Pseudomonas aeruginosa PA01
ggcgcagcguccu

SEQ ID NO: 3466872 - RNA, 19 nt, Pseudomonas aeruginosa PA01
ggcgcagcguccugcccuc

SEQ ID NO: 3466873 - RNA, 14 nt, Pseudomonas aeruginosa PA01
ggcgcagcuucucc

SEQ ID NO: 3466874 - RNA, 14 nt, Pseudomonas aeruginosa PA01
ggcgcaggaccgcc

SEQ ID NO: 3466875 - RNA, 20 nt, Pseudomonas aeruginosa PA01
ggcgcaggaccgccauggcg

SEQ ID NO: 3466876 - RNA, 22 nt, Pseudomonas aeruginosa PA01
ggcgcaggaccgccauggcgcu

SEQ ID NO: 3466877 - RNA, 11 nt, Pseudomonas aeruginosa PA01
ggcgcaggcau

SEQ ID NO: 3466878 - RNA, 13 nt, Pseudomonas aeruginosa PA01
ggcgcaggcaugg

SEQ ID NO: 3466879 - RNA, 15 nt, Pseudomonas aeruginosa PA01
ggcgcaggcauggau

SEQ ID NO: 3466880 - RNA, 15 nt, Pseudomonas aeruginosa PA01
ggcgcaggccgaggu

SEQ ID NO: 3466881 - RNA, 12 nt, Pseudomonas aeruginosa PA01
ggcgcaggccgg

SEQ ID NO: 3466882 - RNA, 13 nt, Pseudomonas aeruginosa PA01
ggcgcaggccggg

SEQ ID NO: 3466883 - RNA, 13 nt, Pseudomonas aeruginosa PA01
ggcgcaggccuuc

SEQ ID NO: 3466884 - RNA, 15 nt, Pseudomonas aeruginosa PA01
ggcgcaggcgaacug

SEQ ID NO: 3466885 - RNA, 18 nt, Pseudomonas aeruginosa PA01
ggcgcaggcgaacugccg

SEQ ID NO: 3466886 - RNA, 21 nt, Pseudomonas aeruginosa PA01
ggcgcaggcgaacugccgacg

SEQ ID NO: 3466887 - RNA, 20 nt, Pseudomonas aeruginosa PA01
ggcgcaggcgaggauggccg

SEQ ID NO: 3466888 - RNA, 12 nt, Pseudomonas aeruginosa PA01
ggcgcaggcgau

SEQ ID NO: 3466889 - RNA, 20 nt, Pseudomonas aeruginosa PA01
ggcgcaggcgaugaucagcc

SEQ ID NO: 3466890 - RNA, 21 nt, Pseudomonas aeruginosa PA01
ggcgcaggcgaugaucagccc

SEQ ID NO: 3466891 - RNA, 16 nt, Pseudomonas aeruginosa PA01
ggcgcaggcggaucgc

SEQ ID NO: 3466892 - RNA, 12 nt, Pseudomonas aeruginosa PA01
ggcgcaggcggc

SEQ ID NO: 3466893 - RNA, 14 nt, Pseudomonas aeruginosa PA01
ggcgcaggcggcgc

SEQ ID NO: 3466894 - RNA, 12 nt, Pseudomonas aeruginosa PA01
ggcgcaggcugu

SEQ ID NO: 3466895 - RNA, 20 nt, Pseudomonas aeruginosa PA01
ggcgcaggcugucggccagc

SEQ ID NO: 3466896 - RNA, 22 nt, Pseudomonas aeruginosa PA01
ggcgcaggcugucggccagccc

SEQ ID NO: 3466897 - RNA, 22 nt, Pseudomonas aeruginosa PA01
ggcgcaggcuuggucagggucg

SEQ ID NO: 3466898 - RNA, 16 nt, Pseudomonas aeruginosa PA01
ggcgcagggagaacgc

SEQ ID NO: 3466899 - RNA, 19 nt, Pseudomonas aeruginosa PA01
ggcgcagggcguucuucac

SEQ ID NO: 3466900 - RNA, 24 nt, Pseudomonas aeruginosa PA01
ggcgcaggggcgagagacugaacu

SEQ ID NO: 3466901 - RNA, 16 nt, Pseudomonas aeruginosa PA01
ggcgcaggggcgcgcc

SEQ ID NO: 3466902 - RNA, 12 nt, Pseudomonas aeruginosa PA01
ggcgcagguaga

SEQ ID NO: 3466903 - RNA, 23 nt, Pseudomonas aeruginosa PA01
ggcgcagguagaaggugcccagc

SEQ ID NO: 3466904 - RNA, 15 nt, Pseudomonas aeruginosa PA01
ggcgcaggucgcugg

SEQ ID NO: 3466905 - RNA, 23 nt, Pseudomonas aeruginosa PA01
ggcgcaggucgcuggcgucgacc

SEQ ID NO: 3466906 - RNA, 16 nt, Pseudomonas aeruginosa PA01
ggcgcaggucggccuc

SEQ ID NO: 3466907 - RNA, 17 nt, Pseudomonas aeruginosa PA01
ggcgcaggucggccucg

SEQ ID NO: 3466908 - RNA, 17 nt, Pseudomonas aeruginosa PA01
ggcgcagguugagggcc

SEQ ID NO: 3466909 - RNA, 19 nt, Pseudomonas aeruginosa PA01
ggcgcagguugagggccgc

SEQ ID NO: 3466910 - RNA, 20 nt, Pseudomonas aeruginosa PA01
ggcgcagguugagggccgcg

SEQ ID NO: 3466911 - RNA, 20 nt, Pseudomonas aeruginosa PA01
ggcgcaguaacgccugucgc

SEQ ID NO: 3466912 - RNA, 16 nt, Pseudomonas aeruginosa PA01
ggcgcaguaggccugg

SEQ ID NO: 3466913 - RNA, 15 nt, Pseudomonas aeruginosa PA01
ggcgcaguucaucga

SEQ ID NO: 3466914 - RNA, 15 nt, Pseudomonas aeruginosa PA01
ggcgcaguucgucga

SEQ ID NO: 3466915 - RNA, 18 nt, Pseudomonas aeruginosa PA01
ggcgcauaaccgcuugcg

SEQ ID NO: 3466916 - RNA, 23 nt, Pseudomonas aeruginosa PA01
ggcgcauaacgccccucuuccac

SEQ ID NO: 3466917 - RNA, 21 nt, Pseudomonas aeruginosa PA01
ggcgcauagccaccgccgaca

SEQ ID NO: 3466918 - RNA, 18 nt, Pseudomonas aeruginosa PA01
ggcgcccggucagguugg

SEQ ID NO: 3466919 - RNA, 16 nt, Pseudomonas aeruginosa PA01
ggcgcccgguggaggu

SEQ ID NO: 3466920 - RNA, 20 nt, Pseudomonas aeruginosa PA01
ggcgcccgguggaggucugc

SEQ ID NO: 3466921 - RNA, 15 nt, Pseudomonas aeruginosa PA01
ggcgcccugccgggc

SEQ ID NO: 3466922 - RNA, 21 nt, Pseudomonas aeruginosa PA01
ggcgcccugcucugguucggc

SEQ ID NO: 3466923 - RNA, 23 nt, Pseudomonas aeruginosa PA01
ggcgcccugcucugguucggcgu

SEQ ID NO: 3466924 - RNA, 11 nt, Pseudomonas aeruginosa PA01
ggcgcccuggc

SEQ ID NO: 3466925 - RNA, 13 nt, Pseudomonas aeruginosa PA01
ggcgcccuggccg

SEQ ID NO: 3466926 - RNA, 15 nt, Pseudomonas aeruginosa PA01
ggcgcccuggccgcc

SEQ ID NO: 3466927 - RNA, 22 nt, Pseudomonas aeruginosa PA01
ggcgcccuggccgucggccugc

SEQ ID NO: 3466928 - RNA, 16 nt, Pseudomonas aeruginosa PA01
ggcgcccuucagcgcc

SEQ ID NO: 3466929 - RNA, 23 nt, Pseudomonas aeruginosa PA01
ggcgcccuucagcgccucgagga

SEQ ID NO: 3466930 - RNA, 17 nt, Pseudomonas aeruginosa PA01
ggcgcccuugacccggu

SEQ ID NO: 3466931 - RNA, 20 nt, Pseudomonas aeruginosa PA01
ggcgccgaacagggcgagca

SEQ ID NO: 3466932 - RNA, 20 nt, Pseudomonas aeruginosa PA01
ggcgccgaccacgaccgcgu

SEQ ID NO: 3466933 - RNA, 14 nt, Pseudomonas aeruginosa PA01
ggcgccgaccagcu

SEQ ID NO: 3466934 - RNA, 14 nt, Pseudomonas aeruginosa PA01
ggcgccgaccucca

SEQ ID NO: 3466935 - RNA, 18 nt, Pseudomonas aeruginosa PA01
ggcgccgagcagcggcgc

SEQ ID NO: 3466936 - RNA, 12 nt, Pseudomonas aeruginosa PA01
ggcgccgaggcc

SEQ ID NO: 3466937 - RNA, 15 nt, Pseudomonas aeruginosa PA01
ggcgccgaggcccua

SEQ ID NO: 3466938 - RNA, 13 nt, Pseudomonas aeruginosa PA01
ggcgccgagguag

SEQ ID NO: 3466939 - RNA, 14 nt, Pseudomonas aeruginosa PA01
ggcgccgaucaggc

SEQ ID NO: 3466940 - RNA, 17 nt, Pseudomonas aeruginosa PA01
ggcgccgaugcccaggc

SEQ ID NO: 3466941 - RNA, 15 nt, Pseudomonas aeruginosa PA01
ggcgccgaugccggc

SEQ ID NO: 3466942 - RNA, 20 nt, Pseudomonas aeruginosa PA01
ggcgccgaugccggccggca

SEQ ID NO: 3466943 - RNA, 21 nt, Pseudomonas aeruginosa PA01
ggcgccgaugccggccggcag

SEQ ID NO: 3466944 - RNA, 22 nt, Pseudomonas aeruginosa PA01
ggcgccgaugccggccggcagc

SEQ ID NO: 3466945 - RNA, 22 nt, Pseudomonas aeruginosa PA01
ggcgccgauggcugucggcgcc

SEQ ID NO: 3466946 - RNA, 13 nt, Pseudomonas aeruginosa PA01
ggcgccgcagggc

SEQ ID NO: 3466947 - RNA, 14 nt, Pseudomonas aeruginosa PA01
ggcgccgcagggcc

SEQ ID NO: 3466948 - RNA, 16 nt, Pseudomonas aeruginosa PA01
ggcgccgccagccaga

SEQ ID NO: 3466949 - RNA, 18 nt, Pseudomonas aeruginosa PA01
ggcgccgccccguuggcg

SEQ ID NO: 3466950 - RNA, 19 nt, Pseudomonas aeruginosa PA01
ggcgccgccgacgccaugg

SEQ ID NO: 3466951 - RNA, 22 nt, Pseudomonas aeruginosa PA01
ggcgccgccgagguugcgcagg

SEQ ID NO: 3466952 - RNA, 13 nt, Pseudomonas aeruginosa PA01
ggcgccgccgcug

SEQ ID NO: 3466953 - RNA, 20 nt, Pseudomonas aeruginosa PA01
ggcgccgccgcuggcgagga

SEQ ID NO: 3466954 - RNA, 12 nt, Pseudomonas aeruginosa PA01
ggcgccgccggc

SEQ ID NO: 3466955 - RNA, 16 nt, Pseudomonas aeruginosa PA01
ggcgccgccggcgaac

SEQ ID NO: 3466956 - RNA, 21 nt, Pseudomonas aeruginosa PA01
ggcgccgccggggaucagcga

SEQ ID NO: 3466957 - RNA, 22 nt, Pseudomonas aeruginosa PA01
ggcgccgccucgggcagccccu

SEQ ID NO: 3466958 - RNA, 18 nt, Pseudomonas aeruginosa PA01
ggcgccgccuggccggug

SEQ ID NO: 3466959 - RNA, 17 nt, Pseudomonas aeruginosa PA01
ggcgccgcgcaccuggg

SEQ ID NO: 3466960 - RNA, 13 nt, Pseudomonas aeruginosa PA01
ggcgccgcgcauc

SEQ ID NO: 3466961 - RNA, 12 nt, Pseudomonas aeruginosa PA01
ggcgccgcgcca

SEQ ID NO: 3466962 - RNA, 21 nt, Pseudomonas aeruginosa PA01
ggcgccgcgccuucugcaccu

SEQ ID NO: 3466963 - RNA, 16 nt, Pseudomonas aeruginosa PA01
ggcgccgcgcggcgcc

SEQ ID NO: 3466964 - RNA, 13 nt, Pseudomonas aeruginosa PA01
ggcgccgcggguc

SEQ ID NO: 3466965 - RNA, 20 nt, Pseudomonas aeruginosa PA01
ggcgccgcgggucugcucgg

SEQ ID NO: 3466966 - RNA, 21 nt, Pseudomonas aeruginosa PA01
ggcgccgcgggucugcucggc

SEQ ID NO: 3466967 - RNA, 12 nt, Pseudomonas aeruginosa PA01
ggcgccgcgguc

SEQ ID NO: 3466968 - RNA, 19 nt, Pseudomonas aeruginosa PA01
ggcgccgcuagggcgcccu

SEQ ID NO: 3466969 - RNA, 15 nt, Pseudomonas aeruginosa PA01
ggcgccgcucgaugc

SEQ ID NO: 3466970 - RNA, 15 nt, Pseudomonas aeruginosa PA01
ggcgccggaccagcc

SEQ ID NO: 3466971 - RNA, 17 nt, Pseudomonas aeruginosa PA01
ggcgccggaccagccgg

SEQ ID NO: 3466972 - RNA, 14 nt, Pseudomonas aeruginosa PA01
ggcgccggagcugg

SEQ ID NO: 3466973 - RNA, 16 nt, Pseudomonas aeruginosa PA01
ggcgccggagcugguc

SEQ ID NO: 3466974 - RNA, 21 nt, Pseudomonas aeruginosa PA01
ggcgccggcaggaacgcccgc

SEQ ID NO: 3466975 - RNA, 15 nt, Pseudomonas aeruginosa PA01
ggcgccggcaggccu

SEQ ID NO: 3466976 - RNA, 17 nt, Pseudomonas aeruginosa PA01
ggcgccggcaggccuuc

SEQ ID NO: 3466977 - RNA, 11 nt, Pseudomonas aeruginosa PA01
ggcgccggcau

SEQ ID NO: 3466978 - RNA, 16 nt, Pseudomonas aeruginosa PA01
ggcgccggcauugccg

SEQ ID NO: 3466979 - RNA, 23 nt, Pseudomonas aeruginosa PA01
ggcgccggcauugccgacuuccu

SEQ ID NO: 3466980 - RNA, 13 nt, Pseudomonas aeruginosa PA01
ggcgccggccaga

SEQ ID NO: 3466981 - RNA, 15 nt, Pseudomonas aeruginosa PA01
ggcgccggccagagc

SEQ ID NO: 3466982 - RNA, 16 nt, Pseudomonas aeruginosa PA01
ggcgccggccagagcu

SEQ ID NO: 3466983 - RNA, 13 nt, Pseudomonas aeruginosa PA01
ggcgccggccggg

SEQ ID NO: 3466984 - RNA, 17 nt, Pseudomonas aeruginosa PA01
ggcgccggccuccagcg

SEQ ID NO: 3466985 - RNA, 21 nt, Pseudomonas aeruginosa PA01
ggcgccggccuccagcgccug

SEQ ID NO: 3466986 - RNA, 15 nt, Pseudomonas aeruginosa PA01
ggcgccggccucgca

SEQ ID NO: 3466987 - RNA, 12 nt, Pseudomonas aeruginosa PA01
ggcgccggcgcg

SEQ ID NO: 3466988 - RNA, 18 nt, Pseudomonas aeruginosa PA01
ggcgccggcgcgcagggu

SEQ ID NO: 3466989 - RNA, 14 nt, Pseudomonas aeruginosa PA01
ggcgccggcgcgcg

SEQ ID NO: 3466990 - RNA, 16 nt, Pseudomonas aeruginosa PA01
ggcgccggcgcgcggc

SEQ ID NO: 3466991 - RNA, 17 nt, Pseudomonas aeruginosa PA01
ggcgccggcgcgcggcg

SEQ ID NO: 3466992 - RNA, 21 nt, Pseudomonas aeruginosa PA01
ggcgccggcggaucagcccgc

SEQ ID NO: 3466993 - RNA, 20 nt, Pseudomonas aeruginosa PA01
ggcgccggcucgcccagcag

SEQ ID NO: 3466994 - RNA, 15 nt, Pseudomonas aeruginosa PA01
ggcgccgggcugccg

SEQ ID NO: 3466995 - RNA, 17 nt, Pseudomonas aeruginosa PA01
ggcgccgggcugccgaa

SEQ ID NO: 3466996 - RNA, 22 nt, Pseudomonas aeruginosa PA01
ggcgccggguagcguuaucgcc

SEQ ID NO: 3466997 - RNA, 11 nt, Pseudomonas aeruginosa PA01
ggcgccggguc

SEQ ID NO: 3466998 - RNA, 14 nt, Pseudomonas aeruginosa PA01
ggcgccgggucaga

SEQ ID NO: 3466999 - RNA, 16 nt, Pseudomonas aeruginosa PA01
ggcgccggugaggcgc

SEQ ID NO: 3467000 - RNA, 12 nt, Pseudomonas aeruginosa PA01
ggcgccggugca

SEQ ID NO: 3467001 - RNA, 17 nt, Pseudomonas aeruginosa PA01
ggcgccggugcuggcga

SEQ ID NO: 3467002 - RNA, 19 nt, Pseudomonas aeruginosa PA01
ggcgccggugcuggcgagc

SEQ ID NO: 3467003 - RNA, 20 nt, Pseudomonas aeruginosa PA01
ggcgccgguugcugcugcgg

SEQ ID NO: 3467004 - RNA, 19 nt, Pseudomonas aeruginosa PA01
ggcgccgguugcugcuggg

SEQ ID NO: 3467005 - RNA, 21 nt, Pseudomonas aeruginosa PA01
ggcgccgguugcugcugggug

SEQ ID NO: 3467006 - RNA, 22 nt, Pseudomonas aeruginosa PA01
ggcgccgucaucgcugaccugg

SEQ ID NO: 3467007 - RNA, 22 nt, Pseudomonas aeruginosa PA01
ggcgccguccugcaacugcucg

SEQ ID NO: 3467008 - RNA, 16 nt, Pseudomonas aeruginosa PA01
ggcgccgucgggggcg

SEQ ID NO: 3467009 - RNA, 20 nt, Pseudomonas aeruginosa PA01
ggcgccguggaucgcccggc

SEQ ID NO: 3467010 - RNA, 22 nt, Pseudomonas aeruginosa PA01
ggcgccguuguucaggcgcgcg

SEQ ID NO: 3467011 - RNA, 23 nt, Pseudomonas aeruginosa PA01
ggcgccguuguucaggcgcgcgg

SEQ ID NO: 3467012 - RNA, 24 nt, Pseudomonas aeruginosa PA01
ggcgccguuguucaggcgcgcggu

SEQ ID NO: 3467013 - RNA, 21 nt, Pseudomonas aeruginosa PA01
ggcgccuagacccugggccaa

SEQ ID NO: 3467014 - RNA, 15 nt, Pseudomonas aeruginosa PA01
ggcgccuccagcggg

SEQ ID NO: 3467015 - RNA, 17 nt, Pseudomonas aeruginosa PA01
ggcgccuccagcgggcc

SEQ ID NO: 3467016 - RNA, 20 nt, Pseudomonas aeruginosa PA01
ggcgccuccagcgggccuuc

SEQ ID NO: 3467017 - RNA, 21 nt, Pseudomonas aeruginosa PA01
ggcgccuccagcgggccuucg

SEQ ID NO: 3467018 - RNA, 21 nt, Pseudomonas aeruginosa PA01
ggcgccucgcaaaggucggcg

SEQ ID NO: 3467019 - RNA, 13 nt, Pseudomonas aeruginosa PA01
ggcgccucgucga

SEQ ID NO: 3467020 - RNA, 16 nt, Pseudomonas aeruginosa PA01
ggcgccugagcagcgc

SEQ ID NO: 3467021 - RNA, 13 nt, Pseudomonas aeruginosa PA01
ggcgcgcgccggg

SEQ ID NO: 3467022 - RNA, 18 nt, Pseudomonas aeruginosa PA01
ggcgcgcgccucagcggc

SEQ ID NO: 3467023 - RNA, 23 nt, Pseudomonas aeruginosa PA01
ggcgcgcgccucagcggcuggcg

SEQ ID NO: 3467024 - RNA, 13 nt, Pseudomonas aeruginosa PA01
ggcgcgcgcgcug

SEQ ID NO: 3467025 - RNA, 15 nt, Pseudomonas aeruginosa PA01
ggcgcgcgcgcugcc

SEQ ID NO: 3467026 - RNA, 22 nt, Pseudomonas aeruginosa PA01
ggcgcgcgcgcugccaguggcg

SEQ ID NO: 3467027 - RNA, 19 nt, Pseudomonas aeruginosa PA01
ggcgcgcggcagcaccagg

SEQ ID NO: 3467028 - RNA, 12 nt, Pseudomonas aeruginosa PA01
ggcgcgcggcca

SEQ ID NO: 3467029 - RNA, 23 nt, Pseudomonas aeruginosa PA01
ggcgcgcggccagcgcggccgcc

SEQ ID NO: 3467030 - RNA, 13 nt, Pseudomonas aeruginosa PA01
ggcgcgcggccgc

SEQ ID NO: 3467031 - RNA, 14 nt, Pseudomonas aeruginosa PA01
ggcgcgcggccgcg

SEQ ID NO: 3467032 - RNA, 20 nt, Pseudomonas aeruginosa PA01
ggcgcgcgguuucuucgccu

SEQ ID NO: 3467033 - RNA, 17 nt, Pseudomonas aeruginosa PA01
ggcgcgcgucguccagg

SEQ ID NO: 3467034 - RNA, 20 nt, Pseudomonas aeruginosa PA01
ggcgcgcgucguccagggcg

SEQ ID NO: 3467035 - RNA, 15 nt, Pseudomonas aeruginosa PA01
ggcgcgcucagcgcu

SEQ ID NO: 3467036 - RNA, 21 nt, Pseudomonas aeruginosa PA01
ggcgcgcucagcgcuucucgg

SEQ ID NO: 3467037 - RNA, 13 nt, Pseudomonas aeruginosa PA01
ggcgcgcuccggc

SEQ ID NO: 3467038 - RNA, 16 nt, Pseudomonas aeruginosa PA01
ggcgcgcuccggcgcg

SEQ ID NO: 3467039 - RNA, 17 nt, Pseudomonas aeruginosa PA01
ggcgcgcucgaucaggu

SEQ ID NO: 3467040 - RNA, 22 nt, Pseudomonas aeruginosa PA01
ggcgcgcugcgaaucgucgccg

SEQ ID NO: 3467041 - RNA, 13 nt, Pseudomonas aeruginosa PA01
ggcgcgcugcggc

SEQ ID NO: 3467042 - RNA, 15 nt, Pseudomonas aeruginosa PA01
ggcgcgcugcggcag

SEQ ID NO: 3467043 - RNA, 16 nt, Pseudomonas aeruginosa PA01
ggcgcgcugcggguca

SEQ ID NO: 3467044 - RNA, 19 nt, Pseudomonas aeruginosa PA01
ggcgcgcugcgggucauug

SEQ ID NO: 3467045 - RNA, 21 nt, Pseudomonas aeruginosa PA01
ggcgcgcugcgugcgccgcuc

SEQ ID NO: 3467046 - RNA, 22 nt, Pseudomonas aeruginosa PA01
ggcgcgcugcgugcgccgcucg

SEQ ID NO: 3467047 - RNA, 14 nt, Pseudomonas aeruginosa PA01
ggcgcgcuggcaga

SEQ ID NO: 3467048 - RNA, 13 nt, Pseudomonas aeruginosa PA01
ggcgcgcuggucg

SEQ ID NO: 3467049 - RNA, 14 nt, Pseudomonas aeruginosa PA01
ggcgcgcuggucgu

SEQ ID NO: 3467050 - RNA, 21 nt, Pseudomonas aeruginosa PA01
ggcgcgcugguuuagcucggc

SEQ ID NO: 3467051 - RNA, 21 nt, Pseudomonas aeruginosa PA01
ggcgcgcuuccuccaguagcg

SEQ ID NO: 3467052 - RNA, 23 nt, Pseudomonas aeruginosa PA01
ggcgcgcuuuccggcgcggccug

SEQ ID NO: 3467053 - RNA, 19 nt, Pseudomonas aeruginosa PA01
ggcgcggaauacguacucg

SEQ ID NO: 3467054 - RNA, 14 nt, Pseudomonas aeruginosa PA01
ggcgcggacaagcc

SEQ ID NO: 3467055 - RNA, 19 nt, Pseudomonas aeruginosa PA01
ggcgcggacauggcgcucg

SEQ ID NO: 3467056 - RNA, 16 nt, Pseudomonas aeruginosa PA01
ggcgcggacgggccgc

SEQ ID NO: 3467057 - RNA, 22 nt, Pseudomonas aeruginosa PA01
ggcgcggacgggccgcgccgca

SEQ ID NO: 3467058 - RNA, 21 nt, Pseudomonas aeruginosa PA01
ggcgcggauacgggaucuuca

SEQ ID NO: 3467059 - RNA, 14 nt, Pseudomonas aeruginosa PA01
ggcgcggaugaccu

SEQ ID NO: 3467060 - RNA, 19 nt, Pseudomonas aeruginosa PA01
ggcgcggcagugcucgauc

SEQ ID NO: 3467061 - RNA, 20 nt, Pseudomonas aeruginosa PA01
ggcgcggcagugcucgauca

SEQ ID NO: 3467062 - RNA, 11 nt, Pseudomonas aeruginosa PA01
ggcgcggccga

SEQ ID NO: 3467063 - RNA, 23 nt, Pseudomonas aeruginosa PA01
ggcgcggccgaacucuggcggcg

SEQ ID NO: 3467064 - RNA, 13 nt, Pseudomonas aeruginosa PA01
ggcgcggccggcg

SEQ ID NO: 3467065 - RNA, 16 nt, Pseudomonas aeruginosa PA01
ggcgcggccggcgccg

SEQ ID NO: 3467066 - RNA, 15 nt, Pseudomonas aeruginosa PA01
ggcgcggccgugccu

SEQ ID NO: 3467067 - RNA, 15 nt, Pseudomonas aeruginosa PA01
ggcgcggccugcagc

SEQ ID NO: 3467068 - RNA, 18 nt, Pseudomonas aeruginosa PA01
ggcgcggccugcagcgac

SEQ ID NO: 3467069 - RNA, 19 nt, Pseudomonas aeruginosa PA01
ggcgcggccugcagcgacu

SEQ ID NO: 3467070 - RNA, 20 nt, Pseudomonas aeruginosa PA01
ggcgcggcgcaaucagggcu

SEQ ID NO: 3467071 - RNA, 14 nt, Pseudomonas aeruginosa PA01
ggcgcggcgcagcg

SEQ ID NO: 3467072 - RNA, 15 nt, Pseudomonas aeruginosa PA01
ggcgcggcgcagcgg

SEQ ID NO: 3467073 - RNA, 16 nt, Pseudomonas aeruginosa PA01
ggcgcggcgcagcggc

SEQ ID NO: 3467074 - RNA, 13 nt, Pseudomonas aeruginosa PA01
ggcgcggcgccag

SEQ ID NO: 3467075 - RNA, 19 nt, Pseudomonas aeruginosa PA01
ggcgcggcgcuccaggcgg

SEQ ID NO: 3467076 - RNA, 13 nt, Pseudomonas aeruginosa PA01
ggcgcggcggaag

SEQ ID NO: 3467077 - RNA, 14 nt, Pseudomonas aeruginosa PA01
ggcgcggcggaggc

SEQ ID NO: 3467078 - RNA, 15 nt, Pseudomonas aeruginosa PA01
ggcgcggcggaggcc

SEQ ID NO: 3467079 - RNA, 15 nt, Pseudomonas aeruginosa PA01
ggcgcggcggccgcc

SEQ ID NO: 3467080 - RNA, 13 nt, Pseudomonas aeruginosa PA01
ggcgcggcgucgg

SEQ ID NO: 3467081 - RNA, 17 nt, Pseudomonas aeruginosa PA01
ggcgcggcgucgggcga

SEQ ID NO: 3467082 - RNA, 17 nt, Pseudomonas aeruginosa PA01
ggcgcggcugaucggcc

SEQ ID NO: 3467083 - RNA, 11 nt, Pseudomonas aeruginosa PA01
ggcgcggcugg

SEQ ID NO: 3467084 - RNA, 20 nt, Pseudomonas aeruginosa PA01
ggcgcgggcauggaucuccc

SEQ ID NO: 3467085 - RNA, 23 nt, Pseudomonas aeruginosa PA01
ggcgcgggcauggaucucccgua

SEQ ID NO: 3467086 - RNA, 20 nt, Pseudomonas aeruginosa PA01
ggcgcgggccuucaggcugc

SEQ ID NO: 3467087 - RNA, 21 nt, Pseudomonas aeruginosa PA01
ggcgcgggccuucaggcugcg

SEQ ID NO: 3467088 - RNA, 15 nt, Pseudomonas aeruginosa PA01
ggcgcgggcgaaggc

SEQ ID NO: 3467089 - RNA, 13 nt, Pseudomonas aeruginosa PA01
ggcgcgggcgcgc

SEQ ID NO: 3467090 - RNA, 17 nt, Pseudomonas aeruginosa PA01
ggcgcgggcgcgcgcca

SEQ ID NO: 3467091 - RNA, 16 nt, Pseudomonas aeruginosa PA01
ggcgcgggcggccucg

SEQ ID NO: 3467092 - RNA, 18 nt, Pseudomonas aeruginosa PA01
ggcgcgggcggccucgau

SEQ ID NO: 3467093 - RNA, 13 nt, Pseudomonas aeruginosa PA01
ggcgcgggcggcg

SEQ ID NO: 3467094 - RNA, 16 nt, Pseudomonas aeruginosa PA01
ggcgcgggcggcggcg

SEQ ID NO: 3467095 - RNA, 18 nt, Pseudomonas aeruginosa PA01
ggcgcggggcccggcucc

SEQ ID NO: 3467096 - RNA, 17 nt, Pseudomonas aeruginosa PA01
ggcgcgggucugcucgc

SEQ ID NO: 3467097 - RNA, 18 nt, Pseudomonas aeruginosa PA01
ggcgcgggucugcucgcg

SEQ ID NO: 3467098 - RNA, 19 nt, Pseudomonas aeruginosa PA01
ggcgcgggucuucaggccg

SEQ ID NO: 3467099 - RNA, 12 nt, Pseudomonas aeruginosa PA01
ggcgcggguggc

SEQ ID NO: 3467100 - RNA, 16 nt, Pseudomonas aeruginosa PA01
ggcgcggguguccucg

SEQ ID NO: 3467101 - RNA, 22 nt, Pseudomonas aeruginosa PA01
ggcgcggguucgugccaggcgg

SEQ ID NO: 3467102 - RNA, 23 nt, Pseudomonas aeruginosa PA01
ggcgcggguucgugccaggcggc

SEQ ID NO: 3467103 - RNA, 18 nt, Pseudomonas aeruginosa PA01
ggcgcgguagggaucguc

SEQ ID NO: 3467104 - RNA, 19 nt, Pseudomonas aeruginosa PA01
ggcgcggucguaggaacgu

SEQ ID NO: 3467105 - RNA, 14 nt, Pseudomonas aeruginosa PA01
ggcgcggugccgug

SEQ ID NO: 3467106 - RNA, 17 nt, Pseudomonas aeruginosa PA01
ggcgcggugggccuuga

SEQ ID NO: 3467107 - RNA, 22 nt, Pseudomonas aeruginosa PA01
ggcgcggugggccuugagcaug

SEQ ID NO: 3467108 - RNA, 18 nt, Pseudomonas aeruginosa PA01
ggcgcgguugccgcugcg

SEQ ID NO: 3467109 - RNA, 22 nt, Pseudomonas aeruginosa PA01
ggcgcgguuucgcagcgcuccu

SEQ ID NO: 3467110 - RNA, 15 nt, Pseudomonas aeruginosa PA01
ggcgcguacgcccgc

SEQ ID NO: 3467111 - RNA, 16 nt, Pseudomonas aeruginosa PA01
ggcgcguacgcccgca

SEQ ID NO: 3467112 - RNA, 19 nt, Pseudomonas aeruginosa PA01
ggcgcguacuugccagggc

SEQ ID NO: 3467113 - RNA, 18 nt, Pseudomonas aeruginosa PA01
ggcgcguagaggaugccg

SEQ ID NO: 3467114 - RNA, 22 nt, Pseudomonas aeruginosa PA01
ggcgcguagaggaugccggccu

SEQ ID NO: 3467115 - RNA, 19 nt, Pseudomonas aeruginosa PA01
ggcgcgucaugccgccguc

SEQ ID NO: 3467116 - RNA, 23 nt, Pseudomonas aeruginosa PA01
ggcgcgucaugccgccgucgcgg

SEQ ID NO: 3467117 - RNA, 16 nt, Pseudomonas aeruginosa PA01
ggcgcguccaccuggc

SEQ ID NO: 3467118 - RNA, 20 nt, Pseudomonas aeruginosa PA01
ggcgcguccaccuggcggcu

SEQ ID NO: 3467119 - RNA, 16 nt, Pseudomonas aeruginosa PA01
ggcgcguccagcucca

SEQ ID NO: 3467120 - RNA, 19 nt, Pseudomonas aeruginosa PA01
ggcgcguccagcuccacca

SEQ ID NO: 3467121 - RNA, 21 nt, Pseudomonas aeruginosa PA01
ggcgcguccagcuccaccagg

SEQ ID NO: 3467122 - RNA, 22 nt, Pseudomonas aeruginosa PA01
ggcgcguccagcuccaccaggc

SEQ ID NO: 3467123 - RNA, 20 nt, Pseudomonas aeruginosa PA01
ggcgcugcaaucgcugccgg

SEQ ID NO: 3467124 - RNA, 16 nt, Pseudomonas aeruginosa PA01
ggcgcugcagccacug

SEQ ID NO: 3467125 - RNA, 19 nt, Pseudomonas aeruginosa PA01
ggcgcugccaaacgccguc

SEQ ID NO: 3467126 - RNA, 14 nt, Pseudomonas aeruginosa PA01
ggcgcugcccgggu

SEQ ID NO: 3467127 - RNA, 14 nt, Pseudomonas aeruginosa PA01
ggcgcugccgaaca

SEQ ID NO: 3467128 - RNA, 19 nt, Pseudomonas aeruginosa PA01
ggcgcugccgaacagcagg

SEQ ID NO: 3467129 - RNA, 20 nt, Pseudomonas aeruginosa PA01
ggcgcugccgaacagcaggg

SEQ ID NO: 3467130 - RNA, 15 nt, Pseudomonas aeruginosa PA01
ggcgcugccgaucag

SEQ ID NO: 3467131 - RNA, 18 nt, Pseudomonas aeruginosa PA01
ggcgcugccgaucagcca

SEQ ID NO: 3467132 - RNA, 18 nt, Pseudomonas aeruginosa PA01
ggcgcugccggccagggu

SEQ ID NO: 3467133 - RNA, 20 nt, Pseudomonas aeruginosa PA01
ggcgcugccggccagggucg

SEQ ID NO: 3467134 - RNA, 22 nt, Pseudomonas aeruginosa PA01
ggcgcugccguagaggucgccg

SEQ ID NO: 3467135 - RNA, 23 nt, Pseudomonas aeruginosa PA01
ggcgcugccguagaggucgccgu

SEQ ID NO: 3467136 - RNA, 21 nt, Pseudomonas aeruginosa PA01
ggcgcugcgccguuucgacga

SEQ ID NO: 3467137 - RNA, 14 nt, Pseudomonas aeruginosa PA01
ggcgcugcgcggcc

SEQ ID NO: 3467138 - RNA, 15 nt, Pseudomonas aeruginosa PA01
ggcgcugcgcggccu

SEQ ID NO: 3467139 - RNA, 18 nt, Pseudomonas aeruginosa PA01
ggcgcugcgcggcgucgg

SEQ ID NO: 3467140 - RNA, 17 nt, Pseudomonas aeruginosa PA01
ggcgcugcucgauggcc

SEQ ID NO: 3467141 - RNA, 14 nt, Pseudomonas aeruginosa PA01
ggcgcugcuggugg

SEQ ID NO: 3467142 - RNA, 23 nt, Pseudomonas aeruginosa PA01
ggcgcugcugguggacgucgucg

SEQ ID NO: 3467143 - RNA, 17 nt, Pseudomonas aeruginosa PA01
ggcgcuggaacagcggu

SEQ ID NO: 3467144 - RNA, 11 nt, Pseudomonas aeruginosa PA01
ggcgcuggcca

SEQ ID NO: 3467145 - RNA, 13 nt, Pseudomonas aeruginosa PA01
ggcgcuggccagc

SEQ ID NO: 3467146 - RNA, 16 nt, Pseudomonas aeruginosa PA01
ggcgcuggccagcgcu

SEQ ID NO: 3467147 - RNA, 12 nt, Pseudomonas aeruginosa PA01
ggcgcuggccga

SEQ ID NO: 3467148 - RNA, 13 nt, Pseudomonas aeruginosa PA01
ggcgcuggccgcg

SEQ ID NO: 3467149 - RNA, 22 nt, Pseudomonas aeruginosa PA01
ggcgcuggccgcgcgaccgcgg

SEQ ID NO: 3467150 - RNA, 13 nt, Pseudomonas aeruginosa PA01
ggcgcuggcgccg

SEQ ID NO: 3467151 - RNA, 16 nt, Pseudomonas aeruginosa PA01
ggcgcuggcgccgaug

SEQ ID NO: 3467152 - RNA, 17 nt, Pseudomonas aeruginosa PA01
ggcgcuggcgccgaugc

SEQ ID NO: 3467153 - RNA, 20 nt, Pseudomonas aeruginosa PA01
ggcgcuggcgccgaugcugu

SEQ ID NO: 3467154 - RNA, 14 nt, Pseudomonas aeruginosa PA01
ggcgcuggcgcgga

SEQ ID NO: 3467155 - RNA, 14 nt, Pseudomonas aeruginosa PA01
ggcgcuggcgggcg

SEQ ID NO: 3467156 - RNA, 15 nt, Pseudomonas aeruginosa PA01
ggcgcuggcgggcgc

SEQ ID NO: 3467157 - RNA, 14 nt, Pseudomonas aeruginosa PA01
ggcgcugggcggcu

SEQ ID NO: 3467158 - RNA, 16 nt, Pseudomonas aeruginosa PA01
ggcgcugggcggcugg

SEQ ID NO: 3467159 - RNA, 17 nt, Pseudomonas aeruginosa PA01
ggcgcugggcggcuggc

SEQ ID NO: 3467160 - RNA, 19 nt, Pseudomonas aeruginosa PA01
ggcgcugggcggcuggccg

SEQ ID NO: 3467161 - RNA, 21 nt, Pseudomonas aeruginosa PA01
ggcgcugguccagcacgcugg

SEQ ID NO: 3467162 - RNA, 18 nt, Pseudomonas aeruginosa PA01
ggcgcugguccuucagcu

SEQ ID NO: 3467163 - RNA, 20 nt, Pseudomonas aeruginosa PA01
ggcgcugguccuucagcugg

SEQ ID NO: 3467164 - RNA, 18 nt, Pseudomonas aeruginosa PA01
ggcgcuggucucuuccag

SEQ ID NO: 3467165 - RNA, 20 nt, Pseudomonas aeruginosa PA01
ggcgcuguaggcgagcagcg

SEQ ID NO: 3467166 - RNA, 23 nt, Pseudomonas aeruginosa PA01
ggcgcuguaggcgagcagcggca

SEQ ID NO: 3467167 - RNA, 13 nt, Pseudomonas aeruginosa PA01
ggcgcugucgccc

SEQ ID NO: 3467168 - RNA, 16 nt, Pseudomonas aeruginosa PA01
ggcgcugucgccgguc

SEQ ID NO: 3467169 - RNA, 23 nt, Pseudomonas aeruginosa PA01
ggcgcugucgccggucaggcugc

SEQ ID NO: 3467170 - RNA, 22 nt, Pseudomonas aeruginosa PA01
ggcgcugucucgccagcccggc

SEQ ID NO: 3467171 - RNA, 23 nt, Pseudomonas aeruginosa PA01
ggcgcugucucgccagcccggca

SEQ ID NO: 3467172 - RNA, 16 nt, Pseudomonas aeruginosa PA01
ggcgcuguuggccugg

SEQ ID NO: 3467173 - RNA, 18 nt, Pseudomonas aeruginosa PA01
ggcgcuguuugcggcgca

SEQ ID NO: 3467174 - RNA, 21 nt, Pseudomonas aeruginosa PA01
ggcgcuucaacugcuucaggu

SEQ ID NO: 3467175 - RNA, 18 nt, Pseudomonas aeruginosa PA01
ggcgcuucaucuccugcu

SEQ ID NO: 3467176 - RNA, 15 nt, Pseudomonas aeruginosa PA01
ggcgcuucgcgcagg

SEQ ID NO: 3467177 - RNA, 14 nt, Pseudomonas aeruginosa PA01
ggcgcuucggcgga

SEQ ID NO: 3467178 - RNA, 16 nt, Pseudomonas aeruginosa PA01
ggcgcuucggcggaua

SEQ ID NO: 3467179 - RNA, 21 nt, Pseudomonas aeruginosa PA01
ggcgcuucugcgagccgcgcg

SEQ ID NO: 3467180 - RNA, 19 nt, Pseudomonas aeruginosa PA01
ggcgcuucugcucggccug

SEQ ID NO: 3467181 - RNA, 20 nt, Pseudomonas aeruginosa PA01
ggcgcuucugcucggccugg

SEQ ID NO: 3467182 - RNA, 18 nt, Pseudomonas aeruginosa PA01
ggcgcuugaagccggcgu

SEQ ID NO: 3467183 - RNA, 13 nt, Pseudomonas aeruginosa PA01
ggcgcuugagcag

SEQ ID NO: 3467184 - RNA, 13 nt, Pseudomonas aeruginosa PA01
ggcgcuugccgcg

SEQ ID NO: 3467185 - RNA, 15 nt, Pseudomonas aeruginosa PA01
ggcgcuugccgcgcc

SEQ ID NO: 3467186 - RNA, 16 nt, Pseudomonas aeruginosa PA01
ggcgcuugccgcgccc

SEQ ID NO: 3467187 - RNA, 19 nt, Pseudomonas aeruginosa PA01
ggcgcuugccgcgcccggc

SEQ ID NO: 3467188 - RNA, 20 nt, Pseudomonas aeruginosa PA01
ggcgcuugccgcgcccggcc

SEQ ID NO: 3467189 - RNA, 21 nt, Pseudomonas aeruginosa PA01
ggcgcuugccgcgcccggcca

SEQ ID NO: 3467190 - RNA, 14 nt, Pseudomonas aeruginosa PA01
ggcgcuugcgcagc

SEQ ID NO: 3467191 - RNA, 15 nt, Pseudomonas aeruginosa PA01
ggcgcuugcgcagca

SEQ ID NO: 3467192 - RNA, 16 nt, Pseudomonas aeruginosa PA01
ggcgcuugcgggcgcg

SEQ ID NO: 3467193 - RNA, 19 nt, Pseudomonas aeruginosa PA01
ggcgcuugcgggcgcgccu

SEQ ID NO: 3467194 - RNA, 17 nt, Pseudomonas aeruginosa PA01
ggcgcuugcucuccacu

SEQ ID NO: 3467195 - RNA, 13 nt, Pseudomonas aeruginosa PA01
ggcgcuugggcgc

SEQ ID NO: 3467196 - RNA, 16 nt, Pseudomonas aeruginosa PA01
ggcgcuugggcgcgga

SEQ ID NO: 3467197 - RNA, 17 nt, Pseudomonas aeruginosa PA01
ggcgcuuguagcccagg

SEQ ID NO: 3467198 - RNA, 18 nt, Pseudomonas aeruginosa PA01
ggcgcuuguagcccaggg

SEQ ID NO: 3467199 - RNA, 18 nt, Pseudomonas aeruginosa PA01
ggcgcuuguccaucggcu

SEQ ID NO: 3467200 - RNA, 17 nt, Pseudomonas aeruginosa PA01
ggcgcuuguccgagacc

SEQ ID NO: 3467201 - RNA, 16 nt, Pseudomonas aeruginosa PA01
ggcgcuuucaucaggc

SEQ ID NO: 3467202 - RNA, 22 nt, Pseudomonas aeruginosa PA01
ggcgcuuuccacucggggucgu

SEQ ID NO: 3467203 - RNA, 19 nt, Pseudomonas aeruginosa PA01
ggcgcuuucccgcuucggc

SEQ ID NO: 3467204 - RNA, 22 nt, Pseudomonas aeruginosa PA01
ggcgcuuucgagaaagcgcagg

SEQ ID NO: 3467205 - RNA, 23 nt, Pseudomonas aeruginosa PA01
ggcgcuuucgcucuggucgaaca

SEQ ID NO: 3467206 - RNA, 22 nt, Pseudomonas aeruginosa PA01
ggcgcuuuuuucuugccgccag

SEQ ID NO: 3467207 - RNA, 16 nt, Pseudomonas aeruginosa PA01
ggcggaaaaagcgcgg

SEQ ID NO: 3467208 - RNA, 15 nt, Pseudomonas aeruginosa PA01
ggcggaaaagcccgc

SEQ ID NO: 3467209 - RNA, 21 nt, Pseudomonas aeruginosa PA01
ggcggaaaccgcauugacccg

SEQ ID NO: 3467210 - RNA, 19 nt, Pseudomonas aeruginosa PA01
ggcggaaauacuccgcgug

SEQ ID NO: 3467211 - RNA, 13 nt, Pseudomonas aeruginosa PA01
ggcggaacggcuc

SEQ ID NO: 3467212 - RNA, 17 nt, Pseudomonas aeruginosa PA01
ggcggaacuugucgccg

SEQ ID NO: 3467213 - RNA, 18 nt, Pseudomonas aeruginosa PA01
ggcggaacuugucgccgc

SEQ ID NO: 3467214 - RNA, 20 nt, Pseudomonas aeruginosa PA01
ggcggaacuugucgccgcug

SEQ ID NO: 3467215 - RNA, 22 nt, Pseudomonas aeruginosa PA01
ggcggaagaaaagaaggcggau

SEQ ID NO: 3467216 - RNA, 17 nt, Pseudomonas aeruginosa PA01
ggcggaagaagcccuug

SEQ ID NO: 3467217 - RNA, 12 nt, Pseudomonas aeruginosa PA01
ggcggaagaauc

SEQ ID NO: 3467218 - RNA, 15 nt, Pseudomonas aeruginosa PA01
ggcggaagacgaucu

SEQ ID NO: 3467219 - RNA, 14 nt, Pseudomonas aeruginosa PA01
ggcggaaggcggcg

SEQ ID NO: 3467220 - RNA, 15 nt, Pseudomonas aeruginosa PA01
ggcggaaggcggcgu

SEQ ID NO: 3467221 - RNA, 13 nt, Pseudomonas aeruginosa PA01
ggcggaaggucag

SEQ ID NO: 3467222 - RNA, 17 nt, Pseudomonas aeruginosa PA01
ggcggaauuccugcucg

SEQ ID NO: 3467223 - RNA, 18 nt, Pseudomonas aeruginosa PA01
ggcggacaaccaccaugc

SEQ ID NO: 3467224 - RNA, 18 nt, Pseudomonas aeruginosa PA01
ggcggacaacccggcgcu

SEQ ID NO: 3467225 - RNA, 23 nt, Pseudomonas aeruginosa PA01
ggcggacaacccggcgcuggccg

SEQ ID NO: 3467226 - RNA, 20 nt, Pseudomonas aeruginosa PA01
ggcggccagcagcacggcga

SEQ ID NO: 3467227 - RNA, 22 nt, Pseudomonas aeruginosa PA01
ggcggccagcagcacggcgacg

SEQ ID NO: 3467228 - RNA, 13 nt, Pseudomonas aeruginosa PA01
ggcggccaggcgg

SEQ ID NO: 3467229 - RNA, 14 nt, Pseudomonas aeruginosa PA01
ggcggccaggcggc

SEQ ID NO: 3467230 - RNA, 21 nt, Pseudomonas aeruginosa PA01
ggcggccagggcaugggucag

SEQ ID NO: 3467231 - RNA, 23 nt, Pseudomonas aeruginosa PA01
ggcggccagggcaugggucagcg

SEQ ID NO: 3467232 - RNA, 14 nt, Pseudomonas aeruginosa PA01
ggcggccaucaggc

SEQ ID NO: 3467233 - RNA, 16 nt, Pseudomonas aeruginosa PA01
ggcggccaucaggcgc

SEQ ID NO: 3467234 - RNA, 16 nt, Pseudomonas aeruginosa PA01
ggcggccauugccgcg

SEQ ID NO: 3467235 - RNA, 19 nt, Pseudomonas aeruginosa PA01
ggcggcccaugcggaucgc

SEQ ID NO: 3467236 - RNA, 18 nt, Pseudomonas aeruginosa PA01
ggcggccccuucagcucc

SEQ ID NO: 3467237 - RNA, 19 nt, Pseudomonas aeruginosa PA01
ggcggccccuucagcucca

SEQ ID NO: 3467238 - RNA, 13 nt, Pseudomonas aeruginosa PA01
ggcggcccgcaca

SEQ ID NO: 3467239 - RNA, 23 nt, Pseudomonas aeruginosa PA01
ggcggcccugguugcggaacggc

SEQ ID NO: 3467240 - RNA, 23 nt, Pseudomonas aeruginosa PA01
ggcggccgaacuggaugauggua

SEQ ID NO: 3467241 - RNA, 13 nt, Pseudomonas aeruginosa PA01
ggcggccgacgug

SEQ ID NO: 3467242 - RNA, 20 nt, Pseudomonas aeruginosa PA01
ggcggccgacgugcacccgc

SEQ ID NO: 3467243 - RNA, 21 nt, Pseudomonas aeruginosa PA01
ggcggccgacgugcacccgcu

SEQ ID NO: 3467244 - RNA, 20 nt, Pseudomonas aeruginosa PA01
ggcggccgcaugccggggug

SEQ ID NO: 3467245 - RNA, 13 nt, Pseudomonas aeruginosa PA01
ggcggccgccauc

SEQ ID NO: 3467246 - RNA, 14 nt, Pseudomonas aeruginosa PA01
ggcggccgccauuc

SEQ ID NO: 3467247 - RNA, 20 nt, Pseudomonas aeruginosa PA01
ggcggccgccggcgcccugc

SEQ ID NO: 3467248 - RNA, 16 nt, Pseudomonas aeruginosa PA01
ggcggccgccuugacc

SEQ ID NO: 3467249 - RNA, 19 nt, Pseudomonas aeruginosa PA01
ggcggccgccuugaccugc

SEQ ID NO: 3467250 - RNA, 20 nt, Pseudomonas aeruginosa PA01
ggcggccgccuugaccugcu

SEQ ID NO: 3467251 - RNA, 16 nt, Pseudomonas aeruginosa PA01
ggcggccggauggccg

SEQ ID NO: 3467252 - RNA, 14 nt, Pseudomonas aeruginosa PA01
ggcggccggccagg

SEQ ID NO: 3467253 - RNA, 15 nt, Pseudomonas aeruginosa PA01
ggcggccggccaggu

SEQ ID NO: 3467254 - RNA, 14 nt, Pseudomonas aeruginosa PA01
ggcggccgggucga

SEQ ID NO: 3467255 - RNA, 20 nt, Pseudomonas aeruginosa PA01
ggcggccggugccuucggcg

SEQ ID NO: 3467256 - RNA, 23 nt, Pseudomonas aeruginosa PA01
ggcggccggugccuucggcggcg

SEQ ID NO: 3467257 - RNA, 17 nt, Pseudomonas aeruginosa PA01
ggcggccguagccgucg

SEQ ID NO: 3467258 - RNA, 13 nt, Pseudomonas aeruginosa PA01
ggcggccguccuc

SEQ ID NO: 3467259 - RNA, 17 nt, Pseudomonas aeruginosa PA01
ggcggccgucgcuggcu

SEQ ID NO: 3467260 - RNA, 15 nt, Pseudomonas aeruginosa PA01
ggcggccucaggccu

SEQ ID NO: 3467261 - RNA, 17 nt, Pseudomonas aeruginosa PA01
ggcggccucaggccugg

SEQ ID NO: 3467262 - RNA, 19 nt, Pseudomonas aeruginosa PA01
ggcggccucaggccuggcg

SEQ ID NO: 3467263 - RNA, 21 nt, Pseudomonas aeruginosa PA01
ggcggccucaggccuggcgca

SEQ ID NO: 3467264 - RNA, 14 nt, Pseudomonas aeruginosa PA01
ggcggccucgaggu

SEQ ID NO: 3467265 - RNA, 22 nt, Pseudomonas aeruginosa PA01
ggcggccucgaggucggccugg

SEQ ID NO: 3467266 - RNA, 16 nt, Pseudomonas aeruginosa PA01
ggcggccucgauggcg

SEQ ID NO: 3467267 - RNA, 19 nt, Pseudomonas aeruginosa PA01
ggcggccucgauggcggca

SEQ ID NO: 3467268 - RNA, 14 nt, Pseudomonas aeruginosa PA01
ggcggccucgcggg

SEQ ID NO: 3467269 - RNA, 19 nt, Pseudomonas aeruginosa PA01
ggcggccucguaggcggcg

SEQ ID NO: 3467270 - RNA, 14 nt, Pseudomonas aeruginosa PA01
ggcggccugagccg

SEQ ID NO: 3467271 - RNA, 16 nt, Pseudomonas aeruginosa PA01
ggcggccugagccggc

SEQ ID NO: 3467272 - RNA, 16 nt, Pseudomonas aeruginosa PA01
ggcggccugccccgcc

SEQ ID NO: 3467273 - RNA, 22 nt, Pseudomonas aeruginosa PA01
ggcggccugccccgccggcgcu

SEQ ID NO: 3467274 - RNA, 17 nt, Pseudomonas aeruginosa PA01
ggcggccugcucgcgca

SEQ ID NO: 3467275 - RNA, 21 nt, Pseudomonas aeruginosa PA01
ggcggccugcucgcgcagcca

SEQ ID NO: 3467276 - RNA, 24 nt, Pseudomonas aeruginosa PA01
ggcggccugcucgcgcagccaggc

SEQ ID NO: 3467277 - RNA, 12 nt, Pseudomonas aeruginosa PA01
ggcggccugggu

SEQ ID NO: 3467278 - RNA, 11 nt, Pseudomonas aeruginosa PA01
ggcggccuggu

SEQ ID NO: 3467279 - RNA, 19 nt, Pseudomonas aeruginosa PA01
ggcggccugguagucgccg

SEQ ID NO: 3467280 - RNA, 14 nt, Pseudomonas aeruginosa PA01
ggcggccuucggcg

SEQ ID NO: 3467281 - RNA, 24 nt, Pseudomonas aeruginosa PA01
ggcggccuuuucggcggccaggcg

SEQ ID NO: 3467282 - RNA, 16 nt, Pseudomonas aeruginosa PA01
ggcggcgaaagccauc

SEQ ID NO: 3467283 - RNA, 15 nt, Pseudomonas aeruginosa PA01
ggcggcgaaggccgc

SEQ ID NO: 3467284 - RNA, 18 nt, Pseudomonas aeruginosa PA01
ggcggcgaaggccgcuug

SEQ ID NO: 3467285 - RNA, 19 nt, Pseudomonas aeruginosa PA01
ggcggcgacccagaccugc

SEQ ID NO: 3467286 - RNA, 13 nt, Pseudomonas aeruginosa PA01
ggcggcgaccgaa

SEQ ID NO: 3467287 - RNA, 21 nt, Pseudomonas aeruginosa PA01
ggcggcgaccgaacagcgcgc

SEQ ID NO: 3467288 - RNA, 12 nt, Pseudomonas aeruginosa PA01
ggcggcgaccgc

SEQ ID NO: 3467289 - RNA, 13 nt, Pseudomonas aeruginosa PA01
ggcggcgaccgca

SEQ ID NO: 3467290 - RNA, 22 nt, Pseudomonas aeruginosa PA01
ggcggcgaccgcaucguuggcg

SEQ ID NO: 3467291 - RNA, 18 nt, Pseudomonas aeruginosa PA01
ggcggcgaccggccucac

SEQ ID NO: 3467292 - RNA, 18 nt, Pseudomonas aeruginosa PA01
ggcggcgacgaagguauc

SEQ ID NO: 3467293 - RNA, 15 nt, Pseudomonas aeruginosa PA01
ggcggcgacgcuggc

SEQ ID NO: 3467294 - RNA, 15 nt, Pseudomonas aeruginosa PA01
ggcggcgagcgccgc

SEQ ID NO: 3467295 - RNA, 18 nt, Pseudomonas aeruginosa PA01
ggcggcgagcgccgcggc

SEQ ID NO: 3467296 - RNA, 12 nt, Pseudomonas aeruginosa PA01
ggcggcgaucgc

SEQ ID NO: 3467297 - RNA, 13 nt, Pseudomonas aeruginosa PA01
ggcggcgaugacc

SEQ ID NO: 3467298 - RNA, 13 nt, Pseudomonas aeruginosa PA01
ggcggcgauggac

SEQ ID NO: 3467299 - RNA, 14 nt, Pseudomonas aeruginosa PA01
ggcggcgcaucggc

SEQ ID NO: 3467300 - RNA, 15 nt, Pseudomonas aeruginosa PA01
ggcggcgcaucggcg

SEQ ID NO: 3467301 - RNA, 23 nt, Pseudomonas aeruginosa PA01
ggcggcgccaccgcgacgcgcug

SEQ ID NO: 3467302 - RNA, 14 nt, Pseudomonas aeruginosa PA01
ggcggcgccaggcc

SEQ ID NO: 3467303 - RNA, 16 nt, Pseudomonas aeruginosa PA01
ggcggcgccaggccgg

SEQ ID NO: 3467304 - RNA, 17 nt, Pseudomonas aeruginosa PA01
ggcggcgccaggccggc

SEQ ID NO: 3467305 - RNA, 14 nt, Pseudomonas aeruginosa PA01
ggcggcgccgaaca

SEQ ID NO: 3467306 - RNA, 14 nt, Pseudomonas aeruginosa PA01
ggcggcgccggcag

SEQ ID NO: 3467307 - RNA, 20 nt, Pseudomonas aeruginosa PA01
ggcggcgccggugaggcgca

SEQ ID NO: 3467308 - RNA, 15 nt, Pseudomonas aeruginosa PA01
ggcggcgccuucgcc

SEQ ID NO: 3467309 - RNA, 17 nt, Pseudomonas aeruginosa PA01
ggcggcgccuucgccgg

SEQ ID NO: 3467310 - RNA, 20 nt, Pseudomonas aeruginosa PA01
ggcggcgccuucgccggaag

SEQ ID NO: 3467311 - RNA, 20 nt, Pseudomonas aeruginosa PA01
ggcggcgccuugcgguccag

SEQ ID NO: 3467312 - RNA, 21 nt, Pseudomonas aeruginosa PA01
ggcggcgcgaaccagcagcag

SEQ ID NO: 3467313 - RNA, 15 nt, Pseudomonas aeruginosa PA01
ggcggcgcgcagcga

SEQ ID NO: 3467314 - RNA, 15 nt, Pseudomonas aeruginosa PA01
ggcggcgcggagcug

SEQ ID NO: 3467315 - RNA, 14 nt, Pseudomonas aeruginosa PA01
ggcggcgcggcagu

SEQ ID NO: 3467316 - RNA, 12 nt, Pseudomonas aeruginosa PA01
ggcggcgcggcg

SEQ ID NO: 3467317 - RNA, 14 nt, Pseudomonas aeruginosa PA01
ggcggcgcggcgca

SEQ ID NO: 3467318 - RNA, 13 nt, Pseudomonas aeruginosa PA01
ggcggcgcggcgg

SEQ ID NO: 3467319 - RNA, 13 nt, Pseudomonas aeruginosa PA01
ggcggcgcggcgu

SEQ ID NO: 3467320 - RNA, 16 nt, Pseudomonas aeruginosa PA01
ggcggcgcggcguacu

SEQ ID NO: 3467321 - RNA, 15 nt, Pseudomonas aeruginosa PA01
ggcggcgcggcgugg

SEQ ID NO: 3467322 - RNA, 11 nt, Pseudomonas aeruginosa PA01
ggcggcgcggg

SEQ ID NO: 3467323 - RNA, 13 nt, Pseudomonas aeruginosa PA01
ggcggcgcgggcg

SEQ ID NO: 3467324 - RNA, 20 nt, Pseudomonas aeruginosa PA01
ggcggcgcgggucugcucgc

SEQ ID NO: 3467325 - RNA, 15 nt, Pseudomonas aeruginosa PA01
ggcggcgcuauccgc

SEQ ID NO: 3467326 - RNA, 11 nt, Pseudomonas aeruginosa PA01
ggcggcgcuca

SEQ ID NO: 3467327 - RNA, 16 nt, Pseudomonas aeruginosa PA01
ggcggcgcucacccac

SEQ ID NO: 3467328 - RNA, 16 nt, Pseudomonas aeruginosa PA01
ggcggcgcucagucga

SEQ ID NO: 3467329 - RNA, 23 nt, Pseudomonas aeruginosa PA01
ggcggggaagccuucgcccggcu

SEQ ID NO: 3467330 - RNA, 22 nt, Pseudomonas aeruginosa PA01
ggcgggguauuaccccgcccac

SEQ ID NO: 3467331 - RNA, 18 nt, Pseudomonas aeruginosa PA01
ggcggggucgcgccggug

SEQ ID NO: 3467332 - RNA, 18 nt, Pseudomonas aeruginosa PA01
ggcggguaaagcgcccgc

SEQ ID NO: 3467333 - RNA, 18 nt, Pseudomonas aeruginosa PA01
ggcggguagagucgcucg

SEQ ID NO: 3467334 - RNA, 21 nt, Pseudomonas aeruginosa PA01
ggcggguaguguuugcgcagg

SEQ ID NO: 3467335 - RNA, 21 nt, Pseudomonas aeruginosa PA01
ggcggguauccgccgggccgc

SEQ ID NO: 3467336 - RNA, 22 nt, Pseudomonas aeruginosa PA01
ggcgggugcguggugcauccgc

SEQ ID NO: 3467337 - RNA, 20 nt, Pseudomonas aeruginosa PA01
ggcgggugugguccgcggug

SEQ ID NO: 3467338 - RNA, 23 nt, Pseudomonas aeruginosa PA01
ggcggguucagcccgccgugcgc

SEQ ID NO: 3467339 - RNA, 14 nt, Pseudomonas aeruginosa PA01
ggcggguucggcgu

SEQ ID NO: 3467340 - RNA, 15 nt, Pseudomonas aeruginosa PA01
ggcgguacaccgcca

SEQ ID NO: 3467341 - RNA, 15 nt, Pseudomonas aeruginosa PA01
ggcgguacagccccc

SEQ ID NO: 3467342 - RNA, 17 nt, Pseudomonas aeruginosa PA01
ggcgguacagcccccag

SEQ ID NO: 3467343 - RNA, 18 nt, Pseudomonas aeruginosa PA01
ggcgguacagcccccagg

SEQ ID NO: 3467344 - RNA, 14 nt, Pseudomonas aeruginosa PA01
ggcgguacaggcgc

SEQ ID NO: 3467345 - RNA, 15 nt, Pseudomonas aeruginosa PA01
ggcgguacaggcgca

SEQ ID NO: 3467346 - RNA, 14 nt, Pseudomonas aeruginosa PA01
ggcgguagcccggc

SEQ ID NO: 3467347 - RNA, 18 nt, Pseudomonas aeruginosa PA01
ggcgguagcccggcagcu

SEQ ID NO: 3467348 - RNA, 22 nt, Pseudomonas aeruginosa PA01
ggcgguagccgaggcggccgag

SEQ ID NO: 3467349 - RNA, 18 nt, Pseudomonas aeruginosa PA01
ggcgguagcgccgcgcca

SEQ ID NO: 3467350 - RNA, 13 nt, Pseudomonas aeruginosa PA01
ggcgguagcgcga

SEQ ID NO: 3467351 - RNA, 20 nt, Pseudomonas aeruginosa PA01
ggcgguaggugagcgacccg

SEQ ID NO: 3467352 - RNA, 22 nt, Pseudomonas aeruginosa PA01
ggcgguaguaggguucgccgac

SEQ ID NO: 3467353 - RNA, 18 nt, Pseudomonas aeruginosa PA01
ggcggucagaucagcggg

SEQ ID NO: 3467354 - RNA, 15 nt, Pseudomonas aeruginosa PA01
ggcggucagcgacug

SEQ ID NO: 3467355 - RNA, 16 nt, Pseudomonas aeruginosa PA01
ggcggucagcgacugg

SEQ ID NO: 3467356 - RNA, 18 nt, Pseudomonas aeruginosa PA01
ggcggucagcgacuggcc

SEQ ID NO: 3467357 - RNA, 11 nt, Pseudomonas aeruginosa PA01
ggcggucaggc

SEQ ID NO: 3467358 - RNA, 16 nt, Pseudomonas aeruginosa PA01
ggcggucaggcucagc

SEQ ID NO: 3467359 - RNA, 17 nt, Pseudomonas aeruginosa PA01
ggcggucaggcucagcu

SEQ ID NO: 3467360 - RNA, 18 nt, Pseudomonas aeruginosa PA01
ggcggucaucgcgccgcc

SEQ ID NO: 3467361 - RNA, 19 nt, Pseudomonas aeruginosa PA01
ggcggucaucgcgccgccg

SEQ ID NO: 3467362 - RNA, 16 nt, Pseudomonas aeruginosa PA01
ggcggucaugcgcccu

SEQ ID NO: 3467363 - RNA, 12 nt, Pseudomonas aeruginosa PA01
ggcgguccagcc

SEQ ID NO: 3467364 - RNA, 14 nt, Pseudomonas aeruginosa PA01
ggcgguccagguca

SEQ ID NO: 3467365 - RNA, 16 nt, Pseudomonas aeruginosa PA01
ggcggucccagaccag

SEQ ID NO: 3467366 - RNA, 17 nt, Pseudomonas aeruginosa PA01
ggcggucccagaccagc

SEQ ID NO: 3467367 - RNA, 22 nt, Pseudomonas aeruginosa PA01
ggcggucccagaccagcagcgg

SEQ ID NO: 3467368 - RNA, 16 nt, Pseudomonas aeruginosa PA01
ggcggucccaucagca

SEQ ID NO: 3467369 - RNA, 15 nt, Pseudomonas aeruginosa PA01
ggcggucccuucgug

SEQ ID NO: 3467370 - RNA, 23 nt, Pseudomonas aeruginosa PA01
ggcggucgagacgccaucaacgg

SEQ ID NO: 3467371 - RNA, 12 nt, Pseudomonas aeruginosa PA01
ggcggucgaggc

SEQ ID NO: 3467372 - RNA, 15 nt, Pseudomonas aeruginosa PA01
ggcggucgccgaaca

SEQ ID NO: 3467373 - RNA, 19 nt, Pseudomonas aeruginosa PA01
ggcggucgccgaacagccg

SEQ ID NO: 3467374 - RNA, 20 nt, Pseudomonas aeruginosa PA01
ggcggucgccgaacagccgc

SEQ ID NO: 3467375 - RNA, 15 nt, Pseudomonas aeruginosa PA01
ggcggucgccgaccc

SEQ ID NO: 3467376 - RNA, 19 nt, Pseudomonas aeruginosa PA01
ggcggucgccgacccagag

SEQ ID NO: 3467377 - RNA, 14 nt, Pseudomonas aeruginosa PA01
ggcggucgccgccg

SEQ ID NO: 3467378 - RNA, 18 nt, Pseudomonas aeruginosa PA01
ggcggucgccgccggcga

SEQ ID NO: 3467379 - RNA, 21 nt, Pseudomonas aeruginosa PA01
ggcggucgccgccggcgaaca

SEQ ID NO: 3467380 - RNA, 13 nt, Pseudomonas aeruginosa PA01
ggcggucgcgauc

SEQ ID NO: 3467381 - RNA, 19 nt, Pseudomonas aeruginosa PA01
ggcggucgcgaucugcugg

SEQ ID NO: 3467382 - RNA, 13 nt, Pseudomonas aeruginosa PA01
ggcggucgcggac

SEQ ID NO: 3467383 - RNA, 14 nt, Pseudomonas aeruginosa PA01
ggcggucgcggacc

SEQ ID NO: 3467384 - RNA, 16 nt, Pseudomonas aeruginosa PA01
ggcggucggccaggcg

SEQ ID NO: 3467385 - RNA, 18 nt, Pseudomonas aeruginosa PA01
ggcggucggccaggcggc

SEQ ID NO: 3467386 - RNA, 21 nt, Pseudomonas aeruginosa PA01
ggcggucggccaggcggccga

SEQ ID NO: 3467387 - RNA, 22 nt, Pseudomonas aeruginosa PA01
ggcggucggccaucuggcugcc

SEQ ID NO: 3467388 - RNA, 16 nt, Pseudomonas aeruginosa PA01
ggcggucggcgagggc

SEQ ID NO: 3467389 - RNA, 19 nt, Pseudomonas aeruginosa PA01
ggcggucgucgccaucgcu

SEQ ID NO: 3467390 - RNA, 19 nt, Pseudomonas aeruginosa PA01
ggcggucucgaacgccagg

SEQ ID NO: 3467391 - RNA, 24 nt, Pseudomonas aeruginosa PA01
ggcggucucgaacgccaggcaggc

SEQ ID NO: 3467392 - RNA, 16 nt, Pseudomonas aeruginosa PA01
ggcggucucggcgggu

SEQ ID NO: 3467393 - RNA, 13 nt, Pseudomonas aeruginosa PA01
ggcggugaccagc

SEQ ID NO: 3467394 - RNA, 14 nt, Pseudomonas aeruginosa PA01
ggcggugaccagcg

SEQ ID NO: 3467395 - RNA, 16 nt, Pseudomonas aeruginosa PA01
ggcggugaccagcggc

SEQ ID NO: 3467396 - RNA, 17 nt, Pseudomonas aeruginosa PA01
ggcggugaccagcggca

SEQ ID NO: 3467397 - RNA, 19 nt, Pseudomonas aeruginosa PA01
ggcggugaccagcggcacc

SEQ ID NO: 3467398 - RNA, 14 nt, Pseudomonas aeruginosa PA01
ggcggugagggcga

SEQ ID NO: 3467399 - RNA, 16 nt, Pseudomonas aeruginosa PA01
ggcggugagguugccg

SEQ ID NO: 3467400 - RNA, 18 nt, Pseudomonas aeruginosa PA01
ggcggugagguugccgcc

SEQ ID NO: 3467401 - RNA, 22 nt, Pseudomonas aeruginosa PA01
ggcggugagguugccgccgauc

SEQ ID NO: 3467402 - RNA, 13 nt, Pseudomonas aeruginosa PA01
ggcggugccaugg

SEQ ID NO: 3467403 - RNA, 17 nt, Pseudomonas aeruginosa PA01
ggcggugccauggauca

SEQ ID NO: 3467404 - RNA, 20 nt, Pseudomonas aeruginosa PA01
ggcggugccauggaucacca

SEQ ID NO: 3467405 - RNA, 12 nt, Pseudomonas aeruginosa PA01
ggcggugccgca

SEQ ID NO: 3467406 - RNA, 13 nt, Pseudomonas aeruginosa PA01
ggcggugcgcaug

SEQ ID NO: 3467407 - RNA, 14 nt, Pseudomonas aeruginosa PA01
ggcggugcgccggc

SEQ ID NO: 3467408 - RNA, 18 nt, Pseudomonas aeruginosa PA01
ggcggugcggaagacgaa

SEQ ID NO: 3467409 - RNA, 16 nt, Pseudomonas aeruginosa PA01
ggcggugcggucggcg

SEQ ID NO: 3467410 - RNA, 14 nt, Pseudomonas aeruginosa PA01
ggcggugcguucgc

SEQ ID NO: 3467411 - RNA, 20 nt, Pseudomonas aeruginosa PA01
ggcggugcguucgcgggcgc

SEQ ID NO: 3467412 - RNA, 18 nt, Pseudomonas aeruginosa PA01
ggcgguggagcacgucga

SEQ ID NO: 3467413 - RNA, 19 nt, Pseudomonas aeruginosa PA01
ggcgguggccacgucgccc

SEQ ID NO: 3467414 - RNA, 14 nt, Pseudomonas aeruginosa PA01
ggcgguggccgcgu

SEQ ID NO: 3467415 - RNA, 19 nt, Pseudomonas aeruginosa PA01
ggcgguggccgugggccgc

SEQ ID NO: 3467416 - RNA, 17 nt, Pseudomonas aeruginosa PA01
ggcgguguagaccacca

SEQ ID NO: 3467417 - RNA, 19 nt, Pseudomonas aeruginosa PA01
ggcgguguagaccaccagc

SEQ ID NO: 3467418 - RNA, 22 nt, Pseudomonas aeruginosa PA01
ggcgguguagaccaccagcagg

SEQ ID NO: 3467419 - RNA, 20 nt, Pseudomonas aeruginosa PA01
ggcgguguccauguugccgu

SEQ ID NO: 3467420 - RNA, 19 nt, Pseudomonas aeruginosa PA01
ggcgguuauuccgcgggac

SEQ ID NO: 3467421 - RNA, 21 nt, Pseudomonas aeruginosa PA01
ggcgguuccagacauccgggu

SEQ ID NO: 3467422 - RNA, 20 nt, Pseudomonas aeruginosa PA01
ggcgguucgccgagcgccgc

SEQ ID NO: 3467423 - RNA, 21 nt, Pseudomonas aeruginosa PA01
ggcgguucgccgagcgccgcc

SEQ ID NO: 3467424 - RNA, 15 nt, Pseudomonas aeruginosa PA01
ggcgguucucgucga

SEQ ID NO: 3467425 - RNA, 15 nt, Pseudomonas aeruginosa PA01
ggcgguucugggugg

SEQ ID NO: 3467426 - RNA, 17 nt, Pseudomonas aeruginosa PA01
ggcgguugaugccgacg

SEQ ID NO: 3467427 - RNA, 14 nt, Pseudomonas aeruginosa PA01
ggcgguuggcccgc

SEQ ID NO: 3467428 - RNA, 23 nt, Pseudomonas aeruginosa PA01
ggcgguuguucagcgggcgcuug

SEQ ID NO: 3467429 - RNA, 14 nt, Pseudomonas aeruginosa PA01
ggcgguuucgccga

SEQ ID NO: 3467430 - RNA, 14 nt, Pseudomonas aeruginosa PA01
ggcgguuucgucga

SEQ ID NO: 3467431 - RNA, 17 nt, Pseudomonas aeruginosa PA01
ggcguacaggccccagg

SEQ ID NO: 3467432 - RNA, 16 nt, Pseudomonas aeruginosa PA01
ggcgucggcgaucacg

SEQ ID NO: 3467433 - RNA, 16 nt, Pseudomonas aeruginosa PA01
ggcgucggcgcgggcg

SEQ ID NO: 3467434 - RNA, 21 nt, Pseudomonas aeruginosa PA01
ggcgucggcgcgggcgccgau

SEQ ID NO: 3467435 - RNA, 15 nt, Pseudomonas aeruginosa PA01
ggcgucggcugcgcu

SEQ ID NO: 3467436 - RNA, 21 nt, Pseudomonas aeruginosa PA01
ggcgucggcugcgcugggcgc

SEQ ID NO: 3467437 - RNA, 15 nt, Pseudomonas aeruginosa PA01
ggcgucggcuggucg

SEQ ID NO: 3467438 - RNA, 16 nt, Pseudomonas aeruginosa PA01
ggcgucggcuggucga

SEQ ID NO: 3467439 - RNA, 13 nt, Pseudomonas aeruginosa PA01
ggcgucgggcagg

SEQ ID NO: 3467440 - RNA, 18 nt, Pseudomonas aeruginosa PA01
ggcgucgggcaguacuca

SEQ ID NO: 3467441 - RNA, 23 nt, Pseudomonas aeruginosa PA01
ggcgucgggcgaaacggcaggcc

SEQ ID NO: 3467442 - RNA, 23 nt, Pseudomonas aeruginosa PA01
ggcgucguccucgaaagccgccg

SEQ ID NO: 3467443 - RNA, 19 nt, Pseudomonas aeruginosa PA01
ggcgucguccugcgcggcg

SEQ ID NO: 3467444 - RNA, 20 nt, Pseudomonas aeruginosa PA01
ggcgucguccugcgcggcga

SEQ ID NO: 3467445 - RNA, 22 nt, Pseudomonas aeruginosa PA01
ggcgucguccugcgcggcgacg

SEQ ID NO: 3467446 - RNA, 16 nt, Pseudomonas aeruginosa PA01
ggcgucgucgaucgga

SEQ ID NO: 3467447 - RNA, 20 nt, Pseudomonas aeruginosa PA01
ggcgucgucggggugccgcc

SEQ ID NO: 3467448 - RNA, 13 nt, Pseudomonas aeruginosa PA01
ggcgucguugccg

SEQ ID NO: 3467449 - RNA, 23 nt, Pseudomonas aeruginosa PA01
ggcgucguuguugcgggcgagca

SEQ ID NO: 3467450 - RNA, 22 nt, Pseudomonas aeruginosa PA01
ggcgucucauggaacagcagcc

SEQ ID NO: 3467451 - RNA, 14 nt, Pseudomonas aeruginosa PA01
ggcgucuccugccg

SEQ ID NO: 3467452 - RNA, 21 nt, Pseudomonas aeruginosa PA01
ggcgucucggagugaggccga

SEQ ID NO: 3467453 - RNA, 22 nt, Pseudomonas aeruginosa PA01
ggcgucucggagugaggccgag

SEQ ID NO: 3467454 - RNA, 23 nt, Pseudomonas aeruginosa PA01
ggcgucucggagugaggccgagc

SEQ ID NO: 3467455 - RNA, 15 nt, Pseudomonas aeruginosa PA01
ggcgucugcccgguc

SEQ ID NO: 3467456 - RNA, 15 nt, Pseudomonas aeruginosa PA01
ggcgucugccgcucg

SEQ ID NO: 3467457 - RNA, 22 nt, Pseudomonas aeruginosa PA01
ggcgucugcucauucggccagc

SEQ ID NO: 3467458 - RNA, 23 nt, Pseudomonas aeruginosa PA01
ggcgucugcucauucggccagcg

SEQ ID NO: 3467459 - RNA, 20 nt, Pseudomonas aeruginosa PA01
ggcgucuggggugaggccga

SEQ ID NO: 3467460 - RNA, 21 nt, Pseudomonas aeruginosa PA01
ggcgucuggggugaggccgag

SEQ ID NO: 3467461 - RNA, 22 nt, Pseudomonas aeruginosa PA01
ggcgucuggggugaggccgagc

SEQ ID NO: 3467462 - RNA, 20 nt, Pseudomonas aeruginosa PA01
ggcgucuuccggcucgccgc

SEQ ID NO: 3467463 - RNA, 13 nt, Pseudomonas aeruginosa PA01
ggcgucuucggcg

SEQ ID NO: 3467464 - RNA, 19 nt, Pseudomonas aeruginosa PA01
ggcgucuucggcggcgccg

SEQ ID NO: 3467465 - RNA, 16 nt, Pseudomonas aeruginosa PA01
ggcgugaacgcggcga

SEQ ID NO: 3467466 - RNA, 14 nt, Pseudomonas aeruginosa PA01
ggcgugaagccgcc

SEQ ID NO: 3467467 - RNA, 16 nt, Pseudomonas aeruginosa PA01
ggcgugaagccgccgc

SEQ ID NO: 3467468 - RNA, 22 nt, Pseudomonas aeruginosa PA01
ggcgugaagccgccgcccagca

SEQ ID NO: 3467469 - RNA, 15 nt, Pseudomonas aeruginosa PA01
ggcgugaaguagccg

SEQ ID NO: 3467470 - RNA, 18 nt, Pseudomonas aeruginosa PA01
ggcgugaaguagccgccg

SEQ ID NO: 3467471 - RNA, 20 nt, Pseudomonas aeruginosa PA01
ggcgugacugcaaucgacca

SEQ ID NO: 3467472 - RNA, 20 nt, Pseudomonas aeruginosa PA01
ggcgugagcagggccgagcg

SEQ ID NO: 3467473 - RNA, 20 nt, Pseudomonas aeruginosa PA01
ggcgugagggucgcgccgac

SEQ ID NO: 3467474 - RNA, 15 nt, Pseudomonas aeruginosa PA01
ggcgugauccgcagg

SEQ ID NO: 3467475 - RNA, 19 nt, Pseudomonas aeruginosa PA01
ggcgugcagaccgucgauc

SEQ ID NO: 3467476 - RNA, 14 nt, Pseudomonas aeruginosa PA01
ggcgugcaggccga

SEQ ID NO: 3467477 - RNA, 17 nt, Pseudomonas aeruginosa PA01
ggcgugcaggccgauca

SEQ ID NO: 3467478 - RNA, 20 nt, Pseudomonas aeruginosa PA01
ggcgugcaggccgccgagug

SEQ ID NO: 3467479 - RNA, 23 nt, Pseudomonas aeruginosa PA01
ggcgugcaggguauuuuccagca

SEQ ID NO: 3467480 - RNA, 19 nt, Pseudomonas aeruginosa PA01
ggcgugcagguagcagccg

SEQ ID NO: 3467481 - RNA, 22 nt, Pseudomonas aeruginosa PA01
ggcgugcaguacuuggccagca

SEQ ID NO: 3467482 - RNA, 18 nt, Pseudomonas aeruginosa PA01
ggcgugcauggccgggcc

SEQ ID NO: 3467483 - RNA, 23 nt, Pseudomonas aeruginosa PA01
ggcgugcauggccgggccgauca

SEQ ID NO: 3467484 - RNA, 22 nt, Pseudomonas aeruginosa PA01
ggcgugcccauccgcucggcga

SEQ ID NO: 3467485 - RNA, 23 nt, Pseudomonas aeruginosa PA01
ggcgugcccauccgcucggcgag

SEQ ID NO: 3467486 - RNA, 20 nt, Pseudomonas aeruginosa PA01
ggcgugccgaccuguaccgc

SEQ ID NO: 3467487 - RNA, 13 nt, Pseudomonas aeruginosa PA01
ggcgugccgcagg

SEQ ID NO: 3467488 - RNA, 14 nt, Pseudomonas aeruginosa PA01
ggcgugccgcaggc

SEQ ID NO: 3467489 - RNA, 17 nt, Pseudomonas aeruginosa PA01
ggcgugccgcaggccgc

SEQ ID NO: 3467490 - RNA, 22 nt, Pseudomonas aeruginosa PA01
ggcgugccgcaggccgcggccg

SEQ ID NO: 3467491 - RNA, 14 nt, Pseudomonas aeruginosa PA01
ggcgugccgccagg

SEQ ID NO: 3467492 - RNA, 16 nt, Pseudomonas aeruginosa PA01
ggcgugccgccaggcc

SEQ ID NO: 3467493 - RNA, 17 nt, Pseudomonas aeruginosa PA01
ggcgugccgccaggccu

SEQ ID NO: 3467494 - RNA, 18 nt, Pseudomonas aeruginosa PA01
ggcgugccgccaggccuu

SEQ ID NO: 3467495 - RNA, 12 nt, Pseudomonas aeruginosa PA01
ggcgugccgcug

SEQ ID NO: 3467496 - RNA, 15 nt, Pseudomonas aeruginosa PA01
ggcgugccgggcagu

SEQ ID NO: 3467497 - RNA, 17 nt, Pseudomonas aeruginosa PA01
ggcgugccgggccggcc

SEQ ID NO: 3467498 - RNA, 18 nt, Pseudomonas aeruginosa PA01
ggcgugccguggcucggc

SEQ ID NO: 3467499 - RNA, 20 nt, Pseudomonas aeruginosa PA01
ggcgugccguggcucggcgg

SEQ ID NO: 3467500 - RNA, 14 nt, Pseudomonas aeruginosa PA01
ggcgugccuguucc

SEQ ID NO: 3467501 - RNA, 21 nt, Pseudomonas aeruginosa PA01
ggcgugccuguuccuccgcca

SEQ ID NO: 3467502 - RNA, 14 nt, Pseudomonas aeruginosa PA01
ggcgugcuccagca

SEQ ID NO: 3467503 - RNA, 15 nt, Pseudomonas aeruginosa PA01
ggcgugcucggcgau

SEQ ID NO: 3467504 - RNA, 13 nt, Pseudomonas aeruginosa PA01
ggcgugcugcacg

SEQ ID NO: 3467505 - RNA, 23 nt, Pseudomonas aeruginosa PA01
ggcgugcugggucuccuccucca

SEQ ID NO: 3467506 - RNA, 14 nt, Pseudomonas aeruginosa PA01
ggcgugcuuggcga

SEQ ID NO: 3467507 - RNA, 13 nt, Pseudomonas aeruginosa PA01
ggcguggccggcg

SEQ ID NO: 3467508 - RNA, 14 nt, Pseudomonas aeruginosa PA01
ggcguggccggcga

SEQ ID NO: 3467509 - RNA, 16 nt, Pseudomonas aeruginosa PA01
ggcguggcggccgccg

SEQ ID NO: 3467510 - RNA, 17 nt, Pseudomonas aeruginosa PA01
ggcguggcggccgccgg

SEQ ID NO: 3467511 - RNA, 19 nt, Pseudomonas aeruginosa PA01
ggcguggcucgaucagccg

SEQ ID NO: 3467512 - RNA, 21 nt, Pseudomonas aeruginosa PA01
ggcguggcucgaucagccggc

SEQ ID NO: 3467513 - RNA, 13 nt, Pseudomonas aeruginosa PA01
ggcgugggccagc

SEQ ID NO: 3467514 - RNA, 17 nt, Pseudomonas aeruginosa PA01
ggcgugggccagcccag

SEQ ID NO: 3467515 - RNA, 13 nt, Pseudomonas aeruginosa PA01
ggcgugggcgccg

SEQ ID NO: 3467516 - RNA, 20 nt, Pseudomonas aeruginosa PA01
ggcgugggcgccggcgcgca

SEQ ID NO: 3467517 - RNA, 17 nt, Pseudomonas aeruginosa PA01
ggcgugggcggucggcg

SEQ ID NO: 3467518 - RNA, 15 nt, Pseudomonas aeruginosa PA01
ggcgugggcugacau

SEQ ID NO: 3467519 - RNA, 22 nt, Pseudomonas aeruginosa PA01
ggcguggggaagacggccagga

SEQ ID NO: 3467520 - RNA, 24 nt, Pseudomonas aeruginosa PA01
ggcguggggaagacggccaggaug

SEQ ID NO: 3467521 - RNA, 14 nt, Pseudomonas aeruginosa PA01
ggcguggucggcgg

SEQ ID NO: 3467522 - RNA, 16 nt, Pseudomonas aeruginosa PA01
ggcguggucggcggcc

SEQ ID NO: 3467523 - RNA, 19 nt, Pseudomonas aeruginosa PA01
ggcguggucuccgugcugg

SEQ ID NO: 3467524 - RNA, 22 nt, Pseudomonas aeruginosa PA01
ggcguggucuccgugcuggccg

SEQ ID NO: 3467525 - RNA, 19 nt, Pseudomonas aeruginosa PA01
ggcgugguggaugacccgc

SEQ ID NO: 3467526 - RNA, 17 nt, Pseudomonas aeruginosa PA01
ggcgugguggcggggaa

SEQ ID NO: 3467527 - RNA, 13 nt, Pseudomonas aeruginosa PA01
ggcgugucgaggg

SEQ ID NO: 3467528 - RNA, 13 nt, Pseudomonas aeruginosa PA01
ggcguguucgucg

SEQ ID NO: 3467529 - RNA, 14 nt, Pseudomonas aeruginosa PA01
ggcguguucgucga

SEQ ID NO: 3467530 - RNA, 20 nt, Pseudomonas aeruginosa PA01
ggcguuacaguaucgcuuag

SEQ ID NO: 3467531 - RNA, 13 nt, Pseudomonas aeruginosa PA01
ggcguuagccgcc

SEQ ID NO: 3467532 - RNA, 13 nt, Pseudomonas aeruginosa PA01
ggcguuauccgcc

SEQ ID NO: 3467533 - RNA, 14 nt, Pseudomonas aeruginosa PA01
ggcguuauccgccg

SEQ ID NO: 3467534 - RNA, 15 nt, Pseudomonas aeruginosa PA01
ggcucaucucguuga

SEQ ID NO: 3467535 - RNA, 15 nt, Pseudomonas aeruginosa PA01
ggcucaugcccagcu

SEQ ID NO: 3467536 - RNA, 15 nt, Pseudomonas aeruginosa PA01
ggcucauggcauggc

SEQ ID NO: 3467537 - RNA, 16 nt, Pseudomonas aeruginosa PA01
ggcucauggccggggu

SEQ ID NO: 3467538 - RNA, 13 nt, Pseudomonas aeruginosa PA01
ggcucaugggcga

SEQ ID NO: 3467539 - RNA, 21 nt, Pseudomonas aeruginosa PA01
ggcuccaauucgacgccgaaa

SEQ ID NO: 3467540 - RNA, 17 nt, Pseudomonas aeruginosa PA01
ggcuccacugcuuggcc

SEQ ID NO: 3467541 - RNA, 20 nt, Pseudomonas aeruginosa PA01
ggcuccacugcuuggccagg

SEQ ID NO: 3467542 - RNA, 21 nt, Pseudomonas aeruginosa PA01
ggcuccacugcuuggccaggc

SEQ ID NO: 3467543 - RNA, 22 nt, Pseudomonas aeruginosa PA01
ggcuccacugcuuggccaggcg

SEQ ID NO: 3467544 - RNA, 17 nt, Pseudomonas aeruginosa PA01
ggcuccagcaucaccuu

SEQ ID NO: 3467545 - RNA, 10 nt, Pseudomonas aeruginosa PA01
ggcuccagcc

SEQ ID NO: 3467546 - RNA, 13 nt, Pseudomonas aeruginosa PA01
ggcuccagccagg

SEQ ID NO: 3467547 - RNA, 15 nt, Pseudomonas aeruginosa PA01
ggcuccagccaggcc

SEQ ID NO: 3467548 - RNA, 14 nt, Pseudomonas aeruginosa PA01
ggcuccagccgcug

SEQ ID NO: 3467549 - RNA, 16 nt, Pseudomonas aeruginosa PA01
ggcuccagccgcugca

SEQ ID NO: 3467550 - RNA, 23 nt, Pseudomonas aeruginosa PA01
ggcuccagccgcugcagggcggc

SEQ ID NO: 3467551 - RNA, 21 nt, Pseudomonas aeruginosa PA01
ggcuccagcgggaaggucggc

SEQ ID NO: 3467552 - RNA, 21 nt, Pseudomonas aeruginosa PA01
ggcuccagcuugucgucggcc

SEQ ID NO: 3467553 - RNA, 15 nt, Pseudomonas aeruginosa PA01
ggcuccaggaccggc

SEQ ID NO: 3467554 - RNA, 13 nt, Pseudomonas aeruginosa PA01
ggcuccagggcga

SEQ ID NO: 3467555 - RNA, 18 nt, Pseudomonas aeruginosa PA01
ggcuccaguugcagcacc

SEQ ID NO: 3467556 - RNA, 14 nt, Pseudomonas aeruginosa PA01
ggcucccccgcgcc

SEQ ID NO: 3467557 - RNA, 12 nt, Pseudomonas aeruginosa PA01
ggcuccccugga

SEQ ID NO: 3467558 - RNA, 21 nt, Pseudomonas aeruginosa PA01
ggcuccccuggagcccccguu

SEQ ID NO: 3467559 - RNA, 22 nt, Pseudomonas aeruginosa PA01
ggcucccugcaauggggcggcc

SEQ ID NO: 3467560 - RNA, 15 nt, Pseudomonas aeruginosa PA01
ggcuccgacuggugg

SEQ ID NO: 3467561 - RNA, 15 nt, Pseudomonas aeruginosa PA01
ggcuccgccgcgagc

SEQ ID NO: 3467562 - RNA, 20 nt, Pseudomonas aeruginosa PA01
ggcuccgcugcucagggcuc

SEQ ID NO: 3467563 - RNA, 12 nt, Pseudomonas aeruginosa PA01
ggcuccggcgcc

SEQ ID NO: 3467564 - RNA, 13 nt, Pseudomonas aeruginosa PA01
ggcuccggcgcca

SEQ ID NO: 3467565 - RNA, 17 nt, Pseudomonas aeruginosa PA01
ggcuccggcgccaggcc

SEQ ID NO: 3467566 - RNA, 19 nt, Pseudomonas aeruginosa PA01
ggcuccggcgccaggccgg

SEQ ID NO: 3467567 - RNA, 13 nt, Pseudomonas aeruginosa PA01
ggcuccggcugcg

SEQ ID NO: 3467568 - RNA, 13 nt, Pseudomonas aeruginosa PA01
ggcuccgggccga

SEQ ID NO: 3467569 - RNA, 19 nt, Pseudomonas aeruginosa PA01
ggcuccggguacuggcgcu

SEQ ID NO: 3467570 - RNA, 16 nt, Pseudomonas aeruginosa PA01
ggcuccucggccuggg

SEQ ID NO: 3467571 - RNA, 13 nt, Pseudomonas aeruginosa PA01
ggcuccucugccu

SEQ ID NO: 3467572 - RNA, 18 nt, Pseudomonas aeruginosa PA01
ggcuccucugccugcgcc

SEQ ID NO: 3467573 - RNA, 21 nt, Pseudomonas aeruginosa PA01
ggcuccucugccugcgcccuc

SEQ ID NO: 3467574 - RNA, 17 nt, Pseudomonas aeruginosa PA01
ggcuccuugaaggcuuc

SEQ ID NO: 3467575 - RNA, 15 nt, Pseudomonas aeruginosa PA01
ggcucgacaggucgg

SEQ ID NO: 3467576 - RNA, 19 nt, Pseudomonas aeruginosa PA01
ggcucgacaggucggcgaa

SEQ ID NO: 3467577 - RNA, 12 nt, Pseudomonas aeruginosa PA01
ggcucgagccga

SEQ ID NO: 3467578 - RNA, 15 nt, Pseudomonas aeruginosa PA01
ggcucgagccgaacu

SEQ ID NO: 3467579 - RNA, 13 nt, Pseudomonas aeruginosa PA01
ggcucgaucagcc

SEQ ID NO: 3467580 - RNA, 16 nt, Pseudomonas aeruginosa PA01
ggcucgaucagccggc

SEQ ID NO: 3467581 - RNA, 14 nt, Pseudomonas aeruginosa PA01
ggcucgaucggcag

SEQ ID NO: 3467582 - RNA, 19 nt, Pseudomonas aeruginosa PA01
ggcucgaucggcagggcgc

SEQ ID NO: 3467583 - RNA, 23 nt, Pseudomonas aeruginosa PA01
ggcucgaucggcagggcgccgac

SEQ ID NO: 3467584 - RNA, 20 nt, Pseudomonas aeruginosa PA01
ggcucgaugaguugcagggc

SEQ ID NO: 3467585 - RNA, 16 nt, Pseudomonas aeruginosa PA01
ggcucgcccagcaggc

SEQ ID NO: 3467586 - RNA, 21 nt, Pseudomonas aeruginosa PA01
ggcucgcccagcaggcgcgcc

SEQ ID NO: 3467587 - RNA, 17 nt, Pseudomonas aeruginosa PA01
ggcucgcccaucugcgc

SEQ ID NO: 3467588 - RNA, 19 nt, Pseudomonas aeruginosa PA01
ggcucgcccaugcgcggcg

SEQ ID NO: 3467589 - RNA, 20 nt, Pseudomonas aeruginosa PA01
ggcucgcccaugcgcggcga

SEQ ID NO: 3467590 - RNA, 14 nt, Pseudomonas aeruginosa PA01
ggcucgccccggcg

SEQ ID NO: 3467591 - RNA, 15 nt, Pseudomonas aeruginosa PA01
ggcucgccccggcgg

SEQ ID NO: 3467592 - RNA, 16 nt, Pseudomonas aeruginosa PA01
ggcucgccccggcggc

SEQ ID NO: 3467593 - RNA, 17 nt, Pseudomonas aeruginosa PA01
ggcucgccccggcggcg

SEQ ID NO: 3467594 - RNA, 18 nt, Pseudomonas aeruginosa PA01
ggcucgccgaaaggccgu

SEQ ID NO: 3467595 - RNA, 21 nt, Pseudomonas aeruginosa PA01
ggcucgccgacuuccaggcgc

SEQ ID NO: 3467596 - RNA, 22 nt, Pseudomonas aeruginosa PA01
ggcucgccgacuuccaggcgca

SEQ ID NO: 3467597 - RNA, 14 nt, Pseudomonas aeruginosa PA01
ggcucgccgccagc

SEQ ID NO: 3467598 - RNA, 15 nt, Pseudomonas aeruginosa PA01
ggcucgccgccagca

SEQ ID NO: 3467599 - RNA, 16 nt, Pseudomonas aeruginosa PA01
ggcucgccgccagcag

SEQ ID NO: 3467600 - RNA, 12 nt, Pseudomonas aeruginosa PA01
ggcucgccgccg

SEQ ID NO: 3467601 - RNA, 19 nt, Pseudomonas aeruginosa PA01
ggcucgccgccgggcgcgc

SEQ ID NO: 3467602 - RNA, 22 nt, Pseudomonas aeruginosa PA01
ggcucgccggguuguccaggcg

SEQ ID NO: 3467603 - RNA, 17 nt, Pseudomonas aeruginosa PA01
ggcucgcgcagcggcgc

SEQ ID NO: 3467604 - RNA, 15 nt, Pseudomonas aeruginosa PA01
ggcucgcgcggggcg

SEQ ID NO: 3467605 - RNA, 20 nt, Pseudomonas aeruginosa PA01
ggcucgcgcggggcgcgcug

SEQ ID NO: 3467606 - RNA, 13 nt, Pseudomonas aeruginosa PA01
ggcucgcggcgcu

SEQ ID NO: 3467607 - RNA, 18 nt, Pseudomonas aeruginosa PA01
ggcucgcggcgcucgucg

SEQ ID NO: 3467608 - RNA, 12 nt, Pseudomonas aeruginosa PA01
ggcucgcucucg

SEQ ID NO: 3467609 - RNA, 23 nt, Pseudomonas aeruginosa PA01
ggcucgcucucgaacaccggcga

SEQ ID NO: 3467610 - RNA, 12 nt, Pseudomonas aeruginosa PA01
ggcucggcagcg

SEQ ID NO: 3467611 - RNA, 16 nt, Pseudomonas aeruginosa PA01
ggcucggccagggccg

SEQ ID NO: 3467612 - RNA, 17 nt, Pseudomonas aeruginosa PA01
ggcucggccagggccgc

SEQ ID NO: 3467613 - RNA, 20 nt, Pseudomonas aeruginosa PA01
ggcucggccuguaccgcuuc

SEQ ID NO: 3467614 - RNA, 19 nt, Pseudomonas aeruginosa PA01
ggcucggcgagcgaaggau

SEQ ID NO: 3467615 - RNA, 12 nt, Pseudomonas aeruginosa PA01
ggcucggcgagg

SEQ ID NO: 3467616 - RNA, 11 nt, Pseudomonas aeruginosa PA01
ggcucggcggc

SEQ ID NO: 3467617 - RNA, 12 nt, Pseudomonas aeruginosa PA01
ggcucggcggca

SEQ ID NO: 3467618 - RNA, 12 nt, Pseudomonas aeruginosa PA01
ggcucggcggcc

SEQ ID NO: 3467619 - RNA, 16 nt, Pseudomonas aeruginosa PA01
ggcucggcgggcugcc

SEQ ID NO: 3467620 - RNA, 19 nt, Pseudomonas aeruginosa PA01
ggcucggcgggcugccgcg

SEQ ID NO: 3467621 - RNA, 22 nt, Pseudomonas aeruginosa PA01
ggcucggcugcuugccggugcc

SEQ ID NO: 3467622 - RNA, 14 nt, Pseudomonas aeruginosa PA01
ggcucgggcgcgga

SEQ ID NO: 3467623 - RNA, 16 nt, Pseudomonas aeruginosa PA01
ggcucgggcgcggaca

SEQ ID NO: 3467624 - RNA, 13 nt, Pseudomonas aeruginosa PA01
ggcucgggcggca

SEQ ID NO: 3467625 - RNA, 18 nt, Pseudomonas aeruginosa PA01
ggcucgggcggcaagggc

SEQ ID NO: 3467626 - RNA, 21 nt, Pseudomonas aeruginosa PA01
ggcucgguucauggacgguau

SEQ ID NO: 3467627 - RNA, 16 nt, Pseudomonas aeruginosa PA01
ggcucgguuccagcuc

SEQ ID NO: 3467628 - RNA, 21 nt, Pseudomonas aeruginosa PA01
ggcucgguuccagcucgucga

SEQ ID NO: 3467629 - RNA, 20 nt, Pseudomonas aeruginosa PA01
ggcucgugccaucaggccgc

SEQ ID NO: 3467630 - RNA, 21 nt, Pseudomonas aeruginosa PA01
ggcucgugccaucaggccgcg

SEQ ID NO: 3467631 - RNA, 14 nt, Pseudomonas aeruginosa PA01
ggcucgugcccucg

SEQ ID NO: 3467632 - RNA, 21 nt, Pseudomonas aeruginosa PA01
ggcucguucaugucggcuccu

SEQ ID NO: 3467633 - RNA, 22 nt, Pseudomonas aeruginosa PA01
ggcucuccccgcucccgcggcc

SEQ ID NO: 3467634 - RNA, 15 nt, Pseudomonas aeruginosa PA01
ggcucucgcgcagca

SEQ ID NO: 3467635 - RNA, 23 nt, Pseudomonas aeruginosa PA01
ggcucucgcgcagcaggauccag

SEQ ID NO: 3467636 - RNA, 16 nt, Pseudomonas aeruginosa PA01
ggcucucuucggccga

SEQ ID NO: 3467637 - RNA, 21 nt, Pseudomonas aeruginosa PA01
ggcugcgucguuggccggcug

SEQ ID NO: 3467638 - RNA, 14 nt, Pseudomonas aeruginosa PA01
ggcugcgugccagc

SEQ ID NO: 3467639 - RNA, 17 nt, Pseudomonas aeruginosa PA01
ggcugcgugccagcacc

SEQ ID NO: 3467640 - RNA, 18 nt, Pseudomonas aeruginosa PA01
ggcugcgugccagcaccu

SEQ ID NO: 3467641 - RNA, 10 nt, Pseudomonas aeruginosa PA01
ggcugcucgc

SEQ ID NO: 3467642 - RNA, 19 nt, Pseudomonas aeruginosa PA01
ggcugcucgccucgggcca

SEQ ID NO: 3467643 - RNA, 16 nt, Pseudomonas aeruginosa PA01
ggcugcugcgccuggc

SEQ ID NO: 3467644 - RNA, 17 nt, Pseudomonas aeruginosa PA01
ggcugcugcgccuggcc

SEQ ID NO: 3467645 - RNA, 18 nt, Pseudomonas aeruginosa PA01
ggcugcugcgccuggccg

SEQ ID NO: 3467646 - RNA, 20 nt, Pseudomonas aeruginosa PA01
ggcugcugcgccuggccgcg

SEQ ID NO: 3467647 - RNA, 22 nt, Pseudomonas aeruginosa PA01
ggcugcugcgccuggccgcgca

SEQ ID NO: 3467648 - RNA, 16 nt, Pseudomonas aeruginosa PA01
ggcugcugcugcggcg

SEQ ID NO: 3467649 - RNA, 18 nt, Pseudomonas aeruginosa PA01
ggcugcugcugcggcggu

SEQ ID NO: 3467650 - RNA, 22 nt, Pseudomonas aeruginosa PA01
ggcugcugcugcggcgguugga

SEQ ID NO: 3467651 - RNA, 17 nt, Pseudomonas aeruginosa PA01
ggcugcuguccagcgcu

SEQ ID NO: 3467652 - RNA, 18 nt, Pseudomonas aeruginosa PA01
ggcugcuguccagcgcuc

SEQ ID NO: 3467653 - RNA, 12 nt, Pseudomonas aeruginosa PA01
ggcugcugucga

SEQ ID NO: 3467654 - RNA, 15 nt, Pseudomonas aeruginosa PA01
ggcugcuucggcagc

SEQ ID NO: 3467655 - RNA, 17 nt, Pseudomonas aeruginosa PA01
ggcugcuucggcagccu

SEQ ID NO: 3467656 - RNA, 19 nt, Pseudomonas aeruginosa PA01
ggcugcuugccgcucaggc

SEQ ID NO: 3467657 - RNA, 22 nt, Pseudomonas aeruginosa PA01
ggcugcuugccgcucaggcugu

SEQ ID NO: 3467658 - RNA, 15 nt, Pseudomonas aeruginosa PA01
ggcugcuuggccagg

SEQ ID NO: 3467659 - RNA, 18 nt, Pseudomonas aeruginosa PA01
ggcuggaagccgcgcucg

SEQ ID NO: 3467660 - RNA, 14 nt, Pseudomonas aeruginosa PA01
ggcuggagcgcugc

SEQ ID NO: 3467661 - RNA, 15 nt, Pseudomonas aeruginosa PA01
ggcuggaguagcuga

SEQ ID NO: 3467662 - RNA, 17 nt, Pseudomonas aeruginosa PA01
ggcuggccaccagcacc

SEQ ID NO: 3467663 - RNA, 18 nt, Pseudomonas aeruginosa PA01
ggcuggccaccagcaccu

SEQ ID NO: 3467664 - RNA, 14 nt, Pseudomonas aeruginosa PA01
ggcuggccaccgcc

SEQ ID NO: 3467665 - RNA, 17 nt, Pseudomonas aeruginosa PA01
ggcuggccaccgccagg

SEQ ID NO: 3467666 - RNA, 20 nt, Pseudomonas aeruginosa PA01
ggcuggccaccgccaggacc

SEQ ID NO: 3467667 - RNA, 17 nt, Pseudomonas aeruginosa PA01
ggcuggccagaauucca

SEQ ID NO: 3467668 - RNA, 13 nt, Pseudomonas aeruginosa PA01
ggcuggccagcaa

SEQ ID NO: 3467669 - RNA, 22 nt, Pseudomonas aeruginosa PA01
ggcuggccagcaauacccgccg

SEQ ID NO: 3467670 - RNA, 16 nt, Pseudomonas aeruginosa PA01
ggcuggccagcaggcu

SEQ ID NO: 3467671 - RNA, 18 nt, Pseudomonas aeruginosa PA01
ggcuggccagcaggcugg

SEQ ID NO: 3467672 - RNA, 19 nt, Pseudomonas aeruginosa PA01
ggcuggccagcaggcuggc

SEQ ID NO: 3467673 - RNA, 23 nt, Pseudomonas aeruginosa PA01
ggcuggccagcaggcuggcggca

SEQ ID NO: 3467674 - RNA, 16 nt, Pseudomonas aeruginosa PA01
ggcuggccagcccugg

SEQ ID NO: 3467675 - RNA, 17 nt, Pseudomonas aeruginosa PA01
ggcuggccagcccuggu

SEQ ID NO: 3467676 - RNA, 20 nt, Pseudomonas aeruginosa PA01
ggcuggccagcccugguagg

SEQ ID NO: 3467677 - RNA, 12 nt, Pseudomonas aeruginosa PA01
ggcuggcccucc

SEQ ID NO: 3467678 - RNA, 19 nt, Pseudomonas aeruginosa PA01
ggcuggcccucggcguuca

SEQ ID NO: 3467679 - RNA, 17 nt, Pseudomonas aeruginosa PA01
ggcuggccgagcgccgc

SEQ ID NO: 3467680 - RNA, 20 nt, Pseudomonas aeruginosa PA01
ggcuggccgagcgccgccug

SEQ ID NO: 3467681 - RNA, 19 nt, Pseudomonas aeruginosa PA01
ggcuggccgccucgcgccg

SEQ ID NO: 3467682 - RNA, 20 nt, Pseudomonas aeruginosa PA01
ggcuggccgccucgcgccgc

SEQ ID NO: 3467683 - RNA, 16 nt, Pseudomonas aeruginosa PA01
ggcuggccgcgguggg

SEQ ID NO: 3467684 - RNA, 17 nt, Pseudomonas aeruginosa PA01
ggcuggccucagggcgc

SEQ ID NO: 3467685 - RNA, 16 nt, Pseudomonas aeruginosa PA01
ggcuggccucggcgau

SEQ ID NO: 3467686 - RNA, 15 nt, Pseudomonas aeruginosa PA01
ggcuggccucguuga

SEQ ID NO: 3467687 - RNA, 18 nt, Pseudomonas aeruginosa PA01
ggcuggccuuggccaugc

SEQ ID NO: 3467688 - RNA, 20 nt, Pseudomonas aeruginosa PA01
ggcuggcgaaccaguccagc

SEQ ID NO: 3467689 - RNA, 23 nt, Pseudomonas aeruginosa PA01
ggcuggcgaaccaguccagcacg

SEQ ID NO: 3467690 - RNA, 21 nt, Pseudomonas aeruginosa PA01
ggcuggcgcaauacaccgcug

SEQ ID NO: 3467691 - RNA, 14 nt, Pseudomonas aeruginosa PA01
ggcuggcgcaggac

SEQ ID NO: 3467692 - RNA, 16 nt, Pseudomonas aeruginosa PA01
ggcuggcgcaggaccg

SEQ ID NO: 3467693 - RNA, 17 nt, Pseudomonas aeruginosa PA01
ggcuggcgcaggaccgc

SEQ ID NO: 3467694 - RNA, 15 nt, Pseudomonas aeruginosa PA01
ggcuggcgccgcggg

SEQ ID NO: 3467695 - RNA, 24 nt, Pseudomonas aeruginosa PA01
ggcuggcgccgcgggucugcucgg

SEQ ID NO: 3467696 - RNA, 16 nt, Pseudomonas aeruginosa PA01
ggcuggcgccggugca

SEQ ID NO: 3467697 - RNA, 19 nt, Pseudomonas aeruginosa PA01
ggcuggcgcgaucggggca

SEQ ID NO: 3467698 - RNA, 17 nt, Pseudomonas aeruginosa PA01
ggcuggcgcuaccgcgc

SEQ ID NO: 3467699 - RNA, 19 nt, Pseudomonas aeruginosa PA01
ggcuggcgcuugccgcgcc

SEQ ID NO: 3467700 - RNA, 22 nt, Pseudomonas aeruginosa PA01
ggcuggcggcauaggcccggcg

SEQ ID NO: 3467701 - RNA, 14 nt, Pseudomonas aeruginosa PA01
ggcuggcggcaucg

SEQ ID NO: 3467702 - RNA, 13 nt, Pseudomonas aeruginosa PA01
ggcuggcggccag

SEQ ID NO: 3467703 - RNA, 17 nt, Pseudomonas aeruginosa PA01
ggcuggcggccagggca

SEQ ID NO: 3467704 - RNA, 14 nt, Pseudomonas aeruginosa PA01
ggcuggcggggucg

SEQ ID NO: 3467705 - RNA, 20 nt, Pseudomonas aeruginosa PA01
ggcuggcggggucgcgccgg

SEQ ID NO: 3467706 - RNA, 15 nt, Pseudomonas aeruginosa PA01
ggcuggcguugacug

SEQ ID NO: 3467707 - RNA, 21 nt, Pseudomonas aeruginosa PA01
ggcuggcugaagccgggcacc

SEQ ID NO: 3467708 - RNA, 15 nt, Pseudomonas aeruginosa PA01
ggcuggcugcccucg

SEQ ID NO: 3467709 - RNA, 16 nt, Pseudomonas aeruginosa PA01
ggcugggcagcgccgc

SEQ ID NO: 3467710 - RNA, 13 nt, Pseudomonas aeruginosa PA01
ggcugggccagga

SEQ ID NO: 3467711 - RNA, 18 nt, Pseudomonas aeruginosa PA01
ggcugggccgaaccgggg

SEQ ID NO: 3467712 - RNA, 23 nt, Pseudomonas aeruginosa PA01
ggcugggcgcccuucagcgccuc

SEQ ID NO: 3467713 - RNA, 17 nt, Pseudomonas aeruginosa PA01
ggcuggggccggccugg

SEQ ID NO: 3467714 - RNA, 22 nt, Pseudomonas aeruginosa PA01
ggcugggguugcggcgcccgcc

SEQ ID NO: 3467715 - RNA, 14 nt, Pseudomonas aeruginosa PA01
ggcugggucggcug

SEQ ID NO: 3467716 - RNA, 12 nt, Pseudomonas aeruginosa PA01
ggcugggugucg

SEQ ID NO: 3467717 - RNA, 18 nt, Pseudomonas aeruginosa PA01
ggcuggguucggcgagga

SEQ ID NO: 3467718 - RNA, 15 nt, Pseudomonas aeruginosa PA01
ggcuggucagaacca

SEQ ID NO: 3467719 - RNA, 14 nt, Pseudomonas aeruginosa PA01
ggcuggucaggcug

SEQ ID NO: 3467720 - RNA, 17 nt, Pseudomonas aeruginosa PA01
ggcuggucaguucggcc

SEQ ID NO: 3467721 - RNA, 20 nt, Pseudomonas aeruginosa PA01
ggcuggucaguucggcccag

SEQ ID NO: 3467722 - RNA, 16 nt, Pseudomonas aeruginosa PA01
ggcuggucggcuuccg

SEQ ID NO: 3467723 - RNA, 18 nt, Pseudomonas aeruginosa PA01
ggcuggucguagcagcgg

SEQ ID NO: 3467724 - RNA, 17 nt, Pseudomonas aeruginosa PA01
ggcuggugccguacuca

SEQ ID NO: 3467725 - RNA, 11 nt, Pseudomonas aeruginosa PA01
ggcugguggcc

SEQ ID NO: 3467726 - RNA, 19 nt, Pseudomonas aeruginosa PA01
ggcugguggucaccgccag

SEQ ID NO: 3467727 - RNA, 15 nt, Pseudomonas aeruginosa PA01
ggcugguugccagca

SEQ ID NO: 3467728 - RNA, 20 nt, Pseudomonas aeruginosa PA01
ggcugguugccagcagcgcu

SEQ ID NO: 3467729 - RNA, 14 nt, Pseudomonas aeruginosa PA01
ggcuguacagcagg

SEQ ID NO: 3467730 - RNA, 15 nt, Pseudomonas aeruginosa PA01
ggcuguacagcagga

SEQ ID NO: 3467731 - RNA, 19 nt, Pseudomonas aeruginosa PA01
ggcuguacagcaggagcgc

SEQ ID NO: 3467732 - RNA, 23 nt, Pseudomonas aeruginosa PA01
ggcuguagccacggcgagagcgc

SEQ ID NO: 3467733 - RNA, 15 nt, Pseudomonas aeruginosa PA01
ggcuguagccggcga

SEQ ID NO: 3467734 - RNA, 16 nt, Pseudomonas aeruginosa PA01
ggcuguagccucccgc

SEQ ID NO: 3467735 - RNA, 19 nt, Pseudomonas aeruginosa PA01
ggcuguagccucccgccgc

SEQ ID NO: 3467736 - RNA, 23 nt, Pseudomonas aeruginosa PA01
ggcuguagccucccgccgcggcg

SEQ ID NO: 3467737 - RNA, 13 nt, Pseudomonas aeruginosa PA01
ggcuguagcgcuc

SEQ ID NO: 3467738 - RNA, 15 nt, Pseudomonas aeruginosa PA01
ggcuguagcgcuccu

SEQ ID NO: 3467739 - RNA, 20 nt, Pseudomonas aeruginosa PA01
ggcuguagcggaucaggccc

SEQ ID NO: 3467740 - RNA, 13 nt, Pseudomonas aeruginosa PA01
gggaaacagggcg

SEQ ID NO: 3467741 - RNA, 19 nt, Pseudomonas aeruginosa PA01
gggaaacagggcgacgccg

SEQ ID NO: 3467742 - RNA, 23 nt, Pseudomonas aeruginosa PA01
gggaacagcccgucgcgcgccgg

SEQ ID NO: 3467743 - RNA, 12 nt, Pseudomonas aeruginosa PA01
gggaacagcgcc

SEQ ID NO: 3467744 - RNA, 13 nt, Pseudomonas aeruginosa PA01
gggaacagcgcca

SEQ ID NO: 3467745 - RNA, 14 nt, Pseudomonas aeruginosa PA01
gggaacagcgccag

SEQ ID NO: 3467746 - RNA, 19 nt, Pseudomonas aeruginosa PA01
gggaacagcgccagcggca

SEQ ID NO: 3467747 - RNA, 22 nt, Pseudomonas aeruginosa PA01
gggaaccaggcgccgcccccgg

SEQ ID NO: 3467748 - RNA, 14 nt, Pseudomonas aeruginosa PA01
gggaacccgcggcg

SEQ ID NO: 3467749 - RNA, 17 nt, Pseudomonas aeruginosa PA01
gggaacccgcggcgcgc

SEQ ID NO: 3467750 - RNA, 20 nt, Pseudomonas aeruginosa PA01
gggaacccgcggcgcgccuu

SEQ ID NO: 3467751 - RNA, 23 nt, Pseudomonas aeruginosa PA01
gggaacgaaacgcuugcguuccu

SEQ ID NO: 3467752 - RNA, 21 nt, Pseudomonas aeruginosa PA01
gggaacgaguugggcgaccug

SEQ ID NO: 3467753 - RNA, 16 nt, Pseudomonas aeruginosa PA01
gggaacugggcgagca

SEQ ID NO: 3467754 - RNA, 16 nt, Pseudomonas aeruginosa PA01
gggaagacggccagga

SEQ ID NO: 3467755 - RNA, 16 nt, Pseudomonas aeruginosa PA01
gggaagauguucgccg

SEQ ID NO: 3467756 - RNA, 19 nt, Pseudomonas aeruginosa PA01
gggaagcaggucucgacgc

SEQ ID NO: 3467757 - RNA, 16 nt, Pseudomonas aeruginosa PA01
gggaagccgcucggcg

SEQ ID NO: 3467758 - RNA, 17 nt, Pseudomonas aeruginosa PA01
gggaagcgaaccaggca

SEQ ID NO: 3467759 - RNA, 15 nt, Pseudomonas aeruginosa PA01
gggaagcgcaggccg

SEQ ID NO: 3467760 - RNA, 21 nt, Pseudomonas aeruginosa PA01
gggaagcugccuuccagcagg

SEQ ID NO: 3467761 - RNA, 22 nt, Pseudomonas aeruginosa PA01
gggaagcugccuuccagcaggu

SEQ ID NO: 3467762 - RNA, 23 nt, Pseudomonas aeruginosa PA01
gggaagcugccuuccagcagguc

SEQ ID NO: 3467763 - RNA, 12 nt, Pseudomonas aeruginosa PA01
gggaagggccgg

SEQ ID NO: 3467764 - RNA, 15 nt, Pseudomonas aeruginosa PA01
gggaaggucggcagc

SEQ ID NO: 3467765 - RNA, 17 nt, Pseudomonas aeruginosa PA01
gggaaggucggcagcag

SEQ ID NO: 3467766 - RNA, 18 nt, Pseudomonas aeruginosa PA01
gggaaguaggccuggccg

SEQ ID NO: 3467767 - RNA, 19 nt, Pseudomonas aeruginosa PA01
gggaaguaggccuggccgc

SEQ ID NO: 3467768 - RNA, 19 nt, Pseudomonas aeruginosa PA01
gggaaucgucacggcgugc

SEQ ID NO: 3467769 - RNA, 15 nt, Pseudomonas aeruginosa PA01
gggaaucuggccgau

SEQ ID NO: 3467770 - RNA, 23 nt, Pseudomonas aeruginosa PA01
gggaaugacuaucgggccgaucg

SEQ ID NO: 3467771 - RNA, 23 nt, Pseudomonas aeruginosa PA01
gggaaugcucagcacggcgacgg

SEQ ID NO: 3467772 - RNA, 12 nt, Pseudomonas aeruginosa PA01
gggaauggcgga

SEQ ID NO: 3467773 - RNA, 17 nt, Pseudomonas aeruginosa PA01
gggaauuucacgccgaa

SEQ ID NO: 3467774 - RNA, 20 nt, Pseudomonas aeruginosa PA01
gggacaccccgucucgcugc

SEQ ID NO: 3467775 - RNA, 19 nt, Pseudomonas aeruginosa PA01
gggacagggcggcagcgug

SEQ ID NO: 3467776 - RNA, 16 nt, Pseudomonas aeruginosa PA01
gggacaugucgagggc

SEQ ID NO: 3467777 - RNA, 18 nt, Pseudomonas aeruginosa PA01
gggacaugucgagggccg

SEQ ID NO: 3467778 - RNA, 21 nt, Pseudomonas aeruginosa PA01
gggacaugucgagggccgggu

SEQ ID NO: 3467779 - RNA, 19 nt, Pseudomonas aeruginosa PA01
gggaccaccccggucaugg

SEQ ID NO: 3467780 - RNA, 21 nt, Pseudomonas aeruginosa PA01
gggaccacgcucaggucgguc

SEQ ID NO: 3467781 - RNA, 15 nt, Pseudomonas aeruginosa PA01
gggaccgcaccuggu

SEQ ID NO: 3467782 - RNA, 22 nt, Pseudomonas aeruginosa PA01
gggaccugucggcucgcgccgg

SEQ ID NO: 3467783 - RNA, 23 nt, Pseudomonas aeruginosa PA01
gggaccugucggcucgcgccggc

SEQ ID NO: 3467784 - RNA, 17 nt, Pseudomonas aeruginosa PA01
gggacgaccucagacca

SEQ ID NO: 3467785 - RNA, 22 nt, Pseudomonas aeruginosa PA01
gggacgaugccgaucucgccca

SEQ ID NO: 3467786 - RNA, 15 nt, Pseudomonas aeruginosa PA01
gggacgcaugcgcgg

SEQ ID NO: 3467787 - RNA, 17 nt, Pseudomonas aeruginosa PA01
gggacgcaugcgcggcg

SEQ ID NO: 3467788 - RNA, 13 nt, Pseudomonas aeruginosa PA01
gggacgccaggcg

SEQ ID NO: 3467789 - RNA, 15 nt, Pseudomonas aeruginosa PA01
gggacgccaggcguc

SEQ ID NO: 3467790 - RNA, 22 nt, Pseudomonas aeruginosa PA01
gggacgcccggagcgcgaaagc

SEQ ID NO: 3467791 - RNA, 16 nt, Pseudomonas aeruginosa PA01
gggacgcgcagcggcg

SEQ ID NO: 3467792 - RNA, 21 nt, Pseudomonas aeruginosa PA01
gggacgcgcagcggcgccgag

SEQ ID NO: 3467793 - RNA, 20 nt, Pseudomonas aeruginosa PA01
gggacgcgcaugcagggcgu

SEQ ID NO: 3467794 - RNA, 12 nt, Pseudomonas aeruginosa PA01
gggacgcgccgg

SEQ ID NO: 3467795 - RNA, 13 nt, Pseudomonas aeruginosa PA01
gggacgcgccggc

SEQ ID NO: 3467796 - RNA, 23 nt, Pseudomonas aeruginosa PA01
gggacgcugucccggccauuccu

SEQ ID NO: 3467797 - RNA, 17 nt, Pseudomonas aeruginosa PA01
gggacggaagcauggcc

SEQ ID NO: 3467798 - RNA, 19 nt, Pseudomonas aeruginosa PA01
gggacggaagcauggccgg

SEQ ID NO: 3467799 - RNA, 21 nt, Pseudomonas aeruginosa PA01
gggacggaagcauggccggcu

SEQ ID NO: 3467800 - RNA, 13 nt, Pseudomonas aeruginosa PA01
gggacggcagccu

SEQ ID NO: 3467801 - RNA, 15 nt, Pseudomonas aeruginosa PA01
gggacggcagccugg

SEQ ID NO: 3467802 - RNA, 14 nt, Pseudomonas aeruginosa PA01
gggacggcggcugg

SEQ ID NO: 3467803 - RNA, 20 nt, Pseudomonas aeruginosa PA01
gggacggcugcccaacuggc

SEQ ID NO: 3467804 - RNA, 16 nt, Pseudomonas aeruginosa PA01
gggacugagccgcugg

SEQ ID NO: 3467805 - RNA, 13 nt, Pseudomonas aeruginosa PA01
gggagaacagcag

SEQ ID NO: 3467806 - RNA, 21 nt, Pseudomonas aeruginosa PA01
gggagaacagcagggucaggg

SEQ ID NO: 3467807 - RNA, 15 nt, Pseudomonas aeruginosa PA01
gggagaaccaggcgg

SEQ ID NO: 3467808 - RNA, 16 nt, Pseudomonas aeruginosa PA01
gggagaaccaggcggu

SEQ ID NO: 3467809 - RNA, 20 nt, Pseudomonas aeruginosa PA01
gggagaaccaggcggugucg

SEQ ID NO: 3467810 - RNA, 23 nt, Pseudomonas aeruginosa PA01
gggagaacuuuucccagcggcug

SEQ ID NO: 3467811 - RNA, 13 nt, Pseudomonas aeruginosa PA01
gggagagcgccgu

SEQ ID NO: 3467812 - RNA, 23 nt, Pseudomonas aeruginosa PA01
gggagauguccaucagccgcgcg

SEQ ID NO: 3467813 - RNA, 12 nt, Pseudomonas aeruginosa PA01
gggagcacggca

SEQ ID NO: 3467814 - RNA, 11 nt, Pseudomonas aeruginosa PA01
gggagccaggc

SEQ ID NO: 3467815 - RNA, 12 nt, Pseudomonas aeruginosa PA01
gggagccaggcg

SEQ ID NO: 3467816 - RNA, 19 nt, Pseudomonas aeruginosa PA01
gggagccgccggacuugga

SEQ ID NO: 3467817 - RNA, 18 nt, Pseudomonas aeruginosa PA01
gggagcgccggcgcgguc

SEQ ID NO: 3467818 - RNA, 21 nt, Pseudomonas aeruginosa PA01
gggagcgccuggcgucgaugc

SEQ ID NO: 3467819 - RNA, 13 nt, Pseudomonas aeruginosa PA01
gggagcgcgaggc

SEQ ID NO: 3467820 - RNA, 14 nt, Pseudomonas aeruginosa PA01
gggagcgcucgcgc

SEQ ID NO: 3467821 - RNA, 15 nt, Pseudomonas aeruginosa PA01
gggagcgcucgcgca

SEQ ID NO: 3467822 - RNA, 12 nt, Pseudomonas aeruginosa PA01
gggagcggccgu

SEQ ID NO: 3467823 - RNA, 14 nt, Pseudomonas aeruginosa PA01
gggaggaacccagg

SEQ ID NO: 3467824 - RNA, 18 nt, Pseudomonas aeruginosa PA01
gggaggaagcuccccgca

SEQ ID NO: 3467825 - RNA, 23 nt, Pseudomonas aeruginosa PA01
gggaggaauaaagaaaaggccgc

SEQ ID NO: 3467826 - RNA, 14 nt, Pseudomonas aeruginosa PA01
gggaggaugccgua

SEQ ID NO: 3467827 - RNA, 19 nt, Pseudomonas aeruginosa PA01
gggaggcgccgcgccaggu

SEQ ID NO: 3467828 - RNA, 13 nt, Pseudomonas aeruginosa PA01
gggagggugccgu

SEQ ID NO: 3467829 - RNA, 19 nt, Pseudomonas aeruginosa PA01
gggagucaacgccuggcca

SEQ ID NO: 3467830 - RNA, 22 nt, Pseudomonas aeruginosa PA01
gggaguccagguacaccagggu

SEQ ID NO: 3467831 - RNA, 14 nt, Pseudomonas aeruginosa PA01
gggaguccgccagc

SEQ ID NO: 3467832 - RNA, 13 nt, Pseudomonas aeruginosa PA01
gggauaccggcca

SEQ ID NO: 3467833 - RNA, 16 nt, Pseudomonas aeruginosa PA01
gggauagacggcggau

SEQ ID NO: 3467834 - RNA, 17 nt, Pseudomonas aeruginosa PA01
gggauagcuuuccaggg

SEQ ID NO: 3467835 - RNA, 13 nt, Pseudomonas aeruginosa PA01
gggauauccaggu

SEQ ID NO: 3467836 - RNA, 13 nt, Pseudomonas aeruginosa PA01
gggaucagcggcg

SEQ ID NO: 3467837 - RNA, 15 nt, Pseudomonas aeruginosa PA01
gggaucagcggcggg

SEQ ID NO: 3467838 - RNA, 17 nt, Pseudomonas aeruginosa PA01
gggaucagcggcggggc

SEQ ID NO: 3467839 - RNA, 20 nt, Pseudomonas aeruginosa PA01
gggauccugcucagcggccc

SEQ ID NO: 3467840 - RNA, 12 nt, Pseudomonas aeruginosa PA01
gggaucgaccgg

SEQ ID NO: 3467841 - RNA, 14 nt, Pseudomonas aeruginosa PA01
gggaucgacgccgc

SEQ ID NO: 3467842 - RNA, 20 nt, Pseudomonas aeruginosa PA01
gggaucgacgccgcuggcgg

SEQ ID NO: 3467843 - RNA, 16 nt, Pseudomonas aeruginosa PA01
gggcaugggcgcgggu

SEQ ID NO: 3467844 - RNA, 16 nt, Pseudomonas aeruginosa PA01
gggcaugggucagcgc

SEQ ID NO: 3467845 - RNA, 19 nt, Pseudomonas aeruginosa PA01
gggcaugggucagcgccag

SEQ ID NO: 3467846 - RNA, 22 nt, Pseudomonas aeruginosa PA01
gggcauguccaccgccgccagc

SEQ ID NO: 3467847 - RNA, 19 nt, Pseudomonas aeruginosa PA01
gggcauucgcagcggcccc

SEQ ID NO: 3467848 - RNA, 18 nt, Pseudomonas aeruginosa PA01
gggcauucguccagccgc

SEQ ID NO: 3467849 - RNA, 20 nt, Pseudomonas aeruginosa PA01
gggcauucguccagccgccg

SEQ ID NO: 3467850 - RNA, 21 nt, Pseudomonas aeruginosa PA01
gggcauucguccagccgccgc

SEQ ID NO: 3467851 - RNA, 14 nt, Pseudomonas aeruginosa PA01
gggcauugaccuug

SEQ ID NO: 3467852 - RNA, 19 nt, Pseudomonas aeruginosa PA01
gggcauuggccaucagcgc

SEQ ID NO: 3467853 - RNA, 22 nt, Pseudomonas aeruginosa PA01
gggcauuggccaucagcgccgc

SEQ ID NO: 3467854 - RNA, 21 nt, Pseudomonas aeruginosa PA01
gggcauugucccugcgggacc

SEQ ID NO: 3467855 - RNA, 14 nt, Pseudomonas aeruginosa PA01
gggccaccggcugc

SEQ ID NO: 3467856 - RNA, 18 nt, Pseudomonas aeruginosa PA01
gggccacguucugcagga

SEQ ID NO: 3467857 - RNA, 14 nt, Pseudomonas aeruginosa PA01
gggccagcagcgcu

SEQ ID NO: 3467858 - RNA, 13 nt, Pseudomonas aeruginosa PA01
gggccagcagcgg

SEQ ID NO: 3467859 - RNA, 17 nt, Pseudomonas aeruginosa PA01
gggccagcagcggcggc

SEQ ID NO: 3467860 - RNA, 18 nt, Pseudomonas aeruginosa PA01
gggccagcagcggcggcg

SEQ ID NO: 3467861 - RNA, 21 nt, Pseudomonas aeruginosa PA01
gggccagcagcuccgggcugg

SEQ ID NO: 3467862 - RNA, 14 nt, Pseudomonas aeruginosa PA01
gggccagcaggcgc

SEQ ID NO: 3467863 - RNA, 20 nt, Pseudomonas aeruginosa PA01
gggccagcaggguggccagg

SEQ ID NO: 3467864 - RNA, 15 nt, Pseudomonas aeruginosa PA01
gggccagcccagaac

SEQ ID NO: 3467865 - RNA, 19 nt, Pseudomonas aeruginosa PA01
gggccagcccagaacagca

SEQ ID NO: 3467866 - RNA, 12 nt, Pseudomonas aeruginosa PA01
gggccagcgccg

SEQ ID NO: 3467867 - RNA, 14 nt, Pseudomonas aeruginosa PA01
gggccagcgccugg

SEQ ID NO: 3467868 - RNA, 19 nt, Pseudomonas aeruginosa PA01
gggccagcuccagcaccgg

SEQ ID NO: 3467869 - RNA, 21 nt, Pseudomonas aeruginosa PA01
gggccaggaugaccaggcuga

SEQ ID NO: 3467870 - RNA, 18 nt, Pseudomonas aeruginosa PA01
gggccaggcauccagcac

SEQ ID NO: 3467871 - RNA, 14 nt, Pseudomonas aeruginosa PA01
gggccaggcccuug

SEQ ID NO: 3467872 - RNA, 12 nt, Pseudomonas aeruginosa PA01
gggccaggccga

SEQ ID NO: 3467873 - RNA, 13 nt, Pseudomonas aeruginosa PA01
gggccaggccgag

SEQ ID NO: 3467874 - RNA, 14 nt, Pseudomonas aeruginosa PA01
gggccaggccgagc

SEQ ID NO: 3467875 - RNA, 23 nt, Pseudomonas aeruginosa PA01
gggccaggccgagcaauccggcg

SEQ ID NO: 3467876 - RNA, 22 nt, Pseudomonas aeruginosa PA01
gggccaggccgagcgcgccgcc

SEQ ID NO: 3467877 - RNA, 16 nt, Pseudomonas aeruginosa PA01
gggccagggaaaucag

SEQ ID NO: 3467878 - RNA, 13 nt, Pseudomonas aeruginosa PA01
gggccagggaggc

SEQ ID NO: 3467879 - RNA, 18 nt, Pseudomonas aeruginosa PA01
gggccagggaggcgcugg

SEQ ID NO: 3467880 - RNA, 16 nt, Pseudomonas aeruginosa PA01
gggccagggcggcggc

SEQ ID NO: 3467881 - RNA, 17 nt, Pseudomonas aeruginosa PA01
gggccagggcggcggcg

SEQ ID NO: 3467882 - RNA, 19 nt, Pseudomonas aeruginosa PA01
gggccaggucgguccgccg

SEQ ID NO: 3467883 - RNA, 20 nt, Pseudomonas aeruginosa PA01
gggccaucagugccugcacg

SEQ ID NO: 3467884 - RNA, 18 nt, Pseudomonas aeruginosa PA01
gggccaucgccggcccgc

SEQ ID NO: 3467885 - RNA, 16 nt, Pseudomonas aeruginosa PA01
gggccaugaccucggc

SEQ ID NO: 3467886 - RNA, 14 nt, Pseudomonas aeruginosa PA01
gggccaugagcagg

SEQ ID NO: 3467887 - RNA, 16 nt, Pseudomonas aeruginosa PA01
gggcccaagccgagcg

SEQ ID NO: 3467888 - RNA, 17 nt, Pseudomonas aeruginosa PA01
gggcccacagugccagg

SEQ ID NO: 3467889 - RNA, 18 nt, Pseudomonas aeruginosa PA01
gggcccacagugccaggc

SEQ ID NO: 3467890 - RNA, 18 nt, Pseudomonas aeruginosa PA01
gggcccagagcagcacca

SEQ ID NO: 3467891 - RNA, 17 nt, Pseudomonas aeruginosa PA01
gggcccaggcuggcggc

SEQ ID NO: 3467892 - RNA, 21 nt, Pseudomonas aeruginosa PA01
gggcccaggcuggcggccagg

SEQ ID NO: 3467893 - RNA, 14 nt, Pseudomonas aeruginosa PA01
gggcccauggcggu

SEQ ID NO: 3467894 - RNA, 17 nt, Pseudomonas aeruginosa PA01
gggcccauuccacgugc

SEQ ID NO: 3467895 - RNA, 15 nt, Pseudomonas aeruginosa PA01
gggccccggccaggu

SEQ ID NO: 3467896 - RNA, 21 nt, Pseudomonas aeruginosa PA01
gggccccucgccgugacgagg

SEQ ID NO: 3467897 - RNA, 18 nt, Pseudomonas aeruginosa PA01
gggcccggcuccagccgg

SEQ ID NO: 3467898 - RNA, 19 nt, Pseudomonas aeruginosa PA01
gggcccguggcaggugacg

SEQ ID NO: 3467899 - RNA, 14 nt, Pseudomonas aeruginosa PA01
gggcccuccaggcg

SEQ ID NO: 3467900 - RNA, 15 nt, Pseudomonas aeruginosa PA01
gggcccuccaggcga

SEQ ID NO: 3467901 - RNA, 15 nt, Pseudomonas aeruginosa PA01
gggcccugccagagg

SEQ ID NO: 3467902 - RNA, 21 nt, Pseudomonas aeruginosa PA01
gggcccugccagaggaucggc

SEQ ID NO: 3467903 - RNA, 23 nt, Pseudomonas aeruginosa PA01
gggcccugccagaggaucggcca

SEQ ID NO: 3467904 - RNA, 17 nt, Pseudomonas aeruginosa PA01
gggcccugggccccggc

SEQ ID NO: 3467905 - RNA, 15 nt, Pseudomonas aeruginosa PA01
gggccgaaggccagg

SEQ ID NO: 3467906 - RNA, 17 nt, Pseudomonas aeruginosa PA01
gggccgaaggccaggcc

SEQ ID NO: 3467907 - RNA, 21 nt, Pseudomonas aeruginosa PA01
gggccgaaggccaggccggcg

SEQ ID NO: 3467908 - RNA, 14 nt, Pseudomonas aeruginosa PA01
gggccgaccugccc

SEQ ID NO: 3467909 - RNA, 15 nt, Pseudomonas aeruginosa PA01
gggccgaccugcccg

SEQ ID NO: 3467910 - RNA, 16 nt, Pseudomonas aeruginosa PA01
gggccgaccugcccgc

SEQ ID NO: 3467911 - RNA, 20 nt, Pseudomonas aeruginosa PA01
gggccgacgaaggccgcggu

SEQ ID NO: 3467912 - RNA, 15 nt, Pseudomonas aeruginosa PA01
gggccgacgcgcugc

SEQ ID NO: 3467913 - RNA, 13 nt, Pseudomonas aeruginosa PA01
gggccgagcgcag

SEQ ID NO: 3467914 - RNA, 14 nt, Pseudomonas aeruginosa PA01
gggccgagcgcagc

SEQ ID NO: 3467915 - RNA, 15 nt, Pseudomonas aeruginosa PA01
gggccgagcgcagcg

SEQ ID NO: 3467916 - RNA, 21 nt, Pseudomonas aeruginosa PA01
gggccgagcgcagcgccacca

SEQ ID NO: 3467917 - RNA, 23 nt, Pseudomonas aeruginosa PA01
gggccgagcgcagcgccaccagg

SEQ ID NO: 3467918 - RNA, 22 nt, Pseudomonas aeruginosa PA01
gggccgagggcugagacgcugc

SEQ ID NO: 3467919 - RNA, 23 nt, Pseudomonas aeruginosa PA01
gggccgagggugaucagccgagg

SEQ ID NO: 3467920 - RNA, 14 nt, Pseudomonas aeruginosa PA01
gggccgaggucgcg

SEQ ID NO: 3467921 - RNA, 22 nt, Pseudomonas aeruginosa PA01
gggccgaggucgcgggccaggc

SEQ ID NO: 3467922 - RNA, 19 nt, Pseudomonas aeruginosa PA01
gggccgaucaccaccugga

SEQ ID NO: 3467923 - RNA, 19 nt, Pseudomonas aeruginosa PA01
gggccgaucgagcggcccg

SEQ ID NO: 3467924 - RNA, 20 nt, Pseudomonas aeruginosa PA01
gggccgaucgagcggcccgc

SEQ ID NO: 3467925 - RNA, 21 nt, Pseudomonas aeruginosa PA01
gggccgaugccgggcaacgcg

SEQ ID NO: 3467926 - RNA, 10 nt, Pseudomonas aeruginosa PA01
gggccgcagg

SEQ ID NO: 3467927 - RNA, 14 nt, Pseudomonas aeruginosa PA01
gggccgcagguugg

SEQ ID NO: 3467928 - RNA, 21 nt, Pseudomonas aeruginosa PA01
gggccgcagguuggccccgcc

SEQ ID NO: 3467929 - RNA, 14 nt, Pseudomonas aeruginosa PA01
gggccgccagccgc

SEQ ID NO: 3467930 - RNA, 15 nt, Pseudomonas aeruginosa PA01
gggccgccagccgcc

SEQ ID NO: 3467931 - RNA, 16 nt, Pseudomonas aeruginosa PA01
gggccgccagccgcca

SEQ ID NO: 3467932 - RNA, 20 nt, Pseudomonas aeruginosa PA01
gggccgccagccgccaggac

SEQ ID NO: 3467933 - RNA, 16 nt, Pseudomonas aeruginosa PA01
gggccgccggcgacga

SEQ ID NO: 3467934 - RNA, 10 nt, Pseudomonas aeruginosa PA01
gggccgccuc

SEQ ID NO: 3467935 - RNA, 23 nt, Pseudomonas aeruginosa PA01
gggccgccuggucggggccggcg

SEQ ID NO: 3467936 - RNA, 21 nt, Pseudomonas aeruginosa PA01
gggccgcgcacaaaaaagccc

SEQ ID NO: 3467937 - RNA, 12 nt, Pseudomonas aeruginosa PA01
gggccgcgcaga

SEQ ID NO: 3467938 - RNA, 13 nt, Pseudomonas aeruginosa PA01
gggccgcgcagau

SEQ ID NO: 3467939 - RNA, 20 nt, Pseudomonas aeruginosa PA01
gggccgcgccgacccagagc

SEQ ID NO: 3467940 - RNA, 14 nt, Pseudomonas aeruginosa PA01
gggccgcgccgagc

SEQ ID NO: 3467941 - RNA, 22 nt, Pseudomonas aeruginosa PA01
gggccgcgccgcaagggcgucg

SEQ ID NO: 3467942 - RNA, 22 nt, Pseudomonas aeruginosa PA01
gggccgcgccuuucgcucaggc

SEQ ID NO: 3467943 - RNA, 13 nt, Pseudomonas aeruginosa PA01
gggccgcgcucgg

SEQ ID NO: 3467944 - RNA, 12 nt, Pseudomonas aeruginosa PA01
gggccgcgcugc

SEQ ID NO: 3467945 - RNA, 14 nt, Pseudomonas aeruginosa PA01
gggccgcgcugcug

SEQ ID NO: 3467946 - RNA, 21 nt, Pseudomonas aeruginosa PA01
gggcgacggaaacgacaggcu

SEQ ID NO: 3467947 - RNA, 13 nt, Pseudomonas aeruginosa PA01
gggcgacuaccag

SEQ ID NO: 3467948 - RNA, 15 nt, Pseudomonas aeruginosa PA01
gggcgagagacugaa

SEQ ID NO: 3467949 - RNA, 14 nt, Pseudomonas aeruginosa PA01
gggcgagcagggcg

SEQ ID NO: 3467950 - RNA, 16 nt, Pseudomonas aeruginosa PA01
gggcgagcgcagacgg

SEQ ID NO: 3467951 - RNA, 18 nt, Pseudomonas aeruginosa PA01
gggcgaggccgcucuucu

SEQ ID NO: 3467952 - RNA, 20 nt, Pseudomonas aeruginosa PA01
gggcgaggcuaacgccgagg

SEQ ID NO: 3467953 - RNA, 14 nt, Pseudomonas aeruginosa PA01
gggcgagggcgcgc

SEQ ID NO: 3467954 - RNA, 16 nt, Pseudomonas aeruginosa PA01
gggcgagggcgcgcac

SEQ ID NO: 3467955 - RNA, 23 nt, Pseudomonas aeruginosa PA01
gggcgagggcggcgcgggcgcgc

SEQ ID NO: 3467956 - RNA, 18 nt, Pseudomonas aeruginosa PA01
gggcgaggucgccacgca

SEQ ID NO: 3467957 - RNA, 18 nt, Pseudomonas aeruginosa PA01
gggcgagucgaucagguc

SEQ ID NO: 3467958 - RNA, 17 nt, Pseudomonas aeruginosa PA01
gggcgaguucggcgagc

SEQ ID NO: 3467959 - RNA, 18 nt, Pseudomonas aeruginosa PA01
gggcgaguucggcgagca

SEQ ID NO: 3467960 - RNA, 15 nt, Pseudomonas aeruginosa PA01
gggcgaucacgccgc

SEQ ID NO: 3467961 - RNA, 18 nt, Pseudomonas aeruginosa PA01
gggcgaucacgccgcgca

SEQ ID NO: 3467962 - RNA, 12 nt, Pseudomonas aeruginosa PA01
gggcgaucuccu

SEQ ID NO: 3467963 - RNA, 15 nt, Pseudomonas aeruginosa PA01
gggcgaucuccucga

SEQ ID NO: 3467964 - RNA, 19 nt, Pseudomonas aeruginosa PA01
gggcgaucuugaucgccag

SEQ ID NO: 3467965 - RNA, 15 nt, Pseudomonas aeruginosa PA01
gggcgaugaggcugu

SEQ ID NO: 3467966 - RNA, 20 nt, Pseudomonas aeruginosa PA01
gggcgaugcccuuggccagc

SEQ ID NO: 3467967 - RNA, 13 nt, Pseudomonas aeruginosa PA01
gggcgaugccgau

SEQ ID NO: 3467968 - RNA, 14 nt, Pseudomonas aeruginosa PA01
gggcgaugccgaug

SEQ ID NO: 3467969 - RNA, 21 nt, Pseudomonas aeruginosa PA01
gggcgaugccgauggcgccgc

SEQ ID NO: 3467970 - RNA, 20 nt, Pseudomonas aeruginosa PA01
gggcgaugcggucaugcccu

SEQ ID NO: 3467971 - RNA, 14 nt, Pseudomonas aeruginosa PA01
gggcgauggccagc

SEQ ID NO: 3467972 - RNA, 15 nt, Pseudomonas aeruginosa PA01
gggcgauggccagcg

SEQ ID NO: 3467973 - RNA, 17 nt, Pseudomonas aeruginosa PA01
gggcgauggcccguucc

SEQ ID NO: 3467974 - RNA, 22 nt, Pseudomonas aeruginosa PA01
gggcgauguugaacagcgccgg

SEQ ID NO: 3467975 - RNA, 17 nt, Pseudomonas aeruginosa PA01
gggcgauuuccaccggc

SEQ ID NO: 3467976 - RNA, 20 nt, Pseudomonas aeruginosa PA01
gggcgcaaggccagcggcau

SEQ ID NO: 3467977 - RNA, 21 nt, Pseudomonas aeruginosa PA01
gggcgcagcccuugcaaccgc

SEQ ID NO: 3467978 - RNA, 16 nt, Pseudomonas aeruginosa PA01
gggcgcaggccgaggu

SEQ ID NO: 3467979 - RNA, 19 nt, Pseudomonas aeruginosa PA01
gggcgcaggggcgcgccgg

SEQ ID NO: 3467980 - RNA, 23 nt, Pseudomonas aeruginosa PA01
gggcgcagguugagggccgcgcu

SEQ ID NO: 3467981 - RNA, 12 nt, Pseudomonas aeruginosa PA01
gggcgccaccgc

SEQ ID NO: 3467982 - RNA, 13 nt, Pseudomonas aeruginosa PA01
gggcgccagccgc

SEQ ID NO: 3467983 - RNA, 13 nt, Pseudomonas aeruginosa PA01
gggcgccagcggu

SEQ ID NO: 3467984 - RNA, 12 nt, Pseudomonas aeruginosa PA01
gggcgccagggg

SEQ ID NO: 3467985 - RNA, 19 nt, Pseudomonas aeruginosa PA01
gggcgccaggugcaggaag

SEQ ID NO: 3467986 - RNA, 21 nt, Pseudomonas aeruginosa PA01
gggcgcccgccaaggcccugc

SEQ ID NO: 3467987 - RNA, 14 nt, Pseudomonas aeruginosa PA01
gggcgccgaccagc

SEQ ID NO: 3467988 - RNA, 15 nt, Pseudomonas aeruginosa PA01
gggcgccgaccagcu

SEQ ID NO: 3467989 - RNA, 13 nt, Pseudomonas aeruginosa PA01
gggcgccgccagc

SEQ ID NO: 3467990 - RNA, 15 nt, Pseudomonas aeruginosa PA01
gggcgccgccagcca

SEQ ID NO: 3467991 - RNA, 14 nt, Pseudomonas aeruginosa PA01
gggcgccgccgagg

SEQ ID NO: 3467992 - RNA, 15 nt, Pseudomonas aeruginosa PA01
gggcgccgccgccga

SEQ ID NO: 3467993 - RNA, 23 nt, Pseudomonas aeruginosa PA01
gggcgccggcaggccuucggcgc

SEQ ID NO: 3467994 - RNA, 12 nt, Pseudomonas aeruginosa PA01
gggcgccgggcu

SEQ ID NO: 3467995 - RNA, 17 nt, Pseudomonas aeruginosa PA01
gggcgccgggcugccga

SEQ ID NO: 3467996 - RNA, 19 nt, Pseudomonas aeruginosa PA01
gggcgccgucgggggcgcg

SEQ ID NO: 3467997 - RNA, 21 nt, Pseudomonas aeruginosa PA01
gggcgccguggaucgcccggc

SEQ ID NO: 3467998 - RNA, 19 nt, Pseudomonas aeruginosa PA01
gggcgccucgccgcggcag

SEQ ID NO: 3467999 - RNA, 23 nt, Pseudomonas aeruginosa PA01
gggcgccuuuuucauggccuggc

SEQ ID NO: 3468000 - RNA, 20 nt, Pseudomonas aeruginosa PA01
gggcgccuuuuuucauccug

SEQ ID NO: 3468001 - RNA, 21 nt, Pseudomonas aeruginosa PA01
gggcgcgagguuucgcuuucc

SEQ ID NO: 3468002 - RNA, 12 nt, Pseudomonas aeruginosa PA01
gggcgcgcccgc

SEQ ID NO: 3468003 - RNA, 13 nt, Pseudomonas aeruginosa PA01
gggcgcgccgcag

SEQ ID NO: 3468004 - RNA, 15 nt, Pseudomonas aeruginosa PA01
gggcgcgccugagcu

SEQ ID NO: 3468005 - RNA, 12 nt, Pseudomonas aeruginosa PA01
gggcgcgcgccg

SEQ ID NO: 3468006 - RNA, 22 nt, Pseudomonas aeruginosa PA01
gggcgcgcgccucagcggcugg

SEQ ID NO: 3468007 - RNA, 15 nt, Pseudomonas aeruginosa PA01
gggcgcgcugcgaau

SEQ ID NO: 3468008 - RNA, 18 nt, Pseudomonas aeruginosa PA01
gggcgcggacaagcccag

SEQ ID NO: 3468009 - RNA, 12 nt, Pseudomonas aeruginosa PA01
gggcgcggcgcc

SEQ ID NO: 3468010 - RNA, 13 nt, Pseudomonas aeruginosa PA01
gggcgcggcgcca

SEQ ID NO: 3468011 - RNA, 16 nt, Pseudomonas aeruginosa PA01
gggcgcgggcguuguc

SEQ ID NO: 3468012 - RNA, 13 nt, Pseudomonas aeruginosa PA01
gggcgcguccagc

SEQ ID NO: 3468013 - RNA, 20 nt, Pseudomonas aeruginosa PA01
gggcgcguugcccagcccca

SEQ ID NO: 3468014 - RNA, 18 nt, Pseudomonas aeruginosa PA01
gggcgcucaccgaggcga

SEQ ID NO: 3468015 - RNA, 13 nt, Pseudomonas aeruginosa PA01
gggcgcucgcccu

SEQ ID NO: 3468016 - RNA, 15 nt, Pseudomonas aeruginosa PA01
gggcgcucgcccuug

SEQ ID NO: 3468017 - RNA, 16 nt, Pseudomonas aeruginosa PA01
gggcgcucgcccuugc

SEQ ID NO: 3468018 - RNA, 21 nt, Pseudomonas aeruginosa PA01
gggcgcucguugcgccgcucc

SEQ ID NO: 3468019 - RNA, 15 nt, Pseudomonas aeruginosa PA01
gggcgcucuggccgc

SEQ ID NO: 3468020 - RNA, 16 nt, Pseudomonas aeruginosa PA01
gggcgcucuggccgcg

SEQ ID NO: 3468021 - RNA, 15 nt, Pseudomonas aeruginosa PA01
gggcgcugagcgcgg

SEQ ID NO: 3468022 - RNA, 18 nt, Pseudomonas aeruginosa PA01
gggcgcugcaugggcucg

SEQ ID NO: 3468023 - RNA, 19 nt, Pseudomonas aeruginosa PA01
gggcgcugccgaucagcca

SEQ ID NO: 3468024 - RNA, 13 nt, Pseudomonas aeruginosa PA01
gggcgcugguccu

SEQ ID NO: 3468025 - RNA, 20 nt, Pseudomonas aeruginosa PA01
gggcgcuguuggccugggcg

SEQ ID NO: 3468026 - RNA, 13 nt, Pseudomonas aeruginosa PA01
gggcgcuuccggc

SEQ ID NO: 3468027 - RNA, 16 nt, Pseudomonas aeruginosa PA01
gggcgcuugaagccgg

SEQ ID NO: 3468028 - RNA, 17 nt, Pseudomonas aeruginosa PA01
gggcgcuugaagccggc

SEQ ID NO: 3468029 - RNA, 20 nt, Pseudomonas aeruginosa PA01
gggcggauaacgccacaggc

SEQ ID NO: 3468030 - RNA, 21 nt, Pseudomonas aeruginosa PA01
gggcggauaaucgcagcgcgg

SEQ ID NO: 3468031 - RNA, 22 nt, Pseudomonas aeruginosa PA01
gggcggaucgagcagcggcgcc

SEQ ID NO: 3468032 - RNA, 13 nt, Pseudomonas aeruginosa PA01
gggcggaucgcca

SEQ ID NO: 3468033 - RNA, 22 nt, Pseudomonas aeruginosa PA01
gggcggauugcguacgcccagc

SEQ ID NO: 3468034 - RNA, 15 nt, Pseudomonas aeruginosa PA01
gggcggcaggcgccg

SEQ ID NO: 3468035 - RNA, 12 nt, Pseudomonas aeruginosa PA01
gggcggccaggu

SEQ ID NO: 3468036 - RNA, 13 nt, Pseudomonas aeruginosa PA01
gggcggccgccga

SEQ ID NO: 3468037 - RNA, 12 nt, Pseudomonas aeruginosa PA01
gggcggccggcg

SEQ ID NO: 3468038 - RNA, 14 nt, Pseudomonas aeruginosa PA01
gggcggccggcgcg

SEQ ID NO: 3468039 - RNA, 16 nt, Pseudomonas aeruginosa PA01
gggcggccggcgcgga

SEQ ID NO: 3468040 - RNA, 11 nt, Pseudomonas aeruginosa PA01
gggcggccuca

SEQ ID NO: 3468041 - RNA, 14 nt, Pseudomonas aeruginosa PA01
gggcggccucaggc

SEQ ID NO: 3468042 - RNA, 19 nt, Pseudomonas aeruginosa PA01
gggcggccucaggccuggc

SEQ ID NO: 3468043 - RNA, 13 nt, Pseudomonas aeruginosa PA01
gggcggcgaacgg

SEQ ID NO: 3468044 - RNA, 12 nt, Pseudomonas aeruginosa PA01
gggcggcgacca

SEQ ID NO: 3468045 - RNA, 12 nt, Pseudomonas aeruginosa PA01
gggcggcgaccg

SEQ ID NO: 3468046 - RNA, 20 nt, Pseudomonas aeruginosa PA01
gggcggcgaccgaacagcgc

SEQ ID NO: 3468047 - RNA, 14 nt, Pseudomonas aeruginosa PA01
gggcggcgagcugg

SEQ ID NO: 3468048 - RNA, 13 nt, Pseudomonas aeruginosa PA01
gggcggcgccugg

SEQ ID NO: 3468049 - RNA, 14 nt, Pseudomonas aeruginosa PA01
gggcggcgccuggu

SEQ ID NO: 3468050 - RNA, 14 nt, Pseudomonas aeruginosa PA01
gggcuucagcgccg

SEQ ID NO: 3468051 - RNA, 15 nt, Pseudomonas aeruginosa PA01
gggcuucccaggcca

SEQ ID NO: 3468052 - RNA, 16 nt, Pseudomonas aeruginosa PA01
gggcuucccaggccag

SEQ ID NO: 3468053 - RNA, 17 nt, Pseudomonas aeruginosa PA01
gggcuucccaggccagc

SEQ ID NO: 3468054 - RNA, 15 nt, Pseudomonas aeruginosa PA01
gggcuuccuggccgg

SEQ ID NO: 3468055 - RNA, 23 nt, Pseudomonas aeruginosa PA01
gggcuuccuggccgggggucgcg

SEQ ID NO: 3468056 - RNA, 14 nt, Pseudomonas aeruginosa PA01
gggcuucgcgcaga

SEQ ID NO: 3468057 - RNA, 20 nt, Pseudomonas aeruginosa PA01
gggcuucgcugaugccggcg

SEQ ID NO: 3468058 - RNA, 16 nt, Pseudomonas aeruginosa PA01
gggcuucgguguaucg

SEQ ID NO: 3468059 - RNA, 17 nt, Pseudomonas aeruginosa PA01
gggcuucgguguaucgg

SEQ ID NO: 3468060 - RNA, 13 nt, Pseudomonas aeruginosa PA01
gggcuucguccgc

SEQ ID NO: 3468061 - RNA, 18 nt, Pseudomonas aeruginosa PA01
gggcuucguccgccuggg

SEQ ID NO: 3468062 - RNA, 20 nt, Pseudomonas aeruginosa PA01
gggcuucuucaccaggccga

SEQ ID NO: 3468063 - RNA, 13 nt, Pseudomonas aeruginosa PA01
gggcuucuucagg

SEQ ID NO: 3468064 - RNA, 12 nt, Pseudomonas aeruginosa PA01
gggcuucuuuua

SEQ ID NO: 3468065 - RNA, 14 nt, Pseudomonas aeruginosa PA01
gggcuugcaauccg

SEQ ID NO: 3468066 - RNA, 11 nt, Pseudomonas aeruginosa PA01
gggcuugccgg

SEQ ID NO: 3468067 - RNA, 13 nt, Pseudomonas aeruginosa PA01
gggcuugccgggg

SEQ ID NO: 3468068 - RNA, 19 nt, Pseudomonas aeruginosa PA01
gggcuugccggggucgagg

SEQ ID NO: 3468069 - RNA, 13 nt, Pseudomonas aeruginosa PA01
gggcuugcgcccc

SEQ ID NO: 3468070 - RNA, 14 nt, Pseudomonas aeruginosa PA01
gggcuugcgcgcca

SEQ ID NO: 3468071 - RNA, 23 nt, Pseudomonas aeruginosa PA01
gggcuuuucauuaccggcgaccu

SEQ ID NO: 3468072 - RNA, 19 nt, Pseudomonas aeruginosa PA01
gggcuuuuucaugcgugcg

SEQ ID NO: 3468073 - RNA, 20 nt, Pseudomonas aeruginosa PA01
gggcuuuuucaugcgugcga

SEQ ID NO: 3468074 - RNA, 21 nt, Pseudomonas aeruginosa PA01
gggcuuuuucauggcuggccc

SEQ ID NO: 3468075 - RNA, 20 nt, Pseudomonas aeruginosa PA01
gggcuuuuucaugggcgcgc

SEQ ID NO: 3468076 - RNA, 21 nt, Pseudomonas aeruginosa PA01
gggcuuuuuucguggccgcga

SEQ ID NO: 3468077 - RNA, 20 nt, Pseudomonas aeruginosa PA01
ggggaaauccuugagcaccc

SEQ ID NO: 3468078 - RNA, 13 nt, Pseudomonas aeruginosa PA01
ggggaacagcgcc

SEQ ID NO: 3468079 - RNA, 14 nt, Pseudomonas aeruginosa PA01
ggggaacagcgcca

SEQ ID NO: 3468080 - RNA, 21 nt, Pseudomonas aeruginosa PA01
ggggaacagcgccagcggcag

SEQ ID NO: 3468081 - RNA, 22 nt, Pseudomonas aeruginosa PA01
ggggaacagcgccagcggcagc

SEQ ID NO: 3468082 - RNA, 20 nt, Pseudomonas aeruginosa PA01
ggggaagcugccuuccagca

SEQ ID NO: 3468083 - RNA, 22 nt, Pseudomonas aeruginosa PA01
ggggaagugaagagcucccugc

SEQ ID NO: 3468084 - RNA, 17 nt, Pseudomonas aeruginosa PA01
ggggaaucugcgccagg

SEQ ID NO: 3468085 - RNA, 18 nt, Pseudomonas aeruginosa PA01
ggggaaucugcgccaggu

SEQ ID NO: 3468086 - RNA, 14 nt, Pseudomonas aeruginosa PA01
ggggaauuucacgc

SEQ ID NO: 3468087 - RNA, 15 nt, Pseudomonas aeruginosa PA01
ggggaauuucacgcc

SEQ ID NO: 3468088 - RNA, 15 nt, Pseudomonas aeruginosa PA01
ggggaauuuccggca

SEQ ID NO: 3468089 - RNA, 22 nt, Pseudomonas aeruginosa PA01
ggggacaugucgaggguugggc

SEQ ID NO: 3468090 - RNA, 22 nt, Pseudomonas aeruginosa PA01
ggggaccugucggcucgcgccg

SEQ ID NO: 3468091 - RNA, 23 nt, Pseudomonas aeruginosa PA01
ggggagauguccaucagccgcgc

SEQ ID NO: 3468092 - RNA, 14 nt, Pseudomonas aeruginosa PA01
ggggagccgaggcu

SEQ ID NO: 3468093 - RNA, 15 nt, Pseudomonas aeruginosa PA01
ggggagcgccggcgc

SEQ ID NO: 3468094 - RNA, 18 nt, Pseudomonas aeruginosa PA01
ggggaucagcuucagcuc

SEQ ID NO: 3468095 - RNA, 17 nt, Pseudomonas aeruginosa PA01
ggggaucaggucgccgc

SEQ ID NO: 3468096 - RNA, 17 nt, Pseudomonas aeruginosa PA01
ggggauggucggugacc

SEQ ID NO: 3468097 - RNA, 16 nt, Pseudomonas aeruginosa PA01
ggggauguccgccgcc

SEQ ID NO: 3468098 - RNA, 15 nt, Pseudomonas aeruginosa PA01
ggggauuuccucguc

SEQ ID NO: 3468099 - RNA, 20 nt, Pseudomonas aeruginosa PA01
ggggauuuccucgucgccgu

SEQ ID NO: 3468100 - RNA, 14 nt, Pseudomonas aeruginosa PA01
ggggcacgcuggcg

SEQ ID NO: 3468101 - RNA, 22 nt, Pseudomonas aeruginosa PA01
ggggcagaccuggugggcggcg

SEQ ID NO: 3468102 - RNA, 15 nt, Pseudomonas aeruginosa PA01
ggggcagcagggcgu

SEQ ID NO: 3468103 - RNA, 14 nt, Pseudomonas aeruginosa PA01
ggggcaucggccau

SEQ ID NO: 3468104 - RNA, 24 nt, Pseudomonas aeruginosa PA01
ggggcauguccaccgccgccagca

SEQ ID NO: 3468105 - RNA, 17 nt, Pseudomonas aeruginosa PA01
ggggcauucguccagcc

SEQ ID NO: 3468106 - RNA, 20 nt, Pseudomonas aeruginosa PA01
ggggcauucguccagccgcc

SEQ ID NO: 3468107 - RNA, 21 nt, Pseudomonas aeruginosa PA01
ggggcauucguccagccgccg

SEQ ID NO: 3468108 - RNA, 19 nt, Pseudomonas aeruginosa PA01
ggggccagcagggccgccg

SEQ ID NO: 3468109 - RNA, 14 nt, Pseudomonas aeruginosa PA01
ggggccaucagugc

SEQ ID NO: 3468110 - RNA, 16 nt, Pseudomonas aeruginosa PA01
ggggccaucagugccu

SEQ ID NO: 3468111 - RNA, 17 nt, Pseudomonas aeruginosa PA01
ggggcccggcuccagcc

SEQ ID NO: 3468112 - RNA, 20 nt, Pseudomonas aeruginosa PA01
ggggcccggcuccagccggg

SEQ ID NO: 3468113 - RNA, 14 nt, Pseudomonas aeruginosa PA01
ggggcccuccaggc

SEQ ID NO: 3468114 - RNA, 16 nt, Pseudomonas aeruginosa PA01
ggggccguccgccagg

SEQ ID NO: 3468115 - RNA, 18 nt, Pseudomonas aeruginosa PA01
ggggccucggccagcgcc

SEQ ID NO: 3468116 - RNA, 20 nt, Pseudomonas aeruginosa PA01
ggggccucggccagcgccgc

SEQ ID NO: 3468117 - RNA, 12 nt, Pseudomonas aeruginosa PA01
ggggccugcugc

SEQ ID NO: 3468118 - RNA, 19 nt, Pseudomonas aeruginosa PA01
ggggccuggcucgaucggc

SEQ ID NO: 3468119 - RNA, 15 nt, Pseudomonas aeruginosa PA01
ggggccuucaggcgc

SEQ ID NO: 3468120 - RNA, 17 nt, Pseudomonas aeruginosa PA01
ggggccuucaggcgcuc

SEQ ID NO: 3468121 - RNA, 22 nt, Pseudomonas aeruginosa PA01
ggggcgaccagcaucaugaucu

SEQ ID NO: 3468122 - RNA, 16 nt, Pseudomonas aeruginosa PA01
ggggcgcaaggccagc

SEQ ID NO: 3468123 - RNA, 17 nt, Pseudomonas aeruginosa PA01
ggggcgcagcaggaucu

SEQ ID NO: 3468124 - RNA, 14 nt, Pseudomonas aeruginosa PA01
ggggcgcgcccgcc

SEQ ID NO: 3468125 - RNA, 13 nt, Pseudomonas aeruginosa PA01
ggggcgcgccggc

SEQ ID NO: 3468126 - RNA, 18 nt, Pseudomonas aeruginosa PA01
ggggcgcucaggguggcg

SEQ ID NO: 3468127 - RNA, 11 nt, Pseudomonas aeruginosa PA01
ggggcgcuggu

SEQ ID NO: 3468128 - RNA, 20 nt, Pseudomonas aeruginosa PA01
ggggcgcuguuggccugggc

SEQ ID NO: 3468129 - RNA, 22 nt, Pseudomonas aeruginosa PA01
ggggcggcgucccggcgccgcc

SEQ ID NO: 3468130 - RNA, 18 nt, Pseudomonas aeruginosa PA01
ggggcguauagcccgggu

SEQ ID NO: 3468131 - RNA, 21 nt, Pseudomonas aeruginosa PA01
ggggcuagucgcgcagcgccu

SEQ ID NO: 3468132 - RNA, 12 nt, Pseudomonas aeruginosa PA01
ggggcucggcga

SEQ ID NO: 3468133 - RNA, 16 nt, Pseudomonas aeruginosa PA01
ggggcucggcuuccau

SEQ ID NO: 3468134 - RNA, 15 nt, Pseudomonas aeruginosa PA01
ggggcucugccggug

SEQ ID NO: 3468135 - RNA, 12 nt, Pseudomonas aeruginosa PA01
ggggcuguugcu

SEQ ID NO: 3468136 - RNA, 18 nt, Pseudomonas aeruginosa PA01
ggggcuuucuucgccugg

SEQ ID NO: 3468137 - RNA, 14 nt, Pseudomonas aeruginosa PA01
ggggcuuugcggcc

SEQ ID NO: 3468138 - RNA, 16 nt, Pseudomonas aeruginosa PA01
gggggccagcagggcc

SEQ ID NO: 3468139 - RNA, 17 nt, Pseudomonas aeruginosa PA01
gggggccagcagggccg

SEQ ID NO: 3468140 - RNA, 23 nt, Pseudomonas aeruginosa PA01
gggggccagcagggccgccgagg

SEQ ID NO: 3468141 - RNA, 17 nt, Pseudomonas aeruginosa PA01
gggggugaagcgcaggc

SEQ ID NO: 3468142 - RNA, 17 nt, Pseudomonas aeruginosa PA01
gggguaaggcaugccca

SEQ ID NO: 3468143 - RNA, 13 nt, Pseudomonas aeruginosa PA01
gggguagccgaga

SEQ ID NO: 3468144 - RNA, 14 nt, Pseudomonas aeruginosa PA01
gggguagccggccg

SEQ ID NO: 3468145 - RNA, 21 nt, Pseudomonas aeruginosa PA01
gggguaggggucggccugggu

SEQ ID NO: 3468146 - RNA, 13 nt, Pseudomonas aeruginosa PA01
gggguagggucag

SEQ ID NO: 3468147 - RNA, 22 nt, Pseudomonas aeruginosa PA01
ggggucaguucguugagggccu

SEQ ID NO: 3468148 - RNA, 12 nt, Pseudomonas aeruginosa PA01
gggguccgccgg

SEQ ID NO: 3468149 - RNA, 16 nt, Pseudomonas aeruginosa PA01
ggggucgagguuggag

SEQ ID NO: 3468150 - RNA, 13 nt, Pseudomonas aeruginosa PA01
ggggucgcgccgg

SEQ ID NO: 3468151 - RNA, 22 nt, Pseudomonas aeruginosa PA01
ggggucuucguuuucaggcgac

SEQ ID NO: 3468152 - RNA, 18 nt, Pseudomonas aeruginosa PA01
ggggugaagcgcaggcgg

SEQ ID NO: 3468153 - RNA, 12 nt, Pseudomonas aeruginosa PA01
gggucgcgcagg

SEQ ID NO: 3468154 - RNA, 21 nt, Pseudomonas aeruginosa PA01
gggucgcgcagggcagcgcga

SEQ ID NO: 3468155 - RNA, 16 nt, Pseudomonas aeruginosa PA01
gggucgcggcuggccg

SEQ ID NO: 3468156 - RNA, 22 nt, Pseudomonas aeruginosa PA01
gggucgcggcuggccgccuggc

SEQ ID NO: 3468157 - RNA, 19 nt, Pseudomonas aeruginosa PA01
gggucgcguucgucggcca

SEQ ID NO: 3468158 - RNA, 19 nt, Pseudomonas aeruginosa PA01
gggucgcugcucagggccg

SEQ ID NO: 3468159 - RNA, 20 nt, Pseudomonas aeruginosa PA01
gggucgcugcucagggccgc

SEQ ID NO: 3468160 - RNA, 21 nt, Pseudomonas aeruginosa PA01
gggucgcugcucagggccgcg

SEQ ID NO: 3468161 - RNA, 15 nt, Pseudomonas aeruginosa PA01
gggucggaugcagcg

SEQ ID NO: 3468162 - RNA, 17 nt, Pseudomonas aeruginosa PA01
gggucggaugcagcgcu

SEQ ID NO: 3468163 - RNA, 14 nt, Pseudomonas aeruginosa PA01
gggucggcacggcc

SEQ ID NO: 3468164 - RNA, 13 nt, Pseudomonas aeruginosa PA01
gggucggccugcg

SEQ ID NO: 3468165 - RNA, 21 nt, Pseudomonas aeruginosa PA01
gggucggccuggguacgcacc

SEQ ID NO: 3468166 - RNA, 14 nt, Pseudomonas aeruginosa PA01
gggucgggucggcg

SEQ ID NO: 3468167 - RNA, 18 nt, Pseudomonas aeruginosa PA01
gggucgucgaagcgcagc

SEQ ID NO: 3468168 - RNA, 19 nt, Pseudomonas aeruginosa PA01
gggucgucgcccuggccga

SEQ ID NO: 3468169 - RNA, 19 nt, Pseudomonas aeruginosa PA01
gggucucgaucagcgccgg

SEQ ID NO: 3468170 - RNA, 12 nt, Pseudomonas aeruginosa PA01
gggucucgcggg

SEQ ID NO: 3468171 - RNA, 19 nt, Pseudomonas aeruginosa PA01
gggucugcgaguugaucgg

SEQ ID NO: 3468172 - RNA, 18 nt, Pseudomonas aeruginosa PA01
gggucugcgccucgcugg

SEQ ID NO: 3468173 - RNA, 18 nt, Pseudomonas aeruginosa PA01
gggucugcucgacgaucu

SEQ ID NO: 3468174 - RNA, 15 nt, Pseudomonas aeruginosa PA01
gggucugcucgcgcu

SEQ ID NO: 3468175 - RNA, 16 nt, Pseudomonas aeruginosa PA01
gggucugcucggcgcc

SEQ ID NO: 3468176 - RNA, 14 nt, Pseudomonas aeruginosa PA01
gggucuggccggcg

SEQ ID NO: 3468177 - RNA, 19 nt, Pseudomonas aeruginosa PA01
gggucuggccggcgaucag

SEQ ID NO: 3468178 - RNA, 23 nt, Pseudomonas aeruginosa PA01
gggucuggggaaauucgcgcugg

SEQ ID NO: 3468179 - RNA, 18 nt, Pseudomonas aeruginosa PA01
gggucuucaggccgaguc

SEQ ID NO: 3468180 - RNA, 23 nt, Pseudomonas aeruginosa PA01
gggucuucgaaggucugcccgug

SEQ ID NO: 3468181 - RNA, 15 nt, Pseudomonas aeruginosa PA01
gggucuucggguguc

SEQ ID NO: 3468182 - RNA, 15 nt, Pseudomonas aeruginosa PA01
gggucuugccggucu

SEQ ID NO: 3468183 - RNA, 20 nt, Pseudomonas aeruginosa PA01
gggucuugcgcagggcggcg

SEQ ID NO: 3468184 - RNA, 18 nt, Pseudomonas aeruginosa PA01
gggucuugucuuucugcg

SEQ ID NO: 3468185 - RNA, 15 nt, Pseudomonas aeruginosa PA01
gggugaacagcggcc

SEQ ID NO: 3468186 - RNA, 18 nt, Pseudomonas aeruginosa PA01
gggugaacucaugcaggc

SEQ ID NO: 3468187 - RNA, 15 nt, Pseudomonas aeruginosa PA01
gggugaacuggccgu

SEQ ID NO: 3468188 - RNA, 19 nt, Pseudomonas aeruginosa PA01
gggugaagaccagucggcc

SEQ ID NO: 3468189 - RNA, 21 nt, Pseudomonas aeruginosa PA01
gggugaagcgcaggcggcugg

SEQ ID NO: 3468190 - RNA, 24 nt, Pseudomonas aeruginosa PA01
gggugaagcgcaggcggcuggcgc

SEQ ID NO: 3468191 - RNA, 15 nt, Pseudomonas aeruginosa PA01
gggugaagcucuucu

SEQ ID NO: 3468192 - RNA, 17 nt, Pseudomonas aeruginosa PA01
gggugacgcucuucacc

SEQ ID NO: 3468193 - RNA, 11 nt, Pseudomonas aeruginosa PA01
gggugaggcgc

SEQ ID NO: 3468194 - RNA, 17 nt, Pseudomonas aeruginosa PA01
gggugaggcgcauggac

SEQ ID NO: 3468195 - RNA, 18 nt, Pseudomonas aeruginosa PA01
gggugaggcgcauggaca

SEQ ID NO: 3468196 - RNA, 16 nt, Pseudomonas aeruginosa PA01
gggugaucagcuccgc

SEQ ID NO: 3468197 - RNA, 20 nt, Pseudomonas aeruginosa PA01
gggugauuucuucagccugg

SEQ ID NO: 3468198 - RNA, 13 nt, Pseudomonas aeruginosa PA01
gggugcagagcag

SEQ ID NO: 3468199 - RNA, 17 nt, Pseudomonas aeruginosa PA01
gggugcagcagguuccu

SEQ ID NO: 3468200 - RNA, 16 nt, Pseudomonas aeruginosa PA01
gggugcaggggcgcag

SEQ ID NO: 3468201 - RNA, 12 nt, Pseudomonas aeruginosa PA01
gggugccccagg

SEQ ID NO: 3468202 - RNA, 15 nt, Pseudomonas aeruginosa PA01
gggugccgaccaacg

SEQ ID NO: 3468203 - RNA, 15 nt, Pseudomonas aeruginosa PA01
gggugccgauggaga

SEQ ID NO: 3468204 - RNA, 22 nt, Pseudomonas aeruginosa PA01
gggugccgccagucggccuggc

SEQ ID NO: 3468205 - RNA, 21 nt, Pseudomonas aeruginosa PA01
gggugccgggggcggcgaacg

SEQ ID NO: 3468206 - RNA, 20 nt, Pseudomonas aeruginosa PA01
gggugccuuccgcgcccagg

SEQ ID NO: 3468207 - RNA, 21 nt, Pseudomonas aeruginosa PA01
gggugccuuccgcgcccaggc

SEQ ID NO: 3468208 - RNA, 20 nt, Pseudomonas aeruginosa PA01
gggugcgccggggaucaggu

SEQ ID NO: 3468209 - RNA, 17 nt, Pseudomonas aeruginosa PA01
gggugcgcuggaacggc

SEQ ID NO: 3468210 - RNA, 14 nt, Pseudomonas aeruginosa PA01
gggugcgggcgcgg

SEQ ID NO: 3468211 - RNA, 15 nt, Pseudomonas aeruginosa PA01
gggugcgggcgcggg

SEQ ID NO: 3468212 - RNA, 15 nt, Pseudomonas aeruginosa PA01
gggugcggugggcga

SEQ ID NO: 3468213 - RNA, 22 nt, Pseudomonas aeruginosa PA01
gggugcggugggcgagggcgcg

SEQ ID NO: 3468214 - RNA, 22 nt, Pseudomonas aeruginosa PA01
gggugcguccauccaggcuuuc

SEQ ID NO: 3468215 - RNA, 23 nt, Pseudomonas aeruginosa PA01
gggugcguggugcauccgccgca

SEQ ID NO: 3468216 - RNA, 22 nt, Pseudomonas aeruginosa PA01
gggugcucaggacguccuggcc

SEQ ID NO: 3468217 - RNA, 15 nt, Pseudomonas aeruginosa PA01
gggugcugcccaggg

SEQ ID NO: 3468218 - RNA, 17 nt, Pseudomonas aeruginosa PA01
gggugcugcggaugggc

SEQ ID NO: 3468219 - RNA, 19 nt, Pseudomonas aeruginosa PA01
ggguggaacgaggcgaccc

SEQ ID NO: 3468220 - RNA, 20 nt, Pseudomonas aeruginosa PA01
ggguggaacgaggcgacccg

SEQ ID NO: 3468221 - RNA, 17 nt, Pseudomonas aeruginosa PA01
ggguggagaggcgugcu

SEQ ID NO: 3468222 - RNA, 17 nt, Pseudomonas aeruginosa PA01
ggguggaguaccaggcc

SEQ ID NO: 3468223 - RNA, 19 nt, Pseudomonas aeruginosa PA01
ggguggaguaccaggccac

SEQ ID NO: 3468224 - RNA, 19 nt, Pseudomonas aeruginosa PA01
ggguggcaacugccgcccg

SEQ ID NO: 3468225 - RNA, 15 nt, Pseudomonas aeruginosa PA01
ggguggcaugggcca

SEQ ID NO: 3468226 - RNA, 17 nt, Pseudomonas aeruginosa PA01
ggguggcaugggccagu

SEQ ID NO: 3468227 - RNA, 13 nt, Pseudomonas aeruginosa PA01
ggguggccaggcg

SEQ ID NO: 3468228 - RNA, 22 nt, Pseudomonas aeruginosa PA01
ggguggcgaaggcaaugccgcc

SEQ ID NO: 3468229 - RNA, 12 nt, Pseudomonas aeruginosa PA01
ggguggcgacga

SEQ ID NO: 3468230 - RNA, 15 nt, Pseudomonas aeruginosa PA01
ggguggcgcccaugc

SEQ ID NO: 3468231 - RNA, 21 nt, Pseudomonas aeruginosa PA01
ggguggcgcccaugccgcccg

SEQ ID NO: 3468232 - RNA, 17 nt, Pseudomonas aeruginosa PA01
ggguggcgccgagcagc

SEQ ID NO: 3468233 - RNA, 13 nt, Pseudomonas aeruginosa PA01
ggguggcgggcgg

SEQ ID NO: 3468234 - RNA, 17 nt, Pseudomonas aeruginosa PA01
ggguggcgggcggcccc

SEQ ID NO: 3468235 - RNA, 19 nt, Pseudomonas aeruginosa PA01
ggguggcgucgaucaggcg

SEQ ID NO: 3468236 - RNA, 22 nt, Pseudomonas aeruginosa PA01
ggguggcgucgaucaggcgggc

SEQ ID NO: 3468237 - RNA, 16 nt, Pseudomonas aeruginosa PA01
gggugggcggugcggc

SEQ ID NO: 3468238 - RNA, 16 nt, Pseudomonas aeruginosa PA01
ggguggucgccgccca

SEQ ID NO: 3468239 - RNA, 12 nt, Pseudomonas aeruginosa PA01
ggguggucgcgc

SEQ ID NO: 3468240 - RNA, 23 nt, Pseudomonas aeruginosa PA01
ggguguacuugacggcgccgaug

SEQ ID NO: 3468241 - RNA, 22 nt, Pseudomonas aeruginosa PA01
gggugucguagaggcuguagcg

SEQ ID NO: 3468242 - RNA, 16 nt, Pseudomonas aeruginosa PA01
ggguguucagcggcgc

SEQ ID NO: 3468243 - RNA, 21 nt, Pseudomonas aeruginosa PA01
ggguguucagcggcgcgucga

SEQ ID NO: 3468244 - RNA, 21 nt, Pseudomonas aeruginosa PA01
ggguguugucgcggcugacga

SEQ ID NO: 3468245 - RNA, 16 nt, Pseudomonas aeruginosa PA01
ggguguuguucgccag

SEQ ID NO: 3468246 - RNA, 17 nt, Pseudomonas aeruginosa PA01
ggguucagcccgccgug

SEQ ID NO: 3468247 - RNA, 15 nt, Pseudomonas aeruginosa PA01
ggguucccagcagca

SEQ ID NO: 3468248 - RNA, 15 nt, Pseudomonas aeruginosa PA01
ggguucccaguugcu

SEQ ID NO: 3468249 - RNA, 19 nt, Pseudomonas aeruginosa PA01
ggguuccucacggcgcagc

SEQ ID NO: 3468250 - RNA, 19 nt, Pseudomonas aeruginosa PA01
ggguuccucuaaugguagg

SEQ ID NO: 3468251 - RNA, 15 nt, Pseudomonas aeruginosa PA01
ggguucgacagcgcg

SEQ ID NO: 3468252 - RNA, 15 nt, Pseudomonas aeruginosa PA01
ggguucgacgcgcca

SEQ ID NO: 3468253 - RNA, 22 nt, Pseudomonas aeruginosa PA01
ggguucgagucccguccgcugc

SEQ ID NO: 3468254 - RNA, 13 nt, Pseudomonas aeruginosa PA01
ggguucggcgaga

SEQ ID NO: 3468255 - RNA, 14 nt, Pseudomonas aeruginosa PA01
gguagccugcggcc

SEQ ID NO: 3468256 - RNA, 20 nt, Pseudomonas aeruginosa PA01
gguagccugcggccagcgcc

SEQ ID NO: 3468257 - RNA, 21 nt, Pseudomonas aeruginosa PA01
gguagcgaaucugcagggcau

SEQ ID NO: 3468258 - RNA, 18 nt, Pseudomonas aeruginosa PA01
gguagcgcugcgccaggc

SEQ ID NO: 3468259 - RNA, 16 nt, Pseudomonas aeruginosa PA01
gguagcggcaggagca

SEQ ID NO: 3468260 - RNA, 15 nt, Pseudomonas aeruginosa PA01
gguagcgggccagca

SEQ ID NO: 3468261 - RNA, 18 nt, Pseudomonas aeruginosa PA01
gguagcgggccagcagcu

SEQ ID NO: 3468262 - RNA, 13 nt, Pseudomonas aeruginosa PA01
gguagcggucggg

SEQ ID NO: 3468263 - RNA, 16 nt, Pseudomonas aeruginosa PA01
gguagcggucggguuc

SEQ ID NO: 3468264 - RNA, 18 nt, Pseudomonas aeruginosa PA01
gguagcguugcgccagac

SEQ ID NO: 3468265 - RNA, 15 nt, Pseudomonas aeruginosa PA01
gguagcuccaggccg

SEQ ID NO: 3468266 - RNA, 17 nt, Pseudomonas aeruginosa PA01
gguagcugagcaggccg

SEQ ID NO: 3468267 - RNA, 20 nt, Pseudomonas aeruginosa PA01
gguagcugagcaggccgacg

SEQ ID NO: 3468268 - RNA, 22 nt, Pseudomonas aeruginosa PA01
gguagcugcgcagggcgccguc

SEQ ID NO: 3468269 - RNA, 15 nt, Pseudomonas aeruginosa PA01
gguagcugcgccgcc

SEQ ID NO: 3468270 - RNA, 13 nt, Pseudomonas aeruginosa PA01
gguagcugcggcc

SEQ ID NO: 3468271 - RNA, 17 nt, Pseudomonas aeruginosa PA01
gguagcugcuccagccc

SEQ ID NO: 3468272 - RNA, 14 nt, Pseudomonas aeruginosa PA01
gguagcuggaaagc

SEQ ID NO: 3468273 - RNA, 15 nt, Pseudomonas aeruginosa PA01
gguagcuggaaagcu

SEQ ID NO: 3468274 - RNA, 20 nt, Pseudomonas aeruginosa PA01
gguaggacagggccaggccg

SEQ ID NO: 3468275 - RNA, 24 nt, Pseudomonas aeruginosa PA01
gguaggacagggccaggccgagca

SEQ ID NO: 3468276 - RNA, 14 nt, Pseudomonas aeruginosa PA01
gguaggcggcgacg

SEQ ID NO: 3468277 - RNA, 19 nt, Pseudomonas aeruginosa PA01
gguaggcgguggcgaucag

SEQ ID NO: 3468278 - RNA, 21 nt, Pseudomonas aeruginosa PA01
gguaggcgguggcgaucagcg

SEQ ID NO: 3468279 - RNA, 19 nt, Pseudomonas aeruginosa PA01
gguaggcucugcuccagca

SEQ ID NO: 3468280 - RNA, 15 nt, Pseudomonas aeruginosa PA01
gguaggggucggccu

SEQ ID NO: 3468281 - RNA, 16 nt, Pseudomonas aeruginosa PA01
gguaggggucggccug

SEQ ID NO: 3468282 - RNA, 20 nt, Pseudomonas aeruginosa PA01
gguagguagcguugcgccag

SEQ ID NO: 3468283 - RNA, 17 nt, Pseudomonas aeruginosa PA01
gguaggugagcgacccg

SEQ ID NO: 3468284 - RNA, 15 nt, Pseudomonas aeruginosa PA01
gguaggugcgcuggc

SEQ ID NO: 3468285 - RNA, 15 nt, Pseudomonas aeruginosa PA01
gguaguccagcaggu

SEQ ID NO: 3468286 - RNA, 21 nt, Pseudomonas aeruginosa PA01
gguaguccagcagguggcgca

SEQ ID NO: 3468287 - RNA, 14 nt, Pseudomonas aeruginosa PA01
gguaguccagccag

SEQ ID NO: 3468288 - RNA, 18 nt, Pseudomonas aeruginosa PA01
gguaguccagccagugca

SEQ ID NO: 3468289 - RNA, 17 nt, Pseudomonas aeruginosa PA01
gguaguccagcgagugc

SEQ ID NO: 3468290 - RNA, 18 nt, Pseudomonas aeruginosa PA01
gguaguccagcuccucga

SEQ ID NO: 3468291 - RNA, 14 nt, Pseudomonas aeruginosa PA01
gguaguccgcugcg

SEQ ID NO: 3468292 - RNA, 17 nt, Pseudomonas aeruginosa PA01
gguagucgagccggauc

SEQ ID NO: 3468293 - RNA, 20 nt, Pseudomonas aeruginosa PA01
gguagucggugaagcgcggc

SEQ ID NO: 3468294 - RNA, 21 nt, Pseudomonas aeruginosa PA01
gguagucuucgaugcgccgca

SEQ ID NO: 3468295 - RNA, 14 nt, Pseudomonas aeruginosa PA01
gguagugccgcccu

SEQ ID NO: 3468296 - RNA, 14 nt, Pseudomonas aeruginosa PA01
gguagugcggcggg

SEQ ID NO: 3468297 - RNA, 15 nt, Pseudomonas aeruginosa PA01
gguagugcggcgggc

SEQ ID NO: 3468298 - RNA, 18 nt, Pseudomonas aeruginosa PA01
gguagugcggcgggcgcc

SEQ ID NO: 3468299 - RNA, 13 nt, Pseudomonas aeruginosa PA01
gguagugcuucag

SEQ ID NO: 3468300 - RNA, 20 nt, Pseudomonas aeruginosa PA01
gguagugucgaaguagccgg

SEQ ID NO: 3468301 - RNA, 15 nt, Pseudomonas aeruginosa PA01
gguaguguugaagcc

SEQ ID NO: 3468302 - RNA, 19 nt, Pseudomonas aeruginosa PA01
gguaguucuccaggcccau

SEQ ID NO: 3468303 - RNA, 20 nt, Pseudomonas aeruginosa PA01
gguauagaaaucgaucgagc

SEQ ID NO: 3468304 - RNA, 22 nt, Pseudomonas aeruginosa PA01
gguauagaccagcaccgccugc

SEQ ID NO: 3468305 - RNA, 16 nt, Pseudomonas aeruginosa PA01
gguauccagcacccgc

SEQ ID NO: 3468306 - RNA, 15 nt, Pseudomonas aeruginosa PA01
gguauccagcggccg

SEQ ID NO: 3468307 - RNA, 22 nt, Pseudomonas aeruginosa PA01
gguaucccggcugagcgccagg

SEQ ID NO: 3468308 - RNA, 15 nt, Pseudomonas aeruginosa PA01
gguaucccuggaacu

SEQ ID NO: 3468309 - RNA, 19 nt, Pseudomonas aeruginosa PA01
gguauccgcuuacuggcga

SEQ ID NO: 3468310 - RNA, 15 nt, Pseudomonas aeruginosa PA01
gguaucgcugggcgc

SEQ ID NO: 3468311 - RNA, 14 nt, Pseudomonas aeruginosa PA01
gguaucgcugucgc

SEQ ID NO: 3468312 - RNA, 18 nt, Pseudomonas aeruginosa PA01
gguaucggccauggccga

SEQ ID NO: 3468313 - RNA, 18 nt, Pseudomonas aeruginosa PA01
gguaugccggagugccgc

SEQ ID NO: 3468314 - RNA, 16 nt, Pseudomonas aeruginosa PA01
gguauggcagcucugc

SEQ ID NO: 3468315 - RNA, 13 nt, Pseudomonas aeruginosa PA01
gguauggcugcug

SEQ ID NO: 3468316 - RNA, 20 nt, Pseudomonas aeruginosa PA01
gguaugggugcccuugccgg

SEQ ID NO: 3468317 - RNA, 20 nt, Pseudomonas aeruginosa PA01
gguauucagccagagcccgu

SEQ ID NO: 3468318 - RNA, 18 nt, Pseudomonas aeruginosa PA01
gguauucgccggccaggu

SEQ ID NO: 3468319 - RNA, 14 nt, Pseudomonas aeruginosa PA01
gguauucuccagca

SEQ ID NO: 3468320 - RNA, 15 nt, Pseudomonas aeruginosa PA01
gguauugcagacgcu

SEQ ID NO: 3468321 - RNA, 16 nt, Pseudomonas aeruginosa PA01
ggucaacaccagcgcc

SEQ ID NO: 3468322 - RNA, 18 nt, Pseudomonas aeruginosa PA01
ggucaacaccagcgccgc

SEQ ID NO: 3468323 - RNA, 15 nt, Pseudomonas aeruginosa PA01
ggucaaccgcgggcg

SEQ ID NO: 3468324 - RNA, 14 nt, Pseudomonas aeruginosa PA01
ggucaccacccagc

SEQ ID NO: 3468325 - RNA, 15 nt, Pseudomonas aeruginosa PA01
ggucaccacccagcc

SEQ ID NO: 3468326 - RNA, 18 nt, Pseudomonas aeruginosa PA01
ggucaccacccagccgcg

SEQ ID NO: 3468327 - RNA, 21 nt, Pseudomonas aeruginosa PA01
ggucaccacccagccgcggcc

SEQ ID NO: 3468328 - RNA, 21 nt, Pseudomonas aeruginosa PA01
ggucaccacuggaaacgccca

SEQ ID NO: 3468329 - RNA, 13 nt, Pseudomonas aeruginosa PA01
ggucaccagcgcc

SEQ ID NO: 3468330 - RNA, 13 nt, Pseudomonas aeruginosa PA01
ggucaccagcgug

SEQ ID NO: 3468331 - RNA, 22 nt, Pseudomonas aeruginosa PA01
ggucaccagcgugggcaacagg

SEQ ID NO: 3468332 - RNA, 19 nt, Pseudomonas aeruginosa PA01
ggucaccagggucacgccg

SEQ ID NO: 3468333 - RNA, 18 nt, Pseudomonas aeruginosa PA01
ggucaccagguugcccgg

SEQ ID NO: 3468334 - RNA, 20 nt, Pseudomonas aeruginosa PA01
ggucaccaugaucaucggcu

SEQ ID NO: 3468335 - RNA, 22 nt, Pseudomonas aeruginosa PA01
ggucaccaugaucaucggcugg

SEQ ID NO: 3468336 - RNA, 21 nt, Pseudomonas aeruginosa PA01
ggucacccauucgaugccgcg

SEQ ID NO: 3468337 - RNA, 14 nt, Pseudomonas aeruginosa PA01
ggucaccgccagcg

SEQ ID NO: 3468338 - RNA, 13 nt, Pseudomonas aeruginosa PA01
ggucaccgcgccg

SEQ ID NO: 3468339 - RNA, 15 nt, Pseudomonas aeruginosa PA01
ggucaccgcucgcca

SEQ ID NO: 3468340 - RNA, 21 nt, Pseudomonas aeruginosa PA01
ggucaccguggagaggucgcc

SEQ ID NO: 3468341 - RNA, 19 nt, Pseudomonas aeruginosa PA01
ggucaccguggucauggcg

SEQ ID NO: 3468342 - RNA, 23 nt, Pseudomonas aeruginosa PA01
ggucaccuugaccuugucggccg

SEQ ID NO: 3468343 - RNA, 12 nt, Pseudomonas aeruginosa PA01
ggucacgaaggc

SEQ ID NO: 3468344 - RNA, 17 nt, Pseudomonas aeruginosa PA01
ggucacgcaggcgcugg

SEQ ID NO: 3468345 - RNA, 18 nt, Pseudomonas aeruginosa PA01
ggucacgcaggcgcuggc

SEQ ID NO: 3468346 - RNA, 19 nt, Pseudomonas aeruginosa PA01
ggucacgcaggcgcuggcc

SEQ ID NO: 3468347 - RNA, 20 nt, Pseudomonas aeruginosa PA01
ggucacgcaggcgcuggccg

SEQ ID NO: 3468348 - RNA, 16 nt, Pseudomonas aeruginosa PA01
ggucacgcccugcacc

SEQ ID NO: 3468349 - RNA, 20 nt, Pseudomonas aeruginosa PA01
ggucacgccgaaguucuuca

SEQ ID NO: 3468350 - RNA, 21 nt, Pseudomonas aeruginosa PA01
ggucacgccgaaguucuucag

SEQ ID NO: 3468351 - RNA, 23 nt, Pseudomonas aeruginosa PA01
ggucacgccgaaguucuucagca

SEQ ID NO: 3468352 - RNA, 19 nt, Pseudomonas aeruginosa PA01
ggucacgccgagggcgcgg

SEQ ID NO: 3468353 - RNA, 20 nt, Pseudomonas aeruginosa PA01
ggucacgccgagggcgcggc

SEQ ID NO: 3468354 - RNA, 18 nt, Pseudomonas aeruginosa PA01
ggucacgccgaucacccc

SEQ ID NO: 3468355 - RNA, 21 nt, Pseudomonas aeruginosa PA01
ggucacgccgggaauccccag

SEQ ID NO: 3468356 - RNA, 14 nt, Pseudomonas aeruginosa PA01
ggucacgcugggca

SEQ ID NO: 3468357 - RNA, 16 nt, Pseudomonas aeruginosa PA01
ggucccaucagcaguc

SEQ ID NO: 3468358 - RNA, 18 nt, Pseudomonas aeruginosa PA01
gguccccuccagguaggg

SEQ ID NO: 3468359 - RNA, 18 nt, Pseudomonas aeruginosa PA01
ggucccuucgugggccug

SEQ ID NO: 3468360 - RNA, 22 nt, Pseudomonas aeruginosa PA01
gguccgacaaucagcggcgggc

SEQ ID NO: 3468361 - RNA, 20 nt, Pseudomonas aeruginosa PA01
gguccgacggaaauaggcgu

SEQ ID NO: 3468362 - RNA, 20 nt, Pseudomonas aeruginosa PA01
gguccgcaccguagcggcug

SEQ ID NO: 3468363 - RNA, 22 nt, Pseudomonas aeruginosa PA01
gguccgcaccguagcggcugcg

SEQ ID NO: 3468364 - RNA, 17 nt, Pseudomonas aeruginosa PA01
gguccgccagcaggcgu

SEQ ID NO: 3468365 - RNA, 20 nt, Pseudomonas aeruginosa PA01
gguccgccgcgggacgccgc

SEQ ID NO: 3468366 - RNA, 17 nt, Pseudomonas aeruginosa PA01
gguccgccugguccagc

SEQ ID NO: 3468367 - RNA, 16 nt, Pseudomonas aeruginosa PA01
gguccgcgccaugccg

SEQ ID NO: 3468368 - RNA, 19 nt, Pseudomonas aeruginosa PA01
gguccgcgguagcugcgca

SEQ ID NO: 3468369 - RNA, 23 nt, Pseudomonas aeruginosa PA01
gguccgcgguagcugcgcagggc

SEQ ID NO: 3468370 - RNA, 20 nt, Pseudomonas aeruginosa PA01
gguccgcgucacggacccgc

SEQ ID NO: 3468371 - RNA, 19 nt, Pseudomonas aeruginosa PA01
gguccgcguggugagcacg

SEQ ID NO: 3468372 - RNA, 19 nt, Pseudomonas aeruginosa PA01
gguccgcuucagcgcgccg

SEQ ID NO: 3468373 - RNA, 22 nt, Pseudomonas aeruginosa PA01
gguccgcuucagcgcgccgagc

SEQ ID NO: 3468374 - RNA, 23 nt, Pseudomonas aeruginosa PA01
gguccgcuucagcgcgccgagcc

SEQ ID NO: 3468375 - RNA, 14 nt, Pseudomonas aeruginosa PA01
gguccggagggccc

SEQ ID NO: 3468376 - RNA, 15 nt, Pseudomonas aeruginosa PA01
gguccggagggcccg

SEQ ID NO: 3468377 - RNA, 12 nt, Pseudomonas aeruginosa PA01
gguccggcacuu

SEQ ID NO: 3468378 - RNA, 21 nt, Pseudomonas aeruginosa PA01
gguccggcacuuccuugguga

SEQ ID NO: 3468379 - RNA, 15 nt, Pseudomonas aeruginosa PA01
gguccggcagcgccu

SEQ ID NO: 3468380 - RNA, 21 nt, Pseudomonas aeruginosa PA01
gguccggcuccggcugcguga

SEQ ID NO: 3468381 - RNA, 21 nt, Pseudomonas aeruginosa PA01
gguccggcugucgacgcagcc

SEQ ID NO: 3468382 - RNA, 22 nt, Pseudomonas aeruginosa PA01
gguccggcugucgacgcagccg

SEQ ID NO: 3468383 - RNA, 23 nt, Pseudomonas aeruginosa PA01
gguccggcugucgacgcagccgg

SEQ ID NO: 3468384 - RNA, 21 nt, Pseudomonas aeruginosa PA01
gguccggguuggcgcaggccg

SEQ ID NO: 3468385 - RNA, 22 nt, Pseudomonas aeruginosa PA01
gguccggguuggcgcaggccgg

SEQ ID NO: 3468386 - RNA, 24 nt, Pseudomonas aeruginosa PA01
gguccgguacugcugggccuugau

SEQ ID NO: 3468387 - RNA, 21 nt, Pseudomonas aeruginosa PA01
gguccguccagcgcgcccggc

SEQ ID NO: 3468388 - RNA, 22 nt, Pseudomonas aeruginosa PA01
gguccgucgcgcgcccguacca

SEQ ID NO: 3468389 - RNA, 15 nt, Pseudomonas aeruginosa PA01
gguccguucggcgcc

SEQ ID NO: 3468390 - RNA, 19 nt, Pseudomonas aeruginosa PA01
gguccguucggcgcccagg

SEQ ID NO: 3468391 - RNA, 20 nt, Pseudomonas aeruginosa PA01
gguccguucggcgcccaggu

SEQ ID NO: 3468392 - RNA, 17 nt, Pseudomonas aeruginosa PA01
gguccucgggcaccagc

SEQ ID NO: 3468393 - RNA, 19 nt, Pseudomonas aeruginosa PA01
gguccucgggcaccagcac

SEQ ID NO: 3468394 - RNA, 22 nt, Pseudomonas aeruginosa PA01
gguccugcaacuggaaggccgc

SEQ ID NO: 3468395 - RNA, 23 nt, Pseudomonas aeruginosa PA01
gguccugcaacuggaaggccgcg

SEQ ID NO: 3468396 - RNA, 21 nt, Pseudomonas aeruginosa PA01
gguccuggguauagaccagca

SEQ ID NO: 3468397 - RNA, 17 nt, Pseudomonas aeruginosa PA01
gguccuggguggcgacg

SEQ ID NO: 3468398 - RNA, 23 nt, Pseudomonas aeruginosa PA01
gguccuggugaucaucguccugc

SEQ ID NO: 3468399 - RNA, 18 nt, Pseudomonas aeruginosa PA01
gguccuugggccaggcau

SEQ ID NO: 3468400 - RNA, 15 nt, Pseudomonas aeruginosa PA01
gguccuuguccgggu

SEQ ID NO: 3468401 - RNA, 19 nt, Pseudomonas aeruginosa PA01
gguccuuguuccugggcgg

SEQ ID NO: 3468402 - RNA, 21 nt, Pseudomonas aeruginosa PA01
ggucgaaagcuucgucgcgca

SEQ ID NO: 3468403 - RNA, 23 nt, Pseudomonas aeruginosa PA01
ggucgaaagcuucgucgcgcagg

SEQ ID NO: 3468404 - RNA, 22 nt, Pseudomonas aeruginosa PA01
ggucgaacacuugaccgucggc

SEQ ID NO: 3468405 - RNA, 17 nt, Pseudomonas aeruginosa PA01
ggucgaacagcggcugg

SEQ ID NO: 3468406 - RNA, 24 nt, Pseudomonas aeruginosa PA01
ggucgaaccagcucagcuccaggc

SEQ ID NO: 3468407 - RNA, 22 nt, Pseudomonas aeruginosa PA01
ggucgaaccccuuccccccgcg

SEQ ID NO: 3468408 - RNA, 17 nt, Pseudomonas aeruginosa PA01
ggucgaacugaccacca

SEQ ID NO: 3468409 - RNA, 18 nt, Pseudomonas aeruginosa PA01
ggucgaaggcgcggcgga

SEQ ID NO: 3468410 - RNA, 20 nt, Pseudomonas aeruginosa PA01
ggucgaauggaguuuccgcg

SEQ ID NO: 3468411 - RNA, 18 nt, Pseudomonas aeruginosa PA01
ggucgacaugcaccaggc

SEQ ID NO: 3468412 - RNA, 22 nt, Pseudomonas aeruginosa PA01
ggucgacaugcaccaggccgcc

SEQ ID NO: 3468413 - RNA, 16 nt, Pseudomonas aeruginosa PA01
ggucgacaugcaggcc

SEQ ID NO: 3468414 - RNA, 21 nt, Pseudomonas aeruginosa PA01
ggucgaccagccagucggcgg

SEQ ID NO: 3468415 - RNA, 14 nt, Pseudomonas aeruginosa PA01
ggucgaccaggcgu

SEQ ID NO: 3468416 - RNA, 16 nt, Pseudomonas aeruginosa PA01
ggucgaccuugccgac

SEQ ID NO: 3468417 - RNA, 19 nt, Pseudomonas aeruginosa PA01
ggucgaccuugccgacgcc

SEQ ID NO: 3468418 - RNA, 18 nt, Pseudomonas aeruginosa PA01
ggucgacgaccuugccca

SEQ ID NO: 3468419 - RNA, 18 nt, Pseudomonas aeruginosa PA01
ggucgacgcagggcggcg

SEQ ID NO: 3468420 - RNA, 20 nt, Pseudomonas aeruginosa PA01
ggucgacgcagggcggcgcc

SEQ ID NO: 3468421 - RNA, 15 nt, Pseudomonas aeruginosa PA01
ggucgacgccauggc

SEQ ID NO: 3468422 - RNA, 16 nt, Pseudomonas aeruginosa PA01
ggucgacgccauggcg

SEQ ID NO: 3468423 - RNA, 18 nt, Pseudomonas aeruginosa PA01
ggucgacgccauggcgcu

SEQ ID NO: 3468424 - RNA, 21 nt, Pseudomonas aeruginosa PA01
ggucgacgccauggcgcuuca

SEQ ID NO: 3468425 - RNA, 14 nt, Pseudomonas aeruginosa PA01
ggucgacgccgccg

SEQ ID NO: 3468426 - RNA, 13 nt, Pseudomonas aeruginosa PA01
ggucgacggcggc

SEQ ID NO: 3468427 - RNA, 17 nt, Pseudomonas aeruginosa PA01
ggucgacggcggccgcc

SEQ ID NO: 3468428 - RNA, 18 nt, Pseudomonas aeruginosa PA01
ggucgacggcgugcaggu

SEQ ID NO: 3468429 - RNA, 16 nt, Pseudomonas aeruginosa PA01
ggucgacguaggcggc

SEQ ID NO: 3468430 - RNA, 18 nt, Pseudomonas aeruginosa PA01
ggucgacguaggcggcga

SEQ ID NO: 3468431 - RNA, 16 nt, Pseudomonas aeruginosa PA01
ggucgacugcugggua

SEQ ID NO: 3468432 - RNA, 16 nt, Pseudomonas aeruginosa PA01
ggucgacuucgcacca

SEQ ID NO: 3468433 - RNA, 18 nt, Pseudomonas aeruginosa PA01
ggucgagaaggcugccgg

SEQ ID NO: 3468434 - RNA, 21 nt, Pseudomonas aeruginosa PA01
ggucgagaaggcugccgggcu

SEQ ID NO: 3468435 - RNA, 16 nt, Pseudomonas aeruginosa PA01
ggucgagacgccauca

SEQ ID NO: 3468436 - RNA, 15 nt, Pseudomonas aeruginosa PA01
ggucgagcagcgccg

SEQ ID NO: 3468437 - RNA, 20 nt, Pseudomonas aeruginosa PA01
ggucgagcagcgccgcggug

SEQ ID NO: 3468438 - RNA, 17 nt, Pseudomonas aeruginosa PA01
ggucgagcaguuccggc

SEQ ID NO: 3468439 - RNA, 23 nt, Pseudomonas aeruginosa PA01
ggucgagcuuguuggccagcagc

SEQ ID NO: 3468440 - RNA, 18 nt, Pseudomonas aeruginosa PA01
ggucgaggacgaucagcu

SEQ ID NO: 3468441 - RNA, 21 nt, Pseudomonas aeruginosa PA01
ggucgaggcaaucugcccggc

SEQ ID NO: 3468442 - RNA, 13 nt, Pseudomonas aeruginosa PA01
ggucgaggcccuc

SEQ ID NO: 3468443 - RNA, 18 nt, Pseudomonas aeruginosa PA01
ggucgaggcccucggcgg

SEQ ID NO: 3468444 - RNA, 21 nt, Pseudomonas aeruginosa PA01
ggucgaggcccucggcggcga

SEQ ID NO: 3468445 - RNA, 15 nt, Pseudomonas aeruginosa PA01
ggucgaggccgcgga

SEQ ID NO: 3468446 - RNA, 22 nt, Pseudomonas aeruginosa PA01
ggucgaggcgcuccaccgcccc

SEQ ID NO: 3468447 - RNA, 20 nt, Pseudomonas aeruginosa PA01
ggucgaggcggagaagccgc

SEQ ID NO: 3468448 - RNA, 23 nt, Pseudomonas aeruginosa PA01
ggucgaggcggagaagccgcuga

SEQ ID NO: 3468449 - RNA, 13 nt, Pseudomonas aeruginosa PA01
ggucgaggcugcc

SEQ ID NO: 3468450 - RNA, 15 nt, Pseudomonas aeruginosa PA01
ggucgaggcugccga

SEQ ID NO: 3468451 - RNA, 23 nt, Pseudomonas aeruginosa PA01
ggucgagggcaugaccgauggcg

SEQ ID NO: 3468452 - RNA, 14 nt, Pseudomonas aeruginosa PA01
ggucgagggcgcgu

SEQ ID NO: 3468453 - RNA, 18 nt, Pseudomonas aeruginosa PA01
ggucgagguucuccaggc

SEQ ID NO: 3468454 - RNA, 20 nt, Pseudomonas aeruginosa PA01
ggucgagguucuccaggcuu

SEQ ID NO: 3468455 - RNA, 12 nt, Pseudomonas aeruginosa PA01
ggucgagucggg

SEQ ID NO: 3468456 - RNA, 16 nt, Pseudomonas aeruginosa PA01
ggucgaucuccuccuc

SEQ ID NO: 3468457 - RNA, 18 nt, Pseudomonas aeruginosa PA01
ggucgaucuccuccucgg

SEQ ID NO: 3468458 - RNA, 14 nt, Pseudomonas aeruginosa PA01
ggucggagugcucg

SEQ ID NO: 3468459 - RNA, 12 nt, Pseudomonas aeruginosa PA01
ggucggaucggc

SEQ ID NO: 3468460 - RNA, 17 nt, Pseudomonas aeruginosa PA01
ggucggaugcagcgcuu

SEQ ID NO: 3468461 - RNA, 14 nt, Pseudomonas aeruginosa PA01
ggucggcaccgagc

SEQ ID NO: 3468462 - RNA, 14 nt, Pseudomonas aeruginosa PA01
ggucggcacgaugu

SEQ ID NO: 3468463 - RNA, 19 nt, Pseudomonas aeruginosa PA01
ggucggcagaccgacccuc

SEQ ID NO: 3468464 - RNA, 14 nt, Pseudomonas aeruginosa PA01
ggucggcagcagcu

SEQ ID NO: 3468465 - RNA, 20 nt, Pseudomonas aeruginosa PA01
ggucggcagcgucgagcugg

SEQ ID NO: 3468466 - RNA, 24 nt, Pseudomonas aeruginosa PA01
ggucggcagcgucgagcuggcgca

SEQ ID NO: 3468467 - RNA, 14 nt, Pseudomonas aeruginosa PA01
ggucggcaggaccg

SEQ ID NO: 3468468 - RNA, 21 nt, Pseudomonas aeruginosa PA01
ggucggcagguggguaccgaa

SEQ ID NO: 3468469 - RNA, 15 nt, Pseudomonas aeruginosa PA01
ggucggcauccggca

SEQ ID NO: 3468470 - RNA, 17 nt, Pseudomonas aeruginosa PA01
ggucggcauccggcagg

SEQ ID NO: 3468471 - RNA, 19 nt, Pseudomonas aeruginosa PA01
ggucggccaggacgccacc

SEQ ID NO: 3468472 - RNA, 20 nt, Pseudomonas aeruginosa PA01
ggucggccaggacgccacca

SEQ ID NO: 3468473 - RNA, 15 nt, Pseudomonas aeruginosa PA01
ggucggccaggcggc

SEQ ID NO: 3468474 - RNA, 18 nt, Pseudomonas aeruginosa PA01
ggucggccaggcggccga

SEQ ID NO: 3468475 - RNA, 19 nt, Pseudomonas aeruginosa PA01
ggucggccaggggagcgcc

SEQ ID NO: 3468476 - RNA, 18 nt, Pseudomonas aeruginosa PA01
ggucggccggcagcuccg

SEQ ID NO: 3468477 - RNA, 20 nt, Pseudomonas aeruginosa PA01
ggucggccggcagcuccggc

SEQ ID NO: 3468478 - RNA, 14 nt, Pseudomonas aeruginosa PA01
ggucggccucgagc

SEQ ID NO: 3468479 - RNA, 23 nt, Pseudomonas aeruginosa PA01
ggucggccucgagcaucuccggc

SEQ ID NO: 3468480 - RNA, 21 nt, Pseudomonas aeruginosa PA01
ggucggccugcggguucggcg

SEQ ID NO: 3468481 - RNA, 12 nt, Pseudomonas aeruginosa PA01
ggucggccuggg

SEQ ID NO: 3468482 - RNA, 23 nt, Pseudomonas aeruginosa PA01
ggucggccuggguacgcaccggc

SEQ ID NO: 3468483 - RNA, 21 nt, Pseudomonas aeruginosa PA01
ggucggcgaaguccaccaggc

SEQ ID NO: 3468484 - RNA, 20 nt, Pseudomonas aeruginosa PA01
ggucggcgccggugcuggcg

SEQ ID NO: 3468485 - RNA, 12 nt, Pseudomonas aeruginosa PA01
ggucggcgcgca

SEQ ID NO: 3468486 - RNA, 15 nt, Pseudomonas aeruginosa PA01
ggucggcgcgcaccu

SEQ ID NO: 3468487 - RNA, 13 nt, Pseudomonas aeruginosa PA01
ggucggcgcgccc

SEQ ID NO: 3468488 - RNA, 16 nt, Pseudomonas aeruginosa PA01
ggucggcgcgcccggc

SEQ ID NO: 3468489 - RNA, 13 nt, Pseudomonas aeruginosa PA01
ggucggcgcggcg

SEQ ID NO: 3468490 - RNA, 15 nt, Pseudomonas aeruginosa PA01
ggucggcgcggcgcu

SEQ ID NO: 3468491 - RNA, 21 nt, Pseudomonas aeruginosa PA01
ggucggcgcggcgcuccaggc

SEQ ID NO: 3468492 - RNA, 17 nt, Pseudomonas aeruginosa PA01
ggucggcggcagcugcg

SEQ ID NO: 3468493 - RNA, 14 nt, Pseudomonas aeruginosa PA01
ggucggcggccuug

SEQ ID NO: 3468494 - RNA, 13 nt, Pseudomonas aeruginosa PA01
ggucggcgggcac

SEQ ID NO: 3468495 - RNA, 22 nt, Pseudomonas aeruginosa PA01
ggucggcgggcaccgccagccc

SEQ ID NO: 3468496 - RNA, 20 nt, Pseudomonas aeruginosa PA01
ggucggcggucucgaacgcc

SEQ ID NO: 3468497 - RNA, 18 nt, Pseudomonas aeruginosa PA01
ggucggcgucuuccggcu

SEQ ID NO: 3468498 - RNA, 12 nt, Pseudomonas aeruginosa PA01
ggucggcucagc

SEQ ID NO: 3468499 - RNA, 13 nt, Pseudomonas aeruginosa PA01
ggucggcuggcag

SEQ ID NO: 3468500 - RNA, 15 nt, Pseudomonas aeruginosa PA01
ggucggcuuccgccg

SEQ ID NO: 3468501 - RNA, 13 nt, Pseudomonas aeruginosa PA01
ggucgggcaacgg

SEQ ID NO: 3468502 - RNA, 14 nt, Pseudomonas aeruginosa PA01
ggucgggcagcuuc

SEQ ID NO: 3468503 - RNA, 15 nt, Pseudomonas aeruginosa PA01
ggucgggcagcuucu

SEQ ID NO: 3468504 - RNA, 16 nt, Pseudomonas aeruginosa PA01
ggucggggcgcaaggc

SEQ ID NO: 3468505 - RNA, 15 nt, Pseudomonas aeruginosa PA01
ggucggguccgggcc

SEQ ID NO: 3468506 - RNA, 16 nt, Pseudomonas aeruginosa PA01
ggucggguccgggccc

SEQ ID NO: 3468507 - RNA, 18 nt, Pseudomonas aeruginosa PA01
ggucgggucgagcuugcc

SEQ ID NO: 3468508 - RNA, 13 nt, Pseudomonas aeruginosa PA01
ggucggucggcgg

SEQ ID NO: 3468509 - RNA, 15 nt, Pseudomonas aeruginosa PA01
ggucggucggcggcg

SEQ ID NO: 3468510 - RNA, 15 nt, Pseudomonas aeruginosa PA01
ggucggucuggcggc

SEQ ID NO: 3468511 - RNA, 16 nt, Pseudomonas aeruginosa PA01
ggucggucuggcggcc

SEQ ID NO: 3468512 - RNA, 20 nt, Pseudomonas aeruginosa PA01
ggucggucuggcggcccugg

SEQ ID NO: 3468513 - RNA, 13 nt, Pseudomonas aeruginosa PA01
ggucggugacccg

SEQ ID NO: 3468514 - RNA, 23 nt, Pseudomonas aeruginosa PA01
ggucggugacccgcacggcgacg

SEQ ID NO: 3468515 - RNA, 14 nt, Pseudomonas aeruginosa PA01
ggucggugagcacg

SEQ ID NO: 3468516 - RNA, 15 nt, Pseudomonas aeruginosa PA01
ggucggugagcacgc

SEQ ID NO: 3468517 - RNA, 18 nt, Pseudomonas aeruginosa PA01
ggucgguucgcggcgcag

SEQ ID NO: 3468518 - RNA, 21 nt, Pseudomonas aeruginosa PA01
ggucgguucgcggcgcagcuu

SEQ ID NO: 3468519 - RNA, 14 nt, Pseudomonas aeruginosa PA01
ggucgguucgucga

SEQ ID NO: 3468520 - RNA, 16 nt, Pseudomonas aeruginosa PA01
ggucgguucgucgagg

SEQ ID NO: 3468521 - RNA, 14 nt, Pseudomonas aeruginosa PA01
ggucgguugcggcc

SEQ ID NO: 3468522 - RNA, 16 nt, Pseudomonas aeruginosa PA01
ggucguacaccagaug

SEQ ID NO: 3468523 - RNA, 21 nt, Pseudomonas aeruginosa PA01
ggucguacaccgcgcggcaca

SEQ ID NO: 3468524 - RNA, 15 nt, Pseudomonas aeruginosa PA01
ggucguagcccaugg

SEQ ID NO: 3468525 - RNA, 20 nt, Pseudomonas aeruginosa PA01
ggucguaggaacgugcggcc

SEQ ID NO: 3468526 - RNA, 17 nt, Pseudomonas aeruginosa PA01
ggucguaggcgcgggcg

SEQ ID NO: 3468527 - RNA, 18 nt, Pseudomonas aeruginosa PA01
ggucgucgcccuggccga

SEQ ID NO: 3468528 - RNA, 11 nt, Pseudomonas aeruginosa PA01
ggucgugcagc

SEQ ID NO: 3468529 - RNA, 13 nt, Pseudomonas aeruginosa PA01
ggucgugcagcac

SEQ ID NO: 3468530 - RNA, 16 nt, Pseudomonas aeruginosa PA01
ggucgugcagcccggu

SEQ ID NO: 3468531 - RNA, 16 nt, Pseudomonas aeruginosa PA01
ggucguggucgaaugg

SEQ ID NO: 3468532 - RNA, 21 nt, Pseudomonas aeruginosa PA01
ggucguucagugccagcagac

SEQ ID NO: 3468533 - RNA, 16 nt, Pseudomonas aeruginosa PA01
ggucguugcgccggcc

SEQ ID NO: 3468534 - RNA, 23 nt, Pseudomonas aeruginosa PA01
ggucguugcgcgccagcgccacg

SEQ ID NO: 3468535 - RNA, 21 nt, Pseudomonas aeruginosa PA01
ggucguuggccaggcgcgaca

SEQ ID NO: 3468536 - RNA, 14 nt, Pseudomonas aeruginosa PA01
ggucuagccgggcc

SEQ ID NO: 3468537 - RNA, 13 nt, Pseudomonas aeruginosa PA01
ggucucaccgccc

SEQ ID NO: 3468538 - RNA, 19 nt, Pseudomonas aeruginosa PA01
ggucucaccgcccugcgcg

SEQ ID NO: 3468539 - RNA, 20 nt, Pseudomonas aeruginosa PA01
ggucucaguauuucucgacu

SEQ ID NO: 3468540 - RNA, 18 nt, Pseudomonas aeruginosa PA01
ggucuccgugcuggccgg

SEQ ID NO: 3468541 - RNA, 21 nt, Pseudomonas aeruginosa PA01
ggucucgaacgccaggcaggc

SEQ ID NO: 3468542 - RNA, 14 nt, Pseudomonas aeruginosa PA01
ggucucgaucagcg

SEQ ID NO: 3468543 - RNA, 16 nt, Pseudomonas aeruginosa PA01
ggucucgaucagcgcc

SEQ ID NO: 3468544 - RNA, 18 nt, Pseudomonas aeruginosa PA01
ggucucgauggcagccuu

SEQ ID NO: 3468545 - RNA, 21 nt, Pseudomonas aeruginosa PA01
ggucucgccaccccgcuccgc

SEQ ID NO: 3468546 - RNA, 13 nt, Pseudomonas aeruginosa PA01
ggucucgccgccg

SEQ ID NO: 3468547 - RNA, 19 nt, Pseudomonas aeruginosa PA01
ggucucgcgcagcggcgga

SEQ ID NO: 3468548 - RNA, 16 nt, Pseudomonas aeruginosa PA01
ggucucgcgggcgacg

SEQ ID NO: 3468549 - RNA, 20 nt, Pseudomonas aeruginosa PA01
ggucucgcugacccaggcuu

SEQ ID NO: 3468550 - RNA, 23 nt, Pseudomonas aeruginosa PA01
ggucucuacgccauacugggcgg

SEQ ID NO: 3468551 - RNA, 23 nt, Pseudomonas aeruginosa PA01
ggucucuuccagcaugcucgggc

SEQ ID NO: 3468552 - RNA, 13 nt, Pseudomonas aeruginosa PA01
ggucucuucgucg

SEQ ID NO: 3468553 - RNA, 23 nt, Pseudomonas aeruginosa PA01
ggucucuucgucggucauguccg

SEQ ID NO: 3468554 - RNA, 17 nt, Pseudomonas aeruginosa PA01
ggucugccagcucuggc

SEQ ID NO: 3468555 - RNA, 18 nt, Pseudomonas aeruginosa PA01
ggucugccagcucuggcc

SEQ ID NO: 3468556 - RNA, 15 nt, Pseudomonas aeruginosa PA01
ggucugcccguggcg

SEQ ID NO: 3468557 - RNA, 17 nt, Pseudomonas aeruginosa PA01
ggucugcccguggcgcg

SEQ ID NO: 3468558 - RNA, 19 nt, Pseudomonas aeruginosa PA01
ggucugcccguggcgcgga

SEQ ID NO: 3468559 - RNA, 18 nt, Pseudomonas aeruginosa PA01
ggucugccucgccgaggc

SEQ ID NO: 3468560 - RNA, 19 nt, Pseudomonas aeruginosa PA01
ggucugcgccucgcuggcg

SEQ ID NO: 3468561 - RNA, 19 nt, Pseudomonas aeruginosa PA01
ggugcagccacccagcagc

SEQ ID NO: 3468562 - RNA, 23 nt, Pseudomonas aeruginosa PA01
ggugcagccacccagcagcaacu

SEQ ID NO: 3468563 - RNA, 14 nt, Pseudomonas aeruginosa PA01
ggugcagcggaagc

SEQ ID NO: 3468564 - RNA, 18 nt, Pseudomonas aeruginosa PA01
ggugcaggaagcgccggg

SEQ ID NO: 3468565 - RNA, 14 nt, Pseudomonas aeruginosa PA01
ggugcaggccgacg

SEQ ID NO: 3468566 - RNA, 23 nt, Pseudomonas aeruginosa PA01
ggugcaggccgacguagccgcgu

SEQ ID NO: 3468567 - RNA, 15 nt, Pseudomonas aeruginosa PA01
ggugcaggccgcgcg

SEQ ID NO: 3468568 - RNA, 14 nt, Pseudomonas aeruginosa PA01
ggugcaggucgcgc

SEQ ID NO: 3468569 - RNA, 18 nt, Pseudomonas aeruginosa PA01
ggugcagguucaccgccu

SEQ ID NO: 3468570 - RNA, 20 nt, Pseudomonas aeruginosa PA01
ggugcaguucgccguucagc

SEQ ID NO: 3468571 - RNA, 17 nt, Pseudomonas aeruginosa PA01
ggugcauaggguccagu

SEQ ID NO: 3468572 - RNA, 22 nt, Pseudomonas aeruginosa PA01
ggugcauaggguccaguucagg

SEQ ID NO: 3468573 - RNA, 15 nt, Pseudomonas aeruginosa PA01
ggugcauccgccgca

SEQ ID NO: 3468574 - RNA, 21 nt, Pseudomonas aeruginosa PA01
ggugcaugaaggcgcugagcg

SEQ ID NO: 3468575 - RNA, 16 nt, Pseudomonas aeruginosa PA01
ggugcauguagcgcuc

SEQ ID NO: 3468576 - RNA, 17 nt, Pseudomonas aeruginosa PA01
ggugccagggcggucgg

SEQ ID NO: 3468577 - RNA, 21 nt, Pseudomonas aeruginosa PA01
ggugccagggcggucggccag

SEQ ID NO: 3468578 - RNA, 17 nt, Pseudomonas aeruginosa PA01
ggugccauacagcgccc

SEQ ID NO: 3468579 - RNA, 19 nt, Pseudomonas aeruginosa PA01
ggugccauacucggacggc

SEQ ID NO: 3468580 - RNA, 21 nt, Pseudomonas aeruginosa PA01
ggugccauacucggacggcuc

SEQ ID NO: 3468581 - RNA, 14 nt, Pseudomonas aeruginosa PA01
ggugcccagcggcg

SEQ ID NO: 3468582 - RNA, 17 nt, Pseudomonas aeruginosa PA01
ggugcccagcggcgccu

SEQ ID NO: 3468583 - RNA, 17 nt, Pseudomonas aeruginosa PA01
ggugcccaucaggcuca

SEQ ID NO: 3468584 - RNA, 15 nt, Pseudomonas aeruginosa PA01
ggugccccgcuggcc

SEQ ID NO: 3468585 - RNA, 21 nt, Pseudomonas aeruginosa PA01
ggugccccgcuggcccaacag

SEQ ID NO: 3468586 - RNA, 22 nt, Pseudomonas aeruginosa PA01
ggugcccucgcggacgcuggcg

SEQ ID NO: 3468587 - RNA, 17 nt, Pseudomonas aeruginosa PA01
ggugcccuggaagccgg

SEQ ID NO: 3468588 - RNA, 23 nt, Pseudomonas aeruginosa PA01
ggugccgaagaccaccauggucu

SEQ ID NO: 3468589 - RNA, 18 nt, Pseudomonas aeruginosa PA01
ggugccgaccuucaccac

SEQ ID NO: 3468590 - RNA, 19 nt, Pseudomonas aeruginosa PA01
ggugccgaccuucaccacc

SEQ ID NO: 3468591 - RNA, 19 nt, Pseudomonas aeruginosa PA01
ggugccgaucucguaggca

SEQ ID NO: 3468592 - RNA, 21 nt, Pseudomonas aeruginosa PA01
ggugccgccagucggccuggc

SEQ ID NO: 3468593 - RNA, 23 nt, Pseudomonas aeruginosa PA01
ggugccgccagucggccuggcuc

SEQ ID NO: 3468594 - RNA, 16 nt, Pseudomonas aeruginosa PA01
ggugccgcccggcgcc

SEQ ID NO: 3468595 - RNA, 14 nt, Pseudomonas aeruginosa PA01
ggugccgcccuggg

SEQ ID NO: 3468596 - RNA, 13 nt, Pseudomonas aeruginosa PA01
ggugccgccggcc

SEQ ID NO: 3468597 - RNA, 14 nt, Pseudomonas aeruginosa PA01
ggugccgccggcca

SEQ ID NO: 3468598 - RNA, 22 nt, Pseudomonas aeruginosa PA01
ggugccgccggccaccagcagc

SEQ ID NO: 3468599 - RNA, 23 nt, Pseudomonas aeruginosa PA01
ggugccgccggccaccagcagca

SEQ ID NO: 3468600 - RNA, 16 nt, Pseudomonas aeruginosa PA01
ggugccgccggcgccg

SEQ ID NO: 3468601 - RNA, 19 nt, Pseudomonas aeruginosa PA01
ggugccgccggcgccgccg

SEQ ID NO: 3468602 - RNA, 13 nt, Pseudomonas aeruginosa PA01
ggugccgcgcagc

SEQ ID NO: 3468603 - RNA, 15 nt, Pseudomonas aeruginosa PA01
ggugccgcguagggc

SEQ ID NO: 3468604 - RNA, 15 nt, Pseudomonas aeruginosa PA01
ggugccggcggcgga

SEQ ID NO: 3468605 - RNA, 11 nt, Pseudomonas aeruginosa PA01
ggugccgggcu

SEQ ID NO: 3468606 - RNA, 13 nt, Pseudomonas aeruginosa PA01
ggugccgggggcg

SEQ ID NO: 3468607 - RNA, 15 nt, Pseudomonas aeruginosa PA01
ggugcgcaggcgcuc

SEQ ID NO: 3468608 - RNA, 18 nt, Pseudomonas aeruginosa PA01
ggugcgcaggcgcucgcg

SEQ ID NO: 3468609 - RNA, 23 nt, Pseudomonas aeruginosa PA01
ggugcgcaggcgcucgcgggccg

SEQ ID NO: 3468610 - RNA, 14 nt, Pseudomonas aeruginosa PA01
ggugcgcaggcugc

SEQ ID NO: 3468611 - RNA, 19 nt, Pseudomonas aeruginosa PA01
ggugcgcaggcugccuucg

SEQ ID NO: 3468612 - RNA, 10 nt, Pseudomonas aeruginosa PA01
ggugcgccga

SEQ ID NO: 3468613 - RNA, 19 nt, Pseudomonas aeruginosa PA01
ggugcgccgagcgcucgcc

SEQ ID NO: 3468614 - RNA, 20 nt, Pseudomonas aeruginosa PA01
ggugcgccgagcgcucgccg

SEQ ID NO: 3468615 - RNA, 21 nt, Pseudomonas aeruginosa PA01
ggugcgccggcggccggcgca

SEQ ID NO: 3468616 - RNA, 14 nt, Pseudomonas aeruginosa PA01
ggugcgcucgcgga

SEQ ID NO: 3468617 - RNA, 12 nt, Pseudomonas aeruginosa PA01
ggugcgcuggcg

SEQ ID NO: 3468618 - RNA, 14 nt, Pseudomonas aeruginosa PA01
ggugcgcuggcgcc

SEQ ID NO: 3468619 - RNA, 20 nt, Pseudomonas aeruginosa PA01
ggugcggauggcgaucgagc

SEQ ID NO: 3468620 - RNA, 14 nt, Pseudomonas aeruginosa PA01
ggugcggcaccagc

SEQ ID NO: 3468621 - RNA, 14 nt, Pseudomonas aeruginosa PA01
ggugcggccgagga

SEQ ID NO: 3468622 - RNA, 15 nt, Pseudomonas aeruginosa PA01
ggugcggccgaugau

SEQ ID NO: 3468623 - RNA, 14 nt, Pseudomonas aeruginosa PA01
ggugcggcugcuca

SEQ ID NO: 3468624 - RNA, 13 nt, Pseudomonas aeruginosa PA01
ggugcggcuggcg

SEQ ID NO: 3468625 - RNA, 15 nt, Pseudomonas aeruginosa PA01
ggugcggcuggcgcg

SEQ ID NO: 3468626 - RNA, 14 nt, Pseudomonas aeruginosa PA01
ggugcgggcgcggg

SEQ ID NO: 3468627 - RNA, 17 nt, Pseudomonas aeruginosa PA01
ggugcggguggucgccg

SEQ ID NO: 3468628 - RNA, 21 nt, Pseudomonas aeruginosa PA01
ggugcggguggucgccgccca

SEQ ID NO: 3468629 - RNA, 16 nt, Pseudomonas aeruginosa PA01
ggugcggucggcgccu

SEQ ID NO: 3468630 - RNA, 17 nt, Pseudomonas aeruginosa PA01
ggugcggugggcgaggg

SEQ ID NO: 3468631 - RNA, 17 nt, Pseudomonas aeruginosa PA01
ggugcgguuggagcgga

SEQ ID NO: 3468632 - RNA, 21 nt, Pseudomonas aeruginosa PA01
ggugcguggugcauccgccgc

SEQ ID NO: 3468633 - RNA, 15 nt, Pseudomonas aeruginosa PA01
ggugcuaugcgccgg

SEQ ID NO: 3468634 - RNA, 22 nt, Pseudomonas aeruginosa PA01
ggugcucaggacguccuggccg

SEQ ID NO: 3468635 - RNA, 23 nt, Pseudomonas aeruginosa PA01
ggugcucaggacguccuggccga

SEQ ID NO: 3468636 - RNA, 16 nt, Pseudomonas aeruginosa PA01
ggugcucaggcggccg

SEQ ID NO: 3468637 - RNA, 20 nt, Pseudomonas aeruginosa PA01
ggugcucaggcggccgaacu

SEQ ID NO: 3468638 - RNA, 23 nt, Pseudomonas aeruginosa PA01
ggugcucggccugaucaucuggg

SEQ ID NO: 3468639 - RNA, 17 nt, Pseudomonas aeruginosa PA01
ggugcugcaccgggagu

SEQ ID NO: 3468640 - RNA, 16 nt, Pseudomonas aeruginosa PA01
ggugcugcgcgcggcc

SEQ ID NO: 3468641 - RNA, 17 nt, Pseudomonas aeruginosa PA01
ggugcuggacucgcgcc

SEQ ID NO: 3468642 - RNA, 20 nt, Pseudomonas aeruginosa PA01
ggugcuggucgugguccagc

SEQ ID NO: 3468643 - RNA, 16 nt, Pseudomonas aeruginosa PA01
ggugcuggugcggccg

SEQ ID NO: 3468644 - RNA, 23 nt, Pseudomonas aeruginosa PA01
ggugcugguggcccugggcggcg

SEQ ID NO: 3468645 - RNA, 19 nt, Pseudomonas aeruginosa PA01
ggugcuggugggcgucgcu

SEQ ID NO: 3468646 - RNA, 13 nt, Pseudomonas aeruginosa PA01
ggugcuuggcacc

SEQ ID NO: 3468647 - RNA, 22 nt, Pseudomonas aeruginosa PA01
ggugcuuggcuucgagcugcga

SEQ ID NO: 3468648 - RNA, 18 nt, Pseudomonas aeruginosa PA01
ggugcuuuccugcuccag

SEQ ID NO: 3468649 - RNA, 22 nt, Pseudomonas aeruginosa PA01
ggugcuuuccugcuccagcagg

SEQ ID NO: 3468650 - RNA, 15 nt, Pseudomonas aeruginosa PA01
gguggaacagcauca

SEQ ID NO: 3468651 - RNA, 21 nt, Pseudomonas aeruginosa PA01
gguggaacagccgcagcggca

SEQ ID NO: 3468652 - RNA, 13 nt, Pseudomonas aeruginosa PA01
gguggaacgaggc

SEQ ID NO: 3468653 - RNA, 17 nt, Pseudomonas aeruginosa PA01
gguggaacgaggcgacc

SEQ ID NO: 3468654 - RNA, 15 nt, Pseudomonas aeruginosa PA01
gguggaauccagggc

SEQ ID NO: 3468655 - RNA, 21 nt, Pseudomonas aeruginosa PA01
gguggaauccagggccgagca

SEQ ID NO: 3468656 - RNA, 23 nt, Pseudomonas aeruginosa PA01
gguggacacccugcugcugcuca

SEQ ID NO: 3468657 - RNA, 16 nt, Pseudomonas aeruginosa PA01
gguggaccagcgccgc

SEQ ID NO: 3468658 - RNA, 21 nt, Pseudomonas aeruginosa PA01
gguggacggcauuggagauga

SEQ ID NO: 3468659 - RNA, 17 nt, Pseudomonas aeruginosa PA01
gguggagaucagcggac

SEQ ID NO: 3468660 - RNA, 15 nt, Pseudomonas aeruginosa PA01
gguggagcacgucga

SEQ ID NO: 3468661 - RNA, 14 nt, Pseudomonas aeruginosa PA01
gguggaggcccaga

SEQ ID NO: 3468662 - RNA, 15 nt, Pseudomonas aeruginosa PA01
gguggaggcgucggc

SEQ ID NO: 3468663 - RNA, 19 nt, Pseudomonas aeruginosa PA01
gguucaggucgaugcccag

SEQ ID NO: 3468664 - RNA, 19 nt, Pseudomonas aeruginosa PA01
gguucaggugaaaagcgcu

SEQ ID NO: 3468665 - RNA, 18 nt, Pseudomonas aeruginosa PA01
gguucaucgagcggcggc

SEQ ID NO: 3468666 - RNA, 19 nt, Pseudomonas aeruginosa PA01
gguucaucgagcggcggcc

SEQ ID NO: 3468667 - RNA, 16 nt, Pseudomonas aeruginosa PA01
gguuccagcggccgcg

SEQ ID NO: 3468668 - RNA, 23 nt, Pseudomonas aeruginosa PA01
gguuccaugcgaaaacggcgacc

SEQ ID NO: 3468669 - RNA, 14 nt, Pseudomonas aeruginosa PA01
gguucccagcagca

SEQ ID NO: 3468670 - RNA, 22 nt, Pseudomonas aeruginosa PA01
gguucccagcagcaacagcgcc

SEQ ID NO: 3468671 - RNA, 23 nt, Pseudomonas aeruginosa PA01
gguucccagcagcaacagcgccg

SEQ ID NO: 3468672 - RNA, 13 nt, Pseudomonas aeruginosa PA01
gguucccgcagcg

SEQ ID NO: 3468673 - RNA, 15 nt, Pseudomonas aeruginosa PA01
gguuccgcggcgacg

SEQ ID NO: 3468674 - RNA, 16 nt, Pseudomonas aeruginosa PA01
gguuccucacggcgca

SEQ ID NO: 3468675 - RNA, 18 nt, Pseudomonas aeruginosa PA01
gguuccucacggcgcagc

SEQ ID NO: 3468676 - RNA, 16 nt, Pseudomonas aeruginosa PA01
gguuccuccugggccg

SEQ ID NO: 3468677 - RNA, 14 nt, Pseudomonas aeruginosa PA01
gguuccuggcugga

SEQ ID NO: 3468678 - RNA, 16 nt, Pseudomonas aeruginosa PA01
gguuccuggcuggagu

SEQ ID NO: 3468679 - RNA, 14 nt, Pseudomonas aeruginosa PA01
gguucgaaugcugc

SEQ ID NO: 3468680 - RNA, 14 nt, Pseudomonas aeruginosa PA01
gguucgacgcgcca

SEQ ID NO: 3468681 - RNA, 16 nt, Pseudomonas aeruginosa PA01
gguucgacgcgccacg

SEQ ID NO: 3468682 - RNA, 15 nt, Pseudomonas aeruginosa PA01
gguucgauuccucua

SEQ ID NO: 3468683 - RNA, 13 nt, Pseudomonas aeruginosa PA01
gguucgcaggcca

SEQ ID NO: 3468684 - RNA, 19 nt, Pseudomonas aeruginosa PA01
gguucgcaggccaggcgca

SEQ ID NO: 3468685 - RNA, 16 nt, Pseudomonas aeruginosa PA01
gguucgcccgcgggca

SEQ ID NO: 3468686 - RNA, 12 nt, Pseudomonas aeruginosa PA01
gguucgccgacg

SEQ ID NO: 3468687 - RNA, 21 nt, Pseudomonas aeruginosa PA01
gguucgccgagcgccgccagg

SEQ ID NO: 3468688 - RNA, 17 nt, Pseudomonas aeruginosa PA01
gguucgcguggcccggc

SEQ ID NO: 3468689 - RNA, 15 nt, Pseudomonas aeruginosa PA01
gguucggcaaggcgc

SEQ ID NO: 3468690 - RNA, 13 nt, Pseudomonas aeruginosa PA01
gguucggcagcgc

SEQ ID NO: 3468691 - RNA, 14 nt, Pseudomonas aeruginosa PA01
gguucggcaggccu

SEQ ID NO: 3468692 - RNA, 21 nt, Pseudomonas aeruginosa PA01
gguucggcgaggaucgccagc

SEQ ID NO: 3468693 - RNA, 22 nt, Pseudomonas aeruginosa PA01
gguucggcgaggaucgccagca

SEQ ID NO: 3468694 - RNA, 20 nt, Pseudomonas aeruginosa PA01
gguucggcgguagcgcgaag

SEQ ID NO: 3468695 - RNA, 21 nt, Pseudomonas aeruginosa PA01
gguucggcgucuucggcggcg

SEQ ID NO: 3468696 - RNA, 18 nt, Pseudomonas aeruginosa PA01
gguucggggaacagcgcc

SEQ ID NO: 3468697 - RNA, 19 nt, Pseudomonas aeruginosa PA01
gguucggggaacagcgcca

SEQ ID NO: 3468698 - RNA, 21 nt, Pseudomonas aeruginosa PA01
gguucggggaacagcgccagc

SEQ ID NO: 3468699 - RNA, 18 nt, Pseudomonas aeruginosa PA01
gguucuccacuuccacuu

SEQ ID NO: 3468700 - RNA, 13 nt, Pseudomonas aeruginosa PA01
gguucucgacccg

SEQ ID NO: 3468701 - RNA, 12 nt, Pseudomonas aeruginosa PA01
gguucucggcca

SEQ ID NO: 3468702 - RNA, 14 nt, Pseudomonas aeruginosa PA01
gguucucggccacc

SEQ ID NO: 3468703 - RNA, 16 nt, Pseudomonas aeruginosa PA01
gguucucggccaccac

SEQ ID NO: 3468704 - RNA, 19 nt, Pseudomonas aeruginosa PA01
gguucucggucgggcgggc

SEQ ID NO: 3468705 - RNA, 22 nt, Pseudomonas aeruginosa PA01
gguucucgucgaugucgcggcu

SEQ ID NO: 3468706 - RNA, 20 nt, Pseudomonas aeruginosa PA01
gguucugccagagcgcugcc

SEQ ID NO: 3468707 - RNA, 13 nt, Pseudomonas aeruginosa PA01
gguucugcgagua

SEQ ID NO: 3468708 - RNA, 14 nt, Pseudomonas aeruginosa PA01
gguucugcuccgga

SEQ ID NO: 3468709 - RNA, 20 nt, Pseudomonas aeruginosa PA01
gguucugcuccggacugccg

SEQ ID NO: 3468710 - RNA, 21 nt, Pseudomonas aeruginosa PA01
gguucugcucgaacaucagca

SEQ ID NO: 3468711 - RNA, 21 nt, Pseudomonas aeruginosa PA01
gguucugguccaccagcccgc

SEQ ID NO: 3468712 - RNA, 21 nt, Pseudomonas aeruginosa PA01
gguugaaacugcgcaggcugg

SEQ ID NO: 3468713 - RNA, 18 nt, Pseudomonas aeruginosa PA01
gguugaacugcgguccgg

SEQ ID NO: 3468714 - RNA, 15 nt, Pseudomonas aeruginosa PA01
gguugaaggcgcggu

SEQ ID NO: 3468715 - RNA, 23 nt, Pseudomonas aeruginosa PA01
gguugacccagagccgcucggcg

SEQ ID NO: 3468716 - RNA, 19 nt, Pseudomonas aeruginosa PA01
gguugaccccgaggucggc

SEQ ID NO: 3468717 - RNA, 20 nt, Pseudomonas aeruginosa PA01
gguugaccccgaggucggcg

SEQ ID NO: 3468718 - RNA, 17 nt, Pseudomonas aeruginosa PA01
gguugaccccgcggccg

SEQ ID NO: 3468719 - RNA, 18 nt, Pseudomonas aeruginosa PA01
gguugaccccgcggccga

SEQ ID NO: 3468720 - RNA, 19 nt, Pseudomonas aeruginosa PA01
gguugaccugcagcgccuc

SEQ ID NO: 3468721 - RNA, 17 nt, Pseudomonas aeruginosa PA01
gguugaccuucuguccg

SEQ ID NO: 3468722 - RNA, 14 nt, Pseudomonas aeruginosa PA01
gguugacgaugcgg

SEQ ID NO: 3468723 - RNA, 20 nt, Pseudomonas aeruginosa PA01
gguugacgaugcggcccgcc

SEQ ID NO: 3468724 - RNA, 16 nt, Pseudomonas aeruginosa PA01
gguugagauccuggcc

SEQ ID NO: 3468725 - RNA, 20 nt, Pseudomonas aeruginosa PA01
gguugagauccuggccggcg

SEQ ID NO: 3468726 - RNA, 22 nt, Pseudomonas aeruginosa PA01
gguugagauccuggccggcggc

SEQ ID NO: 3468727 - RNA, 23 nt, Pseudomonas aeruginosa PA01
gguugagauccuggccggcggcg

SEQ ID NO: 3468728 - RNA, 14 nt, Pseudomonas aeruginosa PA01
gguugaggcgcucg

SEQ ID NO: 3468729 - RNA, 20 nt, Pseudomonas aeruginosa PA01
gguugaggcgcucguagagc

SEQ ID NO: 3468730 - RNA, 23 nt, Pseudomonas aeruginosa PA01
gguugagguagagcacgccgucg

SEQ ID NO: 3468731 - RNA, 18 nt, Pseudomonas aeruginosa PA01
gguugaguugcaggccgg

SEQ ID NO: 3468732 - RNA, 20 nt, Pseudomonas aeruginosa PA01
gguugaguugcaggccggcg

SEQ ID NO: 3468733 - RNA, 21 nt, Pseudomonas aeruginosa PA01
gguugaguugcaggccggcga

SEQ ID NO: 3468734 - RNA, 24 nt, Pseudomonas aeruginosa PA01
gguugaguugcaggccggcgagcc

SEQ ID NO: 3468735 - RNA, 20 nt, Pseudomonas aeruginosa PA01
gguugaucagguucggcagc

SEQ ID NO: 3468736 - RNA, 22 nt, Pseudomonas aeruginosa PA01
gguugauccugggcgccagccg

SEQ ID NO: 3468737 - RNA, 18 nt, Pseudomonas aeruginosa PA01
gguugaucgacgccagcu

SEQ ID NO: 3468738 - RNA, 15 nt, Pseudomonas aeruginosa PA01
gguugaugucgucga

SEQ ID NO: 3468739 - RNA, 22 nt, Pseudomonas aeruginosa PA01
gguugcagccaccagccgaaca

SEQ ID NO: 3468740 - RNA, 12 nt, Pseudomonas aeruginosa PA01
gguugccaggcc

SEQ ID NO: 3468741 - RNA, 16 nt, Pseudomonas aeruginosa PA01
gguugccaggccggcg

SEQ ID NO: 3468742 - RNA, 18 nt, Pseudomonas aeruginosa PA01
gguugccaggccggcgca

SEQ ID NO: 3468743 - RNA, 19 nt, Pseudomonas aeruginosa PA01
gguugcccacggccaggcc

SEQ ID NO: 3468744 - RNA, 22 nt, Pseudomonas aeruginosa PA01
gguugcccacggccaggcccac

SEQ ID NO: 3468745 - RNA, 15 nt, Pseudomonas aeruginosa PA01
gguugcccagcaggc

SEQ ID NO: 3468746 - RNA, 19 nt, Pseudomonas aeruginosa PA01
gguugcccagcaggcucau

SEQ ID NO: 3468747 - RNA, 16 nt, Pseudomonas aeruginosa PA01
gguugcccaggguggc

SEQ ID NO: 3468748 - RNA, 20 nt, Pseudomonas aeruginosa PA01
gguugcccucgcagccggcg

SEQ ID NO: 3468749 - RNA, 16 nt, Pseudomonas aeruginosa PA01
gguugccgaagcgcuc

SEQ ID NO: 3468750 - RNA, 14 nt, Pseudomonas aeruginosa PA01
gguugccgccgauc

SEQ ID NO: 3468751 - RNA, 21 nt, Pseudomonas aeruginosa PA01
gguugccgccgaucagcgcgc

SEQ ID NO: 3468752 - RNA, 13 nt, Pseudomonas aeruginosa PA01
gguugccgcgccg

SEQ ID NO: 3468753 - RNA, 13 nt, Pseudomonas aeruginosa PA01
gguugccgcugcg

SEQ ID NO: 3468754 - RNA, 15 nt, Pseudomonas aeruginosa PA01
gguugccgcuggccu

SEQ ID NO: 3468755 - RNA, 20 nt, Pseudomonas aeruginosa PA01
gguugccugcuguguccggc

SEQ ID NO: 3468756 - RNA, 13 nt, Pseudomonas aeruginosa PA01
gguugcgcaggau

SEQ ID NO: 3468757 - RNA, 20 nt, Pseudomonas aeruginosa PA01
gguugcgccauugccgccag

SEQ ID NO: 3468758 - RNA, 21 nt, Pseudomonas aeruginosa PA01
gguugcgccauugccgccagg

SEQ ID NO: 3468759 - RNA, 11 nt, Pseudomonas aeruginosa PA01
gguugcgccgc

SEQ ID NO: 3468760 - RNA, 13 nt, Pseudomonas aeruginosa PA01
gguugcgcggcag

SEQ ID NO: 3468761 - RNA, 13 nt, Pseudomonas aeruginosa PA01
gguugcgcuggcg

SEQ ID NO: 3468762 - RNA, 15 nt, Pseudomonas aeruginosa PA01
gguugcgcuggcgca

SEQ ID NO: 3468763 - RNA, 18 nt, Pseudomonas aeruginosa PA01
gguugcgcuggcgcagca

SEQ ID NO: 3468764 - RNA, 20 nt, Pseudomonas aeruginosa PA01
gguugcggccugaucaugua

SEQ ID NO: 3468765 - RNA, 17 nt, Pseudomonas aeruginosa PA01
guaccagcgcaccaggg

SEQ ID NO: 3468766 - RNA, 15 nt, Pseudomonas aeruginosa PA01
guaccaggccaccgg

SEQ ID NO: 3468767 - RNA, 22 nt, Pseudomonas aeruginosa PA01
guaccagggaagcgcgcgccag

SEQ ID NO: 3468768 - RNA, 23 nt, Pseudomonas aeruginosa PA01
guaccagggaagcgcgcgccagu

SEQ ID NO: 3468769 - RNA, 12 nt, Pseudomonas aeruginosa PA01
guaccaggggau

SEQ ID NO: 3468770 - RNA, 21 nt, Pseudomonas aeruginosa PA01
guaccaggguguugucgcggc

SEQ ID NO: 3468771 - RNA, 14 nt, Pseudomonas aeruginosa PA01
guaccagucgcccg

SEQ ID NO: 3468772 - RNA, 15 nt, Pseudomonas aeruginosa PA01
guaccagucgcccgc

SEQ ID NO: 3468773 - RNA, 20 nt, Pseudomonas aeruginosa PA01
guacccagcuugcuggcgua

SEQ ID NO: 3468774 - RNA, 15 nt, Pseudomonas aeruginosa PA01
guacccggcagggcc

SEQ ID NO: 3468775 - RNA, 20 nt, Pseudomonas aeruginosa PA01
guacccggcagggccagcgg

SEQ ID NO: 3468776 - RNA, 15 nt, Pseudomonas aeruginosa PA01
guacccggccgccuu

SEQ ID NO: 3468777 - RNA, 16 nt, Pseudomonas aeruginosa PA01
guacccguacgcugcc

SEQ ID NO: 3468778 - RNA, 18 nt, Pseudomonas aeruginosa PA01
guacccguacgcugccag

SEQ ID NO: 3468779 - RNA, 23 nt, Pseudomonas aeruginosa PA01
guacccguacgcugccagguugg

SEQ ID NO: 3468780 - RNA, 16 nt, Pseudomonas aeruginosa PA01
guaccgaaacagggcg

SEQ ID NO: 3468781 - RNA, 17 nt, Pseudomonas aeruginosa PA01
guaccgaaacagggcga

SEQ ID NO: 3468782 - RNA, 14 nt, Pseudomonas aeruginosa PA01
guaccgacggucgg

SEQ ID NO: 3468783 - RNA, 18 nt, Pseudomonas aeruginosa PA01
guaccgcugcggccggcg

SEQ ID NO: 3468784 - RNA, 15 nt, Pseudomonas aeruginosa PA01
guaccgcugcgugcc

SEQ ID NO: 3468785 - RNA, 20 nt, Pseudomonas aeruginosa PA01
guaccgcugcgugccagggc

SEQ ID NO: 3468786 - RNA, 14 nt, Pseudomonas aeruginosa PA01
guaccgcuggcgcu

SEQ ID NO: 3468787 - RNA, 15 nt, Pseudomonas aeruginosa PA01
guaccggcagcgccg

SEQ ID NO: 3468788 - RNA, 16 nt, Pseudomonas aeruginosa PA01
guaccggcagcgccga

SEQ ID NO: 3468789 - RNA, 13 nt, Pseudomonas aeruginosa PA01
guaccggccaggc

SEQ ID NO: 3468790 - RNA, 17 nt, Pseudomonas aeruginosa PA01
guaccggccaggcgguc

SEQ ID NO: 3468791 - RNA, 20 nt, Pseudomonas aeruginosa PA01
guaccggccaggcgguccag

SEQ ID NO: 3468792 - RNA, 21 nt, Pseudomonas aeruginosa PA01
guaccggccaggcgguccagc

SEQ ID NO: 3468793 - RNA, 18 nt, Pseudomonas aeruginosa PA01
guaccggcuacaggccgu

SEQ ID NO: 3468794 - RNA, 22 nt, Pseudomonas aeruginosa PA01
guaccguuugcucucaucccug

SEQ ID NO: 3468795 - RNA, 14 nt, Pseudomonas aeruginosa PA01
guaccucgaagccc

SEQ ID NO: 3468796 - RNA, 20 nt, Pseudomonas aeruginosa PA01
guaccucgaagcccagcgcc

SEQ ID NO: 3468797 - RNA, 21 nt, Pseudomonas aeruginosa PA01
guaccucgaagcccagcgccu

SEQ ID NO: 3468798 - RNA, 16 nt, Pseudomonas aeruginosa PA01
guaccucgccaggcug

SEQ ID NO: 3468799 - RNA, 16 nt, Pseudomonas aeruginosa PA01
guaccucgugggugcc

SEQ ID NO: 3468800 - RNA, 17 nt, Pseudomonas aeruginosa PA01
guaccucgugggugccg

SEQ ID NO: 3468801 - RNA, 12 nt, Pseudomonas aeruginosa PA01
guaccucuggcu

SEQ ID NO: 3468802 - RNA, 14 nt, Pseudomonas aeruginosa PA01
guaccucuggcuga

SEQ ID NO: 3468803 - RNA, 14 nt, Pseudomonas aeruginosa PA01
guaccugcaaggcg

SEQ ID NO: 3468804 - RNA, 15 nt, Pseudomonas aeruginosa PA01
guaccugcucacggc

SEQ ID NO: 3468805 - RNA, 23 nt, Pseudomonas aeruginosa PA01
guaccugcucgcgggucaccacc

SEQ ID NO: 3468806 - RNA, 21 nt, Pseudomonas aeruginosa PA01
guaccuggcgguacagccccc

SEQ ID NO: 3468807 - RNA, 19 nt, Pseudomonas aeruginosa PA01
guaccuggguugccgcgcc

SEQ ID NO: 3468808 - RNA, 21 nt, Pseudomonas aeruginosa PA01
guaccuggguugccgcgccga

SEQ ID NO: 3468809 - RNA, 23 nt, Pseudomonas aeruginosa PA01
guaccuuucuccccucaggcgcc

SEQ ID NO: 3468810 - RNA, 19 nt, Pseudomonas aeruginosa PA01
guacgaaaucuccuuggcc

SEQ ID NO: 3468811 - RNA, 23 nt, Pseudomonas aeruginosa PA01
guacgaaaucuccuuggccaugu

SEQ ID NO: 3468812 - RNA, 20 nt, Pseudomonas aeruginosa PA01
guacgacuucggcgacagcc

SEQ ID NO: 3468813 - RNA, 16 nt, Pseudomonas aeruginosa PA01
guacgaggggccgccg

SEQ ID NO: 3468814 - RNA, 20 nt, Pseudomonas aeruginosa PA01
guacgaggggccgccguaca

SEQ ID NO: 3468815 - RNA, 14 nt, Pseudomonas aeruginosa PA01
guacgcccgcagcc

SEQ ID NO: 3468816 - RNA, 16 nt, Pseudomonas aeruginosa PA01
guacgcccuccagcac

SEQ ID NO: 3468817 - RNA, 22 nt, Pseudomonas aeruginosa PA01
guacgcccuccagcacccaggu

SEQ ID NO: 3468818 - RNA, 21 nt, Pseudomonas aeruginosa PA01
guacgccgcgcugcgccaggc

SEQ ID NO: 3468819 - RNA, 20 nt, Pseudomonas aeruginosa PA01
guacgcguacgacuucggcg

SEQ ID NO: 3468820 - RNA, 20 nt, Pseudomonas aeruginosa PA01
guacgcucaccaccaccgcg

SEQ ID NO: 3468821 - RNA, 23 nt, Pseudomonas aeruginosa PA01
guacggaucgguccccuccaggu

SEQ ID NO: 3468822 - RNA, 13 nt, Pseudomonas aeruginosa PA01
guacggaugccgc

SEQ ID NO: 3468823 - RNA, 17 nt, Pseudomonas aeruginosa PA01
guacggcaccaccaccg

SEQ ID NO: 3468824 - RNA, 19 nt, Pseudomonas aeruginosa PA01
guacggccuucacgcagcu

SEQ ID NO: 3468825 - RNA, 12 nt, Pseudomonas aeruginosa PA01
guacggcgcggu

SEQ ID NO: 3468826 - RNA, 20 nt, Pseudomonas aeruginosa PA01
guacggucuugcgcuugccg

SEQ ID NO: 3468827 - RNA, 14 nt, Pseudomonas aeruginosa PA01
guacguagcgcggu

SEQ ID NO: 3468828 - RNA, 14 nt, Pseudomonas aeruginosa PA01
guacguaucccagc

SEQ ID NO: 3468829 - RNA, 23 nt, Pseudomonas aeruginosa PA01
guacguaucccagcgcgugcagg

SEQ ID NO: 3468830 - RNA, 14 nt, Pseudomonas aeruginosa PA01
guacguccagggca

SEQ ID NO: 3468831 - RNA, 15 nt, Pseudomonas aeruginosa PA01
guacguccagggcac

SEQ ID NO: 3468832 - RNA, 21 nt, Pseudomonas aeruginosa PA01
guacguggcgcuugagcagcc

SEQ ID NO: 3468833 - RNA, 16 nt, Pseudomonas aeruginosa PA01
guacucaggccgggcg

SEQ ID NO: 3468834 - RNA, 20 nt, Pseudomonas aeruginosa PA01
guacuccgagggccgcgccg

SEQ ID NO: 3468835 - RNA, 19 nt, Pseudomonas aeruginosa PA01
guacucgaucugucgcagc

SEQ ID NO: 3468836 - RNA, 14 nt, Pseudomonas aeruginosa PA01
guacucgccgggcg

SEQ ID NO: 3468837 - RNA, 16 nt, Pseudomonas aeruginosa PA01
guacucggcccgggcc

SEQ ID NO: 3468838 - RNA, 14 nt, Pseudomonas aeruginosa PA01
guacucggcggggc

SEQ ID NO: 3468839 - RNA, 16 nt, Pseudomonas aeruginosa PA01
guacucggcggggcgc

SEQ ID NO: 3468840 - RNA, 18 nt, Pseudomonas aeruginosa PA01
guacucggcggggcgcag

SEQ ID NO: 3468841 - RNA, 20 nt, Pseudomonas aeruginosa PA01
guacucggcuacgaaccgag

SEQ ID NO: 3468842 - RNA, 15 nt, Pseudomonas aeruginosa PA01
guacucguccuccca

SEQ ID NO: 3468843 - RNA, 16 nt, Pseudomonas aeruginosa PA01
guacucguccucccag

SEQ ID NO: 3468844 - RNA, 18 nt, Pseudomonas aeruginosa PA01
guacucguguuccggcag

SEQ ID NO: 3468845 - RNA, 22 nt, Pseudomonas aeruginosa PA01
guacucguguuccggcaggacc

SEQ ID NO: 3468846 - RNA, 14 nt, Pseudomonas aeruginosa PA01
guacugcgccaguu

SEQ ID NO: 3468847 - RNA, 20 nt, Pseudomonas aeruginosa PA01
guacuggcgccaggccgcgu

SEQ ID NO: 3468848 - RNA, 20 nt, Pseudomonas aeruginosa PA01
guacugggcgauguccugga

SEQ ID NO: 3468849 - RNA, 19 nt, Pseudomonas aeruginosa PA01
guacugggucuuguaguuc

SEQ ID NO: 3468850 - RNA, 24 nt, Pseudomonas aeruginosa PA01
guacugguccggguuggcgcaggc

SEQ ID NO: 3468851 - RNA, 19 nt, Pseudomonas aeruginosa PA01
guacuggucgcgcgcggcc

SEQ ID NO: 3468852 - RNA, 22 nt, Pseudomonas aeruginosa PA01
guacuggucgcgcgcggccagc

SEQ ID NO: 3468853 - RNA, 14 nt, Pseudomonas aeruginosa PA01
guacuucggcgcgg

SEQ ID NO: 3468854 - RNA, 15 nt, Pseudomonas aeruginosa PA01
guacuucggcgcggu

SEQ ID NO: 3468855 - RNA, 14 nt, Pseudomonas aeruginosa PA01
guacuugccagggc

SEQ ID NO: 3468856 - RNA, 19 nt, Pseudomonas aeruginosa PA01
guacuugccagggcaggga

SEQ ID NO: 3468857 - RNA, 23 nt, Pseudomonas aeruginosa PA01
guacuugccagggcagggagucc

SEQ ID NO: 3468858 - RNA, 22 nt, Pseudomonas aeruginosa PA01
guacuuggccacgccuucgggc

SEQ ID NO: 3468859 - RNA, 14 nt, Pseudomonas aeruginosa PA01
guagaacaccaccc

SEQ ID NO: 3468860 - RNA, 15 nt, Pseudomonas aeruginosa PA01
guagaacaggcugcc

SEQ ID NO: 3468861 - RNA, 19 nt, Pseudomonas aeruginosa PA01
guagaacaggcugccgcag

SEQ ID NO: 3468862 - RNA, 14 nt, Pseudomonas aeruginosa PA01
guagaacgccagga

SEQ ID NO: 3468863 - RNA, 14 nt, Pseudomonas aeruginosa PA01
guagaacggcggca

SEQ ID NO: 3468864 - RNA, 15 nt, Pseudomonas aeruginosa PA01
guagaagcgcgcggu

SEQ ID NO: 3468865 - RNA, 20 nt, Pseudomonas aeruginosa PA01
guagaaggugcccagcggcg

SEQ ID NO: 3468866 - RNA, 11 nt, Pseudomonas aeruginosa PA01
guagaccacca

SEQ ID NO: 3468867 - RNA, 20 nt, Pseudomonas aeruginosa PA01
guagcgcagguugcgcuggc

SEQ ID NO: 3468868 - RNA, 21 nt, Pseudomonas aeruginosa PA01
guagcgcagguugcgcuggcg

SEQ ID NO: 3468869 - RNA, 22 nt, Pseudomonas aeruginosa PA01
guagcgcagguugcgcuggcgc

SEQ ID NO: 3468870 - RNA, 19 nt, Pseudomonas aeruginosa PA01
guagcgcaguucgccgccg

SEQ ID NO: 3468871 - RNA, 23 nt, Pseudomonas aeruginosa PA01
guagcgcaguucgccgccgagcg

SEQ ID NO: 3468872 - RNA, 18 nt, Pseudomonas aeruginosa PA01
guagcgcaguugccagga

SEQ ID NO: 3468873 - RNA, 22 nt, Pseudomonas aeruginosa PA01
guagcgcaugccguuggccgag

SEQ ID NO: 3468874 - RNA, 13 nt, Pseudomonas aeruginosa PA01
guagcgccaggcc

SEQ ID NO: 3468875 - RNA, 20 nt, Pseudomonas aeruginosa PA01
guagcgccgcgggccagccg

SEQ ID NO: 3468876 - RNA, 14 nt, Pseudomonas aeruginosa PA01
guagcgcgccgagg

SEQ ID NO: 3468877 - RNA, 17 nt, Pseudomonas aeruginosa PA01
guagcgcgcggcgagcc

SEQ ID NO: 3468878 - RNA, 13 nt, Pseudomonas aeruginosa PA01
guagcgcggcagc

SEQ ID NO: 3468879 - RNA, 22 nt, Pseudomonas aeruginosa PA01
guagcgcuccucgcgcugcccg

SEQ ID NO: 3468880 - RNA, 21 nt, Pseudomonas aeruginosa PA01
guagcgcuccuucuccggggc

SEQ ID NO: 3468881 - RNA, 22 nt, Pseudomonas aeruginosa PA01
guagcgcuccuucuccggggcc

SEQ ID NO: 3468882 - RNA, 23 nt, Pseudomonas aeruginosa PA01
guagcgcucgauagcguccaggu

SEQ ID NO: 3468883 - RNA, 11 nt, Pseudomonas aeruginosa PA01
guagcgcucgc

SEQ ID NO: 3468884 - RNA, 21 nt, Pseudomonas aeruginosa PA01
guagcgcucgccuaccggcgc

SEQ ID NO: 3468885 - RNA, 23 nt, Pseudomonas aeruginosa PA01
guagcgcucgccuaccggcgccg

SEQ ID NO: 3468886 - RNA, 15 nt, Pseudomonas aeruginosa PA01
guagcgcugcgccag

SEQ ID NO: 3468887 - RNA, 17 nt, Pseudomonas aeruginosa PA01
guagcgcugcgccaggc

SEQ ID NO: 3468888 - RNA, 18 nt, Pseudomonas aeruginosa PA01
guagcgcugcgccaggcu

SEQ ID NO: 3468889 - RNA, 19 nt, Pseudomonas aeruginosa PA01
guagcgcugcgccaggcuu

SEQ ID NO: 3468890 - RNA, 18 nt, Pseudomonas aeruginosa PA01
guagcgcugcgcccgcuc

SEQ ID NO: 3468891 - RNA, 17 nt, Pseudomonas aeruginosa PA01
guagcgcuucaucaggc

SEQ ID NO: 3468892 - RNA, 16 nt, Pseudomonas aeruginosa PA01
guagcgcuucccgcgg

SEQ ID NO: 3468893 - RNA, 21 nt, Pseudomonas aeruginosa PA01
guagcgcuucccgcggcucca

SEQ ID NO: 3468894 - RNA, 21 nt, Pseudomonas aeruginosa PA01
guagcgcuucgcgcagcucgg

SEQ ID NO: 3468895 - RNA, 17 nt, Pseudomonas aeruginosa PA01
guagcggaagcacggcu

SEQ ID NO: 3468896 - RNA, 20 nt, Pseudomonas aeruginosa PA01
guagcggaaguucaccucgg

SEQ ID NO: 3468897 - RNA, 15 nt, Pseudomonas aeruginosa PA01
guagcggaucagccg

SEQ ID NO: 3468898 - RNA, 16 nt, Pseudomonas aeruginosa PA01
guagcggaucagccgg

SEQ ID NO: 3468899 - RNA, 13 nt, Pseudomonas aeruginosa PA01
guagcggaucagg

SEQ ID NO: 3468900 - RNA, 18 nt, Pseudomonas aeruginosa PA01
guagcggaucaggcccau

SEQ ID NO: 3468901 - RNA, 22 nt, Pseudomonas aeruginosa PA01
guagcggcaggguacgggucgg

SEQ ID NO: 3468902 - RNA, 23 nt, Pseudomonas aeruginosa PA01
guagcggccucguucggcgacca

SEQ ID NO: 3468903 - RNA, 14 nt, Pseudomonas aeruginosa PA01
guagcggcgaagcg

SEQ ID NO: 3468904 - RNA, 13 nt, Pseudomonas aeruginosa PA01
guagcggcugcgg

SEQ ID NO: 3468905 - RNA, 14 nt, Pseudomonas aeruginosa PA01
guagcgggccagca

SEQ ID NO: 3468906 - RNA, 16 nt, Pseudomonas aeruginosa PA01
guagcgggccagcagc

SEQ ID NO: 3468907 - RNA, 17 nt, Pseudomonas aeruginosa PA01
guagcgggccagcagcu

SEQ ID NO: 3468908 - RNA, 21 nt, Pseudomonas aeruginosa PA01
guagcggucggguucuugcug

SEQ ID NO: 3468909 - RNA, 19 nt, Pseudomonas aeruginosa PA01
guagcggucgugcagcagc

SEQ ID NO: 3468910 - RNA, 17 nt, Pseudomonas aeruginosa PA01
guagcguuaucgccggu

SEQ ID NO: 3468911 - RNA, 18 nt, Pseudomonas aeruginosa PA01
guagcguuaucgccgguc

SEQ ID NO: 3468912 - RNA, 16 nt, Pseudomonas aeruginosa PA01
guagcguugcgccaga

SEQ ID NO: 3468913 - RNA, 17 nt, Pseudomonas aeruginosa PA01
guagcguugcgccagac

SEQ ID NO: 3468914 - RNA, 15 nt, Pseudomonas aeruginosa PA01
guagcguugcgcgag

SEQ ID NO: 3468915 - RNA, 16 nt, Pseudomonas aeruginosa PA01
guagcguugcgcgagc

SEQ ID NO: 3468916 - RNA, 14 nt, Pseudomonas aeruginosa PA01
guagcucaucggcg

SEQ ID NO: 3468917 - RNA, 15 nt, Pseudomonas aeruginosa PA01
guagcucaucggcga

SEQ ID NO: 3468918 - RNA, 15 nt, Pseudomonas aeruginosa PA01
guagcuccaggccga

SEQ ID NO: 3468919 - RNA, 15 nt, Pseudomonas aeruginosa PA01
guagcucugcuggcu

SEQ ID NO: 3468920 - RNA, 16 nt, Pseudomonas aeruginosa PA01
guagcucugcuggcug

SEQ ID NO: 3468921 - RNA, 13 nt, Pseudomonas aeruginosa PA01
guagcugaccacg

SEQ ID NO: 3468922 - RNA, 17 nt, Pseudomonas aeruginosa PA01
guagcugagcaggccga

SEQ ID NO: 3468923 - RNA, 20 nt, Pseudomonas aeruginosa PA01
guagcugagcaggccgacgg

SEQ ID NO: 3468924 - RNA, 20 nt, Pseudomonas aeruginosa PA01
guagcugcagcgccccagca

SEQ ID NO: 3468925 - RNA, 15 nt, Pseudomonas aeruginosa PA01
guagcugccggcguc

SEQ ID NO: 3468926 - RNA, 15 nt, Pseudomonas aeruginosa PA01
guagcugcggccgag

SEQ ID NO: 3468927 - RNA, 16 nt, Pseudomonas aeruginosa PA01
guagcugcggccgagc

SEQ ID NO: 3468928 - RNA, 17 nt, Pseudomonas aeruginosa PA01
guagcugcuccagcccg

SEQ ID NO: 3468929 - RNA, 17 nt, Pseudomonas aeruginosa PA01
guagcuggaucugguug

SEQ ID NO: 3468930 - RNA, 19 nt, Pseudomonas aeruginosa PA01
guagcuggaucugguugaa

SEQ ID NO: 3468931 - RNA, 14 nt, Pseudomonas aeruginosa PA01
guagcuguucucuu

SEQ ID NO: 3468932 - RNA, 12 nt, Pseudomonas aeruginosa PA01
guaggacaggcc

SEQ ID NO: 3468933 - RNA, 14 nt, Pseudomonas aeruginosa PA01
guaggacaggccga

SEQ ID NO: 3468934 - RNA, 21 nt, Pseudomonas aeruginosa PA01
guaggacagggccaggccgag

SEQ ID NO: 3468935 - RNA, 20 nt, Pseudomonas aeruginosa PA01
guaggacagguucaggucga

SEQ ID NO: 3468936 - RNA, 23 nt, Pseudomonas aeruginosa PA01
guaggacagguucaggucgaugc

SEQ ID NO: 3468937 - RNA, 17 nt, Pseudomonas aeruginosa PA01
guaggagaugcagcguc

SEQ ID NO: 3468938 - RNA, 16 nt, Pseudomonas aeruginosa PA01
guaggagccggccagg

SEQ ID NO: 3468939 - RNA, 17 nt, Pseudomonas aeruginosa PA01
guaggagccggccaggc

SEQ ID NO: 3468940 - RNA, 20 nt, Pseudomonas aeruginosa PA01
guaggaggaaauacagcacc

SEQ ID NO: 3468941 - RNA, 23 nt, Pseudomonas aeruginosa PA01
guaggcacaggacccuuccagcg

SEQ ID NO: 3468942 - RNA, 15 nt, Pseudomonas aeruginosa PA01
guaggcaggcgcggc

SEQ ID NO: 3468943 - RNA, 16 nt, Pseudomonas aeruginosa PA01
guaggcauccacgccc

SEQ ID NO: 3468944 - RNA, 23 nt, Pseudomonas aeruginosa PA01
guaggcaucgaucuugcccaugu

SEQ ID NO: 3468945 - RNA, 22 nt, Pseudomonas aeruginosa PA01
guaggccaggcagaccagcgca

SEQ ID NO: 3468946 - RNA, 13 nt, Pseudomonas aeruginosa PA01
guaggccaugauc

SEQ ID NO: 3468947 - RNA, 14 nt, Pseudomonas aeruginosa PA01
guaggccaugauca

SEQ ID NO: 3468948 - RNA, 14 nt, Pseudomonas aeruginosa PA01
guaggccgagccca

SEQ ID NO: 3468949 - RNA, 14 nt, Pseudomonas aeruginosa PA01
guaggccgcuuccg

SEQ ID NO: 3468950 - RNA, 17 nt, Pseudomonas aeruginosa PA01
guaggccgucgcugccg

SEQ ID NO: 3468951 - RNA, 20 nt, Pseudomonas aeruginosa PA01
guaggccgucgcugccgagc

SEQ ID NO: 3468952 - RNA, 13 nt, Pseudomonas aeruginosa PA01
guaggccuggccg

SEQ ID NO: 3468953 - RNA, 16 nt, Pseudomonas aeruginosa PA01
guaggccuggccgccc

SEQ ID NO: 3468954 - RNA, 18 nt, Pseudomonas aeruginosa PA01
guaggccuggccgcccag

SEQ ID NO: 3468955 - RNA, 17 nt, Pseudomonas aeruginosa PA01
guaggcgaacacgucgg

SEQ ID NO: 3468956 - RNA, 19 nt, Pseudomonas aeruginosa PA01
guaggcgaacacgucggcg

SEQ ID NO: 3468957 - RNA, 14 nt, Pseudomonas aeruginosa PA01
guaggcgaagccca

SEQ ID NO: 3468958 - RNA, 16 nt, Pseudomonas aeruginosa PA01
guaggcgaaggcgaug

SEQ ID NO: 3468959 - RNA, 20 nt, Pseudomonas aeruginosa PA01
guaggcgacgaagcuggcga

SEQ ID NO: 3468960 - RNA, 13 nt, Pseudomonas aeruginosa PA01
guaggcgagcagc

SEQ ID NO: 3468961 - RNA, 19 nt, Pseudomonas aeruginosa PA01
guaggcgagcagcggcacg

SEQ ID NO: 3468962 - RNA, 22 nt, Pseudomonas aeruginosa PA01
guaggcgauggccuggucggcg

SEQ ID NO: 3468963 - RNA, 15 nt, Pseudomonas aeruginosa PA01
guaggcgcaccaggc

SEQ ID NO: 3468964 - RNA, 17 nt, Pseudomonas aeruginosa PA01
guaggcgcaccaggcca

SEQ ID NO: 3468965 - RNA, 13 nt, Pseudomonas aeruginosa PA01
guaggcgccgccg

SEQ ID NO: 3468966 - RNA, 14 nt, Pseudomonas aeruginosa PA01
guaggcgccgccgu

SEQ ID NO: 3468967 - RNA, 15 nt, Pseudomonas aeruginosa PA01
guaggcgcucuggaa

SEQ ID NO: 3468968 - RNA, 22 nt, Pseudomonas aeruginosa PA01
guaggcgcugcaaucgcugccg

SEQ ID NO: 3468969 - RNA, 23 nt, Pseudomonas aeruginosa PA01
guaggcgcugcaaucgcugccgg

SEQ ID NO: 3468970 - RNA, 20 nt, Pseudomonas aeruginosa PA01
guaugccggagugccgcgga

SEQ ID NO: 3468971 - RNA, 17 nt, Pseudomonas aeruginosa PA01
guaugcgcggucaccag

SEQ ID NO: 3468972 - RNA, 15 nt, Pseudomonas aeruginosa PA01
guauggcgggccuug

SEQ ID NO: 3468973 - RNA, 23 nt, Pseudomonas aeruginosa PA01
guauggcggucggccaggcggcc

SEQ ID NO: 3468974 - RNA, 22 nt, Pseudomonas aeruginosa PA01
guaugggugcccuugccgguca

SEQ ID NO: 3468975 - RNA, 15 nt, Pseudomonas aeruginosa PA01
guauguuucuggccg

SEQ ID NO: 3468976 - RNA, 17 nt, Pseudomonas aeruginosa PA01
guauuccacgucgccga

SEQ ID NO: 3468977 - RNA, 16 nt, Pseudomonas aeruginosa PA01
guauucgaacagcuug

SEQ ID NO: 3468978 - RNA, 20 nt, Pseudomonas aeruginosa PA01
guauucgccgaagauccgcu

SEQ ID NO: 3468979 - RNA, 17 nt, Pseudomonas aeruginosa PA01
guauucgccggccaggu

SEQ ID NO: 3468980 - RNA, 20 nt, Pseudomonas aeruginosa PA01
guauucgccggccagguagc

SEQ ID NO: 3468981 - RNA, 22 nt, Pseudomonas aeruginosa PA01
guauucggcgaccagcccgcgc

SEQ ID NO: 3468982 - RNA, 15 nt, Pseudomonas aeruginosa PA01
guauuguggccccag

SEQ ID NO: 3468983 - RNA, 16 nt, Pseudomonas aeruginosa PA01
gucaaaccauggcgua

SEQ ID NO: 3468984 - RNA, 20 nt, Pseudomonas aeruginosa PA01
gucaacaagaauaggaacag

SEQ ID NO: 3468985 - RNA, 15 nt, Pseudomonas aeruginosa PA01
gucaacaccagcgcc

SEQ ID NO: 3468986 - RNA, 22 nt, Pseudomonas aeruginosa PA01
gucaacaccagcgccgccaggc

SEQ ID NO: 3468987 - RNA, 23 nt, Pseudomonas aeruginosa PA01
gucaacaccagcgccgccaggca

SEQ ID NO: 3468988 - RNA, 18 nt, Pseudomonas aeruginosa PA01
gucaacccuugcucccgc

SEQ ID NO: 3468989 - RNA, 17 nt, Pseudomonas aeruginosa PA01
gucaaccgcgggcgagg

SEQ ID NO: 3468990 - RNA, 18 nt, Pseudomonas aeruginosa PA01
gucaacgaagucgcgagg

SEQ ID NO: 3468991 - RNA, 16 nt, Pseudomonas aeruginosa PA01
gucaacgccuggccac

SEQ ID NO: 3468992 - RNA, 21 nt, Pseudomonas aeruginosa PA01
gucaacgccuggccacgccau

SEQ ID NO: 3468993 - RNA, 20 nt, Pseudomonas aeruginosa PA01
gucaccacccagccgcggcc

SEQ ID NO: 3468994 - RNA, 22 nt, Pseudomonas aeruginosa PA01
gucaccacccagccgcggccgu

SEQ ID NO: 3468995 - RNA, 23 nt, Pseudomonas aeruginosa PA01
gucaccacccagccgcggccguu

SEQ ID NO: 3468996 - RNA, 18 nt, Pseudomonas aeruginosa PA01
gucaccacguugcgccgc

SEQ ID NO: 3468997 - RNA, 13 nt, Pseudomonas aeruginosa PA01
gucaccagcagcc

SEQ ID NO: 3468998 - RNA, 16 nt, Pseudomonas aeruginosa PA01
gucaccagcagccccg

SEQ ID NO: 3468999 - RNA, 13 nt, Pseudomonas aeruginosa PA01
gucaccaggucgc

SEQ ID NO: 3469000 - RNA, 22 nt, Pseudomonas aeruginosa PA01
gucaccaggucgcggaucaggc

SEQ ID NO: 3469001 - RNA, 22 nt, Pseudomonas aeruginosa PA01
gucaccaugaucaucggcuggc

SEQ ID NO: 3469002 - RNA, 20 nt, Pseudomonas aeruginosa PA01
gucacccauucgaugccgcg

SEQ ID NO: 3469003 - RNA, 23 nt, Pseudomonas aeruginosa PA01
gucacccauucgaugccgcgcgc

SEQ ID NO: 3469004 - RNA, 20 nt, Pseudomonas aeruginosa PA01
gucaccccgaccagcgcgcu

SEQ ID NO: 3469005 - RNA, 12 nt, Pseudomonas aeruginosa PA01
gucacccgcgcc

SEQ ID NO: 3469006 - RNA, 15 nt, Pseudomonas aeruginosa PA01
gucacccgcgccugc

SEQ ID NO: 3469007 - RNA, 17 nt, Pseudomonas aeruginosa PA01
gucacccgcgccugcag

SEQ ID NO: 3469008 - RNA, 19 nt, Pseudomonas aeruginosa PA01
gucacccgcgccugcaggu

SEQ ID NO: 3469009 - RNA, 12 nt, Pseudomonas aeruginosa PA01
gucaccgccagc

SEQ ID NO: 3469010 - RNA, 13 nt, Pseudomonas aeruginosa PA01
gucaccgccagcg

SEQ ID NO: 3469011 - RNA, 16 nt, Pseudomonas aeruginosa PA01
gucaccgccagcggga

SEQ ID NO: 3469012 - RNA, 13 nt, Pseudomonas aeruginosa PA01
gucaccgcgccga

SEQ ID NO: 3469013 - RNA, 17 nt, Pseudomonas aeruginosa PA01
gucaccggcagggcgau

SEQ ID NO: 3469014 - RNA, 20 nt, Pseudomonas aeruginosa PA01
gucaccggcagggcgauccg

SEQ ID NO: 3469015 - RNA, 12 nt, Pseudomonas aeruginosa PA01
gucaccggcgcc

SEQ ID NO: 3469016 - RNA, 13 nt, Pseudomonas aeruginosa PA01
gucaccggcgcca

SEQ ID NO: 3469017 - RNA, 22 nt, Pseudomonas aeruginosa PA01
gucaccggcgccacccucggcu

SEQ ID NO: 3469018 - RNA, 20 nt, Pseudomonas aeruginosa PA01
gucaccgucugcaccgcccu

SEQ ID NO: 3469019 - RNA, 18 nt, Pseudomonas aeruginosa PA01
gucaccguggagaggucg

SEQ ID NO: 3469020 - RNA, 21 nt, Pseudomonas aeruginosa PA01
gucaccguggagaggucgccg

SEQ ID NO: 3469021 - RNA, 22 nt, Pseudomonas aeruginosa PA01
gucaccguggagaggucgccga

SEQ ID NO: 3469022 - RNA, 16 nt, Pseudomonas aeruginosa PA01
gucaccguggucaugg

SEQ ID NO: 3469023 - RNA, 15 nt, Pseudomonas aeruginosa PA01
gucaccucggcgcca

SEQ ID NO: 3469024 - RNA, 18 nt, Pseudomonas aeruginosa PA01
gucaccuguucggcgcug

SEQ ID NO: 3469025 - RNA, 16 nt, Pseudomonas aeruginosa PA01
gucaccuugaccuugu

SEQ ID NO: 3469026 - RNA, 18 nt, Pseudomonas aeruginosa PA01
gucacgaaggcgaucacg

SEQ ID NO: 3469027 - RNA, 17 nt, Pseudomonas aeruginosa PA01
gucacgcaggcgcuggc

SEQ ID NO: 3469028 - RNA, 19 nt, Pseudomonas aeruginosa PA01
gucacgcaggcgcuggccg

SEQ ID NO: 3469029 - RNA, 23 nt, Pseudomonas aeruginosa PA01
gucacgccgaaguucuucagcag

SEQ ID NO: 3469030 - RNA, 18 nt, Pseudomonas aeruginosa PA01
gucacgccgaggcugcgg

SEQ ID NO: 3469031 - RNA, 18 nt, Pseudomonas aeruginosa PA01
gucacgccgagggcgcgg

SEQ ID NO: 3469032 - RNA, 22 nt, Pseudomonas aeruginosa PA01
gucacgccgagggcgcggcgcc

SEQ ID NO: 3469033 - RNA, 21 nt, Pseudomonas aeruginosa PA01
gucacgccgaucaccccgccc

SEQ ID NO: 3469034 - RNA, 22 nt, Pseudomonas aeruginosa PA01
gucacgccgaucccggcggcga

SEQ ID NO: 3469035 - RNA, 18 nt, Pseudomonas aeruginosa PA01
gucacgccgcggcugaug

SEQ ID NO: 3469036 - RNA, 20 nt, Pseudomonas aeruginosa PA01
gucacgccgcggcugaugcc

SEQ ID NO: 3469037 - RNA, 21 nt, Pseudomonas aeruginosa PA01
gucacgccgggaauccccagu

SEQ ID NO: 3469038 - RNA, 22 nt, Pseudomonas aeruginosa PA01
gucacgccguucagggucaggu

SEQ ID NO: 3469039 - RNA, 19 nt, Pseudomonas aeruginosa PA01
gucacgcguugcgagggcu

SEQ ID NO: 3469040 - RNA, 13 nt, Pseudomonas aeruginosa PA01
gucacgcugggca

SEQ ID NO: 3469041 - RNA, 19 nt, Pseudomonas aeruginosa PA01
gucacggacccgcucggcc

SEQ ID NO: 3469042 - RNA, 20 nt, Pseudomonas aeruginosa PA01
gucacggacccgcucggccu

SEQ ID NO: 3469043 - RNA, 17 nt, Pseudomonas aeruginosa PA01
gucacggauaggcggcg

SEQ ID NO: 3469044 - RNA, 18 nt, Pseudomonas aeruginosa PA01
gucacggccuccgguggc

SEQ ID NO: 3469045 - RNA, 19 nt, Pseudomonas aeruginosa PA01
gucacggccuccgguggcg

SEQ ID NO: 3469046 - RNA, 16 nt, Pseudomonas aeruginosa PA01
gucacggcgaagcggc

SEQ ID NO: 3469047 - RNA, 22 nt, Pseudomonas aeruginosa PA01
gucacggcgaagcggcccuugu

SEQ ID NO: 3469048 - RNA, 16 nt, Pseudomonas aeruginosa PA01
gucacggcgugccgca

SEQ ID NO: 3469049 - RNA, 17 nt, Pseudomonas aeruginosa PA01
gucacggcgugccgcag

SEQ ID NO: 3469050 - RNA, 20 nt, Pseudomonas aeruginosa PA01
gucacggcgugccgcaggcc

SEQ ID NO: 3469051 - RNA, 22 nt, Pseudomonas aeruginosa PA01
gucacggucuuggcggcgaucg

SEQ ID NO: 3469052 - RNA, 17 nt, Pseudomonas aeruginosa PA01
gucacggugacggugca

SEQ ID NO: 3469053 - RNA, 20 nt, Pseudomonas aeruginosa PA01
gucacggugacggugcagcc

SEQ ID NO: 3469054 - RNA, 22 nt, Pseudomonas aeruginosa PA01
gucacggugaggaccuggccgc

SEQ ID NO: 3469055 - RNA, 20 nt, Pseudomonas aeruginosa PA01
gucacucccaggcuggcggc

SEQ ID NO: 3469056 - RNA, 16 nt, Pseudomonas aeruginosa PA01
gucacucgacaggcca

SEQ ID NO: 3469057 - RNA, 21 nt, Pseudomonas aeruginosa PA01
gucacuggaacagcgcgucac

SEQ ID NO: 3469058 - RNA, 14 nt, Pseudomonas aeruginosa PA01
gucacuguuuucca

SEQ ID NO: 3469059 - RNA, 19 nt, Pseudomonas aeruginosa PA01
gucacuuccgucacgcccu

SEQ ID NO: 3469060 - RNA, 19 nt, Pseudomonas aeruginosa PA01
gucagaacacacgaauggc

SEQ ID NO: 3469061 - RNA, 14 nt, Pseudomonas aeruginosa PA01
gucagaaccaccgg

SEQ ID NO: 3469062 - RNA, 14 nt, Pseudomonas aeruginosa PA01
gucagaccagcccu

SEQ ID NO: 3469063 - RNA, 19 nt, Pseudomonas aeruginosa PA01
gucagaccagcccuggcgc

SEQ ID NO: 3469064 - RNA, 22 nt, Pseudomonas aeruginosa PA01
gucagaccagcccuggcgcggc

SEQ ID NO: 3469065 - RNA, 13 nt, Pseudomonas aeruginosa PA01
gucagaucagcgg

SEQ ID NO: 3469066 - RNA, 22 nt, Pseudomonas aeruginosa PA01
gucagcaacugccaaccgcgcu

SEQ ID NO: 3469067 - RNA, 14 nt, Pseudomonas aeruginosa PA01
gucagcaccagggc

SEQ ID NO: 3469068 - RNA, 18 nt, Pseudomonas aeruginosa PA01
gucagcagcaccgcgagc

SEQ ID NO: 3469069 - RNA, 19 nt, Pseudomonas aeruginosa PA01
gucagcaggcccgagccgg

SEQ ID NO: 3469070 - RNA, 15 nt, Pseudomonas aeruginosa PA01
gucagcaggcugccg

SEQ ID NO: 3469071 - RNA, 19 nt, Pseudomonas aeruginosa PA01
gucaugaccagagccgccg

SEQ ID NO: 3469072 - RNA, 18 nt, Pseudomonas aeruginosa PA01
gucaugagguucaggccg

SEQ ID NO: 3469073 - RNA, 17 nt, Pseudomonas aeruginosa PA01
gucaugcccaggccgaa

SEQ ID NO: 3469074 - RNA, 16 nt, Pseudomonas aeruginosa PA01
gucaugcccuggccga

SEQ ID NO: 3469075 - RNA, 19 nt, Pseudomonas aeruginosa PA01
gucaugcccuugucgcccu

SEQ ID NO: 3469076 - RNA, 14 nt, Pseudomonas aeruginosa PA01
gucaugccgccauc

SEQ ID NO: 3469077 - RNA, 13 nt, Pseudomonas aeruginosa PA01
gucaugccgccgu

SEQ ID NO: 3469078 - RNA, 15 nt, Pseudomonas aeruginosa PA01
gucaugccgccgucg

SEQ ID NO: 3469079 - RNA, 20 nt, Pseudomonas aeruginosa PA01
gucaugccgccgucgcggcc

SEQ ID NO: 3469080 - RNA, 12 nt, Pseudomonas aeruginosa PA01
gucaugccgucu

SEQ ID NO: 3469081 - RNA, 23 nt, Pseudomonas aeruginosa PA01
gucaugcgcccuacgccaccuga

SEQ ID NO: 3469082 - RNA, 12 nt, Pseudomonas aeruginosa PA01
gucauggccagc

SEQ ID NO: 3469083 - RNA, 15 nt, Pseudomonas aeruginosa PA01
gucauggccagcucg

SEQ ID NO: 3469084 - RNA, 19 nt, Pseudomonas aeruginosa PA01
gucauggccagcucgaccu

SEQ ID NO: 3469085 - RNA, 17 nt, Pseudomonas aeruginosa PA01
gucauggcgcacgccgc

SEQ ID NO: 3469086 - RNA, 19 nt, Pseudomonas aeruginosa PA01
gucauggcgcacgccgcgg

SEQ ID NO: 3469087 - RNA, 20 nt, Pseudomonas aeruginosa PA01
gucauggcgcacgccgcgga

SEQ ID NO: 3469088 - RNA, 14 nt, Pseudomonas aeruginosa PA01
gucauggcguccgg

SEQ ID NO: 3469089 - RNA, 13 nt, Pseudomonas aeruginosa PA01
gucauggugccga

SEQ ID NO: 3469090 - RNA, 15 nt, Pseudomonas aeruginosa PA01
gucauggugccgagc

SEQ ID NO: 3469091 - RNA, 19 nt, Pseudomonas aeruginosa PA01
gucauggugccgagcagga

SEQ ID NO: 3469092 - RNA, 14 nt, Pseudomonas aeruginosa PA01
gucauguccggggc

SEQ ID NO: 3469093 - RNA, 17 nt, Pseudomonas aeruginosa PA01
gucauguccggggcgau

SEQ ID NO: 3469094 - RNA, 21 nt, Pseudomonas aeruginosa PA01
gucauuggcgaaauugccucc

SEQ ID NO: 3469095 - RNA, 22 nt, Pseudomonas aeruginosa PA01
gucauuggcgaaauugccuccg

SEQ ID NO: 3469096 - RNA, 18 nt, Pseudomonas aeruginosa PA01
gucauugucguaaaggac

SEQ ID NO: 3469097 - RNA, 19 nt, Pseudomonas aeruginosa PA01
guccaaccgggcaucgccg

SEQ ID NO: 3469098 - RNA, 15 nt, Pseudomonas aeruginosa PA01
guccaccaccagcag

SEQ ID NO: 3469099 - RNA, 16 nt, Pseudomonas aeruginosa PA01
guccaccaccagcagg

SEQ ID NO: 3469100 - RNA, 20 nt, Pseudomonas aeruginosa PA01
guccaccaccagcaggccca

SEQ ID NO: 3469101 - RNA, 12 nt, Pseudomonas aeruginosa PA01
guccaccaccga

SEQ ID NO: 3469102 - RNA, 19 nt, Pseudomonas aeruginosa PA01
guccaccaccgacgggucg

SEQ ID NO: 3469103 - RNA, 21 nt, Pseudomonas aeruginosa PA01
guccaccaccgacgggucgcc

SEQ ID NO: 3469104 - RNA, 16 nt, Pseudomonas aeruginosa PA01
guccaccagccagcuc

SEQ ID NO: 3469105 - RNA, 18 nt, Pseudomonas aeruginosa PA01
guccaccagccagcucgg

SEQ ID NO: 3469106 - RNA, 13 nt, Pseudomonas aeruginosa PA01
guccaccagcccg

SEQ ID NO: 3469107 - RNA, 15 nt, Pseudomonas aeruginosa PA01
guccaccagcccgca

SEQ ID NO: 3469108 - RNA, 20 nt, Pseudomonas aeruginosa PA01
guccaccagcgcccguagca

SEQ ID NO: 3469109 - RNA, 19 nt, Pseudomonas aeruginosa PA01
guccaccgaguggcgcagc

SEQ ID NO: 3469110 - RNA, 16 nt, Pseudomonas aeruginosa PA01
guccaccgccgccagc

SEQ ID NO: 3469111 - RNA, 17 nt, Pseudomonas aeruginosa PA01
guccaccgccgccagca

SEQ ID NO: 3469112 - RNA, 15 nt, Pseudomonas aeruginosa PA01
guccaccgcggccuc

SEQ ID NO: 3469113 - RNA, 22 nt, Pseudomonas aeruginosa PA01
guccaccgcggccucgcuggcg

SEQ ID NO: 3469114 - RNA, 15 nt, Pseudomonas aeruginosa PA01
guccaccggcccgga

SEQ ID NO: 3469115 - RNA, 12 nt, Pseudomonas aeruginosa PA01
guccaccggcgc

SEQ ID NO: 3469116 - RNA, 19 nt, Pseudomonas aeruginosa PA01
guccaccgguggcgacgcg

SEQ ID NO: 3469117 - RNA, 20 nt, Pseudomonas aeruginosa PA01
guccaccgguggcgacgcgc

SEQ ID NO: 3469118 - RNA, 13 nt, Pseudomonas aeruginosa PA01
guccaccuggcgg

SEQ ID NO: 3469119 - RNA, 21 nt, Pseudomonas aeruginosa PA01
guccaccuggcggcugagcug

SEQ ID NO: 3469120 - RNA, 21 nt, Pseudomonas aeruginosa PA01
guccacgacgaacggcgcuuc

SEQ ID NO: 3469121 - RNA, 14 nt, Pseudomonas aeruginosa PA01
guccacggcgcguc

SEQ ID NO: 3469122 - RNA, 15 nt, Pseudomonas aeruginosa PA01
guccacggcgcgucg

SEQ ID NO: 3469123 - RNA, 18 nt, Pseudomonas aeruginosa PA01
guccacgucguaggccga

SEQ ID NO: 3469124 - RNA, 21 nt, Pseudomonas aeruginosa PA01
guccacgucguaggccgagcc

SEQ ID NO: 3469125 - RNA, 20 nt, Pseudomonas aeruginosa PA01
guccacguugcaguccaggc

SEQ ID NO: 3469126 - RNA, 23 nt, Pseudomonas aeruginosa PA01
guccacguugcaguccaggccgu

SEQ ID NO: 3469127 - RNA, 15 nt, Pseudomonas aeruginosa PA01
guccacuccggcagc

SEQ ID NO: 3469128 - RNA, 15 nt, Pseudomonas aeruginosa PA01
guccacuggcccacg

SEQ ID NO: 3469129 - RNA, 21 nt, Pseudomonas aeruginosa PA01
guccagaugaaacugcccggc

SEQ ID NO: 3469130 - RNA, 22 nt, Pseudomonas aeruginosa PA01
guccagaugaaacugcccggcu

SEQ ID NO: 3469131 - RNA, 22 nt, Pseudomonas aeruginosa PA01
guccagcaaggugcgggcgacg

SEQ ID NO: 3469132 - RNA, 12 nt, Pseudomonas aeruginosa PA01
guccagcacgcu

SEQ ID NO: 3469133 - RNA, 21 nt, Pseudomonas aeruginosa PA01
guccagcacggugaaccaggc

SEQ ID NO: 3469134 - RNA, 13 nt, Pseudomonas aeruginosa PA01
guccagcaggccc

SEQ ID NO: 3469135 - RNA, 12 nt, Pseudomonas aeruginosa PA01
guccagcaggcg

SEQ ID NO: 3469136 - RNA, 13 nt, Pseudomonas aeruginosa PA01
guccagcagguuc

SEQ ID NO: 3469137 - RNA, 21 nt, Pseudomonas aeruginosa PA01
guccagccagacguccggcag

SEQ ID NO: 3469138 - RNA, 14 nt, Pseudomonas aeruginosa PA01
guccagccagccgc

SEQ ID NO: 3469139 - RNA, 16 nt, Pseudomonas aeruginosa PA01
guccagccaguggcug

SEQ ID NO: 3469140 - RNA, 13 nt, Pseudomonas aeruginosa PA01
guccagccgccgc

SEQ ID NO: 3469141 - RNA, 15 nt, Pseudomonas aeruginosa PA01
guccagccgccgcug

SEQ ID NO: 3469142 - RNA, 16 nt, Pseudomonas aeruginosa PA01
guccagccgccgcugc

SEQ ID NO: 3469143 - RNA, 21 nt, Pseudomonas aeruginosa PA01
guccagccgguaggggccgac

SEQ ID NO: 3469144 - RNA, 23 nt, Pseudomonas aeruginosa PA01
guccagcgagaacuugccggcgc

SEQ ID NO: 3469145 - RNA, 17 nt, Pseudomonas aeruginosa PA01
guccagcgaggcgugga

SEQ ID NO: 3469146 - RNA, 22 nt, Pseudomonas aeruginosa PA01
guccagcgccgagacgaucagc

SEQ ID NO: 3469147 - RNA, 16 nt, Pseudomonas aeruginosa PA01
guccagcgccgcgcug

SEQ ID NO: 3469148 - RNA, 17 nt, Pseudomonas aeruginosa PA01
guccagcgccgcgcugc

SEQ ID NO: 3469149 - RNA, 15 nt, Pseudomonas aeruginosa PA01
guccagcgcgcccgg

SEQ ID NO: 3469150 - RNA, 18 nt, Pseudomonas aeruginosa PA01
guccagcgcgcccggcgc

SEQ ID NO: 3469151 - RNA, 20 nt, Pseudomonas aeruginosa PA01
guccagcgcgcccggcgcca

SEQ ID NO: 3469152 - RNA, 22 nt, Pseudomonas aeruginosa PA01
guccagcgcgcccggcgccacc

SEQ ID NO: 3469153 - RNA, 16 nt, Pseudomonas aeruginosa PA01
guccagcgcgccgcgc

SEQ ID NO: 3469154 - RNA, 20 nt, Pseudomonas aeruginosa PA01
guccagcgcuccuugcgcca

SEQ ID NO: 3469155 - RNA, 21 nt, Pseudomonas aeruginosa PA01
guccagcgcuugaacgcgcgc

SEQ ID NO: 3469156 - RNA, 16 nt, Pseudomonas aeruginosa PA01
guccagcggcaugccg

SEQ ID NO: 3469157 - RNA, 18 nt, Pseudomonas aeruginosa PA01
guccagcggccgcgccuu

SEQ ID NO: 3469158 - RNA, 14 nt, Pseudomonas aeruginosa PA01
guccagcggcucgc

SEQ ID NO: 3469159 - RNA, 19 nt, Pseudomonas aeruginosa PA01
guccagcggguagaugcca

SEQ ID NO: 3469160 - RNA, 21 nt, Pseudomonas aeruginosa PA01
guccagcgguaccagcagcgc

SEQ ID NO: 3469161 - RNA, 16 nt, Pseudomonas aeruginosa PA01
guccagcuccaccagg

SEQ ID NO: 3469162 - RNA, 18 nt, Pseudomonas aeruginosa PA01
guccagcuccaccaggcc

SEQ ID NO: 3469163 - RNA, 14 nt, Pseudomonas aeruginosa PA01
guccagcucggcca

SEQ ID NO: 3469164 - RNA, 15 nt, Pseudomonas aeruginosa PA01
guccagcucggccau

SEQ ID NO: 3469165 - RNA, 19 nt, Pseudomonas aeruginosa PA01
guccagcucggccaucagc

SEQ ID NO: 3469166 - RNA, 17 nt, Pseudomonas aeruginosa PA01
guccagcucggucagcg

SEQ ID NO: 3469167 - RNA, 18 nt, Pseudomonas aeruginosa PA01
guccagcucggucagcgg

SEQ ID NO: 3469168 - RNA, 16 nt, Pseudomonas aeruginosa PA01
guccagcuggcgcagc

SEQ ID NO: 3469169 - RNA, 17 nt, Pseudomonas aeruginosa PA01
guccaggccgcagguga

SEQ ID NO: 3469170 - RNA, 16 nt, Pseudomonas aeruginosa PA01
guccaggcgccagagc

SEQ ID NO: 3469171 - RNA, 17 nt, Pseudomonas aeruginosa PA01
guccaggcgccagagcg

SEQ ID NO: 3469172 - RNA, 21 nt, Pseudomonas aeruginosa PA01
guccaggcgcgaacgcuccca

SEQ ID NO: 3469173 - RNA, 12 nt, Pseudomonas aeruginosa PA01
guccaggcgcug

SEQ ID NO: 3469174 - RNA, 20 nt, Pseudomonas aeruginosa PA01
gucccuuguuuuccuggccc

SEQ ID NO: 3469175 - RNA, 22 nt, Pseudomonas aeruginosa PA01
gucccuuguuuuccuggcccug

SEQ ID NO: 3469176 - RNA, 23 nt, Pseudomonas aeruginosa PA01
gucccuuguuuuccuggcccugg

SEQ ID NO: 3469177 - RNA, 24 nt, Pseudomonas aeruginosa PA01
guccgaacagaggaaggcgccggc

SEQ ID NO: 3469178 - RNA, 14 nt, Pseudomonas aeruginosa PA01
guccgaacgcgcug

SEQ ID NO: 3469179 - RNA, 22 nt, Pseudomonas aeruginosa PA01
guccgacaaucagcggcgggcg

SEQ ID NO: 3469180 - RNA, 14 nt, Pseudomonas aeruginosa PA01
guccgacagcaggu

SEQ ID NO: 3469181 - RNA, 15 nt, Pseudomonas aeruginosa PA01
guccgacagcagguc

SEQ ID NO: 3469182 - RNA, 16 nt, Pseudomonas aeruginosa PA01
guccgacagcaggucg

SEQ ID NO: 3469183 - RNA, 17 nt, Pseudomonas aeruginosa PA01
guccgacccgcuccgga

SEQ ID NO: 3469184 - RNA, 13 nt, Pseudomonas aeruginosa PA01
guccgagagcagg

SEQ ID NO: 3469185 - RNA, 21 nt, Pseudomonas aeruginosa PA01
guccgagagcagggccuggcc

SEQ ID NO: 3469186 - RNA, 15 nt, Pseudomonas aeruginosa PA01
guccgagcaggucgc

SEQ ID NO: 3469187 - RNA, 19 nt, Pseudomonas aeruginosa PA01
guccgagcaggucgcggaa

SEQ ID NO: 3469188 - RNA, 22 nt, Pseudomonas aeruginosa PA01
guccgaggcggauuugccgccg

SEQ ID NO: 3469189 - RNA, 23 nt, Pseudomonas aeruginosa PA01
guccgaggcggauuugccgccga

SEQ ID NO: 3469190 - RNA, 21 nt, Pseudomonas aeruginosa PA01
guccgauucuuggcucggcag

SEQ ID NO: 3469191 - RNA, 22 nt, Pseudomonas aeruginosa PA01
guccgauucuuggcucggcagc

SEQ ID NO: 3469192 - RNA, 20 nt, Pseudomonas aeruginosa PA01
guccgcagcacagccccagc

SEQ ID NO: 3469193 - RNA, 22 nt, Pseudomonas aeruginosa PA01
guccgcagcgccacuuccagcu

SEQ ID NO: 3469194 - RNA, 17 nt, Pseudomonas aeruginosa PA01
guccgcaggcaggucgc

SEQ ID NO: 3469195 - RNA, 22 nt, Pseudomonas aeruginosa PA01
guccgcaguucgccccgccgcc

SEQ ID NO: 3469196 - RNA, 23 nt, Pseudomonas aeruginosa PA01
guccgcaguucgccccgccgcca

SEQ ID NO: 3469197 - RNA, 20 nt, Pseudomonas aeruginosa PA01
guccgccacuucaagcuggc

SEQ ID NO: 3469198 - RNA, 13 nt, Pseudomonas aeruginosa PA01
guccgccagcagg

SEQ ID NO: 3469199 - RNA, 14 nt, Pseudomonas aeruginosa PA01
guccgccagcaggc

SEQ ID NO: 3469200 - RNA, 17 nt, Pseudomonas aeruginosa PA01
guccgccaguuccggca

SEQ ID NO: 3469201 - RNA, 23 nt, Pseudomonas aeruginosa PA01
guccgcccuuuuucgucgccagc

SEQ ID NO: 3469202 - RNA, 17 nt, Pseudomonas aeruginosa PA01
guccgccgaggugcugc

SEQ ID NO: 3469203 - RNA, 15 nt, Pseudomonas aeruginosa PA01
guccgccgcccaguc

SEQ ID NO: 3469204 - RNA, 12 nt, Pseudomonas aeruginosa PA01
guccgccgccgc

SEQ ID NO: 3469205 - RNA, 14 nt, Pseudomonas aeruginosa PA01
guccgccgccgcgg

SEQ ID NO: 3469206 - RNA, 15 nt, Pseudomonas aeruginosa PA01
guccgccgccgcggc

SEQ ID NO: 3469207 - RNA, 12 nt, Pseudomonas aeruginosa PA01
guccgccgccgu

SEQ ID NO: 3469208 - RNA, 15 nt, Pseudomonas aeruginosa PA01
guccgccgcgggacg

SEQ ID NO: 3469209 - RNA, 12 nt, Pseudomonas aeruginosa PA01
guccgccggccu

SEQ ID NO: 3469210 - RNA, 13 nt, Pseudomonas aeruginosa PA01
guccgccggccuc

SEQ ID NO: 3469211 - RNA, 16 nt, Pseudomonas aeruginosa PA01
guccgccucgcugagc

SEQ ID NO: 3469212 - RNA, 20 nt, Pseudomonas aeruginosa PA01
guccgccugggacggaacgu

SEQ ID NO: 3469213 - RNA, 19 nt, Pseudomonas aeruginosa PA01
guccgccugguccagcagg

SEQ ID NO: 3469214 - RNA, 13 nt, Pseudomonas aeruginosa PA01
guccgcgaugcgu

SEQ ID NO: 3469215 - RNA, 15 nt, Pseudomonas aeruginosa PA01
guccgcgcaggcggu

SEQ ID NO: 3469216 - RNA, 20 nt, Pseudomonas aeruginosa PA01
guccgcgccacggaugcagu

SEQ ID NO: 3469217 - RNA, 19 nt, Pseudomonas aeruginosa PA01
guccgcgccaugccggcgc

SEQ ID NO: 3469218 - RNA, 15 nt, Pseudomonas aeruginosa PA01
guccgcgccgcgucg

SEQ ID NO: 3469219 - RNA, 19 nt, Pseudomonas aeruginosa PA01
guccgcgccgcgucgccgc

SEQ ID NO: 3469220 - RNA, 15 nt, Pseudomonas aeruginosa PA01
guccgcgccucgcgc

SEQ ID NO: 3469221 - RNA, 13 nt, Pseudomonas aeruginosa PA01
guccgcggccugc

SEQ ID NO: 3469222 - RNA, 17 nt, Pseudomonas aeruginosa PA01
guccgcggccugcucgg

SEQ ID NO: 3469223 - RNA, 15 nt, Pseudomonas aeruginosa PA01
guccgcggugccgcc

SEQ ID NO: 3469224 - RNA, 17 nt, Pseudomonas aeruginosa PA01
guccgcggugccgccau

SEQ ID NO: 3469225 - RNA, 15 nt, Pseudomonas aeruginosa PA01
guccgcucuggauca

SEQ ID NO: 3469226 - RNA, 18 nt, Pseudomonas aeruginosa PA01
guccgcugcgagcagguc

SEQ ID NO: 3469227 - RNA, 22 nt, Pseudomonas aeruginosa PA01
guccgcuggccugcagcagguc

SEQ ID NO: 3469228 - RNA, 21 nt, Pseudomonas aeruginosa PA01
guccgcuucagcgcgccgagc

SEQ ID NO: 3469229 - RNA, 22 nt, Pseudomonas aeruginosa PA01
guccgcuucagcgcgccgagcc

SEQ ID NO: 3469230 - RNA, 23 nt, Pseudomonas aeruginosa PA01
guccggaccgggcggcaggcgcc

SEQ ID NO: 3469231 - RNA, 14 nt, Pseudomonas aeruginosa PA01
guccggagccgggc

SEQ ID NO: 3469232 - RNA, 15 nt, Pseudomonas aeruginosa PA01
guccggagccgggca

SEQ ID NO: 3469233 - RNA, 17 nt, Pseudomonas aeruginosa PA01
guccggauugccgcggg

SEQ ID NO: 3469234 - RNA, 20 nt, Pseudomonas aeruginosa PA01
guccggauugccgcgggucu

SEQ ID NO: 3469235 - RNA, 16 nt, Pseudomonas aeruginosa PA01
guccggcaccaccagc

SEQ ID NO: 3469236 - RNA, 22 nt, Pseudomonas aeruginosa PA01
guccggcaccaccagcgcgcgc

SEQ ID NO: 3469237 - RNA, 20 nt, Pseudomonas aeruginosa PA01
guccggcaccgcucugcagu

SEQ ID NO: 3469238 - RNA, 16 nt, Pseudomonas aeruginosa PA01
guccggcagcacggcg

SEQ ID NO: 3469239 - RNA, 18 nt, Pseudomonas aeruginosa PA01
guccggcagcacggcgau

SEQ ID NO: 3469240 - RNA, 14 nt, Pseudomonas aeruginosa PA01
guccggcagcgccu

SEQ ID NO: 3469241 - RNA, 13 nt, Pseudomonas aeruginosa PA01
guccggcagggcc

SEQ ID NO: 3469242 - RNA, 14 nt, Pseudomonas aeruginosa PA01
guccggcagggccu

SEQ ID NO: 3469243 - RNA, 19 nt, Pseudomonas aeruginosa PA01
guccggcagggccucgggc

SEQ ID NO: 3469244 - RNA, 21 nt, Pseudomonas aeruginosa PA01
guccggcagggccucgggcgg

SEQ ID NO: 3469245 - RNA, 13 nt, Pseudomonas aeruginosa PA01
guccggcaggucu

SEQ ID NO: 3469246 - RNA, 14 nt, Pseudomonas aeruginosa PA01
guccggccagccug

SEQ ID NO: 3469247 - RNA, 16 nt, Pseudomonas aeruginosa PA01
guccggccagccuggc

SEQ ID NO: 3469248 - RNA, 23 nt, Pseudomonas aeruginosa PA01
guccggccagccuggccagcgcu

SEQ ID NO: 3469249 - RNA, 13 nt, Pseudomonas aeruginosa PA01
guccggccgcccg

SEQ ID NO: 3469250 - RNA, 22 nt, Pseudomonas aeruginosa PA01
guccggccgcccgagccgcugc

SEQ ID NO: 3469251 - RNA, 15 nt, Pseudomonas aeruginosa PA01
guccggcgaccacca

SEQ ID NO: 3469252 - RNA, 11 nt, Pseudomonas aeruginosa PA01
guccggcgaga

SEQ ID NO: 3469253 - RNA, 19 nt, Pseudomonas aeruginosa PA01
guccggcgagcacggcgaa

SEQ ID NO: 3469254 - RNA, 16 nt, Pseudomonas aeruginosa PA01
guccggcgccaacugc

SEQ ID NO: 3469255 - RNA, 21 nt, Pseudomonas aeruginosa PA01
guccggcggcgaugaagcuga

SEQ ID NO: 3469256 - RNA, 13 nt, Pseudomonas aeruginosa PA01
guccggcggcugc

SEQ ID NO: 3469257 - RNA, 15 nt, Pseudomonas aeruginosa PA01
guccggcgucccgca

SEQ ID NO: 3469258 - RNA, 18 nt, Pseudomonas aeruginosa PA01
guccggcgugguggcggg

SEQ ID NO: 3469259 - RNA, 15 nt, Pseudomonas aeruginosa PA01
guccggcuccggcug

SEQ ID NO: 3469260 - RNA, 16 nt, Pseudomonas aeruginosa PA01
guccggcugucgacgc

SEQ ID NO: 3469261 - RNA, 16 nt, Pseudomonas aeruginosa PA01
guccgggaaguccggg

SEQ ID NO: 3469262 - RNA, 18 nt, Pseudomonas aeruginosa PA01
guccgggaaguccgggcg

SEQ ID NO: 3469263 - RNA, 17 nt, Pseudomonas aeruginosa PA01
guccgggaaugcucagc

SEQ ID NO: 3469264 - RNA, 13 nt, Pseudomonas aeruginosa PA01
guccgggcgcggc

SEQ ID NO: 3469265 - RNA, 19 nt, Pseudomonas aeruginosa PA01
guccgggcgguacaggcgc

SEQ ID NO: 3469266 - RNA, 17 nt, Pseudomonas aeruginosa PA01
guccggguaguccagcg

SEQ ID NO: 3469267 - RNA, 17 nt, Pseudomonas aeruginosa PA01
guccgggucggucacga

SEQ ID NO: 3469268 - RNA, 13 nt, Pseudomonas aeruginosa PA01
guccgggugcccc

SEQ ID NO: 3469269 - RNA, 17 nt, Pseudomonas aeruginosa PA01
guccgggugccccaggc

SEQ ID NO: 3469270 - RNA, 17 nt, Pseudomonas aeruginosa PA01
guccgggugggucaugg

SEQ ID NO: 3469271 - RNA, 22 nt, Pseudomonas aeruginosa PA01
guccggguugacccagagccgc

SEQ ID NO: 3469272 - RNA, 19 nt, Pseudomonas aeruginosa PA01
guccggguugagcaccccg

SEQ ID NO: 3469273 - RNA, 18 nt, Pseudomonas aeruginosa PA01
guccggguuggcgcaggc

SEQ ID NO: 3469274 - RNA, 19 nt, Pseudomonas aeruginosa PA01
guccggguuggcgcaggcc

SEQ ID NO: 3469275 - RNA, 14 nt, Pseudomonas aeruginosa PA01
guccgguagcgcgc

SEQ ID NO: 3469276 - RNA, 21 nt, Pseudomonas aeruginosa PA01
guccgguaggagcgagagcgc

SEQ ID NO: 3469277 - RNA, 18 nt, Pseudomonas aeruginosa PA01
gucgaaagcuucgucgcg

SEQ ID NO: 3469278 - RNA, 22 nt, Pseudomonas aeruginosa PA01
gucgaaagcuucgucgcgcagg

SEQ ID NO: 3469279 - RNA, 16 nt, Pseudomonas aeruginosa PA01
gucgaaaugcucgugc

SEQ ID NO: 3469280 - RNA, 16 nt, Pseudomonas aeruginosa PA01
gucgaacaacccgcca

SEQ ID NO: 3469281 - RNA, 18 nt, Pseudomonas aeruginosa PA01
gucgaacaccggcgccgc

SEQ ID NO: 3469282 - RNA, 20 nt, Pseudomonas aeruginosa PA01
gucgaacaccggcgccgccu

SEQ ID NO: 3469283 - RNA, 14 nt, Pseudomonas aeruginosa PA01
gucgaacagcagcu

SEQ ID NO: 3469284 - RNA, 14 nt, Pseudomonas aeruginosa PA01
gucgaacagcggcu

SEQ ID NO: 3469285 - RNA, 16 nt, Pseudomonas aeruginosa PA01
gucgaaccagcucagc

SEQ ID NO: 3469286 - RNA, 17 nt, Pseudomonas aeruginosa PA01
gucgaaccagcucagcu

SEQ ID NO: 3469287 - RNA, 20 nt, Pseudomonas aeruginosa PA01
gucgaaccagcucagcucca

SEQ ID NO: 3469288 - RNA, 19 nt, Pseudomonas aeruginosa PA01
gucgaaccagggacgcccg

SEQ ID NO: 3469289 - RNA, 16 nt, Pseudomonas aeruginosa PA01
gucgaacugaccacca

SEQ ID NO: 3469290 - RNA, 14 nt, Pseudomonas aeruginosa PA01
gucgaagcagccca

SEQ ID NO: 3469291 - RNA, 16 nt, Pseudomonas aeruginosa PA01
gucgaagcagcccagc

SEQ ID NO: 3469292 - RNA, 16 nt, Pseudomonas aeruginosa PA01
gucgaagcgcagcagg

SEQ ID NO: 3469293 - RNA, 18 nt, Pseudomonas aeruginosa PA01
gucgaagcgcagcagguc

SEQ ID NO: 3469294 - RNA, 16 nt, Pseudomonas aeruginosa PA01
gucgaagcgcaggugc

SEQ ID NO: 3469295 - RNA, 19 nt, Pseudomonas aeruginosa PA01
gucgaagcugucggcccgc

SEQ ID NO: 3469296 - RNA, 21 nt, Pseudomonas aeruginosa PA01
gucgaagcugucggcccgcgc

SEQ ID NO: 3469297 - RNA, 20 nt, Pseudomonas aeruginosa PA01
gucgaaggccucgucgcccg

SEQ ID NO: 3469298 - RNA, 21 nt, Pseudomonas aeruginosa PA01
gucgaaggccucgucgcccgg

SEQ ID NO: 3469299 - RNA, 16 nt, Pseudomonas aeruginosa PA01
gucgaaggcgcggcgg

SEQ ID NO: 3469300 - RNA, 16 nt, Pseudomonas aeruginosa PA01
gucgaaggcggcgcgg

SEQ ID NO: 3469301 - RNA, 17 nt, Pseudomonas aeruginosa PA01
gucgaaggcggcgcggc

SEQ ID NO: 3469302 - RNA, 19 nt, Pseudomonas aeruginosa PA01
gucgaaggugaagcugccg

SEQ ID NO: 3469303 - RNA, 20 nt, Pseudomonas aeruginosa PA01
gucgaaggugaagcugccgu

SEQ ID NO: 3469304 - RNA, 21 nt, Pseudomonas aeruginosa PA01
gucgaaggugaagcugccguc

SEQ ID NO: 3469305 - RNA, 20 nt, Pseudomonas aeruginosa PA01
gucgaaguacaccuuggcgc

SEQ ID NO: 3469306 - RNA, 21 nt, Pseudomonas aeruginosa PA01
gucgaagucgaucaccgcauc

SEQ ID NO: 3469307 - RNA, 18 nt, Pseudomonas aeruginosa PA01
gucgacaccgaucaccug

SEQ ID NO: 3469308 - RNA, 22 nt, Pseudomonas aeruginosa PA01
gucgacaccgaucaccuggccg

SEQ ID NO: 3469309 - RNA, 21 nt, Pseudomonas aeruginosa PA01
gucgacacgagccgcugcggc

SEQ ID NO: 3469310 - RNA, 22 nt, Pseudomonas aeruginosa PA01
gucgacaugcaccaggccgcca

SEQ ID NO: 3469311 - RNA, 18 nt, Pseudomonas aeruginosa PA01
gucgacaugcaggccggc

SEQ ID NO: 3469312 - RNA, 19 nt, Pseudomonas aeruginosa PA01
gucgacaugcaggccggcc

SEQ ID NO: 3469313 - RNA, 21 nt, Pseudomonas aeruginosa PA01
gucgacaugcaggccggccuc

SEQ ID NO: 3469314 - RNA, 19 nt, Pseudomonas aeruginosa PA01
gucgaccaccgcguggugc

SEQ ID NO: 3469315 - RNA, 23 nt, Pseudomonas aeruginosa PA01
gucgaccacggccuucggcagga

SEQ ID NO: 3469316 - RNA, 13 nt, Pseudomonas aeruginosa PA01
gucgaccagccag

SEQ ID NO: 3469317 - RNA, 13 nt, Pseudomonas aeruginosa PA01
gucgaccagcggc

SEQ ID NO: 3469318 - RNA, 14 nt, Pseudomonas aeruginosa PA01
gucgaccagcggcg

SEQ ID NO: 3469319 - RNA, 16 nt, Pseudomonas aeruginosa PA01
gucgaccagcggcggu

SEQ ID NO: 3469320 - RNA, 15 nt, Pseudomonas aeruginosa PA01
gucgaccaucaccag

SEQ ID NO: 3469321 - RNA, 16 nt, Pseudomonas aeruginosa PA01
gucgaccaucaccagc

SEQ ID NO: 3469322 - RNA, 19 nt, Pseudomonas aeruginosa PA01
gucgaccaucaccagcgcc

SEQ ID NO: 3469323 - RNA, 21 nt, Pseudomonas aeruginosa PA01
gucgaccaucaccagcgccgu

SEQ ID NO: 3469324 - RNA, 21 nt, Pseudomonas aeruginosa PA01
gucgaccaugguguuggcggc

SEQ ID NO: 3469325 - RNA, 21 nt, Pseudomonas aeruginosa PA01
gucgaccauucccacgacccg

SEQ ID NO: 3469326 - RNA, 13 nt, Pseudomonas aeruginosa PA01
gucgacccaggcc

SEQ ID NO: 3469327 - RNA, 19 nt, Pseudomonas aeruginosa PA01
gucgacccaggcccagccg

SEQ ID NO: 3469328 - RNA, 14 nt, Pseudomonas aeruginosa PA01
gucgaccgccugcc

SEQ ID NO: 3469329 - RNA, 22 nt, Pseudomonas aeruginosa PA01
gucgaccgccugccagaccgug

SEQ ID NO: 3469330 - RNA, 14 nt, Pseudomonas aeruginosa PA01
gucgaccggaauca

SEQ ID NO: 3469331 - RNA, 18 nt, Pseudomonas aeruginosa PA01
gucgaccgucgccacgcu

SEQ ID NO: 3469332 - RNA, 23 nt, Pseudomonas aeruginosa PA01
gucgaccugcggguuggucggca

SEQ ID NO: 3469333 - RNA, 17 nt, Pseudomonas aeruginosa PA01
gucgaccuugccgacgc

SEQ ID NO: 3469334 - RNA, 19 nt, Pseudomonas aeruginosa PA01
gucgaccuugccgacgccg

SEQ ID NO: 3469335 - RNA, 13 nt, Pseudomonas aeruginosa PA01
gucgacgaacagg

SEQ ID NO: 3469336 - RNA, 19 nt, Pseudomonas aeruginosa PA01
gucgacgaacaggaagcgc

SEQ ID NO: 3469337 - RNA, 22 nt, Pseudomonas aeruginosa PA01
gucgacgaacaggaagcgcggg

SEQ ID NO: 3469338 - RNA, 17 nt, Pseudomonas aeruginosa PA01
gucgacgaccuugccca

SEQ ID NO: 3469339 - RNA, 18 nt, Pseudomonas aeruginosa PA01
gucgacgaccuugcccac

SEQ ID NO: 3469340 - RNA, 17 nt, Pseudomonas aeruginosa PA01
gucgacgaucuguucga

SEQ ID NO: 3469341 - RNA, 22 nt, Pseudomonas aeruginosa PA01
gucgacgcagccgggccgcagc

SEQ ID NO: 3469342 - RNA, 17 nt, Pseudomonas aeruginosa PA01
gucgacgcagcgcgcgu

SEQ ID NO: 3469343 - RNA, 14 nt, Pseudomonas aeruginosa PA01
gucgacgcagggcg

SEQ ID NO: 3469344 - RNA, 16 nt, Pseudomonas aeruginosa PA01
gucgacgcagggcggc

SEQ ID NO: 3469345 - RNA, 17 nt, Pseudomonas aeruginosa PA01
gucgacgcagggcggcg

SEQ ID NO: 3469346 - RNA, 21 nt, Pseudomonas aeruginosa PA01
gucgacgcagggcggcgccug

SEQ ID NO: 3469347 - RNA, 21 nt, Pseudomonas aeruginosa PA01
gucgacgcaucgacggggcgu

SEQ ID NO: 3469348 - RNA, 14 nt, Pseudomonas aeruginosa PA01
gucgacgcccuggg

SEQ ID NO: 3469349 - RNA, 21 nt, Pseudomonas aeruginosa PA01
gucgacgcccugggcgacgcg

SEQ ID NO: 3469350 - RNA, 17 nt, Pseudomonas aeruginosa PA01
gucgacgccgaagccgc

SEQ ID NO: 3469351 - RNA, 22 nt, Pseudomonas aeruginosa PA01
gucgacgccgaagccgcuggca

SEQ ID NO: 3469352 - RNA, 14 nt, Pseudomonas aeruginosa PA01
gucgacgccgagcu

SEQ ID NO: 3469353 - RNA, 13 nt, Pseudomonas aeruginosa PA01
gucgacgccgguc

SEQ ID NO: 3469354 - RNA, 20 nt, Pseudomonas aeruginosa PA01
gucgacgccggucucggcga

SEQ ID NO: 3469355 - RNA, 18 nt, Pseudomonas aeruginosa PA01
gucgacggaacaggagcc

SEQ ID NO: 3469356 - RNA, 15 nt, Pseudomonas aeruginosa PA01
gucgacggccuuggu

SEQ ID NO: 3469357 - RNA, 13 nt, Pseudomonas aeruginosa PA01
gucgacggcggcc

SEQ ID NO: 3469358 - RNA, 15 nt, Pseudomonas aeruginosa PA01
gucgacggcggccgc

SEQ ID NO: 3469359 - RNA, 16 nt, Pseudomonas aeruginosa PA01
gucgacggcggccgcc

SEQ ID NO: 3469360 - RNA, 23 nt, Pseudomonas aeruginosa PA01
gucgacggcuuccagggucgagg

SEQ ID NO: 3469361 - RNA, 15 nt, Pseudomonas aeruginosa PA01
gucgacguugucgca

SEQ ID NO: 3469362 - RNA, 14 nt, Pseudomonas aeruginosa PA01
gucgacucagcggg

SEQ ID NO: 3469363 - RNA, 15 nt, Pseudomonas aeruginosa PA01
gucgacuucgcacca

SEQ ID NO: 3469364 - RNA, 18 nt, Pseudomonas aeruginosa PA01
gucgacuucgcaccagcc

SEQ ID NO: 3469365 - RNA, 23 nt, Pseudomonas aeruginosa PA01
gucgacuucgcaccagccggccg

SEQ ID NO: 3469366 - RNA, 24 nt, Pseudomonas aeruginosa PA01
gucgacuucgcaccagccggccgc

SEQ ID NO: 3469367 - RNA, 23 nt, Pseudomonas aeruginosa PA01
gucgacuucgucgaagaccaggg

SEQ ID NO: 3469368 - RNA, 14 nt, Pseudomonas aeruginosa PA01
gucgagaaggcugc

SEQ ID NO: 3469369 - RNA, 16 nt, Pseudomonas aeruginosa PA01
gucgagaccgaccgac

SEQ ID NO: 3469370 - RNA, 14 nt, Pseudomonas aeruginosa PA01
gucgagacgccagc

SEQ ID NO: 3469371 - RNA, 20 nt, Pseudomonas aeruginosa PA01
gucgagacgccagccgcccu

SEQ ID NO: 3469372 - RNA, 18 nt, Pseudomonas aeruginosa PA01
gucgagagaauccgccgu

SEQ ID NO: 3469373 - RNA, 14 nt, Pseudomonas aeruginosa PA01
gucgagaugcugcg

SEQ ID NO: 3469374 - RNA, 19 nt, Pseudomonas aeruginosa PA01
gucgagaugcugcgggcgc

SEQ ID NO: 3469375 - RNA, 15 nt, Pseudomonas aeruginosa PA01
gucgagcaccagcag

SEQ ID NO: 3469376 - RNA, 17 nt, Pseudomonas aeruginosa PA01
gucgagcaccagcaggu

SEQ ID NO: 3469377 - RNA, 20 nt, Pseudomonas aeruginosa PA01
gucgagcaccagcaggucgg

SEQ ID NO: 3469378 - RNA, 23 nt, Pseudomonas aeruginosa PA01
gucgagcaccagcaggucggcgc

SEQ ID NO: 3469379 - RNA, 23 nt, Pseudomonas aeruginosa PA01
gucgaucugcucguccaggccgc

SEQ ID NO: 3469380 - RNA, 17 nt, Pseudomonas aeruginosa PA01
gucgaugaacagcgacu

SEQ ID NO: 3469381 - RNA, 14 nt, Pseudomonas aeruginosa PA01
gucgaugaacgcgc

SEQ ID NO: 3469382 - RNA, 16 nt, Pseudomonas aeruginosa PA01
gucgaugaacgcgcgg

SEQ ID NO: 3469383 - RNA, 20 nt, Pseudomonas aeruginosa PA01
gucgaugacgaggcccgccc

SEQ ID NO: 3469384 - RNA, 21 nt, Pseudomonas aeruginosa PA01
gucgaugaucuugucgugccg

SEQ ID NO: 3469385 - RNA, 22 nt, Pseudomonas aeruginosa PA01
gucgaugcccagccagggccgc

SEQ ID NO: 3469386 - RNA, 17 nt, Pseudomonas aeruginosa PA01
gucgaugccgcccgguu

SEQ ID NO: 3469387 - RNA, 16 nt, Pseudomonas aeruginosa PA01
gucgaugccuucggcg

SEQ ID NO: 3469388 - RNA, 19 nt, Pseudomonas aeruginosa PA01
gucgaugccuucggcggcc

SEQ ID NO: 3469389 - RNA, 17 nt, Pseudomonas aeruginosa PA01
gucgaugcgcccgccgc

SEQ ID NO: 3469390 - RNA, 19 nt, Pseudomonas aeruginosa PA01
gucgaugcguccgcgcagg

SEQ ID NO: 3469391 - RNA, 21 nt, Pseudomonas aeruginosa PA01
gucgaugcguccgcgcaggcg

SEQ ID NO: 3469392 - RNA, 12 nt, Pseudomonas aeruginosa PA01
gucgaugcugcc

SEQ ID NO: 3469393 - RNA, 13 nt, Pseudomonas aeruginosa PA01
gucgaugcugccg

SEQ ID NO: 3469394 - RNA, 14 nt, Pseudomonas aeruginosa PA01
gucgaugcuuucga

SEQ ID NO: 3469395 - RNA, 14 nt, Pseudomonas aeruginosa PA01
gucgaugggcagga

SEQ ID NO: 3469396 - RNA, 21 nt, Pseudomonas aeruginosa PA01
gucgaugggcgacagcuucca

SEQ ID NO: 3469397 - RNA, 14 nt, Pseudomonas aeruginosa PA01
gucgauguccuggg

SEQ ID NO: 3469398 - RNA, 21 nt, Pseudomonas aeruginosa PA01
gucgauguccugggccaccug

SEQ ID NO: 3469399 - RNA, 18 nt, Pseudomonas aeruginosa PA01
gucgaugucgaacaaccc

SEQ ID NO: 3469400 - RNA, 14 nt, Pseudomonas aeruginosa PA01
gucgaugucgcggc

SEQ ID NO: 3469401 - RNA, 16 nt, Pseudomonas aeruginosa PA01
gucgaugucgcggccc

SEQ ID NO: 3469402 - RNA, 16 nt, Pseudomonas aeruginosa PA01
gucgaugucgcggcug

SEQ ID NO: 3469403 - RNA, 23 nt, Pseudomonas aeruginosa PA01
gucgaugucgcggcugaaggccg

SEQ ID NO: 3469404 - RNA, 22 nt, Pseudomonas aeruginosa PA01
gucgcaagccauuccaacuggc

SEQ ID NO: 3469405 - RNA, 16 nt, Pseudomonas aeruginosa PA01
gucgcacagccagggg

SEQ ID NO: 3469406 - RNA, 14 nt, Pseudomonas aeruginosa PA01
gucgcacccggccc

SEQ ID NO: 3469407 - RNA, 18 nt, Pseudomonas aeruginosa PA01
gucgcacccggcccaugg

SEQ ID NO: 3469408 - RNA, 14 nt, Pseudomonas aeruginosa PA01
gucgcaccgccagc

SEQ ID NO: 3469409 - RNA, 16 nt, Pseudomonas aeruginosa PA01
gucgcaccgccagcag

SEQ ID NO: 3469410 - RNA, 21 nt, Pseudomonas aeruginosa PA01
gucgcaccgggaggcgccgcg

SEQ ID NO: 3469411 - RNA, 23 nt, Pseudomonas aeruginosa PA01
gucgcaccgggaggcgccgcgcc

SEQ ID NO: 3469412 - RNA, 24 nt, Pseudomonas aeruginosa PA01
gucgcaccgggaggcgccgcgcca

SEQ ID NO: 3469413 - RNA, 13 nt, Pseudomonas aeruginosa PA01
gucgcaccuguuc

SEQ ID NO: 3469414 - RNA, 15 nt, Pseudomonas aeruginosa PA01
gucgcacgcagcgcc

SEQ ID NO: 3469415 - RNA, 19 nt, Pseudomonas aeruginosa PA01
gucgcacgcagcgccgcgu

SEQ ID NO: 3469416 - RNA, 14 nt, Pseudomonas aeruginosa PA01
gucgcacucuuccu

SEQ ID NO: 3469417 - RNA, 12 nt, Pseudomonas aeruginosa PA01
gucgcacugguc

SEQ ID NO: 3469418 - RNA, 16 nt, Pseudomonas aeruginosa PA01
gucgcacuggucggcc

SEQ ID NO: 3469419 - RNA, 19 nt, Pseudomonas aeruginosa PA01
gucgcacuggucggccagu

SEQ ID NO: 3469420 - RNA, 17 nt, Pseudomonas aeruginosa PA01
gucgcagagacgcagcg

SEQ ID NO: 3469421 - RNA, 23 nt, Pseudomonas aeruginosa PA01
gucgcagagacgcagcgcuagcg

SEQ ID NO: 3469422 - RNA, 17 nt, Pseudomonas aeruginosa PA01
gucgcagcaggccgcug

SEQ ID NO: 3469423 - RNA, 18 nt, Pseudomonas aeruginosa PA01
gucgcagcaggccgcugg

SEQ ID NO: 3469424 - RNA, 21 nt, Pseudomonas aeruginosa PA01
gucgcagcaggccgcuggcga

SEQ ID NO: 3469425 - RNA, 14 nt, Pseudomonas aeruginosa PA01
gucgcagccgagcc

SEQ ID NO: 3469426 - RNA, 14 nt, Pseudomonas aeruginosa PA01
gucgcagccgcgca

SEQ ID NO: 3469427 - RNA, 13 nt, Pseudomonas aeruginosa PA01
gucgcagccgggg

SEQ ID NO: 3469428 - RNA, 15 nt, Pseudomonas aeruginosa PA01
gucgcagcggccgua

SEQ ID NO: 3469429 - RNA, 14 nt, Pseudomonas aeruginosa PA01
gucgcagcgggcau

SEQ ID NO: 3469430 - RNA, 19 nt, Pseudomonas aeruginosa PA01
gucgcagcguuccagcgcu

SEQ ID NO: 3469431 - RNA, 21 nt, Pseudomonas aeruginosa PA01
gucgcagcguuccagcgcugg

SEQ ID NO: 3469432 - RNA, 14 nt, Pseudomonas aeruginosa PA01
gucgcagcuccagc

SEQ ID NO: 3469433 - RNA, 17 nt, Pseudomonas aeruginosa PA01
gucgcagcuccagcgga

SEQ ID NO: 3469434 - RNA, 15 nt, Pseudomonas aeruginosa PA01
gucgcaggccuggua

SEQ ID NO: 3469435 - RNA, 16 nt, Pseudomonas aeruginosa PA01
gucgcaggccugguag

SEQ ID NO: 3469436 - RNA, 15 nt, Pseudomonas aeruginosa PA01
gucgcaggcgaugcc

SEQ ID NO: 3469437 - RNA, 17 nt, Pseudomonas aeruginosa PA01
gucgcaggcgaugccga

SEQ ID NO: 3469438 - RNA, 21 nt, Pseudomonas aeruginosa PA01
gucgcaggcucaguucggcca

SEQ ID NO: 3469439 - RNA, 23 nt, Pseudomonas aeruginosa PA01
gucgcaggcucaguucggccagc

SEQ ID NO: 3469440 - RNA, 21 nt, Pseudomonas aeruginosa PA01
gucgcagguaacccgcggcga

SEQ ID NO: 3469441 - RNA, 16 nt, Pseudomonas aeruginosa PA01
gucgcagucguagcgc

SEQ ID NO: 3469442 - RNA, 19 nt, Pseudomonas aeruginosa PA01
gucgcagucguagcgcagu

SEQ ID NO: 3469443 - RNA, 19 nt, Pseudomonas aeruginosa PA01
gucgcauaaaaaagccccg

SEQ ID NO: 3469444 - RNA, 15 nt, Pseudomonas aeruginosa PA01
gucgcauccaccagc

SEQ ID NO: 3469445 - RNA, 16 nt, Pseudomonas aeruginosa PA01
gucgccaacgcgccgu

SEQ ID NO: 3469446 - RNA, 16 nt, Pseudomonas aeruginosa PA01
gucgccaagcccggcg

SEQ ID NO: 3469447 - RNA, 21 nt, Pseudomonas aeruginosa PA01
gucgccaagcccggcgagagc

SEQ ID NO: 3469448 - RNA, 22 nt, Pseudomonas aeruginosa PA01
gucgccacgcaguucgcgggcc

SEQ ID NO: 3469449 - RNA, 16 nt, Pseudomonas aeruginosa PA01
gucgccacgcccgccg

SEQ ID NO: 3469450 - RNA, 18 nt, Pseudomonas aeruginosa PA01
gucgccacgcccgccgug

SEQ ID NO: 3469451 - RNA, 21 nt, Pseudomonas aeruginosa PA01
gucgccacgcccgccguggcg

SEQ ID NO: 3469452 - RNA, 22 nt, Pseudomonas aeruginosa PA01
gucgccacgcccgccguggcgg

SEQ ID NO: 3469453 - RNA, 13 nt, Pseudomonas aeruginosa PA01
gucgccacgcucu

SEQ ID NO: 3469454 - RNA, 12 nt, Pseudomonas aeruginosa PA01
gucgccagcagg

SEQ ID NO: 3469455 - RNA, 10 nt, Pseudomonas aeruginosa PA01
gucgccagcc

SEQ ID NO: 3469456 - RNA, 12 nt, Pseudomonas aeruginosa PA01
gucgccagcgcc

SEQ ID NO: 3469457 - RNA, 12 nt, Pseudomonas aeruginosa PA01
gucgccaggccg

SEQ ID NO: 3469458 - RNA, 13 nt, Pseudomonas aeruginosa PA01
gucgccaggccgu

SEQ ID NO: 3469459 - RNA, 21 nt, Pseudomonas aeruginosa PA01
gucgccaggccguagaccacc

SEQ ID NO: 3469460 - RNA, 23 nt, Pseudomonas aeruginosa PA01
gucgccaggccguagaccaccag

SEQ ID NO: 3469461 - RNA, 17 nt, Pseudomonas aeruginosa PA01
gucgccauccuggucgc

SEQ ID NO: 3469462 - RNA, 22 nt, Pseudomonas aeruginosa PA01
gucgccauccuggucgcguucc

SEQ ID NO: 3469463 - RNA, 20 nt, Pseudomonas aeruginosa PA01
gucgccaugcccgucgacca

SEQ ID NO: 3469464 - RNA, 21 nt, Pseudomonas aeruginosa PA01
gucgccaugcccgucgaccau

SEQ ID NO: 3469465 - RNA, 13 nt, Pseudomonas aeruginosa PA01
gucgccaugcggc

SEQ ID NO: 3469466 - RNA, 19 nt, Pseudomonas aeruginosa PA01
gucgccaugcggcaggccu

SEQ ID NO: 3469467 - RNA, 22 nt, Pseudomonas aeruginosa PA01
gucgccauggucguucagcggc

SEQ ID NO: 3469468 - RNA, 17 nt, Pseudomonas aeruginosa PA01
gucgccauucggcgacg

SEQ ID NO: 3469469 - RNA, 16 nt, Pseudomonas aeruginosa PA01
gucgcccaccuugcgg

SEQ ID NO: 3469470 - RNA, 14 nt, Pseudomonas aeruginosa PA01
gucgcccaggccgc

SEQ ID NO: 3469471 - RNA, 16 nt, Pseudomonas aeruginosa PA01
gucgcccaggccgcug

SEQ ID NO: 3469472 - RNA, 17 nt, Pseudomonas aeruginosa PA01
gucgcccaggccgcugg

SEQ ID NO: 3469473 - RNA, 20 nt, Pseudomonas aeruginosa PA01
gucgcccaggccgcuggcgg

SEQ ID NO: 3469474 - RNA, 15 nt, Pseudomonas aeruginosa PA01
gucgccccagggaau

SEQ ID NO: 3469475 - RNA, 20 nt, Pseudomonas aeruginosa PA01
gucgccccgguuggcgcccc

SEQ ID NO: 3469476 - RNA, 21 nt, Pseudomonas aeruginosa PA01
gucgccccgguuggcgcccca

SEQ ID NO: 3469477 - RNA, 13 nt, Pseudomonas aeruginosa PA01
gucgcccgccggc

SEQ ID NO: 3469478 - RNA, 14 nt, Pseudomonas aeruginosa PA01
gucgcccgccggcg

SEQ ID NO: 3469479 - RNA, 18 nt, Pseudomonas aeruginosa PA01
gucgcccgccggcgugcc

SEQ ID NO: 3469480 - RNA, 16 nt, Pseudomonas aeruginosa PA01
gucgcccgcuucgcca

SEQ ID NO: 3469481 - RNA, 23 nt, Pseudomonas aeruginosa PA01
gucgcccgcuucgccaucgaugg

SEQ ID NO: 3469482 - RNA, 20 nt, Pseudomonas aeruginosa PA01
gucgcgcaccacccaucugc

SEQ ID NO: 3469483 - RNA, 16 nt, Pseudomonas aeruginosa PA01
gucgcgcaccuggcgg

SEQ ID NO: 3469484 - RNA, 17 nt, Pseudomonas aeruginosa PA01
gucgcgcaccuggcggu

SEQ ID NO: 3469485 - RNA, 20 nt, Pseudomonas aeruginosa PA01
gucgcgcagcuccucggcgu

SEQ ID NO: 3469486 - RNA, 18 nt, Pseudomonas aeruginosa PA01
gucgcgcagggcagcgcg

SEQ ID NO: 3469487 - RNA, 14 nt, Pseudomonas aeruginosa PA01
gucgcgccagcacc

SEQ ID NO: 3469488 - RNA, 12 nt, Pseudomonas aeruginosa PA01
gucgcgccaggc

SEQ ID NO: 3469489 - RNA, 17 nt, Pseudomonas aeruginosa PA01
gucgcgccccgccagga

SEQ ID NO: 3469490 - RNA, 14 nt, Pseudomonas aeruginosa PA01
gucgcgcccgcugu

SEQ ID NO: 3469491 - RNA, 19 nt, Pseudomonas aeruginosa PA01
gucgcgcccgcugugcggg

SEQ ID NO: 3469492 - RNA, 13 nt, Pseudomonas aeruginosa PA01
gucgcgccgacga

SEQ ID NO: 3469493 - RNA, 21 nt, Pseudomonas aeruginosa PA01
gucgcgccgcggaaucgcgua

SEQ ID NO: 3469494 - RNA, 17 nt, Pseudomonas aeruginosa PA01
gucgcgccguccaucag

SEQ ID NO: 3469495 - RNA, 12 nt, Pseudomonas aeruginosa PA01
gucgcgcgccgg

SEQ ID NO: 3469496 - RNA, 20 nt, Pseudomonas aeruginosa PA01
gucgcgcgccggagccaccg

SEQ ID NO: 3469497 - RNA, 14 nt, Pseudomonas aeruginosa PA01
gucgcgcgcggcau

SEQ ID NO: 3469498 - RNA, 14 nt, Pseudomonas aeruginosa PA01
gucgcgcgcggcca

SEQ ID NO: 3469499 - RNA, 16 nt, Pseudomonas aeruginosa PA01
gucgcgcgcggccagc

SEQ ID NO: 3469500 - RNA, 19 nt, Pseudomonas aeruginosa PA01
gucgcgcgcggccagcucg

SEQ ID NO: 3469501 - RNA, 15 nt, Pseudomonas aeruginosa PA01
gucgcgcggccagcg

SEQ ID NO: 3469502 - RNA, 16 nt, Pseudomonas aeruginosa PA01
gucgcgcggccagcgu

SEQ ID NO: 3469503 - RNA, 15 nt, Pseudomonas aeruginosa PA01
gucgcgcgugccccg

SEQ ID NO: 3469504 - RNA, 17 nt, Pseudomonas aeruginosa PA01
gucgcgcgugccccgug

SEQ ID NO: 3469505 - RNA, 20 nt, Pseudomonas aeruginosa PA01
gucgcgcgugccccguggcg

SEQ ID NO: 3469506 - RNA, 18 nt, Pseudomonas aeruginosa PA01
gucgcgcucaggcgcagc

SEQ ID NO: 3469507 - RNA, 17 nt, Pseudomonas aeruginosa PA01
gucgcgcucuuccuuca

SEQ ID NO: 3469508 - RNA, 12 nt, Pseudomonas aeruginosa PA01
gucgcgcuggac

SEQ ID NO: 3469509 - RNA, 12 nt, Pseudomonas aeruginosa PA01
gucgcgcuucag

SEQ ID NO: 3469510 - RNA, 13 nt, Pseudomonas aeruginosa PA01
gucgcgcuugccu

SEQ ID NO: 3469511 - RNA, 21 nt, Pseudomonas aeruginosa PA01
gucgcgcuugccuuccugggc

SEQ ID NO: 3469512 - RNA, 23 nt, Pseudomonas aeruginosa PA01
gucgcgcuuguugaucaccaccg

SEQ ID NO: 3469513 - RNA, 23 nt, Pseudomonas aeruginosa PA01
gucgcggaacucgaugaaaccgg

SEQ ID NO: 3469514 - RNA, 16 nt, Pseudomonas aeruginosa PA01
gucgcggaagugcggg

SEQ ID NO: 3469515 - RNA, 14 nt, Pseudomonas aeruginosa PA01
gucgcggacccgcg

SEQ ID NO: 3469516 - RNA, 16 nt, Pseudomonas aeruginosa PA01
gucgcggacccgcgcc

SEQ ID NO: 3469517 - RNA, 17 nt, Pseudomonas aeruginosa PA01
gucgcggacccgcgccg

SEQ ID NO: 3469518 - RNA, 16 nt, Pseudomonas aeruginosa PA01
gucgcggaccuccagc

SEQ ID NO: 3469519 - RNA, 18 nt, Pseudomonas aeruginosa PA01
gucgcggacuccggaggc

SEQ ID NO: 3469520 - RNA, 22 nt, Pseudomonas aeruginosa PA01
gucgcggacuccggaggcgcac

SEQ ID NO: 3469521 - RNA, 23 nt, Pseudomonas aeruginosa PA01
gucgcggagaauccgcucggugc

SEQ ID NO: 3469522 - RNA, 15 nt, Pseudomonas aeruginosa PA01
gucgcggcaggcggc

SEQ ID NO: 3469523 - RNA, 16 nt, Pseudomonas aeruginosa PA01
gucgcggcaggcggcg

SEQ ID NO: 3469524 - RNA, 17 nt, Pseudomonas aeruginosa PA01
gucgcggcaggcggcgg

SEQ ID NO: 3469525 - RNA, 19 nt, Pseudomonas aeruginosa PA01
gucgcggcaggcggcggcg

SEQ ID NO: 3469526 - RNA, 16 nt, Pseudomonas aeruginosa PA01
gucgcggccaucggcg

SEQ ID NO: 3469527 - RNA, 14 nt, Pseudomonas aeruginosa PA01
gucgcggcgccugg

SEQ ID NO: 3469528 - RNA, 15 nt, Pseudomonas aeruginosa PA01
gucgcggcgccuggc

SEQ ID NO: 3469529 - RNA, 17 nt, Pseudomonas aeruginosa PA01
gucgcggcgccuggcgu

SEQ ID NO: 3469530 - RNA, 20 nt, Pseudomonas aeruginosa PA01
gucgcggcgccuggcguagc

SEQ ID NO: 3469531 - RNA, 14 nt, Pseudomonas aeruginosa PA01
gucgcggcgcgaga

SEQ ID NO: 3469532 - RNA, 15 nt, Pseudomonas aeruginosa PA01
gucgcggcugaaggc

SEQ ID NO: 3469533 - RNA, 20 nt, Pseudomonas aeruginosa PA01
gucgcggcugacgaaguccu

SEQ ID NO: 3469534 - RNA, 17 nt, Pseudomonas aeruginosa PA01
gucgcggcugcgcgccg

SEQ ID NO: 3469535 - RNA, 20 nt, Pseudomonas aeruginosa PA01
gucgcggcugcgcgccgggu

SEQ ID NO: 3469536 - RNA, 14 nt, Pseudomonas aeruginosa PA01
gucgcggcuggccg

SEQ ID NO: 3469537 - RNA, 15 nt, Pseudomonas aeruginosa PA01
gucgcggcuggccgc

SEQ ID NO: 3469538 - RNA, 22 nt, Pseudomonas aeruginosa PA01
gucgcggcuuucuuccagcacg

SEQ ID NO: 3469539 - RNA, 20 nt, Pseudomonas aeruginosa PA01
gucgcgggcaugcugcucgg

SEQ ID NO: 3469540 - RNA, 13 nt, Pseudomonas aeruginosa PA01
gucgcgggccagg

SEQ ID NO: 3469541 - RNA, 14 nt, Pseudomonas aeruginosa PA01
gucgcgggccaggc

SEQ ID NO: 3469542 - RNA, 15 nt, Pseudomonas aeruginosa PA01
gucgcgggccaggcc

SEQ ID NO: 3469543 - RNA, 13 nt, Pseudomonas aeruginosa PA01
gucgcgggccugg

SEQ ID NO: 3469544 - RNA, 15 nt, Pseudomonas aeruginosa PA01
gucgcgggccugggc

SEQ ID NO: 3469545 - RNA, 16 nt, Pseudomonas aeruginosa PA01
gucgcgggccugggca

SEQ ID NO: 3469546 - RNA, 14 nt, Pseudomonas aeruginosa PA01
gucgcgggcgaugg

SEQ ID NO: 3469547 - RNA, 19 nt, Pseudomonas aeruginosa PA01
gucgcggucaucgccggcg

SEQ ID NO: 3469548 - RNA, 20 nt, Pseudomonas aeruginosa PA01
gucgcggucuuccgccgacu

SEQ ID NO: 3469549 - RNA, 22 nt, Pseudomonas aeruginosa PA01
gucgcggucuuccgccgacugc

SEQ ID NO: 3469550 - RNA, 17 nt, Pseudomonas aeruginosa PA01
gucgcgguugccgaagc

SEQ ID NO: 3469551 - RNA, 23 nt, Pseudomonas aeruginosa PA01
gucgcgguugccgaagcgcucgg

SEQ ID NO: 3469552 - RNA, 20 nt, Pseudomonas aeruginosa PA01
gucgcguacagcgggccggg

SEQ ID NO: 3469553 - RNA, 16 nt, Pseudomonas aeruginosa PA01
gucgcguagaccaucg

SEQ ID NO: 3469554 - RNA, 13 nt, Pseudomonas aeruginosa PA01
gucgcguccggcc

SEQ ID NO: 3469555 - RNA, 20 nt, Pseudomonas aeruginosa PA01
gucgcguccggccagccugg

SEQ ID NO: 3469556 - RNA, 16 nt, Pseudomonas aeruginosa PA01
gucgcgucgcacccgg

SEQ ID NO: 3469557 - RNA, 16 nt, Pseudomonas aeruginosa PA01
gucgcgucggccuggc

SEQ ID NO: 3469558 - RNA, 18 nt, Pseudomonas aeruginosa PA01
gucgcgucggccuggcgc

SEQ ID NO: 3469559 - RNA, 21 nt, Pseudomonas aeruginosa PA01
gucgcgucggccuggcgcagc

SEQ ID NO: 3469560 - RNA, 19 nt, Pseudomonas aeruginosa PA01
gucgcguucccacucgcga

SEQ ID NO: 3469561 - RNA, 16 nt, Pseudomonas aeruginosa PA01
gucgcguucgucggcc

SEQ ID NO: 3469562 - RNA, 18 nt, Pseudomonas aeruginosa PA01
gucgcguucgucggccac

SEQ ID NO: 3469563 - RNA, 19 nt, Pseudomonas aeruginosa PA01
gucgcguucgucggccacc

SEQ ID NO: 3469564 - RNA, 21 nt, Pseudomonas aeruginosa PA01
gucgcguuggcgugcucgcgc

SEQ ID NO: 3469565 - RNA, 13 nt, Pseudomonas aeruginosa PA01
gucgcucagcggg

SEQ ID NO: 3469566 - RNA, 17 nt, Pseudomonas aeruginosa PA01
gucgcucagcgggccga

SEQ ID NO: 3469567 - RNA, 19 nt, Pseudomonas aeruginosa PA01
gucgcucagcgggccgauc

SEQ ID NO: 3469568 - RNA, 17 nt, Pseudomonas aeruginosa PA01
gucgcucauccgcgagg

SEQ ID NO: 3469569 - RNA, 14 nt, Pseudomonas aeruginosa PA01
gucgcucauggcgc

SEQ ID NO: 3469570 - RNA, 16 nt, Pseudomonas aeruginosa PA01
gucgcucauggcgccg

SEQ ID NO: 3469571 - RNA, 19 nt, Pseudomonas aeruginosa PA01
gucgcucauggcgccgcca

SEQ ID NO: 3469572 - RNA, 13 nt, Pseudomonas aeruginosa PA01
gucgcuccagacc

SEQ ID NO: 3469573 - RNA, 14 nt, Pseudomonas aeruginosa PA01
gucgcuccagcccc

SEQ ID NO: 3469574 - RNA, 13 nt, Pseudomonas aeruginosa PA01
gucgcuccggcag

SEQ ID NO: 3469575 - RNA, 13 nt, Pseudomonas aeruginosa PA01
gucgcucgcgcag

SEQ ID NO: 3469576 - RNA, 14 nt, Pseudomonas aeruginosa PA01
gucgcucgcgcagg

SEQ ID NO: 3469577 - RNA, 14 nt, Pseudomonas aeruginosa PA01
gucgcugaccaccc

SEQ ID NO: 3469578 - RNA, 18 nt, Pseudomonas aeruginosa PA01
gucgcugaccacccggug

SEQ ID NO: 3469579 - RNA, 19 nt, Pseudomonas aeruginosa PA01
gucgcugaccacccggugc

SEQ ID NO: 3469580 - RNA, 22 nt, Pseudomonas aeruginosa PA01
gucgcugaccagcccggcggcg

SEQ ID NO: 3469581 - RNA, 12 nt, Pseudomonas aeruginosa PA01
gucgcugaccgg

SEQ ID NO: 3469582 - RNA, 16 nt, Pseudomonas aeruginosa PA01
gucgcugaccggccgc

SEQ ID NO: 3469583 - RNA, 17 nt, Pseudomonas aeruginosa PA01
gucgcugaccggccgca

SEQ ID NO: 3469584 - RNA, 20 nt, Pseudomonas aeruginosa PA01
gucgcugaccggccgcagca

SEQ ID NO: 3469585 - RNA, 18 nt, Pseudomonas aeruginosa PA01
gucggccuggcgguugau

SEQ ID NO: 3469586 - RNA, 16 nt, Pseudomonas aeruginosa PA01
gucggccuggcugccg

SEQ ID NO: 3469587 - RNA, 12 nt, Pseudomonas aeruginosa PA01
gucggccugggu

SEQ ID NO: 3469588 - RNA, 21 nt, Pseudomonas aeruginosa PA01
gucggccuggguacgcaccgg

SEQ ID NO: 3469589 - RNA, 22 nt, Pseudomonas aeruginosa PA01
gucggccuggguacgcaccggc

SEQ ID NO: 3469590 - RNA, 17 nt, Pseudomonas aeruginosa PA01
gucggccuguucgccca

SEQ ID NO: 3469591 - RNA, 18 nt, Pseudomonas aeruginosa PA01
gucggccuugaggcgggc

SEQ ID NO: 3469592 - RNA, 20 nt, Pseudomonas aeruginosa PA01
gucggccuugaggcgggcca

SEQ ID NO: 3469593 - RNA, 21 nt, Pseudomonas aeruginosa PA01
gucggccuugaggcgggccag

SEQ ID NO: 3469594 - RNA, 22 nt, Pseudomonas aeruginosa PA01
gucggccuugaggcgggccagc

SEQ ID NO: 3469595 - RNA, 14 nt, Pseudomonas aeruginosa PA01
gucggccuugguca

SEQ ID NO: 3469596 - RNA, 18 nt, Pseudomonas aeruginosa PA01
gucggcgaaauccucgcg

SEQ ID NO: 3469597 - RNA, 19 nt, Pseudomonas aeruginosa PA01
gucggcgaaauccucgcgc

SEQ ID NO: 3469598 - RNA, 20 nt, Pseudomonas aeruginosa PA01
gucggcgaaauccucgcgca

SEQ ID NO: 3469599 - RNA, 20 nt, Pseudomonas aeruginosa PA01
gucggcgaaaugcaggccgg

SEQ ID NO: 3469600 - RNA, 23 nt, Pseudomonas aeruginosa PA01
gucggcgaacccggcgcggcgca

SEQ ID NO: 3469601 - RNA, 15 nt, Pseudomonas aeruginosa PA01
gucggcgaagccugc

SEQ ID NO: 3469602 - RNA, 18 nt, Pseudomonas aeruginosa PA01
gucggcgaagccugcggc

SEQ ID NO: 3469603 - RNA, 20 nt, Pseudomonas aeruginosa PA01
gucggcgaagccugcggcga

SEQ ID NO: 3469604 - RNA, 23 nt, Pseudomonas aeruginosa PA01
gucggcgaaggcgaaccacacca

SEQ ID NO: 3469605 - RNA, 18 nt, Pseudomonas aeruginosa PA01
gucggcgaaguccaccag

SEQ ID NO: 3469606 - RNA, 20 nt, Pseudomonas aeruginosa PA01
gucggcgaaguccaccaggc

SEQ ID NO: 3469607 - RNA, 13 nt, Pseudomonas aeruginosa PA01
gucggcgaccuug

SEQ ID NO: 3469608 - RNA, 19 nt, Pseudomonas aeruginosa PA01
gucggcgacgaugccgccg

SEQ ID NO: 3469609 - RNA, 12 nt, Pseudomonas aeruginosa PA01
gucggcgacgcu

SEQ ID NO: 3469610 - RNA, 16 nt, Pseudomonas aeruginosa PA01
gucggcgagccggcgc

SEQ ID NO: 3469611 - RNA, 13 nt, Pseudomonas aeruginosa PA01
gucggcgagggca

SEQ ID NO: 3469612 - RNA, 15 nt, Pseudomonas aeruginosa PA01
gucggcgaucacguc

SEQ ID NO: 3469613 - RNA, 17 nt, Pseudomonas aeruginosa PA01
gucggcgaucaggccga

SEQ ID NO: 3469614 - RNA, 22 nt, Pseudomonas aeruginosa PA01
gucggcgaucugugcgagcgcg

SEQ ID NO: 3469615 - RNA, 16 nt, Pseudomonas aeruginosa PA01
gucggcgaugcgcugg

SEQ ID NO: 3469616 - RNA, 21 nt, Pseudomonas aeruginosa PA01
gucggcgauucguucgagcag

SEQ ID NO: 3469617 - RNA, 14 nt, Pseudomonas aeruginosa PA01
gucggcgcgacggc

SEQ ID NO: 3469618 - RNA, 16 nt, Pseudomonas aeruginosa PA01
gucggcgcgcaucugg

SEQ ID NO: 3469619 - RNA, 16 nt, Pseudomonas aeruginosa PA01
gucggcgcgccagaag

SEQ ID NO: 3469620 - RNA, 17 nt, Pseudomonas aeruginosa PA01
gucggcgcgcccggcgc

SEQ ID NO: 3469621 - RNA, 19 nt, Pseudomonas aeruginosa PA01
gucggcgcgcccggcgcag

SEQ ID NO: 3469622 - RNA, 24 nt, Pseudomonas aeruginosa PA01
gucggcgcgcgacacauggucggc

SEQ ID NO: 3469623 - RNA, 13 nt, Pseudomonas aeruginosa PA01
gucggcgcggccg

SEQ ID NO: 3469624 - RNA, 14 nt, Pseudomonas aeruginosa PA01
gucggcgcggccgg

SEQ ID NO: 3469625 - RNA, 16 nt, Pseudomonas aeruginosa PA01
gucggcgcggccggcg

SEQ ID NO: 3469626 - RNA, 13 nt, Pseudomonas aeruginosa PA01
gucggcgcggcgc

SEQ ID NO: 3469627 - RNA, 11 nt, Pseudomonas aeruginosa PA01
gucggcgcggg

SEQ ID NO: 3469628 - RNA, 15 nt, Pseudomonas aeruginosa PA01
gucggcgcgggcgcc

SEQ ID NO: 3469629 - RNA, 16 nt, Pseudomonas aeruginosa PA01
gucggcgcgggcgccg

SEQ ID NO: 3469630 - RNA, 17 nt, Pseudomonas aeruginosa PA01
gucggcgcgggcgccga

SEQ ID NO: 3469631 - RNA, 12 nt, Pseudomonas aeruginosa PA01
gucggcgcugga

SEQ ID NO: 3469632 - RNA, 18 nt, Pseudomonas aeruginosa PA01
gucggcgcuuugcugcac

SEQ ID NO: 3469633 - RNA, 21 nt, Pseudomonas aeruginosa PA01
gucggcgcuuugcugcacgcu

SEQ ID NO: 3469634 - RNA, 22 nt, Pseudomonas aeruginosa PA01
gucggcggcacccucuuccgcg

SEQ ID NO: 3469635 - RNA, 13 nt, Pseudomonas aeruginosa PA01
gucggcggcacgc

SEQ ID NO: 3469636 - RNA, 14 nt, Pseudomonas aeruginosa PA01
gucggcggcacgcu

SEQ ID NO: 3469637 - RNA, 20 nt, Pseudomonas aeruginosa PA01
gucggcggcagcugcggcgg

SEQ ID NO: 3469638 - RNA, 17 nt, Pseudomonas aeruginosa PA01
gucggcggccgccuuga

SEQ ID NO: 3469639 - RNA, 11 nt, Pseudomonas aeruginosa PA01
gucggcggccu

SEQ ID NO: 3469640 - RNA, 14 nt, Pseudomonas aeruginosa PA01
gucggcggccucgg

SEQ ID NO: 3469641 - RNA, 16 nt, Pseudomonas aeruginosa PA01
gucggcggccucggcc

SEQ ID NO: 3469642 - RNA, 17 nt, Pseudomonas aeruginosa PA01
gucggcggccucggccu

SEQ ID NO: 3469643 - RNA, 15 nt, Pseudomonas aeruginosa PA01
gucggcggcgguucg

SEQ ID NO: 3469644 - RNA, 15 nt, Pseudomonas aeruginosa PA01
gucggcgggaagggu

SEQ ID NO: 3469645 - RNA, 19 nt, Pseudomonas aeruginosa PA01
gucggcgggcaccgccagc

SEQ ID NO: 3469646 - RNA, 20 nt, Pseudomonas aeruginosa PA01
gucggcgggcaccgccagcc

SEQ ID NO: 3469647 - RNA, 19 nt, Pseudomonas aeruginosa PA01
gucggcggucucgaacgcc

SEQ ID NO: 3469648 - RNA, 13 nt, Pseudomonas aeruginosa PA01
gucggcguagcgc

SEQ ID NO: 3469649 - RNA, 15 nt, Pseudomonas aeruginosa PA01
gucggcguagcgcag

SEQ ID NO: 3469650 - RNA, 21 nt, Pseudomonas aeruginosa PA01
gucggcguagcgcagggucgc

SEQ ID NO: 3469651 - RNA, 13 nt, Pseudomonas aeruginosa PA01
gucggcguaggcc

SEQ ID NO: 3469652 - RNA, 20 nt, Pseudomonas aeruginosa PA01
gucggcguccauggcggcga

SEQ ID NO: 3469653 - RNA, 13 nt, Pseudomonas aeruginosa PA01
gucggcguccgcc

SEQ ID NO: 3469654 - RNA, 14 nt, Pseudomonas aeruginosa PA01
gucggcguccgccu

SEQ ID NO: 3469655 - RNA, 22 nt, Pseudomonas aeruginosa PA01
gucggcgucggcugcgcugggc

SEQ ID NO: 3469656 - RNA, 23 nt, Pseudomonas aeruginosa PA01
gucggcgucuuccggcucgccgc

SEQ ID NO: 3469657 - RNA, 20 nt, Pseudomonas aeruginosa PA01
gucggcgucuugucgaagcc

SEQ ID NO: 3469658 - RNA, 14 nt, Pseudomonas aeruginosa PA01
gucggcgugcuggg

SEQ ID NO: 3469659 - RNA, 23 nt, Pseudomonas aeruginosa PA01
gucggcguugcugaucgcuccgc

SEQ ID NO: 3469660 - RNA, 23 nt, Pseudomonas aeruginosa PA01
gucggcguuuuuuuauccucgcg

SEQ ID NO: 3469661 - RNA, 14 nt, Pseudomonas aeruginosa PA01
gucggcucagccga

SEQ ID NO: 3469662 - RNA, 16 nt, Pseudomonas aeruginosa PA01
gucggcucagccgacc

SEQ ID NO: 3469663 - RNA, 22 nt, Pseudomonas aeruginosa PA01
gucggcucagccgaccaccuuc

SEQ ID NO: 3469664 - RNA, 14 nt, Pseudomonas aeruginosa PA01
gucggcucgcgccg

SEQ ID NO: 3469665 - RNA, 16 nt, Pseudomonas aeruginosa PA01
gucggcucgcgccggc

SEQ ID NO: 3469666 - RNA, 17 nt, Pseudomonas aeruginosa PA01
gucggcucgcgccggcg

SEQ ID NO: 3469667 - RNA, 18 nt, Pseudomonas aeruginosa PA01
gucggcucgguuccagcu

SEQ ID NO: 3469668 - RNA, 14 nt, Pseudomonas aeruginosa PA01
gucggcugcgcugg

SEQ ID NO: 3469669 - RNA, 17 nt, Pseudomonas aeruginosa PA01
gucggcuggcagggcgc

SEQ ID NO: 3469670 - RNA, 12 nt, Pseudomonas aeruginosa PA01
gucggcuggucg

SEQ ID NO: 3469671 - RNA, 16 nt, Pseudomonas aeruginosa PA01
gucggcuuccgccgcc

SEQ ID NO: 3469672 - RNA, 20 nt, Pseudomonas aeruginosa PA01
gucggcuuccgccgccaggu

SEQ ID NO: 3469673 - RNA, 23 nt, Pseudomonas aeruginosa PA01
gucggcuuccgccgccagguccg

SEQ ID NO: 3469674 - RNA, 19 nt, Pseudomonas aeruginosa PA01
gucgggacgcaugcgcggc

SEQ ID NO: 3469675 - RNA, 20 nt, Pseudomonas aeruginosa PA01
gucgggacgcaugcgcggcg

SEQ ID NO: 3469676 - RNA, 23 nt, Pseudomonas aeruginosa PA01
gucgggaucgagcaacagcagga

SEQ ID NO: 3469677 - RNA, 17 nt, Pseudomonas aeruginosa PA01
gucgggcaacggcuggg

SEQ ID NO: 3469678 - RNA, 13 nt, Pseudomonas aeruginosa PA01
gucgggcaggugg

SEQ ID NO: 3469679 - RNA, 17 nt, Pseudomonas aeruginosa PA01
gucgggcaguuccgcca

SEQ ID NO: 3469680 - RNA, 20 nt, Pseudomonas aeruginosa PA01
gucgggcaguuccgccagau

SEQ ID NO: 3469681 - RNA, 15 nt, Pseudomonas aeruginosa PA01
gucgggccgcgcucg

SEQ ID NO: 3469682 - RNA, 16 nt, Pseudomonas aeruginosa PA01
gucgggccgcgcucgg

SEQ ID NO: 3469683 - RNA, 20 nt, Pseudomonas aeruginosa PA01
gucgggcgaaacggcaggcc

SEQ ID NO: 3469684 - RNA, 23 nt, Pseudomonas aeruginosa PA01
gucgggcgaaacggcaggccagc

SEQ ID NO: 3469685 - RNA, 13 nt, Pseudomonas aeruginosa PA01
gucgggcgccgcg

SEQ ID NO: 3469686 - RNA, 15 nt, Pseudomonas aeruginosa PA01
gucgggcgccgcgcc

SEQ ID NO: 3469687 - RNA, 16 nt, Pseudomonas aeruginosa PA01
gucgggcgccgcgccu

SEQ ID NO: 3469688 - RNA, 16 nt, Pseudomonas aeruginosa PA01
gucgucuucggccagu

SEQ ID NO: 3469689 - RNA, 21 nt, Pseudomonas aeruginosa PA01
gucgugcagcccggucacgcc

SEQ ID NO: 3469690 - RNA, 21 nt, Pseudomonas aeruginosa PA01
gucgugcagguguucggcggc

SEQ ID NO: 3469691 - RNA, 19 nt, Pseudomonas aeruginosa PA01
gucgugcccgagcgacugg

SEQ ID NO: 3469692 - RNA, 16 nt, Pseudomonas aeruginosa PA01
gucgugcgccggccuc

SEQ ID NO: 3469693 - RNA, 18 nt, Pseudomonas aeruginosa PA01
gucguggauaggcggcgg

SEQ ID NO: 3469694 - RNA, 21 nt, Pseudomonas aeruginosa PA01
gucguggccauagagccgcug

SEQ ID NO: 3469695 - RNA, 13 nt, Pseudomonas aeruginosa PA01
gucguuagcucag

SEQ ID NO: 3469696 - RNA, 18 nt, Pseudomonas aeruginosa PA01
gucguucagcccaccccc

SEQ ID NO: 3469697 - RNA, 15 nt, Pseudomonas aeruginosa PA01
gucguucagcggcgu

SEQ ID NO: 3469698 - RNA, 18 nt, Pseudomonas aeruginosa PA01
gucguucagugccagcag

SEQ ID NO: 3469699 - RNA, 13 nt, Pseudomonas aeruginosa PA01
gucguucgcccuu

SEQ ID NO: 3469700 - RNA, 15 nt, Pseudomonas aeruginosa PA01
gucguucucgcgcau

SEQ ID NO: 3469701 - RNA, 23 nt, Pseudomonas aeruginosa PA01
gucguugagggcacggccagucg

SEQ ID NO: 3469702 - RNA, 13 nt, Pseudomonas aeruginosa PA01
gucguugcgcgca

SEQ ID NO: 3469703 - RNA, 14 nt, Pseudomonas aeruginosa PA01
gucguugcgcgcca

SEQ ID NO: 3469704 - RNA, 17 nt, Pseudomonas aeruginosa PA01
gucguugcgcgccagcg

SEQ ID NO: 3469705 - RNA, 22 nt, Pseudomonas aeruginosa PA01
gucguuggccaggcgcgacagc

SEQ ID NO: 3469706 - RNA, 15 nt, Pseudomonas aeruginosa PA01
gucguuggccggcug

SEQ ID NO: 3469707 - RNA, 17 nt, Pseudomonas aeruginosa PA01
gucguuguugcgggcga

SEQ ID NO: 3469708 - RNA, 17 nt, Pseudomonas aeruginosa PA01
gucguuucauucgucgc

SEQ ID NO: 3469709 - RNA, 15 nt, Pseudomonas aeruginosa PA01
gucguuucucggcga

SEQ ID NO: 3469710 - RNA, 19 nt, Pseudomonas aeruginosa PA01
gucguuucucggcgauggc

SEQ ID NO: 3469711 - RNA, 16 nt, Pseudomonas aeruginosa PA01
gucguuuuguccggcg

SEQ ID NO: 3469712 - RNA, 18 nt, Pseudomonas aeruginosa PA01
gucguuuuguccggcggc

SEQ ID NO: 3469713 - RNA, 21 nt, Pseudomonas aeruginosa PA01
gucguuuuguccggcggcugc

SEQ ID NO: 3469714 - RNA, 22 nt, Pseudomonas aeruginosa PA01
gucuaauggcaccuggauauca

SEQ ID NO: 3469715 - RNA, 18 nt, Pseudomonas aeruginosa PA01
gucuagcgccccggccgc

SEQ ID NO: 3469716 - RNA, 20 nt, Pseudomonas aeruginosa PA01
gucuaucccgugccgggcca

SEQ ID NO: 3469717 - RNA, 16 nt, Pseudomonas aeruginosa PA01
gucuaucugcguaacg

SEQ ID NO: 3469718 - RNA, 16 nt, Pseudomonas aeruginosa PA01
gucucagcccucggcc

SEQ ID NO: 3469719 - RNA, 13 nt, Pseudomonas aeruginosa PA01
gucucagccggcg

SEQ ID NO: 3469720 - RNA, 14 nt, Pseudomonas aeruginosa PA01
gucucagccggcgc

SEQ ID NO: 3469721 - RNA, 15 nt, Pseudomonas aeruginosa PA01
gucucaggcgccagg

SEQ ID NO: 3469722 - RNA, 15 nt, Pseudomonas aeruginosa PA01
gucuccaggaccagu

SEQ ID NO: 3469723 - RNA, 17 nt, Pseudomonas aeruginosa PA01
gucuccaggcgcgccgu

SEQ ID NO: 3469724 - RNA, 12 nt, Pseudomonas aeruginosa PA01
gucuccaugcgg

SEQ ID NO: 3469725 - RNA, 23 nt, Pseudomonas aeruginosa PA01
gucuccggggagauguccaucag

SEQ ID NO: 3469726 - RNA, 15 nt, Pseudomonas aeruginosa PA01
gucuccgugcuggcc

SEQ ID NO: 3469727 - RNA, 17 nt, Pseudomonas aeruginosa PA01
gucuccgugcuggccgg

SEQ ID NO: 3469728 - RNA, 18 nt, Pseudomonas aeruginosa PA01
gucuccgugcuggccggc

SEQ ID NO: 3469729 - RNA, 19 nt, Pseudomonas aeruginosa PA01
gucuccgugcuggccggca

SEQ ID NO: 3469730 - RNA, 18 nt, Pseudomonas aeruginosa PA01
gucuccuccuccaucucg

SEQ ID NO: 3469731 - RNA, 15 nt, Pseudomonas aeruginosa PA01
gucuccugccgccga

SEQ ID NO: 3469732 - RNA, 11 nt, Pseudomonas aeruginosa PA01
gucuccugugc

SEQ ID NO: 3469733 - RNA, 16 nt, Pseudomonas aeruginosa PA01
gucucgaacgccaggc

SEQ ID NO: 3469734 - RNA, 19 nt, Pseudomonas aeruginosa PA01
gucucgaacgccaggcagg

SEQ ID NO: 3469735 - RNA, 19 nt, Pseudomonas aeruginosa PA01
gucucgacgcgcaugucga

SEQ ID NO: 3469736 - RNA, 17 nt, Pseudomonas aeruginosa PA01
gucucgaucagcgccgg

SEQ ID NO: 3469737 - RNA, 19 nt, Pseudomonas aeruginosa PA01
gucucgaucggcccgggcg

SEQ ID NO: 3469738 - RNA, 20 nt, Pseudomonas aeruginosa PA01
gucucgaucggcccgggcgc

SEQ ID NO: 3469739 - RNA, 17 nt, Pseudomonas aeruginosa PA01
gucucgccaccccgcuc

SEQ ID NO: 3469740 - RNA, 23 nt, Pseudomonas aeruginosa PA01
gucucgccagcccggcaggucga

SEQ ID NO: 3469741 - RNA, 20 nt, Pseudomonas aeruginosa PA01
gucucgccgaugcccgggcg

SEQ ID NO: 3469742 - RNA, 13 nt, Pseudomonas aeruginosa PA01
gucucgccgccga

SEQ ID NO: 3469743 - RNA, 15 nt, Pseudomonas aeruginosa PA01
gucucgccgccgagc

SEQ ID NO: 3469744 - RNA, 20 nt, Pseudomonas aeruginosa PA01
gucucgccgccgagcaggcc

SEQ ID NO: 3469745 - RNA, 13 nt, Pseudomonas aeruginosa PA01
gucucgccgccgg

SEQ ID NO: 3469746 - RNA, 15 nt, Pseudomonas aeruginosa PA01
gucucgcgacacgug

SEQ ID NO: 3469747 - RNA, 17 nt, Pseudomonas aeruginosa PA01
gucucgcgcagcggcgg

SEQ ID NO: 3469748 - RNA, 18 nt, Pseudomonas aeruginosa PA01
gucucgcgggcguuggcc

SEQ ID NO: 3469749 - RNA, 20 nt, Pseudomonas aeruginosa PA01
gucucgcguucaucgucggc

SEQ ID NO: 3469750 - RNA, 17 nt, Pseudomonas aeruginosa PA01
gucucgcugacccaggc

SEQ ID NO: 3469751 - RNA, 13 nt, Pseudomonas aeruginosa PA01
gucucgcugccga

SEQ ID NO: 3469752 - RNA, 20 nt, Pseudomonas aeruginosa PA01
gucucggagugaggccgagc

SEQ ID NO: 3469753 - RNA, 13 nt, Pseudomonas aeruginosa PA01
gucucggcgaacg

SEQ ID NO: 3469754 - RNA, 22 nt, Pseudomonas aeruginosa PA01
gucucggcgaacgacagcacca

SEQ ID NO: 3469755 - RNA, 14 nt, Pseudomonas aeruginosa PA01
gucucggcugccgc

SEQ ID NO: 3469756 - RNA, 15 nt, Pseudomonas aeruginosa PA01
gucucggcugccgcc

SEQ ID NO: 3469757 - RNA, 17 nt, Pseudomonas aeruginosa PA01
gucucggcugccgccag

SEQ ID NO: 3469758 - RNA, 18 nt, Pseudomonas aeruginosa PA01
gucucggcugccgccagc

SEQ ID NO: 3469759 - RNA, 20 nt, Pseudomonas aeruginosa PA01
gucucggcugccgccagcuc

SEQ ID NO: 3469760 - RNA, 15 nt, Pseudomonas aeruginosa PA01
gucucggugcucagg

SEQ ID NO: 3469761 - RNA, 17 nt, Pseudomonas aeruginosa PA01
gucucggugcucaggcg

SEQ ID NO: 3469762 - RNA, 18 nt, Pseudomonas aeruginosa PA01
gucucggugcucaggcgg

SEQ ID NO: 3469763 - RNA, 15 nt, Pseudomonas aeruginosa PA01
gucucguagcagcca

SEQ ID NO: 3469764 - RNA, 16 nt, Pseudomonas aeruginosa PA01
gucucguccggcgugg

SEQ ID NO: 3469765 - RNA, 19 nt, Pseudomonas aeruginosa PA01
gucucuacgccauacuggg

SEQ ID NO: 3469766 - RNA, 14 nt, Pseudomonas aeruginosa PA01
gucucuuccagcau

SEQ ID NO: 3469767 - RNA, 14 nt, Pseudomonas aeruginosa PA01
gucugcaccgcccu

SEQ ID NO: 3469768 - RNA, 17 nt, Pseudomonas aeruginosa PA01
gucugcaccgcccuuuc

SEQ ID NO: 3469769 - RNA, 23 nt, Pseudomonas aeruginosa PA01
gucugcaccgcccuuucgaacug

SEQ ID NO: 3469770 - RNA, 22 nt, Pseudomonas aeruginosa PA01
gucugcaccucaugcugcgcgg

SEQ ID NO: 3469771 - RNA, 19 nt, Pseudomonas aeruginosa PA01
gucugccagcucuggccgu

SEQ ID NO: 3469772 - RNA, 18 nt, Pseudomonas aeruginosa PA01
gucugcccguggcgcgga

SEQ ID NO: 3469773 - RNA, 14 nt, Pseudomonas aeruginosa PA01
gucugcccguucug

SEQ ID NO: 3469774 - RNA, 22 nt, Pseudomonas aeruginosa PA01
gucugccgcucguuggcggcca

SEQ ID NO: 3469775 - RNA, 15 nt, Pseudomonas aeruginosa PA01
gucugccgcuggcgg

SEQ ID NO: 3469776 - RNA, 16 nt, Pseudomonas aeruginosa PA01
gucugccgcuggcggc

SEQ ID NO: 3469777 - RNA, 17 nt, Pseudomonas aeruginosa PA01
gucugccgcuggcggcc

SEQ ID NO: 3469778 - RNA, 18 nt, Pseudomonas aeruginosa PA01
gucugccgcuggcggccu

SEQ ID NO: 3469779 - RNA, 24 nt, Pseudomonas aeruginosa PA01
gucugcgcggcguucgcccugcgg

SEQ ID NO: 3469780 - RNA, 20 nt, Pseudomonas aeruginosa PA01
gucugcgguauaggccuugg

SEQ ID NO: 3469781 - RNA, 22 nt, Pseudomonas aeruginosa PA01
gucugcucauucggccagcgcg

SEQ ID NO: 3469782 - RNA, 13 nt, Pseudomonas aeruginosa PA01
gucugcucgcgcu

SEQ ID NO: 3469783 - RNA, 23 nt, Pseudomonas aeruginosa PA01
gucugcucgcgcuucucgacgua

SEQ ID NO: 3469784 - RNA, 13 nt, Pseudomonas aeruginosa PA01
gucugcucggcga

SEQ ID NO: 3469785 - RNA, 14 nt, Pseudomonas aeruginosa PA01
gucugcucggcgcc

SEQ ID NO: 3469786 - RNA, 14 nt, Pseudomonas aeruginosa PA01
gucugcugcgcgca

SEQ ID NO: 3469787 - RNA, 21 nt, Pseudomonas aeruginosa PA01
gucugcugggcggcgaggccg

SEQ ID NO: 3469788 - RNA, 21 nt, Pseudomonas aeruginosa PA01
gucugcugguagcugcugccg

SEQ ID NO: 3469789 - RNA, 19 nt, Pseudomonas aeruginosa PA01
gucugcuugcgcuggccgg

SEQ ID NO: 3469790 - RNA, 21 nt, Pseudomonas aeruginosa PA01
gucuggaugaacgacuccagc

SEQ ID NO: 3469791 - RNA, 16 nt, Pseudomonas aeruginosa PA01
gugaccagcauggcgg

SEQ ID NO: 3469792 - RNA, 18 nt, Pseudomonas aeruginosa PA01
gugacccacuccggcagg

SEQ ID NO: 3469793 - RNA, 20 nt, Pseudomonas aeruginosa PA01
gugacccacuccggcaggcg

SEQ ID NO: 3469794 - RNA, 22 nt, Pseudomonas aeruginosa PA01
gugacccacuccggcaggcgcu

SEQ ID NO: 3469795 - RNA, 23 nt, Pseudomonas aeruginosa PA01
gugacccacuccggcaggcgcuc

SEQ ID NO: 3469796 - RNA, 19 nt, Pseudomonas aeruginosa PA01
gugacccgcacggcgacgc

SEQ ID NO: 3469797 - RNA, 21 nt, Pseudomonas aeruginosa PA01
gugacccgcgcuuccagggua

SEQ ID NO: 3469798 - RNA, 19 nt, Pseudomonas aeruginosa PA01
gugaccgagauucugcagg

SEQ ID NO: 3469799 - RNA, 21 nt, Pseudomonas aeruginosa PA01
gugaccgagauucugcaggcg

SEQ ID NO: 3469800 - RNA, 23 nt, Pseudomonas aeruginosa PA01
gugaccgagauucugcaggcgcu

SEQ ID NO: 3469801 - RNA, 21 nt, Pseudomonas aeruginosa PA01
gugaccgcccagggggccggg

SEQ ID NO: 3469802 - RNA, 22 nt, Pseudomonas aeruginosa PA01
gugaccgcccagggggccgggc

SEQ ID NO: 3469803 - RNA, 14 nt, Pseudomonas aeruginosa PA01
gugaccgcgcgcca

SEQ ID NO: 3469804 - RNA, 19 nt, Pseudomonas aeruginosa PA01
gugaccgcgcgccauggcc

SEQ ID NO: 3469805 - RNA, 16 nt, Pseudomonas aeruginosa PA01
gugaccggcuugguca

SEQ ID NO: 3469806 - RNA, 19 nt, Pseudomonas aeruginosa PA01
gugaccgugcgggucgagg

SEQ ID NO: 3469807 - RNA, 15 nt, Pseudomonas aeruginosa PA01
gugaccuggccgccg

SEQ ID NO: 3469808 - RNA, 14 nt, Pseudomonas aeruginosa PA01
gugacgaaaccggc

SEQ ID NO: 3469809 - RNA, 19 nt, Pseudomonas aeruginosa PA01
gugacgcugcucaccaggu

SEQ ID NO: 3469810 - RNA, 16 nt, Pseudomonas aeruginosa PA01
gugacggccggggcgg

SEQ ID NO: 3469811 - RNA, 20 nt, Pseudomonas aeruginosa PA01
gugacggcguucggggcccu

SEQ ID NO: 3469812 - RNA, 15 nt, Pseudomonas aeruginosa PA01
gugacggugaucgcc

SEQ ID NO: 3469813 - RNA, 16 nt, Pseudomonas aeruginosa PA01
gugacggugaucgccg

SEQ ID NO: 3469814 - RNA, 14 nt, Pseudomonas aeruginosa PA01
gugacggugcagcc

SEQ ID NO: 3469815 - RNA, 21 nt, Pseudomonas aeruginosa PA01
gugacgucgaggaaggccagg

SEQ ID NO: 3469816 - RNA, 16 nt, Pseudomonas aeruginosa PA01
gugacguuggccgggg

SEQ ID NO: 3469817 - RNA, 13 nt, Pseudomonas aeruginosa PA01
gugagcaggcgcc

SEQ ID NO: 3469818 - RNA, 15 nt, Pseudomonas aeruginosa PA01
gugagcaggcgccgg

SEQ ID NO: 3469819 - RNA, 16 nt, Pseudomonas aeruginosa PA01
gugagcagggugacgg

SEQ ID NO: 3469820 - RNA, 23 nt, Pseudomonas aeruginosa PA01
gugagcauggcguugagguugcg

SEQ ID NO: 3469821 - RNA, 15 nt, Pseudomonas aeruginosa PA01
gugagccccaugccg

SEQ ID NO: 3469822 - RNA, 18 nt, Pseudomonas aeruginosa PA01
gugagccccggcgucggc

SEQ ID NO: 3469823 - RNA, 22 nt, Pseudomonas aeruginosa PA01
gugagccccggcgucggcgcgg

SEQ ID NO: 3469824 - RNA, 23 nt, Pseudomonas aeruginosa PA01
gugagccccggcgucggcgcggg

SEQ ID NO: 3469825 - RNA, 17 nt, Pseudomonas aeruginosa PA01
gugagcgacccgcugaa

SEQ ID NO: 3469826 - RNA, 14 nt, Pseudomonas aeruginosa PA01
gugagcugggcagg

SEQ ID NO: 3469827 - RNA, 13 nt, Pseudomonas aeruginosa PA01
gugaggaccuggc

SEQ ID NO: 3469828 - RNA, 22 nt, Pseudomonas aeruginosa PA01
gugaggaucacgcaagugcccu

SEQ ID NO: 3469829 - RNA, 16 nt, Pseudomonas aeruginosa PA01
gugaggccgagccgac

SEQ ID NO: 3469830 - RNA, 22 nt, Pseudomonas aeruginosa PA01
gugaggccgagccgacauccug

SEQ ID NO: 3469831 - RNA, 23 nt, Pseudomonas aeruginosa PA01
gugaggccgagccgacauccugu

SEQ ID NO: 3469832 - RNA, 19 nt, Pseudomonas aeruginosa PA01
gugaggcgcauggacaggu

SEQ ID NO: 3469833 - RNA, 13 nt, Pseudomonas aeruginosa PA01
gugaggcgcgcgc

SEQ ID NO: 3469834 - RNA, 13 nt, Pseudomonas aeruginosa PA01
gugaggcguucga

SEQ ID NO: 3469835 - RNA, 16 nt, Pseudomonas aeruginosa PA01
gugaggcguucgaggg

SEQ ID NO: 3469836 - RNA, 22 nt, Pseudomonas aeruginosa PA01
gugagggcgacggcggugcgca

SEQ ID NO: 3469837 - RNA, 13 nt, Pseudomonas aeruginosa PA01
gugagggcgacgu

SEQ ID NO: 3469838 - RNA, 21 nt, Pseudomonas aeruginosa PA01
gugagggcgacguugcgcagg

SEQ ID NO: 3469839 - RNA, 15 nt, Pseudomonas aeruginosa PA01
gugagggucgcgccg

SEQ ID NO: 3469840 - RNA, 19 nt, Pseudomonas aeruginosa PA01
gugagguagaagcggccgc

SEQ ID NO: 3469841 - RNA, 20 nt, Pseudomonas aeruginosa PA01
gugaggugggcgcgccgcag

SEQ ID NO: 3469842 - RNA, 15 nt, Pseudomonas aeruginosa PA01
gugagguugccgccg

SEQ ID NO: 3469843 - RNA, 19 nt, Pseudomonas aeruginosa PA01
gugauaccgccggcggcga

SEQ ID NO: 3469844 - RNA, 14 nt, Pseudomonas aeruginosa PA01
gugaucaccagcca

SEQ ID NO: 3469845 - RNA, 21 nt, Pseudomonas aeruginosa PA01
gugaucaccuggaucgccagg

SEQ ID NO: 3469846 - RNA, 22 nt, Pseudomonas aeruginosa PA01
gugaucaccuuguacggcagcg

SEQ ID NO: 3469847 - RNA, 20 nt, Pseudomonas aeruginosa PA01
gugaucagucgucguccagc

SEQ ID NO: 3469848 - RNA, 18 nt, Pseudomonas aeruginosa PA01
gugaucaucguccugccg

SEQ ID NO: 3469849 - RNA, 13 nt, Pseudomonas aeruginosa PA01
gugauccagcugg

SEQ ID NO: 3469850 - RNA, 16 nt, Pseudomonas aeruginosa PA01
gugauccagcuggcgc

SEQ ID NO: 3469851 - RNA, 20 nt, Pseudomonas aeruginosa PA01
gugauccaggucgaucagca

SEQ ID NO: 3469852 - RNA, 22 nt, Pseudomonas aeruginosa PA01
gugauccaggucgaucagcagc

SEQ ID NO: 3469853 - RNA, 14 nt, Pseudomonas aeruginosa PA01
gugaucccgcgcgg

SEQ ID NO: 3469854 - RNA, 19 nt, Pseudomonas aeruginosa PA01
gugaucccgcgcgggccga

SEQ ID NO: 3469855 - RNA, 14 nt, Pseudomonas aeruginosa PA01
gugauccguggcga

SEQ ID NO: 3469856 - RNA, 17 nt, Pseudomonas aeruginosa PA01
gugauccguggcgagcg

SEQ ID NO: 3469857 - RNA, 13 nt, Pseudomonas aeruginosa PA01
gugaucgaccaca

SEQ ID NO: 3469858 - RNA, 15 nt, Pseudomonas aeruginosa PA01
gugaucgaccucgcg

SEQ ID NO: 3469859 - RNA, 20 nt, Pseudomonas aeruginosa PA01
gugaucgaccucgcgggcga

SEQ ID NO: 3469860 - RNA, 14 nt, Pseudomonas aeruginosa PA01
gugaucgagccgcc

SEQ ID NO: 3469861 - RNA, 24 nt, Pseudomonas aeruginosa PA01
gugaucgagggaggucgcacgcag

SEQ ID NO: 3469862 - RNA, 13 nt, Pseudomonas aeruginosa PA01
gugaucgccgcga

SEQ ID NO: 3469863 - RNA, 20 nt, Pseudomonas aeruginosa PA01
gugaucucgcggcgcggcgg

SEQ ID NO: 3469864 - RNA, 21 nt, Pseudomonas aeruginosa PA01
gugaucuggaaauucagcgcu

SEQ ID NO: 3469865 - RNA, 20 nt, Pseudomonas aeruginosa PA01
gugaucuugaucugcaugcc

SEQ ID NO: 3469866 - RNA, 23 nt, Pseudomonas aeruginosa PA01
gugaugcccagcggcgccagcuc

SEQ ID NO: 3469867 - RNA, 15 nt, Pseudomonas aeruginosa PA01
gugaugcgucgcacc

SEQ ID NO: 3469868 - RNA, 18 nt, Pseudomonas aeruginosa PA01
gugauggaagagcgccgc

SEQ ID NO: 3469869 - RNA, 14 nt, Pseudomonas aeruginosa PA01
gugauggcgaucgg

SEQ ID NO: 3469870 - RNA, 15 nt, Pseudomonas aeruginosa PA01
gugauguaggccgcu

SEQ ID NO: 3469871 - RNA, 18 nt, Pseudomonas aeruginosa PA01
gugauguccccccuacga

SEQ ID NO: 3469872 - RNA, 17 nt, Pseudomonas aeruginosa PA01
gugaugucgcggcaggc

SEQ ID NO: 3469873 - RNA, 22 nt, Pseudomonas aeruginosa PA01
gugaugucgcggcaggcggcgg

SEQ ID NO: 3469874 - RNA, 22 nt, Pseudomonas aeruginosa PA01
gugauucguccggagccgggca

SEQ ID NO: 3469875 - RNA, 22 nt, Pseudomonas aeruginosa PA01
gugauuuacaggacugugcuua

SEQ ID NO: 3469876 - RNA, 17 nt, Pseudomonas aeruginosa PA01
gugauuucuucagccug

SEQ ID NO: 3469877 - RNA, 19 nt, Pseudomonas aeruginosa PA01
gugauuucuucagccuggg

SEQ ID NO: 3469878 - RNA, 16 nt, Pseudomonas aeruginosa PA01
gugcaacaccuggcgc

SEQ ID NO: 3469879 - RNA, 19 nt, Pseudomonas aeruginosa PA01
gugcaacaccuggcgcucg

SEQ ID NO: 3469880 - RNA, 22 nt, Pseudomonas aeruginosa PA01
gugcaacaccuggcgcucgccg

SEQ ID NO: 3469881 - RNA, 15 nt, Pseudomonas aeruginosa PA01
gugcaccgaggcgcg

SEQ ID NO: 3469882 - RNA, 23 nt, Pseudomonas aeruginosa PA01
gugcaccgccggguacagcgcca

SEQ ID NO: 3469883 - RNA, 13 nt, Pseudomonas aeruginosa PA01
gugcaccgcgcug

SEQ ID NO: 3469884 - RNA, 18 nt, Pseudomonas aeruginosa PA01
gugcaccuggcgaugccc

SEQ ID NO: 3469885 - RNA, 23 nt, Pseudomonas aeruginosa PA01
gugcacgaacaggugcugguggc

SEQ ID NO: 3469886 - RNA, 16 nt, Pseudomonas aeruginosa PA01
gugcacgccgauggcg

SEQ ID NO: 3469887 - RNA, 14 nt, Pseudomonas aeruginosa PA01
gugcacgcgccggg

SEQ ID NO: 3469888 - RNA, 15 nt, Pseudomonas aeruginosa PA01
gugcacgcgccgggu

SEQ ID NO: 3469889 - RNA, 18 nt, Pseudomonas aeruginosa PA01
gugcacgcgccgggucgg

SEQ ID NO: 3469890 - RNA, 20 nt, Pseudomonas aeruginosa PA01
gugcacgcugaagaucgcca

SEQ ID NO: 3469891 - RNA, 13 nt, Pseudomonas aeruginosa PA01
gugcacggccagg

SEQ ID NO: 3469892 - RNA, 14 nt, Pseudomonas aeruginosa PA01
gugcacggccaggc

SEQ ID NO: 3469893 - RNA, 16 nt, Pseudomonas aeruginosa PA01
gugccccguggcgggc

SEQ ID NO: 3469894 - RNA, 16 nt, Pseudomonas aeruginosa PA01
gugcccgagcgacugg

SEQ ID NO: 3469895 - RNA, 19 nt, Pseudomonas aeruginosa PA01
gugcccgaugccgcgccgg

SEQ ID NO: 3469896 - RNA, 13 nt, Pseudomonas aeruginosa PA01
gugcccgccggcg

SEQ ID NO: 3469897 - RNA, 21 nt, Pseudomonas aeruginosa PA01
gugcccgccggcgcgcccagg

SEQ ID NO: 3469898 - RNA, 21 nt, Pseudomonas aeruginosa PA01
gugcccgcugcaugugccagg

SEQ ID NO: 3469899 - RNA, 11 nt, Pseudomonas aeruginosa PA01
gugcccggcag

SEQ ID NO: 3469900 - RNA, 21 nt, Pseudomonas aeruginosa PA01
gugcccucgcggacgcuggcg

SEQ ID NO: 3469901 - RNA, 22 nt, Pseudomonas aeruginosa PA01
gugcccucgcggacgcuggcga

SEQ ID NO: 3469902 - RNA, 11 nt, Pseudomonas aeruginosa PA01
gugcccuggaa

SEQ ID NO: 3469903 - RNA, 15 nt, Pseudomonas aeruginosa PA01
gugcccuggcagacg

SEQ ID NO: 3469904 - RNA, 13 nt, Pseudomonas aeruginosa PA01
gugcccugggcgg

SEQ ID NO: 3469905 - RNA, 17 nt, Pseudomonas aeruginosa PA01
gugcccuuuuccuccag

SEQ ID NO: 3469906 - RNA, 21 nt, Pseudomonas aeruginosa PA01
gugccgaagaccaccaugguc

SEQ ID NO: 3469907 - RNA, 19 nt, Pseudomonas aeruginosa PA01
gugccgaccuucaccacca

SEQ ID NO: 3469908 - RNA, 13 nt, Pseudomonas aeruginosa PA01
gugccgaggccgc

SEQ ID NO: 3469909 - RNA, 19 nt, Pseudomonas aeruginosa PA01
gugccgaggccgccgcggg

SEQ ID NO: 3469910 - RNA, 21 nt, Pseudomonas aeruginosa PA01
gugccgaggccgccgcgggca

SEQ ID NO: 3469911 - RNA, 12 nt, Pseudomonas aeruginosa PA01
gugccgcagaca

SEQ ID NO: 3469912 - RNA, 14 nt, Pseudomonas aeruginosa PA01
gugccgccaggccu

SEQ ID NO: 3469913 - RNA, 19 nt, Pseudomonas aeruginosa PA01
gugccgccagucggccugg

SEQ ID NO: 3469914 - RNA, 21 nt, Pseudomonas aeruginosa PA01
gugccgccagucggccuggcu

SEQ ID NO: 3469915 - RNA, 20 nt, Pseudomonas aeruginosa PA01
gugccgccaucgccucgccg

SEQ ID NO: 3469916 - RNA, 23 nt, Pseudomonas aeruginosa PA01
gugccgccaucgccucgccggcc

SEQ ID NO: 3469917 - RNA, 14 nt, Pseudomonas aeruginosa PA01
gugccgcccggcgc

SEQ ID NO: 3469918 - RNA, 21 nt, Pseudomonas aeruginosa PA01
gugccgcccggcgccaccgcg

SEQ ID NO: 3469919 - RNA, 13 nt, Pseudomonas aeruginosa PA01
gugccgcccuggg

SEQ ID NO: 3469920 - RNA, 14 nt, Pseudomonas aeruginosa PA01
gugccgccggccac

SEQ ID NO: 3469921 - RNA, 19 nt, Pseudomonas aeruginosa PA01
gugccgccggccaccagca

SEQ ID NO: 3469922 - RNA, 18 nt, Pseudomonas aeruginosa PA01
gugccgccggcgccgccg

SEQ ID NO: 3469923 - RNA, 13 nt, Pseudomonas aeruginosa PA01
gugccgcgcagcu

SEQ ID NO: 3469924 - RNA, 15 nt, Pseudomonas aeruginosa PA01
gugccgcgcagguuc

SEQ ID NO: 3469925 - RNA, 19 nt, Pseudomonas aeruginosa PA01
gugccgcggaauggcgcgc

SEQ ID NO: 3469926 - RNA, 20 nt, Pseudomonas aeruginosa PA01
gugccgcggaauggcgcgca

SEQ ID NO: 3469927 - RNA, 13 nt, Pseudomonas aeruginosa PA01
gugccgcggugcg

SEQ ID NO: 3469928 - RNA, 15 nt, Pseudomonas aeruginosa PA01
gugccgcggugcggg

SEQ ID NO: 3469929 - RNA, 15 nt, Pseudomonas aeruginosa PA01
gugccgcuggccgac

SEQ ID NO: 3469930 - RNA, 17 nt, Pseudomonas aeruginosa PA01
gugccggagaacgccgc

SEQ ID NO: 3469931 - RNA, 19 nt, Pseudomonas aeruginosa PA01
gugccggagaacgccgcca

SEQ ID NO: 3469932 - RNA, 21 nt, Pseudomonas aeruginosa PA01
gugccggagaacgccgccacg

SEQ ID NO: 3469933 - RNA, 20 nt, Pseudomonas aeruginosa PA01
gugccggccaugcaggccag

SEQ ID NO: 3469934 - RNA, 22 nt, Pseudomonas aeruginosa PA01
gugccggccaugcaggccaggg

SEQ ID NO: 3469935 - RNA, 17 nt, Pseudomonas aeruginosa PA01
gugccgggcagugcgcc

SEQ ID NO: 3469936 - RNA, 13 nt, Pseudomonas aeruginosa PA01
gugccgggccggc

SEQ ID NO: 3469937 - RNA, 15 nt, Pseudomonas aeruginosa PA01
gugccgggccggcca

SEQ ID NO: 3469938 - RNA, 17 nt, Pseudomonas aeruginosa PA01
gugccgggccggccagg

SEQ ID NO: 3469939 - RNA, 19 nt, Pseudomonas aeruginosa PA01
gugccgggccggccagggc

SEQ ID NO: 3469940 - RNA, 20 nt, Pseudomonas aeruginosa PA01
gugccgggccggccagggcg

SEQ ID NO: 3469941 - RNA, 15 nt, Pseudomonas aeruginosa PA01
gugccgggcgucugc

SEQ ID NO: 3469942 - RNA, 20 nt, Pseudomonas aeruginosa PA01
gugccgggcuuuuucauggc

SEQ ID NO: 3469943 - RNA, 17 nt, Pseudomonas aeruginosa PA01
gugccgguagcuggcca

SEQ ID NO: 3469944 - RNA, 19 nt, Pseudomonas aeruginosa PA01
gugccgguagcuggccaug

SEQ ID NO: 3469945 - RNA, 19 nt, Pseudomonas aeruginosa PA01
gugccggugcggguggucg

SEQ ID NO: 3469946 - RNA, 13 nt, Pseudomonas aeruginosa PA01
gugccgucaugca

SEQ ID NO: 3469947 - RNA, 13 nt, Pseudomonas aeruginosa PA01
gugccguggacca

SEQ ID NO: 3469948 - RNA, 16 nt, Pseudomonas aeruginosa PA01
gugccguggaccaaca

SEQ ID NO: 3469949 - RNA, 17 nt, Pseudomonas aeruginosa PA01
gugccguggcucggcgg

SEQ ID NO: 3469950 - RNA, 22 nt, Pseudomonas aeruginosa PA01
gugccguggcucggcggcaggc

SEQ ID NO: 3469951 - RNA, 15 nt, Pseudomonas aeruginosa PA01
gugccguuccagcgg

SEQ ID NO: 3469952 - RNA, 17 nt, Pseudomonas aeruginosa PA01
gugccguugcuaccggc

SEQ ID NO: 3469953 - RNA, 18 nt, Pseudomonas aeruginosa PA01
gugccuccagccucagcc

SEQ ID NO: 3469954 - RNA, 19 nt, Pseudomonas aeruginosa PA01
gugccuccagccucagcca

SEQ ID NO: 3469955 - RNA, 23 nt, Pseudomonas aeruginosa PA01
gugccucgcgcguggccgccagg

SEQ ID NO: 3469956 - RNA, 12 nt, Pseudomonas aeruginosa PA01
gugccucggcgg

SEQ ID NO: 3469957 - RNA, 18 nt, Pseudomonas aeruginosa PA01
gugccucugaccgcgccc

SEQ ID NO: 3469958 - RNA, 14 nt, Pseudomonas aeruginosa PA01
gugccugagcuggc

SEQ ID NO: 3469959 - RNA, 18 nt, Pseudomonas aeruginosa PA01
gugccugagcuggcuguc

SEQ ID NO: 3469960 - RNA, 15 nt, Pseudomonas aeruginosa PA01
gugccugcaccacgc

SEQ ID NO: 3469961 - RNA, 16 nt, Pseudomonas aeruginosa PA01
gugccugcaccacgca

SEQ ID NO: 3469962 - RNA, 19 nt, Pseudomonas aeruginosa PA01
gugccugcaccacgcaggc

SEQ ID NO: 3469963 - RNA, 18 nt, Pseudomonas aeruginosa PA01
gugccugcuucaggucgu

SEQ ID NO: 3469964 - RNA, 23 nt, Pseudomonas aeruginosa PA01
gugccuggaaguauucggcggga

SEQ ID NO: 3469965 - RNA, 19 nt, Pseudomonas aeruginosa PA01
gugccuguuccuccgccag

SEQ ID NO: 3469966 - RNA, 16 nt, Pseudomonas aeruginosa PA01
gugccuucccagccga

SEQ ID NO: 3469967 - RNA, 16 nt, Pseudomonas aeruginosa PA01
gugccuuccgcgccca

SEQ ID NO: 3469968 - RNA, 19 nt, Pseudomonas aeruginosa PA01
gugccuuccgcgcccaggc

SEQ ID NO: 3469969 - RNA, 20 nt, Pseudomonas aeruginosa PA01
gugccuuccgcgcccaggcu

SEQ ID NO: 3469970 - RNA, 15 nt, Pseudomonas aeruginosa PA01
gugccuucggcggcg

SEQ ID NO: 3469971 - RNA, 18 nt, Pseudomonas aeruginosa PA01
gugccuucggcggcgccu

SEQ ID NO: 3469972 - RNA, 16 nt, Pseudomonas aeruginosa PA01
gugccuucguagguga

SEQ ID NO: 3469973 - RNA, 20 nt, Pseudomonas aeruginosa PA01
gugccuugaauugcugccac

SEQ ID NO: 3469974 - RNA, 18 nt, Pseudomonas aeruginosa PA01
gugcgaauguccggcgac

SEQ ID NO: 3469975 - RNA, 20 nt, Pseudomonas aeruginosa PA01
gugcgaauguccggcgacca

SEQ ID NO: 3469976 - RNA, 15 nt, Pseudomonas aeruginosa PA01
gugcgacgcagcaga

SEQ ID NO: 3469977 - RNA, 17 nt, Pseudomonas aeruginosa PA01
gugcgacgcagcagagg

SEQ ID NO: 3469978 - RNA, 23 nt, Pseudomonas aeruginosa PA01
gugcgacucguugcacgcaggcc

SEQ ID NO: 3469979 - RNA, 13 nt, Pseudomonas aeruginosa PA01
gugcgagggcggc

SEQ ID NO: 3469980 - RNA, 16 nt, Pseudomonas aeruginosa PA01
gugcgagggcggcggc

SEQ ID NO: 3469981 - RNA, 23 nt, Pseudomonas aeruginosa PA01
gugcgagucaccccgaccagcgc

SEQ ID NO: 3469982 - RNA, 16 nt, Pseudomonas aeruginosa PA01
gugcgcaccucgcccu

SEQ ID NO: 3469983 - RNA, 21 nt, Pseudomonas aeruginosa PA01
gugcgcacgcaauggcgcagc

SEQ ID NO: 3469984 - RNA, 13 nt, Pseudomonas aeruginosa PA01
gugcgcagcagcg

SEQ ID NO: 3469985 - RNA, 15 nt, Pseudomonas aeruginosa PA01
gugcgcaggcgcucg

SEQ ID NO: 3469986 - RNA, 15 nt, Pseudomonas aeruginosa PA01
gugcgcaugcccgcg

SEQ ID NO: 3469987 - RNA, 13 nt, Pseudomonas aeruginosa PA01
gugcgccagcucg

SEQ ID NO: 3469988 - RNA, 14 nt, Pseudomonas aeruginosa PA01
gugcgccaggccgg

SEQ ID NO: 3469989 - RNA, 13 nt, Pseudomonas aeruginosa PA01
gugcgcccagcag

SEQ ID NO: 3469990 - RNA, 17 nt, Pseudomonas aeruginosa PA01
gugcgcccagcagcagg

SEQ ID NO: 3469991 - RNA, 15 nt, Pseudomonas aeruginosa PA01
gugcgccccagcuca

SEQ ID NO: 3469992 - RNA, 19 nt, Pseudomonas aeruginosa PA01
gugcgccccagcucagcag

SEQ ID NO: 3469993 - RNA, 13 nt, Pseudomonas aeruginosa PA01
gugcgccccaggu

SEQ ID NO: 3469994 - RNA, 17 nt, Pseudomonas aeruginosa PA01
gugcgccccaggugcag

SEQ ID NO: 3469995 - RNA, 12 nt, Pseudomonas aeruginosa PA01
gugcgcccguuc

SEQ ID NO: 3469996 - RNA, 14 nt, Pseudomonas aeruginosa PA01
gugcuggcggaagg

SEQ ID NO: 3469997 - RNA, 19 nt, Pseudomonas aeruginosa PA01
gugcuggcgucgccuucca

SEQ ID NO: 3469998 - RNA, 22 nt, Pseudomonas aeruginosa PA01
gugcuggcuauucgcccagugg

SEQ ID NO: 3469999 - RNA, 15 nt, Pseudomonas aeruginosa PA01
gugcugggcgaccuu

SEQ ID NO: 3470000 - RNA, 22 nt, Pseudomonas aeruginosa PA01
gugcugggcgaccuucagcggg

SEQ ID NO: 3470001 - RNA, 18 nt, Pseudomonas aeruginosa PA01
gugcugggucacguggcc

SEQ ID NO: 3470002 - RNA, 20 nt, Pseudomonas aeruginosa PA01
gugcugggucacguggccgc

SEQ ID NO: 3470003 - RNA, 20 nt, Pseudomonas aeruginosa PA01
gugcuggguggaggcccaga

SEQ ID NO: 3470004 - RNA, 20 nt, Pseudomonas aeruginosa PA01
gugcugguagggcuucgccc

SEQ ID NO: 3470005 - RNA, 23 nt, Pseudomonas aeruginosa PA01
gugcuggucgugguccagcucgg

SEQ ID NO: 3470006 - RNA, 21 nt, Pseudomonas aeruginosa PA01
gugcugguggcccugggcggc

SEQ ID NO: 3470007 - RNA, 16 nt, Pseudomonas aeruginosa PA01
gugcuguuguugccgg

SEQ ID NO: 3470008 - RNA, 18 nt, Pseudomonas aeruginosa PA01
gugcuucagguagcucau

SEQ ID NO: 3470009 - RNA, 18 nt, Pseudomonas aeruginosa PA01
gugcuugaccgccgccug

SEQ ID NO: 3470010 - RNA, 17 nt, Pseudomonas aeruginosa PA01
gugcuuggcaccgcgca

SEQ ID NO: 3470011 - RNA, 22 nt, Pseudomonas aeruginosa PA01
gugcuuggcuucgagcugcgag

SEQ ID NO: 3470012 - RNA, 20 nt, Pseudomonas aeruginosa PA01
gugcuugucacgcucggcau

SEQ ID NO: 3470013 - RNA, 19 nt, Pseudomonas aeruginosa PA01
gugcuuguccaccaccgac

SEQ ID NO: 3470014 - RNA, 14 nt, Pseudomonas aeruginosa PA01
gugcuugugguagu

SEQ ID NO: 3470015 - RNA, 17 nt, Pseudomonas aeruginosa PA01
gugcuugugguaguggu

SEQ ID NO: 3470016 - RNA, 21 nt, Pseudomonas aeruginosa PA01
gugcuuuccugcuccagcagg

SEQ ID NO: 3470017 - RNA, 21 nt, Pseudomonas aeruginosa PA01
gugcuuugcccgucuagcgca

SEQ ID NO: 3470018 - RNA, 13 nt, Pseudomonas aeruginosa PA01
guggaacagccgc

SEQ ID NO: 3470019 - RNA, 19 nt, Pseudomonas aeruginosa PA01
guggaacagccgcagcggc

SEQ ID NO: 3470020 - RNA, 15 nt, Pseudomonas aeruginosa PA01
guggaacagcgcguc

SEQ ID NO: 3470021 - RNA, 18 nt, Pseudomonas aeruginosa PA01
guggaacccauggcgcga

SEQ ID NO: 3470022 - RNA, 22 nt, Pseudomonas aeruginosa PA01
guggaacccauggcgcgaugcu

SEQ ID NO: 3470023 - RNA, 14 nt, Pseudomonas aeruginosa PA01
guggaaccgcggcg

SEQ ID NO: 3470024 - RNA, 16 nt, Pseudomonas aeruginosa PA01
guggaaccgcggcgcc

SEQ ID NO: 3470025 - RNA, 18 nt, Pseudomonas aeruginosa PA01
guggaaccgcggcgcccu

SEQ ID NO: 3470026 - RNA, 22 nt, Pseudomonas aeruginosa PA01
guggaacgaggcgacccggguc

SEQ ID NO: 3470027 - RNA, 14 nt, Pseudomonas aeruginosa PA01
guggaagcgcgcgu

SEQ ID NO: 3470028 - RNA, 15 nt, Pseudomonas aeruginosa PA01
guggaagcgcgcguc

SEQ ID NO: 3470029 - RNA, 18 nt, Pseudomonas aeruginosa PA01
guggaaguacggcgcggu

SEQ ID NO: 3470030 - RNA, 15 nt, Pseudomonas aeruginosa PA01
guggaauccagggcc

SEQ ID NO: 3470031 - RNA, 16 nt, Pseudomonas aeruginosa PA01
guggacacccugcugc

SEQ ID NO: 3470032 - RNA, 18 nt, Pseudomonas aeruginosa PA01
guggacacccugcugcug

SEQ ID NO: 3470033 - RNA, 23 nt, Pseudomonas aeruginosa PA01
guggacacccugcugcugcucag

SEQ ID NO: 3470034 - RNA, 17 nt, Pseudomonas aeruginosa PA01
guggacauacaggcgcg

SEQ ID NO: 3470035 - RNA, 22 nt, Pseudomonas aeruginosa PA01
guggacauacaggcgcgccugg

SEQ ID NO: 3470036 - RNA, 23 nt, Pseudomonas aeruginosa PA01
guggaccaacgggcugccagcau

SEQ ID NO: 3470037 - RNA, 23 nt, Pseudomonas aeruginosa PA01
guggacgaaacgguagcccgcgg

SEQ ID NO: 3470038 - RNA, 14 nt, Pseudomonas aeruginosa PA01
guggacgccgguga

SEQ ID NO: 3470039 - RNA, 19 nt, Pseudomonas aeruginosa PA01
guggacggucucgccgccg

SEQ ID NO: 3470040 - RNA, 17 nt, Pseudomonas aeruginosa PA01
guggacgucgucggcga

SEQ ID NO: 3470041 - RNA, 19 nt, Pseudomonas aeruginosa PA01
guggacugguugaccugca

SEQ ID NO: 3470042 - RNA, 14 nt, Pseudomonas aeruginosa PA01
guggagaggucgcc

SEQ ID NO: 3470043 - RNA, 18 nt, Pseudomonas aeruginosa PA01
guggagccggugccggcg

SEQ ID NO: 3470044 - RNA, 23 nt, Pseudomonas aeruginosa PA01
guggagccggugccggcggcgga

SEQ ID NO: 3470045 - RNA, 19 nt, Pseudomonas aeruginosa PA01
guggaggaucuccaacugg

SEQ ID NO: 3470046 - RNA, 20 nt, Pseudomonas aeruginosa PA01
guggaggaucuccaacuggc

SEQ ID NO: 3470047 - RNA, 13 nt, Pseudomonas aeruginosa PA01
guggaggcggcgg

SEQ ID NO: 3470048 - RNA, 14 nt, Pseudomonas aeruginosa PA01
guggaggcggcggu

SEQ ID NO: 3470049 - RNA, 12 nt, Pseudomonas aeruginosa PA01
guggaggcgggc

SEQ ID NO: 3470050 - RNA, 16 nt, Pseudomonas aeruginosa PA01
guggaggucugccacc

SEQ ID NO: 3470051 - RNA, 16 nt, Pseudomonas aeruginosa PA01
guggaguaccaggcca

SEQ ID NO: 3470052 - RNA, 23 nt, Pseudomonas aeruginosa PA01
guggaguagguuuucguugggug

SEQ ID NO: 3470053 - RNA, 18 nt, Pseudomonas aeruginosa PA01
guggauaacucugugggc

SEQ ID NO: 3470054 - RNA, 17 nt, Pseudomonas aeruginosa PA01
guggauaggcggcggau

SEQ ID NO: 3470055 - RNA, 13 nt, Pseudomonas aeruginosa PA01
guggaucgcccga

SEQ ID NO: 3470056 - RNA, 17 nt, Pseudomonas aeruginosa PA01
guggaucgcccgaacgc

SEQ ID NO: 3470057 - RNA, 18 nt, Pseudomonas aeruginosa PA01
guggaucgcccgaacgcc

SEQ ID NO: 3470058 - RNA, 17 nt, Pseudomonas aeruginosa PA01
guggaucgcccggcugc

SEQ ID NO: 3470059 - RNA, 17 nt, Pseudomonas aeruginosa PA01
guggaucgcggcguagg

SEQ ID NO: 3470060 - RNA, 11 nt, Pseudomonas aeruginosa PA01
guggaucggcc

SEQ ID NO: 3470061 - RNA, 18 nt, Pseudomonas aeruginosa PA01
guggaugccgguggcgcc

SEQ ID NO: 3470062 - RNA, 20 nt, Pseudomonas aeruginosa PA01
guggauguucgccgccacca

SEQ ID NO: 3470063 - RNA, 15 nt, Pseudomonas aeruginosa PA01
guggauugcagcguc

SEQ ID NO: 3470064 - RNA, 23 nt, Pseudomonas aeruginosa PA01
guggauugcagcgucgacgccga

SEQ ID NO: 3470065 - RNA, 21 nt, Pseudomonas aeruginosa PA01
guggauuucagcaggccgagg

SEQ ID NO: 3470066 - RNA, 15 nt, Pseudomonas aeruginosa PA01
guggcaacugccgcc

SEQ ID NO: 3470067 - RNA, 19 nt, Pseudomonas aeruginosa PA01
guggcaacugccgcccgcu

SEQ ID NO: 3470068 - RNA, 15 nt, Pseudomonas aeruginosa PA01
guggcaagccucgcg

SEQ ID NO: 3470069 - RNA, 14 nt, Pseudomonas aeruginosa PA01
guggcaccaggucg

SEQ ID NO: 3470070 - RNA, 15 nt, Pseudomonas aeruginosa PA01
guggcacccaggcca

SEQ ID NO: 3470071 - RNA, 20 nt, Pseudomonas aeruginosa PA01
guggcacguacguccagggc

SEQ ID NO: 3470072 - RNA, 20 nt, Pseudomonas aeruginosa PA01
guggcaggaaaugccuggcu

SEQ ID NO: 3470073 - RNA, 12 nt, Pseudomonas aeruginosa PA01
guggcaggccug

SEQ ID NO: 3470074 - RNA, 14 nt, Pseudomonas aeruginosa PA01
guggcaggcgcccg

SEQ ID NO: 3470075 - RNA, 16 nt, Pseudomonas aeruginosa PA01
guggcaggcgcccggu

SEQ ID NO: 3470076 - RNA, 14 nt, Pseudomonas aeruginosa PA01
guggcaggcgcugc

SEQ ID NO: 3470077 - RNA, 14 nt, Pseudomonas aeruginosa PA01
guggcaugggccag

SEQ ID NO: 3470078 - RNA, 21 nt, Pseudomonas aeruginosa PA01
guggcaugggccaguuccggc

SEQ ID NO: 3470079 - RNA, 22 nt, Pseudomonas aeruginosa PA01
guggcaugguguccggcggcga

SEQ ID NO: 3470080 - RNA, 17 nt, Pseudomonas aeruginosa PA01
guggcauucgucgccgc

SEQ ID NO: 3470081 - RNA, 14 nt, Pseudomonas aeruginosa PA01
guggccagcgaacc

SEQ ID NO: 3470082 - RNA, 19 nt, Pseudomonas aeruginosa PA01
guggccagcgaacccaggc

SEQ ID NO: 3470083 - RNA, 22 nt, Pseudomonas aeruginosa PA01
guggccagcgaacccaggccgc

SEQ ID NO: 3470084 - RNA, 12 nt, Pseudomonas aeruginosa PA01
guggccagcgcc

SEQ ID NO: 3470085 - RNA, 13 nt, Pseudomonas aeruginosa PA01
guggccagcgccc

SEQ ID NO: 3470086 - RNA, 16 nt, Pseudomonas aeruginosa PA01
guggccagcgcccagg

SEQ ID NO: 3470087 - RNA, 17 nt, Pseudomonas aeruginosa PA01
guggccagcgcccaggc

SEQ ID NO: 3470088 - RNA, 20 nt, Pseudomonas aeruginosa PA01
guggccagcgcccaggccgg

SEQ ID NO: 3470089 - RNA, 20 nt, Pseudomonas aeruginosa PA01
guggccaggacgcuggcgau

SEQ ID NO: 3470090 - RNA, 20 nt, Pseudomonas aeruginosa PA01
guggccauagagccgcuggg

SEQ ID NO: 3470091 - RNA, 21 nt, Pseudomonas aeruginosa PA01
guggccauagagccgcugggu

SEQ ID NO: 3470092 - RNA, 16 nt, Pseudomonas aeruginosa PA01
guggccccagcgcgag

SEQ ID NO: 3470093 - RNA, 17 nt, Pseudomonas aeruginosa PA01
guggccccagcgcgagc

SEQ ID NO: 3470094 - RNA, 18 nt, Pseudomonas aeruginosa PA01
guggccccagcgcgagcg

SEQ ID NO: 3470095 - RNA, 15 nt, Pseudomonas aeruginosa PA01
guggcccggcgcggc

SEQ ID NO: 3470096 - RNA, 20 nt, Pseudomonas aeruginosa PA01
guggccgaaggcgcuccccu

SEQ ID NO: 3470097 - RNA, 12 nt, Pseudomonas aeruginosa PA01
guggccgccagg

SEQ ID NO: 3470098 - RNA, 20 nt, Pseudomonas aeruginosa PA01
gugggacugagccgcuggua

SEQ ID NO: 3470099 - RNA, 21 nt, Pseudomonas aeruginosa PA01
gugggaucgccacgccggcgc

SEQ ID NO: 3470100 - RNA, 22 nt, Pseudomonas aeruginosa PA01
gugggcacgagucgaggcgaug

SEQ ID NO: 3470101 - RNA, 15 nt, Pseudomonas aeruginosa PA01
gugggcaugcucggc

SEQ ID NO: 3470102 - RNA, 15 nt, Pseudomonas aeruginosa PA01
gugggccaccaucag

SEQ ID NO: 3470103 - RNA, 14 nt, Pseudomonas aeruginosa PA01
gugggccaccggcu

SEQ ID NO: 3470104 - RNA, 14 nt, Pseudomonas aeruginosa PA01
gugggccagcaggc

SEQ ID NO: 3470105 - RNA, 16 nt, Pseudomonas aeruginosa PA01
gugggccagcaggccg

SEQ ID NO: 3470106 - RNA, 17 nt, Pseudomonas aeruginosa PA01
gugggccagcaggccga

SEQ ID NO: 3470107 - RNA, 13 nt, Pseudomonas aeruginosa PA01
gugggccagccca

SEQ ID NO: 3470108 - RNA, 15 nt, Pseudomonas aeruginosa PA01
gugggccagcccaga

SEQ ID NO: 3470109 - RNA, 22 nt, Pseudomonas aeruginosa PA01
gugggccagcccagaacagcaa

SEQ ID NO: 3470110 - RNA, 13 nt, Pseudomonas aeruginosa PA01
gugggccgccgaa

SEQ ID NO: 3470111 - RNA, 15 nt, Pseudomonas aeruginosa PA01
gugggccggcaugcu

SEQ ID NO: 3470112 - RNA, 23 nt, Pseudomonas aeruginosa PA01
gugggccggcaugcucagccgcg

SEQ ID NO: 3470113 - RNA, 16 nt, Pseudomonas aeruginosa PA01
gugggccggcgcgccg

SEQ ID NO: 3470114 - RNA, 21 nt, Pseudomonas aeruginosa PA01
gugggcgaaguugaaacggcg

SEQ ID NO: 3470115 - RNA, 17 nt, Pseudomonas aeruginosa PA01
gugggcgaggcgcucga

SEQ ID NO: 3470116 - RNA, 17 nt, Pseudomonas aeruginosa PA01
gugggcgagggcgcgca

SEQ ID NO: 3470117 - RNA, 15 nt, Pseudomonas aeruginosa PA01
gugggcgccgccggu

SEQ ID NO: 3470118 - RNA, 17 nt, Pseudomonas aeruginosa PA01
gugggcggccggccagg

SEQ ID NO: 3470119 - RNA, 13 nt, Pseudomonas aeruginosa PA01
gugggcggcggcu

SEQ ID NO: 3470120 - RNA, 14 nt, Pseudomonas aeruginosa PA01
gugggcggcggcua

SEQ ID NO: 3470121 - RNA, 15 nt, Pseudomonas aeruginosa PA01
gugggcggucggcga

SEQ ID NO: 3470122 - RNA, 20 nt, Pseudomonas aeruginosa PA01
gugggcggucggcgagggca

SEQ ID NO: 3470123 - RNA, 21 nt, Pseudomonas aeruginosa PA01
gugggcucuaugcaauggggc

SEQ ID NO: 3470124 - RNA, 21 nt, Pseudomonas aeruginosa PA01
guggggaaaucgguugccgcg

SEQ ID NO: 3470125 - RNA, 17 nt, Pseudomonas aeruginosa PA01
guggggaugcgcgaggu

SEQ ID NO: 3470126 - RNA, 12 nt, Pseudomonas aeruginosa PA01
guggggccgccg

SEQ ID NO: 3470127 - RNA, 12 nt, Pseudomonas aeruginosa PA01
guggggcgccgg

SEQ ID NO: 3470128 - RNA, 16 nt, Pseudomonas aeruginosa PA01
guggggcgccggcucg

SEQ ID NO: 3470129 - RNA, 12 nt, Pseudomonas aeruginosa PA01
guggggcggcgc

SEQ ID NO: 3470130 - RNA, 18 nt, Pseudomonas aeruginosa PA01
guggguaagcucgaucac

SEQ ID NO: 3470131 - RNA, 17 nt, Pseudomonas aeruginosa PA01
guggguauccagcggcc

SEQ ID NO: 3470132 - RNA, 19 nt, Pseudomonas aeruginosa PA01
guggguauccagcggccgc

SEQ ID NO: 3470133 - RNA, 14 nt, Pseudomonas aeruginosa PA01
guggguccacgccg

SEQ ID NO: 3470134 - RNA, 15 nt, Pseudomonas aeruginosa PA01
guggguccacgccgg

SEQ ID NO: 3470135 - RNA, 17 nt, Pseudomonas aeruginosa PA01
gugggucgaugcccucg

SEQ ID NO: 3470136 - RNA, 14 nt, Pseudomonas aeruginosa PA01
gugggucgggucgg

SEQ ID NO: 3470137 - RNA, 17 nt, Pseudomonas aeruginosa PA01
guggucaccgccagcgg

SEQ ID NO: 3470138 - RNA, 22 nt, Pseudomonas aeruginosa PA01
guggucaccgccagcgggacga

SEQ ID NO: 3470139 - RNA, 22 nt, Pseudomonas aeruginosa PA01
guggucagcaccagggccaggg

SEQ ID NO: 3470140 - RNA, 18 nt, Pseudomonas aeruginosa PA01
guggucagccagccgagc

SEQ ID NO: 3470141 - RNA, 19 nt, Pseudomonas aeruginosa PA01
guggucagccagccgagca

SEQ ID NO: 3470142 - RNA, 15 nt, Pseudomonas aeruginosa PA01
guggucaggcgccag

SEQ ID NO: 3470143 - RNA, 16 nt, Pseudomonas aeruginosa PA01
guggucaggcgccagg

SEQ ID NO: 3470144 - RNA, 13 nt, Pseudomonas aeruginosa PA01
guggucauggcgc

SEQ ID NO: 3470145 - RNA, 17 nt, Pseudomonas aeruginosa PA01
gugguccagcucgguca

SEQ ID NO: 3470146 - RNA, 13 nt, Pseudomonas aeruginosa PA01
gugguccgccagc

SEQ ID NO: 3470147 - RNA, 17 nt, Pseudomonas aeruginosa PA01
gugguccgccagcaggc

SEQ ID NO: 3470148 - RNA, 15 nt, Pseudomonas aeruginosa PA01
guggucgaauggagu

SEQ ID NO: 3470149 - RNA, 21 nt, Pseudomonas aeruginosa PA01
guggucgaggguggucagcca

SEQ ID NO: 3470150 - RNA, 19 nt, Pseudomonas aeruginosa PA01
guggucgcagcuccagcgg

SEQ ID NO: 3470151 - RNA, 21 nt, Pseudomonas aeruginosa PA01
guggucgcagcuccagcggaa

SEQ ID NO: 3470152 - RNA, 18 nt, Pseudomonas aeruginosa PA01
guggucgccgcccacgcc

SEQ ID NO: 3470153 - RNA, 14 nt, Pseudomonas aeruginosa PA01
guggucgcgcaggc

SEQ ID NO: 3470154 - RNA, 18 nt, Pseudomonas aeruginosa PA01
guggucguagcagguccg

SEQ ID NO: 3470155 - RNA, 16 nt, Pseudomonas aeruginosa PA01
guggucguugcgcgcc

SEQ ID NO: 3470156 - RNA, 21 nt, Pseudomonas aeruginosa PA01
guggugacauggaugaccacg

SEQ ID NO: 3470157 - RNA, 15 nt, Pseudomonas aeruginosa PA01
guggugaucagcggc

SEQ ID NO: 3470158 - RNA, 17 nt, Pseudomonas aeruginosa PA01
guggugaucagcggccg

SEQ ID NO: 3470159 - RNA, 19 nt, Pseudomonas aeruginosa PA01
guggugaucagcggccgag

SEQ ID NO: 3470160 - RNA, 20 nt, Pseudomonas aeruginosa PA01
guggugaucagcggccgagc

SEQ ID NO: 3470161 - RNA, 20 nt, Pseudomonas aeruginosa PA01
guggugccacagguggaucg

SEQ ID NO: 3470162 - RNA, 16 nt, Pseudomonas aeruginosa PA01
guggugcuaucgaugc

SEQ ID NO: 3470163 - RNA, 17 nt, Pseudomonas aeruginosa PA01
gugguggaaguggacgg

SEQ ID NO: 3470164 - RNA, 23 nt, Pseudomonas aeruginosa PA01
gugguggccguggcgccccaggc

SEQ ID NO: 3470165 - RNA, 19 nt, Pseudomonas aeruginosa PA01
gugguggcggggaacagca

SEQ ID NO: 3470166 - RNA, 14 nt, Pseudomonas aeruginosa PA01
gugguuccaggagg

SEQ ID NO: 3470167 - RNA, 18 nt, Pseudomonas aeruginosa PA01
gugguugggcaggcgcau

SEQ ID NO: 3470168 - RNA, 16 nt, Pseudomonas aeruginosa PA01
guguaauugacgauga

SEQ ID NO: 3470169 - RNA, 23 nt, Pseudomonas aeruginosa PA01
guguaccuggguugccgcgccga

SEQ ID NO: 3470170 - RNA, 15 nt, Pseudomonas aeruginosa PA01
guguagaccaccagc

SEQ ID NO: 3470171 - RNA, 22 nt, Pseudomonas aeruginosa PA01
guguagaggcucaacugguccu

SEQ ID NO: 3470172 - RNA, 14 nt, Pseudomonas aeruginosa PA01
guguagaucaggcu

SEQ ID NO: 3470173 - RNA, 17 nt, Pseudomonas aeruginosa PA01
guguagcgacggaaggu

SEQ ID NO: 3470174 - RNA, 23 nt, Pseudomonas aeruginosa PA01
guguagcgauccugaccguccug

SEQ ID NO: 3470175 - RNA, 18 nt, Pseudomonas aeruginosa PA01
guguagcgcagguugcgc

SEQ ID NO: 3470176 - RNA, 22 nt, Pseudomonas aeruginosa PA01
guguccaccaccagcaggccca

SEQ ID NO: 3470177 - RNA, 23 nt, Pseudomonas aeruginosa PA01
guguccaccaccagcaggcccag

SEQ ID NO: 3470178 - RNA, 20 nt, Pseudomonas aeruginosa PA01
gugucccgaguaggcgcugc

SEQ ID NO: 3470179 - RNA, 20 nt, Pseudomonas aeruginosa PA01
guguccgauucuuggcucgg

SEQ ID NO: 3470180 - RNA, 23 nt, Pseudomonas aeruginosa PA01
guguccgcccuuuuucgucgcca

SEQ ID NO: 3470181 - RNA, 15 nt, Pseudomonas aeruginosa PA01
guguccgcggugccg

SEQ ID NO: 3470182 - RNA, 15 nt, Pseudomonas aeruginosa PA01
gugucgacaccuggc

SEQ ID NO: 3470183 - RNA, 16 nt, Pseudomonas aeruginosa PA01
gugucgacaccuggca

SEQ ID NO: 3470184 - RNA, 17 nt, Pseudomonas aeruginosa PA01
gugucgacaccuggcaa

SEQ ID NO: 3470185 - RNA, 19 nt, Pseudomonas aeruginosa PA01
gugucgacaccuggcaaca

SEQ ID NO: 3470186 - RNA, 23 nt, Pseudomonas aeruginosa PA01
gugucgacucagcgggcgcggua

SEQ ID NO: 3470187 - RNA, 20 nt, Pseudomonas aeruginosa PA01
gugucgaggaaggccagcag

SEQ ID NO: 3470188 - RNA, 20 nt, Pseudomonas aeruginosa PA01
gugucgagggcugggcagcg

SEQ ID NO: 3470189 - RNA, 17 nt, Pseudomonas aeruginosa PA01
gugucgccuuccggcag

SEQ ID NO: 3470190 - RNA, 19 nt, Pseudomonas aeruginosa PA01
gugucgccuuccggcaggu

SEQ ID NO: 3470191 - RNA, 18 nt, Pseudomonas aeruginosa PA01
gugucgcgaacucggcgc

SEQ ID NO: 3470192 - RNA, 19 nt, Pseudomonas aeruginosa PA01
gugucgcgaacucggcgcc

SEQ ID NO: 3470193 - RNA, 22 nt, Pseudomonas aeruginosa PA01
gugucgcucccuacgaugcugg

SEQ ID NO: 3470194 - RNA, 14 nt, Pseudomonas aeruginosa PA01
gugucggccaacug

SEQ ID NO: 3470195 - RNA, 17 nt, Pseudomonas aeruginosa PA01
gugucggcgaucaggcc

SEQ ID NO: 3470196 - RNA, 19 nt, Pseudomonas aeruginosa PA01
gugucggcgaucaggccga

SEQ ID NO: 3470197 - RNA, 20 nt, Pseudomonas aeruginosa PA01
gugucggcgaucaggccgau

SEQ ID NO: 3470198 - RNA, 13 nt, Pseudomonas aeruginosa PA01
gugucggcggcgc

SEQ ID NO: 3470199 - RNA, 16 nt, Pseudomonas aeruginosa PA01
gugucggugcccucgc

SEQ ID NO: 3470200 - RNA, 16 nt, Pseudomonas aeruginosa PA01
guuccaccuggcgcag

SEQ ID NO: 3470201 - RNA, 16 nt, Pseudomonas aeruginosa PA01
guuccacgagagaaau

SEQ ID NO: 3470202 - RNA, 22 nt, Pseudomonas aeruginosa PA01
guuccacucccaugccaggaga

SEQ ID NO: 3470203 - RNA, 13 nt, Pseudomonas aeruginosa PA01
guuccagcaccuc

SEQ ID NO: 3470204 - RNA, 22 nt, Pseudomonas aeruginosa PA01
guuccagcggcacuucccgccc

SEQ ID NO: 3470205 - RNA, 14 nt, Pseudomonas aeruginosa PA01
guuccagcggccgc

SEQ ID NO: 3470206 - RNA, 17 nt, Pseudomonas aeruginosa PA01
guuccagcggccgcgag

SEQ ID NO: 3470207 - RNA, 18 nt, Pseudomonas aeruginosa PA01
guuccagcggccgcgagc

SEQ ID NO: 3470208 - RNA, 23 nt, Pseudomonas aeruginosa PA01
guuccagcucgucgagcugcucg

SEQ ID NO: 3470209 - RNA, 23 nt, Pseudomonas aeruginosa PA01
guuccaggagggcugcuguccag

SEQ ID NO: 3470210 - RNA, 14 nt, Pseudomonas aeruginosa PA01
guuccaggcccgcc

SEQ ID NO: 3470211 - RNA, 18 nt, Pseudomonas aeruginosa PA01
guuccaggcccgccgcgg

SEQ ID NO: 3470212 - RNA, 19 nt, Pseudomonas aeruginosa PA01
guuccaggcccgccgcggc

SEQ ID NO: 3470213 - RNA, 14 nt, Pseudomonas aeruginosa PA01
guuccaggcggggc

SEQ ID NO: 3470214 - RNA, 19 nt, Pseudomonas aeruginosa PA01
guuccagggccugcuccag

SEQ ID NO: 3470215 - RNA, 18 nt, Pseudomonas aeruginosa PA01
guuccagggccugguaga

SEQ ID NO: 3470216 - RNA, 18 nt, Pseudomonas aeruginosa PA01
guuccagggucagcuggc

SEQ ID NO: 3470217 - RNA, 16 nt, Pseudomonas aeruginosa PA01
guuccaggucgcugcu

SEQ ID NO: 3470218 - RNA, 19 nt, Pseudomonas aeruginosa PA01
guuccaggucgcugcugaa

SEQ ID NO: 3470219 - RNA, 20 nt, Pseudomonas aeruginosa PA01
guuccaguacacccagggca

SEQ ID NO: 3470220 - RNA, 16 nt, Pseudomonas aeruginosa PA01
guuccaguucggccgc

SEQ ID NO: 3470221 - RNA, 23 nt, Pseudomonas aeruginosa PA01
guuccaguucggccgcggcuggc

SEQ ID NO: 3470222 - RNA, 23 nt, Pseudomonas aeruginosa PA01
guuccaugcgaaaacggcgaccc

SEQ ID NO: 3470223 - RNA, 23 nt, Pseudomonas aeruginosa PA01
guuccaugucgcuggccugcagg

SEQ ID NO: 3470224 - RNA, 18 nt, Pseudomonas aeruginosa PA01
guucccagaaaaucggca

SEQ ID NO: 3470225 - RNA, 18 nt, Pseudomonas aeruginosa PA01
guucccagaccuggccgc

SEQ ID NO: 3470226 - RNA, 14 nt, Pseudomonas aeruginosa PA01
guucccccagcacc

SEQ ID NO: 3470227 - RNA, 18 nt, Pseudomonas aeruginosa PA01
guucccccagcaccugga

SEQ ID NO: 3470228 - RNA, 17 nt, Pseudomonas aeruginosa PA01
guucccccguggcgacg

SEQ ID NO: 3470229 - RNA, 22 nt, Pseudomonas aeruginosa PA01
guucccccuuuuucggcgcgga

SEQ ID NO: 3470230 - RNA, 16 nt, Pseudomonas aeruginosa PA01
guucccggaucagcuc

SEQ ID NO: 3470231 - RNA, 15 nt, Pseudomonas aeruginosa PA01
guucccggccuggcg

SEQ ID NO: 3470232 - RNA, 16 nt, Pseudomonas aeruginosa PA01
guucccggccuggcgc

SEQ ID NO: 3470233 - RNA, 16 nt, Pseudomonas aeruginosa PA01
guucccguccgggcac

SEQ ID NO: 3470234 - RNA, 18 nt, Pseudomonas aeruginosa PA01
guucccguccgggcacgc

SEQ ID NO: 3470235 - RNA, 22 nt, Pseudomonas aeruginosa PA01
guucccucaggauagccggcgc

SEQ ID NO: 3470236 - RNA, 20 nt, Pseudomonas aeruginosa PA01
guucccugcgccucgaccug

SEQ ID NO: 3470237 - RNA, 22 nt, Pseudomonas aeruginosa PA01
guuccgacccggccgaccaggu

SEQ ID NO: 3470238 - RNA, 18 nt, Pseudomonas aeruginosa PA01
guuccgcgauagcucagu

SEQ ID NO: 3470239 - RNA, 14 nt, Pseudomonas aeruginosa PA01
guuccgcgaucaac

SEQ ID NO: 3470240 - RNA, 17 nt, Pseudomonas aeruginosa PA01
guuccgcggagucgccg

SEQ ID NO: 3470241 - RNA, 15 nt, Pseudomonas aeruginosa PA01
guuccggcaggaccu

SEQ ID NO: 3470242 - RNA, 18 nt, Pseudomonas aeruginosa PA01
guuccggcucagccgcug

SEQ ID NO: 3470243 - RNA, 19 nt, Pseudomonas aeruginosa PA01
guuccggcucagccgcugg

SEQ ID NO: 3470244 - RNA, 15 nt, Pseudomonas aeruginosa PA01
guuccgggcagcggc

SEQ ID NO: 3470245 - RNA, 19 nt, Pseudomonas aeruginosa PA01
guuccgggucgcugcccau

SEQ ID NO: 3470246 - RNA, 18 nt, Pseudomonas aeruginosa PA01
guuccggguugguggccg

SEQ ID NO: 3470247 - RNA, 20 nt, Pseudomonas aeruginosa PA01
guuccggucgggaugccgug

SEQ ID NO: 3470248 - RNA, 16 nt, Pseudomonas aeruginosa PA01
guuccucacggcgcag

SEQ ID NO: 3470249 - RNA, 17 nt, Pseudomonas aeruginosa PA01
guuccuccagagugcgc

SEQ ID NO: 3470250 - RNA, 15 nt, Pseudomonas aeruginosa PA01
guuccuccucgccgc

SEQ ID NO: 3470251 - RNA, 16 nt, Pseudomonas aeruginosa PA01
guuccuccucgccgcc

SEQ ID NO: 3470252 - RNA, 18 nt, Pseudomonas aeruginosa PA01
guuccucgccgcugcugg

SEQ ID NO: 3470253 - RNA, 19 nt, Pseudomonas aeruginosa PA01
guuccucgccgcugcuggc

SEQ ID NO: 3470254 - RNA, 13 nt, Pseudomonas aeruginosa PA01
guuccucgcgagg

SEQ ID NO: 3470255 - RNA, 23 nt, Pseudomonas aeruginosa PA01
guuccucgcggaagcguugcucg

SEQ ID NO: 3470256 - RNA, 21 nt, Pseudomonas aeruginosa PA01
guuccucgcggcucaccgaga

SEQ ID NO: 3470257 - RNA, 13 nt, Pseudomonas aeruginosa PA01
guuccucggcggc

SEQ ID NO: 3470258 - RNA, 14 nt, Pseudomonas aeruginosa PA01
guuccucggcggcg

SEQ ID NO: 3470259 - RNA, 20 nt, Pseudomonas aeruginosa PA01
guuccucggcggcggucgcg

SEQ ID NO: 3470260 - RNA, 15 nt, Pseudomonas aeruginosa PA01
guuccugcuccuccg

SEQ ID NO: 3470261 - RNA, 17 nt, Pseudomonas aeruginosa PA01
guuccugcuccuccgac

SEQ ID NO: 3470262 - RNA, 19 nt, Pseudomonas aeruginosa PA01
guuccuguaccaggggaug

SEQ ID NO: 3470263 - RNA, 16 nt, Pseudomonas aeruginosa PA01
guuccuguucgcugcc

SEQ ID NO: 3470264 - RNA, 13 nt, Pseudomonas aeruginosa PA01
guuccuucgccga

SEQ ID NO: 3470265 - RNA, 16 nt, Pseudomonas aeruginosa PA01
guucgaagcgccaggc

SEQ ID NO: 3470266 - RNA, 17 nt, Pseudomonas aeruginosa PA01
guucgaagcgccaggcg

SEQ ID NO: 3470267 - RNA, 14 nt, Pseudomonas aeruginosa PA01
guucgaaggccagu

SEQ ID NO: 3470268 - RNA, 19 nt, Pseudomonas aeruginosa PA01
guucgaaguucuccagcaa

SEQ ID NO: 3470269 - RNA, 22 nt, Pseudomonas aeruginosa PA01
guucgaaguucuccagcaagcc

SEQ ID NO: 3470270 - RNA, 16 nt, Pseudomonas aeruginosa PA01
guucgaauccuacacg

SEQ ID NO: 3470271 - RNA, 16 nt, Pseudomonas aeruginosa PA01
guucgaaugcugcccg

SEQ ID NO: 3470272 - RNA, 20 nt, Pseudomonas aeruginosa PA01
guucgaccuccaggccgaag

SEQ ID NO: 3470273 - RNA, 14 nt, Pseudomonas aeruginosa PA01
guucgaggcgccga

SEQ ID NO: 3470274 - RNA, 16 nt, Pseudomonas aeruginosa PA01
guucgaggcgccgacc

SEQ ID NO: 3470275 - RNA, 19 nt, Pseudomonas aeruginosa PA01
guucgaggcgccgaccacg

SEQ ID NO: 3470276 - RNA, 13 nt, Pseudomonas aeruginosa PA01
guucgaucuugua

SEQ ID NO: 3470277 - RNA, 15 nt, Pseudomonas aeruginosa PA01
guucgcaggccaggc

SEQ ID NO: 3470278 - RNA, 16 nt, Pseudomonas aeruginosa PA01
guucgcaggccaggcg

SEQ ID NO: 3470279 - RNA, 19 nt, Pseudomonas aeruginosa PA01
guucgcaggccaggcgcag

SEQ ID NO: 3470280 - RNA, 20 nt, Pseudomonas aeruginosa PA01
guucgccaaaaaaagccccg

SEQ ID NO: 3470281 - RNA, 15 nt, Pseudomonas aeruginosa PA01
guucgccacgcugcu

SEQ ID NO: 3470282 - RNA, 21 nt, Pseudomonas aeruginosa PA01
guucgccacgcugcugccggc

SEQ ID NO: 3470283 - RNA, 22 nt, Pseudomonas aeruginosa PA01
guucgccccgccgccaggcggc

SEQ ID NO: 3470284 - RNA, 15 nt, Pseudomonas aeruginosa PA01
guucgcccgcggcgg

SEQ ID NO: 3470285 - RNA, 13 nt, Pseudomonas aeruginosa PA01
guucgcccgcggg

SEQ ID NO: 3470286 - RNA, 14 nt, Pseudomonas aeruginosa PA01
guucgcccugcgga

SEQ ID NO: 3470287 - RNA, 17 nt, Pseudomonas aeruginosa PA01
guucgcccugcggaugg

SEQ ID NO: 3470288 - RNA, 21 nt, Pseudomonas aeruginosa PA01
guucgccgaaauagcgcgccc

SEQ ID NO: 3470289 - RNA, 12 nt, Pseudomonas aeruginosa PA01
guucgccgagcg

SEQ ID NO: 3470290 - RNA, 18 nt, Pseudomonas aeruginosa PA01
guucgccgaggcggcgca

SEQ ID NO: 3470291 - RNA, 20 nt, Pseudomonas aeruginosa PA01
guucgccgaggcggcgcagc

SEQ ID NO: 3470292 - RNA, 13 nt, Pseudomonas aeruginosa PA01
guucgccgccacc

SEQ ID NO: 3470293 - RNA, 14 nt, Pseudomonas aeruginosa PA01
guucgccgccgagc

SEQ ID NO: 3470294 - RNA, 17 nt, Pseudomonas aeruginosa PA01
guucgccgccgagcgcc

SEQ ID NO: 3470295 - RNA, 20 nt, Pseudomonas aeruginosa PA01
guucgccgccgagcgccugg

SEQ ID NO: 3470296 - RNA, 22 nt, Pseudomonas aeruginosa PA01
guucgccgccgagcgccuggca

SEQ ID NO: 3470297 - RNA, 12 nt, Pseudomonas aeruginosa PA01
guucgccgccgc

SEQ ID NO: 3470298 - RNA, 12 nt, Pseudomonas aeruginosa PA01
guucgccggcca

SEQ ID NO: 3470299 - RNA, 14 nt, Pseudomonas aeruginosa PA01
guucgccggccagc

SEQ ID NO: 3470300 - RNA, 18 nt, Pseudomonas aeruginosa PA01
guucgccggccagcaccu

SEQ ID NO: 3470301 - RNA, 19 nt, Pseudomonas aeruginosa PA01
guucgccggccuccagcac

SEQ ID NO: 3470302 - RNA, 15 nt, Pseudomonas aeruginosa PA01
guucgccguucagcu

SEQ ID NO: 3470303 - RNA, 14 nt, Pseudomonas aeruginosa PA01
guugaaggcgcggu

SEQ ID NO: 3470304 - RNA, 15 nt, Pseudomonas aeruginosa PA01
guugaaggcgcgguc

SEQ ID NO: 3470305 - RNA, 22 nt, Pseudomonas aeruginosa PA01
guugaccagcgcgucgaccacc

SEQ ID NO: 3470306 - RNA, 17 nt, Pseudomonas aeruginosa PA01
guugaccccgcggccga

SEQ ID NO: 3470307 - RNA, 14 nt, Pseudomonas aeruginosa PA01
guugaccugcagcg

SEQ ID NO: 3470308 - RNA, 17 nt, Pseudomonas aeruginosa PA01
guugaccugcagcgccu

SEQ ID NO: 3470309 - RNA, 18 nt, Pseudomonas aeruginosa PA01
guugaccugcgaggcguc

SEQ ID NO: 3470310 - RNA, 17 nt, Pseudomonas aeruginosa PA01
guugaccuuggccauga

SEQ ID NO: 3470311 - RNA, 17 nt, Pseudomonas aeruginosa PA01
guugacgaucugcgagc

SEQ ID NO: 3470312 - RNA, 23 nt, Pseudomonas aeruginosa PA01
guugacgaugcggcccgccggcg

SEQ ID NO: 3470313 - RNA, 19 nt, Pseudomonas aeruginosa PA01
guugacgccaguuucuauc

SEQ ID NO: 3470314 - RNA, 15 nt, Pseudomonas aeruginosa PA01
guugacgcuggcuga

SEQ ID NO: 3470315 - RNA, 15 nt, Pseudomonas aeruginosa PA01
guugacgucgccgau

SEQ ID NO: 3470316 - RNA, 18 nt, Pseudomonas aeruginosa PA01
guugacgucgccgaugcg

SEQ ID NO: 3470317 - RNA, 19 nt, Pseudomonas aeruginosa PA01
guugacguucugcccgccg

SEQ ID NO: 3470318 - RNA, 17 nt, Pseudomonas aeruginosa PA01
guugagauccuggccgg

SEQ ID NO: 3470319 - RNA, 20 nt, Pseudomonas aeruginosa PA01
guugagauccuggccggcgg

SEQ ID NO: 3470320 - RNA, 21 nt, Pseudomonas aeruginosa PA01
guugagcaccggaaaggcguc

SEQ ID NO: 3470321 - RNA, 17 nt, Pseudomonas aeruginosa PA01
guugagcaccucgaccu

SEQ ID NO: 3470322 - RNA, 19 nt, Pseudomonas aeruginosa PA01
guugagcaccucgaccugg

SEQ ID NO: 3470323 - RNA, 16 nt, Pseudomonas aeruginosa PA01
guugaggcccaucagg

SEQ ID NO: 3470324 - RNA, 16 nt, Pseudomonas aeruginosa PA01
guugaggccguccagu

SEQ ID NO: 3470325 - RNA, 14 nt, Pseudomonas aeruginosa PA01
guugaggccgucga

SEQ ID NO: 3470326 - RNA, 14 nt, Pseudomonas aeruginosa PA01
guugaggcgcucgu

SEQ ID NO: 3470327 - RNA, 14 nt, Pseudomonas aeruginosa PA01
guugagggccgcgc

SEQ ID NO: 3470328 - RNA, 14 nt, Pseudomonas aeruginosa PA01
guugagggccuuga

SEQ ID NO: 3470329 - RNA, 21 nt, Pseudomonas aeruginosa PA01
guugagguagagcacgccguc

SEQ ID NO: 3470330 - RNA, 23 nt, Pseudomonas aeruginosa PA01
guugagguagagcacgccgucgc

SEQ ID NO: 3470331 - RNA, 16 nt, Pseudomonas aeruginosa PA01
guugagucgcgcgcgc

SEQ ID NO: 3470332 - RNA, 20 nt, Pseudomonas aeruginosa PA01
guugaguucgaagcgccagg

SEQ ID NO: 3470333 - RNA, 22 nt, Pseudomonas aeruginosa PA01
guugaguugcaggccggcgagc

SEQ ID NO: 3470334 - RNA, 22 nt, Pseudomonas aeruginosa PA01
guugaucaccaccggcuggcgg

SEQ ID NO: 3470335 - RNA, 16 nt, Pseudomonas aeruginosa PA01
guugaucaccgcggug

SEQ ID NO: 3470336 - RNA, 23 nt, Pseudomonas aeruginosa PA01
guugaucagguucggcagcgccu

SEQ ID NO: 3470337 - RNA, 15 nt, Pseudomonas aeruginosa PA01
guugauccugggcgc

SEQ ID NO: 3470338 - RNA, 16 nt, Pseudomonas aeruginosa PA01
guugaucgacgccagc

SEQ ID NO: 3470339 - RNA, 15 nt, Pseudomonas aeruginosa PA01
guugaucgccgcgcc

SEQ ID NO: 3470340 - RNA, 16 nt, Pseudomonas aeruginosa PA01
guugaucgccgcgccg

SEQ ID NO: 3470341 - RNA, 19 nt, Pseudomonas aeruginosa PA01
guugaucgccgcgccgccg

SEQ ID NO: 3470342 - RNA, 22 nt, Pseudomonas aeruginosa PA01
guugaucgccgcgccgccgagg

SEQ ID NO: 3470343 - RNA, 17 nt, Pseudomonas aeruginosa PA01
guugaucggcguggcgg

SEQ ID NO: 3470344 - RNA, 16 nt, Pseudomonas aeruginosa PA01
guugaugaagccgcga

SEQ ID NO: 3470345 - RNA, 20 nt, Pseudomonas aeruginosa PA01
guugaugaagccgcgaccgg

SEQ ID NO: 3470346 - RNA, 14 nt, Pseudomonas aeruginosa PA01
guugaugccgauca

SEQ ID NO: 3470347 - RNA, 23 nt, Pseudomonas aeruginosa PA01
guugaugccguuguggcaggcgc

SEQ ID NO: 3470348 - RNA, 16 nt, Pseudomonas aeruginosa PA01
guugaugucgaccacg

SEQ ID NO: 3470349 - RNA, 18 nt, Pseudomonas aeruginosa PA01
guugcacagcgcccagac

SEQ ID NO: 3470350 - RNA, 15 nt, Pseudomonas aeruginosa PA01
guugcacgcaggccg

SEQ ID NO: 3470351 - RNA, 21 nt, Pseudomonas aeruginosa PA01
guugcagagcggccaggucga

SEQ ID NO: 3470352 - RNA, 22 nt, Pseudomonas aeruginosa PA01
guugcagagcggccaggucgag

SEQ ID NO: 3470353 - RNA, 19 nt, Pseudomonas aeruginosa PA01
guugcagcacccccagcag

SEQ ID NO: 3470354 - RNA, 21 nt, Pseudomonas aeruginosa PA01
guugcagcacccccagcaggc

SEQ ID NO: 3470355 - RNA, 22 nt, Pseudomonas aeruginosa PA01
guugcagcacccccagcaggcc

SEQ ID NO: 3470356 - RNA, 15 nt, Pseudomonas aeruginosa PA01
guugcagccaccagc

SEQ ID NO: 3470357 - RNA, 14 nt, Pseudomonas aeruginosa PA01
guugcagcgccugu

SEQ ID NO: 3470358 - RNA, 19 nt, Pseudomonas aeruginosa PA01
guugcaggcagucccagaa

SEQ ID NO: 3470359 - RNA, 17 nt, Pseudomonas aeruginosa PA01
guugcaggccagcgcca

SEQ ID NO: 3470360 - RNA, 13 nt, Pseudomonas aeruginosa PA01
guugcaggcccag

SEQ ID NO: 3470361 - RNA, 12 nt, Pseudomonas aeruginosa PA01
guugcaggccgg

SEQ ID NO: 3470362 - RNA, 19 nt, Pseudomonas aeruginosa PA01
guugcagggcuugugcaga

SEQ ID NO: 3470363 - RNA, 24 nt, Pseudomonas aeruginosa PA01
guugcaguaccugcucacggccga

SEQ ID NO: 3470364 - RNA, 17 nt, Pseudomonas aeruginosa PA01
guugcaguccaggccgu

SEQ ID NO: 3470365 - RNA, 16 nt, Pseudomonas aeruginosa PA01
guugcagugcgccgca

SEQ ID NO: 3470366 - RNA, 18 nt, Pseudomonas aeruginosa PA01
guugccagacgaucagcg

SEQ ID NO: 3470367 - RNA, 13 nt, Pseudomonas aeruginosa PA01
guugccagcagcg

SEQ ID NO: 3470368 - RNA, 15 nt, Pseudomonas aeruginosa PA01
guugccagcagcgcu

SEQ ID NO: 3470369 - RNA, 13 nt, Pseudomonas aeruginosa PA01
guugccagccggc

SEQ ID NO: 3470370 - RNA, 15 nt, Pseudomonas aeruginosa PA01
guugccagccggccu

SEQ ID NO: 3470371 - RNA, 16 nt, Pseudomonas aeruginosa PA01
guugccagccggccuu

SEQ ID NO: 3470372 - RNA, 20 nt, Pseudomonas aeruginosa PA01
guugccaggaggauucgcca

SEQ ID NO: 3470373 - RNA, 15 nt, Pseudomonas aeruginosa PA01
guugccaggccggcg

SEQ ID NO: 3470374 - RNA, 17 nt, Pseudomonas aeruginosa PA01
guugccaggccggcgca

SEQ ID NO: 3470375 - RNA, 22 nt, Pseudomonas aeruginosa PA01
guugccagggauacucaugcag

SEQ ID NO: 3470376 - RNA, 20 nt, Pseudomonas aeruginosa PA01
guugccagguauuccgccca

SEQ ID NO: 3470377 - RNA, 13 nt, Pseudomonas aeruginosa PA01
guugcccaccagc

SEQ ID NO: 3470378 - RNA, 16 nt, Pseudomonas aeruginosa PA01
guugcccacggccagg

SEQ ID NO: 3470379 - RNA, 16 nt, Pseudomonas aeruginosa PA01
guugcccagcaggcuc

SEQ ID NO: 3470380 - RNA, 13 nt, Pseudomonas aeruginosa PA01
guugcccagcccc

SEQ ID NO: 3470381 - RNA, 22 nt, Pseudomonas aeruginosa PA01
guugcccagccccaccgccagg

SEQ ID NO: 3470382 - RNA, 17 nt, Pseudomonas aeruginosa PA01
guugcccucgcagccgg

SEQ ID NO: 3470383 - RNA, 14 nt, Pseudomonas aeruginosa PA01
guugcccucgcgcu

SEQ ID NO: 3470384 - RNA, 15 nt, Pseudomonas aeruginosa PA01
guugcccucgcgcug

SEQ ID NO: 3470385 - RNA, 18 nt, Pseudomonas aeruginosa PA01
guugcccugggccggcgc

SEQ ID NO: 3470386 - RNA, 24 nt, Pseudomonas aeruginosa PA01
guugccgaccgagcagcggacgca

SEQ ID NO: 3470387 - RNA, 14 nt, Pseudomonas aeruginosa PA01
guugccgaucaggc

SEQ ID NO: 3470388 - RNA, 18 nt, Pseudomonas aeruginosa PA01
guugccgaucaguggucg

SEQ ID NO: 3470389 - RNA, 22 nt, Pseudomonas aeruginosa PA01
guugccgaucaucuucuggaca

SEQ ID NO: 3470390 - RNA, 14 nt, Pseudomonas aeruginosa PA01
guugccgaugccgg

SEQ ID NO: 3470391 - RNA, 15 nt, Pseudomonas aeruginosa PA01
guugccgcagcagcg

SEQ ID NO: 3470392 - RNA, 16 nt, Pseudomonas aeruginosa PA01
guugccgcagcagcgg

SEQ ID NO: 3470393 - RNA, 12 nt, Pseudomonas aeruginosa PA01
guugccgccagc

SEQ ID NO: 3470394 - RNA, 12 nt, Pseudomonas aeruginosa PA01
guugccgccgau

SEQ ID NO: 3470395 - RNA, 14 nt, Pseudomonas aeruginosa PA01
guugccgccgauca

SEQ ID NO: 3470396 - RNA, 15 nt, Pseudomonas aeruginosa PA01
guugccgccgaucag

SEQ ID NO: 3470397 - RNA, 19 nt, Pseudomonas aeruginosa PA01
guugccgccgaucagcgcg

SEQ ID NO: 3470398 - RNA, 14 nt, Pseudomonas aeruginosa PA01
guugccgccgccga

SEQ ID NO: 3470399 - RNA, 17 nt, Pseudomonas aeruginosa PA01
guugccgccgcuggccu

SEQ ID NO: 3470400 - RNA, 18 nt, Pseudomonas aeruginosa PA01
guugccgccgcuggccug

SEQ ID NO: 3470401 - RNA, 12 nt, Pseudomonas aeruginosa PA01
guugccgcgcac

SEQ ID NO: 3470402 - RNA, 20 nt, Pseudomonas aeruginosa PA01
guugccgcgcaccaccgaga

SEQ ID NO: 3470403 - RNA, 12 nt, Pseudomonas aeruginosa PA01
guugccgcgcca

SEQ ID NO: 3470404 - RNA, 20 nt, Pseudomonas aeruginosa PA01
guugccgcgcgggccggcga

SEQ ID NO: 3470405 - RNA, 14 nt, Pseudomonas aeruginosa PA01
guugccgcgcuugc

SEQ ID NO: 3470406 - RNA, 19 nt, Pseudomonas aeruginosa PA01
guuggccuugagcaggcgg

SEQ ID NO: 3470407 - RNA, 17 nt, Pseudomonas aeruginosa PA01
guuggccuugaugccgg

SEQ ID NO: 3470408 - RNA, 20 nt, Pseudomonas aeruginosa PA01
guuggccuugaugccggcga

SEQ ID NO: 3470409 - RNA, 20 nt, Pseudomonas aeruginosa PA01
guuggcgaacuucaggccgg

SEQ ID NO: 3470410 - RNA, 21 nt, Pseudomonas aeruginosa PA01
guuggcgaacuucaggccggc

SEQ ID NO: 3470411 - RNA, 23 nt, Pseudomonas aeruginosa PA01
guuggcgaggacuuucuugacca

SEQ ID NO: 3470412 - RNA, 14 nt, Pseudomonas aeruginosa PA01
guuggcgaggucgc

SEQ ID NO: 3470413 - RNA, 15 nt, Pseudomonas aeruginosa PA01
guuggcgcaggccgg

SEQ ID NO: 3470414 - RNA, 15 nt, Pseudomonas aeruginosa PA01
guuggcgccgggcgc

SEQ ID NO: 3470415 - RNA, 17 nt, Pseudomonas aeruginosa PA01
guuggcgccuucggcga

SEQ ID NO: 3470416 - RNA, 18 nt, Pseudomonas aeruginosa PA01
guuggcgccuucggcgac

SEQ ID NO: 3470417 - RNA, 14 nt, Pseudomonas aeruginosa PA01
guuggcgcgaccgc

SEQ ID NO: 3470418 - RNA, 14 nt, Pseudomonas aeruginosa PA01
guuggcgcgggcga

SEQ ID NO: 3470419 - RNA, 13 nt, Pseudomonas aeruginosa PA01
guuggcgcucggc

SEQ ID NO: 3470420 - RNA, 15 nt, Pseudomonas aeruginosa PA01
guuggcggccaucag

SEQ ID NO: 3470421 - RNA, 16 nt, Pseudomonas aeruginosa PA01
guuggcggccaucagg

SEQ ID NO: 3470422 - RNA, 17 nt, Pseudomonas aeruginosa PA01
guuggcggccaucaggc

SEQ ID NO: 3470423 - RNA, 15 nt, Pseudomonas aeruginosa PA01
guuggcggccgacgg

SEQ ID NO: 3470424 - RNA, 16 nt, Pseudomonas aeruginosa PA01
guuggcggugccgcag

SEQ ID NO: 3470425 - RNA, 17 nt, Pseudomonas aeruginosa PA01
guuggcggugccgcaga

SEQ ID NO: 3470426 - RNA, 17 nt, Pseudomonas aeruginosa PA01
guuggcgucgcgcacga

SEQ ID NO: 3470427 - RNA, 21 nt, Pseudomonas aeruginosa PA01
guuggcgucgcgcacgaggau

SEQ ID NO: 3470428 - RNA, 16 nt, Pseudomonas aeruginosa PA01
guuggcuccgggccga

SEQ ID NO: 3470429 - RNA, 15 nt, Pseudomonas aeruginosa PA01
guuggcuggcggggu

SEQ ID NO: 3470430 - RNA, 14 nt, Pseudomonas aeruginosa PA01
guuggcuuccagcc

SEQ ID NO: 3470431 - RNA, 18 nt, Pseudomonas aeruginosa PA01
guugggauagcuuuccag

SEQ ID NO: 3470432 - RNA, 14 nt, Pseudomonas aeruginosa PA01
guugggcaggcgca

SEQ ID NO: 3470433 - RNA, 14 nt, Pseudomonas aeruginosa PA01
guugggcagggugu

SEQ ID NO: 3470434 - RNA, 12 nt, Pseudomonas aeruginosa PA01
guugggccggaa

SEQ ID NO: 3470435 - RNA, 21 nt, Pseudomonas aeruginosa PA01
guuggggcugcccaccaccag

SEQ ID NO: 3470436 - RNA, 14 nt, Pseudomonas aeruginosa PA01
guuggucggcacca

SEQ ID NO: 3470437 - RNA, 17 nt, Pseudomonas aeruginosa PA01
guuggucugcucggcga

SEQ ID NO: 3470438 - RNA, 21 nt, Pseudomonas aeruginosa PA01
guuggucuguugguggggcgc

SEQ ID NO: 3470439 - RNA, 13 nt, Pseudomonas aeruginosa PA01
guuggugcccuug

SEQ ID NO: 3470440 - RNA, 16 nt, Pseudomonas aeruginosa PA01
guugguggccgcgccg

SEQ ID NO: 3470441 - RNA, 17 nt, Pseudomonas aeruginosa PA01
guugguggggcgccggc

SEQ ID NO: 3470442 - RNA, 14 nt, Pseudomonas aeruginosa PA01
guuguacagcgagg

SEQ ID NO: 3470443 - RNA, 22 nt, Pseudomonas aeruginosa PA01
guuguacucgaucugucgcagc

SEQ ID NO: 3470444 - RNA, 16 nt, Pseudomonas aeruginosa PA01
guuguacuggccgaaa

SEQ ID NO: 3470445 - RNA, 17 nt, Pseudomonas aeruginosa PA01
guuguagaucggcagca

SEQ ID NO: 3470446 - RNA, 18 nt, Pseudomonas aeruginosa PA01
guuguagaucggcagcau

SEQ ID NO: 3470447 - RNA, 18 nt, Pseudomonas aeruginosa PA01
guuguagaugaucuccag

SEQ ID NO: 3470448 - RNA, 19 nt, Pseudomonas aeruginosa PA01
guuguagcguucggcgacc

SEQ ID NO: 3470449 - RNA, 16 nt, Pseudomonas aeruginosa PA01
guuguaggcgccgccg

SEQ ID NO: 3470450 - RNA, 11 nt, Pseudomonas aeruginosa PA01
guuguccaggg

SEQ ID NO: 3470451 - RNA, 19 nt, Pseudomonas aeruginosa PA01
guugucccugucccgccgc

SEQ ID NO: 3470452 - RNA, 14 nt, Pseudomonas aeruginosa PA01
guuguccucggcgg

SEQ ID NO: 3470453 - RNA, 15 nt, Pseudomonas aeruginosa PA01
guuguccucggcggc

SEQ ID NO: 3470454 - RNA, 14 nt, Pseudomonas aeruginosa PA01
guugucgcggcuga

SEQ ID NO: 3470455 - RNA, 20 nt, Pseudomonas aeruginosa PA01
guugucgcggcugacgaagu

SEQ ID NO: 3470456 - RNA, 15 nt, Pseudomonas aeruginosa PA01
guugucggccagcag

SEQ ID NO: 3470457 - RNA, 17 nt, Pseudomonas aeruginosa PA01
guugucggccagcagca

SEQ ID NO: 3470458 - RNA, 21 nt, Pseudomonas aeruginosa PA01
guugugaucgaccucgcgggc

SEQ ID NO: 3470459 - RNA, 14 nt, Pseudomonas aeruginosa PA01
guuguggcggcgcu

SEQ ID NO: 3470460 - RNA, 16 nt, Pseudomonas aeruginosa PA01
guuguggcggcgcuca

SEQ ID NO: 3470461 - RNA, 15 nt, Pseudomonas aeruginosa PA01
guuguggcuggccuc

SEQ ID NO: 3470462 - RNA, 17 nt, Pseudomonas aeruginosa PA01
guuguggcuggccucgg

SEQ ID NO: 3470463 - RNA, 14 nt, Pseudomonas aeruginosa PA01
guuguucgcgcacc

SEQ ID NO: 3470464 - RNA, 20 nt, Pseudomonas aeruginosa PA01
guuguugaacgucucggcga

SEQ ID NO: 3470465 - RNA, 15 nt, Pseudomonas aeruginosa PA01
guuguugaccgcagg

SEQ ID NO: 3470466 - RNA, 19 nt, Pseudomonas aeruginosa PA01
guuguugccggucuugccg

SEQ ID NO: 3470467 - RNA, 17 nt, Pseudomonas aeruginosa PA01
guuucaacucccaggac

SEQ ID NO: 3470468 - RNA, 20 nt, Pseudomonas aeruginosa PA01
guuucacggcggauaaccgc

SEQ ID NO: 3470469 - RNA, 17 nt, Pseudomonas aeruginosa PA01
guuucagaacgucggcg

SEQ ID NO: 3470470 - RNA, 22 nt, Pseudomonas aeruginosa PA01
guuucagcccacgcgccuggcc

SEQ ID NO: 3470471 - RNA, 23 nt, Pseudomonas aeruginosa PA01
guuucagcccacgcgccuggccg

SEQ ID NO: 3470472 - RNA, 20 nt, Pseudomonas aeruginosa PA01
guuucagcgcuugcuggcgc

SEQ ID NO: 3470473 - RNA, 11 nt, Pseudomonas aeruginosa PA01
guuucagcggg

SEQ ID NO: 3470474 - RNA, 20 nt, Pseudomonas aeruginosa PA01
guuucagcggguagcugcug

SEQ ID NO: 3470475 - RNA, 20 nt, Pseudomonas aeruginosa PA01
guuucauucgucgcugcacg

SEQ ID NO: 3470476 - RNA, 16 nt, Pseudomonas aeruginosa PA01
guuuccagcagcaccc

SEQ ID NO: 3470477 - RNA, 20 nt, Pseudomonas aeruginosa PA01
guuuccaggaugcaaccgcc

SEQ ID NO: 3470478 - RNA, 22 nt, Pseudomonas aeruginosa PA01
guuuccaggcucaccucgaagg

SEQ ID NO: 3470479 - RNA, 15 nt, Pseudomonas aeruginosa PA01
guuuccgaacuguau

SEQ ID NO: 3470480 - RNA, 17 nt, Pseudomonas aeruginosa PA01
guuuccgcuguccgccg

SEQ ID NO: 3470481 - RNA, 19 nt, Pseudomonas aeruginosa PA01
guuuccggcaugcuugcca

SEQ ID NO: 3470482 - RNA, 14 nt, Pseudomonas aeruginosa PA01
guuuccgugcgcug

SEQ ID NO: 3470483 - RNA, 16 nt, Pseudomonas aeruginosa PA01
guuuccgugcgcugcg

SEQ ID NO: 3470484 - RNA, 17 nt, Pseudomonas aeruginosa PA01
guuuccgugcgcugcgc

SEQ ID NO: 3470485 - RNA, 21 nt, Pseudomonas aeruginosa PA01
guuuccgugcgcugcgcguac

SEQ ID NO: 3470486 - RNA, 23 nt, Pseudomonas aeruginosa PA01
guuuccgugcggaaaccgcggcc

SEQ ID NO: 3470487 - RNA, 18 nt, Pseudomonas aeruginosa PA01
guuuccgugugcagcagg

SEQ ID NO: 3470488 - RNA, 20 nt, Pseudomonas aeruginosa PA01
guuuccucgaugauccgcuc

SEQ ID NO: 3470489 - RNA, 19 nt, Pseudomonas aeruginosa PA01
guuucgaagccgccgccga

SEQ ID NO: 3470490 - RNA, 16 nt, Pseudomonas aeruginosa PA01
guuucgaccggcgcgc

SEQ ID NO: 3470491 - RNA, 17 nt, Pseudomonas aeruginosa PA01
guuucgacgaugcucgg

SEQ ID NO: 3470492 - RNA, 15 nt, Pseudomonas aeruginosa PA01
guuucgccgccggcc

SEQ ID NO: 3470493 - RNA, 16 nt, Pseudomonas aeruginosa PA01
guuucgccgccggcca

SEQ ID NO: 3470494 - RNA, 16 nt, Pseudomonas aeruginosa PA01
guuucgcggaaggcgu

SEQ ID NO: 3470495 - RNA, 17 nt, Pseudomonas aeruginosa PA01
guuucgcugcugccgcg

SEQ ID NO: 3470496 - RNA, 14 nt, Pseudomonas aeruginosa PA01
guuucggccgcugc

SEQ ID NO: 3470497 - RNA, 15 nt, Pseudomonas aeruginosa PA01
guuucggccgcugcc

SEQ ID NO: 3470498 - RNA, 16 nt, Pseudomonas aeruginosa PA01
guuucggccgcugccg

SEQ ID NO: 3470499 - RNA, 21 nt, Pseudomonas aeruginosa PA01
guuucggccgcugccguugca

SEQ ID NO: 3470500 - RNA, 17 nt, Pseudomonas aeruginosa PA01
guuucggguccaggcgc

SEQ ID NO: 3470501 - RNA, 17 nt, Pseudomonas aeruginosa PA01
guuucucggcgauggcg

SEQ ID NO: 3470502 - RNA, 16 nt, Pseudomonas aeruginosa PA01
guuucucggucgccgc

SEQ ID NO: 3470503 - RNA, 18 nt, Pseudomonas aeruginosa PA01
guuucucggucgccgcca

SEQ ID NO: 3470504 - RNA, 19 nt, Pseudomonas aeruginosa PA01
guuucucggucgccgccag

SEQ ID NO: 3470505 - RNA, 14 nt, Pseudomonas aeruginosa PA01
guuucugcuggcca

SEQ ID NO: 3470506 - RNA, 20 nt, Pseudomonas aeruginosa PA01
guuucuuuuuauccggcgga

SEQ ID NO: 3470507 - RNA, 18 nt, Pseudomonas aeruginosa PA01
guuugcccagcgccgccu

SEQ ID NO: 3470508 - RNA, 22 nt, Pseudomonas aeruginosa PA01
guuugcgccgaauccaggccga

SEQ ID NO: 3470509 - RNA, 20 nt, Pseudomonas aeruginosa PA01
uaccaguagcgacagcaucu

SEQ ID NO: 3470510 - RNA, 22 nt, Pseudomonas aeruginosa PA01
uaccagugccgcggugcgggcc

SEQ ID NO: 3470511 - RNA, 22 nt, Pseudomonas aeruginosa PA01
uacccacaggguggcgggcggc

SEQ ID NO: 3470512 - RNA, 13 nt, Pseudomonas aeruginosa PA01
uacccagcgggca

SEQ ID NO: 3470513 - RNA, 14 nt, Pseudomonas aeruginosa PA01
uacccagggugcgc

SEQ ID NO: 3470514 - RNA, 18 nt, Pseudomonas aeruginosa PA01
uacccagggugcgccggg

SEQ ID NO: 3470515 - RNA, 20 nt, Pseudomonas aeruginosa PA01
uacccagggugcgccgggga

SEQ ID NO: 3470516 - RNA, 18 nt, Pseudomonas aeruginosa PA01
uacccagguaagcggcgu

SEQ ID NO: 3470517 - RNA, 21 nt, Pseudomonas aeruginosa PA01
uacccagguggucgaccaggc

SEQ ID NO: 3470518 - RNA, 11 nt, Pseudomonas aeruginosa PA01
uaccccagggg

SEQ ID NO: 3470519 - RNA, 15 nt, Pseudomonas aeruginosa PA01
uacccccucgaccuu

SEQ ID NO: 3470520 - RNA, 20 nt, Pseudomonas aeruginosa PA01
uaccccgaccaggucgcugg

SEQ ID NO: 3470521 - RNA, 13 nt, Pseudomonas aeruginosa PA01
uaccccgggucgc

SEQ ID NO: 3470522 - RNA, 19 nt, Pseudomonas aeruginosa PA01
uaccccgggucgcgcagcg

SEQ ID NO: 3470523 - RNA, 22 nt, Pseudomonas aeruginosa PA01
uaccccgggucgcgcagcggcu

SEQ ID NO: 3470524 - RNA, 17 nt, Pseudomonas aeruginosa PA01
uaccccguagcgcucgg

SEQ ID NO: 3470525 - RNA, 20 nt, Pseudomonas aeruginosa PA01
uaccccguuguacccggcgg

SEQ ID NO: 3470526 - RNA, 19 nt, Pseudomonas aeruginosa PA01
uacccgacaggcagcgccg

SEQ ID NO: 3470527 - RNA, 21 nt, Pseudomonas aeruginosa PA01
uacccgacaggcagcgccgcc

SEQ ID NO: 3470528 - RNA, 22 nt, Pseudomonas aeruginosa PA01
uacccgacaggcagcgccgccc

SEQ ID NO: 3470529 - RNA, 24 nt, Pseudomonas aeruginosa PA01
uacccgagacuugaucgcacggcg

SEQ ID NO: 3470530 - RNA, 14 nt, Pseudomonas aeruginosa PA01
uacccgccggccau

SEQ ID NO: 3470531 - RNA, 16 nt, Pseudomonas aeruginosa PA01
uacccgcgaccacagg

SEQ ID NO: 3470532 - RNA, 19 nt, Pseudomonas aeruginosa PA01
uacccgcgaccacaggcgg

SEQ ID NO: 3470533 - RNA, 13 nt, Pseudomonas aeruginosa PA01
uacccggcgcccc

SEQ ID NO: 3470534 - RNA, 22 nt, Pseudomonas aeruginosa PA01
uacccgugggggggaagggccg

SEQ ID NO: 3470535 - RNA, 23 nt, Pseudomonas aeruginosa PA01
uacccgugggggggaagggccgg

SEQ ID NO: 3470536 - RNA, 18 nt, Pseudomonas aeruginosa PA01
uacccucaggggugcagc

SEQ ID NO: 3470537 - RNA, 13 nt, Pseudomonas aeruginosa PA01
uacccucucccca

SEQ ID NO: 3470538 - RNA, 16 nt, Pseudomonas aeruginosa PA01
uacccuggccggccuc

SEQ ID NO: 3470539 - RNA, 17 nt, Pseudomonas aeruginosa PA01
uacccugggagccgccg

SEQ ID NO: 3470540 - RNA, 19 nt, Pseudomonas aeruginosa PA01
uacccuucaucccuucuuu

SEQ ID NO: 3470541 - RNA, 14 nt, Pseudomonas aeruginosa PA01
uaccgaaacagggc

SEQ ID NO: 3470542 - RNA, 19 nt, Pseudomonas aeruginosa PA01
uaccgacaugccccgccga

SEQ ID NO: 3470543 - RNA, 15 nt, Pseudomonas aeruginosa PA01
uaccgacggucggca

SEQ ID NO: 3470544 - RNA, 19 nt, Pseudomonas aeruginosa PA01
uaccgccacguacagcgcg

SEQ ID NO: 3470545 - RNA, 13 nt, Pseudomonas aeruginosa PA01
uaccgccagcgca

SEQ ID NO: 3470546 - RNA, 16 nt, Pseudomonas aeruginosa PA01
uaccgccagcgcaccu

SEQ ID NO: 3470547 - RNA, 18 nt, Pseudomonas aeruginosa PA01
uaccgccgagggcgccag

SEQ ID NO: 3470548 - RNA, 19 nt, Pseudomonas aeruginosa PA01
uaccgccgagggcgccagg

SEQ ID NO: 3470549 - RNA, 21 nt, Pseudomonas aeruginosa PA01
uaccgccgagggcgccaggug

SEQ ID NO: 3470550 - RNA, 18 nt, Pseudomonas aeruginosa PA01
uaccgccggcggcgauga

SEQ ID NO: 3470551 - RNA, 15 nt, Pseudomonas aeruginosa PA01
uaccgcgggcucagg

SEQ ID NO: 3470552 - RNA, 18 nt, Pseudomonas aeruginosa PA01
uaccgcuccccacucggc

SEQ ID NO: 3470553 - RNA, 16 nt, Pseudomonas aeruginosa PA01
uaccgcucucggugac

SEQ ID NO: 3470554 - RNA, 22 nt, Pseudomonas aeruginosa PA01
uaccgcugcgcgggucuugccg

SEQ ID NO: 3470555 - RNA, 14 nt, Pseudomonas aeruginosa PA01
uaccgcugcggccg

SEQ ID NO: 3470556 - RNA, 16 nt, Pseudomonas aeruginosa PA01
uaccgcugcggccggc

SEQ ID NO: 3470557 - RNA, 18 nt, Pseudomonas aeruginosa PA01
uaccgcugcgugccaggg

SEQ ID NO: 3470558 - RNA, 15 nt, Pseudomonas aeruginosa PA01
uaccgcuggccaggu

SEQ ID NO: 3470559 - RNA, 18 nt, Pseudomonas aeruginosa PA01
uaccgcugggacggcggc

SEQ ID NO: 3470560 - RNA, 17 nt, Pseudomonas aeruginosa PA01
uaccggagcgaacgaca

SEQ ID NO: 3470561 - RNA, 16 nt, Pseudomonas aeruginosa PA01
uaccggcaaggcgcug

SEQ ID NO: 3470562 - RNA, 21 nt, Pseudomonas aeruginosa PA01
uaccggcaaggcgcugaagcg

SEQ ID NO: 3470563 - RNA, 18 nt, Pseudomonas aeruginosa PA01
uaccggcaaggcggccuc

SEQ ID NO: 3470564 - RNA, 14 nt, Pseudomonas aeruginosa PA01
uaccggcagcgccg

SEQ ID NO: 3470565 - RNA, 17 nt, Pseudomonas aeruginosa PA01
uaccggcagcgccgagg

SEQ ID NO: 3470566 - RNA, 20 nt, Pseudomonas aeruginosa PA01
uaccggccaucagcaccagg

SEQ ID NO: 3470567 - RNA, 17 nt, Pseudomonas aeruginosa PA01
uaccggcgaccaccgcc

SEQ ID NO: 3470568 - RNA, 23 nt, Pseudomonas aeruginosa PA01
uaccgggccaggcaaugucguug

SEQ ID NO: 3470569 - RNA, 15 nt, Pseudomonas aeruginosa PA01
uaccguccgcgccgc

SEQ ID NO: 3470570 - RNA, 19 nt, Pseudomonas aeruginosa PA01
uaccguggaaccgauggcc

SEQ ID NO: 3470571 - RNA, 21 nt, Pseudomonas aeruginosa PA01
uaccguggaaccgauggccag

SEQ ID NO: 3470572 - RNA, 23 nt, Pseudomonas aeruginosa PA01
uaccuccagccagcagcccggcc

SEQ ID NO: 3470573 - RNA, 21 nt, Pseudomonas aeruginosa PA01
uaccucgaagcccagcgccug

SEQ ID NO: 3470574 - RNA, 22 nt, Pseudomonas aeruginosa PA01
uaccucgaagcccagcgccugc

SEQ ID NO: 3470575 - RNA, 13 nt, Pseudomonas aeruginosa PA01
uaccucgccaggc

SEQ ID NO: 3470576 - RNA, 14 nt, Pseudomonas aeruginosa PA01
uaccucuggcugaa

SEQ ID NO: 3470577 - RNA, 18 nt, Pseudomonas aeruginosa PA01
uaccugccggcacgcuca

SEQ ID NO: 3470578 - RNA, 23 nt, Pseudomonas aeruginosa PA01
uaccugcgaauugcgcuggaagu

SEQ ID NO: 3470579 - RNA, 14 nt, Pseudomonas aeruginosa PA01
uaccuggcgcugaa

SEQ ID NO: 3470580 - RNA, 16 nt, Pseudomonas aeruginosa PA01
uaccuucgagcaggag

SEQ ID NO: 3470581 - RNA, 17 nt, Pseudomonas aeruginosa PA01
uaccuugccggugcggu

SEQ ID NO: 3470582 - RNA, 20 nt, Pseudomonas aeruginosa PA01
uaccuuucuccccucaggcg

SEQ ID NO: 3470583 - RNA, 19 nt, Pseudomonas aeruginosa PA01
uacgaaaaaaaggcgcugc

SEQ ID NO: 3470584 - RNA, 23 nt, Pseudomonas aeruginosa PA01
uacgaaaaagccccugcgccuca

SEQ ID NO: 3470585 - RNA, 11 nt, Pseudomonas aeruginosa PA01
uacgcaccggc

SEQ ID NO: 3470586 - RNA, 13 nt, Pseudomonas aeruginosa PA01
uacgcaccggcuu

SEQ ID NO: 3470587 - RNA, 16 nt, Pseudomonas aeruginosa PA01
uacgcaucugcucgag

SEQ ID NO: 3470588 - RNA, 22 nt, Pseudomonas aeruginosa PA01
uacgccagggugcugcccaggg

SEQ ID NO: 3470589 - RNA, 22 nt, Pseudomonas aeruginosa PA01
uacgcccccuccccugugguca

SEQ ID NO: 3470590 - RNA, 21 nt, Pseudomonas aeruginosa PA01
uacgccccguuugccgucggc

SEQ ID NO: 3470591 - RNA, 15 nt, Pseudomonas aeruginosa PA01
uacgcccgcagccac

SEQ ID NO: 3470592 - RNA, 20 nt, Pseudomonas aeruginosa PA01
uacgcccuccagcacccagg

SEQ ID NO: 3470593 - RNA, 21 nt, Pseudomonas aeruginosa PA01
uacgccgcgcugcgccaggcc

SEQ ID NO: 3470594 - RNA, 17 nt, Pseudomonas aeruginosa PA01
uacgccggauuucacgg

SEQ ID NO: 3470595 - RNA, 21 nt, Pseudomonas aeruginosa PA01
uacgccggauuucacggcgga

SEQ ID NO: 3470596 - RNA, 19 nt, Pseudomonas aeruginosa PA01
uacgccggguuucacggcg

SEQ ID NO: 3470597 - RNA, 21 nt, Pseudomonas aeruginosa PA01
uacgccggguuucacggcgga

SEQ ID NO: 3470598 - RNA, 13 nt, Pseudomonas aeruginosa PA01
uacgcgcagcggu

SEQ ID NO: 3470599 - RNA, 20 nt, Pseudomonas aeruginosa PA01
uacgcguacgacuucggcga

SEQ ID NO: 3470600 - RNA, 13 nt, Pseudomonas aeruginosa PA01
uacgcucaggaag

SEQ ID NO: 3470601 - RNA, 20 nt, Pseudomonas aeruginosa PA01
uacgcuccggugccagggcg

SEQ ID NO: 3470602 - RNA, 12 nt, Pseudomonas aeruginosa PA01
uacgcucggcgu

SEQ ID NO: 3470603 - RNA, 13 nt, Pseudomonas aeruginosa PA01
uacgcucggcguc

SEQ ID NO: 3470604 - RNA, 17 nt, Pseudomonas aeruginosa PA01
uacgcucgggcccuccc

SEQ ID NO: 3470605 - RNA, 23 nt, Pseudomonas aeruginosa PA01
uacgcugcauguccgcaggcagg

SEQ ID NO: 3470606 - RNA, 12 nt, Pseudomonas aeruginosa PA01
uacgcuuggcca

SEQ ID NO: 3470607 - RNA, 21 nt, Pseudomonas aeruginosa PA01
uacgcuuggccaggucgucgc

SEQ ID NO: 3470608 - RNA, 16 nt, Pseudomonas aeruginosa PA01
uacggaggaaacccau

SEQ ID NO: 3470609 - RNA, 14 nt, Pseudomonas aeruginosa PA01
uacggaugcugaca

SEQ ID NO: 3470610 - RNA, 19 nt, Pseudomonas aeruginosa PA01
uacggaugcugucccaacc

SEQ ID NO: 3470611 - RNA, 16 nt, Pseudomonas aeruginosa PA01
uagcccuucuccgcca

SEQ ID NO: 3470612 - RNA, 14 nt, Pseudomonas aeruginosa PA01
uagccgaccaggcc

SEQ ID NO: 3470613 - RNA, 15 nt, Pseudomonas aeruginosa PA01
uagccgacgaaggcg

SEQ ID NO: 3470614 - RNA, 18 nt, Pseudomonas aeruginosa PA01
uagccgaggcggccgagg

SEQ ID NO: 3470615 - RNA, 20 nt, Pseudomonas aeruginosa PA01
uagccgaucaacgcggccag

SEQ ID NO: 3470616 - RNA, 24 nt, Pseudomonas aeruginosa PA01
uagccgaucaacgcggccagcagc

SEQ ID NO: 3470617 - RNA, 17 nt, Pseudomonas aeruginosa PA01
uagccgcaguccagggc

SEQ ID NO: 3470618 - RNA, 21 nt, Pseudomonas aeruginosa PA01
uagccgccuuguuccaggcgu

SEQ ID NO: 3470619 - RNA, 12 nt, Pseudomonas aeruginosa PA01
uagccgcgccgg

SEQ ID NO: 3470620 - RNA, 18 nt, Pseudomonas aeruginosa PA01
uagccgcgccggccgucc

SEQ ID NO: 3470621 - RNA, 16 nt, Pseudomonas aeruginosa PA01
uagccgcguacggucu

SEQ ID NO: 3470622 - RNA, 19 nt, Pseudomonas aeruginosa PA01
uagccggaaaacagcgagc

SEQ ID NO: 3470623 - RNA, 17 nt, Pseudomonas aeruginosa PA01
uagccggacuccgacgc

SEQ ID NO: 3470624 - RNA, 20 nt, Pseudomonas aeruginosa PA01
uagccggccaaccaccggcg

SEQ ID NO: 3470625 - RNA, 22 nt, Pseudomonas aeruginosa PA01
uagccggcgaaccaggcggccg

SEQ ID NO: 3470626 - RNA, 17 nt, Pseudomonas aeruginosa PA01
uagccggcgagcgccug

SEQ ID NO: 3470627 - RNA, 20 nt, Pseudomonas aeruginosa PA01
uagccggcgaucagcgcuuc

SEQ ID NO: 3470628 - RNA, 17 nt, Pseudomonas aeruginosa PA01
uagccggcgauccgcug

SEQ ID NO: 3470629 - RNA, 19 nt, Pseudomonas aeruginosa PA01
uagccggcgauccgcugca

SEQ ID NO: 3470630 - RNA, 14 nt, Pseudomonas aeruginosa PA01
uagccggcgaugcc

SEQ ID NO: 3470631 - RNA, 17 nt, Pseudomonas aeruginosa PA01
uagccggcgaugccgcc

SEQ ID NO: 3470632 - RNA, 21 nt, Pseudomonas aeruginosa PA01
uagccggcgaugugcggcgug

SEQ ID NO: 3470633 - RNA, 14 nt, Pseudomonas aeruginosa PA01
uagccggcgcgccc

SEQ ID NO: 3470634 - RNA, 17 nt, Pseudomonas aeruginosa PA01
uagccggcgcgcccggc

SEQ ID NO: 3470635 - RNA, 12 nt, Pseudomonas aeruginosa PA01
uagccggcgcgg

SEQ ID NO: 3470636 - RNA, 19 nt, Pseudomonas aeruginosa PA01
uagccggcgcggcgcagcg

SEQ ID NO: 3470637 - RNA, 15 nt, Pseudomonas aeruginosa PA01
uagccggggccguuc

SEQ ID NO: 3470638 - RNA, 19 nt, Pseudomonas aeruginosa PA01
uagccgucaagcaacggcg

SEQ ID NO: 3470639 - RNA, 18 nt, Pseudomonas aeruginosa PA01
uagccgucgaacagcagc

SEQ ID NO: 3470640 - RNA, 19 nt, Pseudomonas aeruginosa PA01
uagccgucgaacagcagcu

SEQ ID NO: 3470641 - RNA, 19 nt, Pseudomonas aeruginosa PA01
uagccgucguagcgcagcg

SEQ ID NO: 3470642 - RNA, 21 nt, Pseudomonas aeruginosa PA01
uagccgucguagcgcagcggc

SEQ ID NO: 3470643 - RNA, 22 nt, Pseudomonas aeruginosa PA01
uagccgucguagcgcagcggca

SEQ ID NO: 3470644 - RNA, 14 nt, Pseudomonas aeruginosa PA01
uagccgugcagcag

SEQ ID NO: 3470645 - RNA, 16 nt, Pseudomonas aeruginosa PA01
uagccgugcagcagcg

SEQ ID NO: 3470646 - RNA, 14 nt, Pseudomonas aeruginosa PA01
uagccguucgacgc

SEQ ID NO: 3470647 - RNA, 19 nt, Pseudomonas aeruginosa PA01
uagccguucgacgcugcua

SEQ ID NO: 3470648 - RNA, 16 nt, Pseudomonas aeruginosa PA01
uagccguugaggccgu

SEQ ID NO: 3470649 - RNA, 17 nt, Pseudomonas aeruginosa PA01
uagccguugaggccguc

SEQ ID NO: 3470650 - RNA, 16 nt, Pseudomonas aeruginosa PA01
uagccguugucgguga

SEQ ID NO: 3470651 - RNA, 14 nt, Pseudomonas aeruginosa PA01
uagccucaguaccu

SEQ ID NO: 3470652 - RNA, 14 nt, Pseudomonas aeruginosa PA01
uagccucccgccgc

SEQ ID NO: 3470653 - RNA, 18 nt, Pseudomonas aeruginosa PA01
uagccucccgccgcggcg

SEQ ID NO: 3470654 - RNA, 17 nt, Pseudomonas aeruginosa PA01
uagccugcggccagcgc

SEQ ID NO: 3470655 - RNA, 19 nt, Pseudomonas aeruginosa PA01
uagcgacccuucaacggcg

SEQ ID NO: 3470656 - RNA, 19 nt, Pseudomonas aeruginosa PA01
uagcgauaggccuugccuu

SEQ ID NO: 3470657 - RNA, 15 nt, Pseudomonas aeruginosa PA01
uagcgauugaacucg

SEQ ID NO: 3470658 - RNA, 14 nt, Pseudomonas aeruginosa PA01
uagcgcagccgcuc

SEQ ID NO: 3470659 - RNA, 19 nt, Pseudomonas aeruginosa PA01
uagcgcagguugcgcuggc

SEQ ID NO: 3470660 - RNA, 22 nt, Pseudomonas aeruginosa PA01
uagcgcagguugcgcuggcgca

SEQ ID NO: 3470661 - RNA, 16 nt, Pseudomonas aeruginosa PA01
uagcgcaguccgguag

SEQ ID NO: 3470662 - RNA, 23 nt, Pseudomonas aeruginosa PA01
uagcgcaguccgguagcgcgccu

SEQ ID NO: 3470663 - RNA, 22 nt, Pseudomonas aeruginosa PA01
uagcgcaguucgccgccgagcg

SEQ ID NO: 3470664 - RNA, 23 nt, Pseudomonas aeruginosa PA01
uagcgcaguucgccgccgagcgc

SEQ ID NO: 3470665 - RNA, 23 nt, Pseudomonas aeruginosa PA01
uagcgcaugccguuggccgagcg

SEQ ID NO: 3470666 - RNA, 20 nt, Pseudomonas aeruginosa PA01
uagcgccaggccuuggcccg

SEQ ID NO: 3470667 - RNA, 17 nt, Pseudomonas aeruginosa PA01
uagcgccccggccgcgc

SEQ ID NO: 3470668 - RNA, 19 nt, Pseudomonas aeruginosa PA01
uagcgccccggccgcgcca

SEQ ID NO: 3470669 - RNA, 22 nt, Pseudomonas aeruginosa PA01
uagcgccccggccgcgccagcc

SEQ ID NO: 3470670 - RNA, 14 nt, Pseudomonas aeruginosa PA01
uagcgcccgacggc

SEQ ID NO: 3470671 - RNA, 14 nt, Pseudomonas aeruginosa PA01
uagcgccgcgggcg

SEQ ID NO: 3470672 - RNA, 13 nt, Pseudomonas aeruginosa PA01
uagcgcgccgagg

SEQ ID NO: 3470673 - RNA, 13 nt, Pseudomonas aeruginosa PA01
uagcgcgccgggu

SEQ ID NO: 3470674 - RNA, 11 nt, Pseudomonas aeruginosa PA01
uagcgcgccug

SEQ ID NO: 3470675 - RNA, 16 nt, Pseudomonas aeruginosa PA01
uagcgcgcuguagccg

SEQ ID NO: 3470676 - RNA, 20 nt, Pseudomonas aeruginosa PA01
uagcgcgcuguagccggcgc

SEQ ID NO: 3470677 - RNA, 16 nt, Pseudomonas aeruginosa PA01
uagcgcggcagcgcca

SEQ ID NO: 3470678 - RNA, 14 nt, Pseudomonas aeruginosa PA01
uagcgcuccagcuc

SEQ ID NO: 3470679 - RNA, 20 nt, Pseudomonas aeruginosa PA01
uagcgcuccagcuccuccag

SEQ ID NO: 3470680 - RNA, 21 nt, Pseudomonas aeruginosa PA01
uagcgcuccagcuccuccagc

SEQ ID NO: 3470681 - RNA, 19 nt, Pseudomonas aeruginosa PA01
uagcgcuccucgcgcugcc

SEQ ID NO: 3470682 - RNA, 22 nt, Pseudomonas aeruginosa PA01
uagcgcucgccuaccggcgccg

SEQ ID NO: 3470683 - RNA, 14 nt, Pseudomonas aeruginosa PA01
uagcgcugcgccag

SEQ ID NO: 3470684 - RNA, 18 nt, Pseudomonas aeruginosa PA01
uagcgcugcgccaggcuu

SEQ ID NO: 3470685 - RNA, 14 nt, Pseudomonas aeruginosa PA01
uagcgcugcgcccg

SEQ ID NO: 3470686 - RNA, 21 nt, Pseudomonas aeruginosa PA01
uagcgcuucaucaggcugcug

SEQ ID NO: 3470687 - RNA, 17 nt, Pseudomonas aeruginosa PA01
uagcgcuucgcgcagcu

SEQ ID NO: 3470688 - RNA, 23 nt, Pseudomonas aeruginosa PA01
uagcgcuucgcgcagcucggcca

SEQ ID NO: 3470689 - RNA, 23 nt, Pseudomonas aeruginosa PA01
uagcggaccccggccuccaggcu

SEQ ID NO: 3470690 - RNA, 15 nt, Pseudomonas aeruginosa PA01
uagcggaugugcagg

SEQ ID NO: 3470691 - RNA, 20 nt, Pseudomonas aeruginosa PA01
uagcggccauugucggccuc

SEQ ID NO: 3470692 - RNA, 22 nt, Pseudomonas aeruginosa PA01
uagcggcguucgccgagcaagc

SEQ ID NO: 3470693 - RNA, 16 nt, Pseudomonas aeruginosa PA01
uagcgggcauccagcg

SEQ ID NO: 3470694 - RNA, 20 nt, Pseudomonas aeruginosa PA01
uagcgggcauccagcggacg

SEQ ID NO: 3470695 - RNA, 13 nt, Pseudomonas aeruginosa PA01
uagcgggccagca

SEQ ID NO: 3470696 - RNA, 17 nt, Pseudomonas aeruginosa PA01
uagcgggccagcagcuc

SEQ ID NO: 3470697 - RNA, 21 nt, Pseudomonas aeruginosa PA01
uagcgguagccgucaagcaac

SEQ ID NO: 3470698 - RNA, 16 nt, Pseudomonas aeruginosa PA01
uagcggucgugcagca

SEQ ID NO: 3470699 - RNA, 17 nt, Pseudomonas aeruginosa PA01
uagcggucgugcagcag

SEQ ID NO: 3470700 - RNA, 13 nt, Pseudomonas aeruginosa PA01
uagcguccagcuc

SEQ ID NO: 3470701 - RNA, 20 nt, Pseudomonas aeruginosa PA01
uagcgucgcgcggccagcgu

SEQ ID NO: 3470702 - RNA, 12 nt, Pseudomonas aeruginosa PA01
uagcgugccgcc

SEQ ID NO: 3470703 - RNA, 17 nt, Pseudomonas aeruginosa PA01
uagcguugacgcaguuc

SEQ ID NO: 3470704 - RNA, 15 nt, Pseudomonas aeruginosa PA01
uagcguugcgccaga

SEQ ID NO: 3470705 - RNA, 22 nt, Pseudomonas aeruginosa PA01
uagcguugcgccagaccagccc

SEQ ID NO: 3470706 - RNA, 21 nt, Pseudomonas aeruginosa PA01
uagcuaccgucggccugcaac

SEQ ID NO: 3470707 - RNA, 22 nt, Pseudomonas aeruginosa PA01
uagcucagcuggauagaguacu

SEQ ID NO: 3470708 - RNA, 21 nt, Pseudomonas aeruginosa PA01
uagcucagucgguagagcaaa

SEQ ID NO: 3470709 - RNA, 22 nt, Pseudomonas aeruginosa PA01
uagcugaagcugucgcccucgc

SEQ ID NO: 3470710 - RNA, 17 nt, Pseudomonas aeruginosa PA01
uagcugagcaggccgac

SEQ ID NO: 3470711 - RNA, 16 nt, Pseudomonas aeruginosa PA01
uagcugaggccguagc

SEQ ID NO: 3470712 - RNA, 17 nt, Pseudomonas aeruginosa PA01
uagcugaucucggcgac

SEQ ID NO: 3470713 - RNA, 22 nt, Pseudomonas aeruginosa PA01
uauccgccgcucacccuguccc

SEQ ID NO: 3470714 - RNA, 21 nt, Pseudomonas aeruginosa PA01
uauccgccggccggggcgcgc

SEQ ID NO: 3470715 - RNA, 13 nt, Pseudomonas aeruginosa PA01
uauccgccgucgg

SEQ ID NO: 3470716 - RNA, 17 nt, Pseudomonas aeruginosa PA01
uauccuccaggccgccg

SEQ ID NO: 3470717 - RNA, 17 nt, Pseudomonas aeruginosa PA01
uaucgaucacugccugg

SEQ ID NO: 3470718 - RNA, 14 nt, Pseudomonas aeruginosa PA01
uaucgaugcgcgcg

SEQ ID NO: 3470719 - RNA, 17 nt, Pseudomonas aeruginosa PA01
uaucgccaacgccaccg

SEQ ID NO: 3470720 - RNA, 13 nt, Pseudomonas aeruginosa PA01
uaucgcuuucagc

SEQ ID NO: 3470721 - RNA, 17 nt, Pseudomonas aeruginosa PA01
uaucggggccaggucgg

SEQ ID NO: 3470722 - RNA, 19 nt, Pseudomonas aeruginosa PA01
uaucucuuuuuaagagaau

SEQ ID NO: 3470723 - RNA, 13 nt, Pseudomonas aeruginosa PA01
uaugccucggcgg

SEQ ID NO: 3470724 - RNA, 17 nt, Pseudomonas aeruginosa PA01
uaugcgcccuaccuguc

SEQ ID NO: 3470725 - RNA, 19 nt, Pseudomonas aeruginosa PA01
uaugcgcccuaccuguccc

SEQ ID NO: 3470726 - RNA, 13 nt, Pseudomonas aeruginosa PA01
uaugcgccgccac

SEQ ID NO: 3470727 - RNA, 23 nt, Pseudomonas aeruginosa PA01
uaugcgccgccacgugcacgccg

SEQ ID NO: 3470728 - RNA, 20 nt, Pseudomonas aeruginosa PA01
uaugcgcggucaccaggguc

SEQ ID NO: 3470729 - RNA, 20 nt, Pseudomonas aeruginosa PA01
uauggccgacccgugcgccg

SEQ ID NO: 3470730 - RNA, 20 nt, Pseudomonas aeruginosa PA01
uauggcgggccuugcgacca

SEQ ID NO: 3470731 - RNA, 14 nt, Pseudomonas aeruginosa PA01
uauggcugcugugc

SEQ ID NO: 3470732 - RNA, 15 nt, Pseudomonas aeruginosa PA01
uauggcugcugugcg

SEQ ID NO: 3470733 - RNA, 13 nt, Pseudomonas aeruginosa PA01
uauggguggcccu

SEQ ID NO: 3470734 - RNA, 21 nt, Pseudomonas aeruginosa PA01
uauuccuugcgggaacuggcg

SEQ ID NO: 3470735 - RNA, 15 nt, Pseudomonas aeruginosa PA01
uauucgcccuacccc

SEQ ID NO: 3470736 - RNA, 15 nt, Pseudomonas aeruginosa PA01
uauucgcccuacgaa

SEQ ID NO: 3470737 - RNA, 17 nt, Pseudomonas aeruginosa PA01
uauucgccggccaggua

SEQ ID NO: 3470738 - RNA, 17 nt, Pseudomonas aeruginosa PA01
uauucgcgcucggcgag

SEQ ID NO: 3470739 - RNA, 20 nt, Pseudomonas aeruginosa PA01
uauuucgaaggguuccucuc

SEQ ID NO: 3470740 - RNA, 21 nt, Pseudomonas aeruginosa PA01
ucaaaaccagccuugagccuu

SEQ ID NO: 3470741 - RNA, 15 nt, Pseudomonas aeruginosa PA01
ucaaagggcagcggc

SEQ ID NO: 3470742 - RNA, 16 nt, Pseudomonas aeruginosa PA01
ucaacaagaauaggaa

SEQ ID NO: 3470743 - RNA, 12 nt, Pseudomonas aeruginosa PA01
ucaacaccagcg

SEQ ID NO: 3470744 - RNA, 22 nt, Pseudomonas aeruginosa PA01
ucaacaccagcgccgccaggca

SEQ ID NO: 3470745 - RNA, 22 nt, Pseudomonas aeruginosa PA01
ucaacauccugaaaagcgcugc

SEQ ID NO: 3470746 - RNA, 17 nt, Pseudomonas aeruginosa PA01
ucaaccacuccagcggg

SEQ ID NO: 3470747 - RNA, 18 nt, Pseudomonas aeruginosa PA01
ucaacccaccgaccacca

SEQ ID NO: 3470748 - RNA, 19 nt, Pseudomonas aeruginosa PA01
ucaaccccuggaucuccug

SEQ ID NO: 3470749 - RNA, 17 nt, Pseudomonas aeruginosa PA01
ucaacgaagucgcgagg

SEQ ID NO: 3470750 - RNA, 17 nt, Pseudomonas aeruginosa PA01
ucaacgaccgcccaggc

SEQ ID NO: 3470751 - RNA, 23 nt, Pseudomonas aeruginosa PA01
ucaacgaccgcccaggcugccgc

SEQ ID NO: 3470752 - RNA, 18 nt, Pseudomonas aeruginosa PA01
ucaacgccuggccacgcc

SEQ ID NO: 3470753 - RNA, 18 nt, Pseudomonas aeruginosa PA01
ucaacgcggccagcagca

SEQ ID NO: 3470754 - RNA, 18 nt, Pseudomonas aeruginosa PA01
ucaacggcgugccgggca

SEQ ID NO: 3470755 - RNA, 24 nt, Pseudomonas aeruginosa PA01
ucaacugcuuaccuugccggugcg

SEQ ID NO: 3470756 - RNA, 16 nt, Pseudomonas aeruginosa PA01
ucaacuggucgcagcc

SEQ ID NO: 3470757 - RNA, 15 nt, Pseudomonas aeruginosa PA01
ucaagacgaaaaagc

SEQ ID NO: 3470758 - RNA, 15 nt, Pseudomonas aeruginosa PA01
ucaagacggcccgca

SEQ ID NO: 3470759 - RNA, 13 nt, Pseudomonas aeruginosa PA01
ucaagcgcggaaa

SEQ ID NO: 3470760 - RNA, 19 nt, Pseudomonas aeruginosa PA01
ucaaggcagaaaaacccag

SEQ ID NO: 3470761 - RNA, 22 nt, Pseudomonas aeruginosa PA01
ucaaggcgaaacguccggcguc

SEQ ID NO: 3470762 - RNA, 22 nt, Pseudomonas aeruginosa PA01
ucaagggccaggaaaucgagcg

SEQ ID NO: 3470763 - RNA, 12 nt, Pseudomonas aeruginosa PA01
ucaagggcuggc

SEQ ID NO: 3470764 - RNA, 19 nt, Pseudomonas aeruginosa PA01
ucaagugucgaugaagaag

SEQ ID NO: 3470765 - RNA, 14 nt, Pseudomonas aeruginosa PA01
ucaaugacggggau

SEQ ID NO: 3470766 - RNA, 16 nt, Pseudomonas aeruginosa PA01
ucaaugcguuccuguc

SEQ ID NO: 3470767 - RNA, 21 nt, Pseudomonas aeruginosa PA01
ucaauucgcggacgccgaagc

SEQ ID NO: 3470768 - RNA, 20 nt, Pseudomonas aeruginosa PA01
ucaauugccgguagccggcg

SEQ ID NO: 3470769 - RNA, 13 nt, Pseudomonas aeruginosa PA01
ucacaaaggcguc

SEQ ID NO: 3470770 - RNA, 22 nt, Pseudomonas aeruginosa PA01
ucacauacaccuugcgacaggc

SEQ ID NO: 3470771 - RNA, 12 nt, Pseudomonas aeruginosa PA01
ucacaucgcccg

SEQ ID NO: 3470772 - RNA, 14 nt, Pseudomonas aeruginosa PA01
ucacaucgcccggc

SEQ ID NO: 3470773 - RNA, 22 nt, Pseudomonas aeruginosa PA01
ucacaucgcccggcagcaggcc

SEQ ID NO: 3470774 - RNA, 18 nt, Pseudomonas aeruginosa PA01
ucacaucguugaacucgc

SEQ ID NO: 3470775 - RNA, 14 nt, Pseudomonas aeruginosa PA01
ucacaugcaccagg

SEQ ID NO: 3470776 - RNA, 20 nt, Pseudomonas aeruginosa PA01
ucacaugcaccaggcccugc

SEQ ID NO: 3470777 - RNA, 18 nt, Pseudomonas aeruginosa PA01
ucacauggugggcgccgc

SEQ ID NO: 3470778 - RNA, 20 nt, Pseudomonas aeruginosa PA01
ucacauggugggcgccgcug

SEQ ID NO: 3470779 - RNA, 18 nt, Pseudomonas aeruginosa PA01
ucaccaccaccgcgccga

SEQ ID NO: 3470780 - RNA, 21 nt, Pseudomonas aeruginosa PA01
ucaccaccaccgcgccgaugu

SEQ ID NO: 3470781 - RNA, 19 nt, Pseudomonas aeruginosa PA01
ucaccaccagcaucagcag

SEQ ID NO: 3470782 - RNA, 18 nt, Pseudomonas aeruginosa PA01
ucaccaccagcgccgcca

SEQ ID NO: 3470783 - RNA, 12 nt, Pseudomonas aeruginosa PA01
ucaccaccggcu

SEQ ID NO: 3470784 - RNA, 20 nt, Pseudomonas aeruginosa PA01
ucaccaccggcuggcggcuc

SEQ ID NO: 3470785 - RNA, 21 nt, Pseudomonas aeruginosa PA01
ucaccaccggcuggcggcucg

SEQ ID NO: 3470786 - RNA, 16 nt, Pseudomonas aeruginosa PA01
ucaccaccuggauggu

SEQ ID NO: 3470787 - RNA, 17 nt, Pseudomonas aeruginosa PA01
ucaccaccuggauggug

SEQ ID NO: 3470788 - RNA, 22 nt, Pseudomonas aeruginosa PA01
ucaccacgcgauauccgccagg

SEQ ID NO: 3470789 - RNA, 24 nt, Pseudomonas aeruginosa PA01
ucaccacgcgauauccgccaggcg

SEQ ID NO: 3470790 - RNA, 16 nt, Pseudomonas aeruginosa PA01
ucaccacucgccagcg

SEQ ID NO: 3470791 - RNA, 14 nt, Pseudomonas aeruginosa PA01
ucaccagcaauugc

SEQ ID NO: 3470792 - RNA, 19 nt, Pseudomonas aeruginosa PA01
ucaccagcaauugccggcg

SEQ ID NO: 3470793 - RNA, 22 nt, Pseudomonas aeruginosa PA01
ucaccagcaauugccggcguga

SEQ ID NO: 3470794 - RNA, 12 nt, Pseudomonas aeruginosa PA01
ucaccagcacca

SEQ ID NO: 3470795 - RNA, 12 nt, Pseudomonas aeruginosa PA01
ucaccagcagcc

SEQ ID NO: 3470796 - RNA, 15 nt, Pseudomonas aeruginosa PA01
ucaccagcagccccg

SEQ ID NO: 3470797 - RNA, 13 nt, Pseudomonas aeruginosa PA01
ucaccagccacug

SEQ ID NO: 3470798 - RNA, 22 nt, Pseudomonas aeruginosa PA01
ucaccagccacugcuuggcgaa

SEQ ID NO: 3470799 - RNA, 12 nt, Pseudomonas aeruginosa PA01
ucaccagcgcca

SEQ ID NO: 3470800 - RNA, 12 nt, Pseudomonas aeruginosa PA01
ucaccagcgccg

SEQ ID NO: 3470801 - RNA, 21 nt, Pseudomonas aeruginosa PA01
ucaccagcgccgucaccagca

SEQ ID NO: 3470802 - RNA, 18 nt, Pseudomonas aeruginosa PA01
ucaccagcggcgagcagg

SEQ ID NO: 3470803 - RNA, 23 nt, Pseudomonas aeruginosa PA01
ucaccaggccgaacgggaaguag

SEQ ID NO: 3470804 - RNA, 16 nt, Pseudomonas aeruginosa PA01
ucaccaggcugccgcc

SEQ ID NO: 3470805 - RNA, 21 nt, Pseudomonas aeruginosa PA01
ucaccagggucggcaccugca

SEQ ID NO: 3470806 - RNA, 20 nt, Pseudomonas aeruginosa PA01
ucaccagguugcccggcuug

SEQ ID NO: 3470807 - RNA, 19 nt, Pseudomonas aeruginosa PA01
ucaccagguugugaucgac

SEQ ID NO: 3470808 - RNA, 20 nt, Pseudomonas aeruginosa PA01
ucaccagguugugaucgacc

SEQ ID NO: 3470809 - RNA, 15 nt, Pseudomonas aeruginosa PA01
ucacccccagcgagc

SEQ ID NO: 3470810 - RNA, 13 nt, Pseudomonas aeruginosa PA01
ucaccccgaccag

SEQ ID NO: 3470811 - RNA, 20 nt, Pseudomonas aeruginosa PA01
ucaccccgcaaccgcagacu

SEQ ID NO: 3470812 - RNA, 21 nt, Pseudomonas aeruginosa PA01
ucacccgcagcggcagcggcu

SEQ ID NO: 3470813 - RNA, 22 nt, Pseudomonas aeruginosa PA01
ucacccgcagcggcagcggcuc

SEQ ID NO: 3470814 - RNA, 17 nt, Pseudomonas aeruginosa PA01
ucacccgcccgccgucg

SEQ ID NO: 3470815 - RNA, 14 nt, Pseudomonas aeruginosa PA01
ucacggucuuggcg

SEQ ID NO: 3470816 - RNA, 17 nt, Pseudomonas aeruginosa PA01
ucacggucuuggcggcg

SEQ ID NO: 3470817 - RNA, 14 nt, Pseudomonas aeruginosa PA01
ucacggugacggug

SEQ ID NO: 3470818 - RNA, 21 nt, Pseudomonas aeruginosa PA01
ucacggugaggaccuggccgc

SEQ ID NO: 3470819 - RNA, 21 nt, Pseudomonas aeruginosa PA01
ucacggugaugguaucgccgu

SEQ ID NO: 3470820 - RNA, 15 nt, Pseudomonas aeruginosa PA01
ucacguagcccccgc

SEQ ID NO: 3470821 - RNA, 18 nt, Pseudomonas aeruginosa PA01
ucacguaggagccggcca

SEQ ID NO: 3470822 - RNA, 20 nt, Pseudomonas aeruginosa PA01
ucacguaggagccggccagg

SEQ ID NO: 3470823 - RNA, 22 nt, Pseudomonas aeruginosa PA01
ucacguaggagccggccaggcg

SEQ ID NO: 3470824 - RNA, 14 nt, Pseudomonas aeruginosa PA01
ucacguaguucugg

SEQ ID NO: 3470825 - RNA, 14 nt, Pseudomonas aeruginosa PA01
ucacguccagguug

SEQ ID NO: 3470826 - RNA, 17 nt, Pseudomonas aeruginosa PA01
ucacguccuugaccacg

SEQ ID NO: 3470827 - RNA, 14 nt, Pseudomonas aeruginosa PA01
ucacgucgcgcacc

SEQ ID NO: 3470828 - RNA, 21 nt, Pseudomonas aeruginosa PA01
ucacgucgcgcaccuggcggu

SEQ ID NO: 3470829 - RNA, 15 nt, Pseudomonas aeruginosa PA01
ucacgucggcgucca

SEQ ID NO: 3470830 - RNA, 18 nt, Pseudomonas aeruginosa PA01
ucacgucggcguuguaca

SEQ ID NO: 3470831 - RNA, 22 nt, Pseudomonas aeruginosa PA01
ucacgucguacucggcggggcg

SEQ ID NO: 3470832 - RNA, 20 nt, Pseudomonas aeruginosa PA01
ucacguugaacacaucgacc

SEQ ID NO: 3470833 - RNA, 23 nt, Pseudomonas aeruginosa PA01
ucacguugaacacaucgaccagg

SEQ ID NO: 3470834 - RNA, 14 nt, Pseudomonas aeruginosa PA01
ucacuacaggaccu

SEQ ID NO: 3470835 - RNA, 20 nt, Pseudomonas aeruginosa PA01
ucacucccaggcuggcggca

SEQ ID NO: 3470836 - RNA, 21 nt, Pseudomonas aeruginosa PA01
ucacuccugcguacagggaac

SEQ ID NO: 3470837 - RNA, 12 nt, Pseudomonas aeruginosa PA01
ucacucgccgcc

SEQ ID NO: 3470838 - RNA, 14 nt, Pseudomonas aeruginosa PA01
ucacucgccgccgu

SEQ ID NO: 3470839 - RNA, 14 nt, Pseudomonas aeruginosa PA01
ucacugcgagcacc

SEQ ID NO: 3470840 - RNA, 22 nt, Pseudomonas aeruginosa PA01
ucacugcgagcaccaugccgau

SEQ ID NO: 3470841 - RNA, 12 nt, Pseudomonas aeruginosa PA01
ucacugcgggcc

SEQ ID NO: 3470842 - RNA, 12 nt, Pseudomonas aeruginosa PA01
ucacuucaccuu

SEQ ID NO: 3470843 - RNA, 15 nt, Pseudomonas aeruginosa PA01
ucacuuccagcugcc

SEQ ID NO: 3470844 - RNA, 18 nt, Pseudomonas aeruginosa PA01
ucacuuccgucacgcccu

SEQ ID NO: 3470845 - RNA, 21 nt, Pseudomonas aeruginosa PA01
ucacuugaggaagugcagggc

SEQ ID NO: 3470846 - RNA, 20 nt, Pseudomonas aeruginosa PA01
ucagacacgaaaaagccggc

SEQ ID NO: 3470847 - RNA, 21 nt, Pseudomonas aeruginosa PA01
ucagacacgaaaaagccggcg

SEQ ID NO: 3470848 - RNA, 14 nt, Pseudomonas aeruginosa PA01
ucagaccacgcccu

SEQ ID NO: 3470849 - RNA, 16 nt, Pseudomonas aeruginosa PA01
ucagaccacgcccugc

SEQ ID NO: 3470850 - RNA, 22 nt, Pseudomonas aeruginosa PA01
ucagaccacgcccugcgccagc

SEQ ID NO: 3470851 - RNA, 21 nt, Pseudomonas aeruginosa PA01
ucagaccagcccuggcgcggc

SEQ ID NO: 3470852 - RNA, 23 nt, Pseudomonas aeruginosa PA01
ucagagcagggugaagcugcggc

SEQ ID NO: 3470853 - RNA, 14 nt, Pseudomonas aeruginosa PA01
ucagagcuggacga

SEQ ID NO: 3470854 - RNA, 16 nt, Pseudomonas aeruginosa PA01
ucagagucgcaccggg

SEQ ID NO: 3470855 - RNA, 16 nt, Pseudomonas aeruginosa PA01
ucagauacuccagcag

SEQ ID NO: 3470856 - RNA, 14 nt, Pseudomonas aeruginosa PA01
ucagaugcgguagg

SEQ ID NO: 3470857 - RNA, 22 nt, Pseudomonas aeruginosa PA01
ucagcaacugccaaccgcgcuc

SEQ ID NO: 3470858 - RNA, 17 nt, Pseudomonas aeruginosa PA01
ucagcaauuccgcagcc

SEQ ID NO: 3470859 - RNA, 16 nt, Pseudomonas aeruginosa PA01
ucagcacauggaucgg

SEQ ID NO: 3470860 - RNA, 19 nt, Pseudomonas aeruginosa PA01
ucagcaccagcggaccguc

SEQ ID NO: 3470861 - RNA, 22 nt, Pseudomonas aeruginosa PA01
ucagcaccagcggaccgucggg

SEQ ID NO: 3470862 - RNA, 13 nt, Pseudomonas aeruginosa PA01
ucagcaccaggaa

SEQ ID NO: 3470863 - RNA, 18 nt, Pseudomonas aeruginosa PA01
ucagcaccaggaagcccc

SEQ ID NO: 3470864 - RNA, 20 nt, Pseudomonas aeruginosa PA01
ucagcaccaggaagccccag

SEQ ID NO: 3470865 - RNA, 14 nt, Pseudomonas aeruginosa PA01
ucagcaccagggcc

SEQ ID NO: 3470866 - RNA, 18 nt, Pseudomonas aeruginosa PA01
ucagcaccagggccaggg

SEQ ID NO: 3470867 - RNA, 20 nt, Pseudomonas aeruginosa PA01
ucagcaccagggccagggcg

SEQ ID NO: 3470868 - RNA, 22 nt, Pseudomonas aeruginosa PA01
ucagcacgcccaguugcgccgc

SEQ ID NO: 3470869 - RNA, 23 nt, Pseudomonas aeruginosa PA01
ucagcacgcccaguugcgccgcc

SEQ ID NO: 3470870 - RNA, 14 nt, Pseudomonas aeruginosa PA01
ucagcacggcgcgg

SEQ ID NO: 3470871 - RNA, 18 nt, Pseudomonas aeruginosa PA01
ucagcacgucguccagcg

SEQ ID NO: 3470872 - RNA, 14 nt, Pseudomonas aeruginosa PA01
ucagcacuucggcg

SEQ ID NO: 3470873 - RNA, 20 nt, Pseudomonas aeruginosa PA01
ucagcacuucggcgcgcggc

SEQ ID NO: 3470874 - RNA, 23 nt, Pseudomonas aeruginosa PA01
ucagcagcaggauguccuuguuc

SEQ ID NO: 3470875 - RNA, 15 nt, Pseudomonas aeruginosa PA01
ucagcagcaggcgcu

SEQ ID NO: 3470876 - RNA, 19 nt, Pseudomonas aeruginosa PA01
ucagcagcaggcgcucggg

SEQ ID NO: 3470877 - RNA, 21 nt, Pseudomonas aeruginosa PA01
ucagcagcaugccgcucugcc

SEQ ID NO: 3470878 - RNA, 23 nt, Pseudomonas aeruginosa PA01
ucagcagcaugccgcucugccag

SEQ ID NO: 3470879 - RNA, 18 nt, Pseudomonas aeruginosa PA01
ucagcagcaugucgccgg

SEQ ID NO: 3470880 - RNA, 15 nt, Pseudomonas aeruginosa PA01
ucagcagcgccagua

SEQ ID NO: 3470881 - RNA, 14 nt, Pseudomonas aeruginosa PA01
ucagcagcgccgcc

SEQ ID NO: 3470882 - RNA, 17 nt, Pseudomonas aeruginosa PA01
ucagcagcgccgcccug

SEQ ID NO: 3470883 - RNA, 14 nt, Pseudomonas aeruginosa PA01
ucagcagcggcacc

SEQ ID NO: 3470884 - RNA, 18 nt, Pseudomonas aeruginosa PA01
ucagcagcggcacccggc

SEQ ID NO: 3470885 - RNA, 16 nt, Pseudomonas aeruginosa PA01
ucagcagcgggcgucc

SEQ ID NO: 3470886 - RNA, 21 nt, Pseudomonas aeruginosa PA01
ucagcaggcccgagccggacg

SEQ ID NO: 3470887 - RNA, 12 nt, Pseudomonas aeruginosa PA01
ucagcaggcugc

SEQ ID NO: 3470888 - RNA, 14 nt, Pseudomonas aeruginosa PA01
ucagcaggcugccg

SEQ ID NO: 3470889 - RNA, 17 nt, Pseudomonas aeruginosa PA01
ucagcaggucgcggccc

SEQ ID NO: 3470890 - RNA, 20 nt, Pseudomonas aeruginosa PA01
ucagcaggucgcggccccag

SEQ ID NO: 3470891 - RNA, 16 nt, Pseudomonas aeruginosa PA01
ucagcagugcggggcg

SEQ ID NO: 3470892 - RNA, 18 nt, Pseudomonas aeruginosa PA01
ucagcagugcggggcgcu

SEQ ID NO: 3470893 - RNA, 20 nt, Pseudomonas aeruginosa PA01
ucagcagugcggggcgcucg

SEQ ID NO: 3470894 - RNA, 22 nt, Pseudomonas aeruginosa PA01
ucagcagugcggggcgcucgcc

SEQ ID NO: 3470895 - RNA, 15 nt, Pseudomonas aeruginosa PA01
ucagcaucaggucgg

SEQ ID NO: 3470896 - RNA, 18 nt, Pseudomonas aeruginosa PA01
ucagcauggggcggcacg

SEQ ID NO: 3470897 - RNA, 18 nt, Pseudomonas aeruginosa PA01
ucagccaccugcucgcug

SEQ ID NO: 3470898 - RNA, 19 nt, Pseudomonas aeruginosa PA01
ucagccacggacgcgcagg

SEQ ID NO: 3470899 - RNA, 12 nt, Pseudomonas aeruginosa PA01
ucagccacgggc

SEQ ID NO: 3470900 - RNA, 16 nt, Pseudomonas aeruginosa PA01
ucagccacugccgccu

SEQ ID NO: 3470901 - RNA, 17 nt, Pseudomonas aeruginosa PA01
ucagccacugccgccuc

SEQ ID NO: 3470902 - RNA, 19 nt, Pseudomonas aeruginosa PA01
ucagccagaccggcagcgc

SEQ ID NO: 3470903 - RNA, 21 nt, Pseudomonas aeruginosa PA01
ucagccagaccggcagcgccg

SEQ ID NO: 3470904 - RNA, 22 nt, Pseudomonas aeruginosa PA01
ucagccagaccggcagcgccgc

SEQ ID NO: 3470905 - RNA, 14 nt, Pseudomonas aeruginosa PA01
ucagccagagcccg

SEQ ID NO: 3470906 - RNA, 15 nt, Pseudomonas aeruginosa PA01
ucagccagccgagca

SEQ ID NO: 3470907 - RNA, 16 nt, Pseudomonas aeruginosa PA01
ucagccagccggcgaa

SEQ ID NO: 3470908 - RNA, 13 nt, Pseudomonas aeruginosa PA01
ucagccagcggcg

SEQ ID NO: 3470909 - RNA, 22 nt, Pseudomonas aeruginosa PA01
ucagccagcggcgcuugcgggc

SEQ ID NO: 3470910 - RNA, 21 nt, Pseudomonas aeruginosa PA01
ucagccauagaguugcuuggc

SEQ ID NO: 3470911 - RNA, 18 nt, Pseudomonas aeruginosa PA01
ucagccauuggccgacgc

SEQ ID NO: 3470912 - RNA, 19 nt, Pseudomonas aeruginosa PA01
ucagccauuggccgacgcc

SEQ ID NO: 3470913 - RNA, 21 nt, Pseudomonas aeruginosa PA01
ucagccauuggccgacgccgc

SEQ ID NO: 3470914 - RNA, 23 nt, Pseudomonas aeruginosa PA01
ucagccauuggccgacgccgcug

SEQ ID NO: 3470915 - RNA, 12 nt, Pseudomonas aeruginosa PA01
ucagcccacccc

SEQ ID NO: 3470916 - RNA, 23 nt, Pseudomonas aeruginosa PA01
ucagcccacccccagcccggcca

SEQ ID NO: 3470917 - RNA, 21 nt, Pseudomonas aeruginosa PA01
ucagcgcuucucggcagcgcu

SEQ ID NO: 3470918 - RNA, 18 nt, Pseudomonas aeruginosa PA01
ucagcgcuugcuggcgcg

SEQ ID NO: 3470919 - RNA, 15 nt, Pseudomonas aeruginosa PA01
ucagcggaagcccag

SEQ ID NO: 3470920 - RNA, 19 nt, Pseudomonas aeruginosa PA01
ucagcggaagcccagcagg

SEQ ID NO: 3470921 - RNA, 18 nt, Pseudomonas aeruginosa PA01
ucagcggacaaccgccgu

SEQ ID NO: 3470922 - RNA, 19 nt, Pseudomonas aeruginosa PA01
ucagcggacaaccgccgua

SEQ ID NO: 3470923 - RNA, 12 nt, Pseudomonas aeruginosa PA01
ucagcggaccgg

SEQ ID NO: 3470924 - RNA, 23 nt, Pseudomonas aeruginosa PA01
ucagcggcacggucauggccagc

SEQ ID NO: 3470925 - RNA, 16 nt, Pseudomonas aeruginosa PA01
ucagcggcccagcgcc

SEQ ID NO: 3470926 - RNA, 21 nt, Pseudomonas aeruginosa PA01
ucagcggcccgagcaggcugc

SEQ ID NO: 3470927 - RNA, 14 nt, Pseudomonas aeruginosa PA01
ucagcggcgcagcc

SEQ ID NO: 3470928 - RNA, 15 nt, Pseudomonas aeruginosa PA01
ucagcggcgcagccu

SEQ ID NO: 3470929 - RNA, 18 nt, Pseudomonas aeruginosa PA01
ucagcggcgcagccucgc

SEQ ID NO: 3470930 - RNA, 15 nt, Pseudomonas aeruginosa PA01
ucagcggcggggcca

SEQ ID NO: 3470931 - RNA, 14 nt, Pseudomonas aeruginosa PA01
ucagcggcggugcg

SEQ ID NO: 3470932 - RNA, 20 nt, Pseudomonas aeruginosa PA01
ucagcggcggugcgccggcg

SEQ ID NO: 3470933 - RNA, 22 nt, Pseudomonas aeruginosa PA01
ucagcggcggugcgccggcggg

SEQ ID NO: 3470934 - RNA, 22 nt, Pseudomonas aeruginosa PA01
ucagcggcguaugcgccuccag

SEQ ID NO: 3470935 - RNA, 23 nt, Pseudomonas aeruginosa PA01
ucagcgggacagcuugccgucca

SEQ ID NO: 3470936 - RNA, 22 nt, Pseudomonas aeruginosa PA01
ucagcggguaacccagggugcg

SEQ ID NO: 3470937 - RNA, 17 nt, Pseudomonas aeruginosa PA01
ucagcggguagcugcug

SEQ ID NO: 3470938 - RNA, 19 nt, Pseudomonas aeruginosa PA01
ucagcgggucgagccaggc

SEQ ID NO: 3470939 - RNA, 20 nt, Pseudomonas aeruginosa PA01
ucagcgggucgagccaggcg

SEQ ID NO: 3470940 - RNA, 21 nt, Pseudomonas aeruginosa PA01
ucagcggguuggcuuccagcc

SEQ ID NO: 3470941 - RNA, 23 nt, Pseudomonas aeruginosa PA01
ucagcggguuggcuuccagccag

SEQ ID NO: 3470942 - RNA, 17 nt, Pseudomonas aeruginosa PA01
ucagcuccacgucggcc

SEQ ID NO: 3470943 - RNA, 13 nt, Pseudomonas aeruginosa PA01
ucagcuccagcag

SEQ ID NO: 3470944 - RNA, 13 nt, Pseudomonas aeruginosa PA01
ucagcuccaggcc

SEQ ID NO: 3470945 - RNA, 15 nt, Pseudomonas aeruginosa PA01
ucagcuccaggccgc

SEQ ID NO: 3470946 - RNA, 17 nt, Pseudomonas aeruginosa PA01
ucagcuccaggccgcgg

SEQ ID NO: 3470947 - RNA, 15 nt, Pseudomonas aeruginosa PA01
ucagcucccaggcgu

SEQ ID NO: 3470948 - RNA, 19 nt, Pseudomonas aeruginosa PA01
ucagcucgaucagcccgcc

SEQ ID NO: 3470949 - RNA, 19 nt, Pseudomonas aeruginosa PA01
ucagcucgcguagcgcuuc

SEQ ID NO: 3470950 - RNA, 20 nt, Pseudomonas aeruginosa PA01
ucagcucggcaucgucgaag

SEQ ID NO: 3470951 - RNA, 13 nt, Pseudomonas aeruginosa PA01
ucagcucggcgau

SEQ ID NO: 3470952 - RNA, 16 nt, Pseudomonas aeruginosa PA01
ucagcucggcgaugcc

SEQ ID NO: 3470953 - RNA, 19 nt, Pseudomonas aeruginosa PA01
ucagcucggcgaugccgcc

SEQ ID NO: 3470954 - RNA, 21 nt, Pseudomonas aeruginosa PA01
ucagcucggcguagcgcuggg

SEQ ID NO: 3470955 - RNA, 17 nt, Pseudomonas aeruginosa PA01
ucagcucguugcccggc

SEQ ID NO: 3470956 - RNA, 23 nt, Pseudomonas aeruginosa PA01
ucagcucugucuccugugccuug

SEQ ID NO: 3470957 - RNA, 20 nt, Pseudomonas aeruginosa PA01
ucagcucuuccaggugaucc

SEQ ID NO: 3470958 - RNA, 15 nt, Pseudomonas aeruginosa PA01
ucagcugagucgcuu

SEQ ID NO: 3470959 - RNA, 16 nt, Pseudomonas aeruginosa PA01
ucagcuggcgcgccuc

SEQ ID NO: 3470960 - RNA, 19 nt, Pseudomonas aeruginosa PA01
ucagcuggcgcgccuccug

SEQ ID NO: 3470961 - RNA, 15 nt, Pseudomonas aeruginosa PA01
ucagcuucagcuccg

SEQ ID NO: 3470962 - RNA, 14 nt, Pseudomonas aeruginosa PA01
ucagcuucagggug

SEQ ID NO: 3470963 - RNA, 20 nt, Pseudomonas aeruginosa PA01
ucagcuucaggguggcgcug

SEQ ID NO: 3470964 - RNA, 14 nt, Pseudomonas aeruginosa PA01
ucagcuucgccgcc

SEQ ID NO: 3470965 - RNA, 13 nt, Pseudomonas aeruginosa PA01
ucagcuucuacuu

SEQ ID NO: 3470966 - RNA, 14 nt, Pseudomonas aeruginosa PA01
ucagcuuggccuug

SEQ ID NO: 3470967 - RNA, 17 nt, Pseudomonas aeruginosa PA01
ucaggaacgaagaaccc

SEQ ID NO: 3470968 - RNA, 14 nt, Pseudomonas aeruginosa PA01
ucaggaacgcgcca

SEQ ID NO: 3470969 - RNA, 22 nt, Pseudomonas aeruginosa PA01
ucaggaagaagccucgcgacug

SEQ ID NO: 3470970 - RNA, 18 nt, Pseudomonas aeruginosa PA01
ucaggaagacuucuggau

SEQ ID NO: 3470971 - RNA, 17 nt, Pseudomonas aeruginosa PA01
ucaggaccuuccgccag

SEQ ID NO: 3470972 - RNA, 18 nt, Pseudomonas aeruginosa PA01
ucaggaccuuccgccagc

SEQ ID NO: 3470973 - RNA, 21 nt, Pseudomonas aeruginosa PA01
ucaggaccuuccgccagcagg

SEQ ID NO: 3470974 - RNA, 22 nt, Pseudomonas aeruginosa PA01
ucaggaccuuccgccagcaggc

SEQ ID NO: 3470975 - RNA, 23 nt, Pseudomonas aeruginosa PA01
ucaggaccuuccgccagcaggcg

SEQ ID NO: 3470976 - RNA, 21 nt, Pseudomonas aeruginosa PA01
ucaggacgagcguccgccgcc

SEQ ID NO: 3470977 - RNA, 19 nt, Pseudomonas aeruginosa PA01
ucaggacgcuacgcucggg

SEQ ID NO: 3470978 - RNA, 22 nt, Pseudomonas aeruginosa PA01
ucaggacgcuacgcucggggug

SEQ ID NO: 3470979 - RNA, 22 nt, Pseudomonas aeruginosa PA01
ucaggacgcuccugcgccggcu

SEQ ID NO: 3470980 - RNA, 18 nt, Pseudomonas aeruginosa PA01
ucaggacguccuggccga

SEQ ID NO: 3470981 - RNA, 20 nt, Pseudomonas aeruginosa PA01
ucaggacguccuggccgagc

SEQ ID NO: 3470982 - RNA, 16 nt, Pseudomonas aeruginosa PA01
ucaggaggaucgccag

SEQ ID NO: 3470983 - RNA, 17 nt, Pseudomonas aeruginosa PA01
ucaggaggaucgccagg

SEQ ID NO: 3470984 - RNA, 23 nt, Pseudomonas aeruginosa PA01
ucaggaucacaucgcccggcagc

SEQ ID NO: 3470985 - RNA, 14 nt, Pseudomonas aeruginosa PA01
ucaggaucagguug

SEQ ID NO: 3470986 - RNA, 21 nt, Pseudomonas aeruginosa PA01
ucaggauguggccgucgcgcc

SEQ ID NO: 3470987 - RNA, 20 nt, Pseudomonas aeruginosa PA01
ucaggauguugacgauggcc

SEQ ID NO: 3470988 - RNA, 17 nt, Pseudomonas aeruginosa PA01
ucaggcaccucguccag

SEQ ID NO: 3470989 - RNA, 18 nt, Pseudomonas aeruginosa PA01
ucaggcagcgcgcggcca

SEQ ID NO: 3470990 - RNA, 19 nt, Pseudomonas aeruginosa PA01
ucaggcagcgcgcggccag

SEQ ID NO: 3470991 - RNA, 23 nt, Pseudomonas aeruginosa PA01
ucaggcaguccuugagcgccagc

SEQ ID NO: 3470992 - RNA, 20 nt, Pseudomonas aeruginosa PA01
ucaggcauccccggaccagg

SEQ ID NO: 3470993 - RNA, 19 nt, Pseudomonas aeruginosa PA01
ucaggccaaagccgcaauc

SEQ ID NO: 3470994 - RNA, 20 nt, Pseudomonas aeruginosa PA01
ucaggccaaagccgcaaucc

SEQ ID NO: 3470995 - RNA, 16 nt, Pseudomonas aeruginosa PA01
ucaggcccuugaggaa

SEQ ID NO: 3470996 - RNA, 22 nt, Pseudomonas aeruginosa PA01
ucaggcccuugagggccucggc

SEQ ID NO: 3470997 - RNA, 16 nt, Pseudomonas aeruginosa PA01
ucaggccgaagcuguc

SEQ ID NO: 3470998 - RNA, 17 nt, Pseudomonas aeruginosa PA01
ucaggccgaagcugucg

SEQ ID NO: 3470999 - RNA, 17 nt, Pseudomonas aeruginosa PA01
ucaggccgaccagcgcc

SEQ ID NO: 3471000 - RNA, 20 nt, Pseudomonas aeruginosa PA01
ucaggccgagaaaccgccau

SEQ ID NO: 3471001 - RNA, 16 nt, Pseudomonas aeruginosa PA01
ucaggccgagcaccgg

SEQ ID NO: 3471002 - RNA, 16 nt, Pseudomonas aeruginosa PA01
ucaggccgagcagcgc

SEQ ID NO: 3471003 - RNA, 17 nt, Pseudomonas aeruginosa PA01
ucaggccgagcagcgcc

SEQ ID NO: 3471004 - RNA, 21 nt, Pseudomonas aeruginosa PA01
ucaggccgagcagcgccagcc

SEQ ID NO: 3471005 - RNA, 12 nt, Pseudomonas aeruginosa PA01
ucaggccgaggu

SEQ ID NO: 3471006 - RNA, 15 nt, Pseudomonas aeruginosa PA01
ucaggccgaguccgc

SEQ ID NO: 3471007 - RNA, 13 nt, Pseudomonas aeruginosa PA01
ucaggccgccgcg

SEQ ID NO: 3471008 - RNA, 13 nt, Pseudomonas aeruginosa PA01
ucaggccgcggcc

SEQ ID NO: 3471009 - RNA, 18 nt, Pseudomonas aeruginosa PA01
ucaggccgcggcccugcg

SEQ ID NO: 3471010 - RNA, 20 nt, Pseudomonas aeruginosa PA01
ucaggccggaguccacggug

SEQ ID NO: 3471011 - RNA, 12 nt, Pseudomonas aeruginosa PA01
ucaggccggcgc

SEQ ID NO: 3471012 - RNA, 14 nt, Pseudomonas aeruginosa PA01
ucaggccggcgccg

SEQ ID NO: 3471013 - RNA, 16 nt, Pseudomonas aeruginosa PA01
ucaggccggcgccgcc

SEQ ID NO: 3471014 - RNA, 17 nt, Pseudomonas aeruginosa PA01
ucaggccggcgccgccg

SEQ ID NO: 3471015 - RNA, 13 nt, Pseudomonas aeruginosa PA01
ucaggccggcguc

SEQ ID NO: 3471016 - RNA, 23 nt, Pseudomonas aeruginosa PA01
ucaggccgggcaccccgagcggc

SEQ ID NO: 3471017 - RNA, 12 nt, Pseudomonas aeruginosa PA01
ucaggccgggcg

SEQ ID NO: 3471018 - RNA, 11 nt, Pseudomonas aeruginosa PA01
ucaggccuggc

SEQ ID NO: 3471019 - RNA, 23 nt, Pseudomonas aeruginosa PA01
ucagucgagcaguucccccagca

SEQ ID NO: 3471020 - RNA, 14 nt, Pseudomonas aeruginosa PA01
ucagucgcugcucg

SEQ ID NO: 3471021 - RNA, 17 nt, Pseudomonas aeruginosa PA01
ucagucggccaggcgcc

SEQ ID NO: 3471022 - RNA, 17 nt, Pseudomonas aeruginosa PA01
ucagucgguagagcaaa

SEQ ID NO: 3471023 - RNA, 23 nt, Pseudomonas aeruginosa PA01
ucagucgguuagaauaccggccu

SEQ ID NO: 3471024 - RNA, 15 nt, Pseudomonas aeruginosa PA01
ucagucgucguccag

SEQ ID NO: 3471025 - RNA, 14 nt, Pseudomonas aeruginosa PA01
ucagugaaagggaa

SEQ ID NO: 3471026 - RNA, 16 nt, Pseudomonas aeruginosa PA01
ucagugagccccggcg

SEQ ID NO: 3471027 - RNA, 18 nt, Pseudomonas aeruginosa PA01
ucagugagccccggcguc

SEQ ID NO: 3471028 - RNA, 18 nt, Pseudomonas aeruginosa PA01
ucagugcacguuccagcu

SEQ ID NO: 3471029 - RNA, 19 nt, Pseudomonas aeruginosa PA01
ucagugcacguuccagcuc

SEQ ID NO: 3471030 - RNA, 17 nt, Pseudomonas aeruginosa PA01
ucagugccagcagacgc

SEQ ID NO: 3471031 - RNA, 13 nt, Pseudomonas aeruginosa PA01
ucagugcgccggg

SEQ ID NO: 3471032 - RNA, 13 nt, Pseudomonas aeruginosa PA01
ucagugcucauca

SEQ ID NO: 3471033 - RNA, 16 nt, Pseudomonas aeruginosa PA01
ucaguggucgcagcuc

SEQ ID NO: 3471034 - RNA, 16 nt, Pseudomonas aeruginosa PA01
ucaguuccacgcggac

SEQ ID NO: 3471035 - RNA, 13 nt, Pseudomonas aeruginosa PA01
ucaguuccagguc

SEQ ID NO: 3471036 - RNA, 17 nt, Pseudomonas aeruginosa PA01
ucaguuccaggucggcg

SEQ ID NO: 3471037 - RNA, 21 nt, Pseudomonas aeruginosa PA01
ucaguuccgcaucggccaccu

SEQ ID NO: 3471038 - RNA, 13 nt, Pseudomonas aeruginosa PA01
ucaguuccucgcg

SEQ ID NO: 3471039 - RNA, 16 nt, Pseudomonas aeruginosa PA01
ucaguucggccagcgg

SEQ ID NO: 3471040 - RNA, 18 nt, Pseudomonas aeruginosa PA01
ucaguucggccagcggca

SEQ ID NO: 3471041 - RNA, 20 nt, Pseudomonas aeruginosa PA01
ucaguucggugccgccggcg

SEQ ID NO: 3471042 - RNA, 17 nt, Pseudomonas aeruginosa PA01
ucaguucugggcggcca

SEQ ID NO: 3471043 - RNA, 20 nt, Pseudomonas aeruginosa PA01
ucaguucugggcggccaggu

SEQ ID NO: 3471044 - RNA, 23 nt, Pseudomonas aeruginosa PA01
ucauacuugggucguuagcucag

SEQ ID NO: 3471045 - RNA, 15 nt, Pseudomonas aeruginosa PA01
ucauagcucagcugg

SEQ ID NO: 3471046 - RNA, 16 nt, Pseudomonas aeruginosa PA01
ucaucaccaggucgcu

SEQ ID NO: 3471047 - RNA, 22 nt, Pseudomonas aeruginosa PA01
ucaucaccaggucgcuguccuc

SEQ ID NO: 3471048 - RNA, 15 nt, Pseudomonas aeruginosa PA01
ucaucaccggcagga

SEQ ID NO: 3471049 - RNA, 13 nt, Pseudomonas aeruginosa PA01
ucaucaggcugcc

SEQ ID NO: 3471050 - RNA, 20 nt, Pseudomonas aeruginosa PA01
ucaucaggcugccgagcagg

SEQ ID NO: 3471051 - RNA, 13 nt, Pseudomonas aeruginosa PA01
ucauccacaggcg

SEQ ID NO: 3471052 - RNA, 16 nt, Pseudomonas aeruginosa PA01
ucauccgcaccauccg

SEQ ID NO: 3471053 - RNA, 20 nt, Pseudomonas aeruginosa PA01
ucauccgcaccauccgccgc

SEQ ID NO: 3471054 - RNA, 18 nt, Pseudomonas aeruginosa PA01
ucauccgcguggcgaugc

SEQ ID NO: 3471055 - RNA, 21 nt, Pseudomonas aeruginosa PA01
ucauccgcugguagcccaggc

SEQ ID NO: 3471056 - RNA, 23 nt, Pseudomonas aeruginosa PA01
ucauccgcugguagcccaggccg

SEQ ID NO: 3471057 - RNA, 13 nt, Pseudomonas aeruginosa PA01
ucauccugcgcgc

SEQ ID NO: 3471058 - RNA, 16 nt, Pseudomonas aeruginosa PA01
ucauccugcgcgccuc

SEQ ID NO: 3471059 - RNA, 14 nt, Pseudomonas aeruginosa PA01
ucauccuggcccug

SEQ ID NO: 3471060 - RNA, 15 nt, Pseudomonas aeruginosa PA01
ucaucgaaaugccgc

SEQ ID NO: 3471061 - RNA, 21 nt, Pseudomonas aeruginosa PA01
ucaucgaaaugccgcacccca

SEQ ID NO: 3471062 - RNA, 19 nt, Pseudomonas aeruginosa PA01
ucaucgagcggcggccguc

SEQ ID NO: 3471063 - RNA, 14 nt, Pseudomonas aeruginosa PA01
ucaucgccgccagg

SEQ ID NO: 3471064 - RNA, 23 nt, Pseudomonas aeruginosa PA01
ucaucgcgccaaugccgucgauc

SEQ ID NO: 3471065 - RNA, 24 nt, Pseudomonas aeruginosa PA01
ucaucgcguagguggcgccgccgg

SEQ ID NO: 3471066 - RNA, 17 nt, Pseudomonas aeruginosa PA01
ucaucgcgucgccgaac

SEQ ID NO: 3471067 - RNA, 14 nt, Pseudomonas aeruginosa PA01
ucaucggcccuggg

SEQ ID NO: 3471068 - RNA, 21 nt, Pseudomonas aeruginosa PA01
ucaucggcggcaggcgcauca

SEQ ID NO: 3471069 - RNA, 17 nt, Pseudomonas aeruginosa PA01
ucaucucgccgucggcg

SEQ ID NO: 3471070 - RNA, 13 nt, Pseudomonas aeruginosa PA01
ucaucuuggccca

SEQ ID NO: 3471071 - RNA, 15 nt, Pseudomonas aeruginosa PA01
ucaugaaaaagcccc

SEQ ID NO: 3471072 - RNA, 23 nt, Pseudomonas aeruginosa PA01
ucaugaaggaaaccggccagcgc

SEQ ID NO: 3471073 - RNA, 17 nt, Pseudomonas aeruginosa PA01
ucaugaagucagccagg

SEQ ID NO: 3471074 - RNA, 16 nt, Pseudomonas aeruginosa PA01
ucaugaccgccgcuca

SEQ ID NO: 3471075 - RNA, 17 nt, Pseudomonas aeruginosa PA01
ucaugagauccgccagc

SEQ ID NO: 3471076 - RNA, 19 nt, Pseudomonas aeruginosa PA01
ucaugagauccgccagcag

SEQ ID NO: 3471077 - RNA, 20 nt, Pseudomonas aeruginosa PA01
ucaugagauccgccagcaga

SEQ ID NO: 3471078 - RNA, 18 nt, Pseudomonas aeruginosa PA01
ucaugagguucaggccgg

SEQ ID NO: 3471079 - RNA, 17 nt, Pseudomonas aeruginosa PA01
ucaugcacuucgaccag

SEQ ID NO: 3471080 - RNA, 19 nt, Pseudomonas aeruginosa PA01
ucaugcacuucgaccagua

SEQ ID NO: 3471081 - RNA, 13 nt, Pseudomonas aeruginosa PA01
ucaugcaggccga

SEQ ID NO: 3471082 - RNA, 17 nt, Pseudomonas aeruginosa PA01
ucaugcccagcuucacc

SEQ ID NO: 3471083 - RNA, 14 nt, Pseudomonas aeruginosa PA01
ucaugcccaggccg

SEQ ID NO: 3471084 - RNA, 14 nt, Pseudomonas aeruginosa PA01
ucaugccgagcauc

SEQ ID NO: 3471085 - RNA, 18 nt, Pseudomonas aeruginosa PA01
ucaugccgagcaucagcg

SEQ ID NO: 3471086 - RNA, 21 nt, Pseudomonas aeruginosa PA01
ucaugccgccaucgaccagga

SEQ ID NO: 3471087 - RNA, 16 nt, Pseudomonas aeruginosa PA01
ucaugccgccgucgcg

SEQ ID NO: 3471088 - RNA, 21 nt, Pseudomonas aeruginosa PA01
ucaugccgccgucgcggccau

SEQ ID NO: 3471089 - RNA, 23 nt, Pseudomonas aeruginosa PA01
ucaugccgccgucgcggccaucg

SEQ ID NO: 3471090 - RNA, 14 nt, Pseudomonas aeruginosa PA01
ucaugccuucgauc

SEQ ID NO: 3471091 - RNA, 12 nt, Pseudomonas aeruginosa PA01
ucaugcgcgggc

SEQ ID NO: 3471092 - RNA, 18 nt, Pseudomonas aeruginosa PA01
ucauggaaaccccggccu

SEQ ID NO: 3471093 - RNA, 22 nt, Pseudomonas aeruginosa PA01
ucauggaaaccccggccuggcg

SEQ ID NO: 3471094 - RNA, 17 nt, Pseudomonas aeruginosa PA01
ucauggaacugcagggc

SEQ ID NO: 3471095 - RNA, 13 nt, Pseudomonas aeruginosa PA01
ucauggccaguca

SEQ ID NO: 3471096 - RNA, 13 nt, Pseudomonas aeruginosa PA01
ucauggcgccacu

SEQ ID NO: 3471097 - RNA, 19 nt, Pseudomonas aeruginosa PA01
ucauggcgccacucggcgu

SEQ ID NO: 3471098 - RNA, 20 nt, Pseudomonas aeruginosa PA01
ucaugggcgcgcgccgggcu

SEQ ID NO: 3471099 - RNA, 18 nt, Pseudomonas aeruginosa PA01
ucaugguccgucgcgcgc

SEQ ID NO: 3471100 - RNA, 19 nt, Pseudomonas aeruginosa PA01
ucauggugcccagcaggcu

SEQ ID NO: 3471101 - RNA, 14 nt, Pseudomonas aeruginosa PA01
ucauggugccgagc

SEQ ID NO: 3471102 - RNA, 15 nt, Pseudomonas aeruginosa PA01
ucauguagagcaggc

SEQ ID NO: 3471103 - RNA, 16 nt, Pseudomonas aeruginosa PA01
ucauguagagcaggcu

SEQ ID NO: 3471104 - RNA, 18 nt, Pseudomonas aeruginosa PA01
ucauguagagcaggcugc

SEQ ID NO: 3471105 - RNA, 13 nt, Pseudomonas aeruginosa PA01
ucauguuguucgc

SEQ ID NO: 3471106 - RNA, 15 nt, Pseudomonas aeruginosa PA01
ucauucauggcgcca

SEQ ID NO: 3471107 - RNA, 15 nt, Pseudomonas aeruginosa PA01
ucauucggccagcgc

SEQ ID NO: 3471108 - RNA, 14 nt, Pseudomonas aeruginosa PA01
ucauugcgcacggu

SEQ ID NO: 3471109 - RNA, 17 nt, Pseudomonas aeruginosa PA01
ucauuggcgcgucggug

SEQ ID NO: 3471110 - RNA, 19 nt, Pseudomonas aeruginosa PA01
ucauugugcguguucggcg

SEQ ID NO: 3471111 - RNA, 14 nt, Pseudomonas aeruginosa PA01
ucauuuccggcgua

SEQ ID NO: 3471112 - RNA, 19 nt, Pseudomonas aeruginosa PA01
ucauuuucgcgcucagcgc

SEQ ID NO: 3471113 - RNA, 14 nt, Pseudomonas aeruginosa PA01
uccaaagaaaagcc

SEQ ID NO: 3471114 - RNA, 17 nt, Pseudomonas aeruginosa PA01
uccaaccaguaggcgug

SEQ ID NO: 3471115 - RNA, 16 nt, Pseudomonas aeruginosa PA01
uccaacccauguggcg

SEQ ID NO: 3471116 - RNA, 22 nt, Pseudomonas aeruginosa PA01
uccaaccgggcaucgccgacca

SEQ ID NO: 3471117 - RNA, 21 nt, Pseudomonas aeruginosa PA01
uccaacgcaggcgcauggcgu

SEQ ID NO: 3471118 - RNA, 20 nt, Pseudomonas aeruginosa PA01
uccaacgcgcgaagcacgcu

SEQ ID NO: 3471119 - RNA, 21 nt, Pseudomonas aeruginosa PA01
uccaacuggcggcugggcugc

SEQ ID NO: 3471120 - RNA, 23 nt, Pseudomonas aeruginosa PA01
uccacaccgagacgugaagcccc

SEQ ID NO: 3471121 - RNA, 13 nt, Pseudomonas aeruginosa PA01
uccaccaccagca

SEQ ID NO: 3471122 - RNA, 18 nt, Pseudomonas aeruginosa PA01
uccagcagcacccggacc

SEQ ID NO: 3471123 - RNA, 11 nt, Pseudomonas aeruginosa PA01
uccagcaggca

SEQ ID NO: 3471124 - RNA, 17 nt, Pseudomonas aeruginosa PA01
uccagcaggcaggcgcg

SEQ ID NO: 3471125 - RNA, 11 nt, Pseudomonas aeruginosa PA01
uccagcaggcg

SEQ ID NO: 3471126 - RNA, 13 nt, Pseudomonas aeruginosa PA01
uccagcaggcgcu

SEQ ID NO: 3471127 - RNA, 17 nt, Pseudomonas aeruginosa PA01
uccagcagggccagcgc

SEQ ID NO: 3471128 - RNA, 19 nt, Pseudomonas aeruginosa PA01
uccagcagggccagcgccu

SEQ ID NO: 3471129 - RNA, 23 nt, Pseudomonas aeruginosa PA01
uccagcagggccagcgccuggcg

SEQ ID NO: 3471130 - RNA, 20 nt, Pseudomonas aeruginosa PA01
uccagcagggucgccugggu

SEQ ID NO: 3471131 - RNA, 15 nt, Pseudomonas aeruginosa PA01
uccagcagguacagc

SEQ ID NO: 3471132 - RNA, 20 nt, Pseudomonas aeruginosa PA01
uccagcaggucggcagcguc

SEQ ID NO: 3471133 - RNA, 15 nt, Pseudomonas aeruginosa PA01
uccagcagguucggc

SEQ ID NO: 3471134 - RNA, 21 nt, Pseudomonas aeruginosa PA01
uccagcagguucggcgguagc

SEQ ID NO: 3471135 - RNA, 17 nt, Pseudomonas aeruginosa PA01
uccagcagucgcggccc

SEQ ID NO: 3471136 - RNA, 18 nt, Pseudomonas aeruginosa PA01
uccagcagucgcggcccu

SEQ ID NO: 3471137 - RNA, 19 nt, Pseudomonas aeruginosa PA01
uccagcagucgcggcccug

SEQ ID NO: 3471138 - RNA, 22 nt, Pseudomonas aeruginosa PA01
uccagcaguucgucgccacgcc

SEQ ID NO: 3471139 - RNA, 23 nt, Pseudomonas aeruginosa PA01
uccagcauccagcgauacaccug

SEQ ID NO: 3471140 - RNA, 17 nt, Pseudomonas aeruginosa PA01
uccagccagcagcccgg

SEQ ID NO: 3471141 - RNA, 20 nt, Pseudomonas aeruginosa PA01
uccagccagcagcccggccu

SEQ ID NO: 3471142 - RNA, 15 nt, Pseudomonas aeruginosa PA01
uccagccagccgccu

SEQ ID NO: 3471143 - RNA, 23 nt, Pseudomonas aeruginosa PA01
uccagccagccgccuugcucgac

SEQ ID NO: 3471144 - RNA, 13 nt, Pseudomonas aeruginosa PA01
uccagccaggccc

SEQ ID NO: 3471145 - RNA, 14 nt, Pseudomonas aeruginosa PA01
uccagccaggcccg

SEQ ID NO: 3471146 - RNA, 12 nt, Pseudomonas aeruginosa PA01
uccagccaggcg

SEQ ID NO: 3471147 - RNA, 15 nt, Pseudomonas aeruginosa PA01
uccagccaggcgcuc

SEQ ID NO: 3471148 - RNA, 16 nt, Pseudomonas aeruginosa PA01
uccagccaggcgcucu

SEQ ID NO: 3471149 - RNA, 18 nt, Pseudomonas aeruginosa PA01
uccagccaggcgcucucg

SEQ ID NO: 3471150 - RNA, 15 nt, Pseudomonas aeruginosa PA01
uccagccaguggcug

SEQ ID NO: 3471151 - RNA, 17 nt, Pseudomonas aeruginosa PA01
uccagccaguggcuggc

SEQ ID NO: 3471152 - RNA, 17 nt, Pseudomonas aeruginosa PA01
uccagcccggcgugggc

SEQ ID NO: 3471153 - RNA, 23 nt, Pseudomonas aeruginosa PA01
uccagcccuggaaaggccucggc

SEQ ID NO: 3471154 - RNA, 18 nt, Pseudomonas aeruginosa PA01
uccagccgcugcagggcg

SEQ ID NO: 3471155 - RNA, 23 nt, Pseudomonas aeruginosa PA01
uccagccgcugcagggcggcgcu

SEQ ID NO: 3471156 - RNA, 21 nt, Pseudomonas aeruginosa PA01
uccagccggccauccagccag

SEQ ID NO: 3471157 - RNA, 21 nt, Pseudomonas aeruginosa PA01
uccagcgagaacuugccggcg

SEQ ID NO: 3471158 - RNA, 22 nt, Pseudomonas aeruginosa PA01
uccagcgagaacuugccggcgc

SEQ ID NO: 3471159 - RNA, 19 nt, Pseudomonas aeruginosa PA01
uccagcgagcgggcgaggg

SEQ ID NO: 3471160 - RNA, 23 nt, Pseudomonas aeruginosa PA01
uccagcgagcgggcgagggcggc

SEQ ID NO: 3471161 - RNA, 14 nt, Pseudomonas aeruginosa PA01
uccagcgcaccgcc

SEQ ID NO: 3471162 - RNA, 16 nt, Pseudomonas aeruginosa PA01
uccagcgccacuucca

SEQ ID NO: 3471163 - RNA, 18 nt, Pseudomonas aeruginosa PA01
uccagcgccacuuccagg

SEQ ID NO: 3471164 - RNA, 14 nt, Pseudomonas aeruginosa PA01
uccagcgccgcauu

SEQ ID NO: 3471165 - RNA, 20 nt, Pseudomonas aeruginosa PA01
uccagcgccgccaggcgcgu

SEQ ID NO: 3471166 - RNA, 24 nt, Pseudomonas aeruginosa PA01
uccagcgccgccucgaaggccggc

SEQ ID NO: 3471167 - RNA, 17 nt, Pseudomonas aeruginosa PA01
uccagcgccgcgcugcg

SEQ ID NO: 3471168 - RNA, 23 nt, Pseudomonas aeruginosa PA01
uccagcgccguucacgccuggcg

SEQ ID NO: 3471169 - RNA, 14 nt, Pseudomonas aeruginosa PA01
uccagcgccucgac

SEQ ID NO: 3471170 - RNA, 17 nt, Pseudomonas aeruginosa PA01
uccagcgccucgccgag

SEQ ID NO: 3471171 - RNA, 18 nt, Pseudomonas aeruginosa PA01
uccagcgccucgccgagc

SEQ ID NO: 3471172 - RNA, 15 nt, Pseudomonas aeruginosa PA01
uccagcgccucgggc

SEQ ID NO: 3471173 - RNA, 18 nt, Pseudomonas aeruginosa PA01
uccagcgccucgggccgg

SEQ ID NO: 3471174 - RNA, 16 nt, Pseudomonas aeruginosa PA01
uccagcgccuggauga

SEQ ID NO: 3471175 - RNA, 17 nt, Pseudomonas aeruginosa PA01
uccagcgccuggaugau

SEQ ID NO: 3471176 - RNA, 14 nt, Pseudomonas aeruginosa PA01
uccagcgccuggcg

SEQ ID NO: 3471177 - RNA, 20 nt, Pseudomonas aeruginosa PA01
uccagcgccuggcgcaguuc

SEQ ID NO: 3471178 - RNA, 20 nt, Pseudomonas aeruginosa PA01
uccagcgcgccgcgcaguuc

SEQ ID NO: 3471179 - RNA, 13 nt, Pseudomonas aeruginosa PA01
uccagcgcuggca

SEQ ID NO: 3471180 - RNA, 14 nt, Pseudomonas aeruginosa PA01
uccagcggcagcuc

SEQ ID NO: 3471181 - RNA, 21 nt, Pseudomonas aeruginosa PA01
uccagcggccgcgagcgcggc

SEQ ID NO: 3471182 - RNA, 22 nt, Pseudomonas aeruginosa PA01
uccagcggccgcgagcgcggcc

SEQ ID NO: 3471183 - RNA, 21 nt, Pseudomonas aeruginosa PA01
uccagcggcuccuggaugcuc

SEQ ID NO: 3471184 - RNA, 15 nt, Pseudomonas aeruginosa PA01
uccagcggcucgcug

SEQ ID NO: 3471185 - RNA, 11 nt, Pseudomonas aeruginosa PA01
uccagcggcuu

SEQ ID NO: 3471186 - RNA, 20 nt, Pseudomonas aeruginosa PA01
uccagcggcuuguccuggcg

SEQ ID NO: 3471187 - RNA, 22 nt, Pseudomonas aeruginosa PA01
uccagcgggaaggucggcagca

SEQ ID NO: 3471188 - RNA, 20 nt, Pseudomonas aeruginosa PA01
uccagcggggaugaccgucc

SEQ ID NO: 3471189 - RNA, 18 nt, Pseudomonas aeruginosa PA01
uccagcggguagaugcca

SEQ ID NO: 3471190 - RNA, 19 nt, Pseudomonas aeruginosa PA01
uccagcgguaccagcagcg

SEQ ID NO: 3471191 - RNA, 21 nt, Pseudomonas aeruginosa PA01
uccagcgucugccgcuggcgg

SEQ ID NO: 3471192 - RNA, 13 nt, Pseudomonas aeruginosa PA01
uccagcguggcgg

SEQ ID NO: 3471193 - RNA, 15 nt, Pseudomonas aeruginosa PA01
uccagcguguggcga

SEQ ID NO: 3471194 - RNA, 16 nt, Pseudomonas aeruginosa PA01
uccagcguguggcgaa

SEQ ID NO: 3471195 - RNA, 16 nt, Pseudomonas aeruginosa PA01
uccagcuccaccaggc

SEQ ID NO: 3471196 - RNA, 17 nt, Pseudomonas aeruginosa PA01
uccagcuccaccaggcc

SEQ ID NO: 3471197 - RNA, 13 nt, Pseudomonas aeruginosa PA01
uccagcuccucca

SEQ ID NO: 3471198 - RNA, 14 nt, Pseudomonas aeruginosa PA01
uccagcucggccau

SEQ ID NO: 3471199 - RNA, 13 nt, Pseudomonas aeruginosa PA01
uccagcucggcga

SEQ ID NO: 3471200 - RNA, 15 nt, Pseudomonas aeruginosa PA01
uccagcucggcgauc

SEQ ID NO: 3471201 - RNA, 16 nt, Pseudomonas aeruginosa PA01
uccagcucggcgaucc

SEQ ID NO: 3471202 - RNA, 23 nt, Pseudomonas aeruginosa PA01
uccagcucgucgagcugcucggc

SEQ ID NO: 3471203 - RNA, 13 nt, Pseudomonas aeruginosa PA01
uccagcuggcgca

SEQ ID NO: 3471204 - RNA, 13 nt, Pseudomonas aeruginosa PA01
uccagcuggcgcg

SEQ ID NO: 3471205 - RNA, 23 nt, Pseudomonas aeruginosa PA01
uccagcuggcgcguugugccgcc

SEQ ID NO: 3471206 - RNA, 21 nt, Pseudomonas aeruginosa PA01
uccagcuugcgccagagcagg

SEQ ID NO: 3471207 - RNA, 13 nt, Pseudomonas aeruginosa PA01
uccagcuugucca

SEQ ID NO: 3471208 - RNA, 16 nt, Pseudomonas aeruginosa PA01
uccaggaauccuccgc

SEQ ID NO: 3471209 - RNA, 20 nt, Pseudomonas aeruginosa PA01
uccaggaauccuccgccagc

SEQ ID NO: 3471210 - RNA, 22 nt, Pseudomonas aeruginosa PA01
uccaggaauccuccgccagcgu

SEQ ID NO: 3471211 - RNA, 22 nt, Pseudomonas aeruginosa PA01
uccaggaccaguucgccgccgc

SEQ ID NO: 3471212 - RNA, 17 nt, Pseudomonas aeruginosa PA01
uccaggagggaaugacu

SEQ ID NO: 3471213 - RNA, 20 nt, Pseudomonas aeruginosa PA01
uccaggaucgccuccaccag

SEQ ID NO: 3471214 - RNA, 21 nt, Pseudomonas aeruginosa PA01
uccaggcacgaauuuccuggc

SEQ ID NO: 3471215 - RNA, 17 nt, Pseudomonas aeruginosa PA01
uccaggcccauccuggc

SEQ ID NO: 3471216 - RNA, 22 nt, Pseudomonas aeruginosa PA01
uccaggcccauccuggcgauca

SEQ ID NO: 3471217 - RNA, 14 nt, Pseudomonas aeruginosa PA01
uccaggcccggcag

SEQ ID NO: 3471218 - RNA, 15 nt, Pseudomonas aeruginosa PA01
uccaggccgccggcg

SEQ ID NO: 3471219 - RNA, 21 nt, Pseudomonas aeruginosa PA01
uccaggccgccuauggcggau

SEQ ID NO: 3471220 - RNA, 21 nt, Pseudomonas aeruginosa PA01
uccaggccgcucaccgccacc

SEQ ID NO: 3471221 - RNA, 19 nt, Pseudomonas aeruginosa PA01
uccaggcgaaagucggcgc

SEQ ID NO: 3471222 - RNA, 19 nt, Pseudomonas aeruginosa PA01
uccaggcgaaggucgaagg

SEQ ID NO: 3471223 - RNA, 22 nt, Pseudomonas aeruginosa PA01
uccaggcgaaggucgaaggcgc

SEQ ID NO: 3471224 - RNA, 15 nt, Pseudomonas aeruginosa PA01
ucccacuccagcgcg

SEQ ID NO: 3471225 - RNA, 17 nt, Pseudomonas aeruginosa PA01
ucccacuccguccagug

SEQ ID NO: 3471226 - RNA, 18 nt, Pseudomonas aeruginosa PA01
ucccacuuccucggugau

SEQ ID NO: 3471227 - RNA, 14 nt, Pseudomonas aeruginosa PA01
ucccacuuguggug

SEQ ID NO: 3471228 - RNA, 18 nt, Pseudomonas aeruginosa PA01
ucccagaaggccagggca

SEQ ID NO: 3471229 - RNA, 16 nt, Pseudomonas aeruginosa PA01
ucccagaagucgcugg

SEQ ID NO: 3471230 - RNA, 19 nt, Pseudomonas aeruginosa PA01
ucccagaagucgcuggccu

SEQ ID NO: 3471231 - RNA, 15 nt, Pseudomonas aeruginosa PA01
ucccagaccacccgg

SEQ ID NO: 3471232 - RNA, 16 nt, Pseudomonas aeruginosa PA01
ucccagaccacccggc

SEQ ID NO: 3471233 - RNA, 16 nt, Pseudomonas aeruginosa PA01
ucccagaccagcagcg

SEQ ID NO: 3471234 - RNA, 20 nt, Pseudomonas aeruginosa PA01
ucccagaccagcagcggcag

SEQ ID NO: 3471235 - RNA, 15 nt, Pseudomonas aeruginosa PA01
ucccagaccuggccg

SEQ ID NO: 3471236 - RNA, 20 nt, Pseudomonas aeruginosa PA01
ucccagaccuggccgcugug

SEQ ID NO: 3471237 - RNA, 17 nt, Pseudomonas aeruginosa PA01
ucccagauaccggcguu

SEQ ID NO: 3471238 - RNA, 11 nt, Pseudomonas aeruginosa PA01
ucccagcagca

SEQ ID NO: 3471239 - RNA, 14 nt, Pseudomonas aeruginosa PA01
ucccagcagcgccu

SEQ ID NO: 3471240 - RNA, 18 nt, Pseudomonas aeruginosa PA01
ucccagcagcgccucggc

SEQ ID NO: 3471241 - RNA, 16 nt, Pseudomonas aeruginosa PA01
ucccagccgacguagg

SEQ ID NO: 3471242 - RNA, 13 nt, Pseudomonas aeruginosa PA01
ucccagccgaggc

SEQ ID NO: 3471243 - RNA, 14 nt, Pseudomonas aeruginosa PA01
ucccagccgaggca

SEQ ID NO: 3471244 - RNA, 21 nt, Pseudomonas aeruginosa PA01
ucccagccgaggcagccgucg

SEQ ID NO: 3471245 - RNA, 16 nt, Pseudomonas aeruginosa PA01
ucccagcgaguagucg

SEQ ID NO: 3471246 - RNA, 22 nt, Pseudomonas aeruginosa PA01
ucccagcgaguagucgcggggc

SEQ ID NO: 3471247 - RNA, 12 nt, Pseudomonas aeruginosa PA01
ucccaggccagc

SEQ ID NO: 3471248 - RNA, 16 nt, Pseudomonas aeruginosa PA01
ucccaggccagcgggc

SEQ ID NO: 3471249 - RNA, 18 nt, Pseudomonas aeruginosa PA01
ucccaggccagcgggcug

SEQ ID NO: 3471250 - RNA, 18 nt, Pseudomonas aeruginosa PA01
ucccaggcuggcggcaua

SEQ ID NO: 3471251 - RNA, 23 nt, Pseudomonas aeruginosa PA01
ucccagguagcgcugcgccaggc

SEQ ID NO: 3471252 - RNA, 20 nt, Pseudomonas aeruginosa PA01
ucccaggugguacggcugag

SEQ ID NO: 3471253 - RNA, 16 nt, Pseudomonas aeruginosa PA01
ucccauauggaaguuc

SEQ ID NO: 3471254 - RNA, 13 nt, Pseudomonas aeruginosa PA01
ucccaucagcagu

SEQ ID NO: 3471255 - RNA, 21 nt, Pseudomonas aeruginosa PA01
ucccaugaaaaauggccgcuu

SEQ ID NO: 3471256 - RNA, 20 nt, Pseudomonas aeruginosa PA01
ucccaugaccgucagccagg

SEQ ID NO: 3471257 - RNA, 15 nt, Pseudomonas aeruginosa PA01
ucccauggcgccacg

SEQ ID NO: 3471258 - RNA, 17 nt, Pseudomonas aeruginosa PA01
uccccaacccggccagc

SEQ ID NO: 3471259 - RNA, 19 nt, Pseudomonas aeruginosa PA01
uccccaacccggccagccc

SEQ ID NO: 3471260 - RNA, 22 nt, Pseudomonas aeruginosa PA01
uccccaacccggccagcccggc

SEQ ID NO: 3471261 - RNA, 15 nt, Pseudomonas aeruginosa PA01
uccccaaccuucucc

SEQ ID NO: 3471262 - RNA, 21 nt, Pseudomonas aeruginosa PA01
uccccaccaacucagucgagg

SEQ ID NO: 3471263 - RNA, 16 nt, Pseudomonas aeruginosa PA01
uccccacucggccagc

SEQ ID NO: 3471264 - RNA, 17 nt, Pseudomonas aeruginosa PA01
uccccagacccucuccc

SEQ ID NO: 3471265 - RNA, 18 nt, Pseudomonas aeruginosa PA01
uccccagacccucucccu

SEQ ID NO: 3471266 - RNA, 14 nt, Pseudomonas aeruginosa PA01
uccccagcaggcag

SEQ ID NO: 3471267 - RNA, 17 nt, Pseudomonas aeruginosa PA01
uccccagcaggcaggca

SEQ ID NO: 3471268 - RNA, 22 nt, Pseudomonas aeruginosa PA01
uccccaguagcgcuucgcgcag

SEQ ID NO: 3471269 - RNA, 14 nt, Pseudomonas aeruginosa PA01
ucccccagcaccug

SEQ ID NO: 3471270 - RNA, 16 nt, Pseudomonas aeruginosa PA01
ucccccagcaccugga

SEQ ID NO: 3471271 - RNA, 13 nt, Pseudomonas aeruginosa PA01
ucccccggccgau

SEQ ID NO: 3471272 - RNA, 13 nt, Pseudomonas aeruginosa PA01
ucccccgguccgg

SEQ ID NO: 3471273 - RNA, 21 nt, Pseudomonas aeruginosa PA01
ucccccguggcgacgcagcac

SEQ ID NO: 3471274 - RNA, 18 nt, Pseudomonas aeruginosa PA01
ucccccuuuuucggcgcg

SEQ ID NO: 3471275 - RNA, 16 nt, Pseudomonas aeruginosa PA01
uccccgaggcgacgcc

SEQ ID NO: 3471276 - RNA, 18 nt, Pseudomonas aeruginosa PA01
uccccgccacuuccagca

SEQ ID NO: 3471277 - RNA, 15 nt, Pseudomonas aeruginosa PA01
uccccgccgccaggc

SEQ ID NO: 3471278 - RNA, 16 nt, Pseudomonas aeruginosa PA01
uccccgccgccaggcg

SEQ ID NO: 3471279 - RNA, 22 nt, Pseudomonas aeruginosa PA01
uccccgccucgaccagcgccgc

SEQ ID NO: 3471280 - RNA, 21 nt, Pseudomonas aeruginosa PA01
uccccggaccagggcgccggg

SEQ ID NO: 3471281 - RNA, 20 nt, Pseudomonas aeruginosa PA01
uccccggccagcagcgccuc

SEQ ID NO: 3471282 - RNA, 20 nt, Pseudomonas aeruginosa PA01
uccccggcccgcgccgccuc

SEQ ID NO: 3471283 - RNA, 21 nt, Pseudomonas aeruginosa PA01
uccccggcggguucagcccgc

SEQ ID NO: 3471284 - RNA, 14 nt, Pseudomonas aeruginosa PA01
uccccgucccucag

SEQ ID NO: 3471285 - RNA, 15 nt, Pseudomonas aeruginosa PA01
uccccguccuggcgg

SEQ ID NO: 3471286 - RNA, 18 nt, Pseudomonas aeruginosa PA01
uccccguggcgccgcagg

SEQ ID NO: 3471287 - RNA, 22 nt, Pseudomonas aeruginosa PA01
uccccuaccggcaaggcgcuga

SEQ ID NO: 3471288 - RNA, 14 nt, Pseudomonas aeruginosa PA01
uccccucacggcgc

SEQ ID NO: 3471289 - RNA, 17 nt, Pseudomonas aeruginosa PA01
uccccucacggcgcgag

SEQ ID NO: 3471290 - RNA, 14 nt, Pseudomonas aeruginosa PA01
uccccucaggcgcc

SEQ ID NO: 3471291 - RNA, 17 nt, Pseudomonas aeruginosa PA01
uccccucccgcgccagc

SEQ ID NO: 3471292 - RNA, 18 nt, Pseudomonas aeruginosa PA01
uccccucccgcgccagcg

SEQ ID NO: 3471293 - RNA, 19 nt, Pseudomonas aeruginosa PA01
uccccugccgaaccgccuc

SEQ ID NO: 3471294 - RNA, 20 nt, Pseudomonas aeruginosa PA01
uccccuggaaugccggccgg

SEQ ID NO: 3471295 - RNA, 14 nt, Pseudomonas aeruginosa PA01
uccccuggcccugc

SEQ ID NO: 3471296 - RNA, 22 nt, Pseudomonas aeruginosa PA01
uccccuguggucaggcgccagg

SEQ ID NO: 3471297 - RNA, 13 nt, Pseudomonas aeruginosa PA01
uccccuuuuuuca

SEQ ID NO: 3471298 - RNA, 20 nt, Pseudomonas aeruginosa PA01
ucccgacgcccuccagcacc

SEQ ID NO: 3471299 - RNA, 12 nt, Pseudomonas aeruginosa PA01
ucccgagcaccg

SEQ ID NO: 3471300 - RNA, 14 nt, Pseudomonas aeruginosa PA01
ucccgagcaccggc

SEQ ID NO: 3471301 - RNA, 21 nt, Pseudomonas aeruginosa PA01
ucccgaggcgaucgccgcggc

SEQ ID NO: 3471302 - RNA, 14 nt, Pseudomonas aeruginosa PA01
ucccgaggguggcg

SEQ ID NO: 3471303 - RNA, 22 nt, Pseudomonas aeruginosa PA01
ucccgaggguggcgcuggccaa

SEQ ID NO: 3471304 - RNA, 13 nt, Pseudomonas aeruginosa PA01
ucccgaucggcaa

SEQ ID NO: 3471305 - RNA, 17 nt, Pseudomonas aeruginosa PA01
ucccgaucguuggcgaa

SEQ ID NO: 3471306 - RNA, 17 nt, Pseudomonas aeruginosa PA01
ucccgcaaagcccgcuc

SEQ ID NO: 3471307 - RNA, 13 nt, Pseudomonas aeruginosa PA01
ucccgcaccggcg

SEQ ID NO: 3471308 - RNA, 23 nt, Pseudomonas aeruginosa PA01
ucccgcaccggcgcgccggacag

SEQ ID NO: 3471309 - RNA, 22 nt, Pseudomonas aeruginosa PA01
ucccgcagauagggcaucagcc

SEQ ID NO: 3471310 - RNA, 13 nt, Pseudomonas aeruginosa PA01
ucccgcaggcgcu

SEQ ID NO: 3471311 - RNA, 12 nt, Pseudomonas aeruginosa PA01
ucccgcauggcu

SEQ ID NO: 3471312 - RNA, 11 nt, Pseudomonas aeruginosa PA01
ucccgccgccg

SEQ ID NO: 3471313 - RNA, 17 nt, Pseudomonas aeruginosa PA01
ucccgccgccgcgccuu

SEQ ID NO: 3471314 - RNA, 17 nt, Pseudomonas aeruginosa PA01
ucccgccgcgccgcuca

SEQ ID NO: 3471315 - RNA, 20 nt, Pseudomonas aeruginosa PA01
ucccgccgcgccgcucaggc

SEQ ID NO: 3471316 - RNA, 13 nt, Pseudomonas aeruginosa PA01
ucccgccgcggcg

SEQ ID NO: 3471317 - RNA, 22 nt, Pseudomonas aeruginosa PA01
ucccgccgcggcguuagccgcc

SEQ ID NO: 3471318 - RNA, 15 nt, Pseudomonas aeruginosa PA01
ucccgccgcuccggc

SEQ ID NO: 3471319 - RNA, 13 nt, Pseudomonas aeruginosa PA01
ucccgccgcucug

SEQ ID NO: 3471320 - RNA, 14 nt, Pseudomonas aeruginosa PA01
ucccgccgcucugc

SEQ ID NO: 3471321 - RNA, 16 nt, Pseudomonas aeruginosa PA01
ucccgccgcucugcug

SEQ ID NO: 3471322 - RNA, 18 nt, Pseudomonas aeruginosa PA01
ucccgcgacaacggccgu

SEQ ID NO: 3471323 - RNA, 19 nt, Pseudomonas aeruginosa PA01
ucccgcgagcagccgacga

SEQ ID NO: 3471324 - RNA, 16 nt, Pseudomonas aeruginosa PA01
ucccgcgauucgccgg

SEQ ID NO: 3471325 - RNA, 12 nt, Pseudomonas aeruginosa PA01
ucccgcgccagc

SEQ ID NO: 3471326 - RNA, 14 nt, Pseudomonas aeruginosa PA01
ucccgcgccagcgc

SEQ ID NO: 3471327 - RNA, 14 nt, Pseudomonas aeruginosa PA01
uccgcaucggccac

SEQ ID NO: 3471328 - RNA, 16 nt, Pseudomonas aeruginosa PA01
uccgcaucggccgaca

SEQ ID NO: 3471329 - RNA, 17 nt, Pseudomonas aeruginosa PA01
uccgcaucggccgacag

SEQ ID NO: 3471330 - RNA, 19 nt, Pseudomonas aeruginosa PA01
uccgcaucuccccaccaac

SEQ ID NO: 3471331 - RNA, 15 nt, Pseudomonas aeruginosa PA01
uccgccaccacggcg

SEQ ID NO: 3471332 - RNA, 15 nt, Pseudomonas aeruginosa PA01
uccgccaccagccag

SEQ ID NO: 3471333 - RNA, 16 nt, Pseudomonas aeruginosa PA01
uccgccaccagccagu

SEQ ID NO: 3471334 - RNA, 17 nt, Pseudomonas aeruginosa PA01
uccgccacccgcuccgg

SEQ ID NO: 3471335 - RNA, 18 nt, Pseudomonas aeruginosa PA01
uccgccacccgcuccggc

SEQ ID NO: 3471336 - RNA, 20 nt, Pseudomonas aeruginosa PA01
uccgccagaugcgcgucgcc

SEQ ID NO: 3471337 - RNA, 15 nt, Pseudomonas aeruginosa PA01
uccgccagcaccacc

SEQ ID NO: 3471338 - RNA, 21 nt, Pseudomonas aeruginosa PA01
uccgccagcaccacccggccg

SEQ ID NO: 3471339 - RNA, 12 nt, Pseudomonas aeruginosa PA01
uccgccagcagg

SEQ ID NO: 3471340 - RNA, 13 nt, Pseudomonas aeruginosa PA01
uccgccagccagc

SEQ ID NO: 3471341 - RNA, 21 nt, Pseudomonas aeruginosa PA01
uccgccagccagccgcgcgcc

SEQ ID NO: 3471342 - RNA, 12 nt, Pseudomonas aeruginosa PA01
uccgccagccgg

SEQ ID NO: 3471343 - RNA, 13 nt, Pseudomonas aeruginosa PA01
uccgccaggaccu

SEQ ID NO: 3471344 - RNA, 17 nt, Pseudomonas aeruginosa PA01
uccgccaggaccuccug

SEQ ID NO: 3471345 - RNA, 20 nt, Pseudomonas aeruginosa PA01
uccgccaggaccuccugcac

SEQ ID NO: 3471346 - RNA, 16 nt, Pseudomonas aeruginosa PA01
uccgccaggccgcgca

SEQ ID NO: 3471347 - RNA, 13 nt, Pseudomonas aeruginosa PA01
uccgccaggcgcu

SEQ ID NO: 3471348 - RNA, 13 nt, Pseudomonas aeruginosa PA01
uccgccaggcggc

SEQ ID NO: 3471349 - RNA, 18 nt, Pseudomonas aeruginosa PA01
uccgccagguccaggcuc

SEQ ID NO: 3471350 - RNA, 22 nt, Pseudomonas aeruginosa PA01
uccgcccaguucuucgccgccc

SEQ ID NO: 3471351 - RNA, 13 nt, Pseudomonas aeruginosa PA01
uccgccccacccc

SEQ ID NO: 3471352 - RNA, 17 nt, Pseudomonas aeruginosa PA01
uccgcccuacggaccgg

SEQ ID NO: 3471353 - RNA, 16 nt, Pseudomonas aeruginosa PA01
uccgcccugcgggaug

SEQ ID NO: 3471354 - RNA, 22 nt, Pseudomonas aeruginosa PA01
uccgcccuuuuucgucgccagc

SEQ ID NO: 3471355 - RNA, 21 nt, Pseudomonas aeruginosa PA01
uccgccgaaaagaaaaggcca

SEQ ID NO: 3471356 - RNA, 17 nt, Pseudomonas aeruginosa PA01
uccgccgaacgccacca

SEQ ID NO: 3471357 - RNA, 19 nt, Pseudomonas aeruginosa PA01
uccgccgaacgccaccagg

SEQ ID NO: 3471358 - RNA, 21 nt, Pseudomonas aeruginosa PA01
uccgccgaacgccaccagggc

SEQ ID NO: 3471359 - RNA, 18 nt, Pseudomonas aeruginosa PA01
uccgccgaauauuuccca

SEQ ID NO: 3471360 - RNA, 21 nt, Pseudomonas aeruginosa PA01
uccgccgacugcaacuggccg

SEQ ID NO: 3471361 - RNA, 11 nt, Pseudomonas aeruginosa PA01
uccgccgaggu

SEQ ID NO: 3471362 - RNA, 21 nt, Pseudomonas aeruginosa PA01
uccgccgaggugcugcaccgg

SEQ ID NO: 3471363 - RNA, 17 nt, Pseudomonas aeruginosa PA01
uccgccgauacagcgcg

SEQ ID NO: 3471364 - RNA, 18 nt, Pseudomonas aeruginosa PA01
uccgccgauacagcgcgc

SEQ ID NO: 3471365 - RNA, 14 nt, Pseudomonas aeruginosa PA01
uccgccgcagacca

SEQ ID NO: 3471366 - RNA, 13 nt, Pseudomonas aeruginosa PA01
uccgccgccaggu

SEQ ID NO: 3471367 - RNA, 13 nt, Pseudomonas aeruginosa PA01
uccgccgccgacg

SEQ ID NO: 3471368 - RNA, 15 nt, Pseudomonas aeruginosa PA01
uccgccgccgcggcg

SEQ ID NO: 3471369 - RNA, 17 nt, Pseudomonas aeruginosa PA01
uccgccgccgcggcgcg

SEQ ID NO: 3471370 - RNA, 13 nt, Pseudomonas aeruginosa PA01
uccgccgccgggc

SEQ ID NO: 3471371 - RNA, 14 nt, Pseudomonas aeruginosa PA01
uccgccgcggcaau

SEQ ID NO: 3471372 - RNA, 17 nt, Pseudomonas aeruginosa PA01
uccgccgcggcaaugcg

SEQ ID NO: 3471373 - RNA, 22 nt, Pseudomonas aeruginosa PA01
uccgccgcgggacgccgcagga

SEQ ID NO: 3471374 - RNA, 19 nt, Pseudomonas aeruginosa PA01
uccgccgcgugcgcgcccu

SEQ ID NO: 3471375 - RNA, 21 nt, Pseudomonas aeruginosa PA01
uccgccgcuacugcgcgggca

SEQ ID NO: 3471376 - RNA, 18 nt, Pseudomonas aeruginosa PA01
uccgccgcuaucgccgcc

SEQ ID NO: 3471377 - RNA, 21 nt, Pseudomonas aeruginosa PA01
uccgccgcuaucgccgccgca

SEQ ID NO: 3471378 - RNA, 19 nt, Pseudomonas aeruginosa PA01
uccgccgcucacccugucc

SEQ ID NO: 3471379 - RNA, 15 nt, Pseudomonas aeruginosa PA01
uccgccgcuggggac

SEQ ID NO: 3471380 - RNA, 23 nt, Pseudomonas aeruginosa PA01
uccgccgcuggggaccgcaccug

SEQ ID NO: 3471381 - RNA, 19 nt, Pseudomonas aeruginosa PA01
uccgccgcuuccgccggcg

SEQ ID NO: 3471382 - RNA, 15 nt, Pseudomonas aeruginosa PA01
uccgccggccggggc

SEQ ID NO: 3471383 - RNA, 13 nt, Pseudomonas aeruginosa PA01
uccgccggcgccg

SEQ ID NO: 3471384 - RNA, 16 nt, Pseudomonas aeruginosa PA01
uccgccggcgccgccu

SEQ ID NO: 3471385 - RNA, 21 nt, Pseudomonas aeruginosa PA01
uccgccggcgcgucccugggc

SEQ ID NO: 3471386 - RNA, 22 nt, Pseudomonas aeruginosa PA01
uccgccggcgcgucccugggcg

SEQ ID NO: 3471387 - RNA, 24 nt, Pseudomonas aeruginosa PA01
uccgccggcgcgucccugggcgca

SEQ ID NO: 3471388 - RNA, 20 nt, Pseudomonas aeruginosa PA01
uccgccggcugugcagggca

SEQ ID NO: 3471389 - RNA, 12 nt, Pseudomonas aeruginosa PA01
uccgccgggccg

SEQ ID NO: 3471390 - RNA, 14 nt, Pseudomonas aeruginosa PA01
uccgccgggccgcc

SEQ ID NO: 3471391 - RNA, 18 nt, Pseudomonas aeruginosa PA01
uccgccggguccaccgcg

SEQ ID NO: 3471392 - RNA, 18 nt, Pseudomonas aeruginosa PA01
uccgccggucaccacugg

SEQ ID NO: 3471393 - RNA, 21 nt, Pseudomonas aeruginosa PA01
uccgccggucaccacuggaaa

SEQ ID NO: 3471394 - RNA, 13 nt, Pseudomonas aeruginosa PA01
uccgccgugaggc

SEQ ID NO: 3471395 - RNA, 21 nt, Pseudomonas aeruginosa PA01
uccgccguggaacgcaggggc

SEQ ID NO: 3471396 - RNA, 21 nt, Pseudomonas aeruginosa PA01
uccgccucgcugagcaccggg

SEQ ID NO: 3471397 - RNA, 17 nt, Pseudomonas aeruginosa PA01
uccgccugaccgcugau

SEQ ID NO: 3471398 - RNA, 18 nt, Pseudomonas aeruginosa PA01
uccgccugaccgcugaug

SEQ ID NO: 3471399 - RNA, 12 nt, Pseudomonas aeruginosa PA01
uccgccuggcgg

SEQ ID NO: 3471400 - RNA, 13 nt, Pseudomonas aeruginosa PA01
uccgccuggcgga

SEQ ID NO: 3471401 - RNA, 16 nt, Pseudomonas aeruginosa PA01
uccgccuggcggauau

SEQ ID NO: 3471402 - RNA, 18 nt, Pseudomonas aeruginosa PA01
uccgccuggcggauaucg

SEQ ID NO: 3471403 - RNA, 23 nt, Pseudomonas aeruginosa PA01
uccgccugggacggaacgucggc

SEQ ID NO: 3471404 - RNA, 17 nt, Pseudomonas aeruginosa PA01
uccgccugguccagcag

SEQ ID NO: 3471405 - RNA, 18 nt, Pseudomonas aeruginosa PA01
uccgccugguccagcagg

SEQ ID NO: 3471406 - RNA, 16 nt, Pseudomonas aeruginosa PA01
uccgccuguccaccgg

SEQ ID NO: 3471407 - RNA, 22 nt, Pseudomonas aeruginosa PA01
uccgccuuuuuugugcccggcg

SEQ ID NO: 3471408 - RNA, 17 nt, Pseudomonas aeruginosa PA01
uccgcgaauagggcggc

SEQ ID NO: 3471409 - RNA, 15 nt, Pseudomonas aeruginosa PA01
uccgcgacaguucgc

SEQ ID NO: 3471410 - RNA, 19 nt, Pseudomonas aeruginosa PA01
uccgcgacaguucgccgcc

SEQ ID NO: 3471411 - RNA, 17 nt, Pseudomonas aeruginosa PA01
uccgcgacguccacugc

SEQ ID NO: 3471412 - RNA, 21 nt, Pseudomonas aeruginosa PA01
uccgcgaggcauucucgcgac

SEQ ID NO: 3471413 - RNA, 17 nt, Pseudomonas aeruginosa PA01
uccgcgauagcucaguc

SEQ ID NO: 3471414 - RNA, 19 nt, Pseudomonas aeruginosa PA01
uccgcgauguccccggcca

SEQ ID NO: 3471415 - RNA, 21 nt, Pseudomonas aeruginosa PA01
uccgcgauguccccggccagc

SEQ ID NO: 3471416 - RNA, 23 nt, Pseudomonas aeruginosa PA01
uccgcgauguccccggccagcag

SEQ ID NO: 3471417 - RNA, 23 nt, Pseudomonas aeruginosa PA01
uccgcgcacggaucgcgcugggc

SEQ ID NO: 3471418 - RNA, 22 nt, Pseudomonas aeruginosa PA01
uccgcgcaggaccacgcugguc

SEQ ID NO: 3471419 - RNA, 13 nt, Pseudomonas aeruginosa PA01
uccgcgcaggcgg

SEQ ID NO: 3471420 - RNA, 18 nt, Pseudomonas aeruginosa PA01
uccgcgcaggcggucgcc

SEQ ID NO: 3471421 - RNA, 22 nt, Pseudomonas aeruginosa PA01
uccgcgcaggcggucgccgaac

SEQ ID NO: 3471422 - RNA, 12 nt, Pseudomonas aeruginosa PA01
uccgcgccacgc

SEQ ID NO: 3471423 - RNA, 14 nt, Pseudomonas aeruginosa PA01
uccgcgccacgcuc

SEQ ID NO: 3471424 - RNA, 14 nt, Pseudomonas aeruginosa PA01
uccgcgccacggau

SEQ ID NO: 3471425 - RNA, 15 nt, Pseudomonas aeruginosa PA01
uccgcgccaugccgg

SEQ ID NO: 3471426 - RNA, 18 nt, Pseudomonas aeruginosa PA01
uccgcgccaugccggcgc

SEQ ID NO: 3471427 - RNA, 12 nt, Pseudomonas aeruginosa PA01
uccgcgcccagg

SEQ ID NO: 3471428 - RNA, 18 nt, Pseudomonas aeruginosa PA01
uccgcgcccaggcgcacc

SEQ ID NO: 3471429 - RNA, 17 nt, Pseudomonas aeruginosa PA01
uccgcgcccggcuggcc

SEQ ID NO: 3471430 - RNA, 13 nt, Pseudomonas aeruginosa PA01
uccggcggcgaug

SEQ ID NO: 3471431 - RNA, 22 nt, Pseudomonas aeruginosa PA01
uccggcgggcgguagcgggcca

SEQ ID NO: 3471432 - RNA, 15 nt, Pseudomonas aeruginosa PA01
uccggcgugguggcg

SEQ ID NO: 3471433 - RNA, 14 nt, Pseudomonas aeruginosa PA01
uccggcucgccgcg

SEQ ID NO: 3471434 - RNA, 16 nt, Pseudomonas aeruginosa PA01
uccggcucgccgcgcu

SEQ ID NO: 3471435 - RNA, 22 nt, Pseudomonas aeruginosa PA01
uccggcuggacgugcaggauca

SEQ ID NO: 3471436 - RNA, 15 nt, Pseudomonas aeruginosa PA01
uccggcugucgacgc

SEQ ID NO: 3471437 - RNA, 19 nt, Pseudomonas aeruginosa PA01
uccggcugucgacgcagcc

SEQ ID NO: 3471438 - RNA, 15 nt, Pseudomonas aeruginosa PA01
uccggcuugaccgcc

SEQ ID NO: 3471439 - RNA, 19 nt, Pseudomonas aeruginosa PA01
uccggcuugccgaugucgc

SEQ ID NO: 3471440 - RNA, 23 nt, Pseudomonas aeruginosa PA01
uccggcuugccgaugucgccggc

SEQ ID NO: 3471441 - RNA, 21 nt, Pseudomonas aeruginosa PA01
uccggcuugguucgcgcgcug

SEQ ID NO: 3471442 - RNA, 16 nt, Pseudomonas aeruginosa PA01
uccgggaaauuucgcg

SEQ ID NO: 3471443 - RNA, 20 nt, Pseudomonas aeruginosa PA01
uccgggaagcggucguagcc

SEQ ID NO: 3471444 - RNA, 14 nt, Pseudomonas aeruginosa PA01
uccgggaaggccug

SEQ ID NO: 3471445 - RNA, 21 nt, Pseudomonas aeruginosa PA01
uccgggaaguccgggcgcggc

SEQ ID NO: 3471446 - RNA, 21 nt, Pseudomonas aeruginosa PA01
uccgggaaugcucagcacggc

SEQ ID NO: 3471447 - RNA, 22 nt, Pseudomonas aeruginosa PA01
uccgggaaugcucagcacggcg

SEQ ID NO: 3471448 - RNA, 19 nt, Pseudomonas aeruginosa PA01
uccgggagcaucuggcccg

SEQ ID NO: 3471449 - RNA, 14 nt, Pseudomonas aeruginosa PA01
uccgggcagcggcg

SEQ ID NO: 3471450 - RNA, 13 nt, Pseudomonas aeruginosa PA01
uccgggccgaggg

SEQ ID NO: 3471451 - RNA, 19 nt, Pseudomonas aeruginosa PA01
uccgggcgguacaggcgca

SEQ ID NO: 3471452 - RNA, 14 nt, Pseudomonas aeruginosa PA01
uccgggcguaacgg

SEQ ID NO: 3471453 - RNA, 17 nt, Pseudomonas aeruginosa PA01
uccgggcgugccaggag

SEQ ID NO: 3471454 - RNA, 16 nt, Pseudomonas aeruginosa PA01
uccgggcuccaccagu

SEQ ID NO: 3471455 - RNA, 17 nt, Pseudomonas aeruginosa PA01
uccgggcuggccaccag

SEQ ID NO: 3471456 - RNA, 19 nt, Pseudomonas aeruginosa PA01
uccgggcuggccaccagca

SEQ ID NO: 3471457 - RNA, 21 nt, Pseudomonas aeruginosa PA01
uccggggacgcugucccggcc

SEQ ID NO: 3471458 - RNA, 12 nt, Pseudomonas aeruginosa PA01
uccggggcgauc

SEQ ID NO: 3471459 - RNA, 22 nt, Pseudomonas aeruginosa PA01
uccggggucaguuccaggucgg

SEQ ID NO: 3471460 - RNA, 21 nt, Pseudomonas aeruginosa PA01
uccgggucaugccgccaucga

SEQ ID NO: 3471461 - RNA, 13 nt, Pseudomonas aeruginosa PA01
uccggguccagcg

SEQ ID NO: 3471462 - RNA, 14 nt, Pseudomonas aeruginosa PA01
uccggguccagcgg

SEQ ID NO: 3471463 - RNA, 23 nt, Pseudomonas aeruginosa PA01
uccggguccaucugcaacgcggc

SEQ ID NO: 3471464 - RNA, 13 nt, Pseudomonas aeruginosa PA01
uccgggucgaggc

SEQ ID NO: 3471465 - RNA, 15 nt, Pseudomonas aeruginosa PA01
uccgggugaugcccg

SEQ ID NO: 3471466 - RNA, 15 nt, Pseudomonas aeruginosa PA01
uccgggugccccagg

SEQ ID NO: 3471467 - RNA, 15 nt, Pseudomonas aeruginosa PA01
uccggguugaccgcc

SEQ ID NO: 3471468 - RNA, 18 nt, Pseudomonas aeruginosa PA01
uccggguugaccgccaga

SEQ ID NO: 3471469 - RNA, 14 nt, Pseudomonas aeruginosa PA01
uccggguuggcgca

SEQ ID NO: 3471470 - RNA, 19 nt, Pseudomonas aeruginosa PA01
uccggguuggcgcaggccg

SEQ ID NO: 3471471 - RNA, 23 nt, Pseudomonas aeruginosa PA01
uccggguuggcgcaggccgggcg

SEQ ID NO: 3471472 - RNA, 15 nt, Pseudomonas aeruginosa PA01
uccggguugguggcc

SEQ ID NO: 3471473 - RNA, 17 nt, Pseudomonas aeruginosa PA01
uccgguacugcugggcc

SEQ ID NO: 3471474 - RNA, 18 nt, Pseudomonas aeruginosa PA01
uccgguacugcugggccu

SEQ ID NO: 3471475 - RNA, 17 nt, Pseudomonas aeruginosa PA01
uccggucagcagcaggg

SEQ ID NO: 3471476 - RNA, 20 nt, Pseudomonas aeruginosa PA01
uccggucccagguagcgcug

SEQ ID NO: 3471477 - RNA, 15 nt, Pseudomonas aeruginosa PA01
uccggugcaggccga

SEQ ID NO: 3471478 - RNA, 12 nt, Pseudomonas aeruginosa PA01
uccgguggcgga

SEQ ID NO: 3471479 - RNA, 16 nt, Pseudomonas aeruginosa PA01
uccggugucaggccga

SEQ ID NO: 3471480 - RNA, 19 nt, Pseudomonas aeruginosa PA01
uccgguucggcaaggcgca

SEQ ID NO: 3471481 - RNA, 23 nt, Pseudomonas aeruginosa PA01
uccgguugauuuccgcaccgagg

SEQ ID NO: 3471482 - RNA, 18 nt, Pseudomonas aeruginosa PA01
uccgguugcuggcacagg

SEQ ID NO: 3471483 - RNA, 17 nt, Pseudomonas aeruginosa PA01
uccguacuggcgccagg

SEQ ID NO: 3471484 - RNA, 18 nt, Pseudomonas aeruginosa PA01
uccguacuggcgccaggc

SEQ ID NO: 3471485 - RNA, 13 nt, Pseudomonas aeruginosa PA01
uccgucacgcccu

SEQ ID NO: 3471486 - RNA, 17 nt, Pseudomonas aeruginosa PA01
uccgucagggcguaagc

SEQ ID NO: 3471487 - RNA, 19 nt, Pseudomonas aeruginosa PA01
uccguccagcgcgcccggc

SEQ ID NO: 3471488 - RNA, 22 nt, Pseudomonas aeruginosa PA01
uccgucgcgaagaccggccggc

SEQ ID NO: 3471489 - RNA, 18 nt, Pseudomonas aeruginosa PA01
uccgucgucaccucggcg

SEQ ID NO: 3471490 - RNA, 11 nt, Pseudomonas aeruginosa PA01
uccgucucagg

SEQ ID NO: 3471491 - RNA, 18 nt, Pseudomonas aeruginosa PA01
uccgucucaggcgccagg

SEQ ID NO: 3471492 - RNA, 19 nt, Pseudomonas aeruginosa PA01
uccgucucaggcgccaggc

SEQ ID NO: 3471493 - RNA, 15 nt, Pseudomonas aeruginosa PA01
uccgucuccagcaac

SEQ ID NO: 3471494 - RNA, 14 nt, Pseudomonas aeruginosa PA01
uccgucuguucggc

SEQ ID NO: 3471495 - RNA, 15 nt, Pseudomonas aeruginosa PA01
uccgugcgccgggcu

SEQ ID NO: 3471496 - RNA, 22 nt, Pseudomonas aeruginosa PA01
uccgugcgccgggcuugcaauc

SEQ ID NO: 3471497 - RNA, 16 nt, Pseudomonas aeruginosa PA01
uccgugcgcugcgcgu

SEQ ID NO: 3471498 - RNA, 19 nt, Pseudomonas aeruginosa PA01
uccgugcggaaaccgcggc

SEQ ID NO: 3471499 - RNA, 13 nt, Pseudomonas aeruginosa PA01
uccgugcuggccg

SEQ ID NO: 3471500 - RNA, 15 nt, Pseudomonas aeruginosa PA01
uccgugcuggccggc

SEQ ID NO: 3471501 - RNA, 16 nt, Pseudomonas aeruginosa PA01
uccgugcuggccggca

SEQ ID NO: 3471502 - RNA, 20 nt, Pseudomonas aeruginosa PA01
uccgugcuggccggcagcag

SEQ ID NO: 3471503 - RNA, 17 nt, Pseudomonas aeruginosa PA01
uccguugaacucggcgc

SEQ ID NO: 3471504 - RNA, 15 nt, Pseudomonas aeruginosa PA01
uccguuguggcggcg

SEQ ID NO: 3471505 - RNA, 18 nt, Pseudomonas aeruginosa PA01
uccuacacgacccaccau

SEQ ID NO: 3471506 - RNA, 20 nt, Pseudomonas aeruginosa PA01
uccuacgcgaccggucaggc

SEQ ID NO: 3471507 - RNA, 23 nt, Pseudomonas aeruginosa PA01
uccuacgcgaccggucaggcaau

SEQ ID NO: 3471508 - RNA, 18 nt, Pseudomonas aeruginosa PA01
uccucagccucacccugc

SEQ ID NO: 3471509 - RNA, 20 nt, Pseudomonas aeruginosa PA01
uccucagugcgggcaguccu

SEQ ID NO: 3471510 - RNA, 22 nt, Pseudomonas aeruginosa PA01
uccucauagugcugcggcaggu

SEQ ID NO: 3471511 - RNA, 19 nt, Pseudomonas aeruginosa PA01
uccucaucuccuguggaua

SEQ ID NO: 3471512 - RNA, 17 nt, Pseudomonas aeruginosa PA01
uccuccaaagccuggag

SEQ ID NO: 3471513 - RNA, 23 nt, Pseudomonas aeruginosa PA01
uccuccacccccgcaaccgcugc

SEQ ID NO: 3471514 - RNA, 21 nt, Pseudomonas aeruginosa PA01
uccuccaccgcuccggcgccg

SEQ ID NO: 3471515 - RNA, 21 nt, Pseudomonas aeruginosa PA01
uccuccaccguuccgacccgg

SEQ ID NO: 3471516 - RNA, 19 nt, Pseudomonas aeruginosa PA01
uccuccagagugcgcagca

SEQ ID NO: 3471517 - RNA, 22 nt, Pseudomonas aeruginosa PA01
uccuccagagugcgcagcagcg

SEQ ID NO: 3471518 - RNA, 21 nt, Pseudomonas aeruginosa PA01
uccuccagcaggaccuggccg

SEQ ID NO: 3471519 - RNA, 16 nt, Pseudomonas aeruginosa PA01
uccuccagccggcgac

SEQ ID NO: 3471520 - RNA, 17 nt, Pseudomonas aeruginosa PA01
uccuccagccggcgacg

SEQ ID NO: 3471521 - RNA, 14 nt, Pseudomonas aeruginosa PA01
uccuccagcgccgc

SEQ ID NO: 3471522 - RNA, 20 nt, Pseudomonas aeruginosa PA01
uccuccagcgccgccaggcg

SEQ ID NO: 3471523 - RNA, 15 nt, Pseudomonas aeruginosa PA01
uccuccaggaccagg

SEQ ID NO: 3471524 - RNA, 16 nt, Pseudomonas aeruginosa PA01
uccuccaggaccagga

SEQ ID NO: 3471525 - RNA, 13 nt, Pseudomonas aeruginosa PA01
uccuccaggccgc

SEQ ID NO: 3471526 - RNA, 20 nt, Pseudomonas aeruginosa PA01
uccuccaggccgccggcgac

SEQ ID NO: 3471527 - RNA, 14 nt, Pseudomonas aeruginosa PA01
uccuccaggcucag

SEQ ID NO: 3471528 - RNA, 23 nt, Pseudomonas aeruginosa PA01
uccuccaguagcggaagcacggc

SEQ ID NO: 3471529 - RNA, 13 nt, Pseudomonas aeruginosa PA01
uccuccaguuccu

SEQ ID NO: 3471530 - RNA, 20 nt, Pseudomonas aeruginosa PA01
uccucccagugcgagucggc

SEQ ID NO: 3471531 - RNA, 16 nt, Pseudomonas aeruginosa PA01
uccucccaugaaaaau

SEQ ID NO: 3471532 - RNA, 19 nt, Pseudomonas aeruginosa PA01
uccugcugggcgucgaaca

SEQ ID NO: 3471533 - RNA, 20 nt, Pseudomonas aeruginosa PA01
uccugcugggcgucgaacac

SEQ ID NO: 3471534 - RNA, 18 nt, Pseudomonas aeruginosa PA01
uccugcugguugaccagg

SEQ ID NO: 3471535 - RNA, 16 nt, Pseudomonas aeruginosa PA01
uccugcuuccagaccu

SEQ ID NO: 3471536 - RNA, 13 nt, Pseudomonas aeruginosa PA01
uccugcuugaccu

SEQ ID NO: 3471537 - RNA, 14 nt, Pseudomonas aeruginosa PA01
uccuggaaagaccg

SEQ ID NO: 3471538 - RNA, 17 nt, Pseudomonas aeruginosa PA01
uccuggaaagaccggcg

SEQ ID NO: 3471539 - RNA, 19 nt, Pseudomonas aeruginosa PA01
uccuggacgugggaaauca

SEQ ID NO: 3471540 - RNA, 23 nt, Pseudomonas aeruginosa PA01
uccuggagguagcugcgccgccu

SEQ ID NO: 3471541 - RNA, 17 nt, Pseudomonas aeruginosa PA01
uccuggaucggcagcuc

SEQ ID NO: 3471542 - RNA, 13 nt, Pseudomonas aeruginosa PA01
uccuggccgaccc

SEQ ID NO: 3471543 - RNA, 20 nt, Pseudomonas aeruginosa PA01
uccuggccgacccgcagcgg

SEQ ID NO: 3471544 - RNA, 23 nt, Pseudomonas aeruginosa PA01
uccuggccgacccgcagcggcgc

SEQ ID NO: 3471545 - RNA, 11 nt, Pseudomonas aeruginosa PA01
uccuggccggc

SEQ ID NO: 3471546 - RNA, 12 nt, Pseudomonas aeruginosa PA01
uccuggccggcg

SEQ ID NO: 3471547 - RNA, 13 nt, Pseudomonas aeruginosa PA01
uccuggccggcgu

SEQ ID NO: 3471548 - RNA, 18 nt, Pseudomonas aeruginosa PA01
uccuggccggucguucgc

SEQ ID NO: 3471549 - RNA, 14 nt, Pseudomonas aeruginosa PA01
uccuggcgcauguc

SEQ ID NO: 3471550 - RNA, 22 nt, Pseudomonas aeruginosa PA01
uccuggcgcgucaugccgccgu

SEQ ID NO: 3471551 - RNA, 17 nt, Pseudomonas aeruginosa PA01
uccuggcgcgucggccg

SEQ ID NO: 3471552 - RNA, 12 nt, Pseudomonas aeruginosa PA01
uccuggcgguag

SEQ ID NO: 3471553 - RNA, 19 nt, Pseudomonas aeruginosa PA01
uccuggcgguagcccggca

SEQ ID NO: 3471554 - RNA, 16 nt, Pseudomonas aeruginosa PA01
uccuggcgguucuggg

SEQ ID NO: 3471555 - RNA, 21 nt, Pseudomonas aeruginosa PA01
uccugggagaacuuuucccag

SEQ ID NO: 3471556 - RNA, 23 nt, Pseudomonas aeruginosa PA01
uccugggagaacuuuucccagcg

SEQ ID NO: 3471557 - RNA, 14 nt, Pseudomonas aeruginosa PA01
uccugggccaccug

SEQ ID NO: 3471558 - RNA, 17 nt, Pseudomonas aeruginosa PA01
uccugggccccggccag

SEQ ID NO: 3471559 - RNA, 19 nt, Pseudomonas aeruginosa PA01
uccugggccccggccaggu

SEQ ID NO: 3471560 - RNA, 22 nt, Pseudomonas aeruginosa PA01
uccugggccgacgcuuccucgc

SEQ ID NO: 3471561 - RNA, 20 nt, Pseudomonas aeruginosa PA01
uccugggccgguugcggcgc

SEQ ID NO: 3471562 - RNA, 22 nt, Pseudomonas aeruginosa PA01
uccugggcgauuuccaccggca

SEQ ID NO: 3471563 - RNA, 15 nt, Pseudomonas aeruginosa PA01
uccugggcgccagcc

SEQ ID NO: 3471564 - RNA, 15 nt, Pseudomonas aeruginosa PA01
uccugggcggcaacu

SEQ ID NO: 3471565 - RNA, 16 nt, Pseudomonas aeruginosa PA01
uccugggcggucucgg

SEQ ID NO: 3471566 - RNA, 17 nt, Pseudomonas aeruginosa PA01
uccugggcgugcuuggc

SEQ ID NO: 3471567 - RNA, 22 nt, Pseudomonas aeruginosa PA01
uccugggcuucguccgccuggg

SEQ ID NO: 3471568 - RNA, 19 nt, Pseudomonas aeruginosa PA01
uccuggguauagaccagca

SEQ ID NO: 3471569 - RNA, 20 nt, Pseudomonas aeruginosa PA01
uccuggguauagaccagcac

SEQ ID NO: 3471570 - RNA, 21 nt, Pseudomonas aeruginosa PA01
uccuggguauagaccagcacc

SEQ ID NO: 3471571 - RNA, 23 nt, Pseudomonas aeruginosa PA01
uccuggguaugcgcggucaccag

SEQ ID NO: 3471572 - RNA, 22 nt, Pseudomonas aeruginosa PA01
uccugggucgacugcuggguac

SEQ ID NO: 3471573 - RNA, 22 nt, Pseudomonas aeruginosa PA01
uccugggucgcguacagcgggc

SEQ ID NO: 3471574 - RNA, 15 nt, Pseudomonas aeruginosa PA01
uccugggugucguug

SEQ ID NO: 3471575 - RNA, 16 nt, Pseudomonas aeruginosa PA01
uccugguccagccagc

SEQ ID NO: 3471576 - RNA, 20 nt, Pseudomonas aeruginosa PA01
uccuggucgagcuuguuggc

SEQ ID NO: 3471577 - RNA, 23 nt, Pseudomonas aeruginosa PA01
uccuggucgagcuuguuggccag

SEQ ID NO: 3471578 - RNA, 21 nt, Pseudomonas aeruginosa PA01
uccuggugaucaucguccugc

SEQ ID NO: 3471579 - RNA, 17 nt, Pseudomonas aeruginosa PA01
uccuggugcggcaccag

SEQ ID NO: 3471580 - RNA, 20 nt, Pseudomonas aeruginosa PA01
uccuguggauaaaaaggccc

SEQ ID NO: 3471581 - RNA, 20 nt, Pseudomonas aeruginosa PA01
uccuguucgcgcgccucgcg

SEQ ID NO: 3471582 - RNA, 22 nt, Pseudomonas aeruginosa PA01
uccuguucgcugccuuccuuuu

SEQ ID NO: 3471583 - RNA, 13 nt, Pseudomonas aeruginosa PA01
uccuguucgucgc

SEQ ID NO: 3471584 - RNA, 18 nt, Pseudomonas aeruginosa PA01
uccuuauucggcccaugc

SEQ ID NO: 3471585 - RNA, 21 nt, Pseudomonas aeruginosa PA01
uccuucaucuuggcccauucg

SEQ ID NO: 3471586 - RNA, 18 nt, Pseudomonas aeruginosa PA01
uccuuccagcucucgcug

SEQ ID NO: 3471587 - RNA, 15 nt, Pseudomonas aeruginosa PA01
uccuuccaggguuuc

SEQ ID NO: 3471588 - RNA, 16 nt, Pseudomonas aeruginosa PA01
uccuucgagccuggcc

SEQ ID NO: 3471589 - RNA, 17 nt, Pseudomonas aeruginosa PA01
uccuucgagccuggcca

SEQ ID NO: 3471590 - RNA, 20 nt, Pseudomonas aeruginosa PA01
uccuucgagccuggccaggc

SEQ ID NO: 3471591 - RNA, 16 nt, Pseudomonas aeruginosa PA01
uccuucggccaguccu

SEQ ID NO: 3471592 - RNA, 15 nt, Pseudomonas aeruginosa PA01
uccuucucgaagccg

SEQ ID NO: 3471593 - RNA, 14 nt, Pseudomonas aeruginosa PA01
uccuugaccaucuu

SEQ ID NO: 3471594 - RNA, 12 nt, Pseudomonas aeruginosa PA01
uccuugagcauc

SEQ ID NO: 3471595 - RNA, 16 nt, Pseudomonas aeruginosa PA01
uccuugagcgccagca

SEQ ID NO: 3471596 - RNA, 14 nt, Pseudomonas aeruginosa PA01
uccuugcccggcgc

SEQ ID NO: 3471597 - RNA, 20 nt, Pseudomonas aeruginosa PA01
uccuugcgggaacuggcguu

SEQ ID NO: 3471598 - RNA, 15 nt, Pseudomonas aeruginosa PA01
uccuuggccuccgga

SEQ ID NO: 3471599 - RNA, 22 nt, Pseudomonas aeruginosa PA01
uccuuggcuggccagcccuggu

SEQ ID NO: 3471600 - RNA, 16 nt, Pseudomonas aeruginosa PA01
uccuuggucagggugc

SEQ ID NO: 3471601 - RNA, 22 nt, Pseudomonas aeruginosa PA01
uccuugguguuggucaggcccu

SEQ ID NO: 3471602 - RNA, 15 nt, Pseudomonas aeruginosa PA01
uccuuguccagggcc

SEQ ID NO: 3471603 - RNA, 20 nt, Pseudomonas aeruginosa PA01
uccuuguuccugggcggcaa

SEQ ID NO: 3471604 - RNA, 22 nt, Pseudomonas aeruginosa PA01
uccuuguucggcuggaccuccu

SEQ ID NO: 3471605 - RNA, 13 nt, Pseudomonas aeruginosa PA01
uccuuucacaugc

SEQ ID NO: 3471606 - RNA, 17 nt, Pseudomonas aeruginosa PA01
uccuuuccuccgucguu

SEQ ID NO: 3471607 - RNA, 18 nt, Pseudomonas aeruginosa PA01
uccuuucgaucuggcugc

SEQ ID NO: 3471608 - RNA, 16 nt, Pseudomonas aeruginosa PA01
uccuuuuuccgaccuu

SEQ ID NO: 3471609 - RNA, 16 nt, Pseudomonas aeruginosa PA01
ucgaaacgcuggcggc

SEQ ID NO: 3471610 - RNA, 23 nt, Pseudomonas aeruginosa PA01
ucgaaacggaacaggaaacucac

SEQ ID NO: 3471611 - RNA, 22 nt, Pseudomonas aeruginosa PA01
ucgaaacgggcgcucuggccgc

SEQ ID NO: 3471612 - RNA, 13 nt, Pseudomonas aeruginosa PA01
ucgaaagccugcc

SEQ ID NO: 3471613 - RNA, 15 nt, Pseudomonas aeruginosa PA01
ucgaaaugccgcacc

SEQ ID NO: 3471614 - RNA, 16 nt, Pseudomonas aeruginosa PA01
ucgaacaacccgccag

SEQ ID NO: 3471615 - RNA, 17 nt, Pseudomonas aeruginosa PA01
ucgaacaccaggcgcca

SEQ ID NO: 3471616 - RNA, 21 nt, Pseudomonas aeruginosa PA01
ucgaacacuugaccgucggca

SEQ ID NO: 3471617 - RNA, 19 nt, Pseudomonas aeruginosa PA01
ucgaacagcaccgagcagg

SEQ ID NO: 3471618 - RNA, 13 nt, Pseudomonas aeruginosa PA01
ucgaacagcagca

SEQ ID NO: 3471619 - RNA, 21 nt, Pseudomonas aeruginosa PA01
ucgaacagcuccuccagccgc

SEQ ID NO: 3471620 - RNA, 15 nt, Pseudomonas aeruginosa PA01
ucgaacaucagcagc

SEQ ID NO: 3471621 - RNA, 17 nt, Pseudomonas aeruginosa PA01
ucgaacaucagcagcgc

SEQ ID NO: 3471622 - RNA, 21 nt, Pseudomonas aeruginosa PA01
ucgaacaucagcagcgccagc

SEQ ID NO: 3471623 - RNA, 14 nt, Pseudomonas aeruginosa PA01
ucgaaccguggcgg

SEQ ID NO: 3471624 - RNA, 15 nt, Pseudomonas aeruginosa PA01
ucgaaccguggcggc

SEQ ID NO: 3471625 - RNA, 16 nt, Pseudomonas aeruginosa PA01
ucgaacgccaggcagg

SEQ ID NO: 3471626 - RNA, 23 nt, Pseudomonas aeruginosa PA01
ucgaacgccgcccgucgcgccgg

SEQ ID NO: 3471627 - RNA, 17 nt, Pseudomonas aeruginosa PA01
ucgaacgcgugaagcug

SEQ ID NO: 3471628 - RNA, 23 nt, Pseudomonas aeruginosa PA01
ucgaacgcuucuuguuccucguc

SEQ ID NO: 3471629 - RNA, 23 nt, Pseudomonas aeruginosa PA01
ucgaacgggacuuuccgaagccc

SEQ ID NO: 3471630 - RNA, 15 nt, Pseudomonas aeruginosa PA01
ucgaacugaccacca

SEQ ID NO: 3471631 - RNA, 19 nt, Pseudomonas aeruginosa PA01
ucgaacugaccaccaggaa

SEQ ID NO: 3471632 - RNA, 16 nt, Pseudomonas aeruginosa PA01
ucgaacugcacccgcc

SEQ ID NO: 3471633 - RNA, 24 nt, Pseudomonas aeruginosa PA01
ucgaacugcaugucgcugagcggc

SEQ ID NO: 3471634 - RNA, 15 nt, Pseudomonas aeruginosa PA01
ucgaccucgcgggcg

SEQ ID NO: 3471635 - RNA, 14 nt, Pseudomonas aeruginosa PA01
ucgaccucggccgc

SEQ ID NO: 3471636 - RNA, 20 nt, Pseudomonas aeruginosa PA01
ucgaccugcggggcggauga

SEQ ID NO: 3471637 - RNA, 18 nt, Pseudomonas aeruginosa PA01
ucgaccuggguaccgacg

SEQ ID NO: 3471638 - RNA, 21 nt, Pseudomonas aeruginosa PA01
ucgaccuggguaccgacgguc

SEQ ID NO: 3471639 - RNA, 17 nt, Pseudomonas aeruginosa PA01
ucgaccugguagccgaa

SEQ ID NO: 3471640 - RNA, 20 nt, Pseudomonas aeruginosa PA01
ucgaccuugcccucggcgcc

SEQ ID NO: 3471641 - RNA, 22 nt, Pseudomonas aeruginosa PA01
ucgaccuugcccucggcgcccg

SEQ ID NO: 3471642 - RNA, 16 nt, Pseudomonas aeruginosa PA01
ucgaccuugccgacgc

SEQ ID NO: 3471643 - RNA, 22 nt, Pseudomonas aeruginosa PA01
ucgaccuugccgacgccgcggc

SEQ ID NO: 3471644 - RNA, 23 nt, Pseudomonas aeruginosa PA01
ucgaccuugccgagcgcgaucag

SEQ ID NO: 3471645 - RNA, 17 nt, Pseudomonas aeruginosa PA01
ucgacgaacaggaagcg

SEQ ID NO: 3471646 - RNA, 18 nt, Pseudomonas aeruginosa PA01
ucgacgaacucgacgcgc

SEQ ID NO: 3471647 - RNA, 20 nt, Pseudomonas aeruginosa PA01
ucgacgaacucgacgcgcca

SEQ ID NO: 3471648 - RNA, 22 nt, Pseudomonas aeruginosa PA01
ucgacgaacucgacgcgccagg

SEQ ID NO: 3471649 - RNA, 18 nt, Pseudomonas aeruginosa PA01
ucgacgacgaaaggccgc

SEQ ID NO: 3471650 - RNA, 19 nt, Pseudomonas aeruginosa PA01
ucgacgacgaaaggccgcg

SEQ ID NO: 3471651 - RNA, 23 nt, Pseudomonas aeruginosa PA01
ucgacgacgaaaggccgcgccgg

SEQ ID NO: 3471652 - RNA, 15 nt, Pseudomonas aeruginosa PA01
ucgacgauauccacg

SEQ ID NO: 3471653 - RNA, 23 nt, Pseudomonas aeruginosa PA01
ucgacgaugcucgguugccaggc

SEQ ID NO: 3471654 - RNA, 23 nt, Pseudomonas aeruginosa PA01
ucgacgaugcugaacuguucgau

SEQ ID NO: 3471655 - RNA, 22 nt, Pseudomonas aeruginosa PA01
ucgacgauguacugcucgguau

SEQ ID NO: 3471656 - RNA, 16 nt, Pseudomonas aeruginosa PA01
ucgacgcagccgggcc

SEQ ID NO: 3471657 - RNA, 22 nt, Pseudomonas aeruginosa PA01
ucgacgcagccgggccgcagcg

SEQ ID NO: 3471658 - RNA, 12 nt, Pseudomonas aeruginosa PA01
ucgacgcagcgc

SEQ ID NO: 3471659 - RNA, 22 nt, Pseudomonas aeruginosa PA01
ucgacgcagcgcgcgucggcga

SEQ ID NO: 3471660 - RNA, 23 nt, Pseudomonas aeruginosa PA01
ucgacgcagcgcgcgucggcgaa

SEQ ID NO: 3471661 - RNA, 17 nt, Pseudomonas aeruginosa PA01
ucgacgcagggcggcgc

SEQ ID NO: 3471662 - RNA, 12 nt, Pseudomonas aeruginosa PA01
ucgacgccagcg

SEQ ID NO: 3471663 - RNA, 13 nt, Pseudomonas aeruginosa PA01
ucgacgccagcgg

SEQ ID NO: 3471664 - RNA, 18 nt, Pseudomonas aeruginosa PA01
ucgacgccagcggcgauc

SEQ ID NO: 3471665 - RNA, 13 nt, Pseudomonas aeruginosa PA01
ucgacgccagcuc

SEQ ID NO: 3471666 - RNA, 18 nt, Pseudomonas aeruginosa PA01
ucgacgccagcucggccg

SEQ ID NO: 3471667 - RNA, 20 nt, Pseudomonas aeruginosa PA01
ucgacgccagcucggccggc

SEQ ID NO: 3471668 - RNA, 21 nt, Pseudomonas aeruginosa PA01
ucgacgccagcucggccggca

SEQ ID NO: 3471669 - RNA, 23 nt, Pseudomonas aeruginosa PA01
ucgacgccagcucggccggcagg

SEQ ID NO: 3471670 - RNA, 15 nt, Pseudomonas aeruginosa PA01
ucgacgcccgcuugc

SEQ ID NO: 3471671 - RNA, 19 nt, Pseudomonas aeruginosa PA01
ucgacgcccucggcgacga

SEQ ID NO: 3471672 - RNA, 16 nt, Pseudomonas aeruginosa PA01
ucgacgcccuggcgcu

SEQ ID NO: 3471673 - RNA, 13 nt, Pseudomonas aeruginosa PA01
ucgacgcccuggg

SEQ ID NO: 3471674 - RNA, 17 nt, Pseudomonas aeruginosa PA01
ucgacgcccugggcgac

SEQ ID NO: 3471675 - RNA, 15 nt, Pseudomonas aeruginosa PA01
ucgacgccgaagccg

SEQ ID NO: 3471676 - RNA, 17 nt, Pseudomonas aeruginosa PA01
ucgacgccgaagccgcu

SEQ ID NO: 3471677 - RNA, 18 nt, Pseudomonas aeruginosa PA01
ucgacgccgagccagccg

SEQ ID NO: 3471678 - RNA, 14 nt, Pseudomonas aeruginosa PA01
ucgacgccgagcug

SEQ ID NO: 3471679 - RNA, 19 nt, Pseudomonas aeruginosa PA01
ucgacgccgagcugaccac

SEQ ID NO: 3471680 - RNA, 22 nt, Pseudomonas aeruginosa PA01
ucgacgccgagcugaccaccag

SEQ ID NO: 3471681 - RNA, 15 nt, Pseudomonas aeruginosa PA01
ucgacgccgccgagc

SEQ ID NO: 3471682 - RNA, 12 nt, Pseudomonas aeruginosa PA01
ucgacgccgcug

SEQ ID NO: 3471683 - RNA, 17 nt, Pseudomonas aeruginosa PA01
ucgacgccgcuggcggc

SEQ ID NO: 3471684 - RNA, 21 nt, Pseudomonas aeruginosa PA01
ucgacgccggucucggcgaug

SEQ ID NO: 3471685 - RNA, 21 nt, Pseudomonas aeruginosa PA01
ucgacgccuucguggccgcgg

SEQ ID NO: 3471686 - RNA, 13 nt, Pseudomonas aeruginosa PA01
ucgacgcgccacg

SEQ ID NO: 3471687 - RNA, 14 nt, Pseudomonas aeruginosa PA01
ucgacgcgccacgc

SEQ ID NO: 3471688 - RNA, 12 nt, Pseudomonas aeruginosa PA01
ucgacgcgccag

SEQ ID NO: 3471689 - RNA, 14 nt, Pseudomonas aeruginosa PA01
ucgacgcgcggcug

SEQ ID NO: 3471690 - RNA, 15 nt, Pseudomonas aeruginosa PA01
ucgacgcgcggcugc

SEQ ID NO: 3471691 - RNA, 20 nt, Pseudomonas aeruginosa PA01
ucgacgcgcggcugcuugcc

SEQ ID NO: 3471692 - RNA, 15 nt, Pseudomonas aeruginosa PA01
ucgacgcucagcacc

SEQ ID NO: 3471693 - RNA, 20 nt, Pseudomonas aeruginosa PA01
ucgacgcucuccgucagggc

SEQ ID NO: 3471694 - RNA, 13 nt, Pseudomonas aeruginosa PA01
ucgacgcucugcu

SEQ ID NO: 3471695 - RNA, 17 nt, Pseudomonas aeruginosa PA01
ucgacgcugcccagccc

SEQ ID NO: 3471696 - RNA, 18 nt, Pseudomonas aeruginosa PA01
ucgacgcugcccagcccg

SEQ ID NO: 3471697 - RNA, 19 nt, Pseudomonas aeruginosa PA01
ucgacgcugcccagcccgc

SEQ ID NO: 3471698 - RNA, 21 nt, Pseudomonas aeruginosa PA01
ucgacgcugcccagcccgccu

SEQ ID NO: 3471699 - RNA, 20 nt, Pseudomonas aeruginosa PA01
ucgacgcugcuaggcuggaa

SEQ ID NO: 3471700 - RNA, 19 nt, Pseudomonas aeruginosa PA01
ucgacgcuggucaggcuga

SEQ ID NO: 3471701 - RNA, 18 nt, Pseudomonas aeruginosa PA01
ucgacggagagcagcagc

SEQ ID NO: 3471702 - RNA, 17 nt, Pseudomonas aeruginosa PA01
ucgacggauacgccagg

SEQ ID NO: 3471703 - RNA, 12 nt, Pseudomonas aeruginosa PA01
ucgacggcgauc

SEQ ID NO: 3471704 - RNA, 13 nt, Pseudomonas aeruginosa PA01
ucgacggcgaucu

SEQ ID NO: 3471705 - RNA, 15 nt, Pseudomonas aeruginosa PA01
ucgacggcggccgcc

SEQ ID NO: 3471706 - RNA, 17 nt, Pseudomonas aeruginosa PA01
ucgacggcgggagcggc

SEQ ID NO: 3471707 - RNA, 16 nt, Pseudomonas aeruginosa PA01
ucgacgguucgauccc

SEQ ID NO: 3471708 - RNA, 15 nt, Pseudomonas aeruginosa PA01
ucgacgguucgcgaa

SEQ ID NO: 3471709 - RNA, 16 nt, Pseudomonas aeruginosa PA01
ucgacguaccgccugc

SEQ ID NO: 3471710 - RNA, 22 nt, Pseudomonas aeruginosa PA01
ucgacguaccgccugccauccg

SEQ ID NO: 3471711 - RNA, 14 nt, Pseudomonas aeruginosa PA01
ucgacguaggcggc

SEQ ID NO: 3471712 - RNA, 17 nt, Pseudomonas aeruginosa PA01
ucgacguaggcggcgaa

SEQ ID NO: 3471713 - RNA, 18 nt, Pseudomonas aeruginosa PA01
ucgacguaggcggcgagg

SEQ ID NO: 3471714 - RNA, 22 nt, Pseudomonas aeruginosa PA01
ucgacgucauaggccuuggcga

SEQ ID NO: 3471715 - RNA, 14 nt, Pseudomonas aeruginosa PA01
ucgacucgauggcg

SEQ ID NO: 3471716 - RNA, 18 nt, Pseudomonas aeruginosa PA01
ucgacucggugcguagcg

SEQ ID NO: 3471717 - RNA, 17 nt, Pseudomonas aeruginosa PA01
ucgacugcaugaccucc

SEQ ID NO: 3471718 - RNA, 20 nt, Pseudomonas aeruginosa PA01
ucgacugcuggguacgguug

SEQ ID NO: 3471719 - RNA, 13 nt, Pseudomonas aeruginosa PA01
ucgacuucgacga

SEQ ID NO: 3471720 - RNA, 17 nt, Pseudomonas aeruginosa PA01
ucgacuucgcaccagcc

SEQ ID NO: 3471721 - RNA, 23 nt, Pseudomonas aeruginosa PA01
ucgacuucuucgcuggaccaggc

SEQ ID NO: 3471722 - RNA, 15 nt, Pseudomonas aeruginosa PA01
ucgagaaagcgcagg

SEQ ID NO: 3471723 - RNA, 22 nt, Pseudomonas aeruginosa PA01
ucgagaaagcgcaggaagcugc

SEQ ID NO: 3471724 - RNA, 14 nt, Pseudomonas aeruginosa PA01
ucgagaaggcugcc

SEQ ID NO: 3471725 - RNA, 17 nt, Pseudomonas aeruginosa PA01
ucgagacccgcaacacc

SEQ ID NO: 3471726 - RNA, 15 nt, Pseudomonas aeruginosa PA01
ucgagacgccaucaa

SEQ ID NO: 3471727 - RNA, 15 nt, Pseudomonas aeruginosa PA01
ucgagacgccguagc

SEQ ID NO: 3471728 - RNA, 18 nt, Pseudomonas aeruginosa PA01
ucgagagaauccgccguu

SEQ ID NO: 3471729 - RNA, 18 nt, Pseudomonas aeruginosa PA01
ucgagaugcugcgggcgc

SEQ ID NO: 3471730 - RNA, 15 nt, Pseudomonas aeruginosa PA01
ucgagcaacagcagg

SEQ ID NO: 3471731 - RNA, 16 nt, Pseudomonas aeruginosa PA01
ucgagcaacagcagga

SEQ ID NO: 3471732 - RNA, 22 nt, Pseudomonas aeruginosa PA01
ucgagcaauugccagaggcugc

SEQ ID NO: 3471733 - RNA, 23 nt, Pseudomonas aeruginosa PA01
ucgagcaauugccagaggcugcg

SEQ ID NO: 3471734 - RNA, 17 nt, Pseudomonas aeruginosa PA01
ucgagcaccaccacucg

SEQ ID NO: 3471735 - RNA, 19 nt, Pseudomonas aeruginosa PA01
ucgagcaccaccacucgcg

SEQ ID NO: 3471736 - RNA, 18 nt, Pseudomonas aeruginosa PA01
ucgauauccagcggcagc

SEQ ID NO: 3471737 - RNA, 20 nt, Pseudomonas aeruginosa PA01
ucgauauccagcggcagccc

SEQ ID NO: 3471738 - RNA, 19 nt, Pseudomonas aeruginosa PA01
ucgaucacccgcgaggccg

SEQ ID NO: 3471739 - RNA, 21 nt, Pseudomonas aeruginosa PA01
ucgaucacccgcgaggccggc

SEQ ID NO: 3471740 - RNA, 20 nt, Pseudomonas aeruginosa PA01
ucgaucaccgcaucgaaggc

SEQ ID NO: 3471741 - RNA, 14 nt, Pseudomonas aeruginosa PA01
ucgaucaccgcgga

SEQ ID NO: 3471742 - RNA, 16 nt, Pseudomonas aeruginosa PA01
ucgaucaccuugcccu

SEQ ID NO: 3471743 - RNA, 18 nt, Pseudomonas aeruginosa PA01
ucgaucacugccuggcag

SEQ ID NO: 3471744 - RNA, 15 nt, Pseudomonas aeruginosa PA01
ucgaucacuucaccu

SEQ ID NO: 3471745 - RNA, 14 nt, Pseudomonas aeruginosa PA01
ucgaucagcagcac

SEQ ID NO: 3471746 - RNA, 15 nt, Pseudomonas aeruginosa PA01
ucgaucagcagcagc

SEQ ID NO: 3471747 - RNA, 18 nt, Pseudomonas aeruginosa PA01
ucgaucagcagcagcgcc

SEQ ID NO: 3471748 - RNA, 17 nt, Pseudomonas aeruginosa PA01
ucgaucagcagcgccac

SEQ ID NO: 3471749 - RNA, 13 nt, Pseudomonas aeruginosa PA01
ucgaucagccggc

SEQ ID NO: 3471750 - RNA, 15 nt, Pseudomonas aeruginosa PA01
ucgaucagccggcgc

SEQ ID NO: 3471751 - RNA, 21 nt, Pseudomonas aeruginosa PA01
ucgaucagccggcgcgcuucc

SEQ ID NO: 3471752 - RNA, 20 nt, Pseudomonas aeruginosa PA01
ucgaucagcgagcuucgccg

SEQ ID NO: 3471753 - RNA, 14 nt, Pseudomonas aeruginosa PA01
ucgaucagcgccgg

SEQ ID NO: 3471754 - RNA, 14 nt, Pseudomonas aeruginosa PA01
ucgaucagcgcggc

SEQ ID NO: 3471755 - RNA, 15 nt, Pseudomonas aeruginosa PA01
ucgaucagcgcggcc

SEQ ID NO: 3471756 - RNA, 19 nt, Pseudomonas aeruginosa PA01
ucgaucaggaacacccggu

SEQ ID NO: 3471757 - RNA, 21 nt, Pseudomonas aeruginosa PA01
ucgaucaggaacacccggucc

SEQ ID NO: 3471758 - RNA, 16 nt, Pseudomonas aeruginosa PA01
ucgaucaggcgcaugc

SEQ ID NO: 3471759 - RNA, 17 nt, Pseudomonas aeruginosa PA01
ucgaucaggcgcaugcc

SEQ ID NO: 3471760 - RNA, 20 nt, Pseudomonas aeruginosa PA01
ucgaucaggcgcaugcccag

SEQ ID NO: 3471761 - RNA, 22 nt, Pseudomonas aeruginosa PA01
ucgaucaggcgcaugcccaggg

SEQ ID NO: 3471762 - RNA, 21 nt, Pseudomonas aeruginosa PA01
ucgaucagguagucgcccggc

SEQ ID NO: 3471763 - RNA, 14 nt, Pseudomonas aeruginosa PA01
ucgaucaggucgcc

SEQ ID NO: 3471764 - RNA, 16 nt, Pseudomonas aeruginosa PA01
ucgaucaggucgccgc

SEQ ID NO: 3471765 - RNA, 17 nt, Pseudomonas aeruginosa PA01
ucgaucagugcaucggc

SEQ ID NO: 3471766 - RNA, 21 nt, Pseudomonas aeruginosa PA01
ucgaucagugcaucggccgcc

SEQ ID NO: 3471767 - RNA, 17 nt, Pseudomonas aeruginosa PA01
ucgauccccaacccggc

SEQ ID NO: 3471768 - RNA, 18 nt, Pseudomonas aeruginosa PA01
ucgauccccaacccggcc

SEQ ID NO: 3471769 - RNA, 19 nt, Pseudomonas aeruginosa PA01
ucgauccccaacccggcca

SEQ ID NO: 3471770 - RNA, 20 nt, Pseudomonas aeruginosa PA01
ucgauccccaacccggccag

SEQ ID NO: 3471771 - RNA, 12 nt, Pseudomonas aeruginosa PA01
ucgaucccguca

SEQ ID NO: 3471772 - RNA, 14 nt, Pseudomonas aeruginosa PA01
ucgauccgcgccug

SEQ ID NO: 3471773 - RNA, 15 nt, Pseudomonas aeruginosa PA01
ucgauccgcugggcc

SEQ ID NO: 3471774 - RNA, 18 nt, Pseudomonas aeruginosa PA01
ucgauccugaccccggcc

SEQ ID NO: 3471775 - RNA, 15 nt, Pseudomonas aeruginosa PA01
ucgaucgagcgaucg

SEQ ID NO: 3471776 - RNA, 18 nt, Pseudomonas aeruginosa PA01
ucgaucgcuucgcggauc

SEQ ID NO: 3471777 - RNA, 15 nt, Pseudomonas aeruginosa PA01
ucgaucggcagggcg

SEQ ID NO: 3471778 - RNA, 14 nt, Pseudomonas aeruginosa PA01
ucgaucggcccggg

SEQ ID NO: 3471779 - RNA, 16 nt, Pseudomonas aeruginosa PA01
ucgaucggcccgggcg

SEQ ID NO: 3471780 - RNA, 17 nt, Pseudomonas aeruginosa PA01
ucgaucggcccgggcgc

SEQ ID NO: 3471781 - RNA, 21 nt, Pseudomonas aeruginosa PA01
ucgaucucaugggucgauugc

SEQ ID NO: 3471782 - RNA, 14 nt, Pseudomonas aeruginosa PA01
ucgaucuccuccuc

SEQ ID NO: 3471783 - RNA, 13 nt, Pseudomonas aeruginosa PA01
ucgaucuccucgc

SEQ ID NO: 3471784 - RNA, 16 nt, Pseudomonas aeruginosa PA01
ucgaucucgaagacca

SEQ ID NO: 3471785 - RNA, 18 nt, Pseudomonas aeruginosa PA01
ucgaucucgaagaccagc

SEQ ID NO: 3471786 - RNA, 20 nt, Pseudomonas aeruginosa PA01
ucgaucucgccgaaggugca

SEQ ID NO: 3471787 - RNA, 19 nt, Pseudomonas aeruginosa PA01
ucgaucucgcguuccagca

SEQ ID NO: 3471788 - RNA, 14 nt, Pseudomonas aeruginosa PA01
ucgaucucguagcg

SEQ ID NO: 3471789 - RNA, 17 nt, Pseudomonas aeruginosa PA01
ucgaucugcucguccag

SEQ ID NO: 3471790 - RNA, 23 nt, Pseudomonas aeruginosa PA01
ucgaucugcucguccaggccgca

SEQ ID NO: 3471791 - RNA, 14 nt, Pseudomonas aeruginosa PA01
ucgaucuggcugcc

SEQ ID NO: 3471792 - RNA, 17 nt, Pseudomonas aeruginosa PA01
ucgaucuggcugcccag

SEQ ID NO: 3471793 - RNA, 18 nt, Pseudomonas aeruginosa PA01
ucgaucugucgcagcggg

SEQ ID NO: 3471794 - RNA, 15 nt, Pseudomonas aeruginosa PA01
ucgaucuuguagccg

SEQ ID NO: 3471795 - RNA, 15 nt, Pseudomonas aeruginosa PA01
ucgaugaaaccggcc

SEQ ID NO: 3471796 - RNA, 19 nt, Pseudomonas aeruginosa PA01
ucgaugaaauagcucugcc

SEQ ID NO: 3471797 - RNA, 21 nt, Pseudomonas aeruginosa PA01
ucgaugaaauagcucugccga

SEQ ID NO: 3471798 - RNA, 16 nt, Pseudomonas aeruginosa PA01
ucgaugaacgcccuga

SEQ ID NO: 3471799 - RNA, 17 nt, Pseudomonas aeruginosa PA01
ucgaugaacgcgcggac

SEQ ID NO: 3471800 - RNA, 14 nt, Pseudomonas aeruginosa PA01
ucgaugaauggcuu

SEQ ID NO: 3471801 - RNA, 17 nt, Pseudomonas aeruginosa PA01
ucgaugaccuugccgcg

SEQ ID NO: 3471802 - RNA, 18 nt, Pseudomonas aeruginosa PA01
ucgaugaccuugccgcga

SEQ ID NO: 3471803 - RNA, 20 nt, Pseudomonas aeruginosa PA01
ucgaugacgaggcccgccca

SEQ ID NO: 3471804 - RNA, 17 nt, Pseudomonas aeruginosa PA01
ucgaugagcaugccgca

SEQ ID NO: 3471805 - RNA, 19 nt, Pseudomonas aeruginosa PA01
ucgaugagcaugccgcaga

SEQ ID NO: 3471806 - RNA, 21 nt, Pseudomonas aeruginosa PA01
ucgaugauccacuugccgccg

SEQ ID NO: 3471807 - RNA, 13 nt, Pseudomonas aeruginosa PA01
ucgaugaucccga

SEQ ID NO: 3471808 - RNA, 20 nt, Pseudomonas aeruginosa PA01
ucgaugccaucgaggccagg

SEQ ID NO: 3471809 - RNA, 21 nt, Pseudomonas aeruginosa PA01
ucgaugccaucgaggccaggc

SEQ ID NO: 3471810 - RNA, 20 nt, Pseudomonas aeruginosa PA01
ucgaugcccgccagcaggcg

SEQ ID NO: 3471811 - RNA, 22 nt, Pseudomonas aeruginosa PA01
ucgaugcccgccagcaggcgcc

SEQ ID NO: 3471812 - RNA, 17 nt, Pseudomonas aeruginosa PA01
ucgaugcccgccucgcg

SEQ ID NO: 3471813 - RNA, 17 nt, Pseudomonas aeruginosa PA01
ucgaugccgcgcgccug

SEQ ID NO: 3471814 - RNA, 22 nt, Pseudomonas aeruginosa PA01
ucgaugccgcgcgccuggcugg

SEQ ID NO: 3471815 - RNA, 15 nt, Pseudomonas aeruginosa PA01
ucgaugccuucggcg

SEQ ID NO: 3471816 - RNA, 20 nt, Pseudomonas aeruginosa PA01
ucgaugccuucggcggccgg

SEQ ID NO: 3471817 - RNA, 20 nt, Pseudomonas aeruginosa PA01
ucgaugccuugcggccccca

SEQ ID NO: 3471818 - RNA, 16 nt, Pseudomonas aeruginosa PA01
ucgaugcgccucagcg

SEQ ID NO: 3471819 - RNA, 18 nt, Pseudomonas aeruginosa PA01
ucgaugcgccucagcggc

SEQ ID NO: 3471820 - RNA, 20 nt, Pseudomonas aeruginosa PA01
ucgaugcgccucagcggccu

SEQ ID NO: 3471821 - RNA, 13 nt, Pseudomonas aeruginosa PA01
ucgaugcgcgcgg

SEQ ID NO: 3471822 - RNA, 17 nt, Pseudomonas aeruginosa PA01
ucgaugcucauccugcc

SEQ ID NO: 3471823 - RNA, 20 nt, Pseudomonas aeruginosa PA01
ucgaugcuccaaugcaccug

SEQ ID NO: 3471824 - RNA, 17 nt, Pseudomonas aeruginosa PA01
ucgaugcuuagcccggg

SEQ ID NO: 3471825 - RNA, 23 nt, Pseudomonas aeruginosa PA01
ucgauggcagccuuggccacggc

SEQ ID NO: 3471826 - RNA, 22 nt, Pseudomonas aeruginosa PA01
ucgauggcgaagcgcuugccca

SEQ ID NO: 3471827 - RNA, 23 nt, Pseudomonas aeruginosa PA01
ucgauggcgaagcgcuugcccag

SEQ ID NO: 3471828 - RNA, 15 nt, Pseudomonas aeruginosa PA01
ucgauggcggccgcc

SEQ ID NO: 3471829 - RNA, 18 nt, Pseudomonas aeruginosa PA01
ucgauggcggccugguag

SEQ ID NO: 3471830 - RNA, 21 nt, Pseudomonas aeruginosa PA01
ucgaugggcgagcgacgguga

SEQ ID NO: 3471831 - RNA, 13 nt, Pseudomonas aeruginosa PA01
ucgauggucagga

SEQ ID NO: 3471832 - RNA, 18 nt, Pseudomonas aeruginosa PA01
ucgauggucaggcuggcc

SEQ ID NO: 3471833 - RNA, 18 nt, Pseudomonas aeruginosa PA01
ucgauggucuugauccca

SEQ ID NO: 3471834 - RNA, 20 nt, Pseudomonas aeruginosa PA01
ucgauggucuugaucccagg

SEQ ID NO: 3471835 - RNA, 22 nt, Pseudomonas aeruginosa PA01
ucgauggucuugaucccaggga

SEQ ID NO: 3471836 - RNA, 15 nt, Pseudomonas aeruginosa PA01
ucgauggugaucacg

SEQ ID NO: 3471837 - RNA, 21 nt, Pseudomonas aeruginosa PA01
ucgaugguggaauccagggcc

SEQ ID NO: 3471838 - RNA, 21 nt, Pseudomonas aeruginosa PA01
ucgccagaugacgauggccgc

SEQ ID NO: 3471839 - RNA, 22 nt, Pseudomonas aeruginosa PA01
ucgccagaugacgauggccgcc

SEQ ID NO: 3471840 - RNA, 21 nt, Pseudomonas aeruginosa PA01
ucgccagcaauugccgcugca

SEQ ID NO: 3471841 - RNA, 23 nt, Pseudomonas aeruginosa PA01
ucgccagcaccucguaggccgac

SEQ ID NO: 3471842 - RNA, 15 nt, Pseudomonas aeruginosa PA01
ucgccagcaggcugu

SEQ ID NO: 3471843 - RNA, 14 nt, Pseudomonas aeruginosa PA01
ucgccagcccggca

SEQ ID NO: 3471844 - RNA, 21 nt, Pseudomonas aeruginosa PA01
ucgccagcccgguucagcggg

SEQ ID NO: 3471845 - RNA, 14 nt, Pseudomonas aeruginosa PA01
ucgccagccucggc

SEQ ID NO: 3471846 - RNA, 18 nt, Pseudomonas aeruginosa PA01
ucgccagccucggcgaag

SEQ ID NO: 3471847 - RNA, 19 nt, Pseudomonas aeruginosa PA01
ucgccagcgccacggugau

SEQ ID NO: 3471848 - RNA, 16 nt, Pseudomonas aeruginosa PA01
ucgccagcgccagcag

SEQ ID NO: 3471849 - RNA, 17 nt, Pseudomonas aeruginosa PA01
ucgccagcgccagcagg

SEQ ID NO: 3471850 - RNA, 15 nt, Pseudomonas aeruginosa PA01
ucgccagcgccuucg

SEQ ID NO: 3471851 - RNA, 21 nt, Pseudomonas aeruginosa PA01
ucgccagcgcgcgccgacagg

SEQ ID NO: 3471852 - RNA, 21 nt, Pseudomonas aeruginosa PA01
ucgccagcggcguauccucgg

SEQ ID NO: 3471853 - RNA, 21 nt, Pseudomonas aeruginosa PA01
ucgccagcgguacccgccggc

SEQ ID NO: 3471854 - RNA, 22 nt, Pseudomonas aeruginosa PA01
ucgccagcgguacccgccggcc

SEQ ID NO: 3471855 - RNA, 14 nt, Pseudomonas aeruginosa PA01
ucgccagcucgccg

SEQ ID NO: 3471856 - RNA, 16 nt, Pseudomonas aeruginosa PA01
ucgccagcucgccgcg

SEQ ID NO: 3471857 - RNA, 18 nt, Pseudomonas aeruginosa PA01
ucgccagcucgccgcgcu

SEQ ID NO: 3471858 - RNA, 20 nt, Pseudomonas aeruginosa PA01
ucgccagcucgccgcgcucc

SEQ ID NO: 3471859 - RNA, 21 nt, Pseudomonas aeruginosa PA01
ucgccagcucgccgcgcucca

SEQ ID NO: 3471860 - RNA, 14 nt, Pseudomonas aeruginosa PA01
ucgccaggccauug

SEQ ID NO: 3471861 - RNA, 15 nt, Pseudomonas aeruginosa PA01
ucgccaggccguaga

SEQ ID NO: 3471862 - RNA, 22 nt, Pseudomonas aeruginosa PA01
ucgccaggccguagaccaccag

SEQ ID NO: 3471863 - RNA, 16 nt, Pseudomonas aeruginosa PA01
ucgccaggcgauccag

SEQ ID NO: 3471864 - RNA, 14 nt, Pseudomonas aeruginosa PA01
ucgccaggcugauc

SEQ ID NO: 3471865 - RNA, 20 nt, Pseudomonas aeruginosa PA01
ucgccaggcugauccgcgac

SEQ ID NO: 3471866 - RNA, 13 nt, Pseudomonas aeruginosa PA01
ucgccaggcuggc

SEQ ID NO: 3471867 - RNA, 19 nt, Pseudomonas aeruginosa PA01
ucgccagggggaucgcgaa

SEQ ID NO: 3471868 - RNA, 20 nt, Pseudomonas aeruginosa PA01
ucgccagggucuugccgacc

SEQ ID NO: 3471869 - RNA, 21 nt, Pseudomonas aeruginosa PA01
ucgccagggucuugccgaccu

SEQ ID NO: 3471870 - RNA, 22 nt, Pseudomonas aeruginosa PA01
ucgccaguuccgugucgagggc

SEQ ID NO: 3471871 - RNA, 12 nt, Pseudomonas aeruginosa PA01
ucgccauccugg

SEQ ID NO: 3471872 - RNA, 17 nt, Pseudomonas aeruginosa PA01
ucgccauccuggucgcg

SEQ ID NO: 3471873 - RNA, 18 nt, Pseudomonas aeruginosa PA01
ucgccaucgcucaccgga

SEQ ID NO: 3471874 - RNA, 18 nt, Pseudomonas aeruginosa PA01
ucgccaugcccgucgacc

SEQ ID NO: 3471875 - RNA, 18 nt, Pseudomonas aeruginosa PA01
ucgccaugcggcaggccu

SEQ ID NO: 3471876 - RNA, 15 nt, Pseudomonas aeruginosa PA01
ucgccauggcgcugc

SEQ ID NO: 3471877 - RNA, 22 nt, Pseudomonas aeruginosa PA01
ucgccauggucguucagcggcg

SEQ ID NO: 3471878 - RNA, 20 nt, Pseudomonas aeruginosa PA01
ucgccauucggcgacgggcu

SEQ ID NO: 3471879 - RNA, 14 nt, Pseudomonas aeruginosa PA01
ucgccauuggccag

SEQ ID NO: 3471880 - RNA, 22 nt, Pseudomonas aeruginosa PA01
ucgccauuggccagggucacgc

SEQ ID NO: 3471881 - RNA, 21 nt, Pseudomonas aeruginosa PA01
ucgcccaccaggucgccguag

SEQ ID NO: 3471882 - RNA, 12 nt, Pseudomonas aeruginosa PA01
ucgcccaccuug

SEQ ID NO: 3471883 - RNA, 19 nt, Pseudomonas aeruginosa PA01
ucgcccagaccugcaauuc

SEQ ID NO: 3471884 - RNA, 13 nt, Pseudomonas aeruginosa PA01
ucgcccagcgccu

SEQ ID NO: 3471885 - RNA, 14 nt, Pseudomonas aeruginosa PA01
ucgcccagcgccug

SEQ ID NO: 3471886 - RNA, 14 nt, Pseudomonas aeruginosa PA01
ucgcccagcggcug

SEQ ID NO: 3471887 - RNA, 20 nt, Pseudomonas aeruginosa PA01
ucgcccagcggcuggcgggc

SEQ ID NO: 3471888 - RNA, 14 nt, Pseudomonas aeruginosa PA01
ucgcccagcucgcc

SEQ ID NO: 3471889 - RNA, 15 nt, Pseudomonas aeruginosa PA01
ucgcccagcucgccg

SEQ ID NO: 3471890 - RNA, 16 nt, Pseudomonas aeruginosa PA01
ucgcccagcucgccgc

SEQ ID NO: 3471891 - RNA, 16 nt, Pseudomonas aeruginosa PA01
ucgcccaggccgcugg

SEQ ID NO: 3471892 - RNA, 20 nt, Pseudomonas aeruginosa PA01
ucgcccaggccgcuggcggc

SEQ ID NO: 3471893 - RNA, 23 nt, Pseudomonas aeruginosa PA01
ucgcccagggcguggucggcggc

SEQ ID NO: 3471894 - RNA, 22 nt, Pseudomonas aeruginosa PA01
ucgcccaguaccacgcagccac

SEQ ID NO: 3471895 - RNA, 20 nt, Pseudomonas aeruginosa PA01
ucgcccagugguuccaggag

SEQ ID NO: 3471896 - RNA, 13 nt, Pseudomonas aeruginosa PA01
ucgcccaucugcg

SEQ ID NO: 3471897 - RNA, 20 nt, Pseudomonas aeruginosa PA01
ucgcccauggcacgcagggc

SEQ ID NO: 3471898 - RNA, 19 nt, Pseudomonas aeruginosa PA01
ucgcccaugugcuugaccg

SEQ ID NO: 3471899 - RNA, 17 nt, Pseudomonas aeruginosa PA01
ucgcccauugccgggcu

SEQ ID NO: 3471900 - RNA, 13 nt, Pseudomonas aeruginosa PA01
ucgccccacagcg

SEQ ID NO: 3471901 - RNA, 16 nt, Pseudomonas aeruginosa PA01
ucgccccagccuugcu

SEQ ID NO: 3471902 - RNA, 20 nt, Pseudomonas aeruginosa PA01
ucgccccagccuugcuggac

SEQ ID NO: 3471903 - RNA, 20 nt, Pseudomonas aeruginosa PA01
ucgcccccaccgcccccgca

SEQ ID NO: 3471904 - RNA, 14 nt, Pseudomonas aeruginosa PA01
ucgccccgccgcca

SEQ ID NO: 3471905 - RNA, 14 nt, Pseudomonas aeruginosa PA01
ucgccccgccggga

SEQ ID NO: 3471906 - RNA, 20 nt, Pseudomonas aeruginosa PA01
ucgccccgccgggagcggcc

SEQ ID NO: 3471907 - RNA, 13 nt, Pseudomonas aeruginosa PA01
ucgccccggcggc

SEQ ID NO: 3471908 - RNA, 22 nt, Pseudomonas aeruginosa PA01
ucgccccguuggugcccuugau

SEQ ID NO: 3471909 - RNA, 17 nt, Pseudomonas aeruginosa PA01
ucgcccgaacgccgacc

SEQ ID NO: 3471910 - RNA, 14 nt, Pseudomonas aeruginosa PA01
ucgcccgcagccac

SEQ ID NO: 3471911 - RNA, 19 nt, Pseudomonas aeruginosa PA01
ucgcccgcagccacaggcg

SEQ ID NO: 3471912 - RNA, 23 nt, Pseudomonas aeruginosa PA01
ucgcccgcaguuccucgccgcug

SEQ ID NO: 3471913 - RNA, 21 nt, Pseudomonas aeruginosa PA01
ucgcccgccccauugcguagg

SEQ ID NO: 3471914 - RNA, 22 nt, Pseudomonas aeruginosa PA01
ucgcccgcccucgucgcaccug

SEQ ID NO: 3471915 - RNA, 16 nt, Pseudomonas aeruginosa PA01
ucgcccgccugauggc

SEQ ID NO: 3471916 - RNA, 12 nt, Pseudomonas aeruginosa PA01
ucgcccgcggcg

SEQ ID NO: 3471917 - RNA, 14 nt, Pseudomonas aeruginosa PA01
ucgcccgcggcggc

SEQ ID NO: 3471918 - RNA, 19 nt, Pseudomonas aeruginosa PA01
ucgcccgcggcggcgacgc

SEQ ID NO: 3471919 - RNA, 22 nt, Pseudomonas aeruginosa PA01
ucgcccgcggcggcgacgcugg

SEQ ID NO: 3471920 - RNA, 16 nt, Pseudomonas aeruginosa PA01
ucgcccgcgggcagcu

SEQ ID NO: 3471921 - RNA, 14 nt, Pseudomonas aeruginosa PA01
ucgcccgcugcgcu

SEQ ID NO: 3471922 - RNA, 15 nt, Pseudomonas aeruginosa PA01
ucgcccgcugcgcug

SEQ ID NO: 3471923 - RNA, 17 nt, Pseudomonas aeruginosa PA01
ucgcccgcugcgcugcc

SEQ ID NO: 3471924 - RNA, 19 nt, Pseudomonas aeruginosa PA01
ucgcccggcagcaggccgc

SEQ ID NO: 3471925 - RNA, 20 nt, Pseudomonas aeruginosa PA01
ucgcccggcagcaggccgcc

SEQ ID NO: 3471926 - RNA, 22 nt, Pseudomonas aeruginosa PA01
ucgcccggcagcaggccgccgc

SEQ ID NO: 3471927 - RNA, 19 nt, Pseudomonas aeruginosa PA01
ucgcccggcucgcccaugc

SEQ ID NO: 3471928 - RNA, 14 nt, Pseudomonas aeruginosa PA01
ucgcccggcucggc

SEQ ID NO: 3471929 - RNA, 12 nt, Pseudomonas aeruginosa PA01
ucgcccggcuug

SEQ ID NO: 3471930 - RNA, 16 nt, Pseudomonas aeruginosa PA01
ucgcccgugccucggc

SEQ ID NO: 3471931 - RNA, 17 nt, Pseudomonas aeruginosa PA01
ucgcccgugccucggcg

SEQ ID NO: 3471932 - RNA, 18 nt, Pseudomonas aeruginosa PA01
ucgcccgugccucggcgg

SEQ ID NO: 3471933 - RNA, 15 nt, Pseudomonas aeruginosa PA01
ucgcccuacagcccc

SEQ ID NO: 3471934 - RNA, 15 nt, Pseudomonas aeruginosa PA01
ucgcccuaccgccca

SEQ ID NO: 3471935 - RNA, 15 nt, Pseudomonas aeruginosa PA01
ucgcccuacgaaagc

SEQ ID NO: 3471936 - RNA, 14 nt, Pseudomonas aeruginosa PA01
ucgcccuacgcggc

SEQ ID NO: 3471937 - RNA, 19 nt, Pseudomonas aeruginosa PA01
ucgcccuacggccccaggc

SEQ ID NO: 3471938 - RNA, 20 nt, Pseudomonas aeruginosa PA01
ucgcccuacggccccaggcu

SEQ ID NO: 3471939 - RNA, 15 nt, Pseudomonas aeruginosa PA01
ucgcccuacgggggc

SEQ ID NO: 3471940 - RNA, 22 nt, Pseudomonas aeruginosa PA01
ucgccgccggcgaacagccagc

SEQ ID NO: 3471941 - RNA, 13 nt, Pseudomonas aeruginosa PA01
ucgccgccgggcg

SEQ ID NO: 3471942 - RNA, 14 nt, Pseudomonas aeruginosa PA01
ucgccgccgggcgc

SEQ ID NO: 3471943 - RNA, 15 nt, Pseudomonas aeruginosa PA01
ucgccgccgggcgcg

SEQ ID NO: 3471944 - RNA, 20 nt, Pseudomonas aeruginosa PA01
ucgccgccgggcgcgcgccu

SEQ ID NO: 3471945 - RNA, 21 nt, Pseudomonas aeruginosa PA01
ucgccgccgggcgcgcgccuc

SEQ ID NO: 3471946 - RNA, 22 nt, Pseudomonas aeruginosa PA01
ucgccgccgggcgcgcgccuca

SEQ ID NO: 3471947 - RNA, 21 nt, Pseudomonas aeruginosa PA01
ucgccgccguccuguuucugc

SEQ ID NO: 3471948 - RNA, 17 nt, Pseudomonas aeruginosa PA01
ucgccgccuucggcagg

SEQ ID NO: 3471949 - RNA, 19 nt, Pseudomonas aeruginosa PA01
ucgccgcgaccugcucguc

SEQ ID NO: 3471950 - RNA, 23 nt, Pseudomonas aeruginosa PA01
ucgccgcgaccugcucgucgaug

SEQ ID NO: 3471951 - RNA, 22 nt, Pseudomonas aeruginosa PA01
ucgccgcgacgcuccagcggca

SEQ ID NO: 3471952 - RNA, 17 nt, Pseudomonas aeruginosa PA01
ucgccgcgccgccgagg

SEQ ID NO: 3471953 - RNA, 13 nt, Pseudomonas aeruginosa PA01
ucgccgcgcgcca

SEQ ID NO: 3471954 - RNA, 22 nt, Pseudomonas aeruginosa PA01
ucgccgcgcgccaucaguuccu

SEQ ID NO: 3471955 - RNA, 16 nt, Pseudomonas aeruginosa PA01
ucgccgcgcucgcgca

SEQ ID NO: 3471956 - RNA, 24 nt, Pseudomonas aeruginosa PA01
ucgccgcggaaaacgccgcgaagc

SEQ ID NO: 3471957 - RNA, 22 nt, Pseudomonas aeruginosa PA01
ucgccgcggcgaagcgcucgac

SEQ ID NO: 3471958 - RNA, 20 nt, Pseudomonas aeruginosa PA01
ucgccgcggcguaggcggug

SEQ ID NO: 3471959 - RNA, 20 nt, Pseudomonas aeruginosa PA01
ucgccgcgggcguugcgcgc

SEQ ID NO: 3471960 - RNA, 18 nt, Pseudomonas aeruginosa PA01
ucgccgcucauccgcugg

SEQ ID NO: 3471961 - RNA, 21 nt, Pseudomonas aeruginosa PA01
ucgccgcucauccgcugguag

SEQ ID NO: 3471962 - RNA, 18 nt, Pseudomonas aeruginosa PA01
ucgccgcuccgcgccacg

SEQ ID NO: 3471963 - RNA, 19 nt, Pseudomonas aeruginosa PA01
ucgccgcuccgcgccacgc

SEQ ID NO: 3471964 - RNA, 19 nt, Pseudomonas aeruginosa PA01
ucgccgcugaaguccuggc

SEQ ID NO: 3471965 - RNA, 21 nt, Pseudomonas aeruginosa PA01
ucgccgcugaaguccuggccg

SEQ ID NO: 3471966 - RNA, 15 nt, Pseudomonas aeruginosa PA01
ucgccgcugcuggca

SEQ ID NO: 3471967 - RNA, 14 nt, Pseudomonas aeruginosa PA01
ucgccgcuggacga

SEQ ID NO: 3471968 - RNA, 17 nt, Pseudomonas aeruginosa PA01
ucgccgcugggcagcac

SEQ ID NO: 3471969 - RNA, 18 nt, Pseudomonas aeruginosa PA01
ucgccgcugggcagcacg

SEQ ID NO: 3471970 - RNA, 23 nt, Pseudomonas aeruginosa PA01
ucgccggaagcuucaggcucggc

SEQ ID NO: 3471971 - RNA, 19 nt, Pseudomonas aeruginosa PA01
ucgccggaggggcggccgc

SEQ ID NO: 3471972 - RNA, 20 nt, Pseudomonas aeruginosa PA01
ucgccggaggggcggccgcc

SEQ ID NO: 3471973 - RNA, 23 nt, Pseudomonas aeruginosa PA01
ucgccggagucguagcgcgcggc

SEQ ID NO: 3471974 - RNA, 13 nt, Pseudomonas aeruginosa PA01
ucgccggcagcgc

SEQ ID NO: 3471975 - RNA, 18 nt, Pseudomonas aeruginosa PA01
ucgccggcagcgccgcgc

SEQ ID NO: 3471976 - RNA, 19 nt, Pseudomonas aeruginosa PA01
ucgccggcagcgccgcgcg

SEQ ID NO: 3471977 - RNA, 19 nt, Pseudomonas aeruginosa PA01
ucgccggcaucguggccau

SEQ ID NO: 3471978 - RNA, 20 nt, Pseudomonas aeruginosa PA01
ucgccggcaucguggccaug

SEQ ID NO: 3471979 - RNA, 15 nt, Pseudomonas aeruginosa PA01
ucgccggccaccagg

SEQ ID NO: 3471980 - RNA, 15 nt, Pseudomonas aeruginosa PA01
ucgccggccagcacc

SEQ ID NO: 3471981 - RNA, 12 nt, Pseudomonas aeruginosa PA01
ucgccggccagg

SEQ ID NO: 3471982 - RNA, 19 nt, Pseudomonas aeruginosa PA01
ucgccggccagguagcggc

SEQ ID NO: 3471983 - RNA, 22 nt, Pseudomonas aeruginosa PA01
ucgccggccagguagcggcguu

SEQ ID NO: 3471984 - RNA, 14 nt, Pseudomonas aeruginosa PA01
ucgccggccaggug

SEQ ID NO: 3471985 - RNA, 12 nt, Pseudomonas aeruginosa PA01
ucgccggccagu

SEQ ID NO: 3471986 - RNA, 14 nt, Pseudomonas aeruginosa PA01
ucgccggccaguug

SEQ ID NO: 3471987 - RNA, 15 nt, Pseudomonas aeruginosa PA01
ucgccggcccgcgcg

SEQ ID NO: 3471988 - RNA, 17 nt, Pseudomonas aeruginosa PA01
ucgccggcccgcgcggc

SEQ ID NO: 3471989 - RNA, 20 nt, Pseudomonas aeruginosa PA01
ucgccggcccgcgcggcaac

SEQ ID NO: 3471990 - RNA, 16 nt, Pseudomonas aeruginosa PA01
ucgccggccugcgcgc

SEQ ID NO: 3471991 - RNA, 23 nt, Pseudomonas aeruginosa PA01
ucgccggccugcgcgcaccaggc

SEQ ID NO: 3471992 - RNA, 19 nt, Pseudomonas aeruginosa PA01
ucgccggccuggaucucgg

SEQ ID NO: 3471993 - RNA, 22 nt, Pseudomonas aeruginosa PA01
ucgccggccuggaucucggcgg

SEQ ID NO: 3471994 - RNA, 15 nt, Pseudomonas aeruginosa PA01
ucgccggcgagccgc

SEQ ID NO: 3471995 - RNA, 17 nt, Pseudomonas aeruginosa PA01
ucgccggcgagccgcug

SEQ ID NO: 3471996 - RNA, 17 nt, Pseudomonas aeruginosa PA01
ucgccggcgcgcacggu

SEQ ID NO: 3471997 - RNA, 14 nt, Pseudomonas aeruginosa PA01
ucgccggcgcgggc

SEQ ID NO: 3471998 - RNA, 21 nt, Pseudomonas aeruginosa PA01
ucgccggcguccuccuccagu

SEQ ID NO: 3471999 - RNA, 18 nt, Pseudomonas aeruginosa PA01
ucgccgggaaacagggcg

SEQ ID NO: 3472000 - RNA, 22 nt, Pseudomonas aeruginosa PA01
ucgccgggaaacagggcgacgc

SEQ ID NO: 3472001 - RNA, 13 nt, Pseudomonas aeruginosa PA01
ucgccgggaaucg

SEQ ID NO: 3472002 - RNA, 20 nt, Pseudomonas aeruginosa PA01
ucgccgggcuuuucaaggcg

SEQ ID NO: 3472003 - RNA, 19 nt, Pseudomonas aeruginosa PA01
ucgccggggccuacugcug

SEQ ID NO: 3472004 - RNA, 16 nt, Pseudomonas aeruginosa PA01
ucgccgggucgccgca

SEQ ID NO: 3472005 - RNA, 23 nt, Pseudomonas aeruginosa PA01
ucgccggguggaacgaggcgacc

SEQ ID NO: 3472006 - RNA, 22 nt, Pseudomonas aeruginosa PA01
ucgccggguguuuuuccucgga

SEQ ID NO: 3472007 - RNA, 17 nt, Pseudomonas aeruginosa PA01
ucgccggguugccgcug

SEQ ID NO: 3472008 - RNA, 19 nt, Pseudomonas aeruginosa PA01
ucgccggguugccgcuggc

SEQ ID NO: 3472009 - RNA, 16 nt, Pseudomonas aeruginosa PA01
ucgccggguuguccag

SEQ ID NO: 3472010 - RNA, 23 nt, Pseudomonas aeruginosa PA01
ucgccgguaaugaaaagccccgc

SEQ ID NO: 3472011 - RNA, 14 nt, Pseudomonas aeruginosa PA01
ucgccggucaggcu

SEQ ID NO: 3472012 - RNA, 19 nt, Pseudomonas aeruginosa PA01
ucgccggucaggcugcggc

SEQ ID NO: 3472013 - RNA, 20 nt, Pseudomonas aeruginosa PA01
ucgccggucaggcugcggcg

SEQ ID NO: 3472014 - RNA, 15 nt, Pseudomonas aeruginosa PA01
ucgccgguccucgac

SEQ ID NO: 3472015 - RNA, 15 nt, Pseudomonas aeruginosa PA01
ucgccggugacgcug

SEQ ID NO: 3472016 - RNA, 22 nt, Pseudomonas aeruginosa PA01
ucgccggugaggaugcggaugu

SEQ ID NO: 3472017 - RNA, 18 nt, Pseudomonas aeruginosa PA01
ucgccguagaacagcacg

SEQ ID NO: 3472018 - RNA, 15 nt, Pseudomonas aeruginosa PA01
ucgccgucagacgcg

SEQ ID NO: 3472019 - RNA, 16 nt, Pseudomonas aeruginosa PA01
ucgccgucgagccagc

SEQ ID NO: 3472020 - RNA, 18 nt, Pseudomonas aeruginosa PA01
ucgccgucgagccagccc

SEQ ID NO: 3472021 - RNA, 14 nt, Pseudomonas aeruginosa PA01
ucgccgucggcggu

SEQ ID NO: 3472022 - RNA, 16 nt, Pseudomonas aeruginosa PA01
ucgccgucguccgggu

SEQ ID NO: 3472023 - RNA, 18 nt, Pseudomonas aeruginosa PA01
ucgccgucuuccaccaga

SEQ ID NO: 3472024 - RNA, 17 nt, Pseudomonas aeruginosa PA01
ucgccgugguggccgug

SEQ ID NO: 3472025 - RNA, 13 nt, Pseudomonas aeruginosa PA01
ucgccguucagcu

SEQ ID NO: 3472026 - RNA, 20 nt, Pseudomonas aeruginosa PA01
ucgccguucagcucccaggc

SEQ ID NO: 3472027 - RNA, 22 nt, Pseudomonas aeruginosa PA01
ucgccguucagguucagggugg

SEQ ID NO: 3472028 - RNA, 15 nt, Pseudomonas aeruginosa PA01
ucgccguugccuucg

SEQ ID NO: 3472029 - RNA, 20 nt, Pseudomonas aeruginosa PA01
ucgccguugccuucgccguc

SEQ ID NO: 3472030 - RNA, 21 nt, Pseudomonas aeruginosa PA01
ucgccguugccuucgccgucg

SEQ ID NO: 3472031 - RNA, 14 nt, Pseudomonas aeruginosa PA01
ucgccuaccagacc

SEQ ID NO: 3472032 - RNA, 15 nt, Pseudomonas aeruginosa PA01
ucgccuaccagaccg

SEQ ID NO: 3472033 - RNA, 20 nt, Pseudomonas aeruginosa PA01
ucgccuaccagaccgcagcc

SEQ ID NO: 3472034 - RNA, 23 nt, Pseudomonas aeruginosa PA01
ucgccuaccagaccgcagccggc

SEQ ID NO: 3472035 - RNA, 24 nt, Pseudomonas aeruginosa PA01
ucgccuaccagaccgcagccggcg

SEQ ID NO: 3472036 - RNA, 14 nt, Pseudomonas aeruginosa PA01
ucgccuccaccagc

SEQ ID NO: 3472037 - RNA, 17 nt, Pseudomonas aeruginosa PA01
ucgccuccaccagcgcc

SEQ ID NO: 3472038 - RNA, 20 nt, Pseudomonas aeruginosa PA01
ucgccuccaccagcgccggc

SEQ ID NO: 3472039 - RNA, 17 nt, Pseudomonas aeruginosa PA01
ucgccuccacggcggcc

SEQ ID NO: 3472040 - RNA, 21 nt, Pseudomonas aeruginosa PA01
ucgccucccgccaaauggcuc

SEQ ID NO: 3472041 - RNA, 19 nt, Pseudomonas aeruginosa PA01
ucgcgcagccacuggcgga

SEQ ID NO: 3472042 - RNA, 13 nt, Pseudomonas aeruginosa PA01
ucgcgcagccagg

SEQ ID NO: 3472043 - RNA, 15 nt, Pseudomonas aeruginosa PA01
ucgcgcagccaggcg

SEQ ID NO: 3472044 - RNA, 16 nt, Pseudomonas aeruginosa PA01
ucgcgcagccaggcga

SEQ ID NO: 3472045 - RNA, 21 nt, Pseudomonas aeruginosa PA01
ucgcgcagccaggcgaggaac

SEQ ID NO: 3472046 - RNA, 12 nt, Pseudomonas aeruginosa PA01
ucgcgcagcgcc

SEQ ID NO: 3472047 - RNA, 19 nt, Pseudomonas aeruginosa PA01
ucgcgcagcgccuccagcg

SEQ ID NO: 3472048 - RNA, 12 nt, Pseudomonas aeruginosa PA01
ucgcgcagcggc

SEQ ID NO: 3472049 - RNA, 15 nt, Pseudomonas aeruginosa PA01
ucgcgcagcggcgcg

SEQ ID NO: 3472050 - RNA, 16 nt, Pseudomonas aeruginosa PA01
ucgcgcagcggcgcgu

SEQ ID NO: 3472051 - RNA, 13 nt, Pseudomonas aeruginosa PA01
ucgcgcagcggcu

SEQ ID NO: 3472052 - RNA, 14 nt, Pseudomonas aeruginosa PA01
ucgcgcagcggcuc

SEQ ID NO: 3472053 - RNA, 14 nt, Pseudomonas aeruginosa PA01
ucgcgcagcuccuc

SEQ ID NO: 3472054 - RNA, 17 nt, Pseudomonas aeruginosa PA01
ucgcgcagcuccucggc

SEQ ID NO: 3472055 - RNA, 14 nt, Pseudomonas aeruginosa PA01
ucgcgcagcucggc

SEQ ID NO: 3472056 - RNA, 18 nt, Pseudomonas aeruginosa PA01
ucgcgcagcucggccaac

SEQ ID NO: 3472057 - RNA, 20 nt, Pseudomonas aeruginosa PA01
ucgcgcagcucggccaacug

SEQ ID NO: 3472058 - RNA, 16 nt, Pseudomonas aeruginosa PA01
ucgcgcaggcgcuggc

SEQ ID NO: 3472059 - RNA, 15 nt, Pseudomonas aeruginosa PA01
ucgcgcaggcgggcg

SEQ ID NO: 3472060 - RNA, 20 nt, Pseudomonas aeruginosa PA01
ucgcgcaggcgggcggcguc

SEQ ID NO: 3472061 - RNA, 14 nt, Pseudomonas aeruginosa PA01
ucgcgcaggcggug

SEQ ID NO: 3472062 - RNA, 20 nt, Pseudomonas aeruginosa PA01
ucgcgcagggcagcgcgaua

SEQ ID NO: 3472063 - RNA, 18 nt, Pseudomonas aeruginosa PA01
ucgcgcagggccagggcg

SEQ ID NO: 3472064 - RNA, 19 nt, Pseudomonas aeruginosa PA01
ucgcgcagggccagggcgg

SEQ ID NO: 3472065 - RNA, 20 nt, Pseudomonas aeruginosa PA01
ucgcgcagggccagggcggc

SEQ ID NO: 3472066 - RNA, 22 nt, Pseudomonas aeruginosa PA01
ucgcgcaggugcuuggcaccgc

SEQ ID NO: 3472067 - RNA, 22 nt, Pseudomonas aeruginosa PA01
ucgcgcaguucgucuuccagcg

SEQ ID NO: 3472068 - RNA, 23 nt, Pseudomonas aeruginosa PA01
ucgcgcaguucgucuuccagcgg

SEQ ID NO: 3472069 - RNA, 21 nt, Pseudomonas aeruginosa PA01
ucgcgcaugaccuucagcacc

SEQ ID NO: 3472070 - RNA, 23 nt, Pseudomonas aeruginosa PA01
ucgcgcaugaccuucagcaccug

SEQ ID NO: 3472071 - RNA, 20 nt, Pseudomonas aeruginosa PA01
ucgcgcaugaucgccucggc

SEQ ID NO: 3472072 - RNA, 18 nt, Pseudomonas aeruginosa PA01
ucgcgccagccccaggcg

SEQ ID NO: 3472073 - RNA, 20 nt, Pseudomonas aeruginosa PA01
ucgcgccagccccaggcgcg

SEQ ID NO: 3472074 - RNA, 22 nt, Pseudomonas aeruginosa PA01
ucgcgccagccccaggcgcggc

SEQ ID NO: 3472075 - RNA, 23 nt, Pseudomonas aeruginosa PA01
ucgcgccagccccaggcgcggcg

SEQ ID NO: 3472076 - RNA, 14 nt, Pseudomonas aeruginosa PA01
ucgcgccaggccgc

SEQ ID NO: 3472077 - RNA, 16 nt, Pseudomonas aeruginosa PA01
ucgcgccaggcgaaga

SEQ ID NO: 3472078 - RNA, 19 nt, Pseudomonas aeruginosa PA01
ucgcgccauggccgcugaa

SEQ ID NO: 3472079 - RNA, 22 nt, Pseudomonas aeruginosa PA01
ucgcgcccagugcccggcagau

SEQ ID NO: 3472080 - RNA, 18 nt, Pseudomonas aeruginosa PA01
ucgcgcccccaucugcac

SEQ ID NO: 3472081 - RNA, 16 nt, Pseudomonas aeruginosa PA01
ucgcgccccgccagga

SEQ ID NO: 3472082 - RNA, 14 nt, Pseudomonas aeruginosa PA01
ucgcgcccgcugug

SEQ ID NO: 3472083 - RNA, 19 nt, Pseudomonas aeruginosa PA01
ucgcgccgacgacccggau

SEQ ID NO: 3472084 - RNA, 14 nt, Pseudomonas aeruginosa PA01
ucgcgccgagcugg

SEQ ID NO: 3472085 - RNA, 15 nt, Pseudomonas aeruginosa PA01
ucgcgccgccgaagc

SEQ ID NO: 3472086 - RNA, 14 nt, Pseudomonas aeruginosa PA01
ucgcgccgcgccag

SEQ ID NO: 3472087 - RNA, 15 nt, Pseudomonas aeruginosa PA01
ucgcgccgcgccagc

SEQ ID NO: 3472088 - RNA, 16 nt, Pseudomonas aeruginosa PA01
ucgcgccgcgccagca

SEQ ID NO: 3472089 - RNA, 20 nt, Pseudomonas aeruginosa PA01
ucgcgccgcgccagcaggcg

SEQ ID NO: 3472090 - RNA, 21 nt, Pseudomonas aeruginosa PA01
ucgcgccguccaucaggcguu

SEQ ID NO: 3472091 - RNA, 16 nt, Pseudomonas aeruginosa PA01
ucgcgccgucgcuggc

SEQ ID NO: 3472092 - RNA, 16 nt, Pseudomonas aeruginosa PA01
ucgcgcgaggcgcucu

SEQ ID NO: 3472093 - RNA, 12 nt, Pseudomonas aeruginosa PA01
ucgcgcgccgga

SEQ ID NO: 3472094 - RNA, 17 nt, Pseudomonas aeruginosa PA01
ucgcgcgccggagccac

SEQ ID NO: 3472095 - RNA, 18 nt, Pseudomonas aeruginosa PA01
ucgcgcgccucgcggcgu

SEQ ID NO: 3472096 - RNA, 16 nt, Pseudomonas aeruginosa PA01
ucgcgcgccuucagcc

SEQ ID NO: 3472097 - RNA, 22 nt, Pseudomonas aeruginosa PA01
ucgcgcgcgcuucuugucgucg

SEQ ID NO: 3472098 - RNA, 14 nt, Pseudomonas aeruginosa PA01
ucgcgcgcggccag

SEQ ID NO: 3472099 - RNA, 16 nt, Pseudomonas aeruginosa PA01
ucgcgcgcuggucgac

SEQ ID NO: 3472100 - RNA, 21 nt, Pseudomonas aeruginosa PA01
ucgcgcggauauagcugguca

SEQ ID NO: 3472101 - RNA, 13 nt, Pseudomonas aeruginosa PA01
ucgcgcggccagc

SEQ ID NO: 3472102 - RNA, 17 nt, Pseudomonas aeruginosa PA01
ucgcgcggcgccugcug

SEQ ID NO: 3472103 - RNA, 10 nt, Pseudomonas aeruginosa PA01
ucgcgcggcu

SEQ ID NO: 3472104 - RNA, 13 nt, Pseudomonas aeruginosa PA01
ucgcgcggggcgc

SEQ ID NO: 3472105 - RNA, 17 nt, Pseudomonas aeruginosa PA01
ucgcgcggggcgcgcug

SEQ ID NO: 3472106 - RNA, 13 nt, Pseudomonas aeruginosa PA01
ucgcgcgggucgu

SEQ ID NO: 3472107 - RNA, 22 nt, Pseudomonas aeruginosa PA01
ucgcgcgggugcggcuggcgcg

SEQ ID NO: 3472108 - RNA, 19 nt, Pseudomonas aeruginosa PA01
ucgcgcgguaucccuggaa

SEQ ID NO: 3472109 - RNA, 15 nt, Pseudomonas aeruginosa PA01
ucgcgcguccagccg

SEQ ID NO: 3472110 - RNA, 12 nt, Pseudomonas aeruginosa PA01
ucgcgcguggcc

SEQ ID NO: 3472111 - RNA, 16 nt, Pseudomonas aeruginosa PA01
ucgcgcguggccgcca

SEQ ID NO: 3472112 - RNA, 17 nt, Pseudomonas aeruginosa PA01
ucgcgcguggccgccag

SEQ ID NO: 3472113 - RNA, 21 nt, Pseudomonas aeruginosa PA01
ucgcgcguggccgccaggguc

SEQ ID NO: 3472114 - RNA, 15 nt, Pseudomonas aeruginosa PA01
ucgcgcucaggcgca

SEQ ID NO: 3472115 - RNA, 13 nt, Pseudomonas aeruginosa PA01
ucgcgcuccaggc

SEQ ID NO: 3472116 - RNA, 19 nt, Pseudomonas aeruginosa PA01
ucgcgcuccaggcccggca

SEQ ID NO: 3472117 - RNA, 19 nt, Pseudomonas aeruginosa PA01
ucgcgcucggcgaggccgg

SEQ ID NO: 3472118 - RNA, 14 nt, Pseudomonas aeruginosa PA01
ucgcgcucggcggc

SEQ ID NO: 3472119 - RNA, 13 nt, Pseudomonas aeruginosa PA01
ucgcgcucuggcc

SEQ ID NO: 3472120 - RNA, 15 nt, Pseudomonas aeruginosa PA01
ucgcgcucuggccca

SEQ ID NO: 3472121 - RNA, 15 nt, Pseudomonas aeruginosa PA01
ucgcgcugcccggcg

SEQ ID NO: 3472122 - RNA, 18 nt, Pseudomonas aeruginosa PA01
ucgcgcugcccggcgcga

SEQ ID NO: 3472123 - RNA, 19 nt, Pseudomonas aeruginosa PA01
ucgcgcugcccggcgcgac

SEQ ID NO: 3472124 - RNA, 14 nt, Pseudomonas aeruginosa PA01
ucgcgcuggacccg

SEQ ID NO: 3472125 - RNA, 14 nt, Pseudomonas aeruginosa PA01
ucgcgcuggaccug

SEQ ID NO: 3472126 - RNA, 20 nt, Pseudomonas aeruginosa PA01
ucgcgcuggaccuggccggc

SEQ ID NO: 3472127 - RNA, 23 nt, Pseudomonas aeruginosa PA01
ucgcgcuggaccuggccggcgac

SEQ ID NO: 3472128 - RNA, 13 nt, Pseudomonas aeruginosa PA01
ucgcgcuggccag

SEQ ID NO: 3472129 - RNA, 16 nt, Pseudomonas aeruginosa PA01
ucgcgcugguugccca

SEQ ID NO: 3472130 - RNA, 17 nt, Pseudomonas aeruginosa PA01
ucgcgcuguugccgcgc

SEQ ID NO: 3472131 - RNA, 19 nt, Pseudomonas aeruginosa PA01
ucgcgcuucucgacguagg

SEQ ID NO: 3472132 - RNA, 13 nt, Pseudomonas aeruginosa PA01
ucgcgcuugccuu

SEQ ID NO: 3472133 - RNA, 19 nt, Pseudomonas aeruginosa PA01
ucgcggaaguaggcggcgg

SEQ ID NO: 3472134 - RNA, 21 nt, Pseudomonas aeruginosa PA01
ucgcggaagucggcggguccg

SEQ ID NO: 3472135 - RNA, 14 nt, Pseudomonas aeruginosa PA01
ucgcggaccagcuc

SEQ ID NO: 3472136 - RNA, 20 nt, Pseudomonas aeruginosa PA01
ucgcggaccagcuccgaagg

SEQ ID NO: 3472137 - RNA, 17 nt, Pseudomonas aeruginosa PA01
ucgcggacccgcgccgg

SEQ ID NO: 3472138 - RNA, 23 nt, Pseudomonas aeruginosa PA01
ucgcggacccgcgccggcagcuc

SEQ ID NO: 3472139 - RNA, 17 nt, Pseudomonas aeruginosa PA01
ucgcggaccuccagccg

SEQ ID NO: 3472140 - RNA, 21 nt, Pseudomonas aeruginosa PA01
ucgcggaccuccagccggcca

SEQ ID NO: 3472141 - RNA, 17 nt, Pseudomonas aeruginosa PA01
ucgcggaccucgggcag

SEQ ID NO: 3472142 - RNA, 18 nt, Pseudomonas aeruginosa PA01
ucgcggaccucgggcagc

SEQ ID NO: 3472143 - RNA, 23 nt, Pseudomonas aeruginosa PA01
ucgcggaccucugcguucugcug

SEQ ID NO: 3472144 - RNA, 22 nt, Pseudomonas aeruginosa PA01
ucgcggacgaggauggucaggc

SEQ ID NO: 3472145 - RNA, 15 nt, Pseudomonas aeruginosa PA01
ucgcggacgcuggcg

SEQ ID NO: 3472146 - RNA, 18 nt, Pseudomonas aeruginosa PA01
ucgcggacgcuggcgauc

SEQ ID NO: 3472147 - RNA, 20 nt, Pseudomonas aeruginosa PA01
ucgcggacuccggaggcgca

SEQ ID NO: 3472148 - RNA, 17 nt, Pseudomonas aeruginosa PA01
ucgcggagccaacuucc

SEQ ID NO: 3472149 - RNA, 15 nt, Pseudomonas aeruginosa PA01
ucgcggagcuggaaa

SEQ ID NO: 3472150 - RNA, 14 nt, Pseudomonas aeruginosa PA01
ucgcggaucaacgc

SEQ ID NO: 3472151 - RNA, 15 nt, Pseudomonas aeruginosa PA01
ucgcggauguucacc

SEQ ID NO: 3472152 - RNA, 14 nt, Pseudomonas aeruginosa PA01
ucgcggcaggcggc

SEQ ID NO: 3472153 - RNA, 15 nt, Pseudomonas aeruginosa PA01
ucgcggcaucccgcc

SEQ ID NO: 3472154 - RNA, 14 nt, Pseudomonas aeruginosa PA01
ucgcggccccagca

SEQ ID NO: 3472155 - RNA, 15 nt, Pseudomonas aeruginosa PA01
ucgcggccccagcac

SEQ ID NO: 3472156 - RNA, 17 nt, Pseudomonas aeruginosa PA01
ucgcggccucuucgucg

SEQ ID NO: 3472157 - RNA, 22 nt, Pseudomonas aeruginosa PA01
ucgcggccucuucgucggcgaa

SEQ ID NO: 3472158 - RNA, 17 nt, Pseudomonas aeruginosa PA01
ucgcggccuucucgucg

SEQ ID NO: 3472159 - RNA, 19 nt, Pseudomonas aeruginosa PA01
ucgcggccuucucgucgcc

SEQ ID NO: 3472160 - RNA, 14 nt, Pseudomonas aeruginosa PA01
ucgcggcgacagca

SEQ ID NO: 3472161 - RNA, 21 nt, Pseudomonas aeruginosa PA01
ucgcggcgaugcgcaugcgca

SEQ ID NO: 3472162 - RNA, 18 nt, Pseudomonas aeruginosa PA01
ucgcggcgauggccgcca

SEQ ID NO: 3472163 - RNA, 23 nt, Pseudomonas aeruginosa PA01
ucgcggcgauggccgccagcagg

SEQ ID NO: 3472164 - RNA, 23 nt, Pseudomonas aeruginosa PA01
ucgcggcgcaggcugucggccag

SEQ ID NO: 3472165 - RNA, 15 nt, Pseudomonas aeruginosa PA01
ucgcggcgccuggcg

SEQ ID NO: 3472166 - RNA, 23 nt, Pseudomonas aeruginosa PA01
ucgcggcgcgauauccgccaggg

SEQ ID NO: 3472167 - RNA, 20 nt, Pseudomonas aeruginosa PA01
ucgcggcgcuuguagcccag

SEQ ID NO: 3472168 - RNA, 13 nt, Pseudomonas aeruginosa PA01
ucgcggcggcgcg

SEQ ID NO: 3472169 - RNA, 12 nt, Pseudomonas aeruginosa PA01
ucgcggcguagg

SEQ ID NO: 3472170 - RNA, 23 nt, Pseudomonas aeruginosa PA01
ucgcggcuaucgaucacugccug

SEQ ID NO: 3472171 - RNA, 15 nt, Pseudomonas aeruginosa PA01
ucgcggcucuggcgc

SEQ ID NO: 3472172 - RNA, 16 nt, Pseudomonas aeruginosa PA01
ucgcggcucuggcgca

SEQ ID NO: 3472173 - RNA, 18 nt, Pseudomonas aeruginosa PA01
ucgcggcucuggcgcagg

SEQ ID NO: 3472174 - RNA, 15 nt, Pseudomonas aeruginosa PA01
ucgcggcugaagaag

SEQ ID NO: 3472175 - RNA, 21 nt, Pseudomonas aeruginosa PA01
ucgcggcugcgcgccgggucg

SEQ ID NO: 3472176 - RNA, 15 nt, Pseudomonas aeruginosa PA01
ucgcggcuggccgcc

SEQ ID NO: 3472177 - RNA, 20 nt, Pseudomonas aeruginosa PA01
ucgcggcuuucuuccagcac

SEQ ID NO: 3472178 - RNA, 20 nt, Pseudomonas aeruginosa PA01
ucgcgggcaugcugcucggc

SEQ ID NO: 3472179 - RNA, 12 nt, Pseudomonas aeruginosa PA01
ucgcgggccagg

SEQ ID NO: 3472180 - RNA, 13 nt, Pseudomonas aeruginosa PA01
ucgcgggccaggc

SEQ ID NO: 3472181 - RNA, 15 nt, Pseudomonas aeruginosa PA01
ucgcgggccaggccg

SEQ ID NO: 3472182 - RNA, 19 nt, Pseudomonas aeruginosa PA01
ucgcgggccaggccgagcg

SEQ ID NO: 3472183 - RNA, 14 nt, Pseudomonas aeruginosa PA01
ucgcgggccgcggc

SEQ ID NO: 3472184 - RNA, 16 nt, Pseudomonas aeruginosa PA01
ucgcgggccgcggcga

SEQ ID NO: 3472185 - RNA, 17 nt, Pseudomonas aeruginosa PA01
ucgcgggccgcggcgac

SEQ ID NO: 3472186 - RNA, 19 nt, Pseudomonas aeruginosa PA01
ucgcgggccgcggcgacca

SEQ ID NO: 3472187 - RNA, 14 nt, Pseudomonas aeruginosa PA01
ucgcgggccugggc

SEQ ID NO: 3472188 - RNA, 15 nt, Pseudomonas aeruginosa PA01
ucgcgggccugggca

SEQ ID NO: 3472189 - RNA, 17 nt, Pseudomonas aeruginosa PA01
ucgcgggccugggcauc

SEQ ID NO: 3472190 - RNA, 23 nt, Pseudomonas aeruginosa PA01
ucgcgggcgacgaagcccucgcg

SEQ ID NO: 3472191 - RNA, 17 nt, Pseudomonas aeruginosa PA01
ucgcgggcgacgugggc

SEQ ID NO: 3472192 - RNA, 13 nt, Pseudomonas aeruginosa PA01
ucgcgggcgaugg

SEQ ID NO: 3472193 - RNA, 21 nt, Pseudomonas aeruginosa PA01
ucgcgggcgccguggaucgcc

SEQ ID NO: 3472194 - RNA, 21 nt, Pseudomonas aeruginosa PA01
ucgcgggucaccaccgggaug

SEQ ID NO: 3472195 - RNA, 19 nt, Pseudomonas aeruginosa PA01
ucgcgggugaccuggccgc

SEQ ID NO: 3472196 - RNA, 20 nt, Pseudomonas aeruginosa PA01
ucgcgggugaccuggccgcc

SEQ ID NO: 3472197 - RNA, 20 nt, Pseudomonas aeruginosa PA01
ucgcggguuacuucgccgau

SEQ ID NO: 3472198 - RNA, 15 nt, Pseudomonas aeruginosa PA01
ucgcggguucgaguc

SEQ ID NO: 3472199 - RNA, 15 nt, Pseudomonas aeruginosa PA01
ucgcgguacagccgg

SEQ ID NO: 3472200 - RNA, 20 nt, Pseudomonas aeruginosa PA01
ucgcgguacagcucguccuu

SEQ ID NO: 3472201 - RNA, 14 nt, Pseudomonas aeruginosa PA01
ucgcgguaggccag

SEQ ID NO: 3472202 - RNA, 15 nt, Pseudomonas aeruginosa PA01
ucgcgguaggccagc

SEQ ID NO: 3472203 - RNA, 16 nt, Pseudomonas aeruginosa PA01
ucgcgguaggccagcu

SEQ ID NO: 3472204 - RNA, 18 nt, Pseudomonas aeruginosa PA01
ucgcggucaucgccggcg

SEQ ID NO: 3472205 - RNA, 19 nt, Pseudomonas aeruginosa PA01
ucgcggucaucgccggcgc

SEQ ID NO: 3472206 - RNA, 16 nt, Pseudomonas aeruginosa PA01
ucgcggugcaguucgc

SEQ ID NO: 3472207 - RNA, 23 nt, Pseudomonas aeruginosa PA01
ucgcgguuauccgccgccgggcu

SEQ ID NO: 3472208 - RNA, 18 nt, Pseudomonas aeruginosa PA01
ucgcgguuauccgccgga

SEQ ID NO: 3472209 - RNA, 16 nt, Pseudomonas aeruginosa PA01
ucgcgguucgaggacu

SEQ ID NO: 3472210 - RNA, 17 nt, Pseudomonas aeruginosa PA01
ucgcgguucugcuccug

SEQ ID NO: 3472211 - RNA, 16 nt, Pseudomonas aeruginosa PA01
ucgcgguugccgaagc

SEQ ID NO: 3472212 - RNA, 17 nt, Pseudomonas aeruginosa PA01
ucgcgguugccgaagcg

SEQ ID NO: 3472213 - RNA, 16 nt, Pseudomonas aeruginosa PA01
ucgcgguugcgcugcu

SEQ ID NO: 3472214 - RNA, 16 nt, Pseudomonas aeruginosa PA01
ucgcgguugcugugca

SEQ ID NO: 3472215 - RNA, 17 nt, Pseudomonas aeruginosa PA01
ucgcguacagcgggccg

SEQ ID NO: 3472216 - RNA, 17 nt, Pseudomonas aeruginosa PA01
ucgcguagaccaucgcc

SEQ ID NO: 3472217 - RNA, 22 nt, Pseudomonas aeruginosa PA01
ucgcguagaccaucgccggcga

SEQ ID NO: 3472218 - RNA, 24 nt, Pseudomonas aeruginosa PA01
ucgcguagaccaucgccggcgagc

SEQ ID NO: 3472219 - RNA, 21 nt, Pseudomonas aeruginosa PA01
ucgcguaggacgcauaaccgc

SEQ ID NO: 3472220 - RNA, 18 nt, Pseudomonas aeruginosa PA01
ucgcguagguggcgccgc

SEQ ID NO: 3472221 - RNA, 17 nt, Pseudomonas aeruginosa PA01
ucgcguccagggugcug

SEQ ID NO: 3472222 - RNA, 17 nt, Pseudomonas aeruginosa PA01
ucgcguccggccagccu

SEQ ID NO: 3472223 - RNA, 14 nt, Pseudomonas aeruginosa PA01
ucgcgucgcaggcg

SEQ ID NO: 3472224 - RNA, 18 nt, Pseudomonas aeruginosa PA01
ucgcgucgcaggcgaugc

SEQ ID NO: 3472225 - RNA, 13 nt, Pseudomonas aeruginosa PA01
ucgcgucgccgaa

SEQ ID NO: 3472226 - RNA, 16 nt, Pseudomonas aeruginosa PA01
ucgcgucggccuggcg

SEQ ID NO: 3472227 - RNA, 18 nt, Pseudomonas aeruginosa PA01
ucgcgucggccuggcgca

SEQ ID NO: 3472228 - RNA, 22 nt, Pseudomonas aeruginosa PA01
ucgcgugaaaacaagaagcccc

SEQ ID NO: 3472229 - RNA, 15 nt, Pseudomonas aeruginosa PA01
ucgcgugccagacgc

SEQ ID NO: 3472230 - RNA, 19 nt, Pseudomonas aeruginosa PA01
ucgcguggcccggcgcggc

SEQ ID NO: 3472231 - RNA, 15 nt, Pseudomonas aeruginosa PA01
ucgcgugggccacca

SEQ ID NO: 3472232 - RNA, 16 nt, Pseudomonas aeruginosa PA01
ucgcgugggccaccau

SEQ ID NO: 3472233 - RNA, 14 nt, Pseudomonas aeruginosa PA01
ucgcgugggccagg

SEQ ID NO: 3472234 - RNA, 16 nt, Pseudomonas aeruginosa PA01
ucgcguucaucgucgg

SEQ ID NO: 3472235 - RNA, 20 nt, Pseudomonas aeruginosa PA01
ucgcguucaucgucggcagc

SEQ ID NO: 3472236 - RNA, 22 nt, Pseudomonas aeruginosa PA01
ucgcguucaucgucggcagcca

SEQ ID NO: 3472237 - RNA, 13 nt, Pseudomonas aeruginosa PA01
ucgcguuccagca

SEQ ID NO: 3472238 - RNA, 18 nt, Pseudomonas aeruginosa PA01
ucgcguuccagcaacggc

SEQ ID NO: 3472239 - RNA, 20 nt, Pseudomonas aeruginosa PA01
ucgcguuccagcaccucgcg

SEQ ID NO: 3472240 - RNA, 14 nt, Pseudomonas aeruginosa PA01
ucgcguuccagcuc

SEQ ID NO: 3472241 - RNA, 15 nt, Pseudomonas aeruginosa PA01
ucgcguuccagcucc

SEQ ID NO: 3472242 - RNA, 16 nt, Pseudomonas aeruginosa PA01
ucgcguuccagcuccg

SEQ ID NO: 3472243 - RNA, 17 nt, Pseudomonas aeruginosa PA01
ucgcguucgcuccgggc

SEQ ID NO: 3472244 - RNA, 16 nt, Pseudomonas aeruginosa PA01
ucgcguucggucaggc

SEQ ID NO: 3472245 - RNA, 21 nt, Pseudomonas aeruginosa PA01
ucgcguucgucggccaccagg

SEQ ID NO: 3472246 - RNA, 21 nt, Pseudomonas aeruginosa PA01
ucgcguuggcggugccgcaga

SEQ ID NO: 3472247 - RNA, 15 nt, Pseudomonas aeruginosa PA01
ucggacuugaugacc

SEQ ID NO: 3472248 - RNA, 18 nt, Pseudomonas aeruginosa PA01
ucggacuugcggcccacc

SEQ ID NO: 3472249 - RNA, 14 nt, Pseudomonas aeruginosa PA01
ucggacuugcucca

SEQ ID NO: 3472250 - RNA, 16 nt, Pseudomonas aeruginosa PA01
ucggagaacagcagcg

SEQ ID NO: 3472251 - RNA, 23 nt, Pseudomonas aeruginosa PA01
ucggagaacagcgagaccucgcc

SEQ ID NO: 3472252 - RNA, 14 nt, Pseudomonas aeruginosa PA01
ucggagaccacggu

SEQ ID NO: 3472253 - RNA, 18 nt, Pseudomonas aeruginosa PA01
ucggagagacccgccagc

SEQ ID NO: 3472254 - RNA, 20 nt, Pseudomonas aeruginosa PA01
ucggagagacccgccagcgg

SEQ ID NO: 3472255 - RNA, 21 nt, Pseudomonas aeruginosa PA01
ucggagagauagucgccguuc

SEQ ID NO: 3472256 - RNA, 21 nt, Pseudomonas aeruginosa PA01
ucggagauagccuccuccggc

SEQ ID NO: 3472257 - RNA, 16 nt, Pseudomonas aeruginosa PA01
ucggaggucgagcaga

SEQ ID NO: 3472258 - RNA, 16 nt, Pseudomonas aeruginosa PA01
ucggagguucgaaucc

SEQ ID NO: 3472259 - RNA, 17 nt, Pseudomonas aeruginosa PA01
ucggagugaggccgagc

SEQ ID NO: 3472260 - RNA, 21 nt, Pseudomonas aeruginosa PA01
ucggauaccagaucaccacca

SEQ ID NO: 3472261 - RNA, 21 nt, Pseudomonas aeruginosa PA01
ucggauacggcaggguagcca

SEQ ID NO: 3472262 - RNA, 17 nt, Pseudomonas aeruginosa PA01
ucggauaugccgcucag

SEQ ID NO: 3472263 - RNA, 13 nt, Pseudomonas aeruginosa PA01
ucggaucaggcgg

SEQ ID NO: 3472264 - RNA, 12 nt, Pseudomonas aeruginosa PA01
ucggauccggac

SEQ ID NO: 3472265 - RNA, 16 nt, Pseudomonas aeruginosa PA01
ucggaucggcccggcg

SEQ ID NO: 3472266 - RNA, 15 nt, Pseudomonas aeruginosa PA01
ucggaugcacgugca

SEQ ID NO: 3472267 - RNA, 15 nt, Pseudomonas aeruginosa PA01
ucggaugcagcgcuu

SEQ ID NO: 3472268 - RNA, 16 nt, Pseudomonas aeruginosa PA01
ucggaugcagcgcuug

SEQ ID NO: 3472269 - RNA, 14 nt, Pseudomonas aeruginosa PA01
ucggaugccgcaca

SEQ ID NO: 3472270 - RNA, 15 nt, Pseudomonas aeruginosa PA01
ucggaugccgcacag

SEQ ID NO: 3472271 - RNA, 13 nt, Pseudomonas aeruginosa PA01
ucggauuccagcg

SEQ ID NO: 3472272 - RNA, 15 nt, Pseudomonas aeruginosa PA01
ucggcaaagccgcug

SEQ ID NO: 3472273 - RNA, 18 nt, Pseudomonas aeruginosa PA01
ucggcaacuggcuggccu

SEQ ID NO: 3472274 - RNA, 21 nt, Pseudomonas aeruginosa PA01
ucggcaagcgaaccgaggagg

SEQ ID NO: 3472275 - RNA, 15 nt, Pseudomonas aeruginosa PA01
ucggcaaggcgcagc

SEQ ID NO: 3472276 - RNA, 21 nt, Pseudomonas aeruginosa PA01
ucggcaaggcgcagcuguuca

SEQ ID NO: 3472277 - RNA, 15 nt, Pseudomonas aeruginosa PA01
ucggcaccgaucgcc

SEQ ID NO: 3472278 - RNA, 17 nt, Pseudomonas aeruginosa PA01
ucggcaccgaucgcccg

SEQ ID NO: 3472279 - RNA, 23 nt, Pseudomonas aeruginosa PA01
ucggcaccugcagacgguucagc

SEQ ID NO: 3472280 - RNA, 16 nt, Pseudomonas aeruginosa PA01
ucggcacgcagcagcu

SEQ ID NO: 3472281 - RNA, 14 nt, Pseudomonas aeruginosa PA01
ucggcacgccgaag

SEQ ID NO: 3472282 - RNA, 15 nt, Pseudomonas aeruginosa PA01
ucggcacucagccag

SEQ ID NO: 3472283 - RNA, 16 nt, Pseudomonas aeruginosa PA01
ucggcacucagccagc

SEQ ID NO: 3472284 - RNA, 15 nt, Pseudomonas aeruginosa PA01
ucggcacucaggaaa

SEQ ID NO: 3472285 - RNA, 18 nt, Pseudomonas aeruginosa PA01
ucggcagcacgcugacgc

SEQ ID NO: 3472286 - RNA, 22 nt, Pseudomonas aeruginosa PA01
ucggcagcacgcugacgccggc

SEQ ID NO: 3472287 - RNA, 19 nt, Pseudomonas aeruginosa PA01
ucggcagcagcuugccggc

SEQ ID NO: 3472288 - RNA, 22 nt, Pseudomonas aeruginosa PA01
ucggcagcagcuugccggcaua

SEQ ID NO: 3472289 - RNA, 15 nt, Pseudomonas aeruginosa PA01
ucggcagcaucagcc

SEQ ID NO: 3472290 - RNA, 19 nt, Pseudomonas aeruginosa PA01
ucggcagcaucagccgcga

SEQ ID NO: 3472291 - RNA, 23 nt, Pseudomonas aeruginosa PA01
ucggcagccaucgcauagccggc

SEQ ID NO: 3472292 - RNA, 16 nt, Pseudomonas aeruginosa PA01
ucggcagccguccgcc

SEQ ID NO: 3472293 - RNA, 12 nt, Pseudomonas aeruginosa PA01
ucggcagcgccu

SEQ ID NO: 3472294 - RNA, 19 nt, Pseudomonas aeruginosa PA01
ucggcagcgccucggcggc

SEQ ID NO: 3472295 - RNA, 20 nt, Pseudomonas aeruginosa PA01
ucggcagcgccucggcggcg

SEQ ID NO: 3472296 - RNA, 16 nt, Pseudomonas aeruginosa PA01
ucggcagcgcuggcga

SEQ ID NO: 3472297 - RNA, 18 nt, Pseudomonas aeruginosa PA01
ucggcagcgcuggcgauc

SEQ ID NO: 3472298 - RNA, 21 nt, Pseudomonas aeruginosa PA01
ucggcagcgcuggcgaucacc

SEQ ID NO: 3472299 - RNA, 23 nt, Pseudomonas aeruginosa PA01
ucggcagcgcuggcgaucaccag

SEQ ID NO: 3472300 - RNA, 22 nt, Pseudomonas aeruginosa PA01
ucggcagcgucgagcuggcgca

SEQ ID NO: 3472301 - RNA, 19 nt, Pseudomonas aeruginosa PA01
ucggcagcucgcuaugcag

SEQ ID NO: 3472302 - RNA, 23 nt, Pseudomonas aeruginosa PA01
ucggcagcucgcuaugcagcagg

SEQ ID NO: 3472303 - RNA, 13 nt, Pseudomonas aeruginosa PA01
ucggcaggaaggc

SEQ ID NO: 3472304 - RNA, 19 nt, Pseudomonas aeruginosa PA01
ucggcaggaaggccuggaa

SEQ ID NO: 3472305 - RNA, 18 nt, Pseudomonas aeruginosa PA01
ucggcaggaccgacucca

SEQ ID NO: 3472306 - RNA, 18 nt, Pseudomonas aeruginosa PA01
ucggcaggaccucgggcg

SEQ ID NO: 3472307 - RNA, 19 nt, Pseudomonas aeruginosa PA01
ucggcaggcugcaucggcu

SEQ ID NO: 3472308 - RNA, 13 nt, Pseudomonas aeruginosa PA01
ucggcaggcuggc

SEQ ID NO: 3472309 - RNA, 23 nt, Pseudomonas aeruginosa PA01
ucggcaggcuggcguugacugcc

SEQ ID NO: 3472310 - RNA, 11 nt, Pseudomonas aeruginosa PA01
ucggcagggcg

SEQ ID NO: 3472311 - RNA, 17 nt, Pseudomonas aeruginosa PA01
ucggcagggcgcccgcc

SEQ ID NO: 3472312 - RNA, 22 nt, Pseudomonas aeruginosa PA01
ucggcagggcgcccgcccggca

SEQ ID NO: 3472313 - RNA, 20 nt, Pseudomonas aeruginosa PA01
ucggcagggcgccgaccagc

SEQ ID NO: 3472314 - RNA, 16 nt, Pseudomonas aeruginosa PA01
ucggcaguggugaucc

SEQ ID NO: 3472315 - RNA, 15 nt, Pseudomonas aeruginosa PA01
ucggcauccggcagg

SEQ ID NO: 3472316 - RNA, 18 nt, Pseudomonas aeruginosa PA01
ucggcauccucgccccgc

SEQ ID NO: 3472317 - RNA, 11 nt, Pseudomonas aeruginosa PA01
ucggcaucgac

SEQ ID NO: 3472318 - RNA, 14 nt, Pseudomonas aeruginosa PA01
ucggcaucgaccag

SEQ ID NO: 3472319 - RNA, 18 nt, Pseudomonas aeruginosa PA01
ucggcaucgaccagggcc

SEQ ID NO: 3472320 - RNA, 14 nt, Pseudomonas aeruginosa PA01
ucggcaucgcguag

SEQ ID NO: 3472321 - RNA, 15 nt, Pseudomonas aeruginosa PA01
ucggcaucgcguagg

SEQ ID NO: 3472322 - RNA, 14 nt, Pseudomonas aeruginosa PA01
ucggcauggccgac

SEQ ID NO: 3472323 - RNA, 15 nt, Pseudomonas aeruginosa PA01
ucggcauggccgacc

SEQ ID NO: 3472324 - RNA, 22 nt, Pseudomonas aeruginosa PA01
ucggcauggcuguagggacagg

SEQ ID NO: 3472325 - RNA, 23 nt, Pseudomonas aeruginosa PA01
ucggcaugguccguucggcgccc

SEQ ID NO: 3472326 - RNA, 17 nt, Pseudomonas aeruginosa PA01
ucggccaacggccgcuu

SEQ ID NO: 3472327 - RNA, 17 nt, Pseudomonas aeruginosa PA01
ucggccaacugagcggc

SEQ ID NO: 3472328 - RNA, 18 nt, Pseudomonas aeruginosa PA01
ucggccaacugagcggcg

SEQ ID NO: 3472329 - RNA, 21 nt, Pseudomonas aeruginosa PA01
ucggccaaugcccggaccugg

SEQ ID NO: 3472330 - RNA, 23 nt, Pseudomonas aeruginosa PA01
ucggccaccaccacgaucugcuu

SEQ ID NO: 3472331 - RNA, 13 nt, Pseudomonas aeruginosa PA01
ucggccaccagcg

SEQ ID NO: 3472332 - RNA, 16 nt, Pseudomonas aeruginosa PA01
ucggccaccagggugc

SEQ ID NO: 3472333 - RNA, 19 nt, Pseudomonas aeruginosa PA01
ucggccaccugcuccggcg

SEQ ID NO: 3472334 - RNA, 18 nt, Pseudomonas aeruginosa PA01
ucggccaccuucgcccgc

SEQ ID NO: 3472335 - RNA, 20 nt, Pseudomonas aeruginosa PA01
ucggccacuaucgccaacgc

SEQ ID NO: 3472336 - RNA, 17 nt, Pseudomonas aeruginosa PA01
ucggccagcaaugcccg

SEQ ID NO: 3472337 - RNA, 12 nt, Pseudomonas aeruginosa PA01
ucggccagccag

SEQ ID NO: 3472338 - RNA, 13 nt, Pseudomonas aeruginosa PA01
ucggccagccagg

SEQ ID NO: 3472339 - RNA, 15 nt, Pseudomonas aeruginosa PA01
ucggccagccagggc

SEQ ID NO: 3472340 - RNA, 20 nt, Pseudomonas aeruginosa PA01
ucggccagccagggcagcag

SEQ ID NO: 3472341 - RNA, 14 nt, Pseudomonas aeruginosa PA01
ucggccagccggcg

SEQ ID NO: 3472342 - RNA, 15 nt, Pseudomonas aeruginosa PA01
ucggccagcgccacg

SEQ ID NO: 3472343 - RNA, 22 nt, Pseudomonas aeruginosa PA01
ucggccagcgccacggcgcgga

SEQ ID NO: 3472344 - RNA, 13 nt, Pseudomonas aeruginosa PA01
ucggccagcgccg

SEQ ID NO: 3472345 - RNA, 16 nt, Pseudomonas aeruginosa PA01
ucggccagcgcggcgc

SEQ ID NO: 3472346 - RNA, 17 nt, Pseudomonas aeruginosa PA01
ucggccagcgcggcgcg

SEQ ID NO: 3472347 - RNA, 14 nt, Pseudomonas aeruginosa PA01
ucggccagcggcag

SEQ ID NO: 3472348 - RNA, 17 nt, Pseudomonas aeruginosa PA01
ucggccagcucgccgaa

SEQ ID NO: 3472349 - RNA, 18 nt, Pseudomonas aeruginosa PA01
ucggccagcucgccgaac

SEQ ID NO: 3472350 - RNA, 22 nt, Pseudomonas aeruginosa PA01
ucggccuggcaguugcaguacc

SEQ ID NO: 3472351 - RNA, 13 nt, Pseudomonas aeruginosa PA01
ucggccuggcgca

SEQ ID NO: 3472352 - RNA, 14 nt, Pseudomonas aeruginosa PA01
ucggccuggcgcag

SEQ ID NO: 3472353 - RNA, 15 nt, Pseudomonas aeruginosa PA01
ucggccuggcgcagc

SEQ ID NO: 3472354 - RNA, 19 nt, Pseudomonas aeruginosa PA01
ucggccuggcgcagcggca

SEQ ID NO: 3472355 - RNA, 21 nt, Pseudomonas aeruginosa PA01
ucggccuggcgcagcggcagc

SEQ ID NO: 3472356 - RNA, 13 nt, Pseudomonas aeruginosa PA01
ucggccuggcggu

SEQ ID NO: 3472357 - RNA, 22 nt, Pseudomonas aeruginosa PA01
ucggccuggcgguugaugccga

SEQ ID NO: 3472358 - RNA, 14 nt, Pseudomonas aeruginosa PA01
ucggccuggcugcc

SEQ ID NO: 3472359 - RNA, 19 nt, Pseudomonas aeruginosa PA01
ucggccugggcgcaggccg

SEQ ID NO: 3472360 - RNA, 17 nt, Pseudomonas aeruginosa PA01
ucggccuggggcucggc

SEQ ID NO: 3472361 - RNA, 18 nt, Pseudomonas aeruginosa PA01
ucggccuggggcucggcu

SEQ ID NO: 3472362 - RNA, 19 nt, Pseudomonas aeruginosa PA01
ucggccuggggcucggcuu

SEQ ID NO: 3472363 - RNA, 22 nt, Pseudomonas aeruginosa PA01
ucggccuggggcucggcuucca

SEQ ID NO: 3472364 - RNA, 14 nt, Pseudomonas aeruginosa PA01
ucggccuggugcac

SEQ ID NO: 3472365 - RNA, 18 nt, Pseudomonas aeruginosa PA01
ucggccuggugcaccugg

SEQ ID NO: 3472366 - RNA, 16 nt, Pseudomonas aeruginosa PA01
ucggccuguucgccca

SEQ ID NO: 3472367 - RNA, 18 nt, Pseudomonas aeruginosa PA01
ucggccuguucgcccaag

SEQ ID NO: 3472368 - RNA, 21 nt, Pseudomonas aeruginosa PA01
ucggccuguuuccagaaggcu

SEQ ID NO: 3472369 - RNA, 17 nt, Pseudomonas aeruginosa PA01
ucggccuugagcgccga

SEQ ID NO: 3472370 - RNA, 20 nt, Pseudomonas aeruginosa PA01
ucggccuuggcgauguucac

SEQ ID NO: 3472371 - RNA, 20 nt, Pseudomonas aeruginosa PA01
ucggccuuggucaucagcac

SEQ ID NO: 3472372 - RNA, 19 nt, Pseudomonas aeruginosa PA01
ucggcgaaauccucgcgca

SEQ ID NO: 3472373 - RNA, 20 nt, Pseudomonas aeruginosa PA01
ucggcgaaauccucgcgcac

SEQ ID NO: 3472374 - RNA, 18 nt, Pseudomonas aeruginosa PA01
ucggcgaaaugcaggccg

SEQ ID NO: 3472375 - RNA, 17 nt, Pseudomonas aeruginosa PA01
ucggcgaacaggguggu

SEQ ID NO: 3472376 - RNA, 21 nt, Pseudomonas aeruginosa PA01
ucggcgaacaggguggugucg

SEQ ID NO: 3472377 - RNA, 20 nt, Pseudomonas aeruginosa PA01
ucggcgaacccggcgcggcg

SEQ ID NO: 3472378 - RNA, 18 nt, Pseudomonas aeruginosa PA01
ucggcgaacgacagcacc

SEQ ID NO: 3472379 - RNA, 21 nt, Pseudomonas aeruginosa PA01
ucggcgaacgacagcaccaug

SEQ ID NO: 3472380 - RNA, 22 nt, Pseudomonas aeruginosa PA01
ucggcgaacgacagcaccaugc

SEQ ID NO: 3472381 - RNA, 23 nt, Pseudomonas aeruginosa PA01
ucggcgaacgacagcaccaugcc

SEQ ID NO: 3472382 - RNA, 17 nt, Pseudomonas aeruginosa PA01
ucggcgaacuccgccag

SEQ ID NO: 3472383 - RNA, 18 nt, Pseudomonas aeruginosa PA01
ucggcgaacuccgccagc

SEQ ID NO: 3472384 - RNA, 19 nt, Pseudomonas aeruginosa PA01
ucggcgaacuccgccagcu

SEQ ID NO: 3472385 - RNA, 21 nt, Pseudomonas aeruginosa PA01
ucggcgaagcggaagcgcagc

SEQ ID NO: 3472386 - RNA, 22 nt, Pseudomonas aeruginosa PA01
ucggcgaagcggaagcgcagcc

SEQ ID NO: 3472387 - RNA, 17 nt, Pseudomonas aeruginosa PA01
ucggcgaaguccaccag

SEQ ID NO: 3472388 - RNA, 19 nt, Pseudomonas aeruginosa PA01
ucggcgaaguccaccaggc

SEQ ID NO: 3472389 - RNA, 14 nt, Pseudomonas aeruginosa PA01
ucggcgaagucgcc

SEQ ID NO: 3472390 - RNA, 17 nt, Pseudomonas aeruginosa PA01
ucggcgaagucgccguc

SEQ ID NO: 3472391 - RNA, 16 nt, Pseudomonas aeruginosa PA01
ucggcgacagccgggc

SEQ ID NO: 3472392 - RNA, 17 nt, Pseudomonas aeruginosa PA01
ucggcgacagccgggca

SEQ ID NO: 3472393 - RNA, 18 nt, Pseudomonas aeruginosa PA01
ucggcgacagccgggcag

SEQ ID NO: 3472394 - RNA, 19 nt, Pseudomonas aeruginosa PA01
ucggcgacagccgggcagc

SEQ ID NO: 3472395 - RNA, 17 nt, Pseudomonas aeruginosa PA01
ucggcgacauagccggc

SEQ ID NO: 3472396 - RNA, 18 nt, Pseudomonas aeruginosa PA01
ucggcgaccaacagggcg

SEQ ID NO: 3472397 - RNA, 16 nt, Pseudomonas aeruginosa PA01
ucggcgaccacccggc

SEQ ID NO: 3472398 - RNA, 13 nt, Pseudomonas aeruginosa PA01
ucggcgaccaccg

SEQ ID NO: 3472399 - RNA, 14 nt, Pseudomonas aeruginosa PA01
ucggcgaccagccc

SEQ ID NO: 3472400 - RNA, 16 nt, Pseudomonas aeruginosa PA01
ucggcgaccagcccgc

SEQ ID NO: 3472401 - RNA, 21 nt, Pseudomonas aeruginosa PA01
ucggcgaccuugcgcaccagg

SEQ ID NO: 3472402 - RNA, 22 nt, Pseudomonas aeruginosa PA01
ucggcgaccuugcgcaccaggg

SEQ ID NO: 3472403 - RNA, 23 nt, Pseudomonas aeruginosa PA01
ucggcgaccuugcgcaccagggc

SEQ ID NO: 3472404 - RNA, 14 nt, Pseudomonas aeruginosa PA01
ucggcgacgaggac

SEQ ID NO: 3472405 - RNA, 16 nt, Pseudomonas aeruginosa PA01
ucggcgacgaugccgc

SEQ ID NO: 3472406 - RNA, 15 nt, Pseudomonas aeruginosa PA01
ucggcgacgcugaug

SEQ ID NO: 3472407 - RNA, 22 nt, Pseudomonas aeruginosa PA01
ucggcgacgcugaugaugccgc

SEQ ID NO: 3472408 - RNA, 23 nt, Pseudomonas aeruginosa PA01
ucggcgacgcugaugaugccgcg

SEQ ID NO: 3472409 - RNA, 17 nt, Pseudomonas aeruginosa PA01
ucggcgacgggaagcga

SEQ ID NO: 3472410 - RNA, 22 nt, Pseudomonas aeruginosa PA01
ucggcgacgggcuucgcgaccc

SEQ ID NO: 3472411 - RNA, 22 nt, Pseudomonas aeruginosa PA01
ucggcgagaggucggcgcgccc

SEQ ID NO: 3472412 - RNA, 23 nt, Pseudomonas aeruginosa PA01
ucggcgagaggucggcgcgcccg

SEQ ID NO: 3472413 - RNA, 13 nt, Pseudomonas aeruginosa PA01
ucggcgagcaggu

SEQ ID NO: 3472414 - RNA, 15 nt, Pseudomonas aeruginosa PA01
ucggcgagcagguag

SEQ ID NO: 3472415 - RNA, 22 nt, Pseudomonas aeruginosa PA01
ucggcgagcagguagaccgccu

SEQ ID NO: 3472416 - RNA, 19 nt, Pseudomonas aeruginosa PA01
ucggcgagccgcagcggcu

SEQ ID NO: 3472417 - RNA, 20 nt, Pseudomonas aeruginosa PA01
ucggcgagccgcagcggcuc

SEQ ID NO: 3472418 - RNA, 18 nt, Pseudomonas aeruginosa PA01
ucggcgagccgccgggcg

SEQ ID NO: 3472419 - RNA, 16 nt, Pseudomonas aeruginosa PA01
ucggcgagccggcgca

SEQ ID NO: 3472420 - RNA, 18 nt, Pseudomonas aeruginosa PA01
ucggcgagcgaaggaucg

SEQ ID NO: 3472421 - RNA, 21 nt, Pseudomonas aeruginosa PA01
ucggcgagcgaaggaucgaca

SEQ ID NO: 3472422 - RNA, 21 nt, Pseudomonas aeruginosa PA01
ucggcgaggaacagcaccagc

SEQ ID NO: 3472423 - RNA, 15 nt, Pseudomonas aeruginosa PA01
ucggcgaggaucgcc

SEQ ID NO: 3472424 - RNA, 18 nt, Pseudomonas aeruginosa PA01
ucggcgaggaucgccagc

SEQ ID NO: 3472425 - RNA, 19 nt, Pseudomonas aeruginosa PA01
ucggcgaggaucgccagca

SEQ ID NO: 3472426 - RNA, 20 nt, Pseudomonas aeruginosa PA01
ucggcgaggaucgccagcaa

SEQ ID NO: 3472427 - RNA, 15 nt, Pseudomonas aeruginosa PA01
ucggcgaggccggcg

SEQ ID NO: 3472428 - RNA, 17 nt, Pseudomonas aeruginosa PA01
ucggcgaguuggccgaa

SEQ ID NO: 3472429 - RNA, 19 nt, Pseudomonas aeruginosa PA01
ucggcgaucaggccgaugc

SEQ ID NO: 3472430 - RNA, 12 nt, Pseudomonas aeruginosa PA01
ucggcgaucgcc

SEQ ID NO: 3472431 - RNA, 17 nt, Pseudomonas aeruginosa PA01
ucggcgaucgccaggug

SEQ ID NO: 3472432 - RNA, 19 nt, Pseudomonas aeruginosa PA01
ucggcgaucugugcgagcg

SEQ ID NO: 3472433 - RNA, 12 nt, Pseudomonas aeruginosa PA01
ucggcgaugacc

SEQ ID NO: 3472434 - RNA, 17 nt, Pseudomonas aeruginosa PA01
ucggcgaugaccagcuc

SEQ ID NO: 3472435 - RNA, 20 nt, Pseudomonas aeruginosa PA01
ucggcgaugaccagcucggc

SEQ ID NO: 3472436 - RNA, 21 nt, Pseudomonas aeruginosa PA01
ucggcgaugaccagcucggcg

SEQ ID NO: 3472437 - RNA, 15 nt, Pseudomonas aeruginosa PA01
ucggcgaugccgcgc

SEQ ID NO: 3472438 - RNA, 17 nt, Pseudomonas aeruginosa PA01
ucggcgaugccgcgcca

SEQ ID NO: 3472439 - RNA, 15 nt, Pseudomonas aeruginosa PA01
ucggcgaugccggag

SEQ ID NO: 3472440 - RNA, 22 nt, Pseudomonas aeruginosa PA01
ucggcgaugccggagagcagca

SEQ ID NO: 3472441 - RNA, 13 nt, Pseudomonas aeruginosa PA01
ucggcgauggcca

SEQ ID NO: 3472442 - RNA, 18 nt, Pseudomonas aeruginosa PA01
ucggcgauggccaucagg

SEQ ID NO: 3472443 - RNA, 12 nt, Pseudomonas aeruginosa PA01
ucggcgauggcg

SEQ ID NO: 3472444 - RNA, 13 nt, Pseudomonas aeruginosa PA01
ucggcgauggcgc

SEQ ID NO: 3472445 - RNA, 14 nt, Pseudomonas aeruginosa PA01
ucggcgauggcgua

SEQ ID NO: 3472446 - RNA, 20 nt, Pseudomonas aeruginosa PA01
ucggcgaugucgcgggcaug

SEQ ID NO: 3472447 - RNA, 17 nt, Pseudomonas aeruginosa PA01
ucggcgauucgcggcga

SEQ ID NO: 3472448 - RNA, 19 nt, Pseudomonas aeruginosa PA01
ucggcgauucguucgagca

SEQ ID NO: 3472449 - RNA, 21 nt, Pseudomonas aeruginosa PA01
ucggcgauucguucgagcagc

SEQ ID NO: 3472450 - RNA, 15 nt, Pseudomonas aeruginosa PA01
ucggcgcaggcaugg

SEQ ID NO: 3472451 - RNA, 21 nt, Pseudomonas aeruginosa PA01
ucggcgccagcucggacaagg

SEQ ID NO: 3472452 - RNA, 20 nt, Pseudomonas aeruginosa PA01
ucggcgggagagggcggcga

SEQ ID NO: 3472453 - RNA, 22 nt, Pseudomonas aeruginosa PA01
ucggcgggagagggcggcgacc

SEQ ID NO: 3472454 - RNA, 17 nt, Pseudomonas aeruginosa PA01
ucggcgggaucgacgcc

SEQ ID NO: 3472455 - RNA, 22 nt, Pseudomonas aeruginosa PA01
ucggcgggaucgacgccgcugg

SEQ ID NO: 3472456 - RNA, 15 nt, Pseudomonas aeruginosa PA01
ucggcgggcaccgcc

SEQ ID NO: 3472457 - RNA, 21 nt, Pseudomonas aeruginosa PA01
ucggcgggcaccgccagcccg

SEQ ID NO: 3472458 - RNA, 14 nt, Pseudomonas aeruginosa PA01
ucggcgggcugccg

SEQ ID NO: 3472459 - RNA, 19 nt, Pseudomonas aeruginosa PA01
ucggcgggcugccgcggaa

SEQ ID NO: 3472460 - RNA, 18 nt, Pseudomonas aeruginosa PA01
ucggcggggcgcagcagg

SEQ ID NO: 3472461 - RNA, 23 nt, Pseudomonas aeruginosa PA01
ucggcggggcuuuuuuucgccug

SEQ ID NO: 3472462 - RNA, 21 nt, Pseudomonas aeruginosa PA01
ucggcggguauccgccgggcc

SEQ ID NO: 3472463 - RNA, 23 nt, Pseudomonas aeruginosa PA01
ucggcgggugugguccgcggugu

SEQ ID NO: 3472464 - RNA, 22 nt, Pseudomonas aeruginosa PA01
ucggcgguacgcccuccagcac

SEQ ID NO: 3472465 - RNA, 17 nt, Pseudomonas aeruginosa PA01
ucggcgguagcgcgaag

SEQ ID NO: 3472466 - RNA, 13 nt, Pseudomonas aeruginosa PA01
ucggcgguccagg

SEQ ID NO: 3472467 - RNA, 15 nt, Pseudomonas aeruginosa PA01
ucggcggugaccgga

SEQ ID NO: 3472468 - RNA, 21 nt, Pseudomonas aeruginosa PA01
ucggcgguggggaagcgaucc

SEQ ID NO: 3472469 - RNA, 15 nt, Pseudomonas aeruginosa PA01
ucggcgguggggccg

SEQ ID NO: 3472470 - RNA, 19 nt, Pseudomonas aeruginosa PA01
ucggcgguggggccgccga

SEQ ID NO: 3472471 - RNA, 22 nt, Pseudomonas aeruginosa PA01
ucggcgguggggccgccgaugc

SEQ ID NO: 3472472 - RNA, 15 nt, Pseudomonas aeruginosa PA01
ucggcgguuuccagu

SEQ ID NO: 3472473 - RNA, 22 nt, Pseudomonas aeruginosa PA01
ucggcguagaccuucucguccu

SEQ ID NO: 3472474 - RNA, 19 nt, Pseudomonas aeruginosa PA01
ucggcguagccggccaggg

SEQ ID NO: 3472475 - RNA, 15 nt, Pseudomonas aeruginosa PA01
ucggcguccauggcg

SEQ ID NO: 3472476 - RNA, 18 nt, Pseudomonas aeruginosa PA01
ucggcguccgcggccugc

SEQ ID NO: 3472477 - RNA, 13 nt, Pseudomonas aeruginosa PA01
ucggcgucgaagu

SEQ ID NO: 3472478 - RNA, 24 nt, Pseudomonas aeruginosa PA01
ucggcgucgaaguuggaaggaucg

SEQ ID NO: 3472479 - RNA, 17 nt, Pseudomonas aeruginosa PA01
ucggcgucgcgcuugcc

SEQ ID NO: 3472480 - RNA, 14 nt, Pseudomonas aeruginosa PA01
ucggcgucgggcag

SEQ ID NO: 3472481 - RNA, 16 nt, Pseudomonas aeruginosa PA01
ucggcgucuuccggcu

SEQ ID NO: 3472482 - RNA, 20 nt, Pseudomonas aeruginosa PA01
ucggcgucuuccggcucgcc

SEQ ID NO: 3472483 - RNA, 21 nt, Pseudomonas aeruginosa PA01
ucggcgucuuccggcucgccg

SEQ ID NO: 3472484 - RNA, 21 nt, Pseudomonas aeruginosa PA01
ucggcgucuucggcggcgccg

SEQ ID NO: 3472485 - RNA, 15 nt, Pseudomonas aeruginosa PA01
ucggcgugccgggcc

SEQ ID NO: 3472486 - RNA, 16 nt, Pseudomonas aeruginosa PA01
ucggcgugccgggccg

SEQ ID NO: 3472487 - RNA, 20 nt, Pseudomonas aeruginosa PA01
ucggcgugccgggccggcca

SEQ ID NO: 3472488 - RNA, 23 nt, Pseudomonas aeruginosa PA01
ucggcgugcugggucuccuccuc

SEQ ID NO: 3472489 - RNA, 17 nt, Pseudomonas aeruginosa PA01
ucggcguucaccgcgca

SEQ ID NO: 3472490 - RNA, 22 nt, Pseudomonas aeruginosa PA01
ucggcguuuagcgcccgacggc

SEQ ID NO: 3472491 - RNA, 21 nt, Pseudomonas aeruginosa PA01
ucggcguuuuuuuauccucgc

SEQ ID NO: 3472492 - RNA, 15 nt, Pseudomonas aeruginosa PA01
ucggcuaaccgccuu

SEQ ID NO: 3472493 - RNA, 15 nt, Pseudomonas aeruginosa PA01
ucggcucagccgacc

SEQ ID NO: 3472494 - RNA, 17 nt, Pseudomonas aeruginosa PA01
ucggcuccagcaccagc

SEQ ID NO: 3472495 - RNA, 23 nt, Pseudomonas aeruginosa PA01
ucggcuccagcaccagcacgccc

SEQ ID NO: 3472496 - RNA, 14 nt, Pseudomonas aeruginosa PA01
ucggcuccaggacc

SEQ ID NO: 3472497 - RNA, 21 nt, Pseudomonas aeruginosa PA01
ucggcuccaggaccggcaggu

SEQ ID NO: 3472498 - RNA, 23 nt, Pseudomonas aeruginosa PA01
ucggcuccgcucaaccgaacagg

SEQ ID NO: 3472499 - RNA, 14 nt, Pseudomonas aeruginosa PA01
ucggcuccucugcc

SEQ ID NO: 3472500 - RNA, 16 nt, Pseudomonas aeruginosa PA01
ucggcucgcgccggcg

SEQ ID NO: 3472501 - RNA, 13 nt, Pseudomonas aeruginosa PA01
ucggcucggcaag

SEQ ID NO: 3472502 - RNA, 14 nt, Pseudomonas aeruginosa PA01
ucggcucggcaagc

SEQ ID NO: 3472503 - RNA, 17 nt, Pseudomonas aeruginosa PA01
ucggcucgguuccagcu

SEQ ID NO: 3472504 - RNA, 17 nt, Pseudomonas aeruginosa PA01
ucggcugaccggcaucg

SEQ ID NO: 3472505 - RNA, 19 nt, Pseudomonas aeruginosa PA01
ucggcugcaacgccggccc

SEQ ID NO: 3472506 - RNA, 18 nt, Pseudomonas aeruginosa PA01
ucggcugcaacuuccacu

SEQ ID NO: 3472507 - RNA, 23 nt, Pseudomonas aeruginosa PA01
ucggcugcccaagggccugggcg

SEQ ID NO: 3472508 - RNA, 17 nt, Pseudomonas aeruginosa PA01
ucggcugcugcugcggc

SEQ ID NO: 3472509 - RNA, 14 nt, Pseudomonas aeruginosa PA01
ucggcugcuugccg

SEQ ID NO: 3472510 - RNA, 11 nt, Pseudomonas aeruginosa PA01
ucggcuggccg

SEQ ID NO: 3472511 - RNA, 14 nt, Pseudomonas aeruginosa PA01
ucggcuggccgagg

SEQ ID NO: 3472512 - RNA, 21 nt, Pseudomonas aeruginosa PA01
ucggcuggccgagggcgcgca

SEQ ID NO: 3472513 - RNA, 14 nt, Pseudomonas aeruginosa PA01
ucggcugggccagg

SEQ ID NO: 3472514 - RNA, 18 nt, Pseudomonas aeruginosa PA01
ucggcuguuucaggccgg

SEQ ID NO: 3472515 - RNA, 19 nt, Pseudomonas aeruginosa PA01
ucggcuguuucaggccggc

SEQ ID NO: 3472516 - RNA, 20 nt, Pseudomonas aeruginosa PA01
ucggcuguuucaggccggcg

SEQ ID NO: 3472517 - RNA, 12 nt, Pseudomonas aeruginosa PA01
ucggcuucaacg

SEQ ID NO: 3472518 - RNA, 17 nt, Pseudomonas aeruginosa PA01
ucggcuucaacgcgacg

SEQ ID NO: 3472519 - RNA, 14 nt, Pseudomonas aeruginosa PA01
ucggcuuccaucac

SEQ ID NO: 3472520 - RNA, 15 nt, Pseudomonas aeruginosa PA01
ucggcuuccugggcg

SEQ ID NO: 3472521 - RNA, 24 nt, Pseudomonas aeruginosa PA01
ucggcuucgcccauggcacgcagg

SEQ ID NO: 3472522 - RNA, 20 nt, Pseudomonas aeruginosa PA01
ucggcuucgcguugcaggcg

SEQ ID NO: 3472523 - RNA, 18 nt, Pseudomonas aeruginosa PA01
ucggcuucguccugcugc

SEQ ID NO: 3472524 - RNA, 19 nt, Pseudomonas aeruginosa PA01
ucggcuucugguucguccg

SEQ ID NO: 3472525 - RNA, 23 nt, Pseudomonas aeruginosa PA01
ucggcuugaagugauccaggucg

SEQ ID NO: 3472526 - RNA, 18 nt, Pseudomonas aeruginosa PA01
ucggcuugacuggcaguc

SEQ ID NO: 3472527 - RNA, 17 nt, Pseudomonas aeruginosa PA01
ucggcuugcaguucagc

SEQ ID NO: 3472528 - RNA, 20 nt, Pseudomonas aeruginosa PA01
ucggcuugcaguucagccac

SEQ ID NO: 3472529 - RNA, 13 nt, Pseudomonas aeruginosa PA01
ucggcuugccggc

SEQ ID NO: 3472530 - RNA, 15 nt, Pseudomonas aeruginosa PA01
ucggcuugccggcgg

SEQ ID NO: 3472531 - RNA, 16 nt, Pseudomonas aeruginosa PA01
ucgggaaaggccgcca

SEQ ID NO: 3472532 - RNA, 17 nt, Pseudomonas aeruginosa PA01
ucgggaaaggccgccac

SEQ ID NO: 3472533 - RNA, 21 nt, Pseudomonas aeruginosa PA01
ucgggaaaggccgccacggcg

SEQ ID NO: 3472534 - RNA, 18 nt, Pseudomonas aeruginosa PA01
ucgggaagguccuugggc

SEQ ID NO: 3472535 - RNA, 19 nt, Pseudomonas aeruginosa PA01
ucgggacgcaugcgcggcg

SEQ ID NO: 3472536 - RNA, 21 nt, Pseudomonas aeruginosa PA01
ucgggauaccggccaucagca

SEQ ID NO: 3472537 - RNA, 19 nt, Pseudomonas aeruginosa PA01
ucgggaucgagcaacagca

SEQ ID NO: 3472538 - RNA, 14 nt, Pseudomonas aeruginosa PA01
ucgggaugcaguuc

SEQ ID NO: 3472539 - RNA, 21 nt, Pseudomonas aeruginosa PA01
ucgggaugccgugccguggac

SEQ ID NO: 3472540 - RNA, 24 nt, Pseudomonas aeruginosa PA01
ucgggcaacggcugggucacgucc

SEQ ID NO: 3472541 - RNA, 12 nt, Pseudomonas aeruginosa PA01
ucgggcaccagc

SEQ ID NO: 3472542 - RNA, 18 nt, Pseudomonas aeruginosa PA01
ucgggcaccagcacggug

SEQ ID NO: 3472543 - RNA, 20 nt, Pseudomonas aeruginosa PA01
ucgggcagauguccaggcag

SEQ ID NO: 3472544 - RNA, 21 nt, Pseudomonas aeruginosa PA01
ucgggcagauguccaggcagg

SEQ ID NO: 3472545 - RNA, 23 nt, Pseudomonas aeruginosa PA01
ucgggcagcucguugcacagcgc

SEQ ID NO: 3472546 - RNA, 24 nt, Pseudomonas aeruginosa PA01
ucgggcagggcagccgccgcggca

SEQ ID NO: 3472547 - RNA, 14 nt, Pseudomonas aeruginosa PA01
ucgggcagggcauc

SEQ ID NO: 3472548 - RNA, 14 nt, Pseudomonas aeruginosa PA01
ucgggcaguuccgc

SEQ ID NO: 3472549 - RNA, 18 nt, Pseudomonas aeruginosa PA01
ucgggcauggcgaucucc

SEQ ID NO: 3472550 - RNA, 18 nt, Pseudomonas aeruginosa PA01
ucgggccaugagcagggc

SEQ ID NO: 3472551 - RNA, 20 nt, Pseudomonas aeruginosa PA01
ucgggccaugagcagggcgg

SEQ ID NO: 3472552 - RNA, 11 nt, Pseudomonas aeruginosa PA01
ucgggccgcgc

SEQ ID NO: 3472553 - RNA, 15 nt, Pseudomonas aeruginosa PA01
ucgggccggagcagg

SEQ ID NO: 3472554 - RNA, 23 nt, Pseudomonas aeruginosa PA01
ucgucgccguggaugucgaggaa

SEQ ID NO: 3472555 - RNA, 14 nt, Pseudomonas aeruginosa PA01
ucgucgcgccaggc

SEQ ID NO: 3472556 - RNA, 13 nt, Pseudomonas aeruginosa PA01
ucgucgcggcgcc

SEQ ID NO: 3472557 - RNA, 14 nt, Pseudomonas aeruginosa PA01
ucgucgcggcgcga

SEQ ID NO: 3472558 - RNA, 17 nt, Pseudomonas aeruginosa PA01
ucgucgcuauagcggau

SEQ ID NO: 3472559 - RNA, 15 nt, Pseudomonas aeruginosa PA01
ucgucgcugcacgca

SEQ ID NO: 3472560 - RNA, 15 nt, Pseudomonas aeruginosa PA01
ucgucgcuuccggcg

SEQ ID NO: 3472561 - RNA, 19 nt, Pseudomonas aeruginosa PA01
ucgucggacuugaugaccg

SEQ ID NO: 3472562 - RNA, 19 nt, Pseudomonas aeruginosa PA01
ucgucggacuugcggccca

SEQ ID NO: 3472563 - RNA, 12 nt, Pseudomonas aeruginosa PA01
ucgucggcccgc

SEQ ID NO: 3472564 - RNA, 20 nt, Pseudomonas aeruginosa PA01
ucgucggcgaacgaggcgag

SEQ ID NO: 3472565 - RNA, 17 nt, Pseudomonas aeruginosa PA01
ucgucggcgaccuuguc

SEQ ID NO: 3472566 - RNA, 13 nt, Pseudomonas aeruginosa PA01
ucgucggcgacgc

SEQ ID NO: 3472567 - RNA, 13 nt, Pseudomonas aeruginosa PA01
ucgucggcgcggc

SEQ ID NO: 3472568 - RNA, 17 nt, Pseudomonas aeruginosa PA01
ucgucggcgcggccggc

SEQ ID NO: 3472569 - RNA, 15 nt, Pseudomonas aeruginosa PA01
ucgucggcggggcgc

SEQ ID NO: 3472570 - RNA, 21 nt, Pseudomonas aeruginosa PA01
ucgucgggacgcaugcgcggc

SEQ ID NO: 3472571 - RNA, 22 nt, Pseudomonas aeruginosa PA01
ucgucgggacgcaugcgcggcg

SEQ ID NO: 3472572 - RNA, 23 nt, Pseudomonas aeruginosa PA01
ucgucgggcagaguggcgcggcu

SEQ ID NO: 3472573 - RNA, 19 nt, Pseudomonas aeruginosa PA01
ucgucggggugccgccagu

SEQ ID NO: 3472574 - RNA, 14 nt, Pseudomonas aeruginosa PA01
ucgucggucggcca

SEQ ID NO: 3472575 - RNA, 15 nt, Pseudomonas aeruginosa PA01
ucgucguaguggccg

SEQ ID NO: 3472576 - RNA, 15 nt, Pseudomonas aeruginosa PA01
ucgucguccagcggc

SEQ ID NO: 3472577 - RNA, 18 nt, Pseudomonas aeruginosa PA01
ucgucguccaucgccgcg

SEQ ID NO: 3472578 - RNA, 15 nt, Pseudomonas aeruginosa PA01
ucgucgucggagaua

SEQ ID NO: 3472579 - RNA, 15 nt, Pseudomonas aeruginosa PA01
ucgucguggccauag

SEQ ID NO: 3472580 - RNA, 16 nt, Pseudomonas aeruginosa PA01
ucgucguggccauaga

SEQ ID NO: 3472581 - RNA, 15 nt, Pseudomonas aeruginosa PA01
ucgucguggcgaacc

SEQ ID NO: 3472582 - RNA, 16 nt, Pseudomonas aeruginosa PA01
ucgucguucagcccac

SEQ ID NO: 3472583 - RNA, 16 nt, Pseudomonas aeruginosa PA01
ucgucucagaccuucc

SEQ ID NO: 3472584 - RNA, 23 nt, Pseudomonas aeruginosa PA01
ucgucugcgcggcguucgcccug

SEQ ID NO: 3472585 - RNA, 14 nt, Pseudomonas aeruginosa PA01
ucgucuggcgccug

SEQ ID NO: 3472586 - RNA, 18 nt, Pseudomonas aeruginosa PA01
ucgucuggcgccuggccu

SEQ ID NO: 3472587 - RNA, 22 nt, Pseudomonas aeruginosa PA01
ucgucuggcgccuggccuggaa

SEQ ID NO: 3472588 - RNA, 16 nt, Pseudomonas aeruginosa PA01
ucgucuuccagcggcc

SEQ ID NO: 3472589 - RNA, 22 nt, Pseudomonas aeruginosa PA01
ucgucuuucaggugggccacuu

SEQ ID NO: 3472590 - RNA, 22 nt, Pseudomonas aeruginosa PA01
ucgugaccauaggcuugcgccg

SEQ ID NO: 3472591 - RNA, 18 nt, Pseudomonas aeruginosa PA01
ucgugcagcaagccgcag

SEQ ID NO: 3472592 - RNA, 21 nt, Pseudomonas aeruginosa PA01
ucgugcagcaagccgcagcgc

SEQ ID NO: 3472593 - RNA, 22 nt, Pseudomonas aeruginosa PA01
ucgugcagcaagccgcagcgcc

SEQ ID NO: 3472594 - RNA, 21 nt, Pseudomonas aeruginosa PA01
ucgugcagccagacccagugg

SEQ ID NO: 3472595 - RNA, 12 nt, Pseudomonas aeruginosa PA01
ucgugcagguag

SEQ ID NO: 3472596 - RNA, 17 nt, Pseudomonas aeruginosa PA01
ucgugcagguguucggc

SEQ ID NO: 3472597 - RNA, 20 nt, Pseudomonas aeruginosa PA01
ucgugcagguguucggcggc

SEQ ID NO: 3472598 - RNA, 16 nt, Pseudomonas aeruginosa PA01
ucgugccacaggcccu

SEQ ID NO: 3472599 - RNA, 12 nt, Pseudomonas aeruginosa PA01
ucgugccaggcg

SEQ ID NO: 3472600 - RNA, 17 nt, Pseudomonas aeruginosa PA01
ucgugccaggcggcagc

SEQ ID NO: 3472601 - RNA, 20 nt, Pseudomonas aeruginosa PA01
ucgugccaggcggcagccgc

SEQ ID NO: 3472602 - RNA, 23 nt, Pseudomonas aeruginosa PA01
ucgugccaggcggcagccgcggc

SEQ ID NO: 3472603 - RNA, 20 nt, Pseudomonas aeruginosa PA01
ucgugccaucaggccgcggc

SEQ ID NO: 3472604 - RNA, 14 nt, Pseudomonas aeruginosa PA01
ucgugccuccagcc

SEQ ID NO: 3472605 - RNA, 16 nt, Pseudomonas aeruginosa PA01
ucgugcgaaaaccggu

SEQ ID NO: 3472606 - RNA, 19 nt, Pseudomonas aeruginosa PA01
ucgugcuuggugucggccg

SEQ ID NO: 3472607 - RNA, 12 nt, Pseudomonas aeruginosa PA01
ucguggaaaaag

SEQ ID NO: 3472608 - RNA, 14 nt, Pseudomonas aeruginosa PA01
ucguggaaggcuuc

SEQ ID NO: 3472609 - RNA, 19 nt, Pseudomonas aeruginosa PA01
ucguggacauacaggcgcg

SEQ ID NO: 3472610 - RNA, 21 nt, Pseudomonas aeruginosa PA01
ucguggacccgugcgccccag

SEQ ID NO: 3472611 - RNA, 18 nt, Pseudomonas aeruginosa PA01
ucguggauaggcggcgga

SEQ ID NO: 3472612 - RNA, 12 nt, Pseudomonas aeruginosa PA01
ucguggccgcga

SEQ ID NO: 3472613 - RNA, 14 nt, Pseudomonas aeruginosa PA01
ucguggcgcgccgc

SEQ ID NO: 3472614 - RNA, 13 nt, Pseudomonas aeruginosa PA01
ucguggggccaga

SEQ ID NO: 3472615 - RNA, 22 nt, Pseudomonas aeruginosa PA01
ucgugguccagcucggucagcg

SEQ ID NO: 3472616 - RNA, 13 nt, Pseudomonas aeruginosa PA01
ucguguugcagca

SEQ ID NO: 3472617 - RNA, 22 nt, Pseudomonas aeruginosa PA01
ucguucagcccacccccggccc

SEQ ID NO: 3472618 - RNA, 18 nt, Pseudomonas aeruginosa PA01
ucguuccaucgcaggcag

SEQ ID NO: 3472619 - RNA, 16 nt, Pseudomonas aeruginosa PA01
ucguucccggccuggc

SEQ ID NO: 3472620 - RNA, 17 nt, Pseudomonas aeruginosa PA01
ucguucccggccuggcg

SEQ ID NO: 3472621 - RNA, 14 nt, Pseudomonas aeruginosa PA01
ucguucgagcagcu

SEQ ID NO: 3472622 - RNA, 14 nt, Pseudomonas aeruginosa PA01
ucguucgcccuuca

SEQ ID NO: 3472623 - RNA, 18 nt, Pseudomonas aeruginosa PA01
ucguucggcgaccauuca

SEQ ID NO: 3472624 - RNA, 14 nt, Pseudomonas aeruginosa PA01
ucguucgggcgcua

SEQ ID NO: 3472625 - RNA, 13 nt, Pseudomonas aeruginosa PA01
ucguucgucgccg

SEQ ID NO: 3472626 - RNA, 21 nt, Pseudomonas aeruginosa PA01
ucguucugggucgcgcagggc

SEQ ID NO: 3472627 - RNA, 14 nt, Pseudomonas aeruginosa PA01
ucguucuuccugag

SEQ ID NO: 3472628 - RNA, 22 nt, Pseudomonas aeruginosa PA01
ucguucuugcgcggucccugga

SEQ ID NO: 3472629 - RNA, 14 nt, Pseudomonas aeruginosa PA01
ucguugaagcggcc

SEQ ID NO: 3472630 - RNA, 16 nt, Pseudomonas aeruginosa PA01
ucguugacggugcugu

SEQ ID NO: 3472631 - RNA, 18 nt, Pseudomonas aeruginosa PA01
ucguugagggucagcgac

SEQ ID NO: 3472632 - RNA, 21 nt, Pseudomonas aeruginosa PA01
ucguugaucacgaacagcuug

SEQ ID NO: 3472633 - RNA, 22 nt, Pseudomonas aeruginosa PA01
ucguugcacgcaggccgcugcc

SEQ ID NO: 3472634 - RNA, 15 nt, Pseudomonas aeruginosa PA01
ucguugcccggcuug

SEQ ID NO: 3472635 - RNA, 17 nt, Pseudomonas aeruginosa PA01
ucguugccgaucaucuu

SEQ ID NO: 3472636 - RNA, 13 nt, Pseudomonas aeruginosa PA01
ucguugccgcgcu

SEQ ID NO: 3472637 - RNA, 14 nt, Pseudomonas aeruginosa PA01
ucguugcgccggcc

SEQ ID NO: 3472638 - RNA, 21 nt, Pseudomonas aeruginosa PA01
ucguugcgcgccagcgccacg

SEQ ID NO: 3472639 - RNA, 19 nt, Pseudomonas aeruginosa PA01
ucguugcggaaagcgacgc

SEQ ID NO: 3472640 - RNA, 18 nt, Pseudomonas aeruginosa PA01
ucguugcggaacgcggcu

SEQ ID NO: 3472641 - RNA, 17 nt, Pseudomonas aeruginosa PA01
ucguuggccaggcgcga

SEQ ID NO: 3472642 - RNA, 12 nt, Pseudomonas aeruginosa PA01
ucguuggcccag

SEQ ID NO: 3472643 - RNA, 16 nt, Pseudomonas aeruginosa PA01
ucguuggcggccagca

SEQ ID NO: 3472644 - RNA, 16 nt, Pseudomonas aeruginosa PA01
ucguuguacuggccga

SEQ ID NO: 3472645 - RNA, 15 nt, Pseudomonas aeruginosa PA01
ucguuguugccgcgc

SEQ ID NO: 3472646 - RNA, 13 nt, Pseudomonas aeruginosa PA01
ucguuucccggcg

SEQ ID NO: 3472647 - RNA, 14 nt, Pseudomonas aeruginosa PA01
ucguuucccggcgc

SEQ ID NO: 3472648 - RNA, 19 nt, Pseudomonas aeruginosa PA01
ucuaaccggcguccgggug

SEQ ID NO: 3472649 - RNA, 20 nt, Pseudomonas aeruginosa PA01
ucuaaggaaaaacccggccc

SEQ ID NO: 3472650 - RNA, 22 nt, Pseudomonas aeruginosa PA01
ucuaaggggcggcucggcucca

SEQ ID NO: 3472651 - RNA, 15 nt, Pseudomonas aeruginosa PA01
ucuaagguuuuccgu

SEQ ID NO: 3472652 - RNA, 20 nt, Pseudomonas aeruginosa PA01
ucuacgccauacugggcggc

SEQ ID NO: 3472653 - RNA, 15 nt, Pseudomonas aeruginosa PA01
ucuacgccuugcggc

SEQ ID NO: 3472654 - RNA, 17 nt, Pseudomonas aeruginosa PA01
ucuacgccuugcggcgc

SEQ ID NO: 3472655 - RNA, 24 nt, Pseudomonas aeruginosa PA01
ucuacgccuugcggcgccgaggcc

SEQ ID NO: 3472656 - RNA, 14 nt, Pseudomonas aeruginosa PA01
ucuacuuaggcuca

SEQ ID NO: 3472657 - RNA, 23 nt, Pseudomonas aeruginosa PA01
ucucgcugaguuugcccagcgcc

SEQ ID NO: 3472658 - RNA, 12 nt, Pseudomonas aeruginosa PA01
ucucggccaggu

SEQ ID NO: 3472659 - RNA, 18 nt, Pseudomonas aeruginosa PA01
ucucggcgaacgacagca

SEQ ID NO: 3472660 - RNA, 16 nt, Pseudomonas aeruginosa PA01
ucucggcggccaggcg

SEQ ID NO: 3472661 - RNA, 18 nt, Pseudomonas aeruginosa PA01
ucucggcggccaggcggc

SEQ ID NO: 3472662 - RNA, 16 nt, Pseudomonas aeruginosa PA01
ucucggcugccgccag

SEQ ID NO: 3472663 - RNA, 14 nt, Pseudomonas aeruginosa PA01
ucucggucgccgcc

SEQ ID NO: 3472664 - RNA, 15 nt, Pseudomonas aeruginosa PA01
ucucggucgccgcca

SEQ ID NO: 3472665 - RNA, 13 nt, Pseudomonas aeruginosa PA01
ucucggucgggcg

SEQ ID NO: 3472666 - RNA, 16 nt, Pseudomonas aeruginosa PA01
ucucggugaccaccag

SEQ ID NO: 3472667 - RNA, 20 nt, Pseudomonas aeruginosa PA01
ucucggugcucaggcggccg

SEQ ID NO: 3472668 - RNA, 16 nt, Pseudomonas aeruginosa PA01
ucucgguguccaccac

SEQ ID NO: 3472669 - RNA, 13 nt, Pseudomonas aeruginosa PA01
ucucguagagggg

SEQ ID NO: 3472670 - RNA, 23 nt, Pseudomonas aeruginosa PA01
ucucguccucggcguagccggcc

SEQ ID NO: 3472671 - RNA, 24 nt, Pseudomonas aeruginosa PA01
ucucguccucggggaagcgcggcu

SEQ ID NO: 3472672 - RNA, 17 nt, Pseudomonas aeruginosa PA01
ucucgucgccgcccggc

SEQ ID NO: 3472673 - RNA, 22 nt, Pseudomonas aeruginosa PA01
ucucgucgccgcccggcagcgg

SEQ ID NO: 3472674 - RNA, 14 nt, Pseudomonas aeruginosa PA01
ucucgucgccgccg

SEQ ID NO: 3472675 - RNA, 14 nt, Pseudomonas aeruginosa PA01
ucucgucguagucg

SEQ ID NO: 3472676 - RNA, 14 nt, Pseudomonas aeruginosa PA01
ucucgugggccagc

SEQ ID NO: 3472677 - RNA, 15 nt, Pseudomonas aeruginosa PA01
ucucgugggccagca

SEQ ID NO: 3472678 - RNA, 21 nt, Pseudomonas aeruginosa PA01
ucucguugaguucgaagcgcc

SEQ ID NO: 3472679 - RNA, 15 nt, Pseudomonas aeruginosa PA01
ucucuacgccguagg

SEQ ID NO: 3472680 - RNA, 19 nt, Pseudomonas aeruginosa PA01
ucucuacgccguaggccac

SEQ ID NO: 3472681 - RNA, 19 nt, Pseudomonas aeruginosa PA01
ucucucuaccccgaccacc

SEQ ID NO: 3472682 - RNA, 11 nt, Pseudomonas aeruginosa PA01
ucucugcaucu

SEQ ID NO: 3472683 - RNA, 17 nt, Pseudomonas aeruginosa PA01
ucucugcaucucggucu

SEQ ID NO: 3472684 - RNA, 22 nt, Pseudomonas aeruginosa PA01
ucucugucggagagggagcgcc

SEQ ID NO: 3472685 - RNA, 17 nt, Pseudomonas aeruginosa PA01
ucucuuccucgcugccu

SEQ ID NO: 3472686 - RNA, 19 nt, Pseudomonas aeruginosa PA01
ucugaacgaagaagccggc

SEQ ID NO: 3472687 - RNA, 23 nt, Pseudomonas aeruginosa PA01
ucugaacgaagaagccggccccu

SEQ ID NO: 3472688 - RNA, 19 nt, Pseudomonas aeruginosa PA01
ucugagggacacggcgacc

SEQ ID NO: 3472689 - RNA, 20 nt, Pseudomonas aeruginosa PA01
ucugagggacacggcgaccu

SEQ ID NO: 3472690 - RNA, 16 nt, Pseudomonas aeruginosa PA01
ucugcaacgcggcguc

SEQ ID NO: 3472691 - RNA, 19 nt, Pseudomonas aeruginosa PA01
ucugcacaugcaccaccug

SEQ ID NO: 3472692 - RNA, 17 nt, Pseudomonas aeruginosa PA01
ucugcaccacguucggc

SEQ ID NO: 3472693 - RNA, 22 nt, Pseudomonas aeruginosa PA01
ucugcaccaggcucgccccggc

SEQ ID NO: 3472694 - RNA, 23 nt, Pseudomonas aeruginosa PA01
ucugcaccaggcucgccccggcg

SEQ ID NO: 3472695 - RNA, 19 nt, Pseudomonas aeruginosa PA01
ucugcaccccgucgacgcc

SEQ ID NO: 3472696 - RNA, 22 nt, Pseudomonas aeruginosa PA01
ucugcaccgcccuuucgaacug

SEQ ID NO: 3472697 - RNA, 15 nt, Pseudomonas aeruginosa PA01
ucugcaccucaugcu

SEQ ID NO: 3472698 - RNA, 15 nt, Pseudomonas aeruginosa PA01
ucugcaccuuggcca

SEQ ID NO: 3472699 - RNA, 19 nt, Pseudomonas aeruginosa PA01
ucugcaggacgaagucgcc

SEQ ID NO: 3472700 - RNA, 18 nt, Pseudomonas aeruginosa PA01
ucugcaggccgugccaga

SEQ ID NO: 3472701 - RNA, 16 nt, Pseudomonas aeruginosa PA01
ucugcagggcaucgcg

SEQ ID NO: 3472702 - RNA, 19 nt, Pseudomonas aeruginosa PA01
ucugcaugccguccgggug

SEQ ID NO: 3472703 - RNA, 22 nt, Pseudomonas aeruginosa PA01
ucugcauggcaccgucaagggc

SEQ ID NO: 3472704 - RNA, 14 nt, Pseudomonas aeruginosa PA01
ucugccacccggcg

SEQ ID NO: 3472705 - RNA, 15 nt, Pseudomonas aeruginosa PA01
ucugccacccggcgc

SEQ ID NO: 3472706 - RNA, 21 nt, Pseudomonas aeruginosa PA01
ucugccacccggcgcccggcg

SEQ ID NO: 3472707 - RNA, 16 nt, Pseudomonas aeruginosa PA01
ucugccagaaggccug

SEQ ID NO: 3472708 - RNA, 19 nt, Pseudomonas aeruginosa PA01
ucugccagagcgcugccug

SEQ ID NO: 3472709 - RNA, 18 nt, Pseudomonas aeruginosa PA01
ucugccagcucuugcccu

SEQ ID NO: 3472710 - RNA, 14 nt, Pseudomonas aeruginosa PA01
ucugccccggcuug

SEQ ID NO: 3472711 - RNA, 15 nt, Pseudomonas aeruginosa PA01
ucugcccgccggcgc

SEQ ID NO: 3472712 - RNA, 12 nt, Pseudomonas aeruginosa PA01
ucugcccggcca

SEQ ID NO: 3472713 - RNA, 14 nt, Pseudomonas aeruginosa PA01
ucugcccggccaug

SEQ ID NO: 3472714 - RNA, 13 nt, Pseudomonas aeruginosa PA01
ucugcccggcuuc

SEQ ID NO: 3472715 - RNA, 20 nt, Pseudomonas aeruginosa PA01
ucugcccggcuucgcuggug

SEQ ID NO: 3472716 - RNA, 16 nt, Pseudomonas aeruginosa PA01
ucugccgcagcgccuc

SEQ ID NO: 3472717 - RNA, 23 nt, Pseudomonas aeruginosa PA01
ucugccgcagcgccucccgggcc

SEQ ID NO: 3472718 - RNA, 14 nt, Pseudomonas aeruginosa PA01
ucugccgcuggcgg

SEQ ID NO: 3472719 - RNA, 20 nt, Pseudomonas aeruginosa PA01
ucugccgguaauuggccagg

SEQ ID NO: 3472720 - RNA, 21 nt, Pseudomonas aeruginosa PA01
ucugccgguaauuggccaggc

SEQ ID NO: 3472721 - RNA, 22 nt, Pseudomonas aeruginosa PA01
ucugccggucggaacgaccacg

SEQ ID NO: 3472722 - RNA, 14 nt, Pseudomonas aeruginosa PA01
ucugccucgccgag

SEQ ID NO: 3472723 - RNA, 17 nt, Pseudomonas aeruginosa PA01
ucugccucgccgaggcg

SEQ ID NO: 3472724 - RNA, 17 nt, Pseudomonas aeruginosa PA01
ucugccuguccgcugcg

SEQ ID NO: 3472725 - RNA, 20 nt, Pseudomonas aeruginosa PA01
ucugcgaauagacgccgcug

SEQ ID NO: 3472726 - RNA, 15 nt, Pseudomonas aeruginosa PA01
ucugcgacaugccgg

SEQ ID NO: 3472727 - RNA, 16 nt, Pseudomonas aeruginosa PA01
ucugcgacaugccggu

SEQ ID NO: 3472728 - RNA, 20 nt, Pseudomonas aeruginosa PA01
ucugcgacgagccggacggc

SEQ ID NO: 3472729 - RNA, 21 nt, Pseudomonas aeruginosa PA01
ucugcgacgagccggacggcg

SEQ ID NO: 3472730 - RNA, 23 nt, Pseudomonas aeruginosa PA01
ucugcgaguugaucggcguggcg

SEQ ID NO: 3472731 - RNA, 13 nt, Pseudomonas aeruginosa PA01
ucugcgccgcaag

SEQ ID NO: 3472732 - RNA, 15 nt, Pseudomonas aeruginosa PA01
ucugcgccgcggcgu

SEQ ID NO: 3472733 - RNA, 17 nt, Pseudomonas aeruginosa PA01
ucugcgccgcggcguug

SEQ ID NO: 3472734 - RNA, 13 nt, Pseudomonas aeruginosa PA01
ucugcuccagcaa

SEQ ID NO: 3472735 - RNA, 14 nt, Pseudomonas aeruginosa PA01
ucugcucgaacauc

SEQ ID NO: 3472736 - RNA, 12 nt, Pseudomonas aeruginosa PA01
ucugcucggccu

SEQ ID NO: 3472737 - RNA, 14 nt, Pseudomonas aeruginosa PA01
ucugcucggccugg

SEQ ID NO: 3472738 - RNA, 15 nt, Pseudomonas aeruginosa PA01
ucugcucggccugga

SEQ ID NO: 3472739 - RNA, 11 nt, Pseudomonas aeruginosa PA01
ucugcucggcg

SEQ ID NO: 3472740 - RNA, 14 nt, Pseudomonas aeruginosa PA01
ucugcucggcgaug

SEQ ID NO: 3472741 - RNA, 17 nt, Pseudomonas aeruginosa PA01
ucugcugaauucccgcu

SEQ ID NO: 3472742 - RNA, 14 nt, Pseudomonas aeruginosa PA01
ucugcugcagcauc

SEQ ID NO: 3472743 - RNA, 17 nt, Pseudomonas aeruginosa PA01
ucugcuggauccucgcc

SEQ ID NO: 3472744 - RNA, 12 nt, Pseudomonas aeruginosa PA01
ucugcuggccac

SEQ ID NO: 3472745 - RNA, 21 nt, Pseudomonas aeruginosa PA01
ucugcuggccaccgcggcguc

SEQ ID NO: 3472746 - RNA, 16 nt, Pseudomonas aeruginosa PA01
ucugcuggccgcccuu

SEQ ID NO: 3472747 - RNA, 19 nt, Pseudomonas aeruginosa PA01
ucugcuggccgcccuugcg

SEQ ID NO: 3472748 - RNA, 18 nt, Pseudomonas aeruginosa PA01
ucugcuggccgcgcagga

SEQ ID NO: 3472749 - RNA, 17 nt, Pseudomonas aeruginosa PA01
ucugcugguagcugcug

SEQ ID NO: 3472750 - RNA, 19 nt, Pseudomonas aeruginosa PA01
ucugcuuuccggcccacgc

SEQ ID NO: 3472751 - RNA, 17 nt, Pseudomonas aeruginosa PA01
ucuggaauucgccgcgc

SEQ ID NO: 3472752 - RNA, 15 nt, Pseudomonas aeruginosa PA01
ucuggaucacguagg

SEQ ID NO: 3472753 - RNA, 17 nt, Pseudomonas aeruginosa PA01
ucuggaugcagccgggg

SEQ ID NO: 3472754 - RNA, 13 nt, Pseudomonas aeruginosa PA01
ucuggccauagaa

SEQ ID NO: 3472755 - RNA, 16 nt, Pseudomonas aeruginosa PA01
ucuggccauagaaacc

SEQ ID NO: 3472756 - RNA, 15 nt, Pseudomonas aeruginosa PA01
ucuggcccuuuuccu

SEQ ID NO: 3472757 - RNA, 14 nt, Pseudomonas aeruginosa PA01
ucuggcgcagggag

SEQ ID NO: 3472758 - RNA, 18 nt, Pseudomonas aeruginosa PA01
ucuggcgccuggccugga

SEQ ID NO: 3472759 - RNA, 15 nt, Pseudomonas aeruginosa PA01
ucuggcggcccuggu

SEQ ID NO: 3472760 - RNA, 21 nt, Pseudomonas aeruginosa PA01
ugaaaaccggucccucggggc

SEQ ID NO: 3472761 - RNA, 14 nt, Pseudomonas aeruginosa PA01
ugaaaacggcgccc

SEQ ID NO: 3472762 - RNA, 15 nt, Pseudomonas aeruginosa PA01
ugaaaacggcgcccu

SEQ ID NO: 3472763 - RNA, 13 nt, Pseudomonas aeruginosa PA01
ugaaacaguugga

SEQ ID NO: 3472764 - RNA, 14 nt, Pseudomonas aeruginosa PA01
ugaaacugcgcagg

SEQ ID NO: 3472765 - RNA, 22 nt, Pseudomonas aeruginosa PA01
ugaaagccagcaaacccgggcc

SEQ ID NO: 3472766 - RNA, 14 nt, Pseudomonas aeruginosa PA01
ugaaagggaaaucc

SEQ ID NO: 3472767 - RNA, 18 nt, Pseudomonas aeruginosa PA01
ugaaauagcucugccgau

SEQ ID NO: 3472768 - RNA, 15 nt, Pseudomonas aeruginosa PA01
ugaaauccaccagca

SEQ ID NO: 3472769 - RNA, 16 nt, Pseudomonas aeruginosa PA01
ugaaauggcggacgau

SEQ ID NO: 3472770 - RNA, 13 nt, Pseudomonas aeruginosa PA01
ugaacaagcccug

SEQ ID NO: 3472771 - RNA, 21 nt, Pseudomonas aeruginosa PA01
ugaacacauagaccagcagcg

SEQ ID NO: 3472772 - RNA, 17 nt, Pseudomonas aeruginosa PA01
ugaacacaucgaccagg

SEQ ID NO: 3472773 - RNA, 17 nt, Pseudomonas aeruginosa PA01
ugaacaccgcuucgagc

SEQ ID NO: 3472774 - RNA, 17 nt, Pseudomonas aeruginosa PA01
ugaacaccucuucgcca

SEQ ID NO: 3472775 - RNA, 19 nt, Pseudomonas aeruginosa PA01
ugaacaccucuucgccauc

SEQ ID NO: 3472776 - RNA, 20 nt, Pseudomonas aeruginosa PA01
ugaacagcaggaugccgcug

SEQ ID NO: 3472777 - RNA, 21 nt, Pseudomonas aeruginosa PA01
ugaacagcgacucgaugcgca

SEQ ID NO: 3472778 - RNA, 15 nt, Pseudomonas aeruginosa PA01
ugaacagcgccacca

SEQ ID NO: 3472779 - RNA, 17 nt, Pseudomonas aeruginosa PA01
ugaacagcgccaccagc

SEQ ID NO: 3472780 - RNA, 18 nt, Pseudomonas aeruginosa PA01
ugaacagcgccaccagca

SEQ ID NO: 3472781 - RNA, 12 nt, Pseudomonas aeruginosa PA01
ugaacagcggcc

SEQ ID NO: 3472782 - RNA, 21 nt, Pseudomonas aeruginosa PA01
ugaacagcuggcgcgucgcug

SEQ ID NO: 3472783 - RNA, 13 nt, Pseudomonas aeruginosa PA01
ugaaccggggcgg

SEQ ID NO: 3472784 - RNA, 17 nt, Pseudomonas aeruginosa PA01
ugaacgaaaacgccgcu

SEQ ID NO: 3472785 - RNA, 13 nt, Pseudomonas aeruginosa PA01
ugaacgccaggca

SEQ ID NO: 3472786 - RNA, 14 nt, Pseudomonas aeruginosa PA01
ugaacgcgcccggc

SEQ ID NO: 3472787 - RNA, 16 nt, Pseudomonas aeruginosa PA01
ugaacgcgcccggcca

SEQ ID NO: 3472788 - RNA, 19 nt, Pseudomonas aeruginosa PA01
ugaacgcgcggaccuucga

SEQ ID NO: 3472789 - RNA, 14 nt, Pseudomonas aeruginosa PA01
ugaacgcggcgaga

SEQ ID NO: 3472790 - RNA, 15 nt, Pseudomonas aeruginosa PA01
ugaacgcuguagaau

SEQ ID NO: 3472791 - RNA, 18 nt, Pseudomonas aeruginosa PA01
ugaacgcuguagaaugcg

SEQ ID NO: 3472792 - RNA, 16 nt, Pseudomonas aeruginosa PA01
ugaacggcgucacgcc

SEQ ID NO: 3472793 - RNA, 19 nt, Pseudomonas aeruginosa PA01
ugaacgugucgacgaccgg

SEQ ID NO: 3472794 - RNA, 21 nt, Pseudomonas aeruginosa PA01
ugaacucgguguagcugaggc

SEQ ID NO: 3472795 - RNA, 19 nt, Pseudomonas aeruginosa PA01
ugaacuggaugucgcuggc

SEQ ID NO: 3472796 - RNA, 22 nt, Pseudomonas aeruginosa PA01
ugaacuggaugucgcuggccag

SEQ ID NO: 3472797 - RNA, 12 nt, Pseudomonas aeruginosa PA01
ugaacuggccgu

SEQ ID NO: 3472798 - RNA, 19 nt, Pseudomonas aeruginosa PA01
ugaacuggucgcuccagcc

SEQ ID NO: 3472799 - RNA, 23 nt, Pseudomonas aeruginosa PA01
ugaacuggucgcuccagccccac

SEQ ID NO: 3472800 - RNA, 21 nt, Pseudomonas aeruginosa PA01
ugaagaagccauugccgaugu

SEQ ID NO: 3472801 - RNA, 15 nt, Pseudomonas aeruginosa PA01
ugaagacccugcaca

SEQ ID NO: 3472802 - RNA, 14 nt, Pseudomonas aeruginosa PA01
ugaagagcagcacc

SEQ ID NO: 3472803 - RNA, 22 nt, Pseudomonas aeruginosa PA01
ugaagagcagcaccacggcgau

SEQ ID NO: 3472804 - RNA, 22 nt, Pseudomonas aeruginosa PA01
ugaagagcucccugccgcccuu

SEQ ID NO: 3472805 - RNA, 23 nt, Pseudomonas aeruginosa PA01
ugaagaguucgcugaaggucgcc

SEQ ID NO: 3472806 - RNA, 19 nt, Pseudomonas aeruginosa PA01
ugaagauauaacgcgagcc

SEQ ID NO: 3472807 - RNA, 23 nt, Pseudomonas aeruginosa PA01
ugaagauaucgccuuccucggcg

SEQ ID NO: 3472808 - RNA, 13 nt, Pseudomonas aeruginosa PA01
ugaagaucaucug

SEQ ID NO: 3472809 - RNA, 20 nt, Pseudomonas aeruginosa PA01
ugaagcacaccuccagcggc

SEQ ID NO: 3472810 - RNA, 21 nt, Pseudomonas aeruginosa PA01
ugaagcacaccuccagcggcu

SEQ ID NO: 3472811 - RNA, 12 nt, Pseudomonas aeruginosa PA01
ugaagcccacca

SEQ ID NO: 3472812 - RNA, 11 nt, Pseudomonas aeruginosa PA01
ugaagcccagg

SEQ ID NO: 3472813 - RNA, 14 nt, Pseudomonas aeruginosa PA01
ugaagcccaggcgc

SEQ ID NO: 3472814 - RNA, 18 nt, Pseudomonas aeruginosa PA01
ugaagcccaggcgcucgg

SEQ ID NO: 3472815 - RNA, 19 nt, Pseudomonas aeruginosa PA01
ugaagcccaggcgcucggc

SEQ ID NO: 3472816 - RNA, 19 nt, Pseudomonas aeruginosa PA01
ugaagccccaguccucgua

SEQ ID NO: 3472817 - RNA, 18 nt, Pseudomonas aeruginosa PA01
ugaagccccuggcgcugg

SEQ ID NO: 3472818 - RNA, 22 nt, Pseudomonas aeruginosa PA01
ugaagccccuggcgcugggccu

SEQ ID NO: 3472819 - RNA, 19 nt, Pseudomonas aeruginosa PA01
ugaagcccgcggcaucggc

SEQ ID NO: 3472820 - RNA, 22 nt, Pseudomonas aeruginosa PA01
ugaagccgccgcccagcagcac

SEQ ID NO: 3472821 - RNA, 20 nt, Pseudomonas aeruginosa PA01
ugaagccuucgcccagguag

SEQ ID NO: 3472822 - RNA, 14 nt, Pseudomonas aeruginosa PA01
ugaagcgccgcggc

SEQ ID NO: 3472823 - RNA, 23 nt, Pseudomonas aeruginosa PA01
ugaagcgcggcggcgcggagauc

SEQ ID NO: 3472824 - RNA, 13 nt, Pseudomonas aeruginosa PA01
ugaagcgcugcug

SEQ ID NO: 3472825 - RNA, 16 nt, Pseudomonas aeruginosa PA01
ugaagcgcugcugggc

SEQ ID NO: 3472826 - RNA, 17 nt, Pseudomonas aeruginosa PA01
ugaagcgcugcugggcg

SEQ ID NO: 3472827 - RNA, 12 nt, Pseudomonas aeruginosa PA01
ugaagcggccgu

SEQ ID NO: 3472828 - RNA, 14 nt, Pseudomonas aeruginosa PA01
ugaagcugccgucg

SEQ ID NO: 3472829 - RNA, 19 nt, Pseudomonas aeruginosa PA01
ugaagcuggagcagcagcg

SEQ ID NO: 3472830 - RNA, 16 nt, Pseudomonas aeruginosa PA01
ugaaggaaaccggcca

SEQ ID NO: 3472831 - RNA, 20 nt, Pseudomonas aeruginosa PA01
ugaaggaaaccggccagcgc

SEQ ID NO: 3472832 - RNA, 14 nt, Pseudomonas aeruginosa PA01
ugaaggacugugcc

SEQ ID NO: 3472833 - RNA, 11 nt, Pseudomonas aeruginosa PA01
ugaaggccgac

SEQ ID NO: 3472834 - RNA, 21 nt, Pseudomonas aeruginosa PA01
ugaaggcgaaguaucuggguc

SEQ ID NO: 3472835 - RNA, 22 nt, Pseudomonas aeruginosa PA01
ugaaggcgcggggcgaggucgg

SEQ ID NO: 3472836 - RNA, 23 nt, Pseudomonas aeruginosa PA01
ugaaggcgcggggcgaggucggc

SEQ ID NO: 3472837 - RNA, 22 nt, Pseudomonas aeruginosa PA01
ugaaggucagcacgccuuccag

SEQ ID NO: 3472838 - RNA, 13 nt, Pseudomonas aeruginosa PA01
ugaaggucgccgc

SEQ ID NO: 3472839 - RNA, 16 nt, Pseudomonas aeruginosa PA01
ugaaguagccgccggg

SEQ ID NO: 3472840 - RNA, 21 nt, Pseudomonas aeruginosa PA01
ugaauaccaccgggccgucgg

SEQ ID NO: 3472841 - RNA, 17 nt, Pseudomonas aeruginosa PA01
ugaauagcagccauagc

SEQ ID NO: 3472842 - RNA, 22 nt, Pseudomonas aeruginosa PA01
ugaaucgccucccuggcgacgu

SEQ ID NO: 3472843 - RNA, 13 nt, Pseudomonas aeruginosa PA01
ugaauugcugcca

SEQ ID NO: 3472844 - RNA, 15 nt, Pseudomonas aeruginosa PA01
ugacacccugccgcg

SEQ ID NO: 3472845 - RNA, 20 nt, Pseudomonas aeruginosa PA01
ugacacggauauccgggccc

SEQ ID NO: 3472846 - RNA, 19 nt, Pseudomonas aeruginosa PA01
ugacagcgaauuugaacgc

SEQ ID NO: 3472847 - RNA, 17 nt, Pseudomonas aeruginosa PA01
ugacauccaccaggguc

SEQ ID NO: 3472848 - RNA, 15 nt, Pseudomonas aeruginosa PA01
ugacauucgacagca

SEQ ID NO: 3472849 - RNA, 17 nt, Pseudomonas aeruginosa PA01
ugacauucgacagcagg

SEQ ID NO: 3472850 - RNA, 18 nt, Pseudomonas aeruginosa PA01
ugaccaccagggcgaugg

SEQ ID NO: 3472851 - RNA, 20 nt, Pseudomonas aeruginosa PA01
ugaccaccuugauccgcgac

SEQ ID NO: 3472852 - RNA, 17 nt, Pseudomonas aeruginosa PA01
ugaccacgcucagccgu

SEQ ID NO: 3472853 - RNA, 15 nt, Pseudomonas aeruginosa PA01
ugaccagagccgccg

SEQ ID NO: 3472854 - RNA, 23 nt, Pseudomonas aeruginosa PA01
ugaccagcagggugcggauggcg

SEQ ID NO: 3472855 - RNA, 18 nt, Pseudomonas aeruginosa PA01
ugaccagcccggcggcgg

SEQ ID NO: 3472856 - RNA, 15 nt, Pseudomonas aeruginosa PA01
ugaccagcggcaccg

SEQ ID NO: 3472857 - RNA, 20 nt, Pseudomonas aeruginosa PA01
ugaccagcggcaccgagagc

SEQ ID NO: 3472858 - RNA, 22 nt, Pseudomonas aeruginosa PA01
ugaccagcggcaccgagagcug

SEQ ID NO: 3472859 - RNA, 17 nt, Pseudomonas aeruginosa PA01
ugaccagcucggcggga

SEQ ID NO: 3472860 - RNA, 11 nt, Pseudomonas aeruginosa PA01
ugaccaggcug

SEQ ID NO: 3472861 - RNA, 18 nt, Pseudomonas aeruginosa PA01
ugaccaggcugaucagcc

SEQ ID NO: 3472862 - RNA, 14 nt, Pseudomonas aeruginosa PA01
ugacgauggcgcca

SEQ ID NO: 3472863 - RNA, 20 nt, Pseudomonas aeruginosa PA01
ugacgcaagcgcucggccug

SEQ ID NO: 3472864 - RNA, 13 nt, Pseudomonas aeruginosa PA01
ugacgcgcagcgc

SEQ ID NO: 3472865 - RNA, 22 nt, Pseudomonas aeruginosa PA01
ugacgcgcagcgccgccgcguc

SEQ ID NO: 3472866 - RNA, 18 nt, Pseudomonas aeruginosa PA01
ugacgcucuucaccucga

SEQ ID NO: 3472867 - RNA, 17 nt, Pseudomonas aeruginosa PA01
ugacgcugcucaccagg

SEQ ID NO: 3472868 - RNA, 13 nt, Pseudomonas aeruginosa PA01
ugacgcuggcgaa

SEQ ID NO: 3472869 - RNA, 15 nt, Pseudomonas aeruginosa PA01
ugacgcuggcugaca

SEQ ID NO: 3472870 - RNA, 22 nt, Pseudomonas aeruginosa PA01
ugacgcuggcugacagcuuguc

SEQ ID NO: 3472871 - RNA, 18 nt, Pseudomonas aeruginosa PA01
ugacggcaaggaccugcu

SEQ ID NO: 3472872 - RNA, 19 nt, Pseudomonas aeruginosa PA01
ugacggcggaaggcggcga

SEQ ID NO: 3472873 - RNA, 15 nt, Pseudomonas aeruginosa PA01
ugacggcguggcgga

SEQ ID NO: 3472874 - RNA, 19 nt, Pseudomonas aeruginosa PA01
ugacgggcauugucccugc

SEQ ID NO: 3472875 - RNA, 20 nt, Pseudomonas aeruginosa PA01
ugacgggcgguaugccggag

SEQ ID NO: 3472876 - RNA, 21 nt, Pseudomonas aeruginosa PA01
ugacggggaucacucgccgcc

SEQ ID NO: 3472877 - RNA, 16 nt, Pseudomonas aeruginosa PA01
ugacgguccgcgccac

SEQ ID NO: 3472878 - RNA, 12 nt, Pseudomonas aeruginosa PA01
ugacggugaucg

SEQ ID NO: 3472879 - RNA, 20 nt, Pseudomonas aeruginosa PA01
ugacggugcagccacccagc

SEQ ID NO: 3472880 - RNA, 21 nt, Pseudomonas aeruginosa PA01
ugacgguggaggcgggcucac

SEQ ID NO: 3472881 - RNA, 13 nt, Pseudomonas aeruginosa PA01
ugacguucccguc

SEQ ID NO: 3472882 - RNA, 20 nt, Pseudomonas aeruginosa PA01
ugacguucugcccgccggcg

SEQ ID NO: 3472883 - RNA, 22 nt, Pseudomonas aeruginosa PA01
ugacguugccgcgcgggccggc

SEQ ID NO: 3472884 - RNA, 14 nt, Pseudomonas aeruginosa PA01
ugacuaacagguca

SEQ ID NO: 3472885 - RNA, 17 nt, Pseudomonas aeruginosa PA01
ugacuaucgucgagggu

SEQ ID NO: 3472886 - RNA, 17 nt, Pseudomonas aeruginosa PA01
ugacugcaaucgaccau

SEQ ID NO: 3472887 - RNA, 14 nt, Pseudomonas aeruginosa PA01
ugacuuccaucagc

SEQ ID NO: 3472888 - RNA, 15 nt, Pseudomonas aeruginosa PA01
ugacuuccaucagcu

SEQ ID NO: 3472889 - RNA, 18 nt, Pseudomonas aeruginosa PA01
ugacuuccaucagcucca

SEQ ID NO: 3472890 - RNA, 21 nt, Pseudomonas aeruginosa PA01
ugagaacguuuccaugcggug

SEQ ID NO: 3472891 - RNA, 14 nt, Pseudomonas aeruginosa PA01
ugagaccuuccugc

SEQ ID NO: 3472892 - RNA, 20 nt, Pseudomonas aeruginosa PA01
ugagaguccuuguccagggc

SEQ ID NO: 3472893 - RNA, 19 nt, Pseudomonas aeruginosa PA01
ugagauccuggccggcggc

SEQ ID NO: 3472894 - RNA, 22 nt, Pseudomonas aeruginosa PA01
ugagauggucgaaccagcucag

SEQ ID NO: 3472895 - RNA, 20 nt, Pseudomonas aeruginosa PA01
ugagcacccgggcgaccugc

SEQ ID NO: 3472896 - RNA, 18 nt, Pseudomonas aeruginosa PA01
ugagcaccggaaaggcgu

SEQ ID NO: 3472897 - RNA, 16 nt, Pseudomonas aeruginosa PA01
ugagcaccucgaccug

SEQ ID NO: 3472898 - RNA, 19 nt, Pseudomonas aeruginosa PA01
ugagcacgguccgcgaacc

SEQ ID NO: 3472899 - RNA, 13 nt, Pseudomonas aeruginosa PA01
ugagcagccaggc

SEQ ID NO: 3472900 - RNA, 21 nt, Pseudomonas aeruginosa PA01
ugagcagccaggcgaagcggc

SEQ ID NO: 3472901 - RNA, 15 nt, Pseudomonas aeruginosa PA01
ugagcaggccgacgg

SEQ ID NO: 3472902 - RNA, 13 nt, Pseudomonas aeruginosa PA01
ugagcagggccga

SEQ ID NO: 3472903 - RNA, 17 nt, Pseudomonas aeruginosa PA01
ugagcagggccgagcgc

SEQ ID NO: 3472904 - RNA, 20 nt, Pseudomonas aeruginosa PA01
ugagcagggccgagcgcagc

SEQ ID NO: 3472905 - RNA, 22 nt, Pseudomonas aeruginosa PA01
ugagcagggccgagcgcagcgc

SEQ ID NO: 3472906 - RNA, 23 nt, Pseudomonas aeruginosa PA01
ugagcagggugacggugaucgcc

SEQ ID NO: 3472907 - RNA, 20 nt, Pseudomonas aeruginosa PA01
ugagcaggguguugaucacc

SEQ ID NO: 3472908 - RNA, 12 nt, Pseudomonas aeruginosa PA01
ugagcaucaccg

SEQ ID NO: 3472909 - RNA, 19 nt, Pseudomonas aeruginosa PA01
ugagcaucugggucuucag

SEQ ID NO: 3472910 - RNA, 20 nt, Pseudomonas aeruginosa PA01
ugagcaucugggucuucagc

SEQ ID NO: 3472911 - RNA, 18 nt, Pseudomonas aeruginosa PA01
ugagccauucggcuuccu

SEQ ID NO: 3472912 - RNA, 21 nt, Pseudomonas aeruginosa PA01
ugagccauucggcuuccuggg

SEQ ID NO: 3472913 - RNA, 16 nt, Pseudomonas aeruginosa PA01
ugagccccagguaggc

SEQ ID NO: 3472914 - RNA, 17 nt, Pseudomonas aeruginosa PA01
ugagccccggcgucggc

SEQ ID NO: 3472915 - RNA, 23 nt, Pseudomonas aeruginosa PA01
ugagccccggcgucggcgcgggc

SEQ ID NO: 3472916 - RNA, 18 nt, Pseudomonas aeruginosa PA01
ugagccgcugguagcuac

SEQ ID NO: 3472917 - RNA, 19 nt, Pseudomonas aeruginosa PA01
ugagccgcugguccagcug

SEQ ID NO: 3472918 - RNA, 19 nt, Pseudomonas aeruginosa PA01
ugagccucuaaggaaaaac

SEQ ID NO: 3472919 - RNA, 17 nt, Pseudomonas aeruginosa PA01
ugagcgaaaacagccgu

SEQ ID NO: 3472920 - RNA, 17 nt, Pseudomonas aeruginosa PA01
ugagcgacccgcugaag

SEQ ID NO: 3472921 - RNA, 20 nt, Pseudomonas aeruginosa PA01
ugagcgaucccaggucggcg

SEQ ID NO: 3472922 - RNA, 12 nt, Pseudomonas aeruginosa PA01
ugagcgccagca

SEQ ID NO: 3472923 - RNA, 17 nt, Pseudomonas aeruginosa PA01
ugagcgccaggcgcaag

SEQ ID NO: 3472924 - RNA, 15 nt, Pseudomonas aeruginosa PA01
ugagcggaaacaagc

SEQ ID NO: 3472925 - RNA, 23 nt, Pseudomonas aeruginosa PA01
ugagcggaacgggacgccuggcg

SEQ ID NO: 3472926 - RNA, 21 nt, Pseudomonas aeruginosa PA01
ugagcggaucgucgcggcgcg

SEQ ID NO: 3472927 - RNA, 14 nt, Pseudomonas aeruginosa PA01
ugagcggcgcccug

SEQ ID NO: 3472928 - RNA, 16 nt, Pseudomonas aeruginosa PA01
ugagcggcgcccuggc

SEQ ID NO: 3472929 - RNA, 13 nt, Pseudomonas aeruginosa PA01
ugagcggcggcac

SEQ ID NO: 3472930 - RNA, 21 nt, Pseudomonas aeruginosa PA01
ugagcuggcccaguugcccgg

SEQ ID NO: 3472931 - RNA, 11 nt, Pseudomonas aeruginosa PA01
ugagcuggccg

SEQ ID NO: 3472932 - RNA, 12 nt, Pseudomonas aeruginosa PA01
ugagcuggccga

SEQ ID NO: 3472933 - RNA, 17 nt, Pseudomonas aeruginosa PA01
ugagcuggccgagcgac

SEQ ID NO: 3472934 - RNA, 17 nt, Pseudomonas aeruginosa PA01
ugagcuggcgcuggucc

SEQ ID NO: 3472935 - RNA, 13 nt, Pseudomonas aeruginosa PA01
ugagcugugguug

SEQ ID NO: 3472936 - RNA, 19 nt, Pseudomonas aeruginosa PA01
ugaggaagucgaugaacgc

SEQ ID NO: 3472937 - RNA, 14 nt, Pseudomonas aeruginosa PA01
ugaggacugccagg

SEQ ID NO: 3472938 - RNA, 20 nt, Pseudomonas aeruginosa PA01
ugaggaucacgauggccggc

SEQ ID NO: 3472939 - RNA, 23 nt, Pseudomonas aeruginosa PA01
ugaggaucacgcaagugcccugg

SEQ ID NO: 3472940 - RNA, 15 nt, Pseudomonas aeruginosa PA01
ugaggaucagccagc

SEQ ID NO: 3472941 - RNA, 21 nt, Pseudomonas aeruginosa PA01
ugaggaucagccagccggcga

SEQ ID NO: 3472942 - RNA, 15 nt, Pseudomonas aeruginosa PA01
ugaggaugcugauca

SEQ ID NO: 3472943 - RNA, 19 nt, Pseudomonas aeruginosa PA01
ugaggauuuucuccggcgc

SEQ ID NO: 3472944 - RNA, 21 nt, Pseudomonas aeruginosa PA01
ugaggauuuucuccggcgccg

SEQ ID NO: 3472945 - RNA, 17 nt, Pseudomonas aeruginosa PA01
ugaggcagguggcgcag

SEQ ID NO: 3472946 - RNA, 12 nt, Pseudomonas aeruginosa PA01
ugaggccgacga

SEQ ID NO: 3472947 - RNA, 14 nt, Pseudomonas aeruginosa PA01
ugaggccgcccugg

SEQ ID NO: 3472948 - RNA, 22 nt, Pseudomonas aeruginosa PA01
ugaggccuuucuucugcugugc

SEQ ID NO: 3472949 - RNA, 15 nt, Pseudomonas aeruginosa PA01
ugaggcgcagcagcg

SEQ ID NO: 3472950 - RNA, 14 nt, Pseudomonas aeruginosa PA01
ugaggcgcaggggc

SEQ ID NO: 3472951 - RNA, 15 nt, Pseudomonas aeruginosa PA01
ugaggcgcgcgccga

SEQ ID NO: 3472952 - RNA, 14 nt, Pseudomonas aeruginosa PA01
ugaggcgggccagc

SEQ ID NO: 3472953 - RNA, 22 nt, Pseudomonas aeruginosa PA01
ugaggcguggggaagacggcca

SEQ ID NO: 3472954 - RNA, 16 nt, Pseudomonas aeruginosa PA01
ugaggcguucgagggu

SEQ ID NO: 3472955 - RNA, 23 nt, Pseudomonas aeruginosa PA01
ugaggcucgccggguuguccagg

SEQ ID NO: 3472956 - RNA, 13 nt, Pseudomonas aeruginosa PA01
ugaggcuggccag

SEQ ID NO: 3472957 - RNA, 15 nt, Pseudomonas aeruginosa PA01
ugaggcuguccagca

SEQ ID NO: 3472958 - RNA, 17 nt, Pseudomonas aeruginosa PA01
ugaggcuguccagcagg

SEQ ID NO: 3472959 - RNA, 20 nt, Pseudomonas aeruginosa PA01
ugaggcuguccagcaggcgu

SEQ ID NO: 3472960 - RNA, 15 nt, Pseudomonas aeruginosa PA01
ugagggcacggccag

SEQ ID NO: 3472961 - RNA, 16 nt, Pseudomonas aeruginosa PA01
ugagggccgcgcugcu

SEQ ID NO: 3472962 - RNA, 19 nt, Pseudomonas aeruginosa PA01
ugagggcgacccagcgcug

SEQ ID NO: 3472963 - RNA, 14 nt, Pseudomonas aeruginosa PA01
ugagggucagcuug

SEQ ID NO: 3472964 - RNA, 17 nt, Pseudomonas aeruginosa PA01
ugagggucgcgccgacg

SEQ ID NO: 3472965 - RNA, 13 nt, Pseudomonas aeruginosa PA01
ugaugccgaggcg

SEQ ID NO: 3472966 - RNA, 13 nt, Pseudomonas aeruginosa PA01
ugaugccgaggcu

SEQ ID NO: 3472967 - RNA, 23 nt, Pseudomonas aeruginosa PA01
ugaugccgauggacaggcugggc

SEQ ID NO: 3472968 - RNA, 15 nt, Pseudomonas aeruginosa PA01
ugaugccgcggacgg

SEQ ID NO: 3472969 - RNA, 20 nt, Pseudomonas aeruginosa PA01
ugaugccgcggacggcacgg

SEQ ID NO: 3472970 - RNA, 14 nt, Pseudomonas aeruginosa PA01
ugaugccgcggcga

SEQ ID NO: 3472971 - RNA, 22 nt, Pseudomonas aeruginosa PA01
ugaugccguucacuaucucgcu

SEQ ID NO: 3472972 - RNA, 23 nt, Pseudomonas aeruginosa PA01
ugaugccuuucggggugcagggg

SEQ ID NO: 3472973 - RNA, 15 nt, Pseudomonas aeruginosa PA01
ugaugguaucgccgu

SEQ ID NO: 3472974 - RNA, 14 nt, Pseudomonas aeruginosa PA01
ugauggugccgccg

SEQ ID NO: 3472975 - RNA, 14 nt, Pseudomonas aeruginosa PA01
ugauguaggacagg

SEQ ID NO: 3472976 - RNA, 18 nt, Pseudomonas aeruginosa PA01
ugauguccccccuacgaa

SEQ ID NO: 3472977 - RNA, 21 nt, Pseudomonas aeruginosa PA01
ugaugucggcgcugucgccgu

SEQ ID NO: 3472978 - RNA, 22 nt, Pseudomonas aeruginosa PA01
ugaugugcaguucgaccuccag

SEQ ID NO: 3472979 - RNA, 19 nt, Pseudomonas aeruginosa PA01
ugaugugcgcaggcuggcc

SEQ ID NO: 3472980 - RNA, 22 nt, Pseudomonas aeruginosa PA01
ugauguugcgccauuucaaggc

SEQ ID NO: 3472981 - RNA, 19 nt, Pseudomonas aeruginosa PA01
ugauguugcggucgauguc

SEQ ID NO: 3472982 - RNA, 15 nt, Pseudomonas aeruginosa PA01
ugauucaggcggcga

SEQ ID NO: 3472983 - RNA, 23 nt, Pseudomonas aeruginosa PA01
ugauucguccggagccgggcaac

SEQ ID NO: 3472984 - RNA, 20 nt, Pseudomonas aeruginosa PA01
ugauugagggucagcuugcc

SEQ ID NO: 3472985 - RNA, 22 nt, Pseudomonas aeruginosa PA01
ugauugcugaaagcgauagccg

SEQ ID NO: 3472986 - RNA, 13 nt, Pseudomonas aeruginosa PA01
ugauuguucuucc

SEQ ID NO: 3472987 - RNA, 18 nt, Pseudomonas aeruginosa PA01
ugauuuacaggacugugc

SEQ ID NO: 3472988 - RNA, 19 nt, Pseudomonas aeruginosa PA01
ugauuuacaggacugugcu

SEQ ID NO: 3472989 - RNA, 18 nt, Pseudomonas aeruginosa PA01
ugauuucguuggcccaga

SEQ ID NO: 3472990 - RNA, 17 nt, Pseudomonas aeruginosa PA01
ugauuugauugaaaaaa

SEQ ID NO: 3472991 - RNA, 22 nt, Pseudomonas aeruginosa PA01
ugcaaacgggcaucgucgaagg

SEQ ID NO: 3472992 - RNA, 16 nt, Pseudomonas aeruginosa PA01
ugcaaacgggguaaag

SEQ ID NO: 3472993 - RNA, 16 nt, Pseudomonas aeruginosa PA01
ugcaacacccaggccu

SEQ ID NO: 3472994 - RNA, 19 nt, Pseudomonas aeruginosa PA01
ugcaacacccaggccuggg

SEQ ID NO: 3472995 - RNA, 14 nt, Pseudomonas aeruginosa PA01
ugcaacaccuggcg

SEQ ID NO: 3472996 - RNA, 16 nt, Pseudomonas aeruginosa PA01
ugcaacaccuggcgcu

SEQ ID NO: 3472997 - RNA, 18 nt, Pseudomonas aeruginosa PA01
ugcaacaccuggcgcucg

SEQ ID NO: 3472998 - RNA, 23 nt, Pseudomonas aeruginosa PA01
ugcaacacguagcgcaggucgcu

SEQ ID NO: 3472999 - RNA, 14 nt, Pseudomonas aeruginosa PA01
ugcaacagaaguug

SEQ ID NO: 3473000 - RNA, 16 nt, Pseudomonas aeruginosa PA01
ugcaacaggacccagc

SEQ ID NO: 3473001 - RNA, 21 nt, Pseudomonas aeruginosa PA01
ugcaacaguggguaggccagg

SEQ ID NO: 3473002 - RNA, 22 nt, Pseudomonas aeruginosa PA01
ugcaacaguggguaggccaggc

SEQ ID NO: 3473003 - RNA, 14 nt, Pseudomonas aeruginosa PA01
ugcaacccgccgcu

SEQ ID NO: 3473004 - RNA, 22 nt, Pseudomonas aeruginosa PA01
ugcaacccuuugauggcgcugc

SEQ ID NO: 3473005 - RNA, 16 nt, Pseudomonas aeruginosa PA01
ugcaaccgcccugguc

SEQ ID NO: 3473006 - RNA, 13 nt, Pseudomonas aeruginosa PA01
ugcaacgccagca

SEQ ID NO: 3473007 - RNA, 16 nt, Pseudomonas aeruginosa PA01
ugcaacgccagcaggc

SEQ ID NO: 3473008 - RNA, 19 nt, Pseudomonas aeruginosa PA01
ugcaacgccagcaggcgca

SEQ ID NO: 3473009 - RNA, 13 nt, Pseudomonas aeruginosa PA01
ugcaacgcccgcg

SEQ ID NO: 3473010 - RNA, 17 nt, Pseudomonas aeruginosa PA01
ugcaacgcccgcgagcc

SEQ ID NO: 3473011 - RNA, 20 nt, Pseudomonas aeruginosa PA01
ugcaacgccggcccgugccc

SEQ ID NO: 3473012 - RNA, 15 nt, Pseudomonas aeruginosa PA01
ugcaacggcacgacc

SEQ ID NO: 3473013 - RNA, 16 nt, Pseudomonas aeruginosa PA01
ugcaacuccgccuguc

SEQ ID NO: 3473014 - RNA, 18 nt, Pseudomonas aeruginosa PA01
ugcaacucgucguccagc

SEQ ID NO: 3473015 - RNA, 11 nt, Pseudomonas aeruginosa PA01
ugcaacuggaa

SEQ ID NO: 3473016 - RNA, 19 nt, Pseudomonas aeruginosa PA01
ugcaacuggaaggccgcgc

SEQ ID NO: 3473017 - RNA, 15 nt, Pseudomonas aeruginosa PA01
ugcaacuggccgaga

SEQ ID NO: 3473018 - RNA, 23 nt, Pseudomonas aeruginosa PA01
ugcaagggcacuucguccaggcc

SEQ ID NO: 3473019 - RNA, 22 nt, Pseudomonas aeruginosa PA01
ugcaauagaaaagaauaauuaa

SEQ ID NO: 3473020 - RNA, 19 nt, Pseudomonas aeruginosa PA01
ugcaauggauguugccgcc

SEQ ID NO: 3473021 - RNA, 20 nt, Pseudomonas aeruginosa PA01
ugcaauggauguugccgccg

SEQ ID NO: 3473022 - RNA, 19 nt, Pseudomonas aeruginosa PA01
ugcaauggggcggccggcg

SEQ ID NO: 3473023 - RNA, 20 nt, Pseudomonas aeruginosa PA01
ugcaauggggcggccggcgc

SEQ ID NO: 3473024 - RNA, 12 nt, Pseudomonas aeruginosa PA01
ugcaauuccacc

SEQ ID NO: 3473025 - RNA, 16 nt, Pseudomonas aeruginosa PA01
ugcaauugcaggcccg

SEQ ID NO: 3473026 - RNA, 19 nt, Pseudomonas aeruginosa PA01
ugcaauugcuugcgcucga

SEQ ID NO: 3473027 - RNA, 15 nt, Pseudomonas aeruginosa PA01
ugcacaaacucaggg

SEQ ID NO: 3473028 - RNA, 15 nt, Pseudomonas aeruginosa PA01
ugcacaacgggugcu

SEQ ID NO: 3473029 - RNA, 19 nt, Pseudomonas aeruginosa PA01
ugcacagccauagcgccgg

SEQ ID NO: 3473030 - RNA, 23 nt, Pseudomonas aeruginosa PA01
ugcacagccauagcgccggcacc

SEQ ID NO: 3473031 - RNA, 13 nt, Pseudomonas aeruginosa PA01
ugcacagcgccca

SEQ ID NO: 3473032 - RNA, 15 nt, Pseudomonas aeruginosa PA01
ugcacauccagcccu

SEQ ID NO: 3473033 - RNA, 17 nt, Pseudomonas aeruginosa PA01
ugcacaugcaccaccug

SEQ ID NO: 3473034 - RNA, 16 nt, Pseudomonas aeruginosa PA01
ugcaccacgucggaaa

SEQ ID NO: 3473035 - RNA, 14 nt, Pseudomonas aeruginosa PA01
ugcaccagcaacug

SEQ ID NO: 3473036 - RNA, 15 nt, Pseudomonas aeruginosa PA01
ugcaccagcaacugg

SEQ ID NO: 3473037 - RNA, 22 nt, Pseudomonas aeruginosa PA01
ugcaccagccaguccggcagca

SEQ ID NO: 3473038 - RNA, 13 nt, Pseudomonas aeruginosa PA01
ugcaccaggcccu

SEQ ID NO: 3473039 - RNA, 15 nt, Pseudomonas aeruginosa PA01
ugcaccaggccgcca

SEQ ID NO: 3473040 - RNA, 17 nt, Pseudomonas aeruginosa PA01
ugcaccaggccgccaug

SEQ ID NO: 3473041 - RNA, 20 nt, Pseudomonas aeruginosa PA01
ugcacccagaccuuccagcc

SEQ ID NO: 3473042 - RNA, 22 nt, Pseudomonas aeruginosa PA01
ugcacccagaccuuccagccgc

SEQ ID NO: 3473043 - RNA, 16 nt, Pseudomonas aeruginosa PA01
ugcaccccgucgacgc

SEQ ID NO: 3473044 - RNA, 21 nt, Pseudomonas aeruginosa PA01
ugcaccccgucgacgcccugg

SEQ ID NO: 3473045 - RNA, 14 nt, Pseudomonas aeruginosa PA01
ugcacccgccgacc

SEQ ID NO: 3473046 - RNA, 20 nt, Pseudomonas aeruginosa PA01
ugcacccgcuguuucuccag

SEQ ID NO: 3473047 - RNA, 14 nt, Pseudomonas aeruginosa PA01
ugcaccgaagggaa

SEQ ID NO: 3473048 - RNA, 12 nt, Pseudomonas aeruginosa PA01
ugcaccgaggcg

SEQ ID NO: 3473049 - RNA, 15 nt, Pseudomonas aeruginosa PA01
ugcaccgaggcgcgc

SEQ ID NO: 3473050 - RNA, 17 nt, Pseudomonas aeruginosa PA01
ugcaccgaggcgcgccg

SEQ ID NO: 3473051 - RNA, 18 nt, Pseudomonas aeruginosa PA01
ugcaccgaggcgcgccga

SEQ ID NO: 3473052 - RNA, 20 nt, Pseudomonas aeruginosa PA01
ugcaccgaguugaccagcau

SEQ ID NO: 3473053 - RNA, 20 nt, Pseudomonas aeruginosa PA01
ugcaccgccggguacagcgc

SEQ ID NO: 3473054 - RNA, 13 nt, Pseudomonas aeruginosa PA01
ugcaccgcgcugg

SEQ ID NO: 3473055 - RNA, 22 nt, Pseudomonas aeruginosa PA01
ugcaccgcgcuggagaccuugu

SEQ ID NO: 3473056 - RNA, 17 nt, Pseudomonas aeruginosa PA01
ugcaccgcuugccagcc

SEQ ID NO: 3473057 - RNA, 14 nt, Pseudomonas aeruginosa PA01
ugcaccggccacuc

SEQ ID NO: 3473058 - RNA, 22 nt, Pseudomonas aeruginosa PA01
ugcaccggccacucgcagccgc

SEQ ID NO: 3473059 - RNA, 20 nt, Pseudomonas aeruginosa PA01
ugcaccgggccgaccugccc

SEQ ID NO: 3473060 - RNA, 15 nt, Pseudomonas aeruginosa PA01
ugcaccgucauggug

SEQ ID NO: 3473061 - RNA, 14 nt, Pseudomonas aeruginosa PA01
ugcaccgugcgcgc

SEQ ID NO: 3473062 - RNA, 16 nt, Pseudomonas aeruginosa PA01
ugcaccgugcgcgcgg

SEQ ID NO: 3473063 - RNA, 19 nt, Pseudomonas aeruginosa PA01
ugcaccgugcgcgcggccu

SEQ ID NO: 3473064 - RNA, 19 nt, Pseudomonas aeruginosa PA01
ugcaccucaugcugcgcgg

SEQ ID NO: 3473065 - RNA, 20 nt, Pseudomonas aeruginosa PA01
ugcaccugcucggggccgua

SEQ ID NO: 3473066 - RNA, 22 nt, Pseudomonas aeruginosa PA01
ugcacgaacaggugcugguggc

SEQ ID NO: 3473067 - RNA, 13 nt, Pseudomonas aeruginosa PA01
ugcaggccagcgc

SEQ ID NO: 3473068 - RNA, 21 nt, Pseudomonas aeruginosa PA01
ugcaggccagcgccagguugg

SEQ ID NO: 3473069 - RNA, 15 nt, Pseudomonas aeruginosa PA01
ugcaggccagggcgg

SEQ ID NO: 3473070 - RNA, 16 nt, Pseudomonas aeruginosa PA01
ugcaggcccggccgcc

SEQ ID NO: 3473071 - RNA, 22 nt, Pseudomonas aeruginosa PA01
ugcaggccgaauccgccggcga

SEQ ID NO: 3473072 - RNA, 16 nt, Pseudomonas aeruginosa PA01
ugcaggccgagaccgc

SEQ ID NO: 3473073 - RNA, 13 nt, Pseudomonas aeruginosa PA01
ugcaggccgccga

SEQ ID NO: 3473074 - RNA, 14 nt, Pseudomonas aeruginosa PA01
ugcaggccgccgag

SEQ ID NO: 3473075 - RNA, 14 nt, Pseudomonas aeruginosa PA01
ugcaggccgcgcga

SEQ ID NO: 3473076 - RNA, 19 nt, Pseudomonas aeruginosa PA01
ugcaggccggccuccagcg

SEQ ID NO: 3473077 - RNA, 21 nt, Pseudomonas aeruginosa PA01
ugcaggccggccuccagcgcc

SEQ ID NO: 3473078 - RNA, 17 nt, Pseudomonas aeruginosa PA01
ugcaggccggcgagcca

SEQ ID NO: 3473079 - RNA, 17 nt, Pseudomonas aeruginosa PA01
ugcaggccgugccagag

SEQ ID NO: 3473080 - RNA, 21 nt, Pseudomonas aeruginosa PA01
ugcaggcgauucaagugucga

SEQ ID NO: 3473081 - RNA, 15 nt, Pseudomonas aeruginosa PA01
ugcaggcgucggucc

SEQ ID NO: 3473082 - RNA, 15 nt, Pseudomonas aeruginosa PA01
ugcaggcucacgcgu

SEQ ID NO: 3473083 - RNA, 20 nt, Pseudomonas aeruginosa PA01
ugcaggcucacgcguucggc

SEQ ID NO: 3473084 - RNA, 16 nt, Pseudomonas aeruginosa PA01
ugcaggcucgacaggu

SEQ ID NO: 3473085 - RNA, 18 nt, Pseudomonas aeruginosa PA01
ugcaggcucgacaggucg

SEQ ID NO: 3473086 - RNA, 19 nt, Pseudomonas aeruginosa PA01
ugcaggcucucgcgcagca

SEQ ID NO: 3473087 - RNA, 21 nt, Pseudomonas aeruginosa PA01
ugcaggcucucgcgcagcagg

SEQ ID NO: 3473088 - RNA, 18 nt, Pseudomonas aeruginosa PA01
ugcagggaaggcgcgcuc

SEQ ID NO: 3473089 - RNA, 22 nt, Pseudomonas aeruginosa PA01
ugcagggauuccgggucgaggc

SEQ ID NO: 3473090 - RNA, 15 nt, Pseudomonas aeruginosa PA01
ugcagggcagcggcc

SEQ ID NO: 3473091 - RNA, 13 nt, Pseudomonas aeruginosa PA01
ugcagggccaggg

SEQ ID NO: 3473092 - RNA, 12 nt, Pseudomonas aeruginosa PA01
ugcagggccgcc

SEQ ID NO: 3473093 - RNA, 16 nt, Pseudomonas aeruginosa PA01
ugcagggccgccagcc

SEQ ID NO: 3473094 - RNA, 15 nt, Pseudomonas aeruginosa PA01
ugcagggccgcggcg

SEQ ID NO: 3473095 - RNA, 23 nt, Pseudomonas aeruginosa PA01
ugcagggcguagugcuccucguc

SEQ ID NO: 3473096 - RNA, 23 nt, Pseudomonas aeruginosa PA01
ugcagggcguccaguagcgccug

SEQ ID NO: 3473097 - RNA, 19 nt, Pseudomonas aeruginosa PA01
ugcagggcgucgccgggaa

SEQ ID NO: 3473098 - RNA, 21 nt, Pseudomonas aeruginosa PA01
ugcagggcugcuguugccagg

SEQ ID NO: 3473099 - RNA, 21 nt, Pseudomonas aeruginosa PA01
ugcagggggcuuugcggcccu

SEQ ID NO: 3473100 - RNA, 16 nt, Pseudomonas aeruginosa PA01
ugcagggucaggucgu

SEQ ID NO: 3473101 - RNA, 20 nt, Pseudomonas aeruginosa PA01
ugcagggucagucgagcagu

SEQ ID NO: 3473102 - RNA, 15 nt, Pseudomonas aeruginosa PA01
ugcagggucgccggg

SEQ ID NO: 3473103 - RNA, 16 nt, Pseudomonas aeruginosa PA01
ugcagggugcguacgg

SEQ ID NO: 3473104 - RNA, 13 nt, Pseudomonas aeruginosa PA01
ugcagguacggcg

SEQ ID NO: 3473105 - RNA, 16 nt, Pseudomonas aeruginosa PA01
ugcagguacggcgccg

SEQ ID NO: 3473106 - RNA, 16 nt, Pseudomonas aeruginosa PA01
ugcagguagcagccgu

SEQ ID NO: 3473107 - RNA, 18 nt, Pseudomonas aeruginosa PA01
ugcagguagccgcgccgg

SEQ ID NO: 3473108 - RNA, 22 nt, Pseudomonas aeruginosa PA01
ugcagguagccgcgccggccgu

SEQ ID NO: 3473109 - RNA, 16 nt, Pseudomonas aeruginosa PA01
ugcagguagcgcugcg

SEQ ID NO: 3473110 - RNA, 22 nt, Pseudomonas aeruginosa PA01
ugcagguagcgcugcgcccgcu

SEQ ID NO: 3473111 - RNA, 20 nt, Pseudomonas aeruginosa PA01
ugcagguagcugcuccagcc

SEQ ID NO: 3473112 - RNA, 17 nt, Pseudomonas aeruginosa PA01
ugcagguaguucuccag

SEQ ID NO: 3473113 - RNA, 12 nt, Pseudomonas aeruginosa PA01
ugcagguccggg

SEQ ID NO: 3473114 - RNA, 15 nt, Pseudomonas aeruginosa PA01
ugcaggucgaggcgc

SEQ ID NO: 3473115 - RNA, 22 nt, Pseudomonas aeruginosa PA01
ugcaggucgaggcgcuccaccg

SEQ ID NO: 3473116 - RNA, 24 nt, Pseudomonas aeruginosa PA01
ugcaggucgcgcggcgccugcugc

SEQ ID NO: 3473117 - RNA, 14 nt, Pseudomonas aeruginosa PA01
ugcagguggcgcuc

SEQ ID NO: 3473118 - RNA, 15 nt, Pseudomonas aeruginosa PA01
ugcagguggcguugc

SEQ ID NO: 3473119 - RNA, 19 nt, Pseudomonas aeruginosa PA01
ugcagguggcguugcaggg

SEQ ID NO: 3473120 - RNA, 15 nt, Pseudomonas aeruginosa PA01
ugcagguguucggcg

SEQ ID NO: 3473121 - RNA, 18 nt, Pseudomonas aeruginosa PA01
ugcagguguucggcggcg

SEQ ID NO: 3473122 - RNA, 20 nt, Pseudomonas aeruginosa PA01
ugcagguguucggcggcgug

SEQ ID NO: 3473123 - RNA, 19 nt, Pseudomonas aeruginosa PA01
ugcagguucaccgccucgg

SEQ ID NO: 3473124 - RNA, 22 nt, Pseudomonas aeruginosa PA01
ugcagguucaccgccucggaga

SEQ ID NO: 3473125 - RNA, 15 nt, Pseudomonas aeruginosa PA01
ugcagguuguccagg

SEQ ID NO: 3473126 - RNA, 18 nt, Pseudomonas aeruginosa PA01
ugcagguuguccagggca

SEQ ID NO: 3473127 - RNA, 19 nt, Pseudomonas aeruginosa PA01
ugcagguuguccagggcau

SEQ ID NO: 3473128 - RNA, 17 nt, Pseudomonas aeruginosa PA01
ugcaguacuuggccagc

SEQ ID NO: 3473129 - RNA, 20 nt, Pseudomonas aeruginosa PA01
ugcaguacuuggccagcagc

SEQ ID NO: 3473130 - RNA, 19 nt, Pseudomonas aeruginosa PA01
ugcagucgaaaaccggcgg

SEQ ID NO: 3473131 - RNA, 18 nt, Pseudomonas aeruginosa PA01
ugcagugcgccgcagcgc

SEQ ID NO: 3473132 - RNA, 16 nt, Pseudomonas aeruginosa PA01
ugcaucaccggcagca

SEQ ID NO: 3473133 - RNA, 19 nt, Pseudomonas aeruginosa PA01
ugcaucacguacggcgccu

SEQ ID NO: 3473134 - RNA, 13 nt, Pseudomonas aeruginosa PA01
ugcauccgccgca

SEQ ID NO: 3473135 - RNA, 17 nt, Pseudomonas aeruginosa PA01
ugcauccgccgcagacc

SEQ ID NO: 3473136 - RNA, 20 nt, Pseudomonas aeruginosa PA01
ugcauccgccgcagaccagc

SEQ ID NO: 3473137 - RNA, 20 nt, Pseudomonas aeruginosa PA01
ugcauccuuuuuccgaccuu

SEQ ID NO: 3473138 - RNA, 21 nt, Pseudomonas aeruginosa PA01
ugcauccuuuuuccgaccuuu

SEQ ID NO: 3473139 - RNA, 17 nt, Pseudomonas aeruginosa PA01
ugcaucggccgccaggc

SEQ ID NO: 3473140 - RNA, 14 nt, Pseudomonas aeruginosa PA01
ugcaucggccggga

SEQ ID NO: 3473141 - RNA, 23 nt, Pseudomonas aeruginosa PA01
ugcaucggccgggauacagcagc

SEQ ID NO: 3473142 - RNA, 15 nt, Pseudomonas aeruginosa PA01
ugcaucugcgccggg

SEQ ID NO: 3473143 - RNA, 21 nt, Pseudomonas aeruginosa PA01
ugcaugaaggcgcugagcgcc

SEQ ID NO: 3473144 - RNA, 17 nt, Pseudomonas aeruginosa PA01
ugcaugagugucgccau

SEQ ID NO: 3473145 - RNA, 22 nt, Pseudomonas aeruginosa PA01
ugcaugauuucguuggcccaga

SEQ ID NO: 3473146 - RNA, 19 nt, Pseudomonas aeruginosa PA01
ugcaugccgacgagcagcu

SEQ ID NO: 3473147 - RNA, 14 nt, Pseudomonas aeruginosa PA01
ugcaugccggccgu

SEQ ID NO: 3473148 - RNA, 18 nt, Pseudomonas aeruginosa PA01
ugcaugccggccgucgcg

SEQ ID NO: 3473149 - RNA, 20 nt, Pseudomonas aeruginosa PA01
ugcaugccgggguccgccgg

SEQ ID NO: 3473150 - RNA, 21 nt, Pseudomonas aeruginosa PA01
ugcaugcuuuugaacaccagc

SEQ ID NO: 3473151 - RNA, 16 nt, Pseudomonas aeruginosa PA01
ugcauggccgggccga

SEQ ID NO: 3473152 - RNA, 21 nt, Pseudomonas aeruginosa PA01
ugcauguagcgcuccucgcgc

SEQ ID NO: 3473153 - RNA, 18 nt, Pseudomonas aeruginosa PA01
ugcaugucaccgauugcg

SEQ ID NO: 3473154 - RNA, 21 nt, Pseudomonas aeruginosa PA01
ugcauguccucggcgccgucg

SEQ ID NO: 3473155 - RNA, 13 nt, Pseudomonas aeruginosa PA01
ugcaugugccagg

SEQ ID NO: 3473156 - RNA, 20 nt, Pseudomonas aeruginosa PA01
ugcauuucagcggaagccca

SEQ ID NO: 3473157 - RNA, 17 nt, Pseudomonas aeruginosa PA01
ugccaaccgcgcucggc

SEQ ID NO: 3473158 - RNA, 13 nt, Pseudomonas aeruginosa PA01
ugccaauccgggc

SEQ ID NO: 3473159 - RNA, 18 nt, Pseudomonas aeruginosa PA01
ugccaauccgggcguggg

SEQ ID NO: 3473160 - RNA, 16 nt, Pseudomonas aeruginosa PA01
ugccacaggcccugga

SEQ ID NO: 3473161 - RNA, 20 nt, Pseudomonas aeruginosa PA01
ugccacagguggaucgcggc

SEQ ID NO: 3473162 - RNA, 21 nt, Pseudomonas aeruginosa PA01
ugccacagguggaucgcggcg

SEQ ID NO: 3473163 - RNA, 18 nt, Pseudomonas aeruginosa PA01
ugccacaguuucauggug

SEQ ID NO: 3473164 - RNA, 11 nt, Pseudomonas aeruginosa PA01
ugccaccacca

SEQ ID NO: 3473165 - RNA, 11 nt, Pseudomonas aeruginosa PA01
ugccacccggc

SEQ ID NO: 3473166 - RNA, 16 nt, Pseudomonas aeruginosa PA01
ugccacccggcgcccg

SEQ ID NO: 3473167 - RNA, 17 nt, Pseudomonas aeruginosa PA01
ugccacccggcgcccgg

SEQ ID NO: 3473168 - RNA, 18 nt, Pseudomonas aeruginosa PA01
ugccacccggcgcccggc

SEQ ID NO: 3473169 - RNA, 13 nt, Pseudomonas aeruginosa PA01
ugccccaggcacg

SEQ ID NO: 3473170 - RNA, 12 nt, Pseudomonas aeruginosa PA01
ugccccaggcga

SEQ ID NO: 3473171 - RNA, 19 nt, Pseudomonas aeruginosa PA01
ugccccauccgacgccggc

SEQ ID NO: 3473172 - RNA, 21 nt, Pseudomonas aeruginosa PA01
ugcccccggcaacacccuccc

SEQ ID NO: 3473173 - RNA, 20 nt, Pseudomonas aeruginosa PA01
ugccccgcuggcccaacagc

SEQ ID NO: 3473174 - RNA, 19 nt, Pseudomonas aeruginosa PA01
ugccccgugcaccgaggcg

SEQ ID NO: 3473175 - RNA, 20 nt, Pseudomonas aeruginosa PA01
ugccccguggcgggccagca

SEQ ID NO: 3473176 - RNA, 16 nt, Pseudomonas aeruginosa PA01
ugccccucacaccacc

SEQ ID NO: 3473177 - RNA, 15 nt, Pseudomonas aeruginosa PA01
ugccccuggcucagg

SEQ ID NO: 3473178 - RNA, 16 nt, Pseudomonas aeruginosa PA01
ugccccuucggcugca

SEQ ID NO: 3473179 - RNA, 16 nt, Pseudomonas aeruginosa PA01
ugccccuugagccagu

SEQ ID NO: 3473180 - RNA, 18 nt, Pseudomonas aeruginosa PA01
ugccccuugagccagucc

SEQ ID NO: 3473181 - RNA, 18 nt, Pseudomonas aeruginosa PA01
ugcccgaccgguuccagc

SEQ ID NO: 3473182 - RNA, 23 nt, Pseudomonas aeruginosa PA01
ugcccgaccgguuccagcggccg

SEQ ID NO: 3473183 - RNA, 21 nt, Pseudomonas aeruginosa PA01
ugcccgacgaaguugcaggcc

SEQ ID NO: 3473184 - RNA, 19 nt, Pseudomonas aeruginosa PA01
ugcccgaggugucgccgcg

SEQ ID NO: 3473185 - RNA, 18 nt, Pseudomonas aeruginosa PA01
ugcccgaugccgcgccgg

SEQ ID NO: 3473186 - RNA, 14 nt, Pseudomonas aeruginosa PA01
ugcccgccagcagg

SEQ ID NO: 3473187 - RNA, 22 nt, Pseudomonas aeruginosa PA01
ugcccgccagcaggcgccggcg

SEQ ID NO: 3473188 - RNA, 19 nt, Pseudomonas aeruginosa PA01
ugcccgccccgcaccagcc

SEQ ID NO: 3473189 - RNA, 12 nt, Pseudomonas aeruginosa PA01
ugcccgccggcg

SEQ ID NO: 3473190 - RNA, 21 nt, Pseudomonas aeruginosa PA01
ugcccgccggcgcgcccaggc

SEQ ID NO: 3473191 - RNA, 13 nt, Pseudomonas aeruginosa PA01
ugcccgccucgcg

SEQ ID NO: 3473192 - RNA, 12 nt, Pseudomonas aeruginosa PA01
ugcccgcgccuc

SEQ ID NO: 3473193 - RNA, 14 nt, Pseudomonas aeruginosa PA01
ugcccgcgccuggg

SEQ ID NO: 3473194 - RNA, 15 nt, Pseudomonas aeruginosa PA01
ugcccgcgccugggc

SEQ ID NO: 3473195 - RNA, 16 nt, Pseudomonas aeruginosa PA01
ugcccgcgccugggcc

SEQ ID NO: 3473196 - RNA, 20 nt, Pseudomonas aeruginosa PA01
ugcccgcgucgcgcgcggca

SEQ ID NO: 3473197 - RNA, 20 nt, Pseudomonas aeruginosa PA01
ugcccggcagaucucccugu

SEQ ID NO: 3473198 - RNA, 17 nt, Pseudomonas aeruginosa PA01
ugcccggcauaggcgcc

SEQ ID NO: 3473199 - RNA, 18 nt, Pseudomonas aeruginosa PA01
ugcccggcauaggcgcca

SEQ ID NO: 3473200 - RNA, 21 nt, Pseudomonas aeruginosa PA01
ugcccggcauaggcgccagcc

SEQ ID NO: 3473201 - RNA, 18 nt, Pseudomonas aeruginosa PA01
ugcccggccaugccgccg

SEQ ID NO: 3473202 - RNA, 22 nt, Pseudomonas aeruginosa PA01
ugcccggccaugccgccgacgc

SEQ ID NO: 3473203 - RNA, 14 nt, Pseudomonas aeruginosa PA01
ugcccggccgcagg

SEQ ID NO: 3473204 - RNA, 12 nt, Pseudomonas aeruginosa PA01
ugcccggccugg

SEQ ID NO: 3473205 - RNA, 14 nt, Pseudomonas aeruginosa PA01
ugcccggccuggcg

SEQ ID NO: 3473206 - RNA, 19 nt, Pseudomonas aeruginosa PA01
ugcccggccuggcgucccg

SEQ ID NO: 3473207 - RNA, 21 nt, Pseudomonas aeruginosa PA01
ugcccggcgccaguucgccgg

SEQ ID NO: 3473208 - RNA, 12 nt, Pseudomonas aeruginosa PA01
ugcccggcgcga

SEQ ID NO: 3473209 - RNA, 23 nt, Pseudomonas aeruginosa PA01
ugcccggcugguugccagcagcg

SEQ ID NO: 3473210 - RNA, 17 nt, Pseudomonas aeruginosa PA01
ugcccggcuugccgucg

SEQ ID NO: 3473211 - RNA, 18 nt, Pseudomonas aeruginosa PA01
ugcccggcuugccgucgg

SEQ ID NO: 3473212 - RNA, 19 nt, Pseudomonas aeruginosa PA01
ugcccgguauucagccaga

SEQ ID NO: 3473213 - RNA, 22 nt, Pseudomonas aeruginosa PA01
ugcccgguauucagccagagcc

SEQ ID NO: 3473214 - RNA, 19 nt, Pseudomonas aeruginosa PA01
ugcccgguggccuccugca

SEQ ID NO: 3473215 - RNA, 13 nt, Pseudomonas aeruginosa PA01
ugcccgucaggcc

SEQ ID NO: 3473216 - RNA, 17 nt, Pseudomonas aeruginosa PA01
ugcccgucaggccuugc

SEQ ID NO: 3473217 - RNA, 21 nt, Pseudomonas aeruginosa PA01
ugcccgucgaccaucaccagc

SEQ ID NO: 3473218 - RNA, 13 nt, Pseudomonas aeruginosa PA01
ugcccucgcagcc

SEQ ID NO: 3473219 - RNA, 15 nt, Pseudomonas aeruginosa PA01
ugcccucgcagccgg

SEQ ID NO: 3473220 - RNA, 14 nt, Pseudomonas aeruginosa PA01
ugcccucgcggacg

SEQ ID NO: 3473221 - RNA, 20 nt, Pseudomonas aeruginosa PA01
ugcccucgcggacgcuggcg

SEQ ID NO: 3473222 - RNA, 16 nt, Pseudomonas aeruginosa PA01
ugcccucgcggcggca

SEQ ID NO: 3473223 - RNA, 21 nt, Pseudomonas aeruginosa PA01
ugcccucguugauuccgccgg

SEQ ID NO: 3473224 - RNA, 13 nt, Pseudomonas aeruginosa PA01
ugcccugccggcg

SEQ ID NO: 3473225 - RNA, 18 nt, Pseudomonas aeruginosa PA01
ugcccugcucuuccagcg

SEQ ID NO: 3473226 - RNA, 15 nt, Pseudomonas aeruginosa PA01
ugcccuggaagccgg

SEQ ID NO: 3473227 - RNA, 19 nt, Pseudomonas aeruginosa PA01
ugcccuggcagacgcugcu

SEQ ID NO: 3473228 - RNA, 20 nt, Pseudomonas aeruginosa PA01
ugcccuggcagacgcugcuc

SEQ ID NO: 3473229 - RNA, 11 nt, Pseudomonas aeruginosa PA01
ugcccuggccg

SEQ ID NO: 3473230 - RNA, 12 nt, Pseudomonas aeruginosa PA01
ugcccuggccga

SEQ ID NO: 3473231 - RNA, 12 nt, Pseudomonas aeruginosa PA01
ugcccuggccgc

SEQ ID NO: 3473232 - RNA, 15 nt, Pseudomonas aeruginosa PA01
ugcccuggccgcugc

SEQ ID NO: 3473233 - RNA, 20 nt, Pseudomonas aeruginosa PA01
ugcccuggccgcugccgcuc

SEQ ID NO: 3473234 - RNA, 22 nt, Pseudomonas aeruginosa PA01
ugcccuggccggcacccugacc

SEQ ID NO: 3473235 - RNA, 12 nt, Pseudomonas aeruginosa PA01
ugcccuggcgcg

SEQ ID NO: 3473236 - RNA, 16 nt, Pseudomonas aeruginosa PA01
ugcccuggcgcgcgcc

SEQ ID NO: 3473237 - RNA, 22 nt, Pseudomonas aeruginosa PA01
ugcccuggcuuuccagggccug

SEQ ID NO: 3473238 - RNA, 11 nt, Pseudomonas aeruginosa PA01
ugcccugggcc

SEQ ID NO: 3473239 - RNA, 14 nt, Pseudomonas aeruginosa PA01
ugcccugggccggc

SEQ ID NO: 3473240 - RNA, 21 nt, Pseudomonas aeruginosa PA01
ugcccuugaggucguuggcca

SEQ ID NO: 3473241 - RNA, 13 nt, Pseudomonas aeruginosa PA01
ugcccuugccggu

SEQ ID NO: 3473242 - RNA, 16 nt, Pseudomonas aeruginosa PA01
ugcccuuguacagcuu

SEQ ID NO: 3473243 - RNA, 17 nt, Pseudomonas aeruginosa PA01
ugcccuuguccggcccg

SEQ ID NO: 3473244 - RNA, 18 nt, Pseudomonas aeruginosa PA01
ugcccuuguccggcccgg

SEQ ID NO: 3473245 - RNA, 16 nt, Pseudomonas aeruginosa PA01
ugcccuuuuccuccag

SEQ ID NO: 3473246 - RNA, 17 nt, Pseudomonas aeruginosa PA01
ugcccuuuuccuccagg

SEQ ID NO: 3473247 - RNA, 20 nt, Pseudomonas aeruginosa PA01
ugccgaacagcagggaggcg

SEQ ID NO: 3473248 - RNA, 14 nt, Pseudomonas aeruginosa PA01
ugccgaacaggcgu

SEQ ID NO: 3473249 - RNA, 23 nt, Pseudomonas aeruginosa PA01
ugccgaacaggcgucccauggcg

SEQ ID NO: 3473250 - RNA, 18 nt, Pseudomonas aeruginosa PA01
ugccgaacugcagggcgu

SEQ ID NO: 3473251 - RNA, 16 nt, Pseudomonas aeruginosa PA01
ugccgaagaccaccau

SEQ ID NO: 3473252 - RNA, 21 nt, Pseudomonas aeruginosa PA01
ugccgaagauacccagcgggc

SEQ ID NO: 3473253 - RNA, 19 nt, Pseudomonas aeruginosa PA01
ugccgaagaucgacaggcc

SEQ ID NO: 3473254 - RNA, 22 nt, Pseudomonas aeruginosa PA01
ugccgaagaucgacaggccgcc

SEQ ID NO: 3473255 - RNA, 16 nt, Pseudomonas aeruginosa PA01
ugccgaagcgcucggu

SEQ ID NO: 3473256 - RNA, 13 nt, Pseudomonas aeruginosa PA01
ugccgaaggcgug

SEQ ID NO: 3473257 - RNA, 22 nt, Pseudomonas aeruginosa PA01
ugccgaaggcgugggcgccggc

SEQ ID NO: 3473258 - RNA, 23 nt, Pseudomonas aeruginosa PA01
ugccgaaggcgugggcgccggcg

SEQ ID NO: 3473259 - RNA, 20 nt, Pseudomonas aeruginosa PA01
ugccgaagggaaacaccagg

SEQ ID NO: 3473260 - RNA, 21 nt, Pseudomonas aeruginosa PA01
ugccgaagggaaacaccaggc

SEQ ID NO: 3473261 - RNA, 22 nt, Pseudomonas aeruginosa PA01
ugccgaagggaaacaccaggcc

SEQ ID NO: 3473262 - RNA, 23 nt, Pseudomonas aeruginosa PA01
ugccgaagggaaacaccaggccg

SEQ ID NO: 3473263 - RNA, 13 nt, Pseudomonas aeruginosa PA01
ugccgacaggcgu

SEQ ID NO: 3473264 - RNA, 23 nt, Pseudomonas aeruginosa PA01
ugccgaccacguaguaggcgcgg

SEQ ID NO: 3473265 - RNA, 17 nt, Pseudomonas aeruginosa PA01
ugccgaccgagcagcgg

SEQ ID NO: 3473266 - RNA, 15 nt, Pseudomonas aeruginosa PA01
ugccgaccuguaccg

SEQ ID NO: 3473267 - RNA, 22 nt, Pseudomonas aeruginosa PA01
ugccgaccuguaccgcucccca

SEQ ID NO: 3473268 - RNA, 12 nt, Pseudomonas aeruginosa PA01
ugccgaccuuca

SEQ ID NO: 3473269 - RNA, 18 nt, Pseudomonas aeruginosa PA01
ugccgaccuucaucaggc

SEQ ID NO: 3473270 - RNA, 16 nt, Pseudomonas aeruginosa PA01
ugccgaccuugccggu

SEQ ID NO: 3473271 - RNA, 19 nt, Pseudomonas aeruginosa PA01
ugccgccgccggagggaau

SEQ ID NO: 3473272 - RNA, 14 nt, Pseudomonas aeruginosa PA01
ugccgccgcgcagg

SEQ ID NO: 3473273 - RNA, 15 nt, Pseudomonas aeruginosa PA01
ugccgccgcgcccgg

SEQ ID NO: 3473274 - RNA, 16 nt, Pseudomonas aeruginosa PA01
ugccgccgcgcccggc

SEQ ID NO: 3473275 - RNA, 17 nt, Pseudomonas aeruginosa PA01
ugccgccgcgcccggcg

SEQ ID NO: 3473276 - RNA, 22 nt, Pseudomonas aeruginosa PA01
ugccgccgcgcccggcgccagg

SEQ ID NO: 3473277 - RNA, 18 nt, Pseudomonas aeruginosa PA01
ugccgccgcgcugcaggc

SEQ ID NO: 3473278 - RNA, 13 nt, Pseudomonas aeruginosa PA01
ugccgccgcuggc

SEQ ID NO: 3473279 - RNA, 15 nt, Pseudomonas aeruginosa PA01
ugccgccgcuggccu

SEQ ID NO: 3473280 - RNA, 11 nt, Pseudomonas aeruginosa PA01
ugccgccggca

SEQ ID NO: 3473281 - RNA, 12 nt, Pseudomonas aeruginosa PA01
ugccgccggcau

SEQ ID NO: 3473282 - RNA, 14 nt, Pseudomonas aeruginosa PA01
ugccgccggccacc

SEQ ID NO: 3473283 - RNA, 19 nt, Pseudomonas aeruginosa PA01
ugccgccggccaccagcag

SEQ ID NO: 3473284 - RNA, 14 nt, Pseudomonas aeruginosa PA01
ugccgccggcgccg

SEQ ID NO: 3473285 - RNA, 16 nt, Pseudomonas aeruginosa PA01
ugccgccggcgccgcc

SEQ ID NO: 3473286 - RNA, 17 nt, Pseudomonas aeruginosa PA01
ugccgccggcgccgccg

SEQ ID NO: 3473287 - RNA, 21 nt, Pseudomonas aeruginosa PA01
ugccgccggcgccgccgggga

SEQ ID NO: 3473288 - RNA, 12 nt, Pseudomonas aeruginosa PA01
ugccgccgggca

SEQ ID NO: 3473289 - RNA, 21 nt, Pseudomonas aeruginosa PA01
ugccgccggggcgcaggucgc

SEQ ID NO: 3473290 - RNA, 12 nt, Pseudomonas aeruginosa PA01
ugccgccggggg

SEQ ID NO: 3473291 - RNA, 22 nt, Pseudomonas aeruginosa PA01
ugccgccggucuucacgccuug

SEQ ID NO: 3473292 - RNA, 19 nt, Pseudomonas aeruginosa PA01
ugccgccgguucgcaggcc

SEQ ID NO: 3473293 - RNA, 20 nt, Pseudomonas aeruginosa PA01
ugccgccgguucgcaggcca

SEQ ID NO: 3473294 - RNA, 15 nt, Pseudomonas aeruginosa PA01
ugccgccgucgcggc

SEQ ID NO: 3473295 - RNA, 17 nt, Pseudomonas aeruginosa PA01
ugccgccgucgcggcca

SEQ ID NO: 3473296 - RNA, 23 nt, Pseudomonas aeruginosa PA01
ugccgccgucgcggccaucggcg

SEQ ID NO: 3473297 - RNA, 13 nt, Pseudomonas aeruginosa PA01
ugccgccucagcg

SEQ ID NO: 3473298 - RNA, 19 nt, Pseudomonas aeruginosa PA01
ugccgccugcgucagcgag

SEQ ID NO: 3473299 - RNA, 20 nt, Pseudomonas aeruginosa PA01
ugccgccugcgucagcgagg

SEQ ID NO: 3473300 - RNA, 18 nt, Pseudomonas aeruginosa PA01
ugccgccuucgcgggcca

SEQ ID NO: 3473301 - RNA, 20 nt, Pseudomonas aeruginosa PA01
ugccgccuucgcgggccagg

SEQ ID NO: 3473302 - RNA, 21 nt, Pseudomonas aeruginosa PA01
ugccgccuucgcgggccaggc

SEQ ID NO: 3473303 - RNA, 14 nt, Pseudomonas aeruginosa PA01
ugccgcgagccagc

SEQ ID NO: 3473304 - RNA, 18 nt, Pseudomonas aeruginosa PA01
ugccgcgagccagccgug

SEQ ID NO: 3473305 - RNA, 18 nt, Pseudomonas aeruginosa PA01
ugccgcgagcuuggcccu

SEQ ID NO: 3473306 - RNA, 21 nt, Pseudomonas aeruginosa PA01
ugccgcgagcuuggcccuggc

SEQ ID NO: 3473307 - RNA, 22 nt, Pseudomonas aeruginosa PA01
ugccgcgagcuuggcccuggcc

SEQ ID NO: 3473308 - RNA, 23 nt, Pseudomonas aeruginosa PA01
ugccgcgagcuuggcccuggccu

SEQ ID NO: 3473309 - RNA, 20 nt, Pseudomonas aeruginosa PA01
ugccgcgcaccaccgagagc

SEQ ID NO: 3473310 - RNA, 13 nt, Pseudomonas aeruginosa PA01
ugccgcgcagcuu

SEQ ID NO: 3473311 - RNA, 20 nt, Pseudomonas aeruginosa PA01
ugccgcgcagguucaucgcc

SEQ ID NO: 3473312 - RNA, 13 nt, Pseudomonas aeruginosa PA01
ugccgcgccaggc

SEQ ID NO: 3473313 - RNA, 21 nt, Pseudomonas aeruginosa PA01
ugccgcgccaggcgcaguagg

SEQ ID NO: 3473314 - RNA, 13 nt, Pseudomonas aeruginosa PA01
ugccgcgcccggc

SEQ ID NO: 3473315 - RNA, 14 nt, Pseudomonas aeruginosa PA01
ugccgcgcccggcc

SEQ ID NO: 3473316 - RNA, 16 nt, Pseudomonas aeruginosa PA01
ugccgcgcccggccag

SEQ ID NO: 3473317 - RNA, 17 nt, Pseudomonas aeruginosa PA01
ugccgcgcccggccagg

SEQ ID NO: 3473318 - RNA, 16 nt, Pseudomonas aeruginosa PA01
ugccgcgcccggccuu

SEQ ID NO: 3473319 - RNA, 22 nt, Pseudomonas aeruginosa PA01
ugccgcgccgaugccguuaccu

SEQ ID NO: 3473320 - RNA, 14 nt, Pseudomonas aeruginosa PA01
ugccgcgccggaag

SEQ ID NO: 3473321 - RNA, 14 nt, Pseudomonas aeruginosa PA01
ugccgcgcgccugg

SEQ ID NO: 3473322 - RNA, 16 nt, Pseudomonas aeruginosa PA01
ugccgcgcgccuggcu

SEQ ID NO: 3473323 - RNA, 21 nt, Pseudomonas aeruginosa PA01
ugccgcgcgccuggcuggcca

SEQ ID NO: 3473324 - RNA, 13 nt, Pseudomonas aeruginosa PA01
ugccgcgcgggcc

SEQ ID NO: 3473325 - RNA, 14 nt, Pseudomonas aeruginosa PA01
ugccgcgcgggccg

SEQ ID NO: 3473326 - RNA, 17 nt, Pseudomonas aeruginosa PA01
ugccgcgcgggccggcg

SEQ ID NO: 3473327 - RNA, 18 nt, Pseudomonas aeruginosa PA01
ugccgcgcgggccggcga

SEQ ID NO: 3473328 - RNA, 19 nt, Pseudomonas aeruginosa PA01
ugccgcgcgggccggcgau

SEQ ID NO: 3473329 - RNA, 14 nt, Pseudomonas aeruginosa PA01
ugccgcgcucggau

SEQ ID NO: 3473330 - RNA, 23 nt, Pseudomonas aeruginosa PA01
ugccgcgcucggaucaggcgggc

SEQ ID NO: 3473331 - RNA, 23 nt, Pseudomonas aeruginosa PA01
ugccgcggaagugcgccgguugc

SEQ ID NO: 3473332 - RNA, 20 nt, Pseudomonas aeruginosa PA01
ugccgcggacggcacggggc

SEQ ID NO: 3473333 - RNA, 21 nt, Pseudomonas aeruginosa PA01
ugccgcggauacggcaggggc

SEQ ID NO: 3473334 - RNA, 20 nt, Pseudomonas aeruginosa PA01
ugccgcggcgauaggcgcgc

SEQ ID NO: 3473335 - RNA, 21 nt, Pseudomonas aeruginosa PA01
ugccgcgggcuauucccgccg

SEQ ID NO: 3473336 - RNA, 17 nt, Pseudomonas aeruginosa PA01
ugccgcgguaggucagc

SEQ ID NO: 3473337 - RNA, 19 nt, Pseudomonas aeruginosa PA01
ugccgcgguaggucagcgg

SEQ ID NO: 3473338 - RNA, 16 nt, Pseudomonas aeruginosa PA01
ugccgcgucggcucgg

SEQ ID NO: 3473339 - RNA, 15 nt, Pseudomonas aeruginosa PA01
ugccgcguuccuugu

SEQ ID NO: 3473340 - RNA, 15 nt, Pseudomonas aeruginosa PA01
ugccgcuagcccugc

SEQ ID NO: 3473341 - RNA, 19 nt, Pseudomonas aeruginosa PA01
ugccgcuaucgcuggcgca

SEQ ID NO: 3473342 - RNA, 20 nt, Pseudomonas aeruginosa PA01
ugccgcuaucgcuggcgcag

SEQ ID NO: 3473343 - RNA, 13 nt, Pseudomonas aeruginosa PA01
ugccgcucagcgg

SEQ ID NO: 3473344 - RNA, 19 nt, Pseudomonas aeruginosa PA01
ugccgcucaggcugugcag

SEQ ID NO: 3473345 - RNA, 17 nt, Pseudomonas aeruginosa PA01
ugccgcucguuggcggc

SEQ ID NO: 3473346 - RNA, 18 nt, Pseudomonas aeruginosa PA01
ugccgcucguuggcggcc

SEQ ID NO: 3473347 - RNA, 19 nt, Pseudomonas aeruginosa PA01
ugccgcucguuggcggcca

SEQ ID NO: 3473348 - RNA, 14 nt, Pseudomonas aeruginosa PA01
ugccgcucugccag

SEQ ID NO: 3473349 - RNA, 13 nt, Pseudomonas aeruginosa PA01
ugccgcucuggcu

SEQ ID NO: 3473350 - RNA, 18 nt, Pseudomonas aeruginosa PA01
ugccgcucuggcugcugg

SEQ ID NO: 3473351 - RNA, 20 nt, Pseudomonas aeruginosa PA01
ugccgcucuggcugcuggcg

SEQ ID NO: 3473352 - RNA, 21 nt, Pseudomonas aeruginosa PA01
ugccgcucuggcugcuggcga

SEQ ID NO: 3473353 - RNA, 14 nt, Pseudomonas aeruginosa PA01
ugccgcugcacgcc

SEQ ID NO: 3473354 - RNA, 14 nt, Pseudomonas aeruginosa PA01
ugccgcugcaggcc

SEQ ID NO: 3473355 - RNA, 17 nt, Pseudomonas aeruginosa PA01
ugccgcugcaggccacc

SEQ ID NO: 3473356 - RNA, 19 nt, Pseudomonas aeruginosa PA01
ugccgcugcaggccaccgg

SEQ ID NO: 3473357 - RNA, 17 nt, Pseudomonas aeruginosa PA01
ugccgcugcgcaucagg

SEQ ID NO: 3473358 - RNA, 13 nt, Pseudomonas aeruginosa PA01
ugccgcugcgcgc

SEQ ID NO: 3473359 - RNA, 19 nt, Pseudomonas aeruginosa PA01
ugccgcugcgcgcaguuca

SEQ ID NO: 3473360 - RNA, 15 nt, Pseudomonas aeruginosa PA01
ugccgcugcggcggu

SEQ ID NO: 3473361 - RNA, 14 nt, Pseudomonas aeruginosa PA01
ugccgcuggccgac

SEQ ID NO: 3473362 - RNA, 16 nt, Pseudomonas aeruginosa PA01
ugccgcuggccgacca

SEQ ID NO: 3473363 - RNA, 13 nt, Pseudomonas aeruginosa PA01
ugccgcuggccuc

SEQ ID NO: 3473364 - RNA, 13 nt, Pseudomonas aeruginosa PA01
ugccgcuggcggc

SEQ ID NO: 3473365 - RNA, 21 nt, Pseudomonas aeruginosa PA01
ugccgcuggcggccuucggcg

SEQ ID NO: 3473366 - RNA, 17 nt, Pseudomonas aeruginosa PA01
ugccgcuggugaucgac

SEQ ID NO: 3473367 - RNA, 21 nt, Pseudomonas aeruginosa PA01
ugccgcuguaggacagguuca

SEQ ID NO: 3473368 - RNA, 17 nt, Pseudomonas aeruginosa PA01
ugccgcuguuggcguga

SEQ ID NO: 3473369 - RNA, 18 nt, Pseudomonas aeruginosa PA01
ugccgcuucggcugcugc

SEQ ID NO: 3473370 - RNA, 24 nt, Pseudomonas aeruginosa PA01
ugccgcuucggcugcugcugcggc

SEQ ID NO: 3473371 - RNA, 22 nt, Pseudomonas aeruginosa PA01
ugccgcuugcccucgcgcccgg

SEQ ID NO: 3473372 - RNA, 17 nt, Pseudomonas aeruginosa PA01
ugccggaaagccuggcc

SEQ ID NO: 3473373 - RNA, 18 nt, Pseudomonas aeruginosa PA01
ugccggaaagccuggccg

SEQ ID NO: 3473374 - RNA, 12 nt, Pseudomonas aeruginosa PA01
ugccgugcagcu

SEQ ID NO: 3473375 - RNA, 18 nt, Pseudomonas aeruginosa PA01
ugccguggaccaacagcc

SEQ ID NO: 3473376 - RNA, 22 nt, Pseudomonas aeruginosa PA01
ugccguggaccaacagccggcg

SEQ ID NO: 3473377 - RNA, 18 nt, Pseudomonas aeruginosa PA01
ugccguggcggcgcgcgu

SEQ ID NO: 3473378 - RNA, 14 nt, Pseudomonas aeruginosa PA01
ugccguggcucggc

SEQ ID NO: 3473379 - RNA, 14 nt, Pseudomonas aeruginosa PA01
ugccgugggcgccg

SEQ ID NO: 3473380 - RNA, 15 nt, Pseudomonas aeruginosa PA01
ugccgugggcgccgc

SEQ ID NO: 3473381 - RNA, 18 nt, Pseudomonas aeruginosa PA01
ugccgugggucgccucga

SEQ ID NO: 3473382 - RNA, 20 nt, Pseudomonas aeruginosa PA01
ugccguggucgcgcaggcgg

SEQ ID NO: 3473383 - RNA, 17 nt, Pseudomonas aeruginosa PA01
ugccguucaggcgcgga

SEQ ID NO: 3473384 - RNA, 17 nt, Pseudomonas aeruginosa PA01
ugccguuccagcggcac

SEQ ID NO: 3473385 - RNA, 13 nt, Pseudomonas aeruginosa PA01
ugccguucgcccg

SEQ ID NO: 3473386 - RNA, 15 nt, Pseudomonas aeruginosa PA01
ugccguucgcccgcg

SEQ ID NO: 3473387 - RNA, 17 nt, Pseudomonas aeruginosa PA01
ugccguucucccgcgcg

SEQ ID NO: 3473388 - RNA, 18 nt, Pseudomonas aeruginosa PA01
ugccguucucggugacca

SEQ ID NO: 3473389 - RNA, 14 nt, Pseudomonas aeruginosa PA01
ugccguugaugucg

SEQ ID NO: 3473390 - RNA, 15 nt, Pseudomonas aeruginosa PA01
ugccguugcccucgc

SEQ ID NO: 3473391 - RNA, 12 nt, Pseudomonas aeruginosa PA01
ugccguugcuca

SEQ ID NO: 3473392 - RNA, 16 nt, Pseudomonas aeruginosa PA01
ugccguuggccgagcg

SEQ ID NO: 3473393 - RNA, 15 nt, Pseudomonas aeruginosa PA01
ugccguugggccagg

SEQ ID NO: 3473394 - RNA, 17 nt, Pseudomonas aeruginosa PA01
ugccguugggccagggc

SEQ ID NO: 3473395 - RNA, 18 nt, Pseudomonas aeruginosa PA01
ugccguugggccagggcc

SEQ ID NO: 3473396 - RNA, 21 nt, Pseudomonas aeruginosa PA01
ugccguuguggcaggcgcugc

SEQ ID NO: 3473397 - RNA, 18 nt, Pseudomonas aeruginosa PA01
ugccucagagucgcaccg

SEQ ID NO: 3473398 - RNA, 15 nt, Pseudomonas aeruginosa PA01
ugccucccggccauu

SEQ ID NO: 3473399 - RNA, 15 nt, Pseudomonas aeruginosa PA01
ugccuccgcucugcu

SEQ ID NO: 3473400 - RNA, 19 nt, Pseudomonas aeruginosa PA01
ugccuccgcucugcuggcc

SEQ ID NO: 3473401 - RNA, 12 nt, Pseudomonas aeruginosa PA01
ugccucgccgag

SEQ ID NO: 3473402 - RNA, 14 nt, Pseudomonas aeruginosa PA01
ugccucgccgaggc

SEQ ID NO: 3473403 - RNA, 15 nt, Pseudomonas aeruginosa PA01
ugccucgccgaggcg

SEQ ID NO: 3473404 - RNA, 16 nt, Pseudomonas aeruginosa PA01
ugccucgccgaggcgg

SEQ ID NO: 3473405 - RNA, 17 nt, Pseudomonas aeruginosa PA01
ugccucgcgcguggccg

SEQ ID NO: 3473406 - RNA, 20 nt, Pseudomonas aeruginosa PA01
ugccucgcgcguggccgcca

SEQ ID NO: 3473407 - RNA, 15 nt, Pseudomonas aeruginosa PA01
ugccucggcggcggc

SEQ ID NO: 3473408 - RNA, 17 nt, Pseudomonas aeruginosa PA01
ugccucggcggcggccu

SEQ ID NO: 3473409 - RNA, 19 nt, Pseudomonas aeruginosa PA01
ugccucggcggcggccugc

SEQ ID NO: 3473410 - RNA, 21 nt, Pseudomonas aeruginosa PA01
ugccucgguuuccggccaggc

SEQ ID NO: 3473411 - RNA, 22 nt, Pseudomonas aeruginosa PA01
ugccucgguuuccggccaggcg

SEQ ID NO: 3473412 - RNA, 18 nt, Pseudomonas aeruginosa PA01
ugccucugaccgcgcccg

SEQ ID NO: 3473413 - RNA, 16 nt, Pseudomonas aeruginosa PA01
ugccugcaccacgcag

SEQ ID NO: 3473414 - RNA, 18 nt, Pseudomonas aeruginosa PA01
ugccugcaccacgcaggc

SEQ ID NO: 3473415 - RNA, 22 nt, Pseudomonas aeruginosa PA01
ugccugcaccacgcaggcgcgu

SEQ ID NO: 3473416 - RNA, 16 nt, Pseudomonas aeruginosa PA01
ugccugcaccgggccg

SEQ ID NO: 3473417 - RNA, 17 nt, Pseudomonas aeruginosa PA01
ugccugcaccgggccga

SEQ ID NO: 3473418 - RNA, 20 nt, Pseudomonas aeruginosa PA01
ugccugcgcccucaagucuc

SEQ ID NO: 3473419 - RNA, 22 nt, Pseudomonas aeruginosa PA01
ugccugcggccccaaggggccg

SEQ ID NO: 3473420 - RNA, 19 nt, Pseudomonas aeruginosa PA01
ugccugcuguguccggcgg

SEQ ID NO: 3473421 - RNA, 20 nt, Pseudomonas aeruginosa PA01
ugccugcuguguccggcgga

SEQ ID NO: 3473422 - RNA, 20 nt, Pseudomonas aeruginosa PA01
ugccuggcagguccgacgga

SEQ ID NO: 3473423 - RNA, 20 nt, Pseudomonas aeruginosa PA01
ugccuggggacggcaggccc

SEQ ID NO: 3473424 - RNA, 14 nt, Pseudomonas aeruginosa PA01
ugccuguccagcuc

SEQ ID NO: 3473425 - RNA, 15 nt, Pseudomonas aeruginosa PA01
ugccuguccagcucc

SEQ ID NO: 3473426 - RNA, 16 nt, Pseudomonas aeruginosa PA01
ugccugucgcagcggg

SEQ ID NO: 3473427 - RNA, 17 nt, Pseudomonas aeruginosa PA01
ugccuguuccuccgcca

SEQ ID NO: 3473428 - RNA, 18 nt, Pseudomonas aeruginosa PA01
ugccuguuccuccgccag

SEQ ID NO: 3473429 - RNA, 14 nt, Pseudomonas aeruginosa PA01
ugccuucaccggcg

SEQ ID NO: 3473430 - RNA, 16 nt, Pseudomonas aeruginosa PA01
ugccuucaccggcgga

SEQ ID NO: 3473431 - RNA, 14 nt, Pseudomonas aeruginosa PA01
ugccuuccaccggg

SEQ ID NO: 3473432 - RNA, 12 nt, Pseudomonas aeruginosa PA01
ugccuuccagca

SEQ ID NO: 3473433 - RNA, 13 nt, Pseudomonas aeruginosa PA01
ugccuuccagcag

SEQ ID NO: 3473434 - RNA, 23 nt, Pseudomonas aeruginosa PA01
ugccuuccagcaggucgagggcg

SEQ ID NO: 3473435 - RNA, 12 nt, Pseudomonas aeruginosa PA01
ugccuuccaggc

SEQ ID NO: 3473436 - RNA, 13 nt, Pseudomonas aeruginosa PA01
ugccuuccaggcu

SEQ ID NO: 3473437 - RNA, 15 nt, Pseudomonas aeruginosa PA01
ugccuuccugggcgu

SEQ ID NO: 3473438 - RNA, 15 nt, Pseudomonas aeruginosa PA01
ugccuucgaagccgg

SEQ ID NO: 3473439 - RNA, 18 nt, Pseudomonas aeruginosa PA01
ugccuucgccgucgagcc

SEQ ID NO: 3473440 - RNA, 12 nt, Pseudomonas aeruginosa PA01
ugccuucggcgg

SEQ ID NO: 3473441 - RNA, 15 nt, Pseudomonas aeruginosa PA01
ugccuucggcggccg

SEQ ID NO: 3473442 - RNA, 16 nt, Pseudomonas aeruginosa PA01
ugccuucggcggcgcc

SEQ ID NO: 3473443 - RNA, 17 nt, Pseudomonas aeruginosa PA01
ugccuucggcggcgccu

SEQ ID NO: 3473444 - RNA, 23 nt, Pseudomonas aeruginosa PA01
ugccuucguuggccuugaugccg

SEQ ID NO: 3473445 - RNA, 14 nt, Pseudomonas aeruginosa PA01
ugccuugcggcccc

SEQ ID NO: 3473446 - RNA, 16 nt, Pseudomonas aeruginosa PA01
ugcgaaaaagaacgcc

SEQ ID NO: 3473447 - RNA, 22 nt, Pseudomonas aeruginosa PA01
ugcgaaaacggcgacccugggg

SEQ ID NO: 3473448 - RNA, 16 nt, Pseudomonas aeruginosa PA01
ugcgaaaagcccgcca

SEQ ID NO: 3473449 - RNA, 21 nt, Pseudomonas aeruginosa PA01
ugcgaacacaccgaccgcgag

SEQ ID NO: 3473450 - RNA, 14 nt, Pseudomonas aeruginosa PA01
ugcgaaucgucgcc

SEQ ID NO: 3473451 - RNA, 17 nt, Pseudomonas aeruginosa PA01
ugcgaauugcgcuggaa

SEQ ID NO: 3473452 - RNA, 16 nt, Pseudomonas aeruginosa PA01
ugcgacacgaugucgc

SEQ ID NO: 3473453 - RNA, 18 nt, Pseudomonas aeruginosa PA01
ugcgacaucuccaggccg

SEQ ID NO: 3473454 - RNA, 20 nt, Pseudomonas aeruginosa PA01
ugcgacaucuccaggccgcu

SEQ ID NO: 3473455 - RNA, 17 nt, Pseudomonas aeruginosa PA01
ugcgaccagguccggag

SEQ ID NO: 3473456 - RNA, 17 nt, Pseudomonas aeruginosa PA01
ugcgaccgugaggcgca

SEQ ID NO: 3473457 - RNA, 19 nt, Pseudomonas aeruginosa PA01
ugcgaccgugaggcgcagg

SEQ ID NO: 3473458 - RNA, 18 nt, Pseudomonas aeruginosa PA01
ugcgaccuggcgccgaaa

SEQ ID NO: 3473459 - RNA, 20 nt, Pseudomonas aeruginosa PA01
ugcgacucguugcacgcagg

SEQ ID NO: 3473460 - RNA, 21 nt, Pseudomonas aeruginosa PA01
ugcgacuggggcaucucggcc

SEQ ID NO: 3473461 - RNA, 17 nt, Pseudomonas aeruginosa PA01
ugcgagacccccgggau

SEQ ID NO: 3473462 - RNA, 17 nt, Pseudomonas aeruginosa PA01
ugcgagacgggcgacgc

SEQ ID NO: 3473463 - RNA, 17 nt, Pseudomonas aeruginosa PA01
ugcgagccgacuuccag

SEQ ID NO: 3473464 - RNA, 21 nt, Pseudomonas aeruginosa PA01
ugcgaggcccguauggcgggc

SEQ ID NO: 3473465 - RNA, 15 nt, Pseudomonas aeruginosa PA01
ugcgaggcggugcag

SEQ ID NO: 3473466 - RNA, 14 nt, Pseudomonas aeruginosa PA01
ugcgaggcuggccu

SEQ ID NO: 3473467 - RNA, 17 nt, Pseudomonas aeruginosa PA01
ugcgagggauguuccag

SEQ ID NO: 3473468 - RNA, 22 nt, Pseudomonas aeruginosa PA01
ugcgagggauguuccaggcccg

SEQ ID NO: 3473469 - RNA, 24 nt, Pseudomonas aeruginosa PA01
ugcgagggcucgggcgcggacaag

SEQ ID NO: 3473470 - RNA, 14 nt, Pseudomonas aeruginosa PA01
ugcgauagaccagg

SEQ ID NO: 3473471 - RNA, 16 nt, Pseudomonas aeruginosa PA01
ugcgauagaccaggaa

SEQ ID NO: 3473472 - RNA, 16 nt, Pseudomonas aeruginosa PA01
ugcgauauggccgauc

SEQ ID NO: 3473473 - RNA, 12 nt, Pseudomonas aeruginosa PA01
ugcgaucgagga

SEQ ID NO: 3473474 - RNA, 21 nt, Pseudomonas aeruginosa PA01
ugcgaugcugucagcgcccgg

SEQ ID NO: 3473475 - RNA, 22 nt, Pseudomonas aeruginosa PA01
ugcgaugcugucagcgcccggc

SEQ ID NO: 3473476 - RNA, 14 nt, Pseudomonas aeruginosa PA01
ugcgauggaugcgc

SEQ ID NO: 3473477 - RNA, 15 nt, Pseudomonas aeruginosa PA01
ugcgcccuacgccac

SEQ ID NO: 3473478 - RNA, 21 nt, Pseudomonas aeruginosa PA01
ugcgcccucaagucuccagcg

SEQ ID NO: 3473479 - RNA, 15 nt, Pseudomonas aeruginosa PA01
ugcgccgaaggcguc

SEQ ID NO: 3473480 - RNA, 18 nt, Pseudomonas aeruginosa PA01
ugcgccgaauccaggccg

SEQ ID NO: 3473481 - RNA, 20 nt, Pseudomonas aeruginosa PA01
ugcgccgaauccaggccgac

SEQ ID NO: 3473482 - RNA, 17 nt, Pseudomonas aeruginosa PA01
ugcgccgaccgcgcgcc

SEQ ID NO: 3473483 - RNA, 21 nt, Pseudomonas aeruginosa PA01
ugcgccgaccgcgcgccugca

SEQ ID NO: 3473484 - RNA, 16 nt, Pseudomonas aeruginosa PA01
ugcgccgacgccacca

SEQ ID NO: 3473485 - RNA, 16 nt, Pseudomonas aeruginosa PA01
ugcgccgagcgcucgc

SEQ ID NO: 3473486 - RNA, 18 nt, Pseudomonas aeruginosa PA01
ugcgccgcaaguggcggc

SEQ ID NO: 3473487 - RNA, 14 nt, Pseudomonas aeruginosa PA01
ugcgccgcaccacg

SEQ ID NO: 3473488 - RNA, 14 nt, Pseudomonas aeruginosa PA01
ugcgccgcagcaag

SEQ ID NO: 3473489 - RNA, 13 nt, Pseudomonas aeruginosa PA01
ugcgccgcagcgc

SEQ ID NO: 3473490 - RNA, 15 nt, Pseudomonas aeruginosa PA01
ugcgccgcagcggcc

SEQ ID NO: 3473491 - RNA, 13 nt, Pseudomonas aeruginosa PA01
ugcgccgccacgu

SEQ ID NO: 3473492 - RNA, 21 nt, Pseudomonas aeruginosa PA01
ugcgccgccacgugcacgccg

SEQ ID NO: 3473493 - RNA, 22 nt, Pseudomonas aeruginosa PA01
ugcgccgccacgugcacgccgu

SEQ ID NO: 3473494 - RNA, 13 nt, Pseudomonas aeruginosa PA01
ugcgccgccggcu

SEQ ID NO: 3473495 - RNA, 20 nt, Pseudomonas aeruginosa PA01
ugcgccgccgucuugccgcu

SEQ ID NO: 3473496 - RNA, 23 nt, Pseudomonas aeruginosa PA01
ugcgccgccgucuugccgcugcg

SEQ ID NO: 3473497 - RNA, 21 nt, Pseudomonas aeruginosa PA01
ugcgccgccuuucugcccggc

SEQ ID NO: 3473498 - RNA, 21 nt, Pseudomonas aeruginosa PA01
ugcgccgcggcguugcgcgga

SEQ ID NO: 3473499 - RNA, 23 nt, Pseudomonas aeruginosa PA01
ugcgccgcggcguugcgcggaau

SEQ ID NO: 3473500 - RNA, 19 nt, Pseudomonas aeruginosa PA01
ugcgccgcgggucaccagc

SEQ ID NO: 3473501 - RNA, 20 nt, Pseudomonas aeruginosa PA01
ugcgccgcgggucaccagcg

SEQ ID NO: 3473502 - RNA, 23 nt, Pseudomonas aeruginosa PA01
ugcgccgcgggucaccagcgccg

SEQ ID NO: 3473503 - RNA, 13 nt, Pseudomonas aeruginosa PA01
ugcgccgcucgcg

SEQ ID NO: 3473504 - RNA, 16 nt, Pseudomonas aeruginosa PA01
ugcgccgcucgcgcac

SEQ ID NO: 3473505 - RNA, 22 nt, Pseudomonas aeruginosa PA01
ugcgccgcucgcgcacggcgaa

SEQ ID NO: 3473506 - RNA, 23 nt, Pseudomonas aeruginosa PA01
ugcgccggaucggcugaccggca

SEQ ID NO: 3473507 - RNA, 11 nt, Pseudomonas aeruginosa PA01
ugcgccggcac

SEQ ID NO: 3473508 - RNA, 21 nt, Pseudomonas aeruginosa PA01
ugcgccggcaucgccauggcg

SEQ ID NO: 3473509 - RNA, 14 nt, Pseudomonas aeruginosa PA01
ugcgccggcccagc

SEQ ID NO: 3473510 - RNA, 15 nt, Pseudomonas aeruginosa PA01
ugcgccggcccagca

SEQ ID NO: 3473511 - RNA, 17 nt, Pseudomonas aeruginosa PA01
ugcgccggcccagcagg

SEQ ID NO: 3473512 - RNA, 14 nt, Pseudomonas aeruginosa PA01
ugcgccggcgcugc

SEQ ID NO: 3473513 - RNA, 15 nt, Pseudomonas aeruginosa PA01
ugcgccggcgcugcg

SEQ ID NO: 3473514 - RNA, 19 nt, Pseudomonas aeruginosa PA01
ugcgccggcggccggcgca

SEQ ID NO: 3473515 - RNA, 12 nt, Pseudomonas aeruginosa PA01
ugcgccgggccu

SEQ ID NO: 3473516 - RNA, 17 nt, Pseudomonas aeruginosa PA01
ugcgccggggaucaggu

SEQ ID NO: 3473517 - RNA, 14 nt, Pseudomonas aeruginosa PA01
ugcgccgggugccg

SEQ ID NO: 3473518 - RNA, 17 nt, Pseudomonas aeruginosa PA01
ugcgccgggugccggug

SEQ ID NO: 3473519 - RNA, 17 nt, Pseudomonas aeruginosa PA01
ugcgccgguccuugucc

SEQ ID NO: 3473520 - RNA, 20 nt, Pseudomonas aeruginosa PA01
ugcgccgguccuuguccggg

SEQ ID NO: 3473521 - RNA, 12 nt, Pseudomonas aeruginosa PA01
ugcgccguggca

SEQ ID NO: 3473522 - RNA, 17 nt, Pseudomonas aeruginosa PA01
ugcgccguggcaccagg

SEQ ID NO: 3473523 - RNA, 18 nt, Pseudomonas aeruginosa PA01
ugcgccguggcaccaggu

SEQ ID NO: 3473524 - RNA, 22 nt, Pseudomonas aeruginosa PA01
ugcgccucacggucgcaggggc

SEQ ID NO: 3473525 - RNA, 14 nt, Pseudomonas aeruginosa PA01
ugcgccuccgggcg

SEQ ID NO: 3473526 - RNA, 16 nt, Pseudomonas aeruginosa PA01
ugcgccucgaccuggc

SEQ ID NO: 3473527 - RNA, 21 nt, Pseudomonas aeruginosa PA01
ugcgccucgaccuggccacgc

SEQ ID NO: 3473528 - RNA, 15 nt, Pseudomonas aeruginosa PA01
ugcgccucgccgccc

SEQ ID NO: 3473529 - RNA, 22 nt, Pseudomonas aeruginosa PA01
ugcgccucgcuggcguucucca

SEQ ID NO: 3473530 - RNA, 23 nt, Pseudomonas aeruginosa PA01
ugcgccucgcuggcguucuccag

SEQ ID NO: 3473531 - RNA, 20 nt, Pseudomonas aeruginosa PA01
ugcgccugcuucagcccggc

SEQ ID NO: 3473532 - RNA, 21 nt, Pseudomonas aeruginosa PA01
ugcgccugcuucagcccggca

SEQ ID NO: 3473533 - RNA, 12 nt, Pseudomonas aeruginosa PA01
ugcgccuggccg

SEQ ID NO: 3473534 - RNA, 14 nt, Pseudomonas aeruginosa PA01
ugcgccuggccgcg

SEQ ID NO: 3473535 - RNA, 15 nt, Pseudomonas aeruginosa PA01
ugcgccuggccgcgc

SEQ ID NO: 3473536 - RNA, 15 nt, Pseudomonas aeruginosa PA01
ugcgcgaagccagga

SEQ ID NO: 3473537 - RNA, 19 nt, Pseudomonas aeruginosa PA01
ugcgcgaauaccgcgcgcg

SEQ ID NO: 3473538 - RNA, 20 nt, Pseudomonas aeruginosa PA01
ugcgcgaaugguucaucuuc

SEQ ID NO: 3473539 - RNA, 13 nt, Pseudomonas aeruginosa PA01
ugcgcgagcaccg

SEQ ID NO: 3473540 - RNA, 21 nt, Pseudomonas aeruginosa PA01
ugcgcgagcaccgcgcagacc

SEQ ID NO: 3473541 - RNA, 22 nt, Pseudomonas aeruginosa PA01
ugcgcgagcgauccgcugcaug

SEQ ID NO: 3473542 - RNA, 14 nt, Pseudomonas aeruginosa PA01
ugcgcgaggagccg

SEQ ID NO: 3473543 - RNA, 20 nt, Pseudomonas aeruginosa PA01
ugcgcgaggggcggagcagc

SEQ ID NO: 3473544 - RNA, 16 nt, Pseudomonas aeruginosa PA01
ugcgcgaguggaugaa

SEQ ID NO: 3473545 - RNA, 13 nt, Pseudomonas aeruginosa PA01
ugcgcgcaccagg

SEQ ID NO: 3473546 - RNA, 14 nt, Pseudomonas aeruginosa PA01
ugcgcgcaccaggc

SEQ ID NO: 3473547 - RNA, 22 nt, Pseudomonas aeruginosa PA01
ugcgcgcaccauagcgagccgc

SEQ ID NO: 3473548 - RNA, 19 nt, Pseudomonas aeruginosa PA01
ugcgcgcaguaggcgcugc

SEQ ID NO: 3473549 - RNA, 19 nt, Pseudomonas aeruginosa PA01
ugcgcgcaguucagggcgu

SEQ ID NO: 3473550 - RNA, 18 nt, Pseudomonas aeruginosa PA01
ugcgcgcauagcaggccu

SEQ ID NO: 3473551 - RNA, 13 nt, Pseudomonas aeruginosa PA01
ugcgcgccaccac

SEQ ID NO: 3473552 - RNA, 23 nt, Pseudomonas aeruginosa PA01
ugcgcgccaccaccgucacggcg

SEQ ID NO: 3473553 - RNA, 14 nt, Pseudomonas aeruginosa PA01
ugcgcgccaccagc

SEQ ID NO: 3473554 - RNA, 13 nt, Pseudomonas aeruginosa PA01
ugcgcgccagcgc

SEQ ID NO: 3473555 - RNA, 14 nt, Pseudomonas aeruginosa PA01
ugcgcgccagcgcc

SEQ ID NO: 3473556 - RNA, 18 nt, Pseudomonas aeruginosa PA01
ugcgcgccagcgccacgg

SEQ ID NO: 3473557 - RNA, 20 nt, Pseudomonas aeruginosa PA01
ugcgcgccagcgccacggcg

SEQ ID NO: 3473558 - RNA, 22 nt, Pseudomonas aeruginosa PA01
ugcgcgccagcgccacggcgau

SEQ ID NO: 3473559 - RNA, 18 nt, Pseudomonas aeruginosa PA01
ugcgcgccaucuccucgc

SEQ ID NO: 3473560 - RNA, 20 nt, Pseudomonas aeruginosa PA01
ugcgcgccauuccgcggcac

SEQ ID NO: 3473561 - RNA, 24 nt, Pseudomonas aeruginosa PA01
ugcgcgccauuccgcggcacuccg

SEQ ID NO: 3473562 - RNA, 13 nt, Pseudomonas aeruginosa PA01
ugcgcgccgccgg

SEQ ID NO: 3473563 - RNA, 14 nt, Pseudomonas aeruginosa PA01
ugcgcgccgccggg

SEQ ID NO: 3473564 - RNA, 16 nt, Pseudomonas aeruginosa PA01
ugcgcgccgccgggcg

SEQ ID NO: 3473565 - RNA, 20 nt, Pseudomonas aeruginosa PA01
ugcgcgccgccgggcgcccg

SEQ ID NO: 3473566 - RNA, 22 nt, Pseudomonas aeruginosa PA01
ugcgcgccgccgggcgcccggc

SEQ ID NO: 3473567 - RNA, 13 nt, Pseudomonas aeruginosa PA01
ugcgcgccggguc

SEQ ID NO: 3473568 - RNA, 14 nt, Pseudomonas aeruginosa PA01
ugcgcgccucuucc

SEQ ID NO: 3473569 - RNA, 21 nt, Pseudomonas aeruginosa PA01
ugcgcgcgcagauaaggcgug

SEQ ID NO: 3473570 - RNA, 13 nt, Pseudomonas aeruginosa PA01
ugcgcgcggccca

SEQ ID NO: 3473571 - RNA, 16 nt, Pseudomonas aeruginosa PA01
ugcgcgcggcccacca

SEQ ID NO: 3473572 - RNA, 18 nt, Pseudomonas aeruginosa PA01
ugcgcgcggcccaccaga

SEQ ID NO: 3473573 - RNA, 14 nt, Pseudomonas aeruginosa PA01
ugcgcgcggccugu

SEQ ID NO: 3473574 - RNA, 20 nt, Pseudomonas aeruginosa PA01
ugcgcgcggcgagggcgccg

SEQ ID NO: 3473575 - RNA, 21 nt, Pseudomonas aeruginosa PA01
ugcgcgcggcgucgaccacgg

SEQ ID NO: 3473576 - RNA, 22 nt, Pseudomonas aeruginosa PA01
ugcgcgcggcgucgaccacggc

SEQ ID NO: 3473577 - RNA, 23 nt, Pseudomonas aeruginosa PA01
ugcgcgcggcgucgaccacggcc

SEQ ID NO: 3473578 - RNA, 14 nt, Pseudomonas aeruginosa PA01
ugcgcggcagcagg

SEQ ID NO: 3473579 - RNA, 15 nt, Pseudomonas aeruginosa PA01
ugcggccccggcgcu

SEQ ID NO: 3473580 - RNA, 18 nt, Pseudomonas aeruginosa PA01
ugcggccccggcgcucgc

SEQ ID NO: 3473581 - RNA, 17 nt, Pseudomonas aeruginosa PA01
ugcggcccgagggcggc

SEQ ID NO: 3473582 - RNA, 18 nt, Pseudomonas aeruginosa PA01
ugcggcccgagggcggca

SEQ ID NO: 3473583 - RNA, 12 nt, Pseudomonas aeruginosa PA01
ugcggcccgcca

SEQ ID NO: 3473584 - RNA, 19 nt, Pseudomonas aeruginosa PA01
ugcggcccgccacagaucg

SEQ ID NO: 3473585 - RNA, 12 nt, Pseudomonas aeruginosa PA01
ugcggcccgccg

SEQ ID NO: 3473586 - RNA, 13 nt, Pseudomonas aeruginosa PA01
ugcggcccgccuc

SEQ ID NO: 3473587 - RNA, 15 nt, Pseudomonas aeruginosa PA01
ugcggcccgccucgg

SEQ ID NO: 3473588 - RNA, 19 nt, Pseudomonas aeruginosa PA01
ugcggcccuuguucgcggc

SEQ ID NO: 3473589 - RNA, 22 nt, Pseudomonas aeruginosa PA01
ugcggcccuuguucgcggcgau

SEQ ID NO: 3473590 - RNA, 19 nt, Pseudomonas aeruginosa PA01
ugcggccgaucaucggcug

SEQ ID NO: 3473591 - RNA, 12 nt, Pseudomonas aeruginosa PA01
ugcggccgaugc

SEQ ID NO: 3473592 - RNA, 22 nt, Pseudomonas aeruginosa PA01
ugcggccgcaaccagcccuggc

SEQ ID NO: 3473593 - RNA, 18 nt, Pseudomonas aeruginosa PA01
ugcggccguucgcccuuc

SEQ ID NO: 3473594 - RNA, 20 nt, Pseudomonas aeruginosa PA01
ugcggccguucuccgggucg

SEQ ID NO: 3473595 - RNA, 14 nt, Pseudomonas aeruginosa PA01
ugcggccugcaaca

SEQ ID NO: 3473596 - RNA, 21 nt, Pseudomonas aeruginosa PA01
ugcggccugcaacgccgccaa

SEQ ID NO: 3473597 - RNA, 21 nt, Pseudomonas aeruginosa PA01
ugcggcgauggcguccaccgc

SEQ ID NO: 3473598 - RNA, 22 nt, Pseudomonas aeruginosa PA01
ugcggcgauggcguccaccgcu

SEQ ID NO: 3473599 - RNA, 17 nt, Pseudomonas aeruginosa PA01
ugcggcgaugucggccu

SEQ ID NO: 3473600 - RNA, 16 nt, Pseudomonas aeruginosa PA01
ugcggcgcaggcggau

SEQ ID NO: 3473601 - RNA, 12 nt, Pseudomonas aeruginosa PA01
ugcggcgcccgc

SEQ ID NO: 3473602 - RNA, 13 nt, Pseudomonas aeruginosa PA01
ugcggcgcccgcc

SEQ ID NO: 3473603 - RNA, 15 nt, Pseudomonas aeruginosa PA01
ugcggcgcccgccaa

SEQ ID NO: 3473604 - RNA, 15 nt, Pseudomonas aeruginosa PA01
ugcggcgccgaggcc

SEQ ID NO: 3473605 - RNA, 17 nt, Pseudomonas aeruginosa PA01
ugcggcgccgaggcccu

SEQ ID NO: 3473606 - RNA, 12 nt, Pseudomonas aeruginosa PA01
ugcggcgccggu

SEQ ID NO: 3473607 - RNA, 21 nt, Pseudomonas aeruginosa PA01
ugcggcgccgguugcugcugc

SEQ ID NO: 3473608 - RNA, 10 nt, Pseudomonas aeruginosa PA01
ugcggcgccu

SEQ ID NO: 3473609 - RNA, 22 nt, Pseudomonas aeruginosa PA01
ugcggcgccuagacccugggcc

SEQ ID NO: 3473610 - RNA, 13 nt, Pseudomonas aeruginosa PA01
ugcggcgcggccc

SEQ ID NO: 3473611 - RNA, 20 nt, Pseudomonas aeruginosa PA01
ugcggcgcggcccguccgcg

SEQ ID NO: 3473612 - RNA, 15 nt, Pseudomonas aeruginosa PA01
ugcggcgcucgggau

SEQ ID NO: 3473613 - RNA, 15 nt, Pseudomonas aeruginosa PA01
ugcggcgcugccaca

SEQ ID NO: 3473614 - RNA, 22 nt, Pseudomonas aeruginosa PA01
ugcggcggaacuugucgccgcu

SEQ ID NO: 3473615 - RNA, 14 nt, Pseudomonas aeruginosa PA01
ugcggcggaaggcg

SEQ ID NO: 3473616 - RNA, 22 nt, Pseudomonas aeruginosa PA01
ugcggcggcaccacgugcagca

SEQ ID NO: 3473617 - RNA, 22 nt, Pseudomonas aeruginosa PA01
ugcggcggcaggucggacaggc

SEQ ID NO: 3473618 - RNA, 18 nt, Pseudomonas aeruginosa PA01
ugcggcgggucacgccga

SEQ ID NO: 3473619 - RNA, 17 nt, Pseudomonas aeruginosa PA01
ugcggcggucccagacc

SEQ ID NO: 3473620 - RNA, 20 nt, Pseudomonas aeruginosa PA01
ugcggcggucccagaccagc

SEQ ID NO: 3473621 - RNA, 15 nt, Pseudomonas aeruginosa PA01
ugcggcguucgccgc

SEQ ID NO: 3473622 - RNA, 19 nt, Pseudomonas aeruginosa PA01
ugcggcguucgccgcgggc

SEQ ID NO: 3473623 - RNA, 19 nt, Pseudomonas aeruginosa PA01
ugcggcugcagggccaggg

SEQ ID NO: 3473624 - RNA, 15 nt, Pseudomonas aeruginosa PA01
ugcggcugccggugc

SEQ ID NO: 3473625 - RNA, 12 nt, Pseudomonas aeruginosa PA01
ugcggcugcuca

SEQ ID NO: 3473626 - RNA, 13 nt, Pseudomonas aeruginosa PA01
ugcggcuugccca

SEQ ID NO: 3473627 - RNA, 23 nt, Pseudomonas aeruginosa PA01
ugcggcuugcccugcucgucgcu

SEQ ID NO: 3473628 - RNA, 21 nt, Pseudomonas aeruginosa PA01
ugcggcuugcguucgcuccag

SEQ ID NO: 3473629 - RNA, 21 nt, Pseudomonas aeruginosa PA01
ugcggcuuucgguuugcgccg

SEQ ID NO: 3473630 - RNA, 17 nt, Pseudomonas aeruginosa PA01
ugcgggaacgaugccgc

SEQ ID NO: 3473631 - RNA, 23 nt, Pseudomonas aeruginosa PA01
ugcgggaacgaugccgcaggcau

SEQ ID NO: 3473632 - RNA, 20 nt, Pseudomonas aeruginosa PA01
ugcgggacccagacaggccu

SEQ ID NO: 3473633 - RNA, 13 nt, Pseudomonas aeruginosa PA01
ugcgggaugcccg

SEQ ID NO: 3473634 - RNA, 19 nt, Pseudomonas aeruginosa PA01
ugcgggcagacaccaccag

SEQ ID NO: 3473635 - RNA, 16 nt, Pseudomonas aeruginosa PA01
ugcgggcaggucgaug

SEQ ID NO: 3473636 - RNA, 12 nt, Pseudomonas aeruginosa PA01
ugcgggcgcagg

SEQ ID NO: 3473637 - RNA, 13 nt, Pseudomonas aeruginosa PA01
ugcgggcgcaggu

SEQ ID NO: 3473638 - RNA, 14 nt, Pseudomonas aeruginosa PA01
ugcgggcgcgccug

SEQ ID NO: 3473639 - RNA, 15 nt, Pseudomonas aeruginosa PA01
ugcgggcgcgccuga

SEQ ID NO: 3473640 - RNA, 22 nt, Pseudomonas aeruginosa PA01
ugcgggcggguaaagcgcccgc

SEQ ID NO: 3473641 - RNA, 14 nt, Pseudomonas aeruginosa PA01
ugcgggcgggugcg

SEQ ID NO: 3473642 - RNA, 21 nt, Pseudomonas aeruginosa PA01
ugcgggcugcgugccagcacc

SEQ ID NO: 3473643 - RNA, 12 nt, Pseudomonas aeruginosa PA01
ugcggggccgga

SEQ ID NO: 3473644 - RNA, 13 nt, Pseudomonas aeruginosa PA01
ugcggggcgacca

SEQ ID NO: 3473645 - RNA, 15 nt, Pseudomonas aeruginosa PA01
ugcggggcgaccagc

SEQ ID NO: 3473646 - RNA, 13 nt, Pseudomonas aeruginosa PA01
ugcggggcgcuca

SEQ ID NO: 3473647 - RNA, 20 nt, Pseudomonas aeruginosa PA01
ugcggggcgcucgcccuugc

SEQ ID NO: 3473648 - RNA, 14 nt, Pseudomonas aeruginosa PA01
ugcggggcggcgca

SEQ ID NO: 3473649 - RNA, 18 nt, Pseudomonas aeruginosa PA01
ugcggggugcgcuggaac

SEQ ID NO: 3473650 - RNA, 19 nt, Pseudomonas aeruginosa PA01
ugcgggguucgacgcgcca

SEQ ID NO: 3473651 - RNA, 13 nt, Pseudomonas aeruginosa PA01
ugcgggucgaggc

SEQ ID NO: 3473652 - RNA, 14 nt, Pseudomonas aeruginosa PA01
ugcgggugcgcagg

SEQ ID NO: 3473653 - RNA, 18 nt, Pseudomonas aeruginosa PA01
ugcgggugcgcaggcugc

SEQ ID NO: 3473654 - RNA, 16 nt, Pseudomonas aeruginosa PA01
ugcggguggucgccgc

SEQ ID NO: 3473655 - RNA, 19 nt, Pseudomonas aeruginosa PA01
ugcggguggucgccgccca

SEQ ID NO: 3473656 - RNA, 20 nt, Pseudomonas aeruginosa PA01
ugcggguggucuugcgcagg

SEQ ID NO: 3473657 - RNA, 18 nt, Pseudomonas aeruginosa PA01
ugcggguucagucggcca

SEQ ID NO: 3473658 - RNA, 21 nt, Pseudomonas aeruginosa PA01
ugcggguucagucggccaggc

SEQ ID NO: 3473659 - RNA, 21 nt, Pseudomonas aeruginosa PA01
ugcggguuggucggcaccagg

SEQ ID NO: 3473660 - RNA, 15 nt, Pseudomonas aeruginosa PA01
ugcgguaccagcgca

SEQ ID NO: 3473661 - RNA, 22 nt, Pseudomonas aeruginosa PA01
ugcgguaccagcgcaccagggu

SEQ ID NO: 3473662 - RNA, 14 nt, Pseudomonas aeruginosa PA01
ugcgguagcgcucg

SEQ ID NO: 3473663 - RNA, 14 nt, Pseudomonas aeruginosa PA01
ugcgguaggugaug

SEQ ID NO: 3473664 - RNA, 14 nt, Pseudomonas aeruginosa PA01
ugcgguauagcuca

SEQ ID NO: 3473665 - RNA, 18 nt, Pseudomonas aeruginosa PA01
ugcggucauccgccggcg

SEQ ID NO: 3473666 - RNA, 19 nt, Pseudomonas aeruginosa PA01
ugcggucauccgccggcgc

SEQ ID NO: 3473667 - RNA, 14 nt, Pseudomonas aeruginosa PA01
ugcgguccggcgaa

SEQ ID NO: 3473668 - RNA, 14 nt, Pseudomonas aeruginosa PA01
ugcggucgcgcccg

SEQ ID NO: 3473669 - RNA, 15 nt, Pseudomonas aeruginosa PA01
ugcggucgggugaag

SEQ ID NO: 3473670 - RNA, 13 nt, Pseudomonas aeruginosa PA01
ugcggugcggcca

SEQ ID NO: 3473671 - RNA, 21 nt, Pseudomonas aeruginosa PA01
ugcggugggcgagggcgcgca

SEQ ID NO: 3473672 - RNA, 14 nt, Pseudomonas aeruginosa PA01
ugcgguggugucug

SEQ ID NO: 3473673 - RNA, 15 nt, Pseudomonas aeruginosa PA01
ugcggugucccuucu

SEQ ID NO: 3473674 - RNA, 18 nt, Pseudomonas aeruginosa PA01
ugcgguuauccgccgucg

SEQ ID NO: 3473675 - RNA, 20 nt, Pseudomonas aeruginosa PA01
ugcgguuauccgccguggaa

SEQ ID NO: 3473676 - RNA, 16 nt, Pseudomonas aeruginosa PA01
ugcgguuauucgcccu

SEQ ID NO: 3473677 - RNA, 15 nt, Pseudomonas aeruginosa PA01
ugcgguuccuggcug

SEQ ID NO: 3473678 - RNA, 18 nt, Pseudomonas aeruginosa PA01
ugcgguuccuggcuggag

SEQ ID NO: 3473679 - RNA, 20 nt, Pseudomonas aeruginosa PA01
ugcgguugaaacugcgcagg

SEQ ID NO: 3473680 - RNA, 23 nt, Pseudomonas aeruginosa PA01
ugcgguuguugaugcccaccaac

SEQ ID NO: 3473681 - RNA, 18 nt, Pseudomonas aeruginosa PA01
ugcguaccagcgcgcagc

SEQ ID NO: 3473682 - RNA, 22 nt, Pseudomonas aeruginosa PA01
ugcucgcgcaugaucgccucgg

SEQ ID NO: 3473683 - RNA, 13 nt, Pseudomonas aeruginosa PA01
ugcucgcgccagc

SEQ ID NO: 3473684 - RNA, 14 nt, Pseudomonas aeruginosa PA01
ugcucgcgccagcc

SEQ ID NO: 3473685 - RNA, 18 nt, Pseudomonas aeruginosa PA01
ugcucgcgccagccccag

SEQ ID NO: 3473686 - RNA, 19 nt, Pseudomonas aeruginosa PA01
ugcucgcgccagccccagg

SEQ ID NO: 3473687 - RNA, 14 nt, Pseudomonas aeruginosa PA01
ugcucgcgcuucuc

SEQ ID NO: 3473688 - RNA, 12 nt, Pseudomonas aeruginosa PA01
ugcucgcggcgu

SEQ ID NO: 3473689 - RNA, 16 nt, Pseudomonas aeruginosa PA01
ugcucgcggcuggccg

SEQ ID NO: 3473690 - RNA, 19 nt, Pseudomonas aeruginosa PA01
ugcucgcgggucaccaccg

SEQ ID NO: 3473691 - RNA, 20 nt, Pseudomonas aeruginosa PA01
ugcucgcgggucaccaccgg

SEQ ID NO: 3473692 - RNA, 14 nt, Pseudomonas aeruginosa PA01
ugcucggccagcgc

SEQ ID NO: 3473693 - RNA, 19 nt, Pseudomonas aeruginosa PA01
ugcucggccagcgccacgg

SEQ ID NO: 3473694 - RNA, 22 nt, Pseudomonas aeruginosa PA01
ugcucggccagguauucgcgcu

SEQ ID NO: 3473695 - RNA, 22 nt, Pseudomonas aeruginosa PA01
ugcucggccugcugcgccggca

SEQ ID NO: 3473696 - RNA, 18 nt, Pseudomonas aeruginosa PA01
ugcucggccuuguccgcg

SEQ ID NO: 3473697 - RNA, 21 nt, Pseudomonas aeruginosa PA01
ugcucggcgaucucgcccagg

SEQ ID NO: 3473698 - RNA, 17 nt, Pseudomonas aeruginosa PA01
ugcucggcgcccugggu

SEQ ID NO: 3473699 - RNA, 19 nt, Pseudomonas aeruginosa PA01
ugcucggcgcccugggugg

SEQ ID NO: 3473700 - RNA, 20 nt, Pseudomonas aeruginosa PA01
ugcucgggcgucuccugccg

SEQ ID NO: 3473701 - RNA, 18 nt, Pseudomonas aeruginosa PA01
ugcucgggcugccgcaga

SEQ ID NO: 3473702 - RNA, 19 nt, Pseudomonas aeruginosa PA01
ugcucggggaacacgcgcu

SEQ ID NO: 3473703 - RNA, 21 nt, Pseudomonas aeruginosa PA01
ugcucggggaacacgcgcugg

SEQ ID NO: 3473704 - RNA, 21 nt, Pseudomonas aeruginosa PA01
ugcucggggucgucgcuggcg

SEQ ID NO: 3473705 - RNA, 15 nt, Pseudomonas aeruginosa PA01
ugcucguccaggccg

SEQ ID NO: 3473706 - RNA, 16 nt, Pseudomonas aeruginosa PA01
ugcucguccaggccgc

SEQ ID NO: 3473707 - RNA, 16 nt, Pseudomonas aeruginosa PA01
ugcucucgcgcacgcu

SEQ ID NO: 3473708 - RNA, 19 nt, Pseudomonas aeruginosa PA01
ugcucugguucggcgucuu

SEQ ID NO: 3473709 - RNA, 16 nt, Pseudomonas aeruginosa PA01
ugcucuucggcggcca

SEQ ID NO: 3473710 - RNA, 19 nt, Pseudomonas aeruginosa PA01
ugcucuuggucaucaccuu

SEQ ID NO: 3473711 - RNA, 12 nt, Pseudomonas aeruginosa PA01
ugcucuuuuccc

SEQ ID NO: 3473712 - RNA, 18 nt, Pseudomonas aeruginosa PA01
ugcugaaaaacgccuggg

SEQ ID NO: 3473713 - RNA, 22 nt, Pseudomonas aeruginosa PA01
ugcugaaagcgauagccggggc

SEQ ID NO: 3473714 - RNA, 16 nt, Pseudomonas aeruginosa PA01
ugcugaaccuguugcu

SEQ ID NO: 3473715 - RNA, 14 nt, Pseudomonas aeruginosa PA01
ugcugaacuguucg

SEQ ID NO: 3473716 - RNA, 15 nt, Pseudomonas aeruginosa PA01
ugcugaagcccaggc

SEQ ID NO: 3473717 - RNA, 16 nt, Pseudomonas aeruginosa PA01
ugcugacggcguggcg

SEQ ID NO: 3473718 - RNA, 19 nt, Pseudomonas aeruginosa PA01
ugcugagcagucgccuggc

SEQ ID NO: 3473719 - RNA, 22 nt, Pseudomonas aeruginosa PA01
ugcugaguuucacgucgagcac

SEQ ID NO: 3473720 - RNA, 23 nt, Pseudomonas aeruginosa PA01
ugcugaguuucacgucgagcacg

SEQ ID NO: 3473721 - RNA, 15 nt, Pseudomonas aeruginosa PA01
ugcugaucagguugc

SEQ ID NO: 3473722 - RNA, 15 nt, Pseudomonas aeruginosa PA01
ugcugcaacauggcg

SEQ ID NO: 3473723 - RNA, 22 nt, Pseudomonas aeruginosa PA01
ugcugcaaccgauauggcuggc

SEQ ID NO: 3473724 - RNA, 13 nt, Pseudomonas aeruginosa PA01
ugcugcaccagca

SEQ ID NO: 3473725 - RNA, 14 nt, Pseudomonas aeruginosa PA01
ugcugcaccagcag

SEQ ID NO: 3473726 - RNA, 15 nt, Pseudomonas aeruginosa PA01
ugcugcaccagcagg

SEQ ID NO: 3473727 - RNA, 22 nt, Pseudomonas aeruginosa PA01
ugcugcaccagcaggucgaggu

SEQ ID NO: 3473728 - RNA, 18 nt, Pseudomonas aeruginosa PA01
ugcugcacggagugggcc

SEQ ID NO: 3473729 - RNA, 20 nt, Pseudomonas aeruginosa PA01
ugcugcacggagugggccgc

SEQ ID NO: 3473730 - RNA, 15 nt, Pseudomonas aeruginosa PA01
ugcugcaggccgaga

SEQ ID NO: 3473731 - RNA, 18 nt, Pseudomonas aeruginosa PA01
ugcugccauccgcgccga

SEQ ID NO: 3473732 - RNA, 20 nt, Pseudomonas aeruginosa PA01
ugcugccauccgcgccgacc

SEQ ID NO: 3473733 - RNA, 15 nt, Pseudomonas aeruginosa PA01
ugcugccauggcggc

SEQ ID NO: 3473734 - RNA, 18 nt, Pseudomonas aeruginosa PA01
ugcugccauggcggcgga

SEQ ID NO: 3473735 - RNA, 12 nt, Pseudomonas aeruginosa PA01
ugcugcccagua

SEQ ID NO: 3473736 - RNA, 13 nt, Pseudomonas aeruginosa PA01
ugcugcccuggcg

SEQ ID NO: 3473737 - RNA, 19 nt, Pseudomonas aeruginosa PA01
ugcugcccuggcgcgcgcc

SEQ ID NO: 3473738 - RNA, 15 nt, Pseudomonas aeruginosa PA01
ugcugccgaggccga

SEQ ID NO: 3473739 - RNA, 23 nt, Pseudomonas aeruginosa PA01
ugcugccgaugcugaucacccgc

SEQ ID NO: 3473740 - RNA, 15 nt, Pseudomonas aeruginosa PA01
ugcugccggcguccu

SEQ ID NO: 3473741 - RNA, 17 nt, Pseudomonas aeruginosa PA01
ugcugccggcguccuug

SEQ ID NO: 3473742 - RNA, 13 nt, Pseudomonas aeruginosa PA01
ugcugcgccggca

SEQ ID NO: 3473743 - RNA, 19 nt, Pseudomonas aeruginosa PA01
ugcugcgccggcacggcau

SEQ ID NO: 3473744 - RNA, 15 nt, Pseudomonas aeruginosa PA01
ugcugcgccuggccg

SEQ ID NO: 3473745 - RNA, 14 nt, Pseudomonas aeruginosa PA01
ugcugcgcgccgca

SEQ ID NO: 3473746 - RNA, 17 nt, Pseudomonas aeruginosa PA01
ugcugcgcgggugucgc

SEQ ID NO: 3473747 - RNA, 17 nt, Pseudomonas aeruginosa PA01
ugcugcgggcgccgccg

SEQ ID NO: 3473748 - RNA, 13 nt, Pseudomonas aeruginosa PA01
ugcugcucgccau

SEQ ID NO: 3473749 - RNA, 17 nt, Pseudomonas aeruginosa PA01
ugcugcucgccaugggc

SEQ ID NO: 3473750 - RNA, 13 nt, Pseudomonas aeruginosa PA01
ugcugcucggcau

SEQ ID NO: 3473751 - RNA, 22 nt, Pseudomonas aeruginosa PA01
ugcugcucggcauucgacccgc

SEQ ID NO: 3473752 - RNA, 16 nt, Pseudomonas aeruginosa PA01
ugcugcugaucaggag

SEQ ID NO: 3473753 - RNA, 16 nt, Pseudomonas aeruginosa PA01
ugcugcugcggggccg

SEQ ID NO: 3473754 - RNA, 14 nt, Pseudomonas aeruginosa PA01
ugcugcugcucagc

SEQ ID NO: 3473755 - RNA, 18 nt, Pseudomonas aeruginosa PA01
ugcugcugcucagcgcgc

SEQ ID NO: 3473756 - RNA, 13 nt, Pseudomonas aeruginosa PA01
ugcugcuggguga

SEQ ID NO: 3473757 - RNA, 14 nt, Pseudomonas aeruginosa PA01
ugcugcuugcgccg

SEQ ID NO: 3473758 - RNA, 14 nt, Pseudomonas aeruginosa PA01
ugcugcuugcgcgc

SEQ ID NO: 3473759 - RNA, 21 nt, Pseudomonas aeruginosa PA01
ugcuggacaagguuugcgccg

SEQ ID NO: 3473760 - RNA, 14 nt, Pseudomonas aeruginosa PA01
ugcuggacggcgga

SEQ ID NO: 3473761 - RNA, 15 nt, Pseudomonas aeruginosa PA01
ugcuggacggcggac

SEQ ID NO: 3473762 - RNA, 24 nt, Pseudomonas aeruginosa PA01
ugcuggacggcggacugcucgccg

SEQ ID NO: 3473763 - RNA, 15 nt, Pseudomonas aeruginosa PA01
ugcuggacucgcgcc

SEQ ID NO: 3473764 - RNA, 15 nt, Pseudomonas aeruginosa PA01
ugcuggagcuugccg

SEQ ID NO: 3473765 - RNA, 15 nt, Pseudomonas aeruginosa PA01
ugcuggauccucgcc

SEQ ID NO: 3473766 - RNA, 24 nt, Pseudomonas aeruginosa PA01
ugcuggauccucgccucgcgccag

SEQ ID NO: 3473767 - RNA, 15 nt, Pseudomonas aeruginosa PA01
ugcuggaugucggcg

SEQ ID NO: 3473768 - RNA, 20 nt, Pseudomonas aeruginosa PA01
ugcuggcaacggcgggccgc

SEQ ID NO: 3473769 - RNA, 18 nt, Pseudomonas aeruginosa PA01
ugcuggcacagguccagc

SEQ ID NO: 3473770 - RNA, 19 nt, Pseudomonas aeruginosa PA01
ugcuggcacagguccagca

SEQ ID NO: 3473771 - RNA, 14 nt, Pseudomonas aeruginosa PA01
ugcuggccacccuu

SEQ ID NO: 3473772 - RNA, 19 nt, Pseudomonas aeruginosa PA01
ugcuggccacccuugcgcc

SEQ ID NO: 3473773 - RNA, 22 nt, Pseudomonas aeruginosa PA01
ugcuggccacccuugcgcccgg

SEQ ID NO: 3473774 - RNA, 23 nt, Pseudomonas aeruginosa PA01
ugcuggccacccuugcgcccggc

SEQ ID NO: 3473775 - RNA, 14 nt, Pseudomonas aeruginosa PA01
ugcuggccaccgcg

SEQ ID NO: 3473776 - RNA, 16 nt, Pseudomonas aeruginosa PA01
ugcuggccaccgcggc

SEQ ID NO: 3473777 - RNA, 18 nt, Pseudomonas aeruginosa PA01
ugcuggccaccgcggcgu

SEQ ID NO: 3473778 - RNA, 12 nt, Pseudomonas aeruginosa PA01
ugcuggccgcgc

SEQ ID NO: 3473779 - RNA, 17 nt, Pseudomonas aeruginosa PA01
ugcuggccgcgcaggaa

SEQ ID NO: 3473780 - RNA, 20 nt, Pseudomonas aeruginosa PA01
ugcuggccgcgcaggaagaa

SEQ ID NO: 3473781 - RNA, 15 nt, Pseudomonas aeruginosa PA01
ugcuggccggcagca

SEQ ID NO: 3473782 - RNA, 16 nt, Pseudomonas aeruginosa PA01
ugcuggccggcagcag

SEQ ID NO: 3473783 - RNA, 17 nt, Pseudomonas aeruginosa PA01
ugcuggccggcagcagc

SEQ ID NO: 3473784 - RNA, 14 nt, Pseudomonas aeruginosa PA01
ugcuggccggugcc

SEQ ID NO: 3473785 - RNA, 17 nt, Pseudomonas aeruginosa PA01
uggaagccgcgcucgcg

SEQ ID NO: 3473786 - RNA, 23 nt, Pseudomonas aeruginosa PA01
uggaagccguggcgggccaugcg

SEQ ID NO: 3473787 - RNA, 21 nt, Pseudomonas aeruginosa PA01
uggaaggaucgagccagcgcu

SEQ ID NO: 3473788 - RNA, 13 nt, Pseudomonas aeruginosa PA01
uggaaggccacua

SEQ ID NO: 3473789 - RNA, 13 nt, Pseudomonas aeruginosa PA01
uggaaggccgcgc

SEQ ID NO: 3473790 - RNA, 14 nt, Pseudomonas aeruginosa PA01
uggaagucgcccug

SEQ ID NO: 3473791 - RNA, 15 nt, Pseudomonas aeruginosa PA01
uggaagucgcccugc

SEQ ID NO: 3473792 - RNA, 19 nt, Pseudomonas aeruginosa PA01
uggaagucgcccugcccgg

SEQ ID NO: 3473793 - RNA, 20 nt, Pseudomonas aeruginosa PA01
uggaaguucacauuggcuuc

SEQ ID NO: 3473794 - RNA, 22 nt, Pseudomonas aeruginosa PA01
uggaaguugcgcacccgcucgg

SEQ ID NO: 3473795 - RNA, 16 nt, Pseudomonas aeruginosa PA01
uggaaugccggccggg

SEQ ID NO: 3473796 - RNA, 18 nt, Pseudomonas aeruginosa PA01
uggaauguccugccgcag

SEQ ID NO: 3473797 - RNA, 11 nt, Pseudomonas aeruginosa PA01
uggacaagguu

SEQ ID NO: 3473798 - RNA, 12 nt, Pseudomonas aeruginosa PA01
uggacacccugc

SEQ ID NO: 3473799 - RNA, 17 nt, Pseudomonas aeruginosa PA01
uggacacccugcugcug

SEQ ID NO: 3473800 - RNA, 21 nt, Pseudomonas aeruginosa PA01
uggacacccugcugcugcuca

SEQ ID NO: 3473801 - RNA, 17 nt, Pseudomonas aeruginosa PA01
uggacagcuuggccagc

SEQ ID NO: 3473802 - RNA, 20 nt, Pseudomonas aeruginosa PA01
uggacagcuuggccagcagg

SEQ ID NO: 3473803 - RNA, 14 nt, Pseudomonas aeruginosa PA01
uggacaggcgcagg

SEQ ID NO: 3473804 - RNA, 17 nt, Pseudomonas aeruginosa PA01
uggacaggcgcaggggc

SEQ ID NO: 3473805 - RNA, 21 nt, Pseudomonas aeruginosa PA01
uggacaggcgcaggggcgaga

SEQ ID NO: 3473806 - RNA, 21 nt, Pseudomonas aeruginosa PA01
uggacagguccuggaacagga

SEQ ID NO: 3473807 - RNA, 15 nt, Pseudomonas aeruginosa PA01
uggacaggucgacgg

SEQ ID NO: 3473808 - RNA, 16 nt, Pseudomonas aeruginosa PA01
uggacaggucgacggc

SEQ ID NO: 3473809 - RNA, 22 nt, Pseudomonas aeruginosa PA01
uggacauacaggcgcgccuggc

SEQ ID NO: 3473810 - RNA, 19 nt, Pseudomonas aeruginosa PA01
uggaccaacagccggcggg

SEQ ID NO: 3473811 - RNA, 14 nt, Pseudomonas aeruginosa PA01
uggaccagcgccgc

SEQ ID NO: 3473812 - RNA, 15 nt, Pseudomonas aeruginosa PA01
uggaccagcgccgcc

SEQ ID NO: 3473813 - RNA, 14 nt, Pseudomonas aeruginosa PA01
uggaccaggaucac

SEQ ID NO: 3473814 - RNA, 15 nt, Pseudomonas aeruginosa PA01
uggaccaggcggccg

SEQ ID NO: 3473815 - RNA, 16 nt, Pseudomonas aeruginosa PA01
uggaccaggcggccgg

SEQ ID NO: 3473816 - RNA, 21 nt, Pseudomonas aeruginosa PA01
uggaccaguucagcgcgcucg

SEQ ID NO: 3473817 - RNA, 23 nt, Pseudomonas aeruginosa PA01
uggaccaguucagcgcgcucgcu

SEQ ID NO: 3473818 - RNA, 20 nt, Pseudomonas aeruginosa PA01
uggaccauggccggcgugcc

SEQ ID NO: 3473819 - RNA, 18 nt, Pseudomonas aeruginosa PA01
uggacccgggccuccugg

SEQ ID NO: 3473820 - RNA, 17 nt, Pseudomonas aeruginosa PA01
uggacccgugcgcccca

SEQ ID NO: 3473821 - RNA, 19 nt, Pseudomonas aeruginosa PA01
uggacccgugcgccccagc

SEQ ID NO: 3473822 - RNA, 16 nt, Pseudomonas aeruginosa PA01
uggacccguugccgac

SEQ ID NO: 3473823 - RNA, 15 nt, Pseudomonas aeruginosa PA01
uggaccgagaccgac

SEQ ID NO: 3473824 - RNA, 22 nt, Pseudomonas aeruginosa PA01
uggaccgagaccgacgcucgcg

SEQ ID NO: 3473825 - RNA, 18 nt, Pseudomonas aeruginosa PA01
uggaccggcucgucggcg

SEQ ID NO: 3473826 - RNA, 19 nt, Pseudomonas aeruginosa PA01
uggaccuccgccaggaccu

SEQ ID NO: 3473827 - RNA, 13 nt, Pseudomonas aeruginosa PA01
uggaccuggccgg

SEQ ID NO: 3473828 - RNA, 22 nt, Pseudomonas aeruginosa PA01
uggacgaaacgguagcccgcgg

SEQ ID NO: 3473829 - RNA, 18 nt, Pseudomonas aeruginosa PA01
uggacgaacgagaagccg

SEQ ID NO: 3473830 - RNA, 15 nt, Pseudomonas aeruginosa PA01
uggacgaaggccucc

SEQ ID NO: 3473831 - RNA, 17 nt, Pseudomonas aeruginosa PA01
uggacgacgcuggccug

SEQ ID NO: 3473832 - RNA, 23 nt, Pseudomonas aeruginosa PA01
uggacgcgcuuguccuccagcug

SEQ ID NO: 3473833 - RNA, 15 nt, Pseudomonas aeruginosa PA01
uggacgcggccuggg

SEQ ID NO: 3473834 - RNA, 23 nt, Pseudomonas aeruginosa PA01
uggacggcggacugcucgccgcc

SEQ ID NO: 3473835 - RNA, 22 nt, Pseudomonas aeruginosa PA01
uggacgguaucucuccaucccc

SEQ ID NO: 3473836 - RNA, 17 nt, Pseudomonas aeruginosa PA01
uggacggucucgccgcc

SEQ ID NO: 3473837 - RNA, 12 nt, Pseudomonas aeruginosa PA01
uggacgucggcg

SEQ ID NO: 3473838 - RNA, 16 nt, Pseudomonas aeruginosa PA01
uggacgugggaaauca

SEQ ID NO: 3473839 - RNA, 21 nt, Pseudomonas aeruginosa PA01
uggacgugggaaaucaccgcc

SEQ ID NO: 3473840 - RNA, 14 nt, Pseudomonas aeruginosa PA01
uggacugcgaggcg

SEQ ID NO: 3473841 - RNA, 12 nt, Pseudomonas aeruginosa PA01
uggacuucgguc

SEQ ID NO: 3473842 - RNA, 14 nt, Pseudomonas aeruginosa PA01
uggagaagaucgcc

SEQ ID NO: 3473843 - RNA, 15 nt, Pseudomonas aeruginosa PA01
uggagaagaucgccg

SEQ ID NO: 3473844 - RNA, 13 nt, Pseudomonas aeruginosa PA01
uggagaggucgcc

SEQ ID NO: 3473845 - RNA, 17 nt, Pseudomonas aeruginosa PA01
uggagaggucgccgaca

SEQ ID NO: 3473846 - RNA, 14 nt, Pseudomonas aeruginosa PA01
uggagaugcucagg

SEQ ID NO: 3473847 - RNA, 20 nt, Pseudomonas aeruginosa PA01
uggagaugcucaggcgcugc

SEQ ID NO: 3473848 - RNA, 19 nt, Pseudomonas aeruginosa PA01
uggagcagaaccgccagca

SEQ ID NO: 3473849 - RNA, 18 nt, Pseudomonas aeruginosa PA01
uggagcagcagcgccgcg

SEQ ID NO: 3473850 - RNA, 21 nt, Pseudomonas aeruginosa PA01
uggagcagggcgaugaacacc

SEQ ID NO: 3473851 - RNA, 22 nt, Pseudomonas aeruginosa PA01
uggagcagggcgaugaacaccg

SEQ ID NO: 3473852 - RNA, 22 nt, Pseudomonas aeruginosa PA01
uggagcaguuucggaucgacgc

SEQ ID NO: 3473853 - RNA, 23 nt, Pseudomonas aeruginosa PA01
uggagcaguuucggaucgacgcc

SEQ ID NO: 3473854 - RNA, 13 nt, Pseudomonas aeruginosa PA01
uggagccgcccuc

SEQ ID NO: 3473855 - RNA, 19 nt, Pseudomonas aeruginosa PA01
uggagccggugccggcggc

SEQ ID NO: 3473856 - RNA, 24 nt, Pseudomonas aeruginosa PA01
uggagcgccucgaaggccucgguc

SEQ ID NO: 3473857 - RNA, 18 nt, Pseudomonas aeruginosa PA01
uggaggaucgagccuugc

SEQ ID NO: 3473858 - RNA, 22 nt, Pseudomonas aeruginosa PA01
uggaggaucuccaacuggcggc

SEQ ID NO: 3473859 - RNA, 15 nt, Pseudomonas aeruginosa PA01
uggaggcggcgguca

SEQ ID NO: 3473860 - RNA, 14 nt, Pseudomonas aeruginosa PA01
uggaggcgggcuca

SEQ ID NO: 3473861 - RNA, 17 nt, Pseudomonas aeruginosa PA01
uggaggcgggcucacau

SEQ ID NO: 3473862 - RNA, 19 nt, Pseudomonas aeruginosa PA01
uggagguagcugcgccgcc

SEQ ID NO: 3473863 - RNA, 21 nt, Pseudomonas aeruginosa PA01
uggagguagcugcgccgccuu

SEQ ID NO: 3473864 - RNA, 16 nt, Pseudomonas aeruginosa PA01
uggaguaggggcagac

SEQ ID NO: 3473865 - RNA, 16 nt, Pseudomonas aeruginosa PA01
uggaguaucgcccugg

SEQ ID NO: 3473866 - RNA, 17 nt, Pseudomonas aeruginosa PA01
uggagucaggcgccggc

SEQ ID NO: 3473867 - RNA, 18 nt, Pseudomonas aeruginosa PA01
uggagucaggcgccggcc

SEQ ID NO: 3473868 - RNA, 20 nt, Pseudomonas aeruginosa PA01
uggagucaggcgccggccuc

SEQ ID NO: 3473869 - RNA, 16 nt, Pseudomonas aeruginosa PA01
uggaguuuccgcgagg

SEQ ID NO: 3473870 - RNA, 14 nt, Pseudomonas aeruginosa PA01
uggauaaaaaggcc

SEQ ID NO: 3473871 - RNA, 14 nt, Pseudomonas aeruginosa PA01
uggauacgcucggc

SEQ ID NO: 3473872 - RNA, 19 nt, Pseudomonas aeruginosa PA01
uggauagaguacucggcua

SEQ ID NO: 3473873 - RNA, 20 nt, Pseudomonas aeruginosa PA01
uggauagaguacucggcuac

SEQ ID NO: 3473874 - RNA, 15 nt, Pseudomonas aeruginosa PA01
uggauaucugggcca

SEQ ID NO: 3473875 - RNA, 19 nt, Pseudomonas aeruginosa PA01
uggaucaccgcggcgcuga

SEQ ID NO: 3473876 - RNA, 22 nt, Pseudomonas aeruginosa PA01
uggaucaccgcggcgcugaagg

SEQ ID NO: 3473877 - RNA, 15 nt, Pseudomonas aeruginosa PA01
uggaucagcgccucg

SEQ ID NO: 3473878 - RNA, 12 nt, Pseudomonas aeruginosa PA01
uggaucaggaag

SEQ ID NO: 3473879 - RNA, 17 nt, Pseudomonas aeruginosa PA01
uggauccgugccaggcg

SEQ ID NO: 3473880 - RNA, 17 nt, Pseudomonas aeruginosa PA01
uggauccucgccucgcg

SEQ ID NO: 3473881 - RNA, 13 nt, Pseudomonas aeruginosa PA01
uggaucgccaggc

SEQ ID NO: 3473882 - RNA, 23 nt, Pseudomonas aeruginosa PA01
uggaucgccauaggaugccgagg

SEQ ID NO: 3473883 - RNA, 13 nt, Pseudomonas aeruginosa PA01
uggaucgcccggc

SEQ ID NO: 3473884 - RNA, 17 nt, Pseudomonas aeruginosa PA01
uggaucgcccggcugca

SEQ ID NO: 3473885 - RNA, 12 nt, Pseudomonas aeruginosa PA01
uggaucgcggcg

SEQ ID NO: 3473886 - RNA, 18 nt, Pseudomonas aeruginosa PA01
uggaucggcaacuggcug

SEQ ID NO: 3473887 - RNA, 23 nt, Pseudomonas aeruginosa PA01
uggccaggaagcgggccucggcg

SEQ ID NO: 3473888 - RNA, 19 nt, Pseudomonas aeruginosa PA01
uggccaggaccaucggcac

SEQ ID NO: 3473889 - RNA, 17 nt, Pseudomonas aeruginosa PA01
uggccaggacgcuggcg

SEQ ID NO: 3473890 - RNA, 12 nt, Pseudomonas aeruginosa PA01
uggccaggcccc

SEQ ID NO: 3473891 - RNA, 16 nt, Pseudomonas aeruginosa PA01
uggccaggccccaggc

SEQ ID NO: 3473892 - RNA, 21 nt, Pseudomonas aeruginosa PA01
uggccaggccccaggccgccg

SEQ ID NO: 3473893 - RNA, 21 nt, Pseudomonas aeruginosa PA01
uggccaggcgcaccagcaggc

SEQ ID NO: 3473894 - RNA, 21 nt, Pseudomonas aeruginosa PA01
uggccaggcgcgacagcucgu

SEQ ID NO: 3473895 - RNA, 12 nt, Pseudomonas aeruginosa PA01
uggccaggcgcu

SEQ ID NO: 3473896 - RNA, 13 nt, Pseudomonas aeruginosa PA01
uggccaggcgcuc

SEQ ID NO: 3473897 - RNA, 13 nt, Pseudomonas aeruginosa PA01
uggccaggcgcuu

SEQ ID NO: 3473898 - RNA, 17 nt, Pseudomonas aeruginosa PA01
uggccagggggccuggc

SEQ ID NO: 3473899 - RNA, 22 nt, Pseudomonas aeruginosa PA01
uggccaggucgcgcagggccag

SEQ ID NO: 3473900 - RNA, 22 nt, Pseudomonas aeruginosa PA01
uggccaguuccaugucgcuggc

SEQ ID NO: 3473901 - RNA, 23 nt, Pseudomonas aeruginosa PA01
uggccaguuccaugucgcuggcc

SEQ ID NO: 3473902 - RNA, 23 nt, Pseudomonas aeruginosa PA01
uggccaguugcgcuccgguggcg

SEQ ID NO: 3473903 - RNA, 19 nt, Pseudomonas aeruginosa PA01
uggccaguuggcccuugac

SEQ ID NO: 3473904 - RNA, 15 nt, Pseudomonas aeruginosa PA01
uggccauagagccgc

SEQ ID NO: 3473905 - RNA, 17 nt, Pseudomonas aeruginosa PA01
uggccaucagcgccgcc

SEQ ID NO: 3473906 - RNA, 20 nt, Pseudomonas aeruginosa PA01
uggccaucagcgccgccucg

SEQ ID NO: 3473907 - RNA, 21 nt, Pseudomonas aeruginosa PA01
uggccaucagcgccgccucgc

SEQ ID NO: 3473908 - RNA, 16 nt, Pseudomonas aeruginosa PA01
uggccauccgcccugc

SEQ ID NO: 3473909 - RNA, 22 nt, Pseudomonas aeruginosa PA01
uggccauccgcccugcgggaug

SEQ ID NO: 3473910 - RNA, 21 nt, Pseudomonas aeruginosa PA01
uggccaucuucucgaagcgcg

SEQ ID NO: 3473911 - RNA, 20 nt, Pseudomonas aeruginosa PA01
uggccaugaugugcgcaggc

SEQ ID NO: 3473912 - RNA, 22 nt, Pseudomonas aeruginosa PA01
uggccaugaugugcgcaggcug

SEQ ID NO: 3473913 - RNA, 23 nt, Pseudomonas aeruginosa PA01
uggccaugaugugcgcaggcugg

SEQ ID NO: 3473914 - RNA, 17 nt, Pseudomonas aeruginosa PA01
uggccauggcagagcug

SEQ ID NO: 3473915 - RNA, 12 nt, Pseudomonas aeruginosa PA01
uggccauggcgc

SEQ ID NO: 3473916 - RNA, 16 nt, Pseudomonas aeruginosa PA01
uggccaugggcacgcc

SEQ ID NO: 3473917 - RNA, 23 nt, Pseudomonas aeruginosa PA01
uggccauguacguaucccagcgc

SEQ ID NO: 3473918 - RNA, 18 nt, Pseudomonas aeruginosa PA01
uggccauucgcuucggcc

SEQ ID NO: 3473919 - RNA, 17 nt, Pseudomonas aeruginosa PA01
uggcccaauccgcgccg

SEQ ID NO: 3473920 - RNA, 18 nt, Pseudomonas aeruginosa PA01
uggcccaauccgcgccgg

SEQ ID NO: 3473921 - RNA, 20 nt, Pseudomonas aeruginosa PA01
uggcccaauccgcgccggug

SEQ ID NO: 3473922 - RNA, 17 nt, Pseudomonas aeruginosa PA01
uggcccacggcgccuuc

SEQ ID NO: 3473923 - RNA, 15 nt, Pseudomonas aeruginosa PA01
uggcccacuccagau

SEQ ID NO: 3473924 - RNA, 16 nt, Pseudomonas aeruginosa PA01
uggcccagaccuugga

SEQ ID NO: 3473925 - RNA, 20 nt, Pseudomonas aeruginosa PA01
uggcccagaccuuggagcca

SEQ ID NO: 3473926 - RNA, 23 nt, Pseudomonas aeruginosa PA01
uggcccagaccuuggagccaugc

SEQ ID NO: 3473927 - RNA, 20 nt, Pseudomonas aeruginosa PA01
uggcccagauauccagggcc

SEQ ID NO: 3473928 - RNA, 23 nt, Pseudomonas aeruginosa PA01
uggcccagauauccagggccagg

SEQ ID NO: 3473929 - RNA, 18 nt, Pseudomonas aeruginosa PA01
uggcccagaugaucaggc

SEQ ID NO: 3473930 - RNA, 21 nt, Pseudomonas aeruginosa PA01
uggcccagaugaucaggccga

SEQ ID NO: 3473931 - RNA, 22 nt, Pseudomonas aeruginosa PA01
uggcccagaugaucaggccgag

SEQ ID NO: 3473932 - RNA, 17 nt, Pseudomonas aeruginosa PA01
uggcccaguugcccggc

SEQ ID NO: 3473933 - RNA, 19 nt, Pseudomonas aeruginosa PA01
uggcccaguugcccggccu

SEQ ID NO: 3473934 - RNA, 13 nt, Pseudomonas aeruginosa PA01
uggccccagcgcg

SEQ ID NO: 3473935 - RNA, 14 nt, Pseudomonas aeruginosa PA01
uggccccagcgcga

SEQ ID NO: 3473936 - RNA, 19 nt, Pseudomonas aeruginosa PA01
uggcccggcgcggcggccg

SEQ ID NO: 3473937 - RNA, 21 nt, Pseudomonas aeruginosa PA01
uggcccggcgcggcggccgcc

SEQ ID NO: 3473938 - RNA, 20 nt, Pseudomonas aeruginosa PA01
uggcccggcguuucgccggg

SEQ ID NO: 3473939 - RNA, 22 nt, Pseudomonas aeruginosa PA01
uggcccucucucgccucggcgg

SEQ ID NO: 3473940 - RNA, 15 nt, Pseudomonas aeruginosa PA01
uggcccugcaacagg

SEQ ID NO: 3473941 - RNA, 20 nt, Pseudomonas aeruginosa PA01
uggcccugcaucgcgacagg

SEQ ID NO: 3473942 - RNA, 16 nt, Pseudomonas aeruginosa PA01
uggcccuggccuuggc

SEQ ID NO: 3473943 - RNA, 15 nt, Pseudomonas aeruginosa PA01
uggcccuggcgcagg

SEQ ID NO: 3473944 - RNA, 17 nt, Pseudomonas aeruginosa PA01
uggcccuggcgcaggcg

SEQ ID NO: 3473945 - RNA, 20 nt, Pseudomonas aeruginosa PA01
uggcccuggcgcaggcggcg

SEQ ID NO: 3473946 - RNA, 19 nt, Pseudomonas aeruginosa PA01
uggcccugguacagcgccu

SEQ ID NO: 3473947 - RNA, 16 nt, Pseudomonas aeruginosa PA01
uggcccuucgcccugc

SEQ ID NO: 3473948 - RNA, 15 nt, Pseudomonas aeruginosa PA01
uggccgaaagcacug

SEQ ID NO: 3473949 - RNA, 17 nt, Pseudomonas aeruginosa PA01
uggccgaaagcacugcg

SEQ ID NO: 3473950 - RNA, 20 nt, Pseudomonas aeruginosa PA01
uggccgaacucaugcccagc

SEQ ID NO: 3473951 - RNA, 20 nt, Pseudomonas aeruginosa PA01
uggccgaaucgaacagggcg

SEQ ID NO: 3473952 - RNA, 20 nt, Pseudomonas aeruginosa PA01
uggccgaccaguaccaggcg

SEQ ID NO: 3473953 - RNA, 12 nt, Pseudomonas aeruginosa PA01
uggccgacccgc

SEQ ID NO: 3473954 - RNA, 18 nt, Pseudomonas aeruginosa PA01
uggccgacccgcagcggc

SEQ ID NO: 3473955 - RNA, 19 nt, Pseudomonas aeruginosa PA01
uggccgacccgcagcggcg

SEQ ID NO: 3473956 - RNA, 21 nt, Pseudomonas aeruginosa PA01
uggccgacccgcagcggcgcu

SEQ ID NO: 3473957 - RNA, 12 nt, Pseudomonas aeruginosa PA01
uggccgacccgu

SEQ ID NO: 3473958 - RNA, 15 nt, Pseudomonas aeruginosa PA01
uggccgacccgugcg

SEQ ID NO: 3473959 - RNA, 16 nt, Pseudomonas aeruginosa PA01
uggccgaccgccaggc

SEQ ID NO: 3473960 - RNA, 17 nt, Pseudomonas aeruginosa PA01
uggccgaccgccaggcc

SEQ ID NO: 3473961 - RNA, 20 nt, Pseudomonas aeruginosa PA01
uggccgaccgccaggccgac

SEQ ID NO: 3473962 - RNA, 15 nt, Pseudomonas aeruginosa PA01
uggccgacgccgcug

SEQ ID NO: 3473963 - RNA, 19 nt, Pseudomonas aeruginosa PA01
uggccgacgccgcuggaac

SEQ ID NO: 3473964 - RNA, 16 nt, Pseudomonas aeruginosa PA01
uggccgagcaucagca

SEQ ID NO: 3473965 - RNA, 22 nt, Pseudomonas aeruginosa PA01
uggccgagcgacuccgggaaca

SEQ ID NO: 3473966 - RNA, 20 nt, Pseudomonas aeruginosa PA01
uggccgagcgcgagugcagc

SEQ ID NO: 3473967 - RNA, 19 nt, Pseudomonas aeruginosa PA01
uggccgagcgggaagcguu

SEQ ID NO: 3473968 - RNA, 21 nt, Pseudomonas aeruginosa PA01
uggccgagcugccgcaccgcc

SEQ ID NO: 3473969 - RNA, 23 nt, Pseudomonas aeruginosa PA01
uggccgagcugccgcaccgccuc

SEQ ID NO: 3473970 - RNA, 15 nt, Pseudomonas aeruginosa PA01
uggccgaggaggcca

SEQ ID NO: 3473971 - RNA, 21 nt, Pseudomonas aeruginosa PA01
uggccgaggaggccagcagca

SEQ ID NO: 3473972 - RNA, 14 nt, Pseudomonas aeruginosa PA01
uggccgagggcgcg

SEQ ID NO: 3473973 - RNA, 16 nt, Pseudomonas aeruginosa PA01
uggccgagggcgcgca

SEQ ID NO: 3473974 - RNA, 22 nt, Pseudomonas aeruginosa PA01
uggccgagguggagaucagcgg

SEQ ID NO: 3473975 - RNA, 19 nt, Pseudomonas aeruginosa PA01
uggccgaguggccgaaggc

SEQ ID NO: 3473976 - RNA, 16 nt, Pseudomonas aeruginosa PA01
uggccgaucaccuggc

SEQ ID NO: 3473977 - RNA, 20 nt, Pseudomonas aeruginosa PA01
uggccgaucaccuggccauu

SEQ ID NO: 3473978 - RNA, 15 nt, Pseudomonas aeruginosa PA01
uggccgaucagcuug

SEQ ID NO: 3473979 - RNA, 19 nt, Pseudomonas aeruginosa PA01
uggccgaucagcuuggccu

SEQ ID NO: 3473980 - RNA, 16 nt, Pseudomonas aeruginosa PA01
uggccgaucuccuggu

SEQ ID NO: 3473981 - RNA, 13 nt, Pseudomonas aeruginosa PA01
uggccgaugccga

SEQ ID NO: 3473982 - RNA, 18 nt, Pseudomonas aeruginosa PA01
uggccgauuucgaugacg

SEQ ID NO: 3473983 - RNA, 14 nt, Pseudomonas aeruginosa PA01
uggccgcagcagcg

SEQ ID NO: 3473984 - RNA, 15 nt, Pseudomonas aeruginosa PA01
uggccgcagcagcgg

SEQ ID NO: 3473985 - RNA, 18 nt, Pseudomonas aeruginosa PA01
uggccgcagcggcuguug

SEQ ID NO: 3473986 - RNA, 21 nt, Pseudomonas aeruginosa PA01
uggccgccagcaggccgaagg

SEQ ID NO: 3473987 - RNA, 21 nt, Pseudomonas aeruginosa PA01
uggccgcccagguugaugccg

SEQ ID NO: 3473988 - RNA, 19 nt, Pseudomonas aeruginosa PA01
uggcgaacuucaggccggc

SEQ ID NO: 3473989 - RNA, 15 nt, Pseudomonas aeruginosa PA01
uggcgaagcuggggc

SEQ ID NO: 3473990 - RNA, 18 nt, Pseudomonas aeruginosa PA01
uggcgaaggcaaugccgc

SEQ ID NO: 3473991 - RNA, 24 nt, Pseudomonas aeruginosa PA01
uggcgaaggcaaugccgcccucca

SEQ ID NO: 3473992 - RNA, 14 nt, Pseudomonas aeruginosa PA01
uggcgaaggcgcuc

SEQ ID NO: 3473993 - RNA, 19 nt, Pseudomonas aeruginosa PA01
uggcgaaguugccgccgcu

SEQ ID NO: 3473994 - RNA, 22 nt, Pseudomonas aeruginosa PA01
uggcgaaguugccgccgcuggc

SEQ ID NO: 3473995 - RNA, 17 nt, Pseudomonas aeruginosa PA01
uggcgaauagccggcgc

SEQ ID NO: 3473996 - RNA, 17 nt, Pseudomonas aeruginosa PA01
uggcgaauuuccugcug

SEQ ID NO: 3473997 - RNA, 23 nt, Pseudomonas aeruginosa PA01
uggcgacaggcgaucgacgccuc

SEQ ID NO: 3473998 - RNA, 18 nt, Pseudomonas aeruginosa PA01
uggcgacaggcgaucgcc

SEQ ID NO: 3473999 - RNA, 21 nt, Pseudomonas aeruginosa PA01
uggcgaccaggacagcacgcu

SEQ ID NO: 3474000 - RNA, 12 nt, Pseudomonas aeruginosa PA01
uggcgaccgccg

SEQ ID NO: 3474001 - RNA, 13 nt, Pseudomonas aeruginosa PA01
uggcgaccuggua

SEQ ID NO: 3474002 - RNA, 17 nt, Pseudomonas aeruginosa PA01
uggcgacgaagacgcug

SEQ ID NO: 3474003 - RNA, 21 nt, Pseudomonas aeruginosa PA01
uggcgacgaagacgcugcgca

SEQ ID NO: 3474004 - RNA, 19 nt, Pseudomonas aeruginosa PA01
uggcgacgacgggagcgcg

SEQ ID NO: 3474005 - RNA, 13 nt, Pseudomonas aeruginosa PA01
uggcgacgaugcg

SEQ ID NO: 3474006 - RNA, 18 nt, Pseudomonas aeruginosa PA01
uggcgacgaugcgcccca

SEQ ID NO: 3474007 - RNA, 15 nt, Pseudomonas aeruginosa PA01
uggcgacgcagcacg

SEQ ID NO: 3474008 - RNA, 17 nt, Pseudomonas aeruginosa PA01
uggcgacgcagcacggc

SEQ ID NO: 3474009 - RNA, 22 nt, Pseudomonas aeruginosa PA01
uggcgacgccggucgggcacuu

SEQ ID NO: 3474010 - RNA, 13 nt, Pseudomonas aeruginosa PA01
uggcgacgcgcag

SEQ ID NO: 3474011 - RNA, 15 nt, Pseudomonas aeruginosa PA01
uggcgacgcgcaggc

SEQ ID NO: 3474012 - RNA, 16 nt, Pseudomonas aeruginosa PA01
uggcgacgcgcaggcc

SEQ ID NO: 3474013 - RNA, 21 nt, Pseudomonas aeruginosa PA01
uggcgacguccugcgggucau

SEQ ID NO: 3474014 - RNA, 19 nt, Pseudomonas aeruginosa PA01
uggcgacgucgccccagcc

SEQ ID NO: 3474015 - RNA, 20 nt, Pseudomonas aeruginosa PA01
uggcgacgucgccccagccu

SEQ ID NO: 3474016 - RNA, 17 nt, Pseudomonas aeruginosa PA01
uggcgagaauggcgaug

SEQ ID NO: 3474017 - RNA, 20 nt, Pseudomonas aeruginosa PA01
uggcgagcgucgagucgcgc

SEQ ID NO: 3474018 - RNA, 11 nt, Pseudomonas aeruginosa PA01
uggcgaggacg

SEQ ID NO: 3474019 - RNA, 21 nt, Pseudomonas aeruginosa PA01
uggcgaggaugaucagggcac

SEQ ID NO: 3474020 - RNA, 18 nt, Pseudomonas aeruginosa PA01
uggcgaggauuuccucgc

SEQ ID NO: 3474021 - RNA, 19 nt, Pseudomonas aeruginosa PA01
uggcgaggauuuccucgcg

SEQ ID NO: 3474022 - RNA, 14 nt, Pseudomonas aeruginosa PA01
uggcgaucaggcag

SEQ ID NO: 3474023 - RNA, 15 nt, Pseudomonas aeruginosa PA01
uggcgaucaggcagc

SEQ ID NO: 3474024 - RNA, 17 nt, Pseudomonas aeruginosa PA01
uggcgaucaggcagcgc

SEQ ID NO: 3474025 - RNA, 22 nt, Pseudomonas aeruginosa PA01
uggcgaucaggcagcgcgcggc

SEQ ID NO: 3474026 - RNA, 17 nt, Pseudomonas aeruginosa PA01
uggcgaucaggccaagc

SEQ ID NO: 3474027 - RNA, 14 nt, Pseudomonas aeruginosa PA01
uggcgaucgagcug

SEQ ID NO: 3474028 - RNA, 15 nt, Pseudomonas aeruginosa PA01
uggcgaucuccggga

SEQ ID NO: 3474029 - RNA, 15 nt, Pseudomonas aeruginosa PA01
uggcgaugcccuggc

SEQ ID NO: 3474030 - RNA, 23 nt, Pseudomonas aeruginosa PA01
uggcgaugcccuggccgcugccg

SEQ ID NO: 3474031 - RNA, 18 nt, Pseudomonas aeruginosa PA01
uggcgaugccgaggagga

SEQ ID NO: 3474032 - RNA, 23 nt, Pseudomonas aeruginosa PA01
uggcgauggaugacccgcucgcc

SEQ ID NO: 3474033 - RNA, 17 nt, Pseudomonas aeruginosa PA01
uggcgauguagcugccg

SEQ ID NO: 3474034 - RNA, 22 nt, Pseudomonas aeruginosa PA01
uggcgauguagcugccggcguc

SEQ ID NO: 3474035 - RNA, 19 nt, Pseudomonas aeruginosa PA01
uggcgauguucaccgcggc

SEQ ID NO: 3474036 - RNA, 19 nt, Pseudomonas aeruginosa PA01
uggcgauuuccucgcugcg

SEQ ID NO: 3474037 - RNA, 16 nt, Pseudomonas aeruginosa PA01
uggcgcaacgccggca

SEQ ID NO: 3474038 - RNA, 21 nt, Pseudomonas aeruginosa PA01
uggcgcaacugcacguugcug

SEQ ID NO: 3474039 - RNA, 15 nt, Pseudomonas aeruginosa PA01
uggcgcaacugcgcc

SEQ ID NO: 3474040 - RNA, 18 nt, Pseudomonas aeruginosa PA01
uggcgcaauacaccgcug

SEQ ID NO: 3474041 - RNA, 13 nt, Pseudomonas aeruginosa PA01
uggcgcaccacug

SEQ ID NO: 3474042 - RNA, 20 nt, Pseudomonas aeruginosa PA01
uggcgcacggccugcaccug

SEQ ID NO: 3474043 - RNA, 16 nt, Pseudomonas aeruginosa PA01
uggcgcacugccagga

SEQ ID NO: 3474044 - RNA, 16 nt, Pseudomonas aeruginosa PA01
uggcgcagacaggccu

SEQ ID NO: 3474045 - RNA, 23 nt, Pseudomonas aeruginosa PA01
uggcgcagacaggccuccagcaa

SEQ ID NO: 3474046 - RNA, 13 nt, Pseudomonas aeruginosa PA01
uggcgcagcauca

SEQ ID NO: 3474047 - RNA, 21 nt, Pseudomonas aeruginosa PA01
uggcgcagccaggcgauggug

SEQ ID NO: 3474048 - RNA, 17 nt, Pseudomonas aeruginosa PA01
uggcgcagccgcugcug

SEQ ID NO: 3474049 - RNA, 15 nt, Pseudomonas aeruginosa PA01
uggcgcagccgcugg

SEQ ID NO: 3474050 - RNA, 21 nt, Pseudomonas aeruginosa PA01
uggcgcagccgcugggccacg

SEQ ID NO: 3474051 - RNA, 13 nt, Pseudomonas aeruginosa PA01
uggcgcagcggca

SEQ ID NO: 3474052 - RNA, 21 nt, Pseudomonas aeruginosa PA01
uggcgcagcggcagcgccagg

SEQ ID NO: 3474053 - RNA, 13 nt, Pseudomonas aeruginosa PA01
uggcgcagcgggu

SEQ ID NO: 3474054 - RNA, 15 nt, Pseudomonas aeruginosa PA01
uggcgcaggccgggc

SEQ ID NO: 3474055 - RNA, 16 nt, Pseudomonas aeruginosa PA01
uggcgcaggccgggcg

SEQ ID NO: 3474056 - RNA, 18 nt, Pseudomonas aeruginosa PA01
uggcgcaggccgggcgga

SEQ ID NO: 3474057 - RNA, 18 nt, Pseudomonas aeruginosa PA01
uggcgcaggcggcgcugu

SEQ ID NO: 3474058 - RNA, 14 nt, Pseudomonas aeruginosa PA01
uggcgcagguagaa

SEQ ID NO: 3474059 - RNA, 20 nt, Pseudomonas aeruginosa PA01
uggcgcauccgcccgaucgc

SEQ ID NO: 3474060 - RNA, 16 nt, Pseudomonas aeruginosa PA01
uggcgcauggcgcucu

SEQ ID NO: 3474061 - RNA, 12 nt, Pseudomonas aeruginosa PA01
uggcgccagcca

SEQ ID NO: 3474062 - RNA, 14 nt, Pseudomonas aeruginosa PA01
uggcgccagccagc

SEQ ID NO: 3474063 - RNA, 15 nt, Pseudomonas aeruginosa PA01
uggcgccagccagcc

SEQ ID NO: 3474064 - RNA, 14 nt, Pseudomonas aeruginosa PA01
uggcgccaggccgc

SEQ ID NO: 3474065 - RNA, 18 nt, Pseudomonas aeruginosa PA01
uggcgccauccuccagcg

SEQ ID NO: 3474066 - RNA, 22 nt, Pseudomonas aeruginosa PA01
uggcgccauccuccagcgccgc

SEQ ID NO: 3474067 - RNA, 21 nt, Pseudomonas aeruginosa PA01
uggcgccauugugcgcgcgca

SEQ ID NO: 3474068 - RNA, 19 nt, Pseudomonas aeruginosa PA01
uggcgcccaugccgcccgg

SEQ ID NO: 3474069 - RNA, 20 nt, Pseudomonas aeruginosa PA01
uggcgcccaugccgcccggc

SEQ ID NO: 3474070 - RNA, 17 nt, Pseudomonas aeruginosa PA01
uggcgccccagaucgcc

SEQ ID NO: 3474071 - RNA, 18 nt, Pseudomonas aeruginosa PA01
uggcgccccaggcgggca

SEQ ID NO: 3474072 - RNA, 14 nt, Pseudomonas aeruginosa PA01
uggcgcccgccuug

SEQ ID NO: 3474073 - RNA, 14 nt, Pseudomonas aeruginosa PA01
uggcgccgagcagc

SEQ ID NO: 3474074 - RNA, 17 nt, Pseudomonas aeruginosa PA01
uggcgccgagcagcggc

SEQ ID NO: 3474075 - RNA, 12 nt, Pseudomonas aeruginosa PA01
uggcgccgaugc

SEQ ID NO: 3474076 - RNA, 14 nt, Pseudomonas aeruginosa PA01
uggcgccgaugcug

SEQ ID NO: 3474077 - RNA, 15 nt, Pseudomonas aeruginosa PA01
uggcgccgaugcugu

SEQ ID NO: 3474078 - RNA, 16 nt, Pseudomonas aeruginosa PA01
uggcgccgaugcugua

SEQ ID NO: 3474079 - RNA, 14 nt, Pseudomonas aeruginosa PA01
uggcgccgcagggc

SEQ ID NO: 3474080 - RNA, 14 nt, Pseudomonas aeruginosa PA01
uggcgccgccgagg

SEQ ID NO: 3474081 - RNA, 15 nt, Pseudomonas aeruginosa PA01
uggcgccgccggcga

SEQ ID NO: 3474082 - RNA, 22 nt, Pseudomonas aeruginosa PA01
uggcgccgcgggucugcucggc

SEQ ID NO: 3474083 - RNA, 14 nt, Pseudomonas aeruginosa PA01
uggcgccgcuggcg

SEQ ID NO: 3474084 - RNA, 14 nt, Pseudomonas aeruginosa PA01
uggcgccggccaga

SEQ ID NO: 3474085 - RNA, 15 nt, Pseudomonas aeruginosa PA01
uggcgccggcgcgcu

SEQ ID NO: 3474086 - RNA, 17 nt, Pseudomonas aeruginosa PA01
uggcgccggcugacgcu

SEQ ID NO: 3474087 - RNA, 19 nt, Pseudomonas aeruginosa PA01
uggcgccgggcgcgaugcc

SEQ ID NO: 3474088 - RNA, 21 nt, Pseudomonas aeruginosa PA01
uggcgccgggguuuucuuuuu

SEQ ID NO: 3474089 - RNA, 14 nt, Pseudomonas aeruginosa PA01
uggcgccggugcau

SEQ ID NO: 3474090 - RNA, 19 nt, Pseudomonas aeruginosa PA01
uggcgccguccugcaacug

SEQ ID NO: 3474091 - RNA, 16 nt, Pseudomonas aeruginosa PA01
uggcggucagcgacug

SEQ ID NO: 3474092 - RNA, 17 nt, Pseudomonas aeruginosa PA01
uggcgguccaggucaug

SEQ ID NO: 3474093 - RNA, 14 nt, Pseudomonas aeruginosa PA01
uggcggucggccag

SEQ ID NO: 3474094 - RNA, 15 nt, Pseudomonas aeruginosa PA01
uggcggucggccagg

SEQ ID NO: 3474095 - RNA, 16 nt, Pseudomonas aeruginosa PA01
uggcggucggccaggc

SEQ ID NO: 3474096 - RNA, 21 nt, Pseudomonas aeruginosa PA01
uggcggucggccaggcggccg

SEQ ID NO: 3474097 - RNA, 23 nt, Pseudomonas aeruginosa PA01
uggcggucggccaggcggccgac

SEQ ID NO: 3474098 - RNA, 15 nt, Pseudomonas aeruginosa PA01
uggcgguuccuccau

SEQ ID NO: 3474099 - RNA, 18 nt, Pseudomonas aeruginosa PA01
uggcguaccucgccaggc

SEQ ID NO: 3474100 - RNA, 17 nt, Pseudomonas aeruginosa PA01
uggcguacuugggcauc

SEQ ID NO: 3474101 - RNA, 20 nt, Pseudomonas aeruginosa PA01
uggcguacuugggcaucagc

SEQ ID NO: 3474102 - RNA, 23 nt, Pseudomonas aeruginosa PA01
uggcguagcguugcgcgagcacc

SEQ ID NO: 3474103 - RNA, 18 nt, Pseudomonas aeruginosa PA01
uggcguaucagcgcucca

SEQ ID NO: 3474104 - RNA, 19 nt, Pseudomonas aeruginosa PA01
uggcguccccaugcccggc

SEQ ID NO: 3474105 - RNA, 14 nt, Pseudomonas aeruginosa PA01
uggcgucgaacagc

SEQ ID NO: 3474106 - RNA, 16 nt, Pseudomonas aeruginosa PA01
uggcgucgacgccgaa

SEQ ID NO: 3474107 - RNA, 16 nt, Pseudomonas aeruginosa PA01
uggcgucgaucaggcg

SEQ ID NO: 3474108 - RNA, 19 nt, Pseudomonas aeruginosa PA01
uggcgucgaucaggcgggc

SEQ ID NO: 3474109 - RNA, 16 nt, Pseudomonas aeruginosa PA01
uggcgucgaugccgaa

SEQ ID NO: 3474110 - RNA, 20 nt, Pseudomonas aeruginosa PA01
uggcgucgccuuccaccacc

SEQ ID NO: 3474111 - RNA, 17 nt, Pseudomonas aeruginosa PA01
uggcgucgcgcacgagg

SEQ ID NO: 3474112 - RNA, 14 nt, Pseudomonas aeruginosa PA01
uggcgucgcugccg

SEQ ID NO: 3474113 - RNA, 13 nt, Pseudomonas aeruginosa PA01
uggcgucggcgau

SEQ ID NO: 3474114 - RNA, 14 nt, Pseudomonas aeruginosa PA01
uggcgucggcgauc

SEQ ID NO: 3474115 - RNA, 15 nt, Pseudomonas aeruginosa PA01
uggcgucggcgauca

SEQ ID NO: 3474116 - RNA, 18 nt, Pseudomonas aeruginosa PA01
uggcgucgggcuucuuca

SEQ ID NO: 3474117 - RNA, 14 nt, Pseudomonas aeruginosa PA01
uggcgugcaucacc

SEQ ID NO: 3474118 - RNA, 15 nt, Pseudomonas aeruginosa PA01
uggcgugccgccagg

SEQ ID NO: 3474119 - RNA, 15 nt, Pseudomonas aeruginosa PA01
uggcgugcucggcga

SEQ ID NO: 3474120 - RNA, 12 nt, Pseudomonas aeruginosa PA01
uggcguggccgg

SEQ ID NO: 3474121 - RNA, 17 nt, Pseudomonas aeruginosa PA01
uggcguguucgucgauc

SEQ ID NO: 3474122 - RNA, 16 nt, Pseudomonas aeruginosa PA01
uggcguuauucgcccu

SEQ ID NO: 3474123 - RNA, 14 nt, Pseudomonas aeruginosa PA01
uggcguuccaggcg

SEQ ID NO: 3474124 - RNA, 16 nt, Pseudomonas aeruginosa PA01
uggcguuccaggcggc

SEQ ID NO: 3474125 - RNA, 20 nt, Pseudomonas aeruginosa PA01
uggcguuccaggcggcggac

SEQ ID NO: 3474126 - RNA, 15 nt, Pseudomonas aeruginosa PA01
uggcguucgccuugc

SEQ ID NO: 3474127 - RNA, 16 nt, Pseudomonas aeruginosa PA01
uggcguucucggccag

SEQ ID NO: 3474128 - RNA, 15 nt, Pseudomonas aeruginosa PA01
uggcguugacugccu

SEQ ID NO: 3474129 - RNA, 16 nt, Pseudomonas aeruginosa PA01
uggcguugccgugccg

SEQ ID NO: 3474130 - RNA, 16 nt, Pseudomonas aeruginosa PA01
uggcguugcugaucac

SEQ ID NO: 3474131 - RNA, 16 nt, Pseudomonas aeruginosa PA01
uggcguuugcgucauc

SEQ ID NO: 3474132 - RNA, 15 nt, Pseudomonas aeruginosa PA01
uggcuaaacaagcca

SEQ ID NO: 3474133 - RNA, 13 nt, Pseudomonas aeruginosa PA01
uggcuacccgcag

SEQ ID NO: 3474134 - RNA, 16 nt, Pseudomonas aeruginosa PA01
uggcuacccgcagggc

SEQ ID NO: 3474135 - RNA, 21 nt, Pseudomonas aeruginosa PA01
uggcuauccuccaggccgccg

SEQ ID NO: 3474136 - RNA, 18 nt, Pseudomonas aeruginosa PA01
uggcucauggcauggcca

SEQ ID NO: 3474137 - RNA, 14 nt, Pseudomonas aeruginosa PA01
uggcuccccccugg

SEQ ID NO: 3474138 - RNA, 20 nt, Pseudomonas aeruginosa PA01
uggcuccgcgcguucagcca

SEQ ID NO: 3474139 - RNA, 21 nt, Pseudomonas aeruginosa PA01
uggcuccgcgcguucagccac

SEQ ID NO: 3474140 - RNA, 23 nt, Pseudomonas aeruginosa PA01
uggcuccuggagguagcugcgcc

SEQ ID NO: 3474141 - RNA, 20 nt, Pseudomonas aeruginosa PA01
uggcucgaucggcagggcgc

SEQ ID NO: 3474142 - RNA, 17 nt, Pseudomonas aeruginosa PA01
uggcucggcggcaggcu

SEQ ID NO: 3474143 - RNA, 17 nt, Pseudomonas aeruginosa PA01
uggcucuugccgcgagc

SEQ ID NO: 3474144 - RNA, 13 nt, Pseudomonas aeruginosa PA01
uggcugaagcccc

SEQ ID NO: 3474145 - RNA, 15 nt, Pseudomonas aeruginosa PA01
uggcugaagccgggc

SEQ ID NO: 3474146 - RNA, 16 nt, Pseudomonas aeruginosa PA01
uggcugaagccgggca

SEQ ID NO: 3474147 - RNA, 22 nt, Pseudomonas aeruginosa PA01
uggcugaauaccacguggccgg

SEQ ID NO: 3474148 - RNA, 23 nt, Pseudomonas aeruginosa PA01
uggcugaauaccacguggccggc

SEQ ID NO: 3474149 - RNA, 21 nt, Pseudomonas aeruginosa PA01
uggcugcagguaggcgguggc

SEQ ID NO: 3474150 - RNA, 22 nt, Pseudomonas aeruginosa PA01
uggcugcccaguugcgcggcga

SEQ ID NO: 3474151 - RNA, 22 nt, Pseudomonas aeruginosa PA01
uggcugcucgccucgggccaug

SEQ ID NO: 3474152 - RNA, 17 nt, Pseudomonas aeruginosa PA01
uggcuggauccuggaag

SEQ ID NO: 3474153 - RNA, 12 nt, Pseudomonas aeruginosa PA01
uggcuggccagc

SEQ ID NO: 3474154 - RNA, 18 nt, Pseudomonas aeruginosa PA01
uggcuggccagcaggcug

SEQ ID NO: 3474155 - RNA, 14 nt, Pseudomonas aeruginosa PA01
uggcuggccagccc

SEQ ID NO: 3474156 - RNA, 12 nt, Pseudomonas aeruginosa PA01
uggcuggccucg

SEQ ID NO: 3474157 - RNA, 16 nt, Pseudomonas aeruginosa PA01
uggcuggccucggcga

SEQ ID NO: 3474158 - RNA, 12 nt, Pseudomonas aeruginosa PA01
uggcuggcgcaa

SEQ ID NO: 3474159 - RNA, 15 nt, Pseudomonas aeruginosa PA01
uggcuggucaggcug

SEQ ID NO: 3474160 - RNA, 18 nt, Pseudomonas aeruginosa PA01
uggcuggugaugccgcgg

SEQ ID NO: 3474161 - RNA, 18 nt, Pseudomonas aeruginosa PA01
uggcuguaggugcccggc

SEQ ID NO: 3474162 - RNA, 15 nt, Pseudomonas aeruginosa PA01
uggcugucggcgccc

SEQ ID NO: 3474163 - RNA, 14 nt, Pseudomonas aeruginosa PA01
uggcuucagcuucu

SEQ ID NO: 3474164 - RNA, 15 nt, Pseudomonas aeruginosa PA01
uggcuuccagccagc

SEQ ID NO: 3474165 - RNA, 15 nt, Pseudomonas aeruginosa PA01
uggcuuccuggcgcc

SEQ ID NO: 3474166 - RNA, 17 nt, Pseudomonas aeruginosa PA01
uggcuuccuggcgccgg

SEQ ID NO: 3474167 - RNA, 13 nt, Pseudomonas aeruginosa PA01
uggcuucgaggcg

SEQ ID NO: 3474168 - RNA, 15 nt, Pseudomonas aeruginosa PA01
uggcuucguccagcg

SEQ ID NO: 3474169 - RNA, 23 nt, Pseudomonas aeruginosa PA01
uggcuugaucgagucgccggcga

SEQ ID NO: 3474170 - RNA, 13 nt, Pseudomonas aeruginosa PA01
uggcuuggcccug

SEQ ID NO: 3474171 - RNA, 14 nt, Pseudomonas aeruginosa PA01
uggcuuggcccugc

SEQ ID NO: 3474172 - RNA, 17 nt, Pseudomonas aeruginosa PA01
uggcuuguuuagccauc

SEQ ID NO: 3474173 - RNA, 12 nt, Pseudomonas aeruginosa PA01
uggcuuuccagg

SEQ ID NO: 3474174 - RNA, 14 nt, Pseudomonas aeruginosa PA01
uggcuuuccaggcg

SEQ ID NO: 3474175 - RNA, 18 nt, Pseudomonas aeruginosa PA01
uggcuuuccaggcgccgc

SEQ ID NO: 3474176 - RNA, 15 nt, Pseudomonas aeruginosa PA01
uggcuuuucucgccu

SEQ ID NO: 3474177 - RNA, 18 nt, Pseudomonas aeruginosa PA01
ugggaacccuugcgcagg

SEQ ID NO: 3474178 - RNA, 23 nt, Pseudomonas aeruginosa PA01
ugggaacgaguugggcgaccugc

SEQ ID NO: 3474179 - RNA, 12 nt, Pseudomonas aeruginosa PA01
ugggaauggcgg

SEQ ID NO: 3474180 - RNA, 22 nt, Pseudomonas aeruginosa PA01
ugggacaggaagagcaggcgga

SEQ ID NO: 3474181 - RNA, 19 nt, Pseudomonas aeruginosa PA01
ugggacauggagaccuggc

SEQ ID NO: 3474182 - RNA, 19 nt, Pseudomonas aeruginosa PA01
ugggacgaagccgauugcc

SEQ ID NO: 3474183 - RNA, 20 nt, Pseudomonas aeruginosa PA01
ugggacggaacgucggccug

SEQ ID NO: 3474184 - RNA, 15 nt, Pseudomonas aeruginosa PA01
ugggacggcggcugg

SEQ ID NO: 3474185 - RNA, 14 nt, Pseudomonas aeruginosa PA01
ugggacugagccgc

SEQ ID NO: 3474186 - RNA, 15 nt, Pseudomonas aeruginosa PA01
ugggacugagccgcu

SEQ ID NO: 3474187 - RNA, 14 nt, Pseudomonas aeruginosa PA01
ugggagccgccgga

SEQ ID NO: 3474188 - RNA, 22 nt, Pseudomonas aeruginosa PA01
ugggagccgccggacuuggaga

SEQ ID NO: 3474189 - RNA, 16 nt, Pseudomonas aeruginosa PA01
ugggauagcuuuccag

SEQ ID NO: 3474190 - RNA, 19 nt, Pseudomonas aeruginosa PA01
ugggaucgccacgccggcg

SEQ ID NO: 3474191 - RNA, 18 nt, Pseudomonas aeruginosa PA01
ugggaucgcugagcaucu

SEQ ID NO: 3474192 - RNA, 19 nt, Pseudomonas aeruginosa PA01
ugggaucgucgaaagccuc

SEQ ID NO: 3474193 - RNA, 15 nt, Pseudomonas aeruginosa PA01
ugggaugccgggccg

SEQ ID NO: 3474194 - RNA, 16 nt, Pseudomonas aeruginosa PA01
ugggcucgcgcggggc

SEQ ID NO: 3474195 - RNA, 17 nt, Pseudomonas aeruginosa PA01
ugggcugggucggcugg

SEQ ID NO: 3474196 - RNA, 18 nt, Pseudomonas aeruginosa PA01
ugggcugggucggcuggc

SEQ ID NO: 3474197 - RNA, 19 nt, Pseudomonas aeruginosa PA01
ugggcugggucggcuggca

SEQ ID NO: 3474198 - RNA, 21 nt, Pseudomonas aeruginosa PA01
ugggcugggucggcuggcagg

SEQ ID NO: 3474199 - RNA, 18 nt, Pseudomonas aeruginosa PA01
ugggcuucgccgccgcgc

SEQ ID NO: 3474200 - RNA, 15 nt, Pseudomonas aeruginosa PA01
ugggcuucgcugaug

SEQ ID NO: 3474201 - RNA, 15 nt, Pseudomonas aeruginosa PA01
ugggcuugccggggu

SEQ ID NO: 3474202 - RNA, 17 nt, Pseudomonas aeruginosa PA01
uggggaccgcaccuggu

SEQ ID NO: 3474203 - RNA, 17 nt, Pseudomonas aeruginosa PA01
uggggacggaagcaugg

SEQ ID NO: 3474204 - RNA, 14 nt, Pseudomonas aeruginosa PA01
uggggaggugcggc

SEQ ID NO: 3474205 - RNA, 19 nt, Pseudomonas aeruginosa PA01
uggggaucgcguccgguau

SEQ ID NO: 3474206 - RNA, 14 nt, Pseudomonas aeruginosa PA01
uggggaugcgccgu

SEQ ID NO: 3474207 - RNA, 17 nt, Pseudomonas aeruginosa PA01
uggggcaucucggccac

SEQ ID NO: 3474208 - RNA, 13 nt, Pseudomonas aeruginosa PA01
uggggcgccggcu

SEQ ID NO: 3474209 - RNA, 15 nt, Pseudomonas aeruginosa PA01
uggggcggcacggug

SEQ ID NO: 3474210 - RNA, 14 nt, Pseudomonas aeruginosa PA01
uggggcggccggcg

SEQ ID NO: 3474211 - RNA, 13 nt, Pseudomonas aeruginosa PA01
uggggcggccuca

SEQ ID NO: 3474212 - RNA, 17 nt, Pseudomonas aeruginosa PA01
uggggcggccucaggcc

SEQ ID NO: 3474213 - RNA, 15 nt, Pseudomonas aeruginosa PA01
uggggcucggcuucc

SEQ ID NO: 3474214 - RNA, 16 nt, Pseudomonas aeruginosa PA01
uggggcugaucucggc

SEQ ID NO: 3474215 - RNA, 16 nt, Pseudomonas aeruginosa PA01
uggggcugcccaccac

SEQ ID NO: 3474216 - RNA, 13 nt, Pseudomonas aeruginosa PA01
uggggcugccggc

SEQ ID NO: 3474217 - RNA, 17 nt, Pseudomonas aeruginosa PA01
ugggggauuuccucguc

SEQ ID NO: 3474218 - RNA, 19 nt, Pseudomonas aeruginosa PA01
uggggucaguucguugagg

SEQ ID NO: 3474219 - RNA, 18 nt, Pseudomonas aeruginosa PA01
ugggguucgacagcgcgg

SEQ ID NO: 3474220 - RNA, 16 nt, Pseudomonas aeruginosa PA01
uggguaccgacggucg

SEQ ID NO: 3474221 - RNA, 15 nt, Pseudomonas aeruginosa PA01
uggguagccauggcg

SEQ ID NO: 3474222 - RNA, 20 nt, Pseudomonas aeruginosa PA01
uggguauccagcggccgcga

SEQ ID NO: 3474223 - RNA, 12 nt, Pseudomonas aeruginosa PA01
ugggucaccagc

SEQ ID NO: 3474224 - RNA, 13 nt, Pseudomonas aeruginosa PA01
ugggucaccagca

SEQ ID NO: 3474225 - RNA, 22 nt, Pseudomonas aeruginosa PA01
ugggucacggugaggaccuggc

SEQ ID NO: 3474226 - RNA, 14 nt, Pseudomonas aeruginosa PA01
ugggucagcgccag

SEQ ID NO: 3474227 - RNA, 19 nt, Pseudomonas aeruginosa PA01
ugggucagcgccagcaacc

SEQ ID NO: 3474228 - RNA, 21 nt, Pseudomonas aeruginosa PA01
ugggucagcggguuggcuucc

SEQ ID NO: 3474229 - RNA, 13 nt, Pseudomonas aeruginosa PA01
ugggucgcgcagg

SEQ ID NO: 3474230 - RNA, 18 nt, Pseudomonas aeruginosa PA01
ugggucuggcgauucucc

SEQ ID NO: 3474231 - RNA, 13 nt, Pseudomonas aeruginosa PA01
ugggucuucagcu

SEQ ID NO: 3474232 - RNA, 19 nt, Pseudomonas aeruginosa PA01
ugggugaugaccccggcga

SEQ ID NO: 3474233 - RNA, 23 nt, Pseudomonas aeruginosa PA01
ugggugcccuugccggucaccgu

SEQ ID NO: 3474234 - RNA, 19 nt, Pseudomonas aeruginosa PA01
ugggugccgggggcggcga

SEQ ID NO: 3474235 - RNA, 16 nt, Pseudomonas aeruginosa PA01
ugggugcuuuccugcu

SEQ ID NO: 3474236 - RNA, 20 nt, Pseudomonas aeruginosa PA01
ugggugcuuuccugcuccag

SEQ ID NO: 3474237 - RNA, 23 nt, Pseudomonas aeruginosa PA01
ugggugcuuuccugcuccagcag

SEQ ID NO: 3474238 - RNA, 14 nt, Pseudomonas aeruginosa PA01
uggguggaggccca

SEQ ID NO: 3474239 - RNA, 13 nt, Pseudomonas aeruginosa PA01
ugggugucggcga

SEQ ID NO: 3474240 - RNA, 14 nt, Pseudomonas aeruginosa PA01
ugggugucggcgau

SEQ ID NO: 3474241 - RNA, 14 nt, Pseudomonas aeruginosa PA01
uggguucaggcucc

SEQ ID NO: 3474242 - RNA, 13 nt, Pseudomonas aeruginosa PA01
uggguucccagca

SEQ ID NO: 3474243 - RNA, 18 nt, Pseudomonas aeruginosa PA01
uggguucccagcagcaac

SEQ ID NO: 3474244 - RNA, 16 nt, Pseudomonas aeruginosa PA01
uggguugccgcgccga

SEQ ID NO: 3474245 - RNA, 17 nt, Pseudomonas aeruginosa PA01
uggguugccgcgccgau

SEQ ID NO: 3474246 - RNA, 13 nt, Pseudomonas aeruginosa PA01
uggguuggcgcga

SEQ ID NO: 3474247 - RNA, 20 nt, Pseudomonas aeruginosa PA01
ugguaacugggaauggcgau

SEQ ID NO: 3474248 - RNA, 18 nt, Pseudomonas aeruginosa PA01
ugguaagcgagcagacug

SEQ ID NO: 3474249 - RNA, 22 nt, Pseudomonas aeruginosa PA01
ugguaccgcugcgugccagggc

SEQ ID NO: 3474250 - RNA, 20 nt, Pseudomonas aeruginosa PA01
ugguagcagagggucgccag

SEQ ID NO: 3474251 - RNA, 23 nt, Pseudomonas aeruginosa PA01
ugguagcgcuccagcuccuccag

SEQ ID NO: 3474252 - RNA, 21 nt, Pseudomonas aeruginosa PA01
ugguagcugcugccggcuugc

SEQ ID NO: 3474253 - RNA, 23 nt, Pseudomonas aeruginosa PA01
ugguaggagccgucgccggcgac

SEQ ID NO: 3474254 - RNA, 22 nt, Pseudomonas aeruginosa PA01
ugguaggccucgaugaucgccg

SEQ ID NO: 3474255 - RNA, 15 nt, Pseudomonas aeruginosa PA01
ugguaguccagcagg

SEQ ID NO: 3474256 - RNA, 18 nt, Pseudomonas aeruginosa PA01
ugguaguccgcugcgagc

SEQ ID NO: 3474257 - RNA, 13 nt, Pseudomonas aeruginosa PA01
ugguagucgccgg

SEQ ID NO: 3474258 - RNA, 21 nt, Pseudomonas aeruginosa PA01
ugguagucgcgguugcugugc

SEQ ID NO: 3474259 - RNA, 14 nt, Pseudomonas aeruginosa PA01
ugguagugcuggcg

SEQ ID NO: 3474260 - RNA, 13 nt, Pseudomonas aeruginosa PA01
ugguauccaggcg

SEQ ID NO: 3474261 - RNA, 15 nt, Pseudomonas aeruginosa PA01
ugguaugcagcaacc

SEQ ID NO: 3474262 - RNA, 15 nt, Pseudomonas aeruginosa PA01
uggucaacggcgauu

SEQ ID NO: 3474263 - RNA, 17 nt, Pseudomonas aeruginosa PA01
uggucaccagcgugggc

SEQ ID NO: 3474264 - RNA, 15 nt, Pseudomonas aeruginosa PA01
uggucaccgccagcg

SEQ ID NO: 3474265 - RNA, 16 nt, Pseudomonas aeruginosa PA01
uggucaccgccagcgg

SEQ ID NO: 3474266 - RNA, 17 nt, Pseudomonas aeruginosa PA01
uggucaccuugaccuug

SEQ ID NO: 3474267 - RNA, 23 nt, Pseudomonas aeruginosa PA01
uggucacgccgaggcugcgggcg

SEQ ID NO: 3474268 - RNA, 21 nt, Pseudomonas aeruginosa PA01
uggucacggcgaagcggcccu

SEQ ID NO: 3474269 - RNA, 15 nt, Pseudomonas aeruginosa PA01
uggucagcaccaggg

SEQ ID NO: 3474270 - RNA, 18 nt, Pseudomonas aeruginosa PA01
uggucagcaccagggcca

SEQ ID NO: 3474271 - RNA, 19 nt, Pseudomonas aeruginosa PA01
uggucagcaccagggccag

SEQ ID NO: 3474272 - RNA, 12 nt, Pseudomonas aeruginosa PA01
uggucagccagc

SEQ ID NO: 3474273 - RNA, 17 nt, Pseudomonas aeruginosa PA01
uggucagccagccgagc

SEQ ID NO: 3474274 - RNA, 22 nt, Pseudomonas aeruginosa PA01
uggucagccagccgagcaacuc

SEQ ID NO: 3474275 - RNA, 23 nt, Pseudomonas aeruginosa PA01
uggucaggaucacaucgcccggc

SEQ ID NO: 3474276 - RNA, 18 nt, Pseudomonas aeruginosa PA01
uggucaggccggcgcgau

SEQ ID NO: 3474277 - RNA, 16 nt, Pseudomonas aeruginosa PA01
uggucaggcgccagga

SEQ ID NO: 3474278 - RNA, 17 nt, Pseudomonas aeruginosa PA01
uggucaggcugacgucg

SEQ ID NO: 3474279 - RNA, 16 nt, Pseudomonas aeruginosa PA01
uggucaggcugcgcac

SEQ ID NO: 3474280 - RNA, 14 nt, Pseudomonas aeruginosa PA01
uggucagggugccg

SEQ ID NO: 3474281 - RNA, 20 nt, Pseudomonas aeruginosa PA01
uggucagggugccgauggag

SEQ ID NO: 3474282 - RNA, 23 nt, Pseudomonas aeruginosa PA01
uggucaggucgacgccgccgagc

SEQ ID NO: 3474283 - RNA, 21 nt, Pseudomonas aeruginosa PA01
uggucaguucggcccagcagc

SEQ ID NO: 3474284 - RNA, 16 nt, Pseudomonas aeruginosa PA01
uggucaugacgggcgg

SEQ ID NO: 3474285 - RNA, 16 nt, Pseudomonas aeruginosa PA01
uggucauggcgcagac

SEQ ID NO: 3474286 - RNA, 14 nt, Pseudomonas aeruginosa PA01
ugguccaccagccc

SEQ ID NO: 3474287 - RNA, 16 nt, Pseudomonas aeruginosa PA01
ugguccaccagcccgc

SEQ ID NO: 3474288 - RNA, 12 nt, Pseudomonas aeruginosa PA01
ugguccagccag

SEQ ID NO: 3474289 - RNA, 13 nt, Pseudomonas aeruginosa PA01
ugguccagccagc

SEQ ID NO: 3474290 - RNA, 22 nt, Pseudomonas aeruginosa PA01
ugguccagcucggucagcggcg

SEQ ID NO: 3474291 - RNA, 14 nt, Pseudomonas aeruginosa PA01
ugguccagcuggcg

SEQ ID NO: 3474292 - RNA, 16 nt, Pseudomonas aeruginosa PA01
ugguccgccagcaggc

SEQ ID NO: 3474293 - RNA, 21 nt, Pseudomonas aeruginosa PA01
ugguccgcgguguuuccgucg

SEQ ID NO: 3474294 - RNA, 19 nt, Pseudomonas aeruginosa PA01
ugguccggguuggcgcagg

SEQ ID NO: 3474295 - RNA, 18 nt, Pseudomonas aeruginosa PA01
ugguccgucgcgcgcccg

SEQ ID NO: 3474296 - RNA, 21 nt, Pseudomonas aeruginosa PA01
uggucgaacacuugaccgucg

SEQ ID NO: 3474297 - RNA, 21 nt, Pseudomonas aeruginosa PA01
uguacagaaacaaagagcccg

SEQ ID NO: 3474298 - RNA, 11 nt, Pseudomonas aeruginosa PA01
uguacagcagg

SEQ ID NO: 3474299 - RNA, 16 nt, Pseudomonas aeruginosa PA01
uguacagcaggagcgc

SEQ ID NO: 3474300 - RNA, 19 nt, Pseudomonas aeruginosa PA01
uguacagcaggagcgccau

SEQ ID NO: 3474301 - RNA, 17 nt, Pseudomonas aeruginosa PA01
uguacagcgaggcccgc

SEQ ID NO: 3474302 - RNA, 19 nt, Pseudomonas aeruginosa PA01
uguacagcuucaggcgcac

SEQ ID NO: 3474303 - RNA, 23 nt, Pseudomonas aeruginosa PA01
uguacauagcgggucaugagguu

SEQ ID NO: 3474304 - RNA, 23 nt, Pseudomonas aeruginosa PA01
uguaccaggggauggucggugac

SEQ ID NO: 3474305 - RNA, 16 nt, Pseudomonas aeruginosa PA01
uguaccucuggcugaa

SEQ ID NO: 3474306 - RNA, 22 nt, Pseudomonas aeruginosa PA01
uguacgccagggugcugcccag

SEQ ID NO: 3474307 - RNA, 14 nt, Pseudomonas aeruginosa PA01
uguacggcaccacc

SEQ ID NO: 3474308 - RNA, 16 nt, Pseudomonas aeruginosa PA01
uguacggcaccaccac

SEQ ID NO: 3474309 - RNA, 17 nt, Pseudomonas aeruginosa PA01
uguacucgccggugcgg

SEQ ID NO: 3474310 - RNA, 20 nt, Pseudomonas aeruginosa PA01
uguacugcucgguauggcug

SEQ ID NO: 3474311 - RNA, 12 nt, Pseudomonas aeruginosa PA01
uguagaccacca

SEQ ID NO: 3474312 - RNA, 15 nt, Pseudomonas aeruginosa PA01
uguagaccaccagcg

SEQ ID NO: 3474313 - RNA, 23 nt, Pseudomonas aeruginosa PA01
uguagagcaggcugcuagguucu

SEQ ID NO: 3474314 - RNA, 15 nt, Pseudomonas aeruginosa PA01
uguagaucggcagca

SEQ ID NO: 3474315 - RNA, 22 nt, Pseudomonas aeruginosa PA01
uguagaugaucuccaggucgcc

SEQ ID NO: 3474316 - RNA, 17 nt, Pseudomonas aeruginosa PA01
uguagcagggugcgggc

SEQ ID NO: 3474317 - RNA, 13 nt, Pseudomonas aeruginosa PA01
uguagcccugggc

SEQ ID NO: 3474318 - RNA, 18 nt, Pseudomonas aeruginosa PA01
uguagcccugggcgaugc

SEQ ID NO: 3474319 - RNA, 20 nt, Pseudomonas aeruginosa PA01
uguagccggcgaugugcggc

SEQ ID NO: 3474320 - RNA, 21 nt, Pseudomonas aeruginosa PA01
uguagccggcgaugugcggcg

SEQ ID NO: 3474321 - RNA, 21 nt, Pseudomonas aeruginosa PA01
uguagccucccgccgcggcgu

SEQ ID NO: 3474322 - RNA, 20 nt, Pseudomonas aeruginosa PA01
uguagcgcuccucgcgcugc

SEQ ID NO: 3474323 - RNA, 22 nt, Pseudomonas aeruginosa PA01
uguagcgcuccuguucgucgcg

SEQ ID NO: 3474324 - RNA, 19 nt, Pseudomonas aeruginosa PA01
uguagcugaggccguagcc

SEQ ID NO: 3474325 - RNA, 14 nt, Pseudomonas aeruginosa PA01
uguagcugccggcg

SEQ ID NO: 3474326 - RNA, 17 nt, Pseudomonas aeruginosa PA01
uguaggccucggccugg

SEQ ID NO: 3474327 - RNA, 18 nt, Pseudomonas aeruginosa PA01
uguaggcgagcagcggca

SEQ ID NO: 3474328 - RNA, 16 nt, Pseudomonas aeruginosa PA01
uguaggcgcaccaggc

SEQ ID NO: 3474329 - RNA, 20 nt, Pseudomonas aeruginosa PA01
uguaggcgcaccaggccagg

SEQ ID NO: 3474330 - RNA, 14 nt, Pseudomonas aeruginosa PA01
uguaggcgccgccg

SEQ ID NO: 3474331 - RNA, 21 nt, Pseudomonas aeruginosa PA01
uguagggcgaauaacgccaca

SEQ ID NO: 3474332 - RNA, 15 nt, Pseudomonas aeruginosa PA01
uguagggucgcagca

SEQ ID NO: 3474333 - RNA, 18 nt, Pseudomonas aeruginosa PA01
uguagggucgcagcaggc

SEQ ID NO: 3474334 - RNA, 15 nt, Pseudomonas aeruginosa PA01
uguagguauccgccg

SEQ ID NO: 3474335 - RNA, 18 nt, Pseudomonas aeruginosa PA01
uguaggucaccgcgccgg

SEQ ID NO: 3474336 - RNA, 21 nt, Pseudomonas aeruginosa PA01
uguaguacaugacgaagcgca

SEQ ID NO: 3474337 - RNA, 18 nt, Pseudomonas aeruginosa PA01
uguagucauggccaguca

SEQ ID NO: 3474338 - RNA, 20 nt, Pseudomonas aeruginosa PA01
uguagucgucccacuugucc

SEQ ID NO: 3474339 - RNA, 15 nt, Pseudomonas aeruginosa PA01
uguaguucaucuugc

SEQ ID NO: 3474340 - RNA, 22 nt, Pseudomonas aeruginosa PA01
uguaguucuugcgcauuuugcc

SEQ ID NO: 3474341 - RNA, 12 nt, Pseudomonas aeruginosa PA01
uguauuccuugc

SEQ ID NO: 3474342 - RNA, 14 nt, Pseudomonas aeruginosa PA01
ugucacgccggggg

SEQ ID NO: 3474343 - RNA, 14 nt, Pseudomonas aeruginosa PA01
uguccaccaccagc

SEQ ID NO: 3474344 - RNA, 15 nt, Pseudomonas aeruginosa PA01
uguccaccaccagca

SEQ ID NO: 3474345 - RNA, 17 nt, Pseudomonas aeruginosa PA01
uguccaccacgcggaua

SEQ ID NO: 3474346 - RNA, 15 nt, Pseudomonas aeruginosa PA01
uguccaccgccgcca

SEQ ID NO: 3474347 - RNA, 16 nt, Pseudomonas aeruginosa PA01
uguccaccgccgccag

SEQ ID NO: 3474348 - RNA, 15 nt, Pseudomonas aeruginosa PA01
uguccaccgguggcg

SEQ ID NO: 3474349 - RNA, 19 nt, Pseudomonas aeruginosa PA01
uguccaccgguggcgacgc

SEQ ID NO: 3474350 - RNA, 21 nt, Pseudomonas aeruginosa PA01
uguccacgccauaggcggcgc

SEQ ID NO: 3474351 - RNA, 21 nt, Pseudomonas aeruginosa PA01
uguccacgucguaggccgagc

SEQ ID NO: 3474352 - RNA, 23 nt, Pseudomonas aeruginosa PA01
uguccagcgcuccuugcgccagg

SEQ ID NO: 3474353 - RNA, 14 nt, Pseudomonas aeruginosa PA01
uguccaggccgauc

SEQ ID NO: 3474354 - RNA, 20 nt, Pseudomonas aeruginosa PA01
uguccaggcuguggcgcggc

SEQ ID NO: 3474355 - RNA, 19 nt, Pseudomonas aeruginosa PA01
uguccagggcgaaccacuc

SEQ ID NO: 3474356 - RNA, 21 nt, Pseudomonas aeruginosa PA01
uguccagggucuucagugcac

SEQ ID NO: 3474357 - RNA, 16 nt, Pseudomonas aeruginosa PA01
uguccaucagccgcgc

SEQ ID NO: 3474358 - RNA, 19 nt, Pseudomonas aeruginosa PA01
uguccaugaaugccuugag

SEQ ID NO: 3474359 - RNA, 17 nt, Pseudomonas aeruginosa PA01
uguccccggccagcagc

SEQ ID NO: 3474360 - RNA, 19 nt, Pseudomonas aeruginosa PA01
ugucccgaguaggcgcugc

SEQ ID NO: 3474361 - RNA, 22 nt, Pseudomonas aeruginosa PA01
ugucccgccgcgccgcucaggc

SEQ ID NO: 3474362 - RNA, 23 nt, Pseudomonas aeruginosa PA01
ugucccggacgacgaaagaagcc

SEQ ID NO: 3474363 - RNA, 20 nt, Pseudomonas aeruginosa PA01
ugucccggccauuccuucca

SEQ ID NO: 3474364 - RNA, 14 nt, Pseudomonas aeruginosa PA01
ugucccuucuuuuu

SEQ ID NO: 3474365 - RNA, 13 nt, Pseudomonas aeruginosa PA01
uguccgaacgcga

SEQ ID NO: 3474366 - RNA, 14 nt, Pseudomonas aeruginosa PA01
uguccgagaccggc

SEQ ID NO: 3474367 - RNA, 17 nt, Pseudomonas aeruginosa PA01
uguccgagaccggcagc

SEQ ID NO: 3474368 - RNA, 16 nt, Pseudomonas aeruginosa PA01
uguccgauucuuggcu

SEQ ID NO: 3474369 - RNA, 22 nt, Pseudomonas aeruginosa PA01
uguccgauucuuggcucggcag

SEQ ID NO: 3474370 - RNA, 23 nt, Pseudomonas aeruginosa PA01
uguccgcccuuuuucgucgccag

SEQ ID NO: 3474371 - RNA, 15 nt, Pseudomonas aeruginosa PA01
uguccgccgccgcgg

SEQ ID NO: 3474372 - RNA, 21 nt, Pseudomonas aeruginosa PA01
uguccgccgccgcggcgcgga

SEQ ID NO: 3474373 - RNA, 16 nt, Pseudomonas aeruginosa PA01
uguccgccggccucga

SEQ ID NO: 3474374 - RNA, 14 nt, Pseudomonas aeruginosa PA01
uguccgcgccacgg

SEQ ID NO: 3474375 - RNA, 22 nt, Pseudomonas aeruginosa PA01
uguccgcgcgcuuccaggcacg

SEQ ID NO: 3474376 - RNA, 17 nt, Pseudomonas aeruginosa PA01
uguccgcggugccgcca

SEQ ID NO: 3474377 - RNA, 23 nt, Pseudomonas aeruginosa PA01
uguccgcugcgcgaagccaggaa

SEQ ID NO: 3474378 - RNA, 16 nt, Pseudomonas aeruginosa PA01
uguccggauugccgcg

SEQ ID NO: 3474379 - RNA, 21 nt, Pseudomonas aeruginosa PA01
uguccggcaccaccagcgcgc

SEQ ID NO: 3474380 - RNA, 14 nt, Pseudomonas aeruginosa PA01
uguccggcccggag

SEQ ID NO: 3474381 - RNA, 18 nt, Pseudomonas aeruginosa PA01
uguccggcccggagcgcg

SEQ ID NO: 3474382 - RNA, 14 nt, Pseudomonas aeruginosa PA01
uguccggcggcugc

SEQ ID NO: 3474383 - RNA, 18 nt, Pseudomonas aeruginosa PA01
uguccggcggcugcugcg

SEQ ID NO: 3474384 - RNA, 22 nt, Pseudomonas aeruginosa PA01
uguccgggaaguccgggcgcgg

SEQ ID NO: 3474385 - RNA, 16 nt, Pseudomonas aeruginosa PA01
uguccgggaugccggu

SEQ ID NO: 3474386 - RNA, 16 nt, Pseudomonas aeruginosa PA01
uguccguugcgcagca

SEQ ID NO: 3474387 - RNA, 15 nt, Pseudomonas aeruginosa PA01
uguccuacccgagac

SEQ ID NO: 3474388 - RNA, 22 nt, Pseudomonas aeruginosa PA01
uguccucgaacagcuugccgcu

SEQ ID NO: 3474389 - RNA, 14 nt, Pseudomonas aeruginosa PA01
uguccucggcgccg

SEQ ID NO: 3474390 - RNA, 15 nt, Pseudomonas aeruginosa PA01
uguccugccgcaggc

SEQ ID NO: 3474391 - RNA, 19 nt, Pseudomonas aeruginosa PA01
uguccugcuccugaaggac

SEQ ID NO: 3474392 - RNA, 13 nt, Pseudomonas aeruginosa PA01
uguccuggauaag

SEQ ID NO: 3474393 - RNA, 18 nt, Pseudomonas aeruginosa PA01
uguccuggauaagccgcg

SEQ ID NO: 3474394 - RNA, 17 nt, Pseudomonas aeruginosa PA01
uguccuggaucggcagc

SEQ ID NO: 3474395 - RNA, 21 nt, Pseudomonas aeruginosa PA01
uguccuggcgcaugucgcgau

SEQ ID NO: 3474396 - RNA, 12 nt, Pseudomonas aeruginosa PA01
uguccuuguucg

SEQ ID NO: 3474397 - RNA, 13 nt, Pseudomonas aeruginosa PA01
uguccuuguucgg

SEQ ID NO: 3474398 - RNA, 14 nt, Pseudomonas aeruginosa PA01
uguccuuguucggc

SEQ ID NO: 3474399 - RNA, 11 nt, Pseudomonas aeruginosa PA01
ugugcuggcca

SEQ ID NO: 3474400 - RNA, 23 nt, Pseudomonas aeruginosa PA01
ugugcuggcggaaggugccuucg

SEQ ID NO: 3474401 - RNA, 22 nt, Pseudomonas aeruginosa PA01
ugugcugggucacguggccgcc

SEQ ID NO: 3474402 - RNA, 21 nt, Pseudomonas aeruginosa PA01
ugugcuugacgaaggcggcag

SEQ ID NO: 3474403 - RNA, 17 nt, Pseudomonas aeruginosa PA01
ugugcuuguccaccacc

SEQ ID NO: 3474404 - RNA, 23 nt, Pseudomonas aeruginosa PA01
uguggagccggugccggcggcgg

SEQ ID NO: 3474405 - RNA, 18 nt, Pseudomonas aeruginosa PA01
uguggcaggcgcugcagc

SEQ ID NO: 3474406 - RNA, 17 nt, Pseudomonas aeruginosa PA01
uguggccgucgcgccgc

SEQ ID NO: 3474407 - RNA, 15 nt, Pseudomonas aeruginosa PA01
uguggcguuauucgc

SEQ ID NO: 3474408 - RNA, 13 nt, Pseudomonas aeruginosa PA01
uguggcugcaggu

SEQ ID NO: 3474409 - RNA, 18 nt, Pseudomonas aeruginosa PA01
uguggcuggugaugccgc

SEQ ID NO: 3474410 - RNA, 21 nt, Pseudomonas aeruginosa PA01
uguggcuggugaugccgcgga

SEQ ID NO: 3474411 - RNA, 21 nt, Pseudomonas aeruginosa PA01
ugugggaaacggugcuagcgg

SEQ ID NO: 3474412 - RNA, 21 nt, Pseudomonas aeruginosa PA01
ugugggacaggaagagcaggc

SEQ ID NO: 3474413 - RNA, 22 nt, Pseudomonas aeruginosa PA01
ugugggacaggaagagcaggcg

SEQ ID NO: 3474414 - RNA, 20 nt, Pseudomonas aeruginosa PA01
uguggggaaaucgguugccg

SEQ ID NO: 3474415 - RNA, 19 nt, Pseudomonas aeruginosa PA01
uguggguauccagcggccg

SEQ ID NO: 3474416 - RNA, 20 nt, Pseudomonas aeruginosa PA01
uguggguauccagcggccgc

SEQ ID NO: 3474417 - RNA, 22 nt, Pseudomonas aeruginosa PA01
uguggguaugugacgucuguug

SEQ ID NO: 3474418 - RNA, 20 nt, Pseudomonas aeruginosa PA01
ugugguuggaaaagccccgc

SEQ ID NO: 3474419 - RNA, 15 nt, Pseudomonas aeruginosa PA01
ugugguugggcaggc

SEQ ID NO: 3474420 - RNA, 18 nt, Pseudomonas aeruginosa PA01
ugugguugggcaggcgca

SEQ ID NO: 3474421 - RNA, 17 nt, Pseudomonas aeruginosa PA01
uguuacagcaggaaaag

SEQ ID NO: 3474422 - RNA, 14 nt, Pseudomonas aeruginosa PA01
uguucagcggcgcg

SEQ ID NO: 3474423 - RNA, 20 nt, Pseudomonas aeruginosa PA01
uguucagcgggugccgaaga

SEQ ID NO: 3474424 - RNA, 15 nt, Pseudomonas aeruginosa PA01
uguucaggcgcgcgg

SEQ ID NO: 3474425 - RNA, 22 nt, Pseudomonas aeruginosa PA01
uguucaggugcuggacucgcgc

SEQ ID NO: 3474426 - RNA, 18 nt, Pseudomonas aeruginosa PA01
uguuccaaggugcugccg

SEQ ID NO: 3474427 - RNA, 21 nt, Pseudomonas aeruginosa PA01
uguuccacgucgagcgggcgg

SEQ ID NO: 3474428 - RNA, 16 nt, Pseudomonas aeruginosa PA01
uguuccaggcccgccg

SEQ ID NO: 3474429 - RNA, 20 nt, Pseudomonas aeruginosa PA01
uguuccggguugguggccgc

SEQ ID NO: 3474430 - RNA, 14 nt, Pseudomonas aeruginosa PA01
uguuccuccgccag

SEQ ID NO: 3474431 - RNA, 16 nt, Pseudomonas aeruginosa PA01
uguuccucggcggcgg

SEQ ID NO: 3474432 - RNA, 17 nt, Pseudomonas aeruginosa PA01
uguuccucguccagcag

SEQ ID NO: 3474433 - RNA, 19 nt, Pseudomonas aeruginosa PA01
uguucgaaguucuccagca

SEQ ID NO: 3474434 - RNA, 13 nt, Pseudomonas aeruginosa PA01
uguucgaggcgcc

SEQ ID NO: 3474435 - RNA, 18 nt, Pseudomonas aeruginosa PA01
uguucgcaaagcucgcgc

SEQ ID NO: 3474436 - RNA, 20 nt, Pseudomonas aeruginosa PA01
uguucgccgaggggcgggau

SEQ ID NO: 3474437 - RNA, 12 nt, Pseudomonas aeruginosa PA01
uguucgccgcca

SEQ ID NO: 3474438 - RNA, 15 nt, Pseudomonas aeruginosa PA01
uguucgccgccacca

SEQ ID NO: 3474439 - RNA, 15 nt, Pseudomonas aeruginosa PA01
uguucgccgccgcca

SEQ ID NO: 3474440 - RNA, 14 nt, Pseudomonas aeruginosa PA01
uguucgcggcgaug

SEQ ID NO: 3474441 - RNA, 21 nt, Pseudomonas aeruginosa PA01
uguucgcggcgaugcgcaugc

SEQ ID NO: 3474442 - RNA, 22 nt, Pseudomonas aeruginosa PA01
uguucgcggcucuggcgcaggg

SEQ ID NO: 3474443 - RNA, 14 nt, Pseudomonas aeruginosa PA01
uguucggccagccg

SEQ ID NO: 3474444 - RNA, 13 nt, Pseudomonas aeruginosa PA01
uguucggccaggg

SEQ ID NO: 3474445 - RNA, 14 nt, Pseudomonas aeruginosa PA01
uguucggccuugcu

SEQ ID NO: 3474446 - RNA, 13 nt, Pseudomonas aeruginosa PA01
uguucggcugggc

SEQ ID NO: 3474447 - RNA, 20 nt, Pseudomonas aeruginosa PA01
uguucgggguggcgaaggca

SEQ ID NO: 3474448 - RNA, 15 nt, Pseudomonas aeruginosa PA01
uguucgggucgcggc

SEQ ID NO: 3474449 - RNA, 13 nt, Pseudomonas aeruginosa PA01
uguucgucuggcg

SEQ ID NO: 3474450 - RNA, 17 nt, Pseudomonas aeruginosa PA01
uguucgucuggcgccug

SEQ ID NO: 3474451 - RNA, 16 nt, Pseudomonas aeruginosa PA01
uguugaacagcgccgg

SEQ ID NO: 3474452 - RNA, 20 nt, Pseudomonas aeruginosa PA01
uguugaacgucucggcgaac

SEQ ID NO: 3474453 - RNA, 21 nt, Pseudomonas aeruginosa PA01
uguugacgauggcccagauau

SEQ ID NO: 3474454 - RNA, 14 nt, Pseudomonas aeruginosa PA01
uguugacgauggcg

SEQ ID NO: 3474455 - RNA, 18 nt, Pseudomonas aeruginosa PA01
uguugaucgccgcgccgc

SEQ ID NO: 3474456 - RNA, 20 nt, Pseudomonas aeruginosa PA01
uguugaucgccgcgccgccg

SEQ ID NO: 3474457 - RNA, 21 nt, Pseudomonas aeruginosa PA01
uguugaucgccgcgccgccga

SEQ ID NO: 3474458 - RNA, 15 nt, Pseudomonas aeruginosa PA01
uguugaugcccacca

SEQ ID NO: 3474459 - RNA, 18 nt, Pseudomonas aeruginosa PA01
uguugcagagcggccagg

SEQ ID NO: 3474460 - RNA, 16 nt, Pseudomonas aeruginosa PA01
uguugcagggucgccg

SEQ ID NO: 3474461 - RNA, 20 nt, Pseudomonas aeruginosa PA01
uguugcagggucgccggguc

SEQ ID NO: 3474462 - RNA, 14 nt, Pseudomonas aeruginosa PA01
uguugcccaccagc

SEQ ID NO: 3474463 - RNA, 21 nt, Pseudomonas aeruginosa PA01
uguugcccugggccggcgcca

SEQ ID NO: 3474464 - RNA, 23 nt, Pseudomonas aeruginosa PA01
uguugccguugaugucgaccacg

SEQ ID NO: 3474465 - RNA, 12 nt, Pseudomonas aeruginosa PA01
uguugcgcaggc

SEQ ID NO: 3474466 - RNA, 19 nt, Pseudomonas aeruginosa PA01
uguugcgccgcaccacgua

SEQ ID NO: 3474467 - RNA, 17 nt, Pseudomonas aeruginosa PA01
uguugcgggcgagcagg

SEQ ID NO: 3474468 - RNA, 22 nt, Pseudomonas aeruginosa PA01
uguugcggucgauguccugggc

SEQ ID NO: 3474469 - RNA, 15 nt, Pseudomonas aeruginosa PA01
uguuggccaaccagg

SEQ ID NO: 3474470 - RNA, 13 nt, Pseudomonas aeruginosa PA01
uguuggccagcag

SEQ ID NO: 3474471 - RNA, 18 nt, Pseudomonas aeruginosa PA01
uguuggccagcagccagg

SEQ ID NO: 3474472 - RNA, 15 nt, Pseudomonas aeruginosa PA01
uguuggcggccuggg

SEQ ID NO: 3474473 - RNA, 17 nt, Pseudomonas aeruginosa PA01
uguuggucaggcugcgc

SEQ ID NO: 3474474 - RNA, 20 nt, Pseudomonas aeruginosa PA01
uguuguagaccaucugccag

SEQ ID NO: 3474475 - RNA, 18 nt, Pseudomonas aeruginosa PA01
uguuguuauggccgaccc

SEQ ID NO: 3474476 - RNA, 13 nt, Pseudomonas aeruginosa PA01
uguuucagcgggu

SEQ ID NO: 3474477 - RNA, 18 nt, Pseudomonas aeruginosa PA01
uguuucagcggguagcug

SEQ ID NO: 3474478 - RNA, 21 nt, Pseudomonas aeruginosa PA01
uguuucagcggguagcugcug

SEQ ID NO: 3474479 - RNA, 22 nt, Pseudomonas aeruginosa PA01
uguuucagcggguagcugcugg

SEQ ID NO: 3474480 - RNA, 15 nt, Pseudomonas aeruginosa PA01
uguuuccucagcucu

SEQ ID NO: 3474481 - RNA, 17 nt, Pseudomonas aeruginosa PA01
uguuucggguccaggcg

SEQ ID NO: 3474482 - RNA, 13 nt, Pseudomonas aeruginosa PA01
uguuugcgcaggg

SEQ ID NO: 3474483 - RNA, 15 nt, Pseudomonas aeruginosa PA01
uuaaaguucgacgau

SEQ ID NO: 3474484 - RNA, 16 nt, Pseudomonas aeruginosa PA01
uuaaauucaccgagcg

SEQ ID NO: 3474485 - RNA, 16 nt, Pseudomonas aeruginosa PA01
uuaccccgaccagguc

SEQ ID NO: 3474486 - RNA, 22 nt, Pseudomonas aeruginosa PA01
uuaccccgcccacucuucaguc

SEQ ID NO: 3474487 - RNA, 14 nt, Pseudomonas aeruginosa PA01
uuaccggcgaccac

SEQ ID NO: 3474488 - RNA, 16 nt, Pseudomonas aeruginosa PA01
uuaccguccgcgccgc

SEQ ID NO: 3474489 - RNA, 15 nt, Pseudomonas aeruginosa PA01
uuacuccgccggcgu

SEQ ID NO: 3474490 - RNA, 16 nt, Pseudomonas aeruginosa PA01
uuacuuggcuucagcu

SEQ ID NO: 3474491 - RNA, 17 nt, Pseudomonas aeruginosa PA01
uuagaauaccggccugu

SEQ ID NO: 3474492 - RNA, 20 nt, Pseudomonas aeruginosa PA01
uuagaauaccggccugucac

SEQ ID NO: 3474493 - RNA, 16 nt, Pseudomonas aeruginosa PA01
uuagacccacugaaga

SEQ ID NO: 3474494 - RNA, 12 nt, Pseudomonas aeruginosa PA01
uuagccgccagu

SEQ ID NO: 3474495 - RNA, 20 nt, Pseudomonas aeruginosa PA01
uuagccgccugcggcguagu

SEQ ID NO: 3474496 - RNA, 20 nt, Pseudomonas aeruginosa PA01
uuagcucagucgguagagca

SEQ ID NO: 3474497 - RNA, 21 nt, Pseudomonas aeruginosa PA01
uuagggauggauacccuucau

SEQ ID NO: 3474498 - RNA, 14 nt, Pseudomonas aeruginosa PA01
uuauccgccgccga

SEQ ID NO: 3474499 - RNA, 14 nt, Pseudomonas aeruginosa PA01
uuauccgccgccgg

SEQ ID NO: 3474500 - RNA, 12 nt, Pseudomonas aeruginosa PA01
uuauccgccgug

SEQ ID NO: 3474501 - RNA, 18 nt, Pseudomonas aeruginosa PA01
uuaugcgcccuaccuguc

SEQ ID NO: 3474502 - RNA, 14 nt, Pseudomonas aeruginosa PA01
uuccaggcuguagc

SEQ ID NO: 3474503 - RNA, 19 nt, Pseudomonas aeruginosa PA01
uuccaggcuguagccggcg

SEQ ID NO: 3474504 - RNA, 13 nt, Pseudomonas aeruginosa PA01
uuccagggccugc

SEQ ID NO: 3474505 - RNA, 22 nt, Pseudomonas aeruginosa PA01
uuccagggcgaagucggcgcgc

SEQ ID NO: 3474506 - RNA, 14 nt, Pseudomonas aeruginosa PA01
uuccagggcggcgc

SEQ ID NO: 3474507 - RNA, 22 nt, Pseudomonas aeruginosa PA01
uuccaggguagcgccgcgggcc

SEQ ID NO: 3474508 - RNA, 21 nt, Pseudomonas aeruginosa PA01
uuccagggucagcuggcgcgc

SEQ ID NO: 3474509 - RNA, 15 nt, Pseudomonas aeruginosa PA01
uuccagggucggcac

SEQ ID NO: 3474510 - RNA, 18 nt, Pseudomonas aeruginosa PA01
uuccaggguuuccagcag

SEQ ID NO: 3474511 - RNA, 23 nt, Pseudomonas aeruginosa PA01
uuccaggucggcggcacgcucca

SEQ ID NO: 3474512 - RNA, 15 nt, Pseudomonas aeruginosa PA01
uuccaguucaucgag

SEQ ID NO: 3474513 - RNA, 20 nt, Pseudomonas aeruginosa PA01
uuccaguucaucgagcaggu

SEQ ID NO: 3474514 - RNA, 15 nt, Pseudomonas aeruginosa PA01
uuccaguucggccgc

SEQ ID NO: 3474515 - RNA, 19 nt, Pseudomonas aeruginosa PA01
uuccauagggcggcgcggc

SEQ ID NO: 3474516 - RNA, 17 nt, Pseudomonas aeruginosa PA01
uuccaucgcaggcagcg

SEQ ID NO: 3474517 - RNA, 19 nt, Pseudomonas aeruginosa PA01
uucccagaaaaucggcagu

SEQ ID NO: 3474518 - RNA, 21 nt, Pseudomonas aeruginosa PA01
uucccagcagcaacagcgccg

SEQ ID NO: 3474519 - RNA, 23 nt, Pseudomonas aeruginosa PA01
uucccagcagcaacagcgccgcg

SEQ ID NO: 3474520 - RNA, 17 nt, Pseudomonas aeruginosa PA01
uucccaggccagcgggc

SEQ ID NO: 3474521 - RNA, 17 nt, Pseudomonas aeruginosa PA01
uucccagugcucccgca

SEQ ID NO: 3474522 - RNA, 21 nt, Pseudomonas aeruginosa PA01
uucccauuguuggcgcucggc

SEQ ID NO: 3474523 - RNA, 17 nt, Pseudomonas aeruginosa PA01
uuccccaaggcacgccc

SEQ ID NO: 3474524 - RNA, 13 nt, Pseudomonas aeruginosa PA01
uucccccguggcg

SEQ ID NO: 3474525 - RNA, 20 nt, Pseudomonas aeruginosa PA01
uucccccuuuuucggcgcgg

SEQ ID NO: 3474526 - RNA, 19 nt, Pseudomonas aeruginosa PA01
uuccccguggcgccgcagg

SEQ ID NO: 3474527 - RNA, 19 nt, Pseudomonas aeruginosa PA01
uucccgaggguggcgcugg

SEQ ID NO: 3474528 - RNA, 15 nt, Pseudomonas aeruginosa PA01
uucccgcaccggcgc

SEQ ID NO: 3474529 - RNA, 16 nt, Pseudomonas aeruginosa PA01
uucccgcaccggcgcg

SEQ ID NO: 3474530 - RNA, 19 nt, Pseudomonas aeruginosa PA01
uucccgcaccggcgcgccg

SEQ ID NO: 3474531 - RNA, 22 nt, Pseudomonas aeruginosa PA01
uucccgcagcgaucagcaccag

SEQ ID NO: 3474532 - RNA, 14 nt, Pseudomonas aeruginosa PA01
uucccgccgcucug

SEQ ID NO: 3474533 - RNA, 21 nt, Pseudomonas aeruginosa PA01
uucccgcggcccgccgccggg

SEQ ID NO: 3474534 - RNA, 22 nt, Pseudomonas aeruginosa PA01
uucccgcggcuccagccgcugc

SEQ ID NO: 3474535 - RNA, 19 nt, Pseudomonas aeruginosa PA01
uucccggaucagcucgcgu

SEQ ID NO: 3474536 - RNA, 12 nt, Pseudomonas aeruginosa PA01
uucccggcgcgg

SEQ ID NO: 3474537 - RNA, 22 nt, Pseudomonas aeruginosa PA01
uucccggcgcggcuacccucuc

SEQ ID NO: 3474538 - RNA, 17 nt, Pseudomonas aeruginosa PA01
uucccggcucggcacgc

SEQ ID NO: 3474539 - RNA, 16 nt, Pseudomonas aeruginosa PA01
uucccguuuugccgac

SEQ ID NO: 3474540 - RNA, 14 nt, Pseudomonas aeruginosa PA01
uucccucaaccggc

SEQ ID NO: 3474541 - RNA, 14 nt, Pseudomonas aeruginosa PA01
uucccucaggauag

SEQ ID NO: 3474542 - RNA, 22 nt, Pseudomonas aeruginosa PA01
uucccucaggauagccggcgcg

SEQ ID NO: 3474543 - RNA, 14 nt, Pseudomonas aeruginosa PA01
uucccugcgccucg

SEQ ID NO: 3474544 - RNA, 12 nt, Pseudomonas aeruginosa PA01
uuccgacccgga

SEQ ID NO: 3474545 - RNA, 14 nt, Pseudomonas aeruginosa PA01
uuccgauccuccug

SEQ ID NO: 3474546 - RNA, 21 nt, Pseudomonas aeruginosa PA01
uuccgauuucagcuucaucgc

SEQ ID NO: 3474547 - RNA, 16 nt, Pseudomonas aeruginosa PA01
uuccgcaucggccacc

SEQ ID NO: 3474548 - RNA, 21 nt, Pseudomonas aeruginosa PA01
uuccgccagaugcgcgucgcc

SEQ ID NO: 3474549 - RNA, 18 nt, Pseudomonas aeruginosa PA01
uuccgccggaagcuucca

SEQ ID NO: 3474550 - RNA, 21 nt, Pseudomonas aeruginosa PA01
uuccgccggaagcuuccagcu

SEQ ID NO: 3474551 - RNA, 19 nt, Pseudomonas aeruginosa PA01
uuccgccggacccugccgu

SEQ ID NO: 3474552 - RNA, 23 nt, Pseudomonas aeruginosa PA01
uuccgccggcgccgccucgggca

SEQ ID NO: 3474553 - RNA, 15 nt, Pseudomonas aeruginosa PA01
uuccgcgcccaggcu

SEQ ID NO: 3474554 - RNA, 16 nt, Pseudomonas aeruginosa PA01
uuccgcgcccaggcug

SEQ ID NO: 3474555 - RNA, 23 nt, Pseudomonas aeruginosa PA01
uuccgcgcccggcuggccaucca

SEQ ID NO: 3474556 - RNA, 16 nt, Pseudomonas aeruginosa PA01
uuccgcggagucgccg

SEQ ID NO: 3474557 - RNA, 21 nt, Pseudomonas aeruginosa PA01
uuccgcggccggcaggccgau

SEQ ID NO: 3474558 - RNA, 19 nt, Pseudomonas aeruginosa PA01
uuccgcucaccaggcccgc

SEQ ID NO: 3474559 - RNA, 15 nt, Pseudomonas aeruginosa PA01
uuccgcuuccacgcu

SEQ ID NO: 3474560 - RNA, 12 nt, Pseudomonas aeruginosa PA01
uuccggccaggc

SEQ ID NO: 3474561 - RNA, 14 nt, Pseudomonas aeruginosa PA01
uuccggccaggcgc

SEQ ID NO: 3474562 - RNA, 17 nt, Pseudomonas aeruginosa PA01
uuccggcccggccaggc

SEQ ID NO: 3474563 - RNA, 13 nt, Pseudomonas aeruginosa PA01
uuccggcgcagcg

SEQ ID NO: 3474564 - RNA, 16 nt, Pseudomonas aeruginosa PA01
uuccggcgcggccugc

SEQ ID NO: 3474565 - RNA, 20 nt, Pseudomonas aeruginosa PA01
uuccggcucagccgcuggcg

SEQ ID NO: 3474566 - RNA, 19 nt, Pseudomonas aeruginosa PA01
uuccggcuggacgugcagg

SEQ ID NO: 3474567 - RNA, 13 nt, Pseudomonas aeruginosa PA01
uuccgggcccagu

SEQ ID NO: 3474568 - RNA, 18 nt, Pseudomonas aeruginosa PA01
uuccgggcugcgcucggc

SEQ ID NO: 3474569 - RNA, 14 nt, Pseudomonas aeruginosa PA01
uuccgggucgcugc

SEQ ID NO: 3474570 - RNA, 21 nt, Pseudomonas aeruginosa PA01
uuccgguugcagccaccagcc

SEQ ID NO: 3474571 - RNA, 23 nt, Pseudomonas aeruginosa PA01
uuccgucgucaccucggcgccau

SEQ ID NO: 3474572 - RNA, 20 nt, Pseudomonas aeruginosa PA01
uuccgucucaggcgccaggc

SEQ ID NO: 3474573 - RNA, 23 nt, Pseudomonas aeruginosa PA01
uuccgugcggaaaccgcggccgg

SEQ ID NO: 3474574 - RNA, 13 nt, Pseudomonas aeruginosa PA01
uuccuccagaguc

SEQ ID NO: 3474575 - RNA, 18 nt, Pseudomonas aeruginosa PA01
uuccuccagaguccaugc

SEQ ID NO: 3474576 - RNA, 21 nt, Pseudomonas aeruginosa PA01
uuccuccagagugcgcagcag

SEQ ID NO: 3474577 - RNA, 23 nt, Pseudomonas aeruginosa PA01
uuccuccaguagcggaagcacgg

SEQ ID NO: 3474578 - RNA, 16 nt, Pseudomonas aeruginosa PA01
uuccuccgagggagga

SEQ ID NO: 3474579 - RNA, 17 nt, Pseudomonas aeruginosa PA01
uuccuccucgccgccga

SEQ ID NO: 3474580 - RNA, 17 nt, Pseudomonas aeruginosa PA01
uuccucgaucaggccuu

SEQ ID NO: 3474581 - RNA, 15 nt, Pseudomonas aeruginosa PA01
uuccucgcccucaug

SEQ ID NO: 3474582 - RNA, 17 nt, Pseudomonas aeruginosa PA01
uuccucgcgagggacga

SEQ ID NO: 3474583 - RNA, 19 nt, Pseudomonas aeruginosa PA01
uuccucggcggcggucgcg

SEQ ID NO: 3474584 - RNA, 14 nt, Pseudomonas aeruginosa PA01
uuccucgggcagcu

SEQ ID NO: 3474585 - RNA, 22 nt, Pseudomonas aeruginosa PA01
uuccucggugucggccaacugg

SEQ ID NO: 3474586 - RNA, 15 nt, Pseudomonas aeruginosa PA01
uuccugaaggcgcgg

SEQ ID NO: 3474587 - RNA, 22 nt, Pseudomonas aeruginosa PA01
uuccugcccgaccgguuccagc

SEQ ID NO: 3474588 - RNA, 15 nt, Pseudomonas aeruginosa PA01
uuccugcgccucguc

SEQ ID NO: 3474589 - RNA, 17 nt, Pseudomonas aeruginosa PA01
uuccugcugguugacca

SEQ ID NO: 3474590 - RNA, 16 nt, Pseudomonas aeruginosa PA01
uuccugcuugucgaug

SEQ ID NO: 3474591 - RNA, 13 nt, Pseudomonas aeruginosa PA01
uuccuggaagccg

SEQ ID NO: 3474592 - RNA, 15 nt, Pseudomonas aeruginosa PA01
uuccuggaccuccgc

SEQ ID NO: 3474593 - RNA, 16 nt, Pseudomonas aeruginosa PA01
uuccugggugccgcga

SEQ ID NO: 3474594 - RNA, 23 nt, Pseudomonas aeruginosa PA01
uuccugguggaacagccgcagcg

SEQ ID NO: 3474595 - RNA, 15 nt, Pseudomonas aeruginosa PA01
uuccuguaccagggg

SEQ ID NO: 3474596 - RNA, 21 nt, Pseudomonas aeruginosa PA01
uuccuuccaggguuuccagca

SEQ ID NO: 3474597 - RNA, 20 nt, Pseudomonas aeruginosa PA01
uuccuugaccacggcgagga

SEQ ID NO: 3474598 - RNA, 20 nt, Pseudomonas aeruginosa PA01
uuccuugaccaucuuuuccu

SEQ ID NO: 3474599 - RNA, 15 nt, Pseudomonas aeruginosa PA01
uuccuugcgcggcag

SEQ ID NO: 3474600 - RNA, 19 nt, Pseudomonas aeruginosa PA01
uucgaaccguggcggccgc

SEQ ID NO: 3474601 - RNA, 17 nt, Pseudomonas aeruginosa PA01
uucgaagauuccgcuga

SEQ ID NO: 3474602 - RNA, 14 nt, Pseudomonas aeruginosa PA01
uucgaauccuccug

SEQ ID NO: 3474603 - RNA, 19 nt, Pseudomonas aeruginosa PA01
uucgacacgcucagccccg

SEQ ID NO: 3474604 - RNA, 15 nt, Pseudomonas aeruginosa PA01
uucggcgaccagccc

SEQ ID NO: 3474605 - RNA, 20 nt, Pseudomonas aeruginosa PA01
uucggcgaccagcccgcgcg

SEQ ID NO: 3474606 - RNA, 21 nt, Pseudomonas aeruginosa PA01
uucggcgagaggucggcgcgc

SEQ ID NO: 3474607 - RNA, 20 nt, Pseudomonas aeruginosa PA01
uucggcgaggaucgccagca

SEQ ID NO: 3474608 - RNA, 17 nt, Pseudomonas aeruginosa PA01
uucggcgaugaccagcu

SEQ ID NO: 3474609 - RNA, 18 nt, Pseudomonas aeruginosa PA01
uucggcgaugaccagcuc

SEQ ID NO: 3474610 - RNA, 11 nt, Pseudomonas aeruginosa PA01
uucggcgaugc

SEQ ID NO: 3474611 - RNA, 21 nt, Pseudomonas aeruginosa PA01
uucggcgcccacuccaaccau

SEQ ID NO: 3474612 - RNA, 17 nt, Pseudomonas aeruginosa PA01
uucggcgcgccggugau

SEQ ID NO: 3474613 - RNA, 21 nt, Pseudomonas aeruginosa PA01
uucggcgcgcggcagcaccag

SEQ ID NO: 3474614 - RNA, 13 nt, Pseudomonas aeruginosa PA01
uucggcggccagc

SEQ ID NO: 3474615 - RNA, 15 nt, Pseudomonas aeruginosa PA01
uucggcggccagcgg

SEQ ID NO: 3474616 - RNA, 14 nt, Pseudomonas aeruginosa PA01
uucggcggccaggc

SEQ ID NO: 3474617 - RNA, 11 nt, Pseudomonas aeruginosa PA01
uucggcggcgc

SEQ ID NO: 3474618 - RNA, 14 nt, Pseudomonas aeruginosa PA01
uucggcgguccagg

SEQ ID NO: 3474619 - RNA, 18 nt, Pseudomonas aeruginosa PA01
uucggcgugcauggccgg

SEQ ID NO: 3474620 - RNA, 18 nt, Pseudomonas aeruginosa PA01
uucggcuguuucaggccg

SEQ ID NO: 3474621 - RNA, 21 nt, Pseudomonas aeruginosa PA01
uucgggaagggaucgaccggu

SEQ ID NO: 3474622 - RNA, 16 nt, Pseudomonas aeruginosa PA01
uucggguagccaugca

SEQ ID NO: 3474623 - RNA, 23 nt, Pseudomonas aeruginosa PA01
uucgguaccugguccgucucguc

SEQ ID NO: 3474624 - RNA, 17 nt, Pseudomonas aeruginosa PA01
uucggucaggcugaucg

SEQ ID NO: 3474625 - RNA, 20 nt, Pseudomonas aeruginosa PA01
uucggucgaucguugccagc

SEQ ID NO: 3474626 - RNA, 16 nt, Pseudomonas aeruginosa PA01
uucgguggcgaccagg

SEQ ID NO: 3474627 - RNA, 19 nt, Pseudomonas aeruginosa PA01
uucguaaugcacgcucaug

SEQ ID NO: 3474628 - RNA, 20 nt, Pseudomonas aeruginosa PA01
uucguccaugcucgccaccu

SEQ ID NO: 3474629 - RNA, 14 nt, Pseudomonas aeruginosa PA01
uucguccggccgcc

SEQ ID NO: 3474630 - RNA, 13 nt, Pseudomonas aeruginosa PA01
uucguccugcugc

SEQ ID NO: 3474631 - RNA, 17 nt, Pseudomonas aeruginosa PA01
uucgucgccacgcccgc

SEQ ID NO: 3474632 - RNA, 15 nt, Pseudomonas aeruginosa PA01
uucgucgcgcaggcg

SEQ ID NO: 3474633 - RNA, 14 nt, Pseudomonas aeruginosa PA01
uucgucggccacca

SEQ ID NO: 3474634 - RNA, 16 nt, Pseudomonas aeruginosa PA01
uucguugaccacgcuc

SEQ ID NO: 3474635 - RNA, 16 nt, Pseudomonas aeruginosa PA01
uucguuggcccagacc

SEQ ID NO: 3474636 - RNA, 18 nt, Pseudomonas aeruginosa PA01
uucguuuucaggcgacgc

SEQ ID NO: 3474637 - RNA, 22 nt, Pseudomonas aeruginosa PA01
uucuauuucccgugcggccuac

SEQ ID NO: 3474638 - RNA, 21 nt, Pseudomonas aeruginosa PA01
uucucauugcgccgccggcuc

SEQ ID NO: 3474639 - RNA, 17 nt, Pseudomonas aeruginosa PA01
uucuccaccgccaccug

SEQ ID NO: 3474640 - RNA, 19 nt, Pseudomonas aeruginosa PA01
uucuccagaaucucccgca

SEQ ID NO: 3474641 - RNA, 16 nt, Pseudomonas aeruginosa PA01
uucuccagguacagcc

SEQ ID NO: 3474642 - RNA, 20 nt, Pseudomonas aeruginosa PA01
uucuccagguacagccgcag

SEQ ID NO: 3474643 - RNA, 19 nt, Pseudomonas aeruginosa PA01
uucucccucgccgaccgcc

SEQ ID NO: 3474644 - RNA, 22 nt, Pseudomonas aeruginosa PA01
uucucccuucagggagaggaag

SEQ ID NO: 3474645 - RNA, 23 nt, Pseudomonas aeruginosa PA01
uucuccggggcccggcaggcagu

SEQ ID NO: 3474646 - RNA, 17 nt, Pseudomonas aeruginosa PA01
uucucgccucccggcuc

SEQ ID NO: 3474647 - RNA, 20 nt, Pseudomonas aeruginosa PA01
uucucgcuccccugccgaac

SEQ ID NO: 3474648 - RNA, 13 nt, Pseudomonas aeruginosa PA01
uucucggccacca

SEQ ID NO: 3474649 - RNA, 14 nt, Pseudomonas aeruginosa PA01
uucucggcgauggc

SEQ ID NO: 3474650 - RNA, 15 nt, Pseudomonas aeruginosa PA01
uucucggucgccgcc

SEQ ID NO: 3474651 - RNA, 18 nt, Pseudomonas aeruginosa PA01
uucucggucgccgccagc

SEQ ID NO: 3474652 - RNA, 19 nt, Pseudomonas aeruginosa PA01
uucucggugaccaccuuga

SEQ ID NO: 3474653 - RNA, 20 nt, Pseudomonas aeruginosa PA01
uucucggugaccaccuugau

SEQ ID NO: 3474654 - RNA, 23 nt, Pseudomonas aeruginosa PA01
uucugcaggcgcuccagacucuc

SEQ ID NO: 3474655 - RNA, 19 nt, Pseudomonas aeruginosa PA01
uucugcagggcggcuucca

SEQ ID NO: 3474656 - RNA, 18 nt, Pseudomonas aeruginosa PA01
uucugccacccggcgccc

SEQ ID NO: 3474657 - RNA, 21 nt, Pseudomonas aeruginosa PA01
uucugccacccggcgcccggc

SEQ ID NO: 3474658 - RNA, 13 nt, Pseudomonas aeruginosa PA01
uucugccgcagac

SEQ ID NO: 3474659 - RNA, 17 nt, Pseudomonas aeruginosa PA01
uucugcuggccgcgcag

SEQ ID NO: 3474660 - RNA, 16 nt, Pseudomonas aeruginosa PA01
uucuggaugcagccgg

SEQ ID NO: 3474661 - RNA, 16 nt, Pseudomonas aeruginosa PA01
uucugggcggccaggu

SEQ ID NO: 3474662 - RNA, 20 nt, Pseudomonas aeruginosa PA01
uucugggucgcgcagggcag

SEQ ID NO: 3474663 - RNA, 21 nt, Pseudomonas aeruginosa PA01
uucugguccaccagcccgcag

SEQ ID NO: 3474664 - RNA, 14 nt, Pseudomonas aeruginosa PA01
uucugucuuguccu

SEQ ID NO: 3474665 - RNA, 19 nt, Pseudomonas aeruginosa PA01
uucuucacccgcagcggca

SEQ ID NO: 3474666 - RNA, 20 nt, Pseudomonas aeruginosa PA01
uucuucacccgcagcggcag

SEQ ID NO: 3474667 - RNA, 23 nt, Pseudomonas aeruginosa PA01
uucuucagcagcgggcguccggc

SEQ ID NO: 3474668 - RNA, 23 nt, Pseudomonas aeruginosa PA01
uucuucaggcaaggucgucucag

SEQ ID NO: 3474669 - RNA, 10 nt, Pseudomonas aeruginosa PA01
uucuucaguu

SEQ ID NO: 3474670 - RNA, 21 nt, Pseudomonas aeruginosa PA01
uucuucccacuccagcgcggg

SEQ ID NO: 3474671 - RNA, 22 nt, Pseudomonas aeruginosa PA01
uucuuccccgccacuuccagca

SEQ ID NO: 3474672 - RNA, 15 nt, Pseudomonas aeruginosa PA01
uucuuccgggaacac

SEQ ID NO: 3474673 - RNA, 14 nt, Pseudomonas aeruginosa PA01
uucuucgccuugcc

SEQ ID NO: 3474674 - RNA, 19 nt, Pseudomonas aeruginosa PA01
uucuucgcgugggccaggg

SEQ ID NO: 3474675 - RNA, 20 nt, Pseudomonas aeruginosa PA01
uucuucgcuaaccggucgca

SEQ ID NO: 3474676 - RNA, 15 nt, Pseudomonas aeruginosa PA01
uucuucguuccugau

SEQ ID NO: 3474677 - RNA, 18 nt, Pseudomonas aeruginosa PA01
uucuucugcugugcgucg

SEQ ID NO: 3474678 - RNA, 17 nt, Pseudomonas aeruginosa PA01
uucuugaugucagcgua

SEQ ID NO: 3474679 - RNA, 12 nt, Pseudomonas aeruginosa PA01
uucuuuucuucc

SEQ ID NO: 3474680 - RNA, 17 nt, Pseudomonas aeruginosa PA01
uugaaaacggcgcccuc

SEQ ID NO: 3474681 - RNA, 14 nt, Pseudomonas aeruginosa PA01
uugaaaccggcgaa

SEQ ID NO: 3474682 - RNA, 15 nt, Pseudomonas aeruginosa PA01
uugaacgcgcgccug

SEQ ID NO: 3474683 - RNA, 16 nt, Pseudomonas aeruginosa PA01
uugaacgcuguagaau

SEQ ID NO: 3474684 - RNA, 19 nt, Pseudomonas aeruginosa PA01
uugaacuggaugucgcugg

SEQ ID NO: 3474685 - RNA, 13 nt, Pseudomonas aeruginosa PA01
uugaagccgccau

SEQ ID NO: 3474686 - RNA, 12 nt, Pseudomonas aeruginosa PA01
uugaagccggcg

SEQ ID NO: 3474687 - RNA, 13 nt, Pseudomonas aeruginosa PA01
uugaagcgggaga

SEQ ID NO: 3474688 - RNA, 16 nt, Pseudomonas aeruginosa PA01
uugaauugcugccacu

SEQ ID NO: 3474689 - RNA, 21 nt, Pseudomonas aeruginosa PA01
uugaccaccaugugcuggcgg

SEQ ID NO: 3474690 - RNA, 17 nt, Pseudomonas aeruginosa PA01
uugaccaccgccaggcu

SEQ ID NO: 3474691 - RNA, 15 nt, Pseudomonas aeruginosa PA01
uugaccagcgcgucg

SEQ ID NO: 3474692 - RNA, 20 nt, Pseudomonas aeruginosa PA01
uugaccaucuuuuccugcug

SEQ ID NO: 3474693 - RNA, 20 nt, Pseudomonas aeruginosa PA01
uugacccgguacagcgccug

SEQ ID NO: 3474694 - RNA, 23 nt, Pseudomonas aeruginosa PA01
uugacccguugcgccucgccgcc

SEQ ID NO: 3474695 - RNA, 15 nt, Pseudomonas aeruginosa PA01
uugacccucugguug

SEQ ID NO: 3474696 - RNA, 17 nt, Pseudomonas aeruginosa PA01
uugaccugcagcgccuc

SEQ ID NO: 3474697 - RNA, 18 nt, Pseudomonas aeruginosa PA01
uugaccugcagcgccucg

SEQ ID NO: 3474698 - RNA, 22 nt, Pseudomonas aeruginosa PA01
uugaccuugcucuucuggcuga

SEQ ID NO: 3474699 - RNA, 17 nt, Pseudomonas aeruginosa PA01
uugaccuugucggccga

SEQ ID NO: 3474700 - RNA, 22 nt, Pseudomonas aeruginosa PA01
uugacgaacaguucgaugggcc

SEQ ID NO: 3474701 - RNA, 18 nt, Pseudomonas aeruginosa PA01
uugacgaaggcggcagcg

SEQ ID NO: 3474702 - RNA, 18 nt, Pseudomonas aeruginosa PA01
uugacgaucuucugcacc

SEQ ID NO: 3474703 - RNA, 21 nt, Pseudomonas aeruginosa PA01
uugacgaugcggcccgccggc

SEQ ID NO: 3474704 - RNA, 21 nt, Pseudomonas aeruginosa PA01
uugacgcggaugcccuggucg

SEQ ID NO: 3474705 - RNA, 23 nt, Pseudomonas aeruginosa PA01
uugacuugacccgacugcagcgg

SEQ ID NO: 3474706 - RNA, 14 nt, Pseudomonas aeruginosa PA01
uugcgcccggcuuc

SEQ ID NO: 3474707 - RNA, 20 nt, Pseudomonas aeruginosa PA01
uugcgccgaauccaggccga

SEQ ID NO: 3474708 - RNA, 23 nt, Pseudomonas aeruginosa PA01
uugcgccgaauccaggccgacga

SEQ ID NO: 3474709 - RNA, 14 nt, Pseudomonas aeruginosa PA01
uugcgccgccucgc

SEQ ID NO: 3474710 - RNA, 16 nt, Pseudomonas aeruginosa PA01
uugcgcgagcaccgcg

SEQ ID NO: 3474711 - RNA, 13 nt, Pseudomonas aeruginosa PA01
uugcgcgccacca

SEQ ID NO: 3474712 - RNA, 17 nt, Pseudomonas aeruginosa PA01
uugcgcgccgccgccgc

SEQ ID NO: 3474713 - RNA, 18 nt, Pseudomonas aeruginosa PA01
uugcgcggcaggccgucc

SEQ ID NO: 3474714 - RNA, 23 nt, Pseudomonas aeruginosa PA01
uugcgcggcagguggcuggccau

SEQ ID NO: 3474715 - RNA, 17 nt, Pseudomonas aeruginosa PA01
uugcgcguggcgucggc

SEQ ID NO: 3474716 - RNA, 14 nt, Pseudomonas aeruginosa PA01
uugcgcuccgacuc

SEQ ID NO: 3474717 - RNA, 16 nt, Pseudomonas aeruginosa PA01
uugcgcuccuuggcug

SEQ ID NO: 3474718 - RNA, 17 nt, Pseudomonas aeruginosa PA01
uugcgcuggccggcaac

SEQ ID NO: 3474719 - RNA, 16 nt, Pseudomonas aeruginosa PA01
uugcgcuggcgcagca

SEQ ID NO: 3474720 - RNA, 19 nt, Pseudomonas aeruginosa PA01
uugcgcuugcgaucgaaga

SEQ ID NO: 3474721 - RNA, 14 nt, Pseudomonas aeruginosa PA01
uugcggcgcaggcg

SEQ ID NO: 3474722 - RNA, 16 nt, Pseudomonas aeruginosa PA01
uugcggcgccgaggcc

SEQ ID NO: 3474723 - RNA, 14 nt, Pseudomonas aeruginosa PA01
uugcgggcgcgccu

SEQ ID NO: 3474724 - RNA, 19 nt, Pseudomonas aeruginosa PA01
uugcgggcgcgccugagcu

SEQ ID NO: 3474725 - RNA, 20 nt, Pseudomonas aeruginosa PA01
uugcggucgauguccugggc

SEQ ID NO: 3474726 - RNA, 22 nt, Pseudomonas aeruginosa PA01
uugcggucgcgcccgcugugcg

SEQ ID NO: 3474727 - RNA, 16 nt, Pseudomonas aeruginosa PA01
uugcguaccagcgcgc

SEQ ID NO: 3474728 - RNA, 15 nt, Pseudomonas aeruginosa PA01
uugcgucccugggcc

SEQ ID NO: 3474729 - RNA, 21 nt, Pseudomonas aeruginosa PA01
uugcucgcaccaggccaggug

SEQ ID NO: 3474730 - RNA, 13 nt, Pseudomonas aeruginosa PA01
uugcucucgcgca

SEQ ID NO: 3474731 - RNA, 13 nt, Pseudomonas aeruginosa PA01
uugcucugggcau

SEQ ID NO: 3474732 - RNA, 23 nt, Pseudomonas aeruginosa PA01
uugcugaccggauguucgaaggc

SEQ ID NO: 3474733 - RNA, 13 nt, Pseudomonas aeruginosa PA01
uugcugccggcgu

SEQ ID NO: 3474734 - RNA, 18 nt, Pseudomonas aeruginosa PA01
uugcugcuugcgcgcggc

SEQ ID NO: 3474735 - RNA, 22 nt, Pseudomonas aeruginosa PA01
uugcuggacaagguuugcgccg

SEQ ID NO: 3474736 - RNA, 15 nt, Pseudomonas aeruginosa PA01
uugcuguagaaugcg

SEQ ID NO: 3474737 - RNA, 18 nt, Pseudomonas aeruginosa PA01
uuggaagaaagacguucc

SEQ ID NO: 3474738 - RNA, 17 nt, Pseudomonas aeruginosa PA01
uuggaaguugccgccag

SEQ ID NO: 3474739 - RNA, 19 nt, Pseudomonas aeruginosa PA01
uuggaaguugccgccagcg

SEQ ID NO: 3474740 - RNA, 13 nt, Pseudomonas aeruginosa PA01
uuggaauugcuga

SEQ ID NO: 3474741 - RNA, 22 nt, Pseudomonas aeruginosa PA01
uuggaauugcugacggcguggc

SEQ ID NO: 3474742 - RNA, 14 nt, Pseudomonas aeruginosa PA01
uuggacagcgucug

SEQ ID NO: 3474743 - RNA, 17 nt, Pseudomonas aeruginosa PA01
uuggauucguugaggcc

SEQ ID NO: 3474744 - RNA, 14 nt, Pseudomonas aeruginosa PA01
uuggcaaagcccgc

SEQ ID NO: 3474745 - RNA, 14 nt, Pseudomonas aeruginosa PA01
uuggcaucgccgcc

SEQ ID NO: 3474746 - RNA, 18 nt, Pseudomonas aeruginosa PA01
uuggcaucgugcuucuca

SEQ ID NO: 3474747 - RNA, 23 nt, Pseudomonas aeruginosa PA01
uuggccaccugcaucacguacgg

SEQ ID NO: 3474748 - RNA, 13 nt, Pseudomonas aeruginosa PA01
uuggccagcagca

SEQ ID NO: 3474749 - RNA, 14 nt, Pseudomonas aeruginosa PA01
uuggccagcagcau

SEQ ID NO: 3474750 - RNA, 19 nt, Pseudomonas aeruginosa PA01
uuggccagcaggccgagcg

SEQ ID NO: 3474751 - RNA, 14 nt, Pseudomonas aeruginosa PA01
uuggccagcaggcg

SEQ ID NO: 3474752 - RNA, 19 nt, Pseudomonas aeruginosa PA01
uuggccagcaggcgccgcg

SEQ ID NO: 3474753 - RNA, 23 nt, Pseudomonas aeruginosa PA01
uuggccagcaggcgccgcgcauc

SEQ ID NO: 3474754 - RNA, 16 nt, Pseudomonas aeruginosa PA01
uuggccagcgccacca

SEQ ID NO: 3474755 - RNA, 15 nt, Pseudomonas aeruginosa PA01
uuggccagcgcggcg

SEQ ID NO: 3474756 - RNA, 16 nt, Pseudomonas aeruginosa PA01
uuggccagcgcggcgc

SEQ ID NO: 3474757 - RNA, 11 nt, Pseudomonas aeruginosa PA01
uuggccaggac

SEQ ID NO: 3474758 - RNA, 20 nt, Pseudomonas aeruginosa PA01
uuggccaggccccaggccgc

SEQ ID NO: 3474759 - RNA, 19 nt, Pseudomonas aeruginosa PA01
uuggccaggcgcuuguccg

SEQ ID NO: 3474760 - RNA, 16 nt, Pseudomonas aeruginosa PA01
uuggccaguuggcccu

SEQ ID NO: 3474761 - RNA, 18 nt, Pseudomonas aeruginosa PA01
uuggccaugggcacgccg

SEQ ID NO: 3474762 - RNA, 14 nt, Pseudomonas aeruginosa PA01
uuggccccgccgag

SEQ ID NO: 3474763 - RNA, 24 nt, Pseudomonas aeruginosa PA01
uuggcccugcgcgcgcguuucagc

SEQ ID NO: 3474764 - RNA, 23 nt, Pseudomonas aeruginosa PA01
uuggccgaaagcacugcggcggu

SEQ ID NO: 3474765 - RNA, 18 nt, Pseudomonas aeruginosa PA01
uuggccgaaucgaacagg

SEQ ID NO: 3474766 - RNA, 22 nt, Pseudomonas aeruginosa PA01
uuggccgaaucgaacagggcga

SEQ ID NO: 3474767 - RNA, 15 nt, Pseudomonas aeruginosa PA01
uuggccgacgccgcu

SEQ ID NO: 3474768 - RNA, 12 nt, Pseudomonas aeruginosa PA01
uuggccgcagca

SEQ ID NO: 3474769 - RNA, 15 nt, Pseudomonas aeruginosa PA01
uuggccgcagcagcg

SEQ ID NO: 3474770 - RNA, 18 nt, Pseudomonas aeruginosa PA01
uuggccgcagcagcggca

SEQ ID NO: 3474771 - RNA, 15 nt, Pseudomonas aeruginosa PA01
uuggccggcugcucc

SEQ ID NO: 3474772 - RNA, 19 nt, Pseudomonas aeruginosa PA01
uuggccgggccgaugcgcg

SEQ ID NO: 3474773 - RNA, 21 nt, Pseudomonas aeruginosa PA01
uuggccgggguauccgggcac

SEQ ID NO: 3474774 - RNA, 18 nt, Pseudomonas aeruginosa PA01
uuggccuccacccgcgaa

SEQ ID NO: 3474775 - RNA, 16 nt, Pseudomonas aeruginosa PA01
uuggccuggcccggcg

SEQ ID NO: 3474776 - RNA, 18 nt, Pseudomonas aeruginosa PA01
uuggccuugaugccggcg

SEQ ID NO: 3474777 - RNA, 20 nt, Pseudomonas aeruginosa PA01
uuggcgaaauugccuccgcu

SEQ ID NO: 3474778 - RNA, 16 nt, Pseudomonas aeruginosa PA01
uuggcgaacaggcagc

SEQ ID NO: 3474779 - RNA, 20 nt, Pseudomonas aeruginosa PA01
uuggcgaaguucccgccgcu

SEQ ID NO: 3474780 - RNA, 23 nt, Pseudomonas aeruginosa PA01
uuggcgaaguucccgccgcucug

SEQ ID NO: 3474781 - RNA, 13 nt, Pseudomonas aeruginosa PA01
uuggcgaggucgc

SEQ ID NO: 3474782 - RNA, 13 nt, Pseudomonas aeruginosa PA01
uuggcgcagguag

SEQ ID NO: 3474783 - RNA, 12 nt, Pseudomonas aeruginosa PA01
uuggcgcccgcc

SEQ ID NO: 3474784 - RNA, 12 nt, Pseudomonas aeruginosa PA01
uuggcgccgucc

SEQ ID NO: 3474785 - RNA, 22 nt, Pseudomonas aeruginosa PA01
uuggcgccucgcaaaggucggc

SEQ ID NO: 3474786 - RNA, 17 nt, Pseudomonas aeruginosa PA01
uuggcgcgggcgaaggc

SEQ ID NO: 3474787 - RNA, 23 nt, Pseudomonas aeruginosa PA01
uuggcgcgggcgaaggccucguc

SEQ ID NO: 3474788 - RNA, 13 nt, Pseudomonas aeruginosa PA01
uuggcggccauca

SEQ ID NO: 3474789 - RNA, 18 nt, Pseudomonas aeruginosa PA01
uuggcgucgaugcgccuc

SEQ ID NO: 3474790 - RNA, 17 nt, Pseudomonas aeruginosa PA01
uuggcgugcucgcgcau

SEQ ID NO: 3474791 - RNA, 23 nt, Pseudomonas aeruginosa PA01
uuggcuggcggggucgcgccggu

SEQ ID NO: 3474792 - RNA, 16 nt, Pseudomonas aeruginosa PA01
uuggcuuccagccagc

SEQ ID NO: 3474793 - RNA, 14 nt, Pseudomonas aeruginosa PA01
uuggcuuccgagca

SEQ ID NO: 3474794 - RNA, 22 nt, Pseudomonas aeruginosa PA01
uugggaucgucgaagcucggcg

SEQ ID NO: 3474795 - RNA, 16 nt, Pseudomonas aeruginosa PA01
uugggauggccagcca

SEQ ID NO: 3474796 - RNA, 13 nt, Pseudomonas aeruginosa PA01
uugggcgccucgc

SEQ ID NO: 3474797 - RNA, 23 nt, Pseudomonas aeruginosa PA01
uugggucagcggguuggcuucca

SEQ ID NO: 3474798 - RNA, 19 nt, Pseudomonas aeruginosa PA01
uugggucguuagcucaguc

SEQ ID NO: 3474799 - RNA, 19 nt, Pseudomonas aeruginosa PA01
uugguaaucguagacgcgc

SEQ ID NO: 3474800 - RNA, 17 nt, Pseudomonas aeruginosa PA01
uugguacagcucgcgca

SEQ ID NO: 3474801 - RNA, 21 nt, Pseudomonas aeruginosa PA01
uuggucaccacguugcgccgc

SEQ ID NO: 3474802 - RNA, 22 nt, Pseudomonas aeruginosa PA01
uuggucacggcgaagcggcccu

SEQ ID NO: 3474803 - RNA, 23 nt, Pseudomonas aeruginosa PA01
uuggucaggccgaccagcgccga

SEQ ID NO: 3474804 - RNA, 13 nt, Pseudomonas aeruginosa PA01
uuggucaggucga

SEQ ID NO: 3474805 - RNA, 19 nt, Pseudomonas aeruginosa PA01
uuggucaggucgacgccgc

SEQ ID NO: 3474806 - RNA, 23 nt, Pseudomonas aeruginosa PA01
uuggucgaguaauuuuguggagu

SEQ ID NO: 3474807 - RNA, 15 nt, Pseudomonas aeruginosa PA01
uuggucugcucggcg

SEQ ID NO: 3474808 - RNA, 21 nt, Pseudomonas aeruginosa PA01
uuugcgccagguagccuggau

SEQ ID NO: 3474809 - RNA, 13 nt, Pseudomonas aeruginosa PA01
uuugggagcagga

SEQ ID NO: 3474810 - RNA, 15 nt, Pseudomonas aeruginosa PA01
uuugggaucggugcu

SEQ ID NO: 3474811 - RNA, 20 nt, Pseudomonas aeruginosa PA01
uuuuaauuuugcuaccagca

SEQ ID NO: 3474812 - RNA, 17 nt, Pseudomonas aeruginosa PA01
uuuuauuccucagugcg

SEQ ID NO: 3474813 - RNA, 16 nt, Pseudomonas aeruginosa PA01
uuuucauccugcggaa

SEQ ID NO: 3474814 - RNA, 16 nt, Pseudomonas aeruginosa PA01
uuuuccugcaucuucu

SEQ ID NO: 3474815 - RNA, 13 nt, Pseudomonas aeruginosa PA01
uuuucgaaaauaa

SEQ ID NO: 3474816 - RNA, 17 nt, Pseudomonas aeruginosa PA01
uuuucguucgcuguucu

SEQ ID NO: 3474817 - RNA, 10 nt, Pseudomonas aeruginosa PA01
uuuucuuccg

SEQ ID NO: 3474818 - RNA, 16 nt, Pseudomonas aeruginosa PA01
uuuuucauggccuggc

SEQ ID NO: 3474819 - RNA, 18 nt, Pseudomonas aeruginosa PA01
uuuuucaugggcggggug

SEQ ID NO: 3474820 - RNA, 15 nt, Pseudomonas aeruginosa PA01
uuuuucaugguccgu

SEQ ID NO: 3474821 - RNA, 21 nt, Pseudomonas aeruginosa PA01
uuuuucauuggcgcgucggug

SEQ ID NO: 3474822 - RNA, 14 nt, Pseudomonas aeruginosa PA01
uuuuucauuuccuc

SEQ ID NO: 3474823 - RNA, 17 nt, Pseudomonas aeruginosa PA01
uuuuuggcaaaccuccc

SEQ ID NO: 3474824 - RNA, 12 nt, Pseudomonas aeruginosa PA01
uuuuuucagccu

SEQ ID NO: 3474825 - RNA, 11 nt, Pseudomonas aeruginosa PA01
uuuuuuugccu

SEQ ID NO: 3474826 - RNA, 23 nt, Pseudomonas aeruginosa PA01
cgagcaucugccgggcgcgcugg

SEQ ID NO: 3474827 - RNA, 22 nt, Pseudomonas aeruginosa PA01
cgagcaucuucuucaaccgcug

SEQ ID NO: 3474828 - RNA, 19 nt, Pseudomonas aeruginosa PA01
cgagcaugccgaggaacgc

SEQ ID NO: 3474829 - RNA, 20 nt, Pseudomonas aeruginosa PA01
cgagcaugccgaggaacgcc

SEQ ID NO: 3474830 - RNA, 15 nt, Pseudomonas aeruginosa PA01
cgagcaugcgggcga

SEQ ID NO: 3474831 - RNA, 19 nt, Pseudomonas aeruginosa PA01
cgagcaugcucacugcgag

SEQ ID NO: 3474832 - RNA, 22 nt, Pseudomonas aeruginosa PA01
cgagcauguaggcgcaccaggc

SEQ ID NO: 3474833 - RNA, 15 nt, Pseudomonas aeruginosa PA01
cgagcaugucgcuga

SEQ ID NO: 3474834 - RNA, 22 nt, Pseudomonas aeruginosa PA01
cgagcauuccgacaaggagcgc

SEQ ID NO: 3474835 - RNA, 19 nt, Pseudomonas aeruginosa PA01
cgagcauuccucagcgccg

SEQ ID NO: 3474836 - RNA, 20 nt, Pseudomonas aeruginosa PA01
cgagcauuccucagcgccgg

SEQ ID NO: 3474837 - RNA, 20 nt, Pseudomonas aeruginosa PA01
cgagccacggauaugcgccg

SEQ ID NO: 3474838 - RNA, 22 nt, Pseudomonas aeruginosa PA01
cgagccacggauaugcgccgcc

SEQ ID NO: 3474839 - RNA, 23 nt, Pseudomonas aeruginosa PA01
cgagccacggauaugcgccgcca

SEQ ID NO: 3474840 - RNA, 21 nt, Pseudomonas aeruginosa PA01
cgagccacucgugcaacggca

SEQ ID NO: 3474841 - RNA, 15 nt, Pseudomonas aeruginosa PA01
cgagccagcccagcg

SEQ ID NO: 3474842 - RNA, 16 nt, Pseudomonas aeruginosa PA01
cgagccagcccagcgg

SEQ ID NO: 3474843 - RNA, 19 nt, Pseudomonas aeruginosa PA01
cgagccagcccagcggcgc

SEQ ID NO: 3474844 - RNA, 14 nt, Pseudomonas aeruginosa PA01
cgagccagccgcgg

SEQ ID NO: 3474845 - RNA, 21 nt, Pseudomonas aeruginosa PA01
cgagccagccgcggaucaccu

SEQ ID NO: 3474846 - RNA, 22 nt, Pseudomonas aeruginosa PA01
cgagccagccguggcaggcgcc

SEQ ID NO: 3474847 - RNA, 21 nt, Pseudomonas aeruginosa PA01
cgagccaggcguauucggcga

SEQ ID NO: 3474848 - RNA, 22 nt, Pseudomonas aeruginosa PA01
cgagccaggcguauucggcgac

SEQ ID NO: 3474849 - RNA, 21 nt, Pseudomonas aeruginosa PA01
cgagccagguacggaugccgc

SEQ ID NO: 3474850 - RNA, 20 nt, Pseudomonas aeruginosa PA01
cgagccagguuuccggcagc

SEQ ID NO: 3474851 - RNA, 21 nt, Pseudomonas aeruginosa PA01
cgagccagguuuccggcagca

SEQ ID NO: 3474852 - RNA, 13 nt, Pseudomonas aeruginosa PA01
cgagcccagcggc

SEQ ID NO: 3474853 - RNA, 16 nt, Pseudomonas aeruginosa PA01
cgagcccagcggcagg

SEQ ID NO: 3474854 - RNA, 20 nt, Pseudomonas aeruginosa PA01
cgagcccaggcagaucgcgc

SEQ ID NO: 3474855 - RNA, 21 nt, Pseudomonas aeruginosa PA01
cgagcccccauaccgccucgg

SEQ ID NO: 3474856 - RNA, 15 nt, Pseudomonas aeruginosa PA01
cgagcccgagugcgc

SEQ ID NO: 3474857 - RNA, 16 nt, Pseudomonas aeruginosa PA01
cgagcccgagugcgcc

SEQ ID NO: 3474858 - RNA, 17 nt, Pseudomonas aeruginosa PA01
cgagcccgagugcgccc

SEQ ID NO: 3474859 - RNA, 22 nt, Pseudomonas aeruginosa PA01
cgagcccgagugcgcccagcag

SEQ ID NO: 3474860 - RNA, 14 nt, Pseudomonas aeruginosa PA01
cgagcccuggucga

SEQ ID NO: 3474861 - RNA, 16 nt, Pseudomonas aeruginosa PA01
cgagcccuggucgaca

SEQ ID NO: 3474862 - RNA, 17 nt, Pseudomonas aeruginosa PA01
cgagcccuugcgcggcg

SEQ ID NO: 3474863 - RNA, 15 nt, Pseudomonas aeruginosa PA01
cgagccgacauccug

SEQ ID NO: 3474864 - RNA, 17 nt, Pseudomonas aeruginosa PA01
cgagccgacauccuguc

SEQ ID NO: 3474865 - RNA, 12 nt, Pseudomonas aeruginosa PA01
cgagccgagcag

SEQ ID NO: 3474866 - RNA, 15 nt, Pseudomonas aeruginosa PA01
cgagccgagcaggcc

SEQ ID NO: 3474867 - RNA, 16 nt, Pseudomonas aeruginosa PA01
cgagccgagcaggcca

SEQ ID NO: 3474868 - RNA, 17 nt, Pseudomonas aeruginosa PA01
cgagccgaucaccagca

SEQ ID NO: 3474869 - RNA, 12 nt, Pseudomonas aeruginosa PA01
cgagccgccggg

SEQ ID NO: 3474870 - RNA, 13 nt, Pseudomonas aeruginosa PA01
cgagccgccgggg

SEQ ID NO: 3474871 - RNA, 18 nt, Pseudomonas aeruginosa PA01
cgagccgccggggaagcu

SEQ ID NO: 3474872 - RNA, 20 nt, Pseudomonas aeruginosa PA01
cgagccgccggggaagcugc

SEQ ID NO: 3474873 - RNA, 22 nt, Pseudomonas aeruginosa PA01
cgagccgccggggaagcugccu

SEQ ID NO: 3474874 - RNA, 21 nt, Pseudomonas aeruginosa PA01
cgagccgcgacgcgaccuccg

SEQ ID NO: 3474875 - RNA, 15 nt, Pseudomonas aeruginosa PA01
cgagccgcgacggcu

SEQ ID NO: 3474876 - RNA, 11 nt, Pseudomonas aeruginosa PA01
cgagccgcgca

SEQ ID NO: 3474877 - RNA, 14 nt, Pseudomonas aeruginosa PA01
cgagccgcgcagca

SEQ ID NO: 3474878 - RNA, 14 nt, Pseudomonas aeruginosa PA01
cgagccgcugcaug

SEQ ID NO: 3474879 - RNA, 20 nt, Pseudomonas aeruginosa PA01
cgagccgcuuggagcgggcg

SEQ ID NO: 3474880 - RNA, 21 nt, Pseudomonas aeruginosa PA01
cgagccgcuuggagcgggcgc

SEQ ID NO: 3474881 - RNA, 14 nt, Pseudomonas aeruginosa PA01
cgagccggacggcg

SEQ ID NO: 3474882 - RNA, 20 nt, Pseudomonas aeruginosa PA01
cgagccggacggcggcguca

SEQ ID NO: 3474883 - RNA, 19 nt, Pseudomonas aeruginosa PA01
cgagccggcauccuguggc

SEQ ID NO: 3474884 - RNA, 18 nt, Pseudomonas aeruginosa PA01
cgagccggcgcaucagcg

SEQ ID NO: 3474885 - RNA, 20 nt, Pseudomonas aeruginosa PA01
cgagccggcugaugcccggg

SEQ ID NO: 3474886 - RNA, 13 nt, Pseudomonas aeruginosa PA01
cgagccggcugcc

SEQ ID NO: 3474887 - RNA, 18 nt, Pseudomonas aeruginosa PA01
cgagccguccugcggccg

SEQ ID NO: 3474888 - RNA, 15 nt, Pseudomonas aeruginosa PA01
cgagccguuccaggc

SEQ ID NO: 3474889 - RNA, 17 nt, Pseudomonas aeruginosa PA01
cgagccguuccaggcgg

SEQ ID NO: 3474890 - RNA, 13 nt, Pseudomonas aeruginosa PA01
cgagccuggccag

SEQ ID NO: 3474891 - RNA, 14 nt, Pseudomonas aeruginosa PA01
cgagccuggccagg

SEQ ID NO: 3474892 - RNA, 15 nt, Pseudomonas aeruginosa PA01
cgagccuggccaggc

SEQ ID NO: 3474893 - RNA, 16 nt, Pseudomonas aeruginosa PA01
cgagccuggccaggcg

SEQ ID NO: 3474894 - RNA, 17 nt, Pseudomonas aeruginosa PA01
cgagccuggccaggcgc

SEQ ID NO: 3474895 - RNA, 20 nt, Pseudomonas aeruginosa PA01
cgagccuggccaggcgcucc

SEQ ID NO: 3474896 - RNA, 23 nt, Pseudomonas aeruginosa PA01
gugggaagagcaucucgccggca

SEQ ID NO: 3474897 - RNA, 23 nt, Pseudomonas aeruginosa PA01
gugggacaggaagagcaggcgga

SEQ ID NO: 3474898 - RNA, 15 nt, Pseudomonas aeruginosa PA01
gugggacugagccgc

SEQ ID NO: 3474899 - RNA, 15 nt, Pseudomonas aeruginosa PA01
gugggaguccaggua

SEQ ID NO: 3474900 - RNA, 16 nt, Pseudomonas aeruginosa PA01
gugggcaacaggccga

SEQ ID NO: 3474901 - RNA, 18 nt, Pseudomonas aeruginosa PA01
gugggcagcagcgaacgc

SEQ ID NO: 3474902 - RNA, 19 nt, Pseudomonas aeruginosa PA01
gugggcaugcucggccagg

SEQ ID NO: 3474903 - RNA, 23 nt, Pseudomonas aeruginosa PA01
gugggccaccaucagguagauga

SEQ ID NO: 3474904 - RNA, 20 nt, Pseudomonas aeruginosa PA01
gugggccagcaggccgauca

SEQ ID NO: 3474905 - RNA, 11 nt, Pseudomonas aeruginosa PA01
gugggccaggg

SEQ ID NO: 3474906 - RNA, 12 nt, Pseudomonas aeruginosa PA01
gugggccaggga

SEQ ID NO: 3474907 - RNA, 12 nt, Pseudomonas aeruginosa PA01
gugggccggcgc

SEQ ID NO: 3474908 - RNA, 15 nt, Pseudomonas aeruginosa PA01
gugggcgaggcgcuc

SEQ ID NO: 3474909 - RNA, 16 nt, Pseudomonas aeruginosa PA01
gugggcgagggcgcgc

SEQ ID NO: 3474910 - RNA, 13 nt, Pseudomonas aeruginosa PA01
gugggcgccgccg

SEQ ID NO: 3474911 - RNA, 14 nt, Pseudomonas aeruginosa PA01
gugggcgccgccgg

SEQ ID NO: 3474912 - RNA, 17 nt, Pseudomonas aeruginosa PA01
gugggcgccgccgguga

SEQ ID NO: 3474913 - RNA, 14 nt, Pseudomonas aeruginosa PA01
gugggcgccggcgc

SEQ ID NO: 3474914 - RNA, 13 nt, Pseudomonas aeruginosa PA01
gugggcggccggc

SEQ ID NO: 3474915 - RNA, 15 nt, Pseudomonas aeruginosa PA01
gugggcggccggcca

SEQ ID NO: 3474916 - RNA, 14 nt, Pseudomonas aeruginosa PA01
gugggcggucggcg

SEQ ID NO: 3474917 - RNA, 13 nt, Pseudomonas aeruginosa PA01
gugggcguagagc

SEQ ID NO: 3474918 - RNA, 24 nt, Pseudomonas aeruginosa PA01
gugggcgucgcuauggugagguug

SEQ ID NO: 3474919 - RNA, 15 nt, Pseudomonas aeruginosa PA01
gugggcuccagcggg

SEQ ID NO: 3474920 - RNA, 23 nt, Pseudomonas aeruginosa PA01
gugggcucuaugcaauggggcgc

SEQ ID NO: 3474921 - RNA, 13 nt, Pseudomonas aeruginosa PA01
gugggcuucgccg

SEQ ID NO: 3474922 - RNA, 23 nt, Pseudomonas aeruginosa PA01
gugggcuucgccgccgcgcgcgc

SEQ ID NO: 3474923 - RNA, 18 nt, Pseudomonas aeruginosa PA01
guggggaagacggccagg

SEQ ID NO: 3474924 - RNA, 12 nt, Pseudomonas aeruginosa PA01
guggggccagaa

SEQ ID NO: 3474925 - RNA, 14 nt, Pseudomonas aeruginosa PA01
guggggccgccgau

SEQ ID NO: 3474926 - RNA, 22 nt, Pseudomonas aeruginosa PA01
guggggccgccgaugccgacgu

SEQ ID NO: 3474927 - RNA, 22 nt, Pseudomonas aeruginosa PA01
guggggcgccggcucgcccagc

SEQ ID NO: 3474928 - RNA, 15 nt, Pseudomonas aeruginosa PA01
guggguagccauggc

SEQ ID NO: 3474929 - RNA, 11 nt, Pseudomonas aeruginosa PA01
guggguagccg

SEQ ID NO: 3474930 - RNA, 15 nt, Pseudomonas aeruginosa PA01
guggguaggccaggc

SEQ ID NO: 3474931 - RNA, 16 nt, Pseudomonas aeruginosa PA01
guggguaggccaggca

SEQ ID NO: 3474932 - RNA, 21 nt, Pseudomonas aeruginosa PA01
gugggucacggugaggaccug

SEQ ID NO: 3474933 - RNA, 12 nt, Pseudomonas aeruginosa PA01
gugggugccggg

SEQ ID NO: 3474934 - RNA, 16 nt, Pseudomonas aeruginosa PA01
gugguaccgcugcgug

SEQ ID NO: 3474935 - RNA, 14 nt, Pseudomonas aeruginosa PA01
gugguagagcggca

SEQ ID NO: 3474936 - RNA, 19 nt, Pseudomonas aeruginosa PA01
gugguaucggcgcucaccg

SEQ ID NO: 3474937 - RNA, 15 nt, Pseudomonas aeruginosa PA01
guggucagcaccagg

SEQ ID NO: 3474938 - RNA, 18 nt, Pseudomonas aeruginosa PA01
guggucagcaccagggcc

SEQ ID NO: 3474939 - RNA, 13 nt, Pseudomonas aeruginosa PA01
guggucagccagc

SEQ ID NO: 3474940 - RNA, 16 nt, Pseudomonas aeruginosa PA01
guggucagccagccga

SEQ ID NO: 3474941 - RNA, 13 nt, Pseudomonas aeruginosa PA01
guggucaggcgcc

SEQ ID NO: 3474942 - RNA, 18 nt, Pseudomonas aeruginosa PA01
guggucaggcgccaggac

SEQ ID NO: 3474943 - RNA, 12 nt, Pseudomonas aeruginosa PA01
gugguccgccag

SEQ ID NO: 3474944 - RNA, 14 nt, Pseudomonas aeruginosa PA01
gugguccgccagca

SEQ ID NO: 3474945 - RNA, 15 nt, Pseudomonas aeruginosa PA01
gugguccgccagcag

SEQ ID NO: 3474946 - RNA, 18 nt, Pseudomonas aeruginosa PA01
gugguccgccagcaggcg

SEQ ID NO: 3474947 - RNA, 21 nt, Pseudomonas aeruginosa PA01
gugguccgccagcaggcguug

SEQ ID NO: 3474948 - RNA, 15 nt, Pseudomonas aeruginosa PA01
guggucgaccaggcg

SEQ ID NO: 3474949 - RNA, 23 nt, Pseudomonas aeruginosa PA01
guggucgaucuccuccucggcgg

SEQ ID NO: 3474950 - RNA, 18 nt, Pseudomonas aeruginosa PA01
guggucgaugcccaccug

SEQ ID NO: 3474951 - RNA, 14 nt, Pseudomonas aeruginosa PA01
guggucgcagcucc

SEQ ID NO: 3474952 - RNA, 15 nt, Pseudomonas aeruginosa PA01
guggucgcagcucca

SEQ ID NO: 3474953 - RNA, 20 nt, Pseudomonas aeruginosa PA01
guggucgcagcuccagcgga

SEQ ID NO: 3474954 - RNA, 20 nt, Pseudomonas aeruginosa PA01
guggucgccguccaccaagc

SEQ ID NO: 3474955 - RNA, 15 nt, Pseudomonas aeruginosa PA01
guggucgcgcaggcg

SEQ ID NO: 3474956 - RNA, 12 nt, Pseudomonas aeruginosa PA01
guggucgcgcuc

SEQ ID NO: 3474957 - RNA, 13 nt, Pseudomonas aeruginosa PA01
guggucguggcgg

SEQ ID NO: 3474958 - RNA, 19 nt, Pseudomonas aeruginosa PA01
guggucguugcgcgccagc

SEQ ID NO: 3474959 - RNA, 12 nt, Pseudomonas aeruginosa PA01
guggucugcacg

SEQ ID NO: 3474960 - RNA, 15 nt, Pseudomonas aeruginosa PA01
guggucuucagcaca

SEQ ID NO: 3474961 - RNA, 23 nt, Pseudomonas aeruginosa PA01
guggucuuccucggugucggcca

SEQ ID NO: 3474962 - RNA, 13 nt, Pseudomonas aeruginosa PA01
guggugauccgca

SEQ ID NO: 3474963 - RNA, 13 nt, Pseudomonas aeruginosa PA01
gugguggcgggga

SEQ ID NO: 3474964 - RNA, 20 nt, Pseudomonas aeruginosa PA01
gugguggcggggaacagcau

SEQ ID NO: 3474965 - RNA, 16 nt, Pseudomonas aeruginosa PA01
gugguguagcgcaggu

SEQ ID NO: 3474966 - RNA, 17 nt, Pseudomonas aeruginosa PA01
gugguguagcgcagguu

SEQ ID NO: 3474967 - RNA, 14 nt, Pseudomonas aeruginosa PA01
gugguugaggcgcu

SEQ ID NO: 3474968 - RNA, 14 nt, Pseudomonas aeruginosa PA01
guguaccacgcccg

SEQ ID NO: 3474969 - RNA, 17 nt, Pseudomonas aeruginosa PA01
guguaccacgcccgcgg

SEQ ID NO: 3474970 - RNA, 20 nt, Pseudomonas aeruginosa PA01
guguacccagggugcgccgg

SEQ ID NO: 3474971 - RNA, 23 nt, Pseudomonas aeruginosa PA01
guguagaucaggcuggcguacuu

SEQ ID NO: 3474972 - RNA, 16 nt, Pseudomonas aeruginosa PA01
guguagcccgcauccc

SEQ ID NO: 3474973 - RNA, 19 nt, Pseudomonas aeruginosa PA01
guguagccgagcacgcacu

SEQ ID NO: 3474974 - RNA, 18 nt, Pseudomonas aeruginosa PA01
guguagcugaggccguag

SEQ ID NO: 3474975 - RNA, 14 nt, Pseudomonas aeruginosa PA01
guguagcugcagcg

SEQ ID NO: 3474976 - RNA, 17 nt, Pseudomonas aeruginosa PA01
guguagcugcagcgccc

SEQ ID NO: 3474977 - RNA, 16 nt, Pseudomonas aeruginosa PA01
guguagguauccgccg

SEQ ID NO: 3474978 - RNA, 19 nt, Pseudomonas aeruginosa PA01
guguagguauccgccggcc

SEQ ID NO: 3474979 - RNA, 12 nt, Pseudomonas aeruginosa PA01
gugucaggccga

SEQ ID NO: 3474980 - RNA, 13 nt, Pseudomonas aeruginosa PA01
guguccaccacca

SEQ ID NO: 3474981 - RNA, 15 nt, Pseudomonas aeruginosa PA01
guguccaccaccagc

SEQ ID NO: 3474982 - RNA, 21 nt, Pseudomonas aeruginosa PA01
guguccaccaccagcaggccc

SEQ ID NO: 3474983 - RNA, 13 nt, Pseudomonas aeruginosa PA01
guguccgauucuu

SEQ ID NO: 3474984 - RNA, 12 nt, Pseudomonas aeruginosa PA01
guguccgcggug

SEQ ID NO: 3474985 - RNA, 23 nt, Pseudomonas aeruginosa PA01
gugucgacgacgaaaggccgcgc

SEQ ID NO: 3474986 - RNA, 14 nt, Pseudomonas aeruginosa PA01
gugucgagggcgaa

SEQ ID NO: 3474987 - RNA, 21 nt, Pseudomonas aeruginosa PA01
gugucgccaucagugacaucc

SEQ ID NO: 3474988 - RNA, 20 nt, Pseudomonas aeruginosa PA01
gugucgcgaacucggcgccg

SEQ ID NO: 3474989 - RNA, 11 nt, Pseudomonas aeruginosa PA01
gugucggccaa

SEQ ID NO: 3474990 - RNA, 16 nt, Pseudomonas aeruginosa PA01
gugucggccgccaggg

SEQ ID NO: 3474991 - RNA, 14 nt, Pseudomonas aeruginosa PA01
gugucggcgaucag

SEQ ID NO: 3474992 - RNA, 16 nt, Pseudomonas aeruginosa PA01
gugucgguauggaaga

SEQ ID NO: 3474993 - RNA, 22 nt, Pseudomonas aeruginosa PA01
gugucggugaugcgucgcacca

SEQ ID NO: 3474994 - RNA, 14 nt, Pseudomonas aeruginosa PA01
gugucgugccgaca

SEQ ID NO: 3474995 - RNA, 19 nt, Pseudomonas aeruginosa PA01
gugucguuguugccgcgca

SEQ ID NO: 3474996 - RNA, 22 nt, Pseudomonas aeruginosa PA01
gugucguuguugccgcgcacca

SEQ ID NO: 3474997 - RNA, 14 nt, Pseudomonas aeruginosa PA01
gugugaucaccagc

SEQ ID NO: 3474998 - RNA, 13 nt, Pseudomonas aeruginosa PA01
gugugcagcaggg

SEQ ID NO: 3474999 - RNA, 21 nt, Pseudomonas aeruginosa PA01
gugugccgcccugcucuugcc

SEQ ID NO: 3475000 - RNA, 17 nt, Pseudomonas aeruginosa PA01
gugugccggccaugcag

SEQ ID NO: 3475001 - RNA, 21 nt, Pseudomonas aeruginosa PA01
gugugccggccaugcaggcca

SEQ ID NO: 3475002 - RNA, 15 nt, Pseudomonas aeruginosa PA01
gugugccgucaggca

SEQ ID NO: 3475003 - RNA, 15 nt, Pseudomonas aeruginosa PA01
guguggccugggcgc

SEQ ID NO: 3475004 - RNA, 20 nt, Pseudomonas aeruginosa PA01
guguggcgaaacuccagcag

SEQ ID NO: 3475005 - RNA, 21 nt, Pseudomonas aeruginosa PA01
guguggcgaaacuccagcagg

SEQ ID NO: 3475006 - RNA, 20 nt, Pseudomonas aeruginosa PA01
guguucccggaucagcucgc

SEQ ID NO: 3475007 - RNA, 16 nt, Pseudomonas aeruginosa PA01
guguucggccccggcc

SEQ ID NO: 3475008 - RNA, 21 nt, Pseudomonas aeruginosa PA01
guguucggcggcgugcagggu

SEQ ID NO: 3475009 - RNA, 23 nt, Pseudomonas aeruginosa PA01
guguucgucgaucagguccuggc

SEQ ID NO: 3475010 - RNA, 14 nt, Pseudomonas aeruginosa PA01
guguugaucaccgc

SEQ ID NO: 3475011 - RNA, 16 nt, Pseudomonas aeruginosa PA01
guguugaucaccgcgg

SEQ ID NO: 3475012 - RNA, 22 nt, Pseudomonas aeruginosa PA01
guguugaucgccgcgccgccga

SEQ ID NO: 3475013 - RNA, 12 nt, Pseudomonas aeruginosa PA01
guguugcgccgc

SEQ ID NO: 3475014 - RNA, 16 nt, Pseudomonas aeruginosa PA01
guguuggaaccgaggg

SEQ ID NO: 3475015 - RNA, 19 nt, Pseudomonas aeruginosa PA01
guguuggucaggcccugcu

SEQ ID NO: 3475016 - RNA, 15 nt, Pseudomonas aeruginosa PA01
guguugucgcggcug

SEQ ID NO: 3475017 - RNA, 11 nt, Pseudomonas aeruginosa PA01
guguuguucgc

SEQ ID NO: 3475018 - RNA, 18 nt, Pseudomonas aeruginosa PA01
guguuuccucagcucugu

SEQ ID NO: 3475019 - RNA, 17 nt, Pseudomonas aeruginosa PA01
guuaacaguugagcugu

SEQ ID NO: 3475020 - RNA, 15 nt, Pseudomonas aeruginosa PA01
guuaaugccgguggg

SEQ ID NO: 3475021 - RNA, 14 nt, Pseudomonas aeruginosa PA01
guuaccaggucugu

SEQ ID NO: 3475022 - RNA, 16 nt, Pseudomonas aeruginosa PA01
guuaccggcgaccacc

SEQ ID NO: 3475023 - RNA, 13 nt, Pseudomonas aeruginosa PA01
guuaccguccgcg

SEQ ID NO: 3475024 - RNA, 13 nt, Pseudomonas aeruginosa PA01
guuaccuuggcca

SEQ ID NO: 3475025 - RNA, 17 nt, Pseudomonas aeruginosa PA01
guuacgacaucgacgcc

SEQ ID NO: 3475026 - RNA, 22 nt, Pseudomonas aeruginosa PA01
guuacgcgcagcgguaguucag

SEQ ID NO: 3475027 - RNA, 12 nt, Pseudomonas aeruginosa PA01
guuagccggcga

SEQ ID NO: 3475028 - RNA, 20 nt, Pseudomonas aeruginosa PA01
guuagccggcgaucauccag

SEQ ID NO: 3475029 - RNA, 15 nt, Pseudomonas aeruginosa PA01
guuauccgccgccga

SEQ ID NO: 3475030 - RNA, 15 nt, Pseudomonas aeruginosa PA01
guuauccgccgccgg

SEQ ID NO: 3475031 - RNA, 16 nt, Pseudomonas aeruginosa PA01
guuauccgccgccuau

SEQ ID NO: 3475032 - RNA, 20 nt, Pseudomonas aeruginosa PA01
guuauccgccguggaacgca

SEQ ID NO: 3475033 - RNA, 18 nt, Pseudomonas aeruginosa PA01
guuaugcgcccuaccugu

SEQ ID NO: 3475034 - RNA, 14 nt, Pseudomonas aeruginosa PA01
guuauggccgaccc

SEQ ID NO: 3475035 - RNA, 12 nt, Pseudomonas aeruginosa PA01
guuauucgcccu

SEQ ID NO: 3475036 - RNA, 15 nt, Pseudomonas aeruginosa PA01
guuauucgcccuacc

SEQ ID NO: 3475037 - RNA, 23 nt, Pseudomonas aeruginosa PA01
guucaccgaggguuuccaccugu

SEQ ID NO: 3475038 - RNA, 12 nt, Pseudomonas aeruginosa PA01
guucaccgcgca

SEQ ID NO: 3475039 - RNA, 14 nt, Pseudomonas aeruginosa PA01
guucaccgcggccu

SEQ ID NO: 3475040 - RNA, 20 nt, Pseudomonas aeruginosa PA01
guucaccguccacuggccca

SEQ ID NO: 3475041 - RNA, 18 nt, Pseudomonas aeruginosa PA01
guucaccguggcgcuggc

SEQ ID NO: 3475042 - RNA, 21 nt, Pseudomonas aeruginosa PA01
guucacgccuggcggcuggcg

SEQ ID NO: 3475043 - RNA, 20 nt, Pseudomonas aeruginosa PA01
guucagagggugaggcgcau

SEQ ID NO: 3475044 - RNA, 20 nt, Pseudomonas aeruginosa PA01
guucagcagcaugccgcucu

SEQ ID NO: 3475045 - RNA, 21 nt, Pseudomonas aeruginosa PA01
guucagcagcggcacccggcu

SEQ ID NO: 3475046 - RNA, 14 nt, Pseudomonas aeruginosa PA01
guucagcaggucgc

SEQ ID NO: 3475047 - RNA, 21 nt, Pseudomonas aeruginosa PA01
guucagcaggucgcggcccca

SEQ ID NO: 3475048 - RNA, 23 nt, Pseudomonas aeruginosa PA01
guucagcaggucgcggccccagc

SEQ ID NO: 3475049 - RNA, 14 nt, Pseudomonas aeruginosa PA01
guucagcccgccgu

SEQ ID NO: 3475050 - RNA, 18 nt, Pseudomonas aeruginosa PA01
guucagcccgccgugcgc

SEQ ID NO: 3475051 - RNA, 18 nt, Pseudomonas aeruginosa PA01
guucagccgguacugcgc

SEQ ID NO: 3475052 - RNA, 20 nt, Pseudomonas aeruginosa PA01
guucagcgccucgcgggucu

SEQ ID NO: 3475053 - RNA, 19 nt, Pseudomonas aeruginosa PA01
guucagcgcgaaggccacg

SEQ ID NO: 3475054 - RNA, 20 nt, Pseudomonas aeruginosa PA01
guucagcgcgcucgcugucg

SEQ ID NO: 3475055 - RNA, 23 nt, Pseudomonas aeruginosa PA01
guucagcgcggagcguccaccag

SEQ ID NO: 3475056 - RNA, 23 nt, Pseudomonas aeruginosa PA01
guucagcggcacggucauggcca

SEQ ID NO: 3475057 - RNA, 16 nt, Pseudomonas aeruginosa PA01
guucagcggcgcgucg

SEQ ID NO: 3475058 - RNA, 19 nt, Pseudomonas aeruginosa PA01
guucagcggcgcgucgacc

SEQ ID NO: 3475059 - RNA, 23 nt, Pseudomonas aeruginosa PA01
guucagcggcgcgucgaccacga

SEQ ID NO: 3475060 - RNA, 17 nt, Pseudomonas aeruginosa PA01
guucaggccggcgccgc

SEQ ID NO: 3475061 - RNA, 13 nt, Pseudomonas aeruginosa PA01
guucaggcgcgga

SEQ ID NO: 3475062 - RNA, 18 nt, Pseudomonas aeruginosa PA01
guucagggcgagcagggc

SEQ ID NO: 3475063 - RNA, 23 nt, Pseudomonas aeruginosa PA01
guucagggucagguugccgguga

SEQ ID NO: 3475064 - RNA, 20 nt, Pseudomonas aeruginosa PA01
guucaggugaaaagcgcuga

SEQ ID NO: 3475065 - RNA, 22 nt, Pseudomonas aeruginosa PA01
guucaggugcuggacucgcgcc

SEQ ID NO: 3475066 - RNA, 17 nt, Pseudomonas aeruginosa PA01
guucagguucagggugg

SEQ ID NO: 3475067 - RNA, 17 nt, Pseudomonas aeruginosa PA01
guucagucggccaggcg

SEQ ID NO: 3475068 - RNA, 15 nt, Pseudomonas aeruginosa PA01
guucagugccagcag

SEQ ID NO: 3475069 - RNA, 15 nt, Pseudomonas aeruginosa PA01
guucaguucagccgg

SEQ ID NO: 3475070 - RNA, 18 nt, Pseudomonas aeruginosa PA01
guucaguucugggcggcc

SEQ ID NO: 3475071 - RNA, 16 nt, Pseudomonas aeruginosa PA01
guucaucgagcggcgg

SEQ ID NO: 3475072 - RNA, 23 nt, Pseudomonas aeruginosa PA01
guucaucgagcggcggccgucgc

SEQ ID NO: 3475073 - RNA, 18 nt, Pseudomonas aeruginosa PA01
guucaucgccgccaggca

SEQ ID NO: 3475074 - RNA, 19 nt, Pseudomonas aeruginosa PA01
guucaucgccgccaggcag

SEQ ID NO: 3475075 - RNA, 20 nt, Pseudomonas aeruginosa PA01
guucaucgccgccaggcaga

SEQ ID NO: 3475076 - RNA, 16 nt, Pseudomonas aeruginosa PA01
guuccaccaggcgucg

SEQ ID NO: 3475077 - RNA, 22 nt, Pseudomonas aeruginosa PA01
guuccacgggucgcagccgagc

SEQ ID NO: 3475078 - RNA, 19 nt, Pseudomonas aeruginosa PA01
guuccacgucgagcgggcg

SEQ ID NO: 3475079 - RNA, 17 nt, Pseudomonas aeruginosa PA01
guuccagcaccucgcgg

SEQ ID NO: 3475080 - RNA, 16 nt, Pseudomonas aeruginosa PA01
guuccagccccgccgg

SEQ ID NO: 3475081 - RNA, 16 nt, Pseudomonas aeruginosa PA01
guuccagcgccucggg

SEQ ID NO: 3475082 - RNA, 18 nt, Pseudomonas aeruginosa PA01
guuccagcgccucgggcc

SEQ ID NO: 3475083 - RNA, 21 nt, Pseudomonas aeruginosa PA01
guuccagcgccucgggccgga

SEQ ID NO: 3475084 - RNA, 12 nt, Pseudomonas aeruginosa PA01
guuccagcggcc

SEQ ID NO: 3475085 - RNA, 13 nt, Pseudomonas aeruginosa PA01
guuccagcuccgu

SEQ ID NO: 3475086 - RNA, 15 nt, Pseudomonas aeruginosa PA01
guuccagcucgucga

SEQ ID NO: 3475087 - RNA, 21 nt, Pseudomonas aeruginosa PA01
guuccagcucgucgagcugcu

SEQ ID NO: 3475088 - RNA, 17 nt, Pseudomonas aeruginosa PA01
guuccaggagggcugcu

SEQ ID NO: 3475089 - RNA, 18 nt, Pseudomonas aeruginosa PA01
guuccaggagggcugcug

SEQ ID NO: 3475090 - RNA, 22 nt, Pseudomonas aeruginosa PA01
guuccaggagggcugcugucca

SEQ ID NO: 3475091 - RNA, 19 nt, Pseudomonas aeruginosa PA01
guuccaggcguccgcuggc

SEQ ID NO: 3475092 - RNA, 19 nt, Pseudomonas aeruginosa PA01
guuccaggcgugcugcacg

SEQ ID NO: 3475093 - RNA, 20 nt, Pseudomonas aeruginosa PA01
guuccagggccugcuccagc

SEQ ID NO: 3475094 - RNA, 14 nt, Pseudomonas aeruginosa PA01
guuccagggucagc

SEQ ID NO: 3475095 - RNA, 19 nt, Pseudomonas aeruginosa PA01
guuccagggucagcuggcg

SEQ ID NO: 3475096 - RNA, 22 nt, Pseudomonas aeruginosa PA01
guuccagggucagcuggcgcgc

SEQ ID NO: 3475097 - RNA, 12 nt, Pseudomonas aeruginosa PA01
guuccaggucgc

SEQ ID NO: 3475098 - RNA, 16 nt, Pseudomonas aeruginosa PA01
guuccaguacacccag

SEQ ID NO: 3475099 - RNA, 22 nt, Pseudomonas aeruginosa PA01
guuccaguacacccagggcagu

SEQ ID NO: 3475100 - RNA, 19 nt, Pseudomonas aeruginosa PA01
guuccaguucggccgcggc

SEQ ID NO: 3475101 - RNA, 20 nt, Pseudomonas aeruginosa PA01
guuccaguucggccgcggcu

SEQ ID NO: 3475102 - RNA, 13 nt, Pseudomonas aeruginosa PA01
guuccaugaacuc

SEQ ID NO: 3475103 - RNA, 14 nt, Pseudomonas aeruginosa PA01
guuccaugaacucu

SEQ ID NO: 3475104 - RNA, 17 nt, Pseudomonas aeruginosa PA01
guuccaugucgcuggcc

SEQ ID NO: 3475105 - RNA, 16 nt, Pseudomonas aeruginosa PA01
guuccauuuguuuuaa

SEQ ID NO: 3475106 - RNA, 19 nt, Pseudomonas aeruginosa PA01
guucccagaaaaucggcag

SEQ ID NO: 3475107 - RNA, 19 nt, Pseudomonas aeruginosa PA01
guucccagaccuggccgcu

SEQ ID NO: 3475108 - RNA, 21 nt, Pseudomonas aeruginosa PA01
guucccagaccuggccgcugu

SEQ ID NO: 3475109 - RNA, 23 nt, Pseudomonas aeruginosa PA01
guucccagcagcaacagcgccgc

SEQ ID NO: 3475110 - RNA, 13 nt, Pseudomonas aeruginosa PA01
guucccagcagcg

SEQ ID NO: 3475111 - RNA, 16 nt, Pseudomonas aeruginosa PA01
guucccagcagcgccu

SEQ ID NO: 3475112 - RNA, 19 nt, Pseudomonas aeruginosa PA01
guucccagcagcgccucgg

SEQ ID NO: 3475113 - RNA, 13 nt, Pseudomonas aeruginosa PA01
guucccccagcac

SEQ ID NO: 3475114 - RNA, 15 nt, Pseudomonas aeruginosa PA01
guucccccagcaccu

SEQ ID NO: 3475115 - RNA, 15 nt, Pseudomonas aeruginosa PA01
guucccgcauggcuc

SEQ ID NO: 3475116 - RNA, 17 nt, Pseudomonas aeruginosa PA01
guucccgccgcucugcu

SEQ ID NO: 3475117 - RNA, 20 nt, Pseudomonas aeruginosa PA01
guucccgccgcucugcuggc

SEQ ID NO: 3475118 - RNA, 21 nt, Pseudomonas aeruginosa PA01
guucccgccgcucugcuggcc

SEQ ID NO: 3475119 - RNA, 22 nt, Pseudomonas aeruginosa PA01
guucccgccgcucugcuggccg

SEQ ID NO: 3475120 - RNA, 20 nt, Pseudomonas aeruginosa PA01
guucccggccuggcgcgcgc

SEQ ID NO: 3475121 - RNA, 21 nt, Pseudomonas aeruginosa PA01
guucccggucgagguugcgcg

SEQ ID NO: 3475122 - RNA, 15 nt, Pseudomonas aeruginosa PA01
guuccgaaucgccua

SEQ ID NO: 3475123 - RNA, 17 nt, Pseudomonas aeruginosa PA01
guuccgaaucgccuacc

SEQ ID NO: 3475124 - RNA, 19 nt, Pseudomonas aeruginosa PA01
guuccgacugcgagccgac

SEQ ID NO: 3475125 - RNA, 16 nt, Pseudomonas aeruginosa PA01
guuccgcaucggccac

SEQ ID NO: 3475126 - RNA, 18 nt, Pseudomonas aeruginosa PA01
guuccgcggagucgccgg

SEQ ID NO: 3475127 - RNA, 14 nt, Pseudomonas aeruginosa PA01
guuccgcucaccag

SEQ ID NO: 3475128 - RNA, 17 nt, Pseudomonas aeruginosa PA01
guuccgcucaccaggcc

SEQ ID NO: 3475129 - RNA, 14 nt, Pseudomonas aeruginosa PA01
guuccggcaggacc

SEQ ID NO: 3475130 - RNA, 13 nt, Pseudomonas aeruginosa PA01
guuccggcucagc

SEQ ID NO: 3475131 - RNA, 21 nt, Pseudomonas aeruginosa PA01
guuccggcucagccgcuggcg

SEQ ID NO: 3475132 - RNA, 20 nt, Pseudomonas aeruginosa PA01
guuccgggcagcggcgcaac

SEQ ID NO: 3475133 - RNA, 18 nt, Pseudomonas aeruginosa PA01
guuccgggcccaguucgc

SEQ ID NO: 3475134 - RNA, 18 nt, Pseudomonas aeruginosa PA01
guuccggucgggaugccg

SEQ ID NO: 3475135 - RNA, 22 nt, Pseudomonas aeruginosa PA01
guuccggucgggaugccgugcc

SEQ ID NO: 3475136 - RNA, 12 nt, Pseudomonas aeruginosa PA01
guuccuccagag

SEQ ID NO: 3475137 - RNA, 19 nt, Pseudomonas aeruginosa PA01
guuccuccagagugcgcag

SEQ ID NO: 3475138 - RNA, 21 nt, Pseudomonas aeruginosa PA01
guuccuccagagugcgcagca

SEQ ID NO: 3475139 - RNA, 20 nt, Pseudomonas aeruginosa PA01
guuccuccauuagcgucgcg

SEQ ID NO: 3475140 - RNA, 13 nt, Pseudomonas aeruginosa PA01
guuccuccgccag

SEQ ID NO: 3475141 - RNA, 14 nt, Pseudomonas aeruginosa PA01
guuccuccgccagg

SEQ ID NO: 3475142 - RNA, 13 nt, Pseudomonas aeruginosa PA01
guuccucuaaugg

SEQ ID NO: 3475143 - RNA, 21 nt, Pseudomonas aeruginosa PA01
guuccugcuccuccgacgccc

SEQ ID NO: 3475144 - RNA, 21 nt, Pseudomonas aeruginosa PA01
guuccuggcgcgcggccgcgu

SEQ ID NO: 3475145 - RNA, 16 nt, Pseudomonas aeruginosa PA01
guuccuguaccagggg

SEQ ID NO: 3475146 - RNA, 22 nt, Pseudomonas aeruginosa PA01
guuccuguccauuuccacgcuc

SEQ ID NO: 3475147 - RNA, 17 nt, Pseudomonas aeruginosa PA01
guuccuucuugacccgc

SEQ ID NO: 3475148 - RNA, 21 nt, Pseudomonas aeruginosa PA01
guuccuucuugacccgcugca

SEQ ID NO: 3475149 - RNA, 22 nt, Pseudomonas aeruginosa PA01
guuccuuuuccucgaucaggcc

SEQ ID NO: 3475150 - RNA, 16 nt, Pseudomonas aeruginosa PA01
guucgaaccguggcgg

SEQ ID NO: 3475151 - RNA, 20 nt, Pseudomonas aeruginosa PA01
guucgaaccguggcggccgc

SEQ ID NO: 3475152 - RNA, 21 nt, Pseudomonas aeruginosa PA01
guucgaaccguggcggccgcc

SEQ ID NO: 3475153 - RNA, 20 nt, Pseudomonas aeruginosa PA01
guucgaaguucuccagcaag

SEQ ID NO: 3475154 - RNA, 21 nt, Pseudomonas aeruginosa PA01
guucgaaguucuccagcaagc

SEQ ID NO: 3475155 - RNA, 20 nt, Pseudomonas aeruginosa PA01
guucgaaucucucuaccccg

SEQ ID NO: 3475156 - RNA, 17 nt, Pseudomonas aeruginosa PA01
guucgaaugcugcccgg

SEQ ID NO: 3475157 - RNA, 23 nt, Pseudomonas aeruginosa PA01
guucgaaugcugcccggagcggc

SEQ ID NO: 3475158 - RNA, 16 nt, Pseudomonas aeruginosa PA01
guucgacacgcucagc

SEQ ID NO: 3475159 - RNA, 19 nt, Pseudomonas aeruginosa PA01
guucgacgaagggcucagc

SEQ ID NO: 3475160 - RNA, 16 nt, Pseudomonas aeruginosa PA01
guucgacgcugcuagg

SEQ ID NO: 3475161 - RNA, 12 nt, Pseudomonas aeruginosa PA01
guucgagcagcu

SEQ ID NO: 3475162 - RNA, 22 nt, Pseudomonas aeruginosa PA01
guucgagcagcucguucgccca

SEQ ID NO: 3475163 - RNA, 20 nt, Pseudomonas aeruginosa PA01
guucgaggcgccgaccacga

SEQ ID NO: 3475164 - RNA, 20 nt, Pseudomonas aeruginosa PA01
guucgaggguacuccuggca

SEQ ID NO: 3475165 - RNA, 20 nt, Pseudomonas aeruginosa PA01
guucgaucucgcguuccagc

SEQ ID NO: 3475166 - RNA, 14 nt, Pseudomonas aeruginosa PA01
guucgccacgcugc

SEQ ID NO: 3475167 - RNA, 22 nt, Pseudomonas aeruginosa PA01
guucgccacugaacuggaucgg

SEQ ID NO: 3475168 - RNA, 15 nt, Pseudomonas aeruginosa PA01
guucgccagcaggcg

SEQ ID NO: 3475169 - RNA, 21 nt, Pseudomonas aeruginosa PA01
guucgcccaaggccaggucga

SEQ ID NO: 3475170 - RNA, 23 nt, Pseudomonas aeruginosa PA01
guucgcccaaggccaggucgacg

SEQ ID NO: 3475171 - RNA, 13 nt, Pseudomonas aeruginosa PA01
guucgcccagacc

SEQ ID NO: 3475172 - RNA, 17 nt, Pseudomonas aeruginosa PA01
guucgcccagaccugca

SEQ ID NO: 3475173 - RNA, 18 nt, Pseudomonas aeruginosa PA01
guucgccccgccgccagg

SEQ ID NO: 3475174 - RNA, 20 nt, Pseudomonas aeruginosa PA01
guucgccccgccgccaggcg

SEQ ID NO: 3475175 - RNA, 14 nt, Pseudomonas aeruginosa PA01
guucgcccgcggcg

SEQ ID NO: 3475176 - RNA, 18 nt, Pseudomonas aeruginosa PA01
guucgcccgcggcggcga

SEQ ID NO: 3475177 - RNA, 20 nt, Pseudomonas aeruginosa PA01
guucgcccgcggcggcgacg

SEQ ID NO: 3475178 - RNA, 19 nt, Pseudomonas aeruginosa PA01
guucgccgaaauagcgcgc

SEQ ID NO: 3475179 - RNA, 16 nt, Pseudomonas aeruginosa PA01
guucgccgagcgccgc

SEQ ID NO: 3475180 - RNA, 20 nt, Pseudomonas aeruginosa PA01
guucgccgagcgccgccagg

SEQ ID NO: 3475181 - RNA, 23 nt, Pseudomonas aeruginosa PA01
guucgccgagcgccgccaggcag

SEQ ID NO: 3475182 - RNA, 17 nt, Pseudomonas aeruginosa PA01
guucgccgaggcggcgc

SEQ ID NO: 3475183 - RNA, 23 nt, Pseudomonas aeruginosa PA01
guucgccgccaccacgaucaggc

SEQ ID NO: 3475184 - RNA, 14 nt, Pseudomonas aeruginosa PA01
guucgccgcgggcg

SEQ ID NO: 3475185 - RNA, 14 nt, Pseudomonas aeruginosa PA01
guucgccggccagg

SEQ ID NO: 3475186 - RNA, 12 nt, Pseudomonas aeruginosa PA01
guucgccggccu

SEQ ID NO: 3475187 - RNA, 22 nt, Pseudomonas aeruginosa PA01
guucgccuucaccucguuuucc

SEQ ID NO: 3475188 - RNA, 14 nt, Pseudomonas aeruginosa PA01
guucgcgcaggacc

SEQ ID NO: 3475189 - RNA, 23 nt, Pseudomonas aeruginosa PA01
guucgcgcaggaccuggcugagg

SEQ ID NO: 3475190 - RNA, 19 nt, Pseudomonas aeruginosa PA01
guucgcgcaggcgcuggcg

SEQ ID NO: 3475191 - RNA, 19 nt, Pseudomonas aeruginosa PA01
guucgcgcaggugcuuggc

SEQ ID NO: 3475192 - RNA, 16 nt, Pseudomonas aeruginosa PA01
guucgcgcgccucgcg

SEQ ID NO: 3475193 - RNA, 14 nt, Pseudomonas aeruginosa PA01
guucgcgcgggucg

SEQ ID NO: 3475194 - RNA, 15 nt, Pseudomonas aeruginosa PA01
guucgcggcucuggc

SEQ ID NO: 3475195 - RNA, 18 nt, Pseudomonas aeruginosa PA01
guucgcgggccgcggcga

SEQ ID NO: 3475196 - RNA, 20 nt, Pseudomonas aeruginosa PA01
guucgcgggccgcggcgacc

SEQ ID NO: 3475197 - RNA, 17 nt, Pseudomonas aeruginosa PA01
guucgcggucggugagc

SEQ ID NO: 3475198 - RNA, 17 nt, Pseudomonas aeruginosa PA01
guucgcguggcccggcg

SEQ ID NO: 3475199 - RNA, 18 nt, Pseudomonas aeruginosa PA01
guucgcguggcccggcgc

SEQ ID NO: 3475200 - RNA, 21 nt, Pseudomonas aeruginosa PA01
guucgcugaccgcgaauggca

SEQ ID NO: 3475201 - RNA, 14 nt, Pseudomonas aeruginosa PA01
guucgcugaggacu

SEQ ID NO: 3475202 - RNA, 19 nt, Pseudomonas aeruginosa PA01
guucgcugaggacugccag

SEQ ID NO: 3475203 - RNA, 12 nt, Pseudomonas aeruginosa PA01
guucgcugccgc

SEQ ID NO: 3475204 - RNA, 19 nt, Pseudomonas aeruginosa PA01
guucgcuggacaggcgcag

SEQ ID NO: 3475205 - RNA, 22 nt, Pseudomonas aeruginosa PA01
guucgcuggacaggcgcagggg

SEQ ID NO: 3475206 - RNA, 13 nt, Pseudomonas aeruginosa PA01
guucgcuguucuu

SEQ ID NO: 3475207 - RNA, 17 nt, Pseudomonas aeruginosa PA01
guucggaccugucccga

SEQ ID NO: 3475208 - RNA, 14 nt, Pseudomonas aeruginosa PA01
guucggaucggccc

SEQ ID NO: 3475209 - RNA, 13 nt, Pseudomonas aeruginosa PA01
guucggcagcgcc

SEQ ID NO: 3475210 - RNA, 19 nt, Pseudomonas aeruginosa PA01
guucggcagguugcucgcc

SEQ ID NO: 3475211 - RNA, 20 nt, Pseudomonas aeruginosa PA01
guucggcagguugcucgccu

SEQ ID NO: 3475212 - RNA, 22 nt, Pseudomonas aeruginosa PA01
guucggcaugguccguucggcg

SEQ ID NO: 3475213 - RNA, 21 nt, Pseudomonas aeruginosa PA01
guucggcauuggugcugccga

SEQ ID NO: 3475214 - RNA, 17 nt, Pseudomonas aeruginosa PA01
guucggccagccggcgc

SEQ ID NO: 3475215 - RNA, 15 nt, Pseudomonas aeruginosa PA01
guucggccagcggca

SEQ ID NO: 3475216 - RNA, 23 nt, Pseudomonas aeruginosa PA01
guucggccagggagucgcuggcc

SEQ ID NO: 3475217 - RNA, 18 nt, Pseudomonas aeruginosa PA01
guucggcccagcagcgcu

SEQ ID NO: 3475218 - RNA, 19 nt, Pseudomonas aeruginosa PA01
guucggcccagcagcgcuc

SEQ ID NO: 3475219 - RNA, 15 nt, Pseudomonas aeruginosa PA01
guucggccccggcca

SEQ ID NO: 3475220 - RNA, 17 nt, Pseudomonas aeruginosa PA01
guucggccccggccagg

SEQ ID NO: 3475221 - RNA, 19 nt, Pseudomonas aeruginosa PA01
guucggccgcggcuggcag

SEQ ID NO: 3475222 - RNA, 21 nt, Pseudomonas aeruginosa PA01
guucggcgaccauucaugggc

SEQ ID NO: 3475223 - RNA, 23 nt, Pseudomonas aeruginosa PA01
guucggcgagaggucggcgcgcc

SEQ ID NO: 3475224 - RNA, 17 nt, Pseudomonas aeruginosa PA01
guucggcgaggaucgcc

SEQ ID NO: 3475225 - RNA, 22 nt, Pseudomonas aeruginosa PA01
guucggcgaugaccagcucggc

SEQ ID NO: 3475226 - RNA, 19 nt, Pseudomonas aeruginosa PA01
guucggcgaugccgcgcca

SEQ ID NO: 3475227 - RNA, 13 nt, Pseudomonas aeruginosa PA01
guucggcgcuggc

SEQ ID NO: 3475228 - RNA, 14 nt, Pseudomonas aeruginosa PA01
guucggcgcuggcg

SEQ ID NO: 3475229 - RNA, 18 nt, Pseudomonas aeruginosa PA01
guucggcgcuggcgcgga

SEQ ID NO: 3475230 - RNA, 17 nt, Pseudomonas aeruginosa PA01
guucggcggcgugcagg

SEQ ID NO: 3475231 - RNA, 17 nt, Pseudomonas aeruginosa PA01
guucggcuguuucaggc

SEQ ID NO: 3475232 - RNA, 22 nt, Pseudomonas aeruginosa PA01
guucggcuguuucaggccggcg

SEQ ID NO: 3475233 - RNA, 19 nt, Pseudomonas aeruginosa PA01
guucggggaacagcgccag

SEQ ID NO: 3475234 - RNA, 13 nt, Pseudomonas aeruginosa PA01
guucggugccgcc

SEQ ID NO: 3475235 - RNA, 15 nt, Pseudomonas aeruginosa PA01
guucggugccgccgg

SEQ ID NO: 3475236 - RNA, 18 nt, Pseudomonas aeruginosa PA01
guucgucaccggcgccac

SEQ ID NO: 3475237 - RNA, 19 nt, Pseudomonas aeruginosa PA01
guucguccaucgccaggcc

SEQ ID NO: 3475238 - RNA, 15 nt, Pseudomonas aeruginosa PA01
guucgucccgagcac

SEQ ID NO: 3475239 - RNA, 20 nt, Pseudomonas aeruginosa PA01
guucgucccgagcaccggcc

SEQ ID NO: 3475240 - RNA, 23 nt, Pseudomonas aeruginosa PA01
guucgucgaucagguccuggccg

SEQ ID NO: 3475241 - RNA, 16 nt, Pseudomonas aeruginosa PA01
guucgucgccacgccc

SEQ ID NO: 3475242 - RNA, 14 nt, Pseudomonas aeruginosa PA01
guucgucgcccauc

SEQ ID NO: 3475243 - RNA, 17 nt, Pseudomonas aeruginosa PA01
guucgucgcccaucucg

SEQ ID NO: 3475244 - RNA, 21 nt, Pseudomonas aeruginosa PA01
guucgucgcgucgcacccggc

SEQ ID NO: 3475245 - RNA, 16 nt, Pseudomonas aeruginosa PA01
guucgucuggcgccug

SEQ ID NO: 3475246 - RNA, 17 nt, Pseudomonas aeruginosa PA01
guucgucuggcgccugg

SEQ ID NO: 3475247 - RNA, 19 nt, Pseudomonas aeruginosa PA01
guucgucuggcgccuggcc

SEQ ID NO: 3475248 - RNA, 14 nt, Pseudomonas aeruginosa PA01
guucgugccaggcg

SEQ ID NO: 3475249 - RNA, 16 nt, Pseudomonas aeruginosa PA01
guucgugccaggcgac

SEQ ID NO: 3475250 - RNA, 21 nt, Pseudomonas aeruginosa PA01
guucguguaggguucgcugcc

SEQ ID NO: 3475251 - RNA, 14 nt, Pseudomonas aeruginosa PA01
guucguugaccacg

SEQ ID NO: 3475252 - RNA, 18 nt, Pseudomonas aeruginosa PA01
guucguugaccguccaca

SEQ ID NO: 3475253 - RNA, 16 nt, Pseudomonas aeruginosa PA01
guucguugggccggaa

SEQ ID NO: 3475254 - RNA, 14 nt, Pseudomonas aeruginosa PA01
guucuccagcaagc

SEQ ID NO: 3475255 - RNA, 18 nt, Pseudomonas aeruginosa PA01
guucuccaggcccauccu

SEQ ID NO: 3475256 - RNA, 19 nt, Pseudomonas aeruginosa PA01
guucucccugagccugucg

SEQ ID NO: 3475257 - RNA, 22 nt, Pseudomonas aeruginosa PA01
guucuccgggucgugcccgagc

SEQ ID NO: 3475258 - RNA, 15 nt, Pseudomonas aeruginosa PA01
guucuccucccgccc

SEQ ID NO: 3475259 - RNA, 18 nt, Pseudomonas aeruginosa PA01
guucucgacccgcucgag

SEQ ID NO: 3475260 - RNA, 18 nt, Pseudomonas aeruginosa PA01
guucucgcagcaggcguu

SEQ ID NO: 3475261 - RNA, 15 nt, Pseudomonas aeruginosa PA01
guucucggccaccac

SEQ ID NO: 3475262 - RNA, 17 nt, Pseudomonas aeruginosa PA01
guucucggccagguacu

SEQ ID NO: 3475263 - RNA, 17 nt, Pseudomonas aeruginosa PA01
guucucggugaccaccu

SEQ ID NO: 3475264 - RNA, 16 nt, Pseudomonas aeruginosa PA01
guucucguccaggucc

SEQ ID NO: 3475265 - RNA, 15 nt, Pseudomonas aeruginosa PA01
guucucguccucggc

SEQ ID NO: 3475266 - RNA, 17 nt, Pseudomonas aeruginosa PA01
guucucguccucggcgu

SEQ ID NO: 3475267 - RNA, 16 nt, Pseudomonas aeruginosa PA01
guucucuuugaccuug

SEQ ID NO: 3475268 - RNA, 14 nt, Pseudomonas aeruginosa PA01
guucugccagagcg

SEQ ID NO: 3475269 - RNA, 13 nt, Pseudomonas aeruginosa PA01
guucugccgcaga

SEQ ID NO: 3475270 - RNA, 19 nt, Pseudomonas aeruginosa PA01
guucugccgcagacgcccu

SEQ ID NO: 3475271 - RNA, 13 nt, Pseudomonas aeruginosa PA01
guucugccgcagc

SEQ ID NO: 3475272 - RNA, 17 nt, Pseudomonas aeruginosa PA01
guucugccgcagcgccu

SEQ ID NO: 3475273 - RNA, 21 nt, Pseudomonas aeruginosa PA01
guucugccgcagcgccucccg

SEQ ID NO: 3475274 - RNA, 21 nt, Pseudomonas aeruginosa PA01
guucugcgcaccaugcccgcu

SEQ ID NO: 3475275 - RNA, 16 nt, Pseudomonas aeruginosa PA01
guucuggucgccgaca

SEQ ID NO: 3475276 - RNA, 19 nt, Pseudomonas aeruginosa PA01
guucuguucgucccgagca

SEQ ID NO: 3475277 - RNA, 17 nt, Pseudomonas aeruginosa PA01
guucuucacccgcagcg

SEQ ID NO: 3475278 - RNA, 14 nt, Pseudomonas aeruginosa PA01
guucuucagcacuu

SEQ ID NO: 3475279 - RNA, 18 nt, Pseudomonas aeruginosa PA01
guucuuccaccguggcga

SEQ ID NO: 3475280 - RNA, 19 nt, Pseudomonas aeruginosa PA01
guucuucgacgcuggucag

SEQ ID NO: 3475281 - RNA, 17 nt, Pseudomonas aeruginosa PA01
guucuucgccgcccgcg

SEQ ID NO: 3475282 - RNA, 16 nt, Pseudomonas aeruginosa PA01
guucuucguuccaucg

SEQ ID NO: 3475283 - RNA, 16 nt, Pseudomonas aeruginosa PA01
guucuugauccgcucc

SEQ ID NO: 3475284 - RNA, 16 nt, Pseudomonas aeruginosa PA01
guucuugcugacguug

SEQ ID NO: 3475285 - RNA, 16 nt, Pseudomonas aeruginosa PA01
guucuugucgaccagc

SEQ ID NO: 3475286 - RNA, 19 nt, Pseudomonas aeruginosa PA01
guucuuguugagcuggccg

SEQ ID NO: 3475287 - RNA, 18 nt, Pseudomonas aeruginosa PA01
guugaaacgcucggcguc

SEQ ID NO: 3475288 - RNA, 19 nt, Pseudomonas aeruginosa PA01
guugaaagccuuuauccac

SEQ ID NO: 3475289 - RNA, 17 nt, Pseudomonas aeruginosa PA01
guugaacucggcgccca

SEQ ID NO: 3475290 - RNA, 13 nt, Pseudomonas aeruginosa PA01
guugaacugcccg

SEQ ID NO: 3475291 - RNA, 13 nt, Pseudomonas aeruginosa PA01
guugaacugcggu

SEQ ID NO: 3475292 - RNA, 20 nt, Pseudomonas aeruginosa PA01
guugaacugcgguccggcga

SEQ ID NO: 3475293 - RNA, 19 nt, Pseudomonas aeruginosa PA01
guugaagaacggcccgcuc

SEQ ID NO: 3475294 - RNA, 13 nt, Pseudomonas aeruginosa PA01
guugaagagcagc

SEQ ID NO: 3475295 - RNA, 14 nt, Pseudomonas aeruginosa PA01
guugaagccgaucg

SEQ ID NO: 3475296 - RNA, 15 nt, Pseudomonas aeruginosa PA01
guugaagcggccgua

SEQ ID NO: 3475297 - RNA, 13 nt, Pseudomonas aeruginosa PA01
guugaccagcaug

SEQ ID NO: 3475298 - RNA, 21 nt, Pseudomonas aeruginosa PA01
guugaccagcauguuguuaug

SEQ ID NO: 3475299 - RNA, 13 nt, Pseudomonas aeruginosa PA01
guugaccagcgcg

SEQ ID NO: 3475300 - RNA, 14 nt, Pseudomonas aeruginosa PA01
guugaccagcgcgu

SEQ ID NO: 3475301 - RNA, 19 nt, Pseudomonas aeruginosa PA01
guugacccagagccgcucg

SEQ ID NO: 3475302 - RNA, 19 nt, Pseudomonas aeruginosa PA01
guugaccccgaggucggcg

SEQ ID NO: 3475303 - RNA, 20 nt, Pseudomonas aeruginosa PA01
guugaccccgaggucggcga

SEQ ID NO: 3475304 - RNA, 14 nt, Pseudomonas aeruginosa PA01
guugaccccgcggg

SEQ ID NO: 3475305 - RNA, 20 nt, Pseudomonas aeruginosa PA01
guugaccgccagacaggcca

SEQ ID NO: 3475306 - RNA, 21 nt, Pseudomonas aeruginosa PA01
guugaccgccagacaggccag

SEQ ID NO: 3475307 - RNA, 23 nt, Pseudomonas aeruginosa PA01
guugaccgugaugcccagcggcg

SEQ ID NO: 3475308 - RNA, 16 nt, Pseudomonas aeruginosa PA01
guugaccugcgaggcg

SEQ ID NO: 3475309 - RNA, 15 nt, Pseudomonas aeruginosa PA01
guugaccuucugucc

SEQ ID NO: 3475310 - RNA, 15 nt, Pseudomonas aeruginosa PA01
guugacgaugcggcc

SEQ ID NO: 3475311 - RNA, 18 nt, Pseudomonas aeruginosa PA01
guugacgaugcggcccgc

SEQ ID NO: 3475312 - RNA, 20 nt, Pseudomonas aeruginosa PA01
guugacgaugcggcccgccg

SEQ ID NO: 3475313 - RNA, 16 nt, Pseudomonas aeruginosa PA01
guugacgcaguuccgc

SEQ ID NO: 3475314 - RNA, 22 nt, Pseudomonas aeruginosa PA01
guugacgccaguuucuaucucc

SEQ ID NO: 3475315 - RNA, 23 nt, Pseudomonas aeruginosa PA01
guugacgcggaugcccuggucgg

SEQ ID NO: 3475316 - RNA, 17 nt, Pseudomonas aeruginosa PA01
guugacgucgccgaugc

SEQ ID NO: 3475317 - RNA, 20 nt, Pseudomonas aeruginosa PA01
guugacguucugcccgccgg

SEQ ID NO: 3475318 - RNA, 23 nt, Pseudomonas aeruginosa PA01
guugacguucugcccgccggcgc

SEQ ID NO: 3475319 - RNA, 16 nt, Pseudomonas aeruginosa PA01
guugagauccuggccg

SEQ ID NO: 3475320 - RNA, 21 nt, Pseudomonas aeruginosa PA01
guugagauccuggccggcggc

SEQ ID NO: 3475321 - RNA, 13 nt, Pseudomonas aeruginosa PA01
guugagcuggccg

SEQ ID NO: 3475322 - RNA, 14 nt, Pseudomonas aeruginosa PA01
guugagcuggccga

SEQ ID NO: 3475323 - RNA, 17 nt, Pseudomonas aeruginosa PA01
guugagcuggccgagcg

SEQ ID NO: 3475324 - RNA, 18 nt, Pseudomonas aeruginosa PA01
guugagcuggccgagcga

SEQ ID NO: 3475325 - RNA, 15 nt, Pseudomonas aeruginosa PA01
guugagcugugguug

SEQ ID NO: 3475326 - RNA, 17 nt, Pseudomonas aeruginosa PA01
guugagcugugguugug

SEQ ID NO: 3475327 - RNA, 22 nt, Pseudomonas aeruginosa PA01
guugaggaaaucaccgcugcgc

SEQ ID NO: 3475328 - RNA, 11 nt, Pseudomonas aeruginosa PA01
guugaggaagu

SEQ ID NO: 3475329 - RNA, 14 nt, Pseudomonas aeruginosa PA01
guugaggcguucga

SEQ ID NO: 3475330 - RNA, 20 nt, Pseudomonas aeruginosa PA01
guugaguugcaggccggcga

SEQ ID NO: 3475331 - RNA, 20 nt, Pseudomonas aeruginosa PA01
guugauacgguuugaggcgu

SEQ ID NO: 3475332 - RNA, 20 nt, Pseudomonas aeruginosa PA01
guugaucagguucggcagcg

SEQ ID NO: 3475333 - RNA, 14 nt, Pseudomonas aeruginosa PA01
guugauccgcgugg

SEQ ID NO: 3475334 - RNA, 18 nt, Pseudomonas aeruginosa PA01
guugaucgacgccagcuc

SEQ ID NO: 3475335 - RNA, 17 nt, Pseudomonas aeruginosa PA01
guugaucgccgcgccgc

SEQ ID NO: 3475336 - RNA, 20 nt, Pseudomonas aeruginosa PA01
guugaucgccgcgccgccga

SEQ ID NO: 3475337 - RNA, 21 nt, Pseudomonas aeruginosa PA01
guugaucgccgcgccgccgag

SEQ ID NO: 3475338 - RNA, 17 nt, Pseudomonas aeruginosa PA01
guugaucggcaacgagc

SEQ ID NO: 3475339 - RNA, 21 nt, Pseudomonas aeruginosa PA01
guugaucggcguggcggucag

SEQ ID NO: 3475340 - RNA, 14 nt, Pseudomonas aeruginosa PA01
guugaugccgaggc

SEQ ID NO: 3475341 - RNA, 15 nt, Pseudomonas aeruginosa PA01
guugauggucaggcu

SEQ ID NO: 3475342 - RNA, 17 nt, Pseudomonas aeruginosa PA01
guugaugguuucuuccc

SEQ ID NO: 3475343 - RNA, 19 nt, Pseudomonas aeruginosa PA01
guugaugucgucgaacgac

SEQ ID NO: 3475344 - RNA, 15 nt, Pseudomonas aeruginosa PA01
guugauucaggcggc

SEQ ID NO: 3475345 - RNA, 14 nt, Pseudomonas aeruginosa PA01
guugauuccgccgg

SEQ ID NO: 3475346 - RNA, 21 nt, Pseudomonas aeruginosa PA01
guugcaauagaaaagaauaau

SEQ ID NO: 3475347 - RNA, 17 nt, Pseudomonas aeruginosa PA01
guugcaauugcaggccc

SEQ ID NO: 3475348 - RNA, 14 nt, Pseudomonas aeruginosa PA01
guugcacagcgccc

SEQ ID NO: 3475349 - RNA, 15 nt, Pseudomonas aeruginosa PA01
guugcagagcggcca

SEQ ID NO: 3475350 - RNA, 17 nt, Pseudomonas aeruginosa PA01
guugcagagcggccagg

SEQ ID NO: 3475351 - RNA, 14 nt, Pseudomonas aeruginosa PA01
guugcagcaccccc

SEQ ID NO: 3475352 - RNA, 19 nt, Pseudomonas aeruginosa PA01
guugcaggcacggaagcgc

SEQ ID NO: 3475353 - RNA, 23 nt, Pseudomonas aeruginosa PA01
guugcaggcacggaagcgcugcu

SEQ ID NO: 3475354 - RNA, 16 nt, Pseudomonas aeruginosa PA01
guugcaggccagcgcc

SEQ ID NO: 3475355 - RNA, 15 nt, Pseudomonas aeruginosa PA01
guugcaggcccagcu

SEQ ID NO: 3475356 - RNA, 16 nt, Pseudomonas aeruginosa PA01
guugcaggccggcgag

SEQ ID NO: 3475357 - RNA, 22 nt, Pseudomonas aeruginosa PA01
guugcaggccggcgagccaggu

SEQ ID NO: 3475358 - RNA, 14 nt, Pseudomonas aeruginosa PA01
guugcaggcuggga

SEQ ID NO: 3475359 - RNA, 16 nt, Pseudomonas aeruginosa PA01
guugcaggcugggaaa

SEQ ID NO: 3475360 - RNA, 22 nt, Pseudomonas aeruginosa PA01
guugcagggauuccgggucgag

SEQ ID NO: 3475361 - RNA, 15 nt, Pseudomonas aeruginosa PA01
guugcagggucgccg

SEQ ID NO: 3475362 - RNA, 12 nt, Pseudomonas aeruginosa PA01
guugcaggucga

SEQ ID NO: 3475363 - RNA, 19 nt, Pseudomonas aeruginosa PA01
guugcaguaccugcucacg

SEQ ID NO: 3475364 - RNA, 16 nt, Pseudomonas aeruginosa PA01
guugcaguccaggccg

SEQ ID NO: 3475365 - RNA, 15 nt, Pseudomonas aeruginosa PA01
guugccagacgauca

SEQ ID NO: 3475366 - RNA, 16 nt, Pseudomonas aeruginosa PA01
guugccaggccggcgc

SEQ ID NO: 3475367 - RNA, 23 nt, Pseudomonas aeruginosa PA01
guugccauagccgacgaaggcga

SEQ ID NO: 3475368 - RNA, 13 nt, Pseudomonas aeruginosa PA01
guugccauccagc

SEQ ID NO: 3475369 - RNA, 14 nt, Pseudomonas aeruginosa PA01
guugccauccagcg

SEQ ID NO: 3475370 - RNA, 16 nt, Pseudomonas aeruginosa PA01
guugccauccagcgcc

SEQ ID NO: 3475371 - RNA, 17 nt, Pseudomonas aeruginosa PA01
guugccauccagcgccu

SEQ ID NO: 3475372 - RNA, 20 nt, Pseudomonas aeruginosa PA01
guugcccaccagcgucgcca

SEQ ID NO: 3475373 - RNA, 14 nt, Pseudomonas aeruginosa PA01
guugcccacggcca

SEQ ID NO: 3475374 - RNA, 20 nt, Pseudomonas aeruginosa PA01
guugcccacggccaggccca

SEQ ID NO: 3475375 - RNA, 16 nt, Pseudomonas aeruginosa PA01
guugcccgagugccgg

SEQ ID NO: 3475376 - RNA, 18 nt, Pseudomonas aeruginosa PA01
guugcccgagugccggcg

SEQ ID NO: 3475377 - RNA, 17 nt, Pseudomonas aeruginosa PA01
guugcccggcuugccgu

SEQ ID NO: 3475378 - RNA, 20 nt, Pseudomonas aeruginosa PA01
guugcccucgcagccggcgg

SEQ ID NO: 3475379 - RNA, 16 nt, Pseudomonas aeruginosa PA01
guugcccugggccggc

SEQ ID NO: 3475380 - RNA, 22 nt, Pseudomonas aeruginosa PA01
guugcccugggccggcgccagc

SEQ ID NO: 3475381 - RNA, 22 nt, Pseudomonas aeruginosa PA01
guugccgaagcgcucggucagc

SEQ ID NO: 3475382 - RNA, 15 nt, Pseudomonas aeruginosa PA01
guugccgaccgagca

SEQ ID NO: 3475383 - RNA, 19 nt, Pseudomonas aeruginosa PA01
guugccgaccgagcagcgg

SEQ ID NO: 3475384 - RNA, 17 nt, Pseudomonas aeruginosa PA01
guugccgaucaggcuga

SEQ ID NO: 3475385 - RNA, 12 nt, Pseudomonas aeruginosa PA01
guugccgcagca

SEQ ID NO: 3475386 - RNA, 19 nt, Pseudomonas aeruginosa PA01
guugccgcagcagcggcga

SEQ ID NO: 3475387 - RNA, 21 nt, Pseudomonas aeruginosa PA01
guugccgcagcagcggcgaca

SEQ ID NO: 3475388 - RNA, 15 nt, Pseudomonas aeruginosa PA01
guugccgccagcgcg

SEQ ID NO: 3475389 - RNA, 20 nt, Pseudomonas aeruginosa PA01
guugccgccagcgcggcgcu

SEQ ID NO: 3475390 - RNA, 13 nt, Pseudomonas aeruginosa PA01
guugccgccgccg

SEQ ID NO: 3475391 - RNA, 18 nt, Pseudomonas aeruginosa PA01
guugccgccgccgaggag

SEQ ID NO: 3475392 - RNA, 24 nt, Pseudomonas aeruginosa PA01
guugccgccgcuggccuggccacc

SEQ ID NO: 3475393 - RNA, 17 nt, Pseudomonas aeruginosa PA01
guugccgcgcaccaccg

SEQ ID NO: 3475394 - RNA, 13 nt, Pseudomonas aeruginosa PA01
guugccgcgccga

SEQ ID NO: 3475395 - RNA, 18 nt, Pseudomonas aeruginosa PA01
guugccgcgcgggccggc

SEQ ID NO: 3475396 - RNA, 23 nt, Pseudomonas aeruginosa PA01
guugccgcgcgggccggcgaugg

SEQ ID NO: 3475397 - RNA, 14 nt, Pseudomonas aeruginosa PA01
guugccgcugcagg

SEQ ID NO: 3475398 - RNA, 17 nt, Pseudomonas aeruginosa PA01
guugccgcugcaggcca

SEQ ID NO: 3475399 - RNA, 19 nt, Pseudomonas aeruginosa PA01
guugccgcugcaggccacc

SEQ ID NO: 3475400 - RNA, 18 nt, Pseudomonas aeruginosa PA01
guugccgcugcggcgguc

SEQ ID NO: 3475401 - RNA, 14 nt, Pseudomonas aeruginosa PA01
guugccgcuggccu

SEQ ID NO: 3475402 - RNA, 19 nt, Pseudomonas aeruginosa PA01
guugccggaaucacgcugc

SEQ ID NO: 3475403 - RNA, 21 nt, Pseudomonas aeruginosa PA01
guugccggagacgauggcgac

SEQ ID NO: 3475404 - RNA, 16 nt, Pseudomonas aeruginosa PA01
guugccggcaaacgcc

SEQ ID NO: 3475405 - RNA, 20 nt, Pseudomonas aeruginosa PA01
guugccggcaaacgccgcca

SEQ ID NO: 3475406 - RNA, 23 nt, Pseudomonas aeruginosa PA01
guugccgucgagcaccagcaggu

SEQ ID NO: 3475407 - RNA, 13 nt, Pseudomonas aeruginosa PA01
guugccguggcgg

SEQ ID NO: 3475408 - RNA, 15 nt, Pseudomonas aeruginosa PA01
guugccuguccagcu

SEQ ID NO: 3475409 - RNA, 16 nt, Pseudomonas aeruginosa PA01
guugccuguccagcuc

SEQ ID NO: 3475410 - RNA, 17 nt, Pseudomonas aeruginosa PA01
guugccuucgccgucga

SEQ ID NO: 3475411 - RNA, 21 nt, Pseudomonas aeruginosa PA01
guugcgacacgaugucgcggg

SEQ ID NO: 3475412 - RNA, 22 nt, Pseudomonas aeruginosa PA01
guugcgaugggugccgcgcagg

SEQ ID NO: 3475413 - RNA, 17 nt, Pseudomonas aeruginosa PA01
guugcgauuguccaccg

SEQ ID NO: 3475414 - RNA, 16 nt, Pseudomonas aeruginosa PA01
guugcgcaaccagcgc

SEQ ID NO: 3475415 - RNA, 14 nt, Pseudomonas aeruginosa PA01
guugcgcacccgcu

SEQ ID NO: 3475416 - RNA, 15 nt, Pseudomonas aeruginosa PA01
guugcgcacccgcuc

SEQ ID NO: 3475417 - RNA, 16 nt, Pseudomonas aeruginosa PA01
guugcgcacccgcucg

SEQ ID NO: 3475418 - RNA, 20 nt, Pseudomonas aeruginosa PA01
guugcgcacccgcucggccu

SEQ ID NO: 3475419 - RNA, 19 nt, Pseudomonas aeruginosa PA01
guugcgcagcuucugcagg

SEQ ID NO: 3475420 - RNA, 18 nt, Pseudomonas aeruginosa PA01
guugcgcaggggcgcggc

SEQ ID NO: 3475421 - RNA, 15 nt, Pseudomonas aeruginosa PA01
guugcgcagggugcc

SEQ ID NO: 3475422 - RNA, 20 nt, Pseudomonas aeruginosa PA01
guugcgcaucugcgcguagc

SEQ ID NO: 3475423 - RNA, 18 nt, Pseudomonas aeruginosa PA01
guugcgccagaccagccc

SEQ ID NO: 3475424 - RNA, 17 nt, Pseudomonas aeruginosa PA01
guugcgccccgggucgc

SEQ ID NO: 3475425 - RNA, 15 nt, Pseudomonas aeruginosa PA01
guugcgccgcagcaa

SEQ ID NO: 3475426 - RNA, 18 nt, Pseudomonas aeruginosa PA01
guugcgccgcuccuggca

SEQ ID NO: 3475427 - RNA, 22 nt, Pseudomonas aeruginosa PA01
guugcgccggcccagcaggccg

SEQ ID NO: 3475428 - RNA, 23 nt, Pseudomonas aeruginosa PA01
guugcgcgaggcguucgucgacc

SEQ ID NO: 3475429 - RNA, 14 nt, Pseudomonas aeruginosa PA01
guugcgcgccagcg

SEQ ID NO: 3475430 - RNA, 16 nt, Pseudomonas aeruginosa PA01
guugcgcgccagcgcc

SEQ ID NO: 3475431 - RNA, 18 nt, Pseudomonas aeruginosa PA01
guugcgcgccucgcccca

SEQ ID NO: 3475432 - RNA, 22 nt, Pseudomonas aeruginosa PA01
guugcgcggcgaguugcgcgag

SEQ ID NO: 3475433 - RNA, 23 nt, Pseudomonas aeruginosa PA01
guugcgcggcgaguugcgcgagg

SEQ ID NO: 3475434 - RNA, 18 nt, Pseudomonas aeruginosa PA01
guugcgcuccacccaggc

SEQ ID NO: 3475435 - RNA, 21 nt, Pseudomonas aeruginosa PA01
guugcgcuccacccaggcgcc

SEQ ID NO: 3475436 - RNA, 12 nt, Pseudomonas aeruginosa PA01
guugcgcuccgg

SEQ ID NO: 3475437 - RNA, 11 nt, Pseudomonas aeruginosa PA01
guugcgcugcu

SEQ ID NO: 3475438 - RNA, 15 nt, Pseudomonas aeruginosa PA01
guugcgcuggcgcag

SEQ ID NO: 3475439 - RNA, 18 nt, Pseudomonas aeruginosa PA01
guugcgcuggcgcagcag

SEQ ID NO: 3475440 - RNA, 20 nt, Pseudomonas aeruginosa PA01
guugcgcuggcgcagcagca

SEQ ID NO: 3475441 - RNA, 15 nt, Pseudomonas aeruginosa PA01
guugcggaaagcgac

SEQ ID NO: 3475442 - RNA, 20 nt, Pseudomonas aeruginosa PA01
guugcggaacggcucgcggg

SEQ ID NO: 3475443 - RNA, 14 nt, Pseudomonas aeruginosa PA01
guugcggcgccggu

SEQ ID NO: 3475444 - RNA, 23 nt, Pseudomonas aeruginosa PA01
guugcggcgggucacgccgaggg

SEQ ID NO: 3475445 - RNA, 14 nt, Pseudomonas aeruginosa PA01
guugcggcgguggc

SEQ ID NO: 3475446 - RNA, 16 nt, Pseudomonas aeruginosa PA01
guugcgggcaggucga

SEQ ID NO: 3475447 - RNA, 15 nt, Pseudomonas aeruginosa PA01
guugcgggcgcaggu

SEQ ID NO: 3475448 - RNA, 18 nt, Pseudomonas aeruginosa PA01
guugcggucgauguccug

SEQ ID NO: 3475449 - RNA, 23 nt, Pseudomonas aeruginosa PA01
guugcggucgauguccugggcca

SEQ ID NO: 3475450 - RNA, 22 nt, Pseudomonas aeruginosa PA01
guugcguuuccggucacgcagg

SEQ ID NO: 3475451 - RNA, 21 nt, Pseudomonas aeruginosa PA01
guugcucaccaaugccagugc

SEQ ID NO: 3475452 - RNA, 17 nt, Pseudomonas aeruginosa PA01
guugcucgagccguucc

SEQ ID NO: 3475453 - RNA, 17 nt, Pseudomonas aeruginosa PA01
guugcucgcaccaggcc

SEQ ID NO: 3475454 - RNA, 18 nt, Pseudomonas aeruginosa PA01
guugcucgcaccaggcca

SEQ ID NO: 3475455 - RNA, 18 nt, Pseudomonas aeruginosa PA01
guugcucugggcauggcu

SEQ ID NO: 3475456 - RNA, 23 nt, Pseudomonas aeruginosa PA01
guugcugaucacguagaugccgg

SEQ ID NO: 3475457 - RNA, 14 nt, Pseudomonas aeruginosa PA01
guugcugcccuggc

SEQ ID NO: 3475458 - RNA, 22 nt, Pseudomonas aeruginosa PA01
guugcugcccuggcgcgcgccc

SEQ ID NO: 3475459 - RNA, 17 nt, Pseudomonas aeruginosa PA01
guugcugcugcggggcc

SEQ ID NO: 3475460 - RNA, 14 nt, Pseudomonas aeruginosa PA01
guugcuggcacagg

SEQ ID NO: 3475461 - RNA, 19 nt, Pseudomonas aeruginosa PA01
guugcuggccggucugcuu

SEQ ID NO: 3475462 - RNA, 13 nt, Pseudomonas aeruginosa PA01
guugcuguagaau

SEQ ID NO: 3475463 - RNA, 16 nt, Pseudomonas aeruginosa PA01
guugcugugcugcacc

SEQ ID NO: 3475464 - RNA, 21 nt, Pseudomonas aeruginosa PA01
guuggaaccaguugccgagcu

SEQ ID NO: 3475465 - RNA, 13 nt, Pseudomonas aeruginosa PA01
guuggacgcggcc

SEQ ID NO: 3475466 - RNA, 17 nt, Pseudomonas aeruginosa PA01
guuggacgcggccuggg

SEQ ID NO: 3475467 - RNA, 16 nt, Pseudomonas aeruginosa PA01
guuggaucaccggggu

SEQ ID NO: 3475468 - RNA, 15 nt, Pseudomonas aeruginosa PA01
guuggcaaagcccgc

SEQ ID NO: 3475469 - RNA, 16 nt, Pseudomonas aeruginosa PA01
guuggcaaagcccgcu

SEQ ID NO: 3475470 - RNA, 19 nt, Pseudomonas aeruginosa PA01
guuggccaaccaggaagga

SEQ ID NO: 3475471 - RNA, 14 nt, Pseudomonas aeruginosa PA01
guuggccacguagg

SEQ ID NO: 3475472 - RNA, 20 nt, Pseudomonas aeruginosa PA01
guuggccagcagccaggccu

SEQ ID NO: 3475473 - RNA, 16 nt, Pseudomonas aeruginosa PA01
guuggccagcaggcgc

SEQ ID NO: 3475474 - RNA, 19 nt, Pseudomonas aeruginosa PA01
guuggccagcaggcgccgc

SEQ ID NO: 3475475 - RNA, 16 nt, Pseudomonas aeruginosa PA01
guuggccagcgaacgc

SEQ ID NO: 3475476 - RNA, 14 nt, Pseudomonas aeruginosa PA01
guuggccagcgcca

SEQ ID NO: 3475477 - RNA, 21 nt, Pseudomonas aeruginosa PA01
guuggccagcgccaccagcag

SEQ ID NO: 3475478 - RNA, 17 nt, Pseudomonas aeruginosa PA01
guuggccaggaccaucg

SEQ ID NO: 3475479 - RNA, 23 nt, Pseudomonas aeruginosa PA01
guuggccaggaccaucggcacca

SEQ ID NO: 3475480 - RNA, 14 nt, Pseudomonas aeruginosa PA01
guuggccaggcgcg

SEQ ID NO: 3475481 - RNA, 15 nt, Pseudomonas aeruginosa PA01
guuggccaggcgcga

SEQ ID NO: 3475482 - RNA, 18 nt, Pseudomonas aeruginosa PA01
guuggccaggcgcgacag

SEQ ID NO: 3475483 - RNA, 20 nt, Pseudomonas aeruginosa PA01
guuggcccaauccgcgccgg

SEQ ID NO: 3475484 - RNA, 15 nt, Pseudomonas aeruginosa PA01
guuggccccgccgag

SEQ ID NO: 3475485 - RNA, 14 nt, Pseudomonas aeruginosa PA01
guuggcccgcgccg

SEQ ID NO: 3475486 - RNA, 15 nt, Pseudomonas aeruginosa PA01
guuggccgagcgcga

SEQ ID NO: 3475487 - RNA, 16 nt, Pseudomonas aeruginosa PA01
guuggccgagcgcgag

SEQ ID NO: 3475488 - RNA, 16 nt, Pseudomonas aeruginosa PA01
guuggccgcagcagcg

SEQ ID NO: 3475489 - RNA, 15 nt, Pseudomonas aeruginosa PA01
guuggccgccuggcg

SEQ ID NO: 3475490 - RNA, 18 nt, Pseudomonas aeruginosa PA01
guuggccggcugcuccgg

SEQ ID NO: 3475491 - RNA, 23 nt, Pseudomonas aeruginosa PA01
guuggccgucuccaggcgcgccg

SEQ ID NO: 3475492 - RNA, 20 nt, Pseudomonas aeruginosa PA01
guuggcgaacaaucggucgc

SEQ ID NO: 3475493 - RNA, 21 nt, Pseudomonas aeruginosa PA01
guuggcgaacaaucggucgcc

SEQ ID NO: 3475494 - RNA, 17 nt, Pseudomonas aeruginosa PA01
guuggcgaacaggcagc

SEQ ID NO: 3475495 - RNA, 17 nt, Pseudomonas aeruginosa PA01
guuggcgaacuucaggc

SEQ ID NO: 3475496 - RNA, 23 nt, Pseudomonas aeruginosa PA01
guuggcgaacuucaggccggcgc

SEQ ID NO: 3475497 - RNA, 20 nt, Pseudomonas aeruginosa PA01
guuggcgaaguucccgccgc

SEQ ID NO: 3475498 - RNA, 21 nt, Pseudomonas aeruginosa PA01
guuggcgaaguucccgccgcu

SEQ ID NO: 3475499 - RNA, 19 nt, Pseudomonas aeruginosa PA01
guuggcgaugaucuggcca

SEQ ID NO: 3475500 - RNA, 12 nt, Pseudomonas aeruginosa PA01
guuggcgcaggc

SEQ ID NO: 3475501 - RNA, 14 nt, Pseudomonas aeruginosa PA01
guuggcgccccaga

SEQ ID NO: 3475502 - RNA, 19 nt, Pseudomonas aeruginosa PA01
guuggcgccccagaucgcc

SEQ ID NO: 3475503 - RNA, 21 nt, Pseudomonas aeruginosa PA01
guuggcgccccagaucgccag

SEQ ID NO: 3475504 - RNA, 22 nt, Pseudomonas aeruginosa PA01
guuggcgccccagaucgccagc

SEQ ID NO: 3475505 - RNA, 15 nt, Pseudomonas aeruginosa PA01
guuggcgccguccug

SEQ ID NO: 3475506 - RNA, 19 nt, Pseudomonas aeruginosa PA01
guuggcgccuucggcgaca

SEQ ID NO: 3475507 - RNA, 20 nt, Pseudomonas aeruginosa PA01
guuggcgcgaccgcccgccu

SEQ ID NO: 3475508 - RNA, 20 nt, Pseudomonas aeruginosa PA01
guuggcgcgagaaggcguag

SEQ ID NO: 3475509 - RNA, 11 nt, Pseudomonas aeruginosa PA01
guuggcgcggg

SEQ ID NO: 3475510 - RNA, 18 nt, Pseudomonas aeruginosa PA01
guuggcgcgggcgaaggc

SEQ ID NO: 3475511 - RNA, 14 nt, Pseudomonas aeruginosa PA01
guuggcgcucggcc

SEQ ID NO: 3475512 - RNA, 11 nt, Pseudomonas aeruginosa PA01
guuggcggcca

SEQ ID NO: 3475513 - RNA, 13 nt, Pseudomonas aeruginosa PA01
guuggcggccagc

SEQ ID NO: 3475514 - RNA, 20 nt, Pseudomonas aeruginosa PA01
guuggcggccaucaggcgcu

SEQ ID NO: 3475515 - RNA, 12 nt, Pseudomonas aeruginosa PA01
guuggcggccga

SEQ ID NO: 3475516 - RNA, 14 nt, Pseudomonas aeruginosa PA01
guuggcggugccgc

SEQ ID NO: 3475517 - RNA, 16 nt, Pseudomonas aeruginosa PA01
guuggcgucgcugccg

SEQ ID NO: 3475518 - RNA, 19 nt, Pseudomonas aeruginosa PA01
guuggcgugcaucaccuug

SEQ ID NO: 3475519 - RNA, 18 nt, Pseudomonas aeruginosa PA01
guuggcguuaugcgcccu

SEQ ID NO: 3475520 - RNA, 15 nt, Pseudomonas aeruginosa PA01
guuggcuacccgcag

SEQ ID NO: 3475521 - RNA, 20 nt, Pseudomonas aeruginosa PA01
guuggcuacccgcagggcuc

SEQ ID NO: 3475522 - RNA, 14 nt, Pseudomonas aeruginosa PA01
guuggcuccgggcc

SEQ ID NO: 3475523 - RNA, 18 nt, Pseudomonas aeruginosa PA01
guuggcuccgggccgagg

SEQ ID NO: 3475524 - RNA, 16 nt, Pseudomonas aeruginosa PA01
guuggcuuccagccag

SEQ ID NO: 3475525 - RNA, 13 nt, Pseudomonas aeruginosa PA01
guugggcaggcgc

SEQ ID NO: 3475526 - RNA, 14 nt, Pseudomonas aeruginosa PA01
guugggccagggcc

SEQ ID NO: 3475527 - RNA, 16 nt, Pseudomonas aeruginosa PA01
guugggccucgcugcg

SEQ ID NO: 3475528 - RNA, 22 nt, Pseudomonas aeruginosa PA01
guugggcgaccugcucgaaccg

SEQ ID NO: 3475529 - RNA, 15 nt, Pseudomonas aeruginosa PA01
guugguacagcucgc

SEQ ID NO: 3475530 - RNA, 21 nt, Pseudomonas aeruginosa PA01
guugguauggcagcucugcga

SEQ ID NO: 3475531 - RNA, 15 nt, Pseudomonas aeruginosa PA01
guuggucggcaccag

SEQ ID NO: 3475532 - RNA, 20 nt, Pseudomonas aeruginosa PA01
guuggucggcaccagggcuu

SEQ ID NO: 3475533 - RNA, 13 nt, Pseudomonas aeruginosa PA01
guuggucugcucg

SEQ ID NO: 3475534 - RNA, 14 nt, Pseudomonas aeruginosa PA01
guuggucugcucgg

SEQ ID NO: 3475535 - RNA, 16 nt, Pseudomonas aeruginosa PA01
guuggugcacgcgccg

SEQ ID NO: 3475536 - RNA, 17 nt, Pseudomonas aeruginosa PA01
guuggugcacgcgccgg

SEQ ID NO: 3475537 - RNA, 19 nt, Pseudomonas aeruginosa PA01
guuggugcacgcgccgggu

SEQ ID NO: 3475538 - RNA, 15 nt, Pseudomonas aeruginosa PA01
guugguggccgcgcc

SEQ ID NO: 3475539 - RNA, 16 nt, Pseudomonas aeruginosa PA01
guugguggggcgccgg

SEQ ID NO: 3475540 - RNA, 22 nt, Pseudomonas aeruginosa PA01
guugguguugauggucaccuug

SEQ ID NO: 3475541 - RNA, 22 nt, Pseudomonas aeruginosa PA01
guuguacagcgaggcccgcgcc

SEQ ID NO: 3475542 - RNA, 14 nt, Pseudomonas aeruginosa PA01
guuguacuggccga

SEQ ID NO: 3475543 - RNA, 19 nt, Pseudomonas aeruginosa PA01
guuguagaaacgguccagg

SEQ ID NO: 3475544 - RNA, 14 nt, Pseudomonas aeruginosa PA01
guuguagaccaucu

SEQ ID NO: 3475545 - RNA, 14 nt, Pseudomonas aeruginosa PA01
guuguagcccuggg

SEQ ID NO: 3475546 - RNA, 17 nt, Pseudomonas aeruginosa PA01
guuguaggccaugauca

SEQ ID NO: 3475547 - RNA, 19 nt, Pseudomonas aeruginosa PA01
guuguaggccaugaucauc

SEQ ID NO: 3475548 - RNA, 13 nt, Pseudomonas aeruginosa PA01
guuguccaggcga

SEQ ID NO: 3475549 - RNA, 18 nt, Pseudomonas aeruginosa PA01
guuguccaggcgaugguu

SEQ ID NO: 3475550 - RNA, 22 nt, Pseudomonas aeruginosa PA01
guuguccaggcuguggcgcggc

SEQ ID NO: 3475551 - RNA, 14 nt, Pseudomonas aeruginosa PA01
guuguccagggcau

SEQ ID NO: 3475552 - RNA, 19 nt, Pseudomonas aeruginosa PA01
guuguccagggcauccauc

SEQ ID NO: 3475553 - RNA, 22 nt, Pseudomonas aeruginosa PA01
guuguccagggcauccaucgcc

SEQ ID NO: 3475554 - RNA, 21 nt, Pseudomonas aeruginosa PA01
guugucugggaguuccgcgca

SEQ ID NO: 3475555 - RNA, 19 nt, Pseudomonas aeruginosa PA01
guugugaucgaccucgcgg

SEQ ID NO: 3475556 - RNA, 16 nt, Pseudomonas aeruginosa PA01
guugugccgccaccuc

SEQ ID NO: 3475557 - RNA, 13 nt, Pseudomonas aeruginosa PA01
guuguggcggcgc

SEQ ID NO: 3475558 - RNA, 14 nt, Pseudomonas aeruginosa PA01
guuguggcuggccu

SEQ ID NO: 3475559 - RNA, 23 nt, Pseudomonas aeruginosa PA01
guuguuauggccgacccgugcgc

SEQ ID NO: 3475560 - RNA, 17 nt, Pseudomonas aeruginosa PA01
guuguucaggcgcgcgg

SEQ ID NO: 3475561 - RNA, 15 nt, Pseudomonas aeruginosa PA01
guuguucgccagcag

SEQ ID NO: 3475562 - RNA, 17 nt, Pseudomonas aeruginosa PA01
guuguucgcgcaccuug

SEQ ID NO: 3475563 - RNA, 13 nt, Pseudomonas aeruginosa PA01
guuguucggcgag

SEQ ID NO: 3475564 - RNA, 14 nt, Pseudomonas aeruginosa PA01
guuguucggcgagu

SEQ ID NO: 3475565 - RNA, 19 nt, Pseudomonas aeruginosa PA01
guuguugaacgucucggcg

SEQ ID NO: 3475566 - RNA, 17 nt, Pseudomonas aeruginosa PA01
guuguugcccaccagcg

SEQ ID NO: 3475567 - RNA, 18 nt, Pseudomonas aeruginosa PA01
guuuaccaggaccagcgc

SEQ ID NO: 3475568 - RNA, 19 nt, Pseudomonas aeruginosa PA01
guuuaccaggaccagcgcc

SEQ ID NO: 3475569 - RNA, 14 nt, Pseudomonas aeruginosa PA01
guuuagccgccagu

SEQ ID NO: 3475570 - RNA, 15 nt, Pseudomonas aeruginosa PA01
guuuagccgccagug

SEQ ID NO: 3475571 - RNA, 21 nt, Pseudomonas aeruginosa PA01
guuucacggcggauaaccgcg

SEQ ID NO: 3475572 - RNA, 16 nt, Pseudomonas aeruginosa PA01
guuucagcgccagcag

SEQ ID NO: 3475573 - RNA, 16 nt, Pseudomonas aeruginosa PA01
guuucaucucggcgca

SEQ ID NO: 3475574 - RNA, 13 nt, Pseudomonas aeruginosa PA01
guuuccagcagca

SEQ ID NO: 3475575 - RNA, 18 nt, Pseudomonas aeruginosa PA01
guuuccccguggcgccgc

SEQ ID NO: 3475576 - RNA, 21 nt, Pseudomonas aeruginosa PA01
guuuccccguggcgccgcagg

SEQ ID NO: 3475577 - RNA, 19 nt, Pseudomonas aeruginosa PA01
guuucccggcgcggcuacc

SEQ ID NO: 3475578 - RNA, 14 nt, Pseudomonas aeruginosa PA01
guuuccgacccgga

SEQ ID NO: 3475579 - RNA, 22 nt, Pseudomonas aeruginosa PA01
guuuccgacccggaucauggua

SEQ ID NO: 3475580 - RNA, 12 nt, Pseudomonas aeruginosa PA01
guuuccgcgagg

SEQ ID NO: 3475581 - RNA, 22 nt, Pseudomonas aeruginosa PA01
guuuccgcuguccgccgccgcg

SEQ ID NO: 3475582 - RNA, 13 nt, Pseudomonas aeruginosa PA01
guuuccggcagca

SEQ ID NO: 3475583 - RNA, 16 nt, Pseudomonas aeruginosa PA01
guuuccggcagcacgu

SEQ ID NO: 3475584 - RNA, 15 nt, Pseudomonas aeruginosa PA01
guuuccggccaggcg

SEQ ID NO: 3475585 - RNA, 17 nt, Pseudomonas aeruginosa PA01
guuuccggccaggcgcg

SEQ ID NO: 3475586 - RNA, 22 nt, Pseudomonas aeruginosa PA01
guuuccgugcggaaaccgcggc

SEQ ID NO: 3475587 - RNA, 17 nt, Pseudomonas aeruginosa PA01
guuuccgugugcagcag

SEQ ID NO: 3475588 - RNA, 13 nt, Pseudomonas aeruginosa PA01
guuuccucgaagc

SEQ ID NO: 3475589 - RNA, 17 nt, Pseudomonas aeruginosa PA01
guuucgaugagcuucgc

SEQ ID NO: 3475590 - RNA, 13 nt, Pseudomonas aeruginosa PA01
guuucgcagcgcu

SEQ ID NO: 3475591 - RNA, 18 nt, Pseudomonas aeruginosa PA01
guuucgccaccuguucca

SEQ ID NO: 3475592 - RNA, 18 nt, Pseudomonas aeruginosa PA01
guuucggguccaggcgcc

SEQ ID NO: 3475593 - RNA, 14 nt, Pseudomonas aeruginosa PA01
guuucguccccuuc

SEQ ID NO: 3475594 - RNA, 12 nt, Pseudomonas aeruginosa PA01
guuucgucgcgg

SEQ ID NO: 3475595 - RNA, 20 nt, Pseudomonas aeruginosa PA01
guuucguugcggaacgcggc

SEQ ID NO: 3475596 - RNA, 17 nt, Pseudomonas aeruginosa PA01
guuucucggucgccgcc

SEQ ID NO: 3475597 - RNA, 15 nt, Pseudomonas aeruginosa PA01
guuucugcuggccac

SEQ ID NO: 3475598 - RNA, 21 nt, Pseudomonas aeruginosa PA01
guuucuucccacuccagcgcg

SEQ ID NO: 3475599 - RNA, 23 nt, Pseudomonas aeruginosa PA01
guuucuucgccuugcccuggccg

SEQ ID NO: 3475600 - RNA, 23 nt, Pseudomonas aeruginosa PA01
guuugccaaaaacgcucggugaa

SEQ ID NO: 3475601 - RNA, 15 nt, Pseudomonas aeruginosa PA01
guuugcccagcgccg

SEQ ID NO: 3475602 - RNA, 16 nt, Pseudomonas aeruginosa PA01
guuugcccagcgccgc

SEQ ID NO: 3475603 - RNA, 15 nt, Pseudomonas aeruginosa PA01
guuugccgucggcgc

SEQ ID NO: 3475604 - RNA, 13 nt, Pseudomonas aeruginosa PA01
guuugcgccgccg

SEQ ID NO: 3475605 - RNA, 12 nt, Pseudomonas aeruginosa PA01
guuuggcgcccg

SEQ ID NO: 3475606 - RNA, 17 nt, Pseudomonas aeruginosa PA01
guuuuacucgucgccaa

SEQ ID NO: 3475607 - RNA, 18 nt, Pseudomonas aeruginosa PA01
guuuuccgcuuccacgcu

SEQ ID NO: 3475608 - RNA, 18 nt, Pseudomonas aeruginosa PA01
guuuuccugccccgugca

SEQ ID NO: 3475609 - RNA, 18 nt, Pseudomonas aeruginosa PA01
guuuucguugccgcgcuc

SEQ ID NO: 3475610 - RNA, 18 nt, Pseudomonas aeruginosa PA01
guuuucguuggcgcgacc

SEQ ID NO: 3475611 - RNA, 16 nt, Pseudomonas aeruginosa PA01
guuuuuccuuguggcg

SEQ ID NO: 3475612 - RNA, 13 nt, Pseudomonas aeruginosa PA01
guuuuuuuugccu

SEQ ID NO: 3475613 - RNA, 20 nt, Pseudomonas aeruginosa PA01
uaaaacggcaggcaaaaaaa

SEQ ID NO: 3475614 - RNA, 22 nt, Pseudomonas aeruginosa PA01
uaaaacggcaggcaaaaaaaag

SEQ ID NO: 3475615 - RNA, 14 nt, Pseudomonas aeruginosa PA01
uaaaggccaccaga

SEQ ID NO: 3475616 - RNA, 17 nt, Pseudomonas aeruginosa PA01
uaaagguaauaucaccc

SEQ ID NO: 3475617 - RNA, 20 nt, Pseudomonas aeruginosa PA01
uaaauccgucauacaacugu

SEQ ID NO: 3475618 - RNA, 19 nt, Pseudomonas aeruginosa PA01
uaacaccaggagcgccagc

SEQ ID NO: 3475619 - RNA, 14 nt, Pseudomonas aeruginosa PA01
uaaccaacagcguu

SEQ ID NO: 3475620 - RNA, 15 nt, Pseudomonas aeruginosa PA01
uaaccaacagcguuc

SEQ ID NO: 3475621 - RNA, 22 nt, Pseudomonas aeruginosa PA01
uaaccaauuucuuccaucgugg

SEQ ID NO: 3475622 - RNA, 15 nt, Pseudomonas aeruginosa PA01
uaaccauugcgcggg

SEQ ID NO: 3475623 - RNA, 14 nt, Pseudomonas aeruginosa PA01
uaaccgcaucgcgg

SEQ ID NO: 3475624 - RNA, 11 nt, Pseudomonas aeruginosa PA01
uaaccgcucgc

SEQ ID NO: 3475625 - RNA, 22 nt, Pseudomonas aeruginosa PA01
uaaccgcuugcgguuauccgcc

SEQ ID NO: 3475626 - RNA, 13 nt, Pseudomonas aeruginosa PA01
uaaccgucgcugg

SEQ ID NO: 3475627 - RNA, 12 nt, Pseudomonas aeruginosa PA01
uaacgccacagg

SEQ ID NO: 3475628 - RNA, 16 nt, Pseudomonas aeruginosa PA01
uaacgccaccggcguu

SEQ ID NO: 3475629 - RNA, 20 nt, Pseudomonas aeruginosa PA01
uaacgccccucuuccacgcg

SEQ ID NO: 3475630 - RNA, 12 nt, Pseudomonas aeruginosa PA01
uaacgccgagga

SEQ ID NO: 3475631 - RNA, 18 nt, Pseudomonas aeruginosa PA01
uaacgccugucgcuccgg

SEQ ID NO: 3475632 - RNA, 19 nt, Pseudomonas aeruginosa PA01
uaacgccugucgcuccggc

SEQ ID NO: 3475633 - RNA, 13 nt, Pseudomonas aeruginosa PA01
uaacguuacgcag

SEQ ID NO: 3475634 - RNA, 22 nt, Pseudomonas aeruginosa PA01
uaaggcaccaccgccgccagca

SEQ ID NO: 3475635 - RNA, 14 nt, Pseudomonas aeruginosa PA01
uaaggcaugcccag

SEQ ID NO: 3475636 - RNA, 11 nt, Pseudomonas aeruginosa PA01
uaaggccaggc

SEQ ID NO: 3475637 - RNA, 14 nt, Pseudomonas aeruginosa PA01
uaaggccaggcucg

SEQ ID NO: 3475638 - RNA, 23 nt, Pseudomonas aeruginosa PA01
uaaggcgugcaguacuuggccag

SEQ ID NO: 3475639 - RNA, 19 nt, Pseudomonas aeruginosa PA01
uaagguuuuccgucacugg

SEQ ID NO: 3475640 - RNA, 22 nt, Pseudomonas aeruginosa PA01
uaagugccgaccacaugggcga

SEQ ID NO: 3475641 - RNA, 22 nt, Pseudomonas aeruginosa PA01
uaauccacgcugugcggcagca

SEQ ID NO: 3475642 - RNA, 13 nt, Pseudomonas aeruginosa PA01
uaauccaucgcuu

SEQ ID NO: 3475643 - RNA, 15 nt, Pseudomonas aeruginosa PA01
uaaucgcagcgcggu

SEQ ID NO: 3475644 - RNA, 20 nt, Pseudomonas aeruginosa PA01
uaaucgccauuggccagggu

SEQ ID NO: 3475645 - RNA, 18 nt, Pseudomonas aeruginosa PA01
uaaucgcucaacggcgug

SEQ ID NO: 3475646 - RNA, 14 nt, Pseudomonas aeruginosa PA01
uaaugcggcgcgau

SEQ ID NO: 3475647 - RNA, 22 nt, Pseudomonas aeruginosa PA01
uaauugcgagcgagcuugcaau

SEQ ID NO: 3475648 - RNA, 13 nt, Pseudomonas aeruginosa PA01
uaauuuugcuacc

SEQ ID NO: 3475649 - RNA, 16 nt, Pseudomonas aeruginosa PA01
uacaaagcauuucuuc

SEQ ID NO: 3475650 - RNA, 17 nt, Pseudomonas aeruginosa PA01
uacaacggcaucggcca

SEQ ID NO: 3475651 - RNA, 18 nt, Pseudomonas aeruginosa PA01
uacaacggcaucggccac

SEQ ID NO: 3475652 - RNA, 16 nt, Pseudomonas aeruginosa PA01
uacaaugauggcccuu

SEQ ID NO: 3475653 - RNA, 21 nt, Pseudomonas aeruginosa PA01
uacacaaugaucgcgccggau

SEQ ID NO: 3475654 - RNA, 22 nt, Pseudomonas aeruginosa PA01
uacacagcuugggauggccagc

SEQ ID NO: 3475655 - RNA, 17 nt, Pseudomonas aeruginosa PA01
uacacaugcaggcucga

SEQ ID NO: 3475656 - RNA, 20 nt, Pseudomonas aeruginosa PA01
uacaccaggccggcggccga

SEQ ID NO: 3475657 - RNA, 22 nt, Pseudomonas aeruginosa PA01
uacaccgcaucgaagcgcacca

SEQ ID NO: 3475658 - RNA, 17 nt, Pseudomonas aeruginosa PA01
uacacgccguuguugac

SEQ ID NO: 3475659 - RNA, 15 nt, Pseudomonas aeruginosa PA01
uacagcacccaggcg

SEQ ID NO: 3475660 - RNA, 20 nt, Pseudomonas aeruginosa PA01
uacagccgggaucuccucga

SEQ ID NO: 3475661 - RNA, 15 nt, Pseudomonas aeruginosa PA01
uacagcgaggcccgc

SEQ ID NO: 3475662 - RNA, 23 nt, Pseudomonas aeruginosa PA01
uacagcgaggcccgcgccgccgg

SEQ ID NO: 3475663 - RNA, 17 nt, Pseudomonas aeruginosa PA01
uacagcgcgacaucggc

SEQ ID NO: 3475664 - RNA, 15 nt, Pseudomonas aeruginosa PA01
uacagcgggccgggg

SEQ ID NO: 3475665 - RNA, 17 nt, Pseudomonas aeruginosa PA01
uacagcucaccccagga

SEQ ID NO: 3475666 - RNA, 13 nt, Pseudomonas aeruginosa PA01
uacagcucgcgca

SEQ ID NO: 3475667 - RNA, 18 nt, Pseudomonas aeruginosa PA01
uacaggaaucauuuggug

SEQ ID NO: 3475668 - RNA, 15 nt, Pseudomonas aeruginosa PA01
uacaggccccaggcg

SEQ ID NO: 3475669 - RNA, 18 nt, Pseudomonas aeruginosa PA01
uacaggccccaggcgauc

SEQ ID NO: 3475670 - RNA, 15 nt, Pseudomonas aeruginosa PA01
uacaggcgcaccugg

SEQ ID NO: 3475671 - RNA, 17 nt, Pseudomonas aeruginosa PA01
uacaggcgcaccuggcg

SEQ ID NO: 3475672 - RNA, 13 nt, Pseudomonas aeruginosa PA01
uacaggcgcagca

SEQ ID NO: 3475673 - RNA, 15 nt, Pseudomonas aeruginosa PA01
uacaggcgcagcagc

SEQ ID NO: 3475674 - RNA, 16 nt, Pseudomonas aeruginosa PA01
uacaggcgcagcagca

SEQ ID NO: 3475675 - RNA, 14 nt, Pseudomonas aeruginosa PA01
uacaggcgcgccug

SEQ ID NO: 3475676 - RNA, 14 nt, Pseudomonas aeruginosa PA01
uacagguuguucgg

SEQ ID NO: 3475677 - RNA, 21 nt, Pseudomonas aeruginosa PA01
uacauagcgggucaugagguu

SEQ ID NO: 3475678 - RNA, 19 nt, Pseudomonas aeruginosa PA01
uacaugacgaagcgcaccg

SEQ ID NO: 3475679 - RNA, 23 nt, Pseudomonas aeruginosa PA01
uacaugcugcucaguugcaccug

SEQ ID NO: 3475680 - RNA, 18 nt, Pseudomonas aeruginosa PA01
uaccaacuuucccucucu

SEQ ID NO: 3475681 - RNA, 23 nt, Pseudomonas aeruginosa PA01
uaccaauuuuaauuuugcuacca

SEQ ID NO: 3475682 - RNA, 17 nt, Pseudomonas aeruginosa PA01
uaccaccgggccgucgg

SEQ ID NO: 3475683 - RNA, 21 nt, Pseudomonas aeruginosa PA01
uaccacgggcaguuccaggcc

SEQ ID NO: 3475684 - RNA, 13 nt, Pseudomonas aeruginosa PA01
uaccacguccaga

SEQ ID NO: 3475685 - RNA, 15 nt, Pseudomonas aeruginosa PA01
uaccacguggccggc

SEQ ID NO: 3475686 - RNA, 14 nt, Pseudomonas aeruginosa PA01
uaccagaagccggc

SEQ ID NO: 3475687 - RNA, 19 nt, Pseudomonas aeruginosa PA01
uaccagaucaccaccaccg

SEQ ID NO: 3475688 - RNA, 20 nt, Pseudomonas aeruginosa PA01
uaccagcaaugcccagcgca

SEQ ID NO: 3475689 - RNA, 15 nt, Pseudomonas aeruginosa PA01
uaccagcaauuccac

SEQ ID NO: 3475690 - RNA, 20 nt, Pseudomonas aeruginosa PA01
uaccagcaauuccacgcgac

SEQ ID NO: 3475691 - RNA, 14 nt, Pseudomonas aeruginosa PA01
uaccagcagcgccg

SEQ ID NO: 3475692 - RNA, 14 nt, Pseudomonas aeruginosa PA01
uaccagcgcaccag

SEQ ID NO: 3475693 - RNA, 22 nt, Pseudomonas aeruginosa PA01
uaccagcgccgcuccuccucgc

SEQ ID NO: 3475694 - RNA, 21 nt, Pseudomonas aeruginosa PA01
uaccagcgcgauacccuggcc

SEQ ID NO: 3475695 - RNA, 22 nt, Pseudomonas aeruginosa PA01
uaccagcgcgauacccuggccg

SEQ ID NO: 3475696 - RNA, 11 nt, Pseudomonas aeruginosa PA01
uaccagcggcu

SEQ ID NO: 3475697 - RNA, 14 nt, Pseudomonas aeruginosa PA01
uaccagcggcuggc

SEQ ID NO: 3475698 - RNA, 12 nt, Pseudomonas aeruginosa PA01
uaccagcuuguc

SEQ ID NO: 3475699 - RNA, 21 nt, Pseudomonas aeruginosa PA01
uaccagcuugucgccuuccuc

SEQ ID NO: 3475700 - RNA, 20 nt, Pseudomonas aeruginosa PA01
uaccaggaagcucggcagca

SEQ ID NO: 3475701 - RNA, 24 nt, Pseudomonas aeruginosa PA01
uaccaggaagcucggcagcacgcu

SEQ ID NO: 3475702 - RNA, 14 nt, Pseudomonas aeruginosa PA01
uaccaggaccagcg

SEQ ID NO: 3475703 - RNA, 20 nt, Pseudomonas aeruginosa PA01
uaccaggaugcccugcucuu

SEQ ID NO: 3475704 - RNA, 20 nt, Pseudomonas aeruginosa PA01
uaccaggguguugucgcggc

SEQ ID NO: 3475705 - RNA, 22 nt, Pseudomonas aeruginosa PA01
uaccaggguguugucgcggcug

SEQ ID NO: 3475706 - RNA, 16 nt, Pseudomonas aeruginosa PA01
uaccagguucugccag

SEQ ID NO: 3475707 - RNA, 19 nt, Pseudomonas aeruginosa PA01
uaccagguucugccagagc

SEQ ID NO: 3475708 - RNA, 20 nt, Pseudomonas aeruginosa PA01
uaccagguucugccagagcg

SEQ ID NO: 3475709 - RNA, 23 nt, Pseudomonas aeruginosa PA01
uaccagguucugccagagcgcug

SEQ ID NO: 3475710 - RNA, 21 nt, Pseudomonas aeruginosa PA01
uaccagucgcccgcuucgcca

SEQ ID NO: 3475711 - RNA, 15 nt, Pseudomonas aeruginosa PA01
uaccauuagaggaac

SEQ ID NO: 3475712 - RNA, 15 nt, Pseudomonas aeruginosa PA01
uacccaggccgucga

SEQ ID NO: 3475713 - RNA, 18 nt, Pseudomonas aeruginosa PA01
uacccaggccgucgaggg

SEQ ID NO: 3475714 - RNA, 13 nt, Pseudomonas aeruginosa PA01
uacccagggugcg

SEQ ID NO: 3475715 - RNA, 17 nt, Pseudomonas aeruginosa PA01
uacccagguaagcggcg

SEQ ID NO: 3475716 - RNA, 23 nt, Pseudomonas aeruginosa PA01
uaccccacgguagagacggcggc

SEQ ID NO: 3475717 - RNA, 18 nt, Pseudomonas aeruginosa PA01
uacccccuugcccgucgg

SEQ ID NO: 3475718 - RNA, 17 nt, Pseudomonas aeruginosa PA01
uaccccgguugugcgcc

SEQ ID NO: 3475719 - RNA, 19 nt, Pseudomonas aeruginosa PA01
uaccccguuguacccggcg

SEQ ID NO: 3475720 - RNA, 18 nt, Pseudomonas aeruginosa PA01
uacccgacaggcagcgcc

SEQ ID NO: 3475721 - RNA, 13 nt, Pseudomonas aeruginosa PA01
uacccgccgcugg

SEQ ID NO: 3475722 - RNA, 15 nt, Pseudomonas aeruginosa PA01
uacccgccgcuggca

SEQ ID NO: 3475723 - RNA, 23 nt, Pseudomonas aeruginosa PA01
uacccgcgaccacaggcggcgga

SEQ ID NO: 3475724 - RNA, 19 nt, Pseudomonas aeruginosa PA01
uacccgcgccuucaguucg

SEQ ID NO: 3475725 - RNA, 14 nt, Pseudomonas aeruginosa PA01
uacccggcagggcc

SEQ ID NO: 3475726 - RNA, 12 nt, Pseudomonas aeruginosa PA01
uacccggcgccc

SEQ ID NO: 3475727 - RNA, 21 nt, Pseudomonas aeruginosa PA01
uacccggcggacaaccaccau

SEQ ID NO: 3475728 - RNA, 15 nt, Pseudomonas aeruginosa PA01
uacccguacgcugcc

SEQ ID NO: 3475729 - RNA, 18 nt, Pseudomonas aeruginosa PA01
uacccguacgcugccagg

SEQ ID NO: 3475730 - RNA, 14 nt, Pseudomonas aeruginosa PA01
uacccucuccccaa

SEQ ID NO: 3475731 - RNA, 13 nt, Pseudomonas aeruginosa PA01
uacccuggccggc

SEQ ID NO: 3475732 - RNA, 14 nt, Pseudomonas aeruginosa PA01
uacccuggccggcc

SEQ ID NO: 3475733 - RNA, 12 nt, Pseudomonas aeruginosa PA01
uacccugggagc

SEQ ID NO: 3475734 - RNA, 17 nt, Pseudomonas aeruginosa PA01
uacccuucaucccuucu

SEQ ID NO: 3475735 - RNA, 21 nt, Pseudomonas aeruginosa PA01
uaccgacaagcauucagcgcg

SEQ ID NO: 3475736 - RNA, 22 nt, Pseudomonas aeruginosa PA01
uaccgacaagcauucagcgcgc

SEQ ID NO: 3475737 - RNA, 17 nt, Pseudomonas aeruginosa PA01
uaccgacggucggcagg

SEQ ID NO: 3475738 - RNA, 15 nt, Pseudomonas aeruginosa PA01
uaccgagaucaccuu

SEQ ID NO: 3475739 - RNA, 15 nt, Pseudomonas aeruginosa PA01
uaccgagggugcaga

SEQ ID NO: 3475740 - RNA, 13 nt, Pseudomonas aeruginosa PA01
uaccgaucggcug

SEQ ID NO: 3475741 - RNA, 13 nt, Pseudomonas aeruginosa PA01
uaccgccagcucg

SEQ ID NO: 3475742 - RNA, 21 nt, Pseudomonas aeruginosa PA01
uaccgccagcucgcuguccag

SEQ ID NO: 3475743 - RNA, 17 nt, Pseudomonas aeruginosa PA01
uaccgcccacccugcgc

SEQ ID NO: 3475744 - RNA, 20 nt, Pseudomonas aeruginosa PA01
uaccgcccacccugcgcgag

SEQ ID NO: 3475745 - RNA, 12 nt, Pseudomonas aeruginosa PA01
uaccgccgaggg

SEQ ID NO: 3475746 - RNA, 21 nt, Pseudomonas aeruginosa PA01
uaccgccggcagugugccgcc

SEQ ID NO: 3475747 - RNA, 13 nt, Pseudomonas aeruginosa PA01
uaccgccggcggc

SEQ ID NO: 3475748 - RNA, 14 nt, Pseudomonas aeruginosa PA01
uaccgccggcggcg

SEQ ID NO: 3475749 - RNA, 17 nt, Pseudomonas aeruginosa PA01
uaccgcgcauggcggcg

SEQ ID NO: 3475750 - RNA, 16 nt, Pseudomonas aeruginosa PA01
uaccgcgcgcgcaagg

SEQ ID NO: 3475751 - RNA, 14 nt, Pseudomonas aeruginosa PA01
uaccgcucugcacc

SEQ ID NO: 3475752 - RNA, 14 nt, Pseudomonas aeruginosa PA01
uaccgcugcgcggg

SEQ ID NO: 3475753 - RNA, 20 nt, Pseudomonas aeruginosa PA01
uaccgcugcggccggcgcgu

SEQ ID NO: 3475754 - RNA, 16 nt, Pseudomonas aeruginosa PA01
uaccgcuggccagguc

SEQ ID NO: 3475755 - RNA, 15 nt, Pseudomonas aeruginosa PA01
uaccgcuggcgcugg

SEQ ID NO: 3475756 - RNA, 15 nt, Pseudomonas aeruginosa PA01
uaccgcuuccugggc

SEQ ID NO: 3475757 - RNA, 17 nt, Pseudomonas aeruginosa PA01
uaccggcaaggcgcuga

SEQ ID NO: 3475758 - RNA, 17 nt, Pseudomonas aeruginosa PA01
uaccggcaaggcggccu

SEQ ID NO: 3475759 - RNA, 19 nt, Pseudomonas aeruginosa PA01
uaccggccaucagcaccag

SEQ ID NO: 3475760 - RNA, 19 nt, Pseudomonas aeruginosa PA01
uaccggccugucacgccgg

SEQ ID NO: 3475761 - RNA, 14 nt, Pseudomonas aeruginosa PA01
uaccggcgaccuca

SEQ ID NO: 3475762 - RNA, 19 nt, Pseudomonas aeruginosa PA01
uaccggcggauaacgccug

SEQ ID NO: 3475763 - RNA, 19 nt, Pseudomonas aeruginosa PA01
uaccggcguugaacugccc

SEQ ID NO: 3475764 - RNA, 15 nt, Pseudomonas aeruginosa PA01
uaccgggccaggcaa

SEQ ID NO: 3475765 - RNA, 14 nt, Pseudomonas aeruginosa PA01
uaccuccagccagc

SEQ ID NO: 3475766 - RNA, 22 nt, Pseudomonas aeruginosa PA01
uaccuccagccagcagcccggc

SEQ ID NO: 3475767 - RNA, 15 nt, Pseudomonas aeruginosa PA01
uaccucgccaggcug

SEQ ID NO: 3475768 - RNA, 20 nt, Pseudomonas aeruginosa PA01
uaccucgugggugccggggg

SEQ ID NO: 3475769 - RNA, 16 nt, Pseudomonas aeruginosa PA01
uaccugcaaggcggug

SEQ ID NO: 3475770 - RNA, 13 nt, Pseudomonas aeruginosa PA01
uaccuggcgcuga

SEQ ID NO: 3475771 - RNA, 16 nt, Pseudomonas aeruginosa PA01
uaccuggcgcugaaca

SEQ ID NO: 3475772 - RNA, 19 nt, Pseudomonas aeruginosa PA01
uaccuggcgguacagcccc

SEQ ID NO: 3475773 - RNA, 20 nt, Pseudomonas aeruginosa PA01
uaccuggguugccgcgccga

SEQ ID NO: 3475774 - RNA, 14 nt, Pseudomonas aeruginosa PA01
uaccuugagcaggg

SEQ ID NO: 3475775 - RNA, 23 nt, Pseudomonas aeruginosa PA01
uacgaaaucuccuuggccaugua

SEQ ID NO: 3475776 - RNA, 23 nt, Pseudomonas aeruginosa PA01
uacgaaggcgugccgcuggccga

SEQ ID NO: 3475777 - RNA, 13 nt, Pseudomonas aeruginosa PA01
uacgacuucggcg

SEQ ID NO: 3475778 - RNA, 21 nt, Pseudomonas aeruginosa PA01
uacgacuucggcgacagccgg

SEQ ID NO: 3475779 - RNA, 14 nt, Pseudomonas aeruginosa PA01
uacgaucagccagg

SEQ ID NO: 3475780 - RNA, 22 nt, Pseudomonas aeruginosa PA01
uacgaugcuggcaacggcgggc

SEQ ID NO: 3475781 - RNA, 16 nt, Pseudomonas aeruginosa PA01
uacgcaacccgcccgg

SEQ ID NO: 3475782 - RNA, 17 nt, Pseudomonas aeruginosa PA01
uacgcaacccgcccggc

SEQ ID NO: 3475783 - RNA, 12 nt, Pseudomonas aeruginosa PA01
uacgcacgcugg

SEQ ID NO: 3475784 - RNA, 14 nt, Pseudomonas aeruginosa PA01
uacgcccagcagcg

SEQ ID NO: 3475785 - RNA, 20 nt, Pseudomonas aeruginosa PA01
uacgccccguuugccgucgg

SEQ ID NO: 3475786 - RNA, 22 nt, Pseudomonas aeruginosa PA01
uacgccccguuugccgucggcg

SEQ ID NO: 3475787 - RNA, 13 nt, Pseudomonas aeruginosa PA01
uacgcccgcagcc

SEQ ID NO: 3475788 - RNA, 15 nt, Pseudomonas aeruginosa PA01
uacgcccuccagcac

SEQ ID NO: 3475789 - RNA, 19 nt, Pseudomonas aeruginosa PA01
uacgccggauuucacggcg

SEQ ID NO: 3475790 - RNA, 17 nt, Pseudomonas aeruginosa PA01
uacgccggguuucacgg

SEQ ID NO: 3475791 - RNA, 11 nt, Pseudomonas aeruginosa PA01
uacgccuugca

SEQ ID NO: 3475792 - RNA, 22 nt, Pseudomonas aeruginosa PA01
uacgccuugcagggggcuuugc

SEQ ID NO: 3475793 - RNA, 17 nt, Pseudomonas aeruginosa PA01
uacgccuugcggcgccg

SEQ ID NO: 3475794 - RNA, 19 nt, Pseudomonas aeruginosa PA01
uacgccuugcggcgccgag

SEQ ID NO: 3475795 - RNA, 17 nt, Pseudomonas aeruginosa PA01
uacgcggcaccgcuuuc

SEQ ID NO: 3475796 - RNA, 21 nt, Pseudomonas aeruginosa PA01
uacgcuccguagggcgacgcc

SEQ ID NO: 3475797 - RNA, 15 nt, Pseudomonas aeruginosa PA01
uacgcucgccgacgg

SEQ ID NO: 3475798 - RNA, 13 nt, Pseudomonas aeruginosa PA01
uacgcucggccaa

SEQ ID NO: 3475799 - RNA, 20 nt, Pseudomonas aeruginosa PA01
uacgcucggggugcgcggcg

SEQ ID NO: 3475800 - RNA, 19 nt, Pseudomonas aeruginosa PA01
uacgcugcauguccgcagg

SEQ ID NO: 3475801 - RNA, 15 nt, Pseudomonas aeruginosa PA01
uacggaagcggccga

SEQ ID NO: 3475802 - RNA, 14 nt, Pseudomonas aeruginosa PA01
uacggaaggucgcc

SEQ ID NO: 3475803 - RNA, 19 nt, Pseudomonas aeruginosa PA01
uacggaaggucgccgggcu

SEQ ID NO: 3475804 - RNA, 19 nt, Pseudomonas aeruginosa PA01
uacggagaagggcgcgccc

SEQ ID NO: 3475805 - RNA, 22 nt, Pseudomonas aeruginosa PA01
uacggaugccgcgagccagccg

SEQ ID NO: 3475806 - RNA, 14 nt, Pseudomonas aeruginosa PA01
uacggcaccaccac

SEQ ID NO: 3475807 - RNA, 15 nt, Pseudomonas aeruginosa PA01
uacggcaccaccacc

SEQ ID NO: 3475808 - RNA, 22 nt, Pseudomonas aeruginosa PA01
uacggcagcggcgugaagccgc

SEQ ID NO: 3475809 - RNA, 14 nt, Pseudomonas aeruginosa PA01
uacgggcgccaggg

SEQ ID NO: 3475810 - RNA, 22 nt, Pseudomonas aeruginosa PA01
uacgggggcgugucgagggcug

SEQ ID NO: 3475811 - RNA, 20 nt, Pseudomonas aeruginosa PA01
uacgguacaguucaggcugg

SEQ ID NO: 3475812 - RNA, 20 nt, Pseudomonas aeruginosa PA01
uacgucuucgauggcggccg

SEQ ID NO: 3475813 - RNA, 23 nt, Pseudomonas aeruginosa PA01
uacgucuucgauggcggccgcca

SEQ ID NO: 3475814 - RNA, 15 nt, Pseudomonas aeruginosa PA01
uacgugauccguggc

SEQ ID NO: 3475815 - RNA, 19 nt, Pseudomonas aeruginosa PA01
uacgugauccguggcgagc

SEQ ID NO: 3475816 - RNA, 15 nt, Pseudomonas aeruginosa PA01
uacucaugaccgccg

SEQ ID NO: 3475817 - RNA, 22 nt, Pseudomonas aeruginosa PA01
uacucaugcaggcgucggucca

SEQ ID NO: 3475818 - RNA, 21 nt, Pseudomonas aeruginosa PA01
uacuccagcagcgcacgcuuc

SEQ ID NO: 3475819 - RNA, 20 nt, Pseudomonas aeruginosa PA01
uacuccgccgcuuccgccgg

SEQ ID NO: 3475820 - RNA, 12 nt, Pseudomonas aeruginosa PA01
uacuccgcgacg

SEQ ID NO: 3475821 - RNA, 18 nt, Pseudomonas aeruginosa PA01
uacucggcggggcgcagc

SEQ ID NO: 3475822 - RNA, 15 nt, Pseudomonas aeruginosa PA01
uacucggcuacgaac

SEQ ID NO: 3475823 - RNA, 18 nt, Pseudomonas aeruginosa PA01
uacucggcuacgaaccga

SEQ ID NO: 3475824 - RNA, 15 nt, Pseudomonas aeruginosa PA01
uacugagcgugaccc

SEQ ID NO: 3475825 - RNA, 23 nt, Pseudomonas aeruginosa PA01
uacugagcgugacccgcgcuucc

SEQ ID NO: 3475826 - RNA, 17 nt, Pseudomonas aeruginosa PA01
uacugcacgcccaggcg

SEQ ID NO: 3475827 - RNA, 18 nt, Pseudomonas aeruginosa PA01
uacugccgcuaucgcugg

SEQ ID NO: 3475828 - RNA, 19 nt, Pseudomonas aeruginosa PA01
uacugccgcuaucgcuggc

SEQ ID NO: 3475829 - RNA, 16 nt, Pseudomonas aeruginosa PA01
uacugcgcgggcaugc

SEQ ID NO: 3475830 - RNA, 17 nt, Pseudomonas aeruginosa PA01
uacugcgcgggcaugca

SEQ ID NO: 3475831 - RNA, 17 nt, Pseudomonas aeruginosa PA01
uacugcuggacggcgga

SEQ ID NO: 3475832 - RNA, 18 nt, Pseudomonas aeruginosa PA01
uacuggcggaucaccggc

SEQ ID NO: 3475833 - RNA, 19 nt, Pseudomonas aeruginosa PA01
uacuggcggaucaccggcu

SEQ ID NO: 3475834 - RNA, 14 nt, Pseudomonas aeruginosa PA01
uacugggcggcgac

SEQ ID NO: 3475835 - RNA, 18 nt, Pseudomonas aeruginosa PA01
uacugggcguggcggccg

SEQ ID NO: 3475836 - RNA, 16 nt, Pseudomonas aeruginosa PA01
uacugggucuuguagu

SEQ ID NO: 3475837 - RNA, 20 nt, Pseudomonas aeruginosa PA01
uacuggucgcgcgcggccag

SEQ ID NO: 3475838 - RNA, 13 nt, Pseudomonas aeruginosa PA01
uacuucgccgggu

SEQ ID NO: 3475839 - RNA, 21 nt, Pseudomonas aeruginosa PA01
uacuugaucagccgcaggcag

SEQ ID NO: 3475840 - RNA, 15 nt, Pseudomonas aeruginosa PA01
uacuugccagggcag

SEQ ID NO: 3475841 - RNA, 16 nt, Pseudomonas aeruginosa PA01
uacuuggcccggcguu

SEQ ID NO: 3475842 - RNA, 15 nt, Pseudomonas aeruginosa PA01
uagaaaagcaaggag

SEQ ID NO: 3475843 - RNA, 14 nt, Pseudomonas aeruginosa PA01
uagaaacgcgccuc

SEQ ID NO: 3475844 - RNA, 14 nt, Pseudomonas aeruginosa PA01
uagaacgccaggau

SEQ ID NO: 3475845 - RNA, 12 nt, Pseudomonas aeruginosa PA01
uagaccaaggca

SEQ ID NO: 3475846 - RNA, 16 nt, Pseudomonas aeruginosa PA01
uagaccaccagcagca

SEQ ID NO: 3475847 - RNA, 19 nt, Pseudomonas aeruginosa PA01
uagaccaccagcagcagcg

SEQ ID NO: 3475848 - RNA, 16 nt, Pseudomonas aeruginosa PA01
uagaccaccgugcgca

SEQ ID NO: 3475849 - RNA, 18 nt, Pseudomonas aeruginosa PA01
uagaccaccgugcgcacc

SEQ ID NO: 3475850 - RNA, 19 nt, Pseudomonas aeruginosa PA01
uagaccaccgugcgcaccu

SEQ ID NO: 3475851 - RNA, 18 nt, Pseudomonas aeruginosa PA01
uagaccaccucgacggcg

SEQ ID NO: 3475852 - RNA, 13 nt, Pseudomonas aeruginosa PA01
uagaccagcaccg

SEQ ID NO: 3475853 - RNA, 19 nt, Pseudomonas aeruginosa PA01
uagaccagcagcgagcagg

SEQ ID NO: 3475854 - RNA, 17 nt, Pseudomonas aeruginosa PA01
uagaccaggaaggccgg

SEQ ID NO: 3475855 - RNA, 19 nt, Pseudomonas aeruginosa PA01
uagaccaggaaggccgggc

SEQ ID NO: 3475856 - RNA, 16 nt, Pseudomonas aeruginosa PA01
uagaccgcuucgauga

SEQ ID NO: 3475857 - RNA, 17 nt, Pseudomonas aeruginosa PA01
uagaccuugcggccguu

SEQ ID NO: 3475858 - RNA, 22 nt, Pseudomonas aeruginosa PA01
uagacgccucccaccgcgcggc

SEQ ID NO: 3475859 - RNA, 21 nt, Pseudomonas aeruginosa PA01
uagacguagucggcagucgcc

SEQ ID NO: 3475860 - RNA, 16 nt, Pseudomonas aeruginosa PA01
uagacugucgcggggc

SEQ ID NO: 3475861 - RNA, 21 nt, Pseudomonas aeruginosa PA01
uagagauauucccgcgacaac

SEQ ID NO: 3475862 - RNA, 13 nt, Pseudomonas aeruginosa PA01
uagagaugcagca

SEQ ID NO: 3475863 - RNA, 22 nt, Pseudomonas aeruginosa PA01
uagagcacgcccauggagaaua

SEQ ID NO: 3475864 - RNA, 20 nt, Pseudomonas aeruginosa PA01
uagagcacgccgucgcgcuc

SEQ ID NO: 3475865 - RNA, 21 nt, Pseudomonas aeruginosa PA01
uagagccuggaguugugccag

SEQ ID NO: 3475866 - RNA, 17 nt, Pseudomonas aeruginosa PA01
uagagcgcggcgcaggc

SEQ ID NO: 3475867 - RNA, 11 nt, Pseudomonas aeruginosa PA01
uagagcggcac

SEQ ID NO: 3475868 - RNA, 13 nt, Pseudomonas aeruginosa PA01
uagagcgugcggc

SEQ ID NO: 3475869 - RNA, 16 nt, Pseudomonas aeruginosa PA01
uagaggaucucgccac

SEQ ID NO: 3475870 - RNA, 19 nt, Pseudomonas aeruginosa PA01
uagagggcguagugcauca

SEQ ID NO: 3475871 - RNA, 20 nt, Pseudomonas aeruginosa PA01
uagagguugauucaggcggc

SEQ ID NO: 3475872 - RNA, 18 nt, Pseudomonas aeruginosa PA01
uagaguacucggcuacga

SEQ ID NO: 3475873 - RNA, 19 nt, Pseudomonas aeruginosa PA01
uagaguacucggcuacgaa

SEQ ID NO: 3475874 - RNA, 15 nt, Pseudomonas aeruginosa PA01
uagagugcccaggcg

SEQ ID NO: 3475875 - RNA, 21 nt, Pseudomonas aeruginosa PA01
uagaguugcuuggcgcgcugg

SEQ ID NO: 3475876 - RNA, 15 nt, Pseudomonas aeruginosa PA01
uagauaaaugcccgg

SEQ ID NO: 3475877 - RNA, 23 nt, Pseudomonas aeruginosa PA01
uagaucgcccgcaguuccucgcc

SEQ ID NO: 3475878 - RNA, 13 nt, Pseudomonas aeruginosa PA01
uagaucugcacca

SEQ ID NO: 3475879 - RNA, 14 nt, Pseudomonas aeruginosa PA01
uagaugaucuccag

SEQ ID NO: 3475880 - RNA, 18 nt, Pseudomonas aeruginosa PA01
uagaugccggccucgacg

SEQ ID NO: 3475881 - RNA, 17 nt, Pseudomonas aeruginosa PA01
uagaugccggugcuggu

SEQ ID NO: 3475882 - RNA, 15 nt, Pseudomonas aeruginosa PA01
uagaugcggcugugc

SEQ ID NO: 3475883 - RNA, 16 nt, Pseudomonas aeruginosa PA01
uagaugugcuggguca

SEQ ID NO: 3475884 - RNA, 13 nt, Pseudomonas aeruginosa PA01
uagcaauacaacc

SEQ ID NO: 3475885 - RNA, 19 nt, Pseudomonas aeruginosa PA01
uagcacauggucuucccag

SEQ ID NO: 3475886 - RNA, 20 nt, Pseudomonas aeruginosa PA01
uagcacauggucuucccaga

SEQ ID NO: 3475887 - RNA, 22 nt, Pseudomonas aeruginosa PA01
uagcacauggucuucccagacc

SEQ ID NO: 3475888 - RNA, 21 nt, Pseudomonas aeruginosa PA01
uagcaccgauuuccccaaggc

SEQ ID NO: 3475889 - RNA, 19 nt, Pseudomonas aeruginosa PA01
uagcagagggucgccagcg

SEQ ID NO: 3475890 - RNA, 18 nt, Pseudomonas aeruginosa PA01
uagcagauaucgugcagg

SEQ ID NO: 3475891 - RNA, 19 nt, Pseudomonas aeruginosa PA01
uagcagaugucguucuugc

SEQ ID NO: 3475892 - RNA, 20 nt, Pseudomonas aeruginosa PA01
uagcagccgcaggaugccgc

SEQ ID NO: 3475893 - RNA, 19 nt, Pseudomonas aeruginosa PA01
uagcaggccuggagcgccu

SEQ ID NO: 3475894 - RNA, 21 nt, Pseudomonas aeruginosa PA01
uagcaggccuggagcgccucg

SEQ ID NO: 3475895 - RNA, 16 nt, Pseudomonas aeruginosa PA01
uagcaggucacgcccu

SEQ ID NO: 3475896 - RNA, 19 nt, Pseudomonas aeruginosa PA01
uagccaaccagauccggga

SEQ ID NO: 3475897 - RNA, 18 nt, Pseudomonas aeruginosa PA01
uagccaggggucaggccg

SEQ ID NO: 3475898 - RNA, 18 nt, Pseudomonas aeruginosa PA01
uagccauggcggaucugg

SEQ ID NO: 3475899 - RNA, 15 nt, Pseudomonas aeruginosa PA01
uagcccaggccgaag

SEQ ID NO: 3475900 - RNA, 16 nt, Pseudomonas aeruginosa PA01
uagcccaggccgaagg

SEQ ID NO: 3475901 - RNA, 17 nt, Pseudomonas aeruginosa PA01
uagcccaggccgaaggc

SEQ ID NO: 3475902 - RNA, 11 nt, Pseudomonas aeruginosa PA01
uagcccagggg

SEQ ID NO: 3475903 - RNA, 13 nt, Pseudomonas aeruginosa PA01
uagcccccgccgc

SEQ ID NO: 3475904 - RNA, 15 nt, Pseudomonas aeruginosa PA01
uagcccccgccgcug

SEQ ID NO: 3475905 - RNA, 17 nt, Pseudomonas aeruginosa PA01
uagcccccgccgcugag

SEQ ID NO: 3475906 - RNA, 16 nt, Pseudomonas aeruginosa PA01
uagccccggcccggcg

SEQ ID NO: 3475907 - RNA, 23 nt, Pseudomonas aeruginosa PA01
uagcccggguugcccucgcagcc

SEQ ID NO: 3475908 - RNA, 13 nt, Pseudomonas aeruginosa PA01
uagcccgucggcg

SEQ ID NO: 3475909 - RNA, 13 nt, Pseudomonas aeruginosa PA01
uagcccugcugcu

SEQ ID NO: 3475910 - RNA, 14 nt, Pseudomonas aeruginosa PA01
uagcccugcugcuc

SEQ ID NO: 3475911 - RNA, 16 nt, Pseudomonas aeruginosa PA01
uagcccugggcgaugc

SEQ ID NO: 3475912 - RNA, 16 nt, Pseudomonas aeruginosa PA01
uagcccugggcgccgc

SEQ ID NO: 3475913 - RNA, 19 nt, Pseudomonas aeruginosa PA01
uagccgaacuccgccagca

SEQ ID NO: 3475914 - RNA, 15 nt, Pseudomonas aeruginosa PA01
uagccgaccaggccg

SEQ ID NO: 3475915 - RNA, 18 nt, Pseudomonas aeruginosa PA01
uagccgaccaggccgauc

SEQ ID NO: 3475916 - RNA, 21 nt, Pseudomonas aeruginosa PA01
uagccgaggcggccgagggcg

SEQ ID NO: 3475917 - RNA, 17 nt, Pseudomonas aeruginosa PA01
uagccgaucaacgcggc

SEQ ID NO: 3475918 - RNA, 21 nt, Pseudomonas aeruginosa PA01
uagccgaucaacgcggccagc

SEQ ID NO: 3475919 - RNA, 22 nt, Pseudomonas aeruginosa PA01
uagccgaucaacgcggccagca

SEQ ID NO: 3475920 - RNA, 20 nt, Pseudomonas aeruginosa PA01
uagccgcaagcggauauccc

SEQ ID NO: 3475921 - RNA, 16 nt, Pseudomonas aeruginosa PA01
uagccgcaguccaggg

SEQ ID NO: 3475922 - RNA, 18 nt, Pseudomonas aeruginosa PA01
uagccgcaguccagggcg

SEQ ID NO: 3475923 - RNA, 14 nt, Pseudomonas aeruginosa PA01
uagccgcccaccgc

SEQ ID NO: 3475924 - RNA, 14 nt, Pseudomonas aeruginosa PA01
uagccgcgccggcc

SEQ ID NO: 3475925 - RNA, 15 nt, Pseudomonas aeruginosa PA01
uagccgcgcgccagc

SEQ ID NO: 3475926 - RNA, 16 nt, Pseudomonas aeruginosa PA01
uagccggacuccgacg

SEQ ID NO: 3475927 - RNA, 18 nt, Pseudomonas aeruginosa PA01
uagccggccaaccaccgg

SEQ ID NO: 3475928 - RNA, 12 nt, Pseudomonas aeruginosa PA01
uagccggccagg

SEQ ID NO: 3475929 - RNA, 13 nt, Pseudomonas aeruginosa PA01
uagccggccaggg

SEQ ID NO: 3475930 - RNA, 18 nt, Pseudomonas aeruginosa PA01
uagccggcgaaccaggcg

SEQ ID NO: 3475931 - RNA, 19 nt, Pseudomonas aeruginosa PA01
uagccggcgaaccaggcgg

SEQ ID NO: 3475932 - RNA, 20 nt, Pseudomonas aeruginosa PA01
uagccggcgaucauccagcc

SEQ ID NO: 3475933 - RNA, 21 nt, Pseudomonas aeruginosa PA01
uagccggcgaucauccagccc

SEQ ID NO: 3475934 - RNA, 14 nt, Pseudomonas aeruginosa PA01
guggccccagcgcg

SEQ ID NO: 3475935 - RNA, 21 nt, Pseudomonas aeruginosa PA01
guggcccggcgcggcggccgc

SEQ ID NO: 3475936 - RNA, 14 nt, Pseudomonas aeruginosa PA01
guggcccugggcgg

SEQ ID NO: 3475937 - RNA, 17 nt, Pseudomonas aeruginosa PA01
guggcccugggcggcga

SEQ ID NO: 3475938 - RNA, 13 nt, Pseudomonas aeruginosa PA01
guggccgaaggcg

SEQ ID NO: 3475939 - RNA, 14 nt, Pseudomonas aeruginosa PA01
guggccgccagggu

SEQ ID NO: 3475940 - RNA, 13 nt, Pseudomonas aeruginosa PA01
guggccgcgccgc

SEQ ID NO: 3475941 - RNA, 22 nt, Pseudomonas aeruginosa PA01
guggccgcgccgcccuggccgc

SEQ ID NO: 3475942 - RNA, 17 nt, Pseudomonas aeruginosa PA01
guggccgcgggaggccg

SEQ ID NO: 3475943 - RNA, 13 nt, Pseudomonas aeruginosa PA01
guggccgcugagc

SEQ ID NO: 3475944 - RNA, 19 nt, Pseudomonas aeruginosa PA01
guggccgcugagcagcagg

SEQ ID NO: 3475945 - RNA, 15 nt, Pseudomonas aeruginosa PA01
guggccggaaaaagc

SEQ ID NO: 3475946 - RNA, 17 nt, Pseudomonas aeruginosa PA01
guggccggcgaccagcu

SEQ ID NO: 3475947 - RNA, 18 nt, Pseudomonas aeruginosa PA01
guggccggucugguagcg

SEQ ID NO: 3475948 - RNA, 21 nt, Pseudomonas aeruginosa PA01
guggccgucgaagggcacgcc

SEQ ID NO: 3475949 - RNA, 24 nt, Pseudomonas aeruginosa PA01
guggccgucgaagggcacgccgcu

SEQ ID NO: 3475950 - RNA, 18 nt, Pseudomonas aeruginosa PA01
guggccgucgcgccgcgg

SEQ ID NO: 3475951 - RNA, 14 nt, Pseudomonas aeruginosa PA01
guggccguggcgcc

SEQ ID NO: 3475952 - RNA, 19 nt, Pseudomonas aeruginosa PA01
guggccguggcgccccagg

SEQ ID NO: 3475953 - RNA, 18 nt, Pseudomonas aeruginosa PA01
guggccgugggccgccga

SEQ ID NO: 3475954 - RNA, 22 nt, Pseudomonas aeruginosa PA01
guggccuccugcaacgccuggu

SEQ ID NO: 3475955 - RNA, 18 nt, Pseudomonas aeruginosa PA01
guggcgaaacuccagcag

SEQ ID NO: 3475956 - RNA, 19 nt, Pseudomonas aeruginosa PA01
guggcgaaacuccagcagg

SEQ ID NO: 3475957 - RNA, 15 nt, Pseudomonas aeruginosa PA01
guggcgaacagcacc

SEQ ID NO: 3475958 - RNA, 22 nt, Pseudomonas aeruginosa PA01
guggcgaacagcaccuuggcca

SEQ ID NO: 3475959 - RNA, 16 nt, Pseudomonas aeruginosa PA01
guggcgaacgcccggc

SEQ ID NO: 3475960 - RNA, 17 nt, Pseudomonas aeruginosa PA01
guggcgaacgcccggcu

SEQ ID NO: 3475961 - RNA, 15 nt, Pseudomonas aeruginosa PA01
guggcgaagccagca

SEQ ID NO: 3475962 - RNA, 17 nt, Pseudomonas aeruginosa PA01
guggcgaagccagcacg

SEQ ID NO: 3475963 - RNA, 16 nt, Pseudomonas aeruginosa PA01
guggcgaccugguagc

SEQ ID NO: 3475964 - RNA, 19 nt, Pseudomonas aeruginosa PA01
guggcgacgaagacgcugc

SEQ ID NO: 3475965 - RNA, 13 nt, Pseudomonas aeruginosa PA01
guggcgacgcagc

SEQ ID NO: 3475966 - RNA, 14 nt, Pseudomonas aeruginosa PA01
guggcgacgcagca

SEQ ID NO: 3475967 - RNA, 14 nt, Pseudomonas aeruginosa PA01
guggcgacgcgcag

SEQ ID NO: 3475968 - RNA, 16 nt, Pseudomonas aeruginosa PA01
guggcgacgcgcaggc

SEQ ID NO: 3475969 - RNA, 16 nt, Pseudomonas aeruginosa PA01
guggcgaucaggcagc

SEQ ID NO: 3475970 - RNA, 14 nt, Pseudomonas aeruginosa PA01
guggcgcaacaccu

SEQ ID NO: 3475971 - RNA, 23 nt, Pseudomonas aeruginosa PA01
guggcgcaacaccuugcgcaccg

SEQ ID NO: 3475972 - RNA, 12 nt, Pseudomonas aeruginosa PA01
guggcgcagcau

SEQ ID NO: 3475973 - RNA, 18 nt, Pseudomonas aeruginosa PA01
guggcgccagccagcccg

SEQ ID NO: 3475974 - RNA, 19 nt, Pseudomonas aeruginosa PA01
guggcgccauccuccagcg

SEQ ID NO: 3475975 - RNA, 21 nt, Pseudomonas aeruginosa PA01
guggcgccauccuccagcgcc

SEQ ID NO: 3475976 - RNA, 16 nt, Pseudomonas aeruginosa PA01
guggcgcccagccaga

SEQ ID NO: 3475977 - RNA, 19 nt, Pseudomonas aeruginosa PA01
guggcgcccagccagagcg

SEQ ID NO: 3475978 - RNA, 21 nt, Pseudomonas aeruginosa PA01
guggcgcccaugccgcccggc

SEQ ID NO: 3475979 - RNA, 22 nt, Pseudomonas aeruginosa PA01
guggcgcccaugccgcccggcc

SEQ ID NO: 3475980 - RNA, 15 nt, Pseudomonas aeruginosa PA01
guggcgccccaggcg

SEQ ID NO: 3475981 - RNA, 21 nt, Pseudomonas aeruginosa PA01
guggcgccccaggcgggcacg

SEQ ID NO: 3475982 - RNA, 13 nt, Pseudomonas aeruginosa PA01
guggcgccgagca

SEQ ID NO: 3475983 - RNA, 16 nt, Pseudomonas aeruginosa PA01
guggcgccgcagggcc

SEQ ID NO: 3475984 - RNA, 14 nt, Pseudomonas aeruginosa PA01
guggcgccgccaug

SEQ ID NO: 3475985 - RNA, 16 nt, Pseudomonas aeruginosa PA01
guggcgccgccggcga

SEQ ID NO: 3475986 - RNA, 16 nt, Pseudomonas aeruginosa PA01
guggcgcgcaccaccu

SEQ ID NO: 3475987 - RNA, 17 nt, Pseudomonas aeruginosa PA01
guggcgcgcaccaccug

SEQ ID NO: 3475988 - RNA, 22 nt, Pseudomonas aeruginosa PA01
guggcgcgcaucggugccggca

SEQ ID NO: 3475989 - RNA, 12 nt, Pseudomonas aeruginosa PA01
guggcgcggcug

SEQ ID NO: 3475990 - RNA, 23 nt, Pseudomonas aeruginosa PA01
guggcgcggcugaucggccgcca

SEQ ID NO: 3475991 - RNA, 17 nt, Pseudomonas aeruginosa PA01
guggcgcuacgcucgcc

SEQ ID NO: 3475992 - RNA, 14 nt, Pseudomonas aeruginosa PA01
guggcgcugccuuc

SEQ ID NO: 3475993 - RNA, 15 nt, Pseudomonas aeruginosa PA01
guggcgcugccuucg

SEQ ID NO: 3475994 - RNA, 18 nt, Pseudomonas aeruginosa PA01
guggcgcugucgccgguc

SEQ ID NO: 3475995 - RNA, 21 nt, Pseudomonas aeruginosa PA01
guggcgcugucgccggucagg

SEQ ID NO: 3475996 - RNA, 20 nt, Pseudomonas aeruginosa PA01
guggcgcuugagcagccagg

SEQ ID NO: 3475997 - RNA, 21 nt, Pseudomonas aeruginosa PA01
guggcgcuugagcagccaggc

SEQ ID NO: 3475998 - RNA, 13 nt, Pseudomonas aeruginosa PA01
guggcggccgccg

SEQ ID NO: 3475999 - RNA, 14 nt, Pseudomonas aeruginosa PA01
guggcggccgccgg

SEQ ID NO: 3476000 - RNA, 19 nt, Pseudomonas aeruginosa PA01
guggcggccgccggcgccc

SEQ ID NO: 3476001 - RNA, 14 nt, Pseudomonas aeruginosa PA01
guggcggcgcgcgu

SEQ ID NO: 3476002 - RNA, 15 nt, Pseudomonas aeruginosa PA01
guggcggcgcgcguc

SEQ ID NO: 3476003 - RNA, 13 nt, Pseudomonas aeruginosa PA01
guggcggcggcga

SEQ ID NO: 3476004 - RNA, 14 nt, Pseudomonas aeruginosa PA01
guggcgggccagca

SEQ ID NO: 3476005 - RNA, 17 nt, Pseudomonas aeruginosa PA01
guggcgggccagcaggc

SEQ ID NO: 3476006 - RNA, 20 nt, Pseudomonas aeruginosa PA01
guggcgggccagcaggcgcu

SEQ ID NO: 3476007 - RNA, 13 nt, Pseudomonas aeruginosa PA01
guggcgggccaug

SEQ ID NO: 3476008 - RNA, 15 nt, Pseudomonas aeruginosa PA01
guggcgggccaugcg

SEQ ID NO: 3476009 - RNA, 14 nt, Pseudomonas aeruginosa PA01
guggcgggcggccc

SEQ ID NO: 3476010 - RNA, 14 nt, Pseudomonas aeruginosa PA01
guggcgggucggcg

SEQ ID NO: 3476011 - RNA, 17 nt, Pseudomonas aeruginosa PA01
guggcgucgaucaggcg

SEQ ID NO: 3476012 - RNA, 14 nt, Pseudomonas aeruginosa PA01
guggcgucggcgcu

SEQ ID NO: 3476013 - RNA, 14 nt, Pseudomonas aeruginosa PA01
guggcgugcucggc

SEQ ID NO: 3476014 - RNA, 16 nt, Pseudomonas aeruginosa PA01
guggcguuauccgccc

SEQ ID NO: 3476015 - RNA, 15 nt, Pseudomonas aeruginosa PA01
guggcguuccaggcg

SEQ ID NO: 3476016 - RNA, 18 nt, Pseudomonas aeruginosa PA01
guggcguuccaggcggcg

SEQ ID NO: 3476017 - RNA, 23 nt, Pseudomonas aeruginosa PA01
guggcguucucguguugcagcag

SEQ ID NO: 3476018 - RNA, 20 nt, Pseudomonas aeruginosa PA01
guggcguugucggcaaccgg

SEQ ID NO: 3476019 - RNA, 23 nt, Pseudomonas aeruginosa PA01
guggcguugucggcaaccgggcg

SEQ ID NO: 3476020 - RNA, 17 nt, Pseudomonas aeruginosa PA01
guggcguuuucccaggu

SEQ ID NO: 3476021 - RNA, 23 nt, Pseudomonas aeruginosa PA01
guggcuauccuccaggccgccgg

SEQ ID NO: 3476022 - RNA, 22 nt, Pseudomonas aeruginosa PA01
guggcuccgcgcguucagccac

SEQ ID NO: 3476023 - RNA, 16 nt, Pseudomonas aeruginosa PA01
guggcucgaucagccg

SEQ ID NO: 3476024 - RNA, 18 nt, Pseudomonas aeruginosa PA01
guggcucgaucagccggc

SEQ ID NO: 3476025 - RNA, 19 nt, Pseudomonas aeruginosa PA01
guggcucgaucagccggcg

SEQ ID NO: 3476026 - RNA, 20 nt, Pseudomonas aeruginosa PA01
guggcucgaucagccggcgc

SEQ ID NO: 3476027 - RNA, 16 nt, Pseudomonas aeruginosa PA01
guggcucggcggcagg

SEQ ID NO: 3476028 - RNA, 18 nt, Pseudomonas aeruginosa PA01
guggcucggcggcaggcu

SEQ ID NO: 3476029 - RNA, 14 nt, Pseudomonas aeruginosa PA01
guggcuggcgccgc

SEQ ID NO: 3476030 - RNA, 17 nt, Pseudomonas aeruginosa PA01
guggcuggcgccgcggg

SEQ ID NO: 3476031 - RNA, 23 nt, Pseudomonas aeruginosa PA01
guggcuggucaguucggcccagc

SEQ ID NO: 3476032 - RNA, 23 nt, Pseudomonas aeruginosa PA01
guggcuggugaugccgcggacgg

SEQ ID NO: 3476033 - RNA, 15 nt, Pseudomonas aeruginosa PA01
guggcuucguccagc

SEQ ID NO: 3476034 - RNA, 21 nt, Pseudomonas aeruginosa PA01
guggcuuggcccugcgcgcgc

SEQ ID NO: 3476035 - RNA, 22 nt, Pseudomonas aeruginosa PA01
guggcuuuucucgccucccggc

SEQ ID NO: 3476036 - RNA, 21 nt, Pseudomonas aeruginosa PA01
gugggaaacggugcuagcggg

SEQ ID NO: 3476037 - RNA, 22 nt, Pseudomonas aeruginosa PA01
gugggaagagcaucucgccggc

SEQ ID NO: 3476038 - RNA, 18 nt, Pseudomonas aeruginosa PA01
gugcguguucggcggcuc

SEQ ID NO: 3476039 - RNA, 20 nt, Pseudomonas aeruginosa PA01
gugcucagcgauucccgagg

SEQ ID NO: 3476040 - RNA, 19 nt, Pseudomonas aeruginosa PA01
gugcucaggacguccuggc

SEQ ID NO: 3476041 - RNA, 13 nt, Pseudomonas aeruginosa PA01
gugcucaggcggc

SEQ ID NO: 3476042 - RNA, 14 nt, Pseudomonas aeruginosa PA01
gugcucaggcggcc

SEQ ID NO: 3476043 - RNA, 16 nt, Pseudomonas aeruginosa PA01
gugcucaggcggccga

SEQ ID NO: 3476044 - RNA, 12 nt, Pseudomonas aeruginosa PA01
gugcuccaccuc

SEQ ID NO: 3476045 - RNA, 17 nt, Pseudomonas aeruginosa PA01
gugcuccgugucggcgg

SEQ ID NO: 3476046 - RNA, 18 nt, Pseudomonas aeruginosa PA01
gugcuccguugaacucgg

SEQ ID NO: 3476047 - RNA, 23 nt, Pseudomonas aeruginosa PA01
gugcuccguugaacucggcgccc

SEQ ID NO: 3476048 - RNA, 23 nt, Pseudomonas aeruginosa PA01
gugcuccucgucguacuggcgga

SEQ ID NO: 3476049 - RNA, 20 nt, Pseudomonas aeruginosa PA01
gugcuccuugacccucuggu

SEQ ID NO: 3476050 - RNA, 14 nt, Pseudomonas aeruginosa PA01
gugcucgaggaagc

SEQ ID NO: 3476051 - RNA, 13 nt, Pseudomonas aeruginosa PA01
gugcucgaucagg

SEQ ID NO: 3476052 - RNA, 18 nt, Pseudomonas aeruginosa PA01
gugcucgaugaucgacug

SEQ ID NO: 3476053 - RNA, 23 nt, Pseudomonas aeruginosa PA01
gugcucgauggcgaagcgcuugc

SEQ ID NO: 3476054 - RNA, 21 nt, Pseudomonas aeruginosa PA01
gugcucggcgaucucgcccag

SEQ ID NO: 3476055 - RNA, 20 nt, Pseudomonas aeruginosa PA01
gugcucggggaacacgcgcu

SEQ ID NO: 3476056 - RNA, 13 nt, Pseudomonas aeruginosa PA01
gugcugcaccagc

SEQ ID NO: 3476057 - RNA, 17 nt, Pseudomonas aeruginosa PA01
gugcugcaccagcaggu

SEQ ID NO: 3476058 - RNA, 19 nt, Pseudomonas aeruginosa PA01
gugcugcccagggcccaga

SEQ ID NO: 3476059 - RNA, 22 nt, Pseudomonas aeruginosa PA01
gugcugccgaugcugaucaccc

SEQ ID NO: 3476060 - RNA, 13 nt, Pseudomonas aeruginosa PA01
gugcugcgcgcgg

SEQ ID NO: 3476061 - RNA, 15 nt, Pseudomonas aeruginosa PA01
gugcugcgcgcggcc

SEQ ID NO: 3476062 - RNA, 17 nt, Pseudomonas aeruginosa PA01
gugcugcgcgcggccca

SEQ ID NO: 3476063 - RNA, 13 nt, Pseudomonas aeruginosa PA01
gugcuggccaccc

SEQ ID NO: 3476064 - RNA, 22 nt, Pseudomonas aeruginosa PA01
gugcuggccacccuugcguccu

SEQ ID NO: 3476065 - RNA, 23 nt, Pseudomonas aeruginosa PA01
gugcuggccacccuugcguccug

SEQ ID NO: 3476066 - RNA, 17 nt, Pseudomonas aeruginosa PA01
gugcuggccggcagcag

SEQ ID NO: 3476067 - RNA, 17 nt, Pseudomonas aeruginosa PA01
gugcuggcgagcagggu

SEQ ID NO: 3476068 - RNA, 11 nt, Pseudomonas aeruginosa PA01
gugcuggcgga

SEQ ID NO: 3476069 - RNA, 23 nt, Pseudomonas aeruginosa PA01
gugcuggcggauguaguccagcg

SEQ ID NO: 3476070 - RNA, 14 nt, Pseudomonas aeruginosa PA01
gugcugggcgaccu

SEQ ID NO: 3476071 - RNA, 23 nt, Pseudomonas aeruginosa PA01
gugcugggcgaccuucagcgggu

SEQ ID NO: 3476072 - RNA, 21 nt, Pseudomonas aeruginosa PA01
gugcuggguggaggcccagau

SEQ ID NO: 3476073 - RNA, 16 nt, Pseudomonas aeruginosa PA01
gugcuggugcggccga

SEQ ID NO: 3476074 - RNA, 16 nt, Pseudomonas aeruginosa PA01
gugcugguggcccugg

SEQ ID NO: 3476075 - RNA, 16 nt, Pseudomonas aeruginosa PA01
gugcuguucagcgggu

SEQ ID NO: 3476076 - RNA, 17 nt, Pseudomonas aeruginosa PA01
gugcuuaauacggcgca

SEQ ID NO: 3476077 - RNA, 20 nt, Pseudomonas aeruginosa PA01
gugcuuacggagaagggcgc

SEQ ID NO: 3476078 - RNA, 22 nt, Pseudomonas aeruginosa PA01
gugcuuacggagaagggcgcgc

SEQ ID NO: 3476079 - RNA, 13 nt, Pseudomonas aeruginosa PA01
gugcuucacgaau

SEQ ID NO: 3476080 - RNA, 18 nt, Pseudomonas aeruginosa PA01
gugcuucaucggcccggc

SEQ ID NO: 3476081 - RNA, 16 nt, Pseudomonas aeruginosa PA01
gugcuucucaccgagg

SEQ ID NO: 3476082 - RNA, 15 nt, Pseudomonas aeruginosa PA01
gugcuugaccgccgc

SEQ ID NO: 3476083 - RNA, 20 nt, Pseudomonas aeruginosa PA01
gugcuugaccgccgccuggg

SEQ ID NO: 3476084 - RNA, 18 nt, Pseudomonas aeruginosa PA01
gugcuugacgaaggcggc

SEQ ID NO: 3476085 - RNA, 15 nt, Pseudomonas aeruginosa PA01
gugcuugcagucgcg

SEQ ID NO: 3476086 - RNA, 20 nt, Pseudomonas aeruginosa PA01
gugcuuggugucggccgcca

SEQ ID NO: 3476087 - RNA, 21 nt, Pseudomonas aeruginosa PA01
gugcuuggugucggccgccag

SEQ ID NO: 3476088 - RNA, 18 nt, Pseudomonas aeruginosa PA01
gugcuugucacgcucggc

SEQ ID NO: 3476089 - RNA, 17 nt, Pseudomonas aeruginosa PA01
guggaaaccucgccgau

SEQ ID NO: 3476090 - RNA, 19 nt, Pseudomonas aeruginosa PA01
guggaacagcaucagaggc

SEQ ID NO: 3476091 - RNA, 20 nt, Pseudomonas aeruginosa PA01
guggaacagccgcagcggca

SEQ ID NO: 3476092 - RNA, 14 nt, Pseudomonas aeruginosa PA01
guggaacagcgcgu

SEQ ID NO: 3476093 - RNA, 19 nt, Pseudomonas aeruginosa PA01
guggaaccgauggccaggg

SEQ ID NO: 3476094 - RNA, 19 nt, Pseudomonas aeruginosa PA01
guggaaccgcggcgcccuc

SEQ ID NO: 3476095 - RNA, 20 nt, Pseudomonas aeruginosa PA01
guggaacgaggcgacccggg

SEQ ID NO: 3476096 - RNA, 14 nt, Pseudomonas aeruginosa PA01
guggaacgcagggg

SEQ ID NO: 3476097 - RNA, 16 nt, Pseudomonas aeruginosa PA01
guggaagccguggcgg

SEQ ID NO: 3476098 - RNA, 17 nt, Pseudomonas aeruginosa PA01
guggaagccguggcggg

SEQ ID NO: 3476099 - RNA, 18 nt, Pseudomonas aeruginosa PA01
guggaagccguggcgggc

SEQ ID NO: 3476100 - RNA, 15 nt, Pseudomonas aeruginosa PA01
guggaaguggacggg

SEQ ID NO: 3476101 - RNA, 17 nt, Pseudomonas aeruginosa PA01
guggaauccagggccga

SEQ ID NO: 3476102 - RNA, 20 nt, Pseudomonas aeruginosa PA01
guggaauccagggccgagca

SEQ ID NO: 3476103 - RNA, 15 nt, Pseudomonas aeruginosa PA01
guggacauacaggcg

SEQ ID NO: 3476104 - RNA, 16 nt, Pseudomonas aeruginosa PA01
guggacauacaggcgc

SEQ ID NO: 3476105 - RNA, 18 nt, Pseudomonas aeruginosa PA01
guggacauacaggcgcgc

SEQ ID NO: 3476106 - RNA, 19 nt, Pseudomonas aeruginosa PA01
guggaccaacagccggcgg

SEQ ID NO: 3476107 - RNA, 20 nt, Pseudomonas aeruginosa PA01
guggaccaacagccggcggg

SEQ ID NO: 3476108 - RNA, 21 nt, Pseudomonas aeruginosa PA01
guggaccaacgggcugccagc

SEQ ID NO: 3476109 - RNA, 14 nt, Pseudomonas aeruginosa PA01
guggaccagcgccg

SEQ ID NO: 3476110 - RNA, 15 nt, Pseudomonas aeruginosa PA01
guggaccagcgccgc

SEQ ID NO: 3476111 - RNA, 17 nt, Pseudomonas aeruginosa PA01
guggacggucucgccgc

SEQ ID NO: 3476112 - RNA, 14 nt, Pseudomonas aeruginosa PA01
guggacgucggcgu

SEQ ID NO: 3476113 - RNA, 20 nt, Pseudomonas aeruginosa PA01
guggacugguugaccugcag

SEQ ID NO: 3476114 - RNA, 15 nt, Pseudomonas aeruginosa PA01
guggagaggucgccg

SEQ ID NO: 3476115 - RNA, 19 nt, Pseudomonas aeruginosa PA01
guggagccggugccggcgg

SEQ ID NO: 3476116 - RNA, 14 nt, Pseudomonas aeruginosa PA01
guggaggcgggcuc

SEQ ID NO: 3476117 - RNA, 14 nt, Pseudomonas aeruginosa PA01
guggagucaggcgc

SEQ ID NO: 3476118 - RNA, 15 nt, Pseudomonas aeruginosa PA01
guggagucaggcgcc

SEQ ID NO: 3476119 - RNA, 17 nt, Pseudomonas aeruginosa PA01
guggagucaggcgccgg

SEQ ID NO: 3476120 - RNA, 16 nt, Pseudomonas aeruginosa PA01
guggauaacguccgcg

SEQ ID NO: 3476121 - RNA, 15 nt, Pseudomonas aeruginosa PA01
guggauaggcggcgg

SEQ ID NO: 3476122 - RNA, 13 nt, Pseudomonas aeruginosa PA01
guggaucgcccgg

SEQ ID NO: 3476123 - RNA, 15 nt, Pseudomonas aeruginosa PA01
guggaucgcccggcu

SEQ ID NO: 3476124 - RNA, 22 nt, Pseudomonas aeruginosa PA01
guggaucgcggcguaggcgcgc

SEQ ID NO: 3476125 - RNA, 14 nt, Pseudomonas aeruginosa PA01
guggaugaacagcg

SEQ ID NO: 3476126 - RNA, 16 nt, Pseudomonas aeruginosa PA01
guggaugaacagcgga

SEQ ID NO: 3476127 - RNA, 20 nt, Pseudomonas aeruginosa PA01
guggaugccgguggcgccca

SEQ ID NO: 3476128 - RNA, 22 nt, Pseudomonas aeruginosa PA01
guggaugccgguggcgcccagc

SEQ ID NO: 3476129 - RNA, 16 nt, Pseudomonas aeruginosa PA01
guggaugugcugguug

SEQ ID NO: 3476130 - RNA, 17 nt, Pseudomonas aeruginosa PA01
guggaugugcugguugg

SEQ ID NO: 3476131 - RNA, 21 nt, Pseudomonas aeruginosa PA01
guggcaaaaaugcccuuggcu

SEQ ID NO: 3476132 - RNA, 21 nt, Pseudomonas aeruginosa PA01
guggcacccaggccacgccca

SEQ ID NO: 3476133 - RNA, 18 nt, Pseudomonas aeruginosa PA01
guggcacguacguccagg

SEQ ID NO: 3476134 - RNA, 13 nt, Pseudomonas aeruginosa PA01
guggcaggcgcug

SEQ ID NO: 3476135 - RNA, 20 nt, Pseudomonas aeruginosa PA01
guggcauucgucgccgcugg

SEQ ID NO: 3476136 - RNA, 17 nt, Pseudomonas aeruginosa PA01
guggccacgucgcccca

SEQ ID NO: 3476137 - RNA, 19 nt, Pseudomonas aeruginosa PA01
guggccacgucgccccagg

SEQ ID NO: 3476138 - RNA, 13 nt, Pseudomonas aeruginosa PA01
guggccaggcgca

SEQ ID NO: 3476139 - RNA, 18 nt, Pseudomonas aeruginosa PA01
guggccaggcgcaccagc

SEQ ID NO: 3476140 - RNA, 20 nt, Pseudomonas aeruginosa PA01
guggccaggcgcaccagcag

SEQ ID NO: 3476141 - RNA, 18 nt, Pseudomonas aeruginosa PA01
guggccauagagccgcug

SEQ ID NO: 3476142 - RNA, 14 nt, Pseudomonas aeruginosa PA01
ggcccguccgcgcc

SEQ ID NO: 3476143 - RNA, 17 nt, Pseudomonas aeruginosa PA01
ggcccgugcggcacgcu

SEQ ID NO: 3476144 - RNA, 19 nt, Pseudomonas aeruginosa PA01
ggcccgugcggcacgcugc

SEQ ID NO: 3476145 - RNA, 15 nt, Pseudomonas aeruginosa PA01
ggcccgugguagucg

SEQ ID NO: 3476146 - RNA, 20 nt, Pseudomonas aeruginosa PA01
ggcccguuccaccgccugga

SEQ ID NO: 3476147 - RNA, 15 nt, Pseudomonas aeruginosa PA01
ggcccuacaaugaug

SEQ ID NO: 3476148 - RNA, 14 nt, Pseudomonas aeruginosa PA01
ggcccuccauccag

SEQ ID NO: 3476149 - RNA, 20 nt, Pseudomonas aeruginosa PA01
ggcccuccauccagucuucg

SEQ ID NO: 3476150 - RNA, 23 nt, Pseudomonas aeruginosa PA01
ggcccuccauccagucuucgccg

SEQ ID NO: 3476151 - RNA, 14 nt, Pseudomonas aeruginosa PA01
ggcccucggcgccg

SEQ ID NO: 3476152 - RNA, 16 nt, Pseudomonas aeruginosa PA01
ggcccucggcgccgag

SEQ ID NO: 3476153 - RNA, 17 nt, Pseudomonas aeruginosa PA01
ggcccucggcgccgagc

SEQ ID NO: 3476154 - RNA, 18 nt, Pseudomonas aeruginosa PA01
ggcccucggcgccgagca

SEQ ID NO: 3476155 - RNA, 19 nt, Pseudomonas aeruginosa PA01
ggcccucggcgccgagcau

SEQ ID NO: 3476156 - RNA, 14 nt, Pseudomonas aeruginosa PA01
ggcccucggcggcg

SEQ ID NO: 3476157 - RNA, 18 nt, Pseudomonas aeruginosa PA01
ggcccucucucgccucgg

SEQ ID NO: 3476158 - RNA, 12 nt, Pseudomonas aeruginosa PA01
ggcccugacauc

SEQ ID NO: 3476159 - RNA, 21 nt, Pseudomonas aeruginosa PA01
ggcccugccagaggaucggcc

SEQ ID NO: 3476160 - RNA, 22 nt, Pseudomonas aeruginosa PA01
ggcccugccagaggaucggcca

SEQ ID NO: 3476161 - RNA, 17 nt, Pseudomonas aeruginosa PA01
ggcccugcgccgcagcg

SEQ ID NO: 3476162 - RNA, 19 nt, Pseudomonas aeruginosa PA01
ggcccugcgccgcagcggc

SEQ ID NO: 3476163 - RNA, 20 nt, Pseudomonas aeruginosa PA01
ggcccugcgcgcgcguuuca

SEQ ID NO: 3476164 - RNA, 14 nt, Pseudomonas aeruginosa PA01
ggcccuggaccucg

SEQ ID NO: 3476165 - RNA, 20 nt, Pseudomonas aeruginosa PA01
ggcccuggauaucugggcca

SEQ ID NO: 3476166 - RNA, 21 nt, Pseudomonas aeruginosa PA01
ggcccuggauaucugggccau

SEQ ID NO: 3476167 - RNA, 23 nt, Pseudomonas aeruginosa PA01
ggcccuggauaucugggccaucg

SEQ ID NO: 3476168 - RNA, 16 nt, Pseudomonas aeruginosa PA01
ggcccuggaucaccgc

SEQ ID NO: 3476169 - RNA, 19 nt, Pseudomonas aeruginosa PA01
ggcccuggaucaccgcggc

SEQ ID NO: 3476170 - RNA, 20 nt, Pseudomonas aeruginosa PA01
ggcccuggaucaccgcggcg

SEQ ID NO: 3476171 - RNA, 21 nt, Pseudomonas aeruginosa PA01
ggcccuggaucaccgcggcgc

SEQ ID NO: 3476172 - RNA, 22 nt, Pseudomonas aeruginosa PA01
ggcccuggaucaccgcggcgcu

SEQ ID NO: 3476173 - RNA, 16 nt, Pseudomonas aeruginosa PA01
ggcccuggccuuggcc

SEQ ID NO: 3476174 - RNA, 15 nt, Pseudomonas aeruginosa PA01
ggcccuggcgcaggc

SEQ ID NO: 3476175 - RNA, 18 nt, Pseudomonas aeruginosa PA01
ggcccuggcgcaggcggc

SEQ ID NO: 3476176 - RNA, 19 nt, Pseudomonas aeruginosa PA01
ggcccugggccccggccgg

SEQ ID NO: 3476177 - RNA, 21 nt, Pseudomonas aeruginosa PA01
ggcccugggccccggccggca

SEQ ID NO: 3476178 - RNA, 13 nt, Pseudomonas aeruginosa PA01
ggcccugggcggc

SEQ ID NO: 3476179 - RNA, 14 nt, Pseudomonas aeruginosa PA01
ggcccugggcggcg

SEQ ID NO: 3476180 - RNA, 17 nt, Pseudomonas aeruginosa PA01
ggcccugggcggcgacc

SEQ ID NO: 3476181 - RNA, 16 nt, Pseudomonas aeruginosa PA01
ggcccugggcggcggg

SEQ ID NO: 3476182 - RNA, 18 nt, Pseudomonas aeruginosa PA01
ggcccugguacagcgccu

SEQ ID NO: 3476183 - RNA, 21 nt, Pseudomonas aeruginosa PA01
ggcccuguacauagcggguca

SEQ ID NO: 3476184 - RNA, 19 nt, Pseudomonas aeruginosa PA01
ggcccuucacgagaccacc

SEQ ID NO: 3476185 - RNA, 14 nt, Pseudomonas aeruginosa PA01
ggcccuuccacuuc

SEQ ID NO: 3476186 - RNA, 19 nt, Pseudomonas aeruginosa PA01
ggcccuugaacaggcuggc

SEQ ID NO: 3476187 - RNA, 14 nt, Pseudomonas aeruginosa PA01
ggcccuugagcaug

SEQ ID NO: 3476188 - RNA, 17 nt, Pseudomonas aeruginosa PA01
ggcccuugagggccucg

SEQ ID NO: 3476189 - RNA, 19 nt, Pseudomonas aeruginosa PA01
ggcccuugagggccucggc

SEQ ID NO: 3476190 - RNA, 22 nt, Pseudomonas aeruginosa PA01
ggcccuugagggccucggcgaa

SEQ ID NO: 3476191 - RNA, 15 nt, Pseudomonas aeruginosa PA01
ggcccuuggucaggc

SEQ ID NO: 3476192 - RNA, 20 nt, Pseudomonas aeruginosa PA01
ggcccuuggucaggccgacc

SEQ ID NO: 3476193 - RNA, 21 nt, Pseudomonas aeruginosa PA01
ggcccuuggucaggccgacca

SEQ ID NO: 3476194 - RNA, 20 nt, Pseudomonas aeruginosa PA01
ggcccuugugaaagggcggc

SEQ ID NO: 3476195 - RNA, 18 nt, Pseudomonas aeruginosa PA01
ggcccuuuuccaccggcc

SEQ ID NO: 3476196 - RNA, 19 nt, Pseudomonas aeruginosa PA01
ggcccuuuuccaccggccg

SEQ ID NO: 3476197 - RNA, 21 nt, Pseudomonas aeruginosa PA01
ggcccuuuuccaccggccgcg

SEQ ID NO: 3476198 - RNA, 21 nt, Pseudomonas aeruginosa PA01
ggccgaaagcacugcggcggu

SEQ ID NO: 3476199 - RNA, 22 nt, Pseudomonas aeruginosa PA01
ggccgaaagcacugcggcgguc

SEQ ID NO: 3476200 - RNA, 17 nt, Pseudomonas aeruginosa PA01
ggccgaaaucgaugucg

SEQ ID NO: 3476201 - RNA, 22 nt, Pseudomonas aeruginosa PA01
ggccgaaaucgaugucgcggcg

SEQ ID NO: 3476202 - RNA, 16 nt, Pseudomonas aeruginosa PA01
ggccgaaauggcggug

SEQ ID NO: 3476203 - RNA, 18 nt, Pseudomonas aeruginosa PA01
ggccgaaauugaccaggu

SEQ ID NO: 3476204 - RNA, 20 nt, Pseudomonas aeruginosa PA01
ggccgaaauugaccagguac

SEQ ID NO: 3476205 - RNA, 20 nt, Pseudomonas aeruginosa PA01
ggccgaacucaugcccagcu

SEQ ID NO: 3476206 - RNA, 18 nt, Pseudomonas aeruginosa PA01
ggccgaacucuggcggcg

SEQ ID NO: 3476207 - RNA, 17 nt, Pseudomonas aeruginosa PA01
ggccgaacuggaugaug

SEQ ID NO: 3476208 - RNA, 18 nt, Pseudomonas aeruginosa PA01
ggccgaagaacaccacgc

SEQ ID NO: 3476209 - RNA, 17 nt, Pseudomonas aeruginosa PA01
ggccgaagaggcccucg

SEQ ID NO: 3476210 - RNA, 18 nt, Pseudomonas aeruginosa PA01
ggccgaagaggcccucgg

SEQ ID NO: 3476211 - RNA, 19 nt, Pseudomonas aeruginosa PA01
ggccgaagaggcccucggc

SEQ ID NO: 3476212 - RNA, 14 nt, Pseudomonas aeruginosa PA01
ggccgaagccgccg

SEQ ID NO: 3476213 - RNA, 15 nt, Pseudomonas aeruginosa PA01
ggccgaagccgccgg

SEQ ID NO: 3476214 - RNA, 16 nt, Pseudomonas aeruginosa PA01
ggccgaagccgccggg

SEQ ID NO: 3476215 - RNA, 17 nt, Pseudomonas aeruginosa PA01
ggccgaagccgccggga

SEQ ID NO: 3476216 - RNA, 18 nt, Pseudomonas aeruginosa PA01
ggccgaagccgccgggaa

SEQ ID NO: 3476217 - RNA, 14 nt, Pseudomonas aeruginosa PA01
ggccgaagcguggg

SEQ ID NO: 3476218 - RNA, 21 nt, Pseudomonas aeruginosa PA01
ggccgaagcgugggcggccgg

SEQ ID NO: 3476219 - RNA, 13 nt, Pseudomonas aeruginosa PA01
ggccgaagcuguc

SEQ ID NO: 3476220 - RNA, 15 nt, Pseudomonas aeruginosa PA01
ggccgaagcugucga

SEQ ID NO: 3476221 - RNA, 13 nt, Pseudomonas aeruginosa PA01
ggccgaaggccag

SEQ ID NO: 3476222 - RNA, 14 nt, Pseudomonas aeruginosa PA01
ggccgaaggccagg

SEQ ID NO: 3476223 - RNA, 16 nt, Pseudomonas aeruginosa PA01
ggccgaaggccaggac

SEQ ID NO: 3476224 - RNA, 17 nt, Pseudomonas aeruginosa PA01
ggccgaaggccaggacc

SEQ ID NO: 3476225 - RNA, 16 nt, Pseudomonas aeruginosa PA01
ggccgaaggccaggcc

SEQ ID NO: 3476226 - RNA, 15 nt, Pseudomonas aeruginosa PA01
ggccgaaggccuggc

SEQ ID NO: 3476227 - RNA, 20 nt, Pseudomonas aeruginosa PA01
ggccgaaggcgcuccccugc

SEQ ID NO: 3476228 - RNA, 13 nt, Pseudomonas aeruginosa PA01
ggccgaaguagcc

SEQ ID NO: 3476229 - RNA, 23 nt, Pseudomonas aeruginosa PA01
ggccgaauaggcgaucuccggca

SEQ ID NO: 3476230 - RNA, 18 nt, Pseudomonas aeruginosa PA01
ggccgaauccuccagccg

SEQ ID NO: 3476231 - RNA, 19 nt, Pseudomonas aeruginosa PA01
ggccgaauccuccagccgg

SEQ ID NO: 3476232 - RNA, 20 nt, Pseudomonas aeruginosa PA01
ggccgaauccuccagccggc

SEQ ID NO: 3476233 - RNA, 17 nt, Pseudomonas aeruginosa PA01
ggccgaaucgaacaggg

SEQ ID NO: 3476234 - RNA, 17 nt, Pseudomonas aeruginosa PA01
ggccgacaccucgauca

SEQ ID NO: 3476235 - RNA, 23 nt, Pseudomonas aeruginosa PA01
ggccgacaccucgaucagcgggu

SEQ ID NO: 3476236 - RNA, 19 nt, Pseudomonas aeruginosa PA01
ggccgacagagcggccggc

SEQ ID NO: 3476237 - RNA, 20 nt, Pseudomonas aeruginosa PA01
ggccgacagagcggccggcg

SEQ ID NO: 3476238 - RNA, 14 nt, Pseudomonas aeruginosa PA01
ggccgacagcggcu

SEQ ID NO: 3476239 - RNA, 15 nt, Pseudomonas aeruginosa PA01
ggccgacagcggcug

SEQ ID NO: 3476240 - RNA, 16 nt, Pseudomonas aeruginosa PA01
ggccgacagcggcugg

SEQ ID NO: 3476241 - RNA, 14 nt, Pseudomonas aeruginosa PA01
ggccgacaggcugg

SEQ ID NO: 3476242 - RNA, 20 nt, Pseudomonas aeruginosa PA01
ggccgaccagcagggccagc

SEQ ID NO: 3476243 - RNA, 15 nt, Pseudomonas aeruginosa PA01
ggccgaccagcgccg

SEQ ID NO: 3476244 - RNA, 13 nt, Pseudomonas aeruginosa PA01
ggccgaccaggcc

SEQ ID NO: 3476245 - RNA, 14 nt, Pseudomonas aeruginosa PA01
ggccgaccaggccg

SEQ ID NO: 3476246 - RNA, 15 nt, Pseudomonas aeruginosa PA01
ggccgaccaggccgu

SEQ ID NO: 3476247 - RNA, 20 nt, Pseudomonas aeruginosa PA01
ggccgaccaggugcuggucg

SEQ ID NO: 3476248 - RNA, 16 nt, Pseudomonas aeruginosa PA01
ggccgacccgcagcgg

SEQ ID NO: 3476249 - RNA, 17 nt, Pseudomonas aeruginosa PA01
ggccgacccgcagcggc

SEQ ID NO: 3476250 - RNA, 18 nt, Pseudomonas aeruginosa PA01
ggccgacccgcagcggcg

SEQ ID NO: 3476251 - RNA, 20 nt, Pseudomonas aeruginosa PA01
ggccgacccgcagcggcgcu

SEQ ID NO: 3476252 - RNA, 11 nt, Pseudomonas aeruginosa PA01
ggccgacccgu

SEQ ID NO: 3476253 - RNA, 19 nt, Pseudomonas aeruginosa PA01
ggccgacccgugcgccgcg

SEQ ID NO: 3476254 - RNA, 15 nt, Pseudomonas aeruginosa PA01
ggccgaccgccaggc

SEQ ID NO: 3476255 - RNA, 15 nt, Pseudomonas aeruginosa PA01
ggccgaccucggcgg

SEQ ID NO: 3476256 - RNA, 14 nt, Pseudomonas aeruginosa PA01
ggccgaccugcccg

SEQ ID NO: 3476257 - RNA, 17 nt, Pseudomonas aeruginosa PA01
ggccgacgaacagccag

SEQ ID NO: 3476258 - RNA, 18 nt, Pseudomonas aeruginosa PA01
ggccgacgaaggccgcgg

SEQ ID NO: 3476259 - RNA, 19 nt, Pseudomonas aeruginosa PA01
ggccgacgaaggccgcggu

SEQ ID NO: 3476260 - RNA, 22 nt, Pseudomonas aeruginosa PA01
ggccgacgaaggccgcggucgg

SEQ ID NO: 3476261 - RNA, 20 nt, Pseudomonas aeruginosa PA01
ggccgacgauguucgaggcg

SEQ ID NO: 3476262 - RNA, 23 nt, Pseudomonas aeruginosa PA01
ggccgacgauguucgaggcgccg

SEQ ID NO: 3476263 - RNA, 23 nt, Pseudomonas aeruginosa PA01
ggccgacgauguuguugcccacc

SEQ ID NO: 3476264 - RNA, 13 nt, Pseudomonas aeruginosa PA01
ggccgacgccgcu

SEQ ID NO: 3476265 - RNA, 14 nt, Pseudomonas aeruginosa PA01
ggccgacgccgcug

SEQ ID NO: 3476266 - RNA, 17 nt, Pseudomonas aeruginosa PA01
ggccgacgccgcuggaa

SEQ ID NO: 3476267 - RNA, 13 nt, Pseudomonas aeruginosa PA01
ggccgacgcuucc

SEQ ID NO: 3476268 - RNA, 14 nt, Pseudomonas aeruginosa PA01
ggccgacgcuuccu

SEQ ID NO: 3476269 - RNA, 15 nt, Pseudomonas aeruginosa PA01
ggccgacggcccucc

SEQ ID NO: 3476270 - RNA, 16 nt, Pseudomonas aeruginosa PA01
ggccgacggcccuccg

SEQ ID NO: 3476271 - RNA, 18 nt, Pseudomonas aeruginosa PA01
ggccgacggcccuccggc

SEQ ID NO: 3476272 - RNA, 15 nt, Pseudomonas aeruginosa PA01
ggccgacggguucuu

SEQ ID NO: 3476273 - RNA, 19 nt, Pseudomonas aeruginosa PA01
ggccgacguccaucagcgu

SEQ ID NO: 3476274 - RNA, 17 nt, Pseudomonas aeruginosa PA01
ggccgacgugcacccgc

SEQ ID NO: 3476275 - RNA, 15 nt, Pseudomonas aeruginosa PA01
ggccgacucgcgauc

SEQ ID NO: 3476276 - RNA, 19 nt, Pseudomonas aeruginosa PA01
ggccgagaaaccgccaucg

SEQ ID NO: 3476277 - RNA, 17 nt, Pseudomonas aeruginosa PA01
ggccgagaagguucucg

SEQ ID NO: 3476278 - RNA, 21 nt, Pseudomonas aeruginosa PA01
ggccgagaagguucucggcca

SEQ ID NO: 3476279 - RNA, 19 nt, Pseudomonas aeruginosa PA01
ggccgagaccgcagcccag

SEQ ID NO: 3476280 - RNA, 20 nt, Pseudomonas aeruginosa PA01
ggccgagaccgcagcccagu

SEQ ID NO: 3476281 - RNA, 18 nt, Pseudomonas aeruginosa PA01
ggccgagauccugcagca

SEQ ID NO: 3476282 - RNA, 21 nt, Pseudomonas aeruginosa PA01
ggccgagauccugcagcaguu

SEQ ID NO: 3476283 - RNA, 15 nt, Pseudomonas aeruginosa PA01
ggccgagaucgguca

SEQ ID NO: 3476284 - RNA, 19 nt, Pseudomonas aeruginosa PA01
ggccgagcaauccggcgcu

SEQ ID NO: 3476285 - RNA, 20 nt, Pseudomonas aeruginosa PA01
ggccgagcaauccggcgcug

SEQ ID NO: 3476286 - RNA, 21 nt, Pseudomonas aeruginosa PA01
ggccgagcaauccggcgcugc

SEQ ID NO: 3476287 - RNA, 23 nt, Pseudomonas aeruginosa PA01
ggccgagcaauccggcgcugccg

SEQ ID NO: 3476288 - RNA, 17 nt, Pseudomonas aeruginosa PA01
ggccgagcacaggguga

SEQ ID NO: 3476289 - RNA, 15 nt, Pseudomonas aeruginosa PA01
ggccgagcaccacgc

SEQ ID NO: 3476290 - RNA, 15 nt, Pseudomonas aeruginosa PA01
ggccgagcaccggca

SEQ ID NO: 3476291 - RNA, 17 nt, Pseudomonas aeruginosa PA01
ggccgagcaccggcagg

SEQ ID NO: 3476292 - RNA, 22 nt, Pseudomonas aeruginosa PA01
ggccgagcaccggcaggacgau

SEQ ID NO: 3476293 - RNA, 14 nt, Pseudomonas aeruginosa PA01
ggccgagcagcgcc

SEQ ID NO: 3476294 - RNA, 16 nt, Pseudomonas aeruginosa PA01
ggccgagcagcgccag

SEQ ID NO: 3476295 - RNA, 17 nt, Pseudomonas aeruginosa PA01
ggccgagcagcgccagc

SEQ ID NO: 3476296 - RNA, 18 nt, Pseudomonas aeruginosa PA01
ggccgagcagcgccagcc

SEQ ID NO: 3476297 - RNA, 21 nt, Pseudomonas aeruginosa PA01
ggccgagcagcgccagccagg

SEQ ID NO: 3476298 - RNA, 14 nt, Pseudomonas aeruginosa PA01
ggccgagcaggaag

SEQ ID NO: 3476299 - RNA, 14 nt, Pseudomonas aeruginosa PA01
ggccgagcaggcgc

SEQ ID NO: 3476300 - RNA, 15 nt, Pseudomonas aeruginosa PA01
ggccgagcaggcgcg

SEQ ID NO: 3476301 - RNA, 16 nt, Pseudomonas aeruginosa PA01
ggccgagcaggcgcgc

SEQ ID NO: 3476302 - RNA, 18 nt, Pseudomonas aeruginosa PA01
ggccgagcaggcgcgcca

SEQ ID NO: 3476303 - RNA, 23 nt, Pseudomonas aeruginosa PA01
ggccgagcauguaggcgcaccag

SEQ ID NO: 3476304 - RNA, 20 nt, Pseudomonas aeruginosa PA01
ggccgagcccagcggcaggg

SEQ ID NO: 3476305 - RNA, 21 nt, Pseudomonas aeruginosa PA01
ggccgagcccagcggcagggc

SEQ ID NO: 3476306 - RNA, 13 nt, Pseudomonas aeruginosa PA01
ggccgagccccgg

SEQ ID NO: 3476307 - RNA, 14 nt, Pseudomonas aeruginosa PA01
ggccgagccccggu

SEQ ID NO: 3476308 - RNA, 17 nt, Pseudomonas aeruginosa PA01
ggccgagcccgagugcg

SEQ ID NO: 3476309 - RNA, 22 nt, Pseudomonas aeruginosa PA01
ggccgagcccgagugcgcccag

SEQ ID NO: 3476310 - RNA, 21 nt, Pseudomonas aeruginosa PA01
ggccgagccgacauccugucg

SEQ ID NO: 3476311 - RNA, 14 nt, Pseudomonas aeruginosa PA01
ggccgagccggcau

SEQ ID NO: 3476312 - RNA, 22 nt, Pseudomonas aeruginosa PA01
ggccgagccggcauccuguggc

SEQ ID NO: 3476313 - RNA, 18 nt, Pseudomonas aeruginosa PA01
ggccgagcgcagcgccac

SEQ ID NO: 3476314 - RNA, 19 nt, Pseudomonas aeruginosa PA01
ggccgagcgcagcgccacc

SEQ ID NO: 3476315 - RNA, 20 nt, Pseudomonas aeruginosa PA01
ggccgagcgcagcgccacca

SEQ ID NO: 3476316 - RNA, 13 nt, Pseudomonas aeruginosa PA01
ggccgagcgccag

SEQ ID NO: 3476317 - RNA, 14 nt, Pseudomonas aeruginosa PA01
ggccgagcgccgcc

SEQ ID NO: 3476318 - RNA, 15 nt, Pseudomonas aeruginosa PA01
ggccgagcgccgccu

SEQ ID NO: 3476319 - RNA, 17 nt, Pseudomonas aeruginosa PA01
ggccgagcgcgagugca

SEQ ID NO: 3476320 - RNA, 23 nt, Pseudomonas aeruginosa PA01
ggccgagcgcgagugcagcgagu

SEQ ID NO: 3476321 - RNA, 15 nt, Pseudomonas aeruginosa PA01
ggccgagcgcgccgc

SEQ ID NO: 3476322 - RNA, 17 nt, Pseudomonas aeruginosa PA01
ggccgagcgcgccgccg

SEQ ID NO: 3476323 - RNA, 13 nt, Pseudomonas aeruginosa PA01
ggccgagcgggaa

SEQ ID NO: 3476324 - RNA, 15 nt, Pseudomonas aeruginosa PA01
ggccgagcugccgca

SEQ ID NO: 3476325 - RNA, 19 nt, Pseudomonas aeruginosa PA01
ggccgagcugccgcaccgc

SEQ ID NO: 3476326 - RNA, 20 nt, Pseudomonas aeruginosa PA01
ggccgagcugccgcaccgcc

SEQ ID NO: 3476327 - RNA, 21 nt, Pseudomonas aeruginosa PA01
ggccgagcugccgcaccgccu

SEQ ID NO: 3476328 - RNA, 13 nt, Pseudomonas aeruginosa PA01
ggccgagcugcuc

SEQ ID NO: 3476329 - RNA, 15 nt, Pseudomonas aeruginosa PA01
ggccgagcugcucga

SEQ ID NO: 3476330 - RNA, 18 nt, Pseudomonas aeruginosa PA01
ggccgagcugcucgaagc

SEQ ID NO: 3476331 - RNA, 19 nt, Pseudomonas aeruginosa PA01
ggccgaggaacuccuccuc

SEQ ID NO: 3476332 - RNA, 19 nt, Pseudomonas aeruginosa PA01
ggccgaggaaggcgcuggc

SEQ ID NO: 3476333 - RNA, 22 nt, Pseudomonas aeruginosa PA01
ggccgaggaaggcgcuggcgcu

SEQ ID NO: 3476334 - RNA, 15 nt, Pseudomonas aeruginosa PA01
ggccgaggacccggc

SEQ ID NO: 3476335 - RNA, 18 nt, Pseudomonas aeruginosa PA01
ggccgaggacccggcgga

SEQ ID NO: 3476336 - RNA, 16 nt, Pseudomonas aeruginosa PA01
ggccgaggaggccagc

SEQ ID NO: 3476337 - RNA, 18 nt, Pseudomonas aeruginosa PA01
ggccgaggaugcucgccu

SEQ ID NO: 3476338 - RNA, 19 nt, Pseudomonas aeruginosa PA01
ggccgaggaugcucgccug

SEQ ID NO: 3476339 - RNA, 20 nt, Pseudomonas aeruginosa PA01
ggccgaggaugcucgccugg

SEQ ID NO: 3476340 - RNA, 22 nt, Pseudomonas aeruginosa PA01
ggccgaggaugcucgccuggua

SEQ ID NO: 3476341 - RNA, 13 nt, Pseudomonas aeruginosa PA01
ggccgaggccggc

SEQ ID NO: 3476342 - RNA, 14 nt, Pseudomonas aeruginosa PA01
ggccgaggcuuccu

SEQ ID NO: 3476343 - RNA, 12 nt, Pseudomonas aeruginosa PA01
ggccgagggcag

SEQ ID NO: 3476344 - RNA, 13 nt, Pseudomonas aeruginosa PA01
ggccgagggcagc

SEQ ID NO: 3476345 - RNA, 14 nt, Pseudomonas aeruginosa PA01
ggccgagggcgagu

SEQ ID NO: 3476346 - RNA, 15 nt, Pseudomonas aeruginosa PA01
ggccgagggcgcgca

SEQ ID NO: 3476347 - RNA, 16 nt, Pseudomonas aeruginosa PA01
ggccgagggcgcgcag

SEQ ID NO: 3476348 - RNA, 18 nt, Pseudomonas aeruginosa PA01
ggccgagggugaucagcc

SEQ ID NO: 3476349 - RNA, 17 nt, Pseudomonas aeruginosa PA01
ggccgagguccaucuug

SEQ ID NO: 3476350 - RNA, 17 nt, Pseudomonas aeruginosa PA01
ggccgaggucgaccagc

SEQ ID NO: 3476351 - RNA, 21 nt, Pseudomonas aeruginosa PA01
ggccgaggucggcggcgggga

SEQ ID NO: 3476352 - RNA, 21 nt, Pseudomonas aeruginosa PA01
ggccgagguggagaucagcgg

SEQ ID NO: 3476353 - RNA, 23 nt, Pseudomonas aeruginosa PA01
ggccgagguggagaucagcggac

SEQ ID NO: 3476354 - RNA, 14 nt, Pseudomonas aeruginosa PA01
ggccgaguccgcgc

SEQ ID NO: 3476355 - RNA, 18 nt, Pseudomonas aeruginosa PA01
ggccgaguccgcgcgcgc

SEQ ID NO: 3476356 - RNA, 19 nt, Pseudomonas aeruginosa PA01
ggccgaguggccgaaggcg

SEQ ID NO: 3476357 - RNA, 18 nt, Pseudomonas aeruginosa PA01
ggccgaucaccaccagcg

SEQ ID NO: 3476358 - RNA, 19 nt, Pseudomonas aeruginosa PA01
ggccgaucaccaccagcgc

SEQ ID NO: 3476359 - RNA, 22 nt, Pseudomonas aeruginosa PA01
ggccgaucaccaccagcgccgc

SEQ ID NO: 3476360 - RNA, 23 nt, Pseudomonas aeruginosa PA01
ggccgaucaccaccagcgccgcc

SEQ ID NO: 3476361 - RNA, 16 nt, Pseudomonas aeruginosa PA01
ggccgaucaccaccug

SEQ ID NO: 3476362 - RNA, 18 nt, Pseudomonas aeruginosa PA01
ggccgaucaccaccugga

SEQ ID NO: 3476363 - RNA, 16 nt, Pseudomonas aeruginosa PA01
ggccgaucaccagcgc

SEQ ID NO: 3476364 - RNA, 17 nt, Pseudomonas aeruginosa PA01
ggccgaucaccagcgcc

SEQ ID NO: 3476365 - RNA, 18 nt, Pseudomonas aeruginosa PA01
ggccgaucaccagcgcca

SEQ ID NO: 3476366 - RNA, 23 nt, Pseudomonas aeruginosa PA01
ggccgaucaccagcgccaggccg

SEQ ID NO: 3476367 - RNA, 15 nt, Pseudomonas aeruginosa PA01
ggccgaucaccuggc

SEQ ID NO: 3476368 - RNA, 17 nt, Pseudomonas aeruginosa PA01
ggccgaucaccuggcca

SEQ ID NO: 3476369 - RNA, 21 nt, Pseudomonas aeruginosa PA01
ggccgaucagcgccucggcgc

SEQ ID NO: 3476370 - RNA, 22 nt, Pseudomonas aeruginosa PA01
ggccgaucagcgccucggcgca

SEQ ID NO: 3476371 - RNA, 18 nt, Pseudomonas aeruginosa PA01
ggccgaucagcuuggccu

SEQ ID NO: 3476372 - RNA, 13 nt, Pseudomonas aeruginosa PA01
ggccgaucaggaa

SEQ ID NO: 3476373 - RNA, 18 nt, Pseudomonas aeruginosa PA01
ggccgaucaucaucaggu

SEQ ID NO: 3476374 - RNA, 15 nt, Pseudomonas aeruginosa PA01
ggccgaucaucggcu

SEQ ID NO: 3476375 - RNA, 20 nt, Pseudomonas aeruginosa PA01
ggccgaucaucggcuggucg

SEQ ID NO: 3476376 - RNA, 15 nt, Pseudomonas aeruginosa PA01
ggccgaucgagcggc

SEQ ID NO: 3476377 - RNA, 14 nt, Pseudomonas aeruginosa PA01
ggccgaucgccucg

SEQ ID NO: 3476378 - RNA, 23 nt, Pseudomonas aeruginosa PA01
ggccgaucgccucguucagcagc

SEQ ID NO: 3476379 - RNA, 14 nt, Pseudomonas aeruginosa PA01
ggccgaucuccugg

SEQ ID NO: 3476380 - RNA, 17 nt, Pseudomonas aeruginosa PA01
ggccgaucuccuggcgg

SEQ ID NO: 3476381 - RNA, 19 nt, Pseudomonas aeruginosa PA01
ggccgaucucguggacccg

SEQ ID NO: 3476382 - RNA, 20 nt, Pseudomonas aeruginosa PA01
ggccgaucucgugggccagc

SEQ ID NO: 3476383 - RNA, 22 nt, Pseudomonas aeruginosa PA01
ggccgaucucgugggccagcag

SEQ ID NO: 3476384 - RNA, 17 nt, Pseudomonas aeruginosa PA01
ggccgaucuucagcagc

SEQ ID NO: 3476385 - RNA, 18 nt, Pseudomonas aeruginosa PA01
ggccgaucuucagcagca

SEQ ID NO: 3476386 - RNA, 23 nt, Pseudomonas aeruginosa PA01
ggccgaucuucagcagcaggcgc

SEQ ID NO: 3476387 - RNA, 15 nt, Pseudomonas aeruginosa PA01
ggccgaucuucgccg

SEQ ID NO: 3476388 - RNA, 16 nt, Pseudomonas aeruginosa PA01
ggccgaucuucgccga

SEQ ID NO: 3476389 - RNA, 17 nt, Pseudomonas aeruginosa PA01
ggccgaucuucgccgac

SEQ ID NO: 3476390 - RNA, 14 nt, Pseudomonas aeruginosa PA01
ggccgaugaacgcc

SEQ ID NO: 3476391 - RNA, 16 nt, Pseudomonas aeruginosa PA01
ggccgaugaacgccgc

SEQ ID NO: 3476392 - RNA, 20 nt, Pseudomonas aeruginosa PA01
ggccgaugaucuccgcgccg

SEQ ID NO: 3476393 - RNA, 22 nt, Pseudomonas aeruginosa PA01
ggccgaugaucuccgcgccggg

SEQ ID NO: 3476394 - RNA, 14 nt, Pseudomonas aeruginosa PA01
ggccgaugccgacc

SEQ ID NO: 3476395 - RNA, 16 nt, Pseudomonas aeruginosa PA01
ggccgaugccgaccuu

SEQ ID NO: 3476396 - RNA, 21 nt, Pseudomonas aeruginosa PA01
ggccgaugccgggcaacgcgc

SEQ ID NO: 3476397 - RNA, 13 nt, Pseudomonas aeruginosa PA01
ggccgaugcgcga

SEQ ID NO: 3476398 - RNA, 15 nt, Pseudomonas aeruginosa PA01
ggccgaugcgcgacu

SEQ ID NO: 3476399 - RNA, 19 nt, Pseudomonas aeruginosa PA01
ggccgaugcuaucgcgugg

SEQ ID NO: 3476400 - RNA, 22 nt, Pseudomonas aeruginosa PA01
ggccgauuucgaugacgccauc

SEQ ID NO: 3476401 - RNA, 16 nt, Pseudomonas aeruginosa PA01
ggccgcaaccagcccu

SEQ ID NO: 3476402 - RNA, 17 nt, Pseudomonas aeruginosa PA01
ggccgcaaccagcccug

SEQ ID NO: 3476403 - RNA, 19 nt, Pseudomonas aeruginosa PA01
ggccgcaaccagcccuggc

SEQ ID NO: 3476404 - RNA, 23 nt, Pseudomonas aeruginosa PA01
ggccgcaaccagcccuggcgcag

SEQ ID NO: 3476405 - RNA, 15 nt, Pseudomonas aeruginosa PA01
ggccgcaagcgguau

SEQ ID NO: 3476406 - RNA, 13 nt, Pseudomonas aeruginosa PA01
ggccgcagcagcg

SEQ ID NO: 3476407 - RNA, 13 nt, Pseudomonas aeruginosa PA01
ggccgcagcaggu

SEQ ID NO: 3476408 - RNA, 19 nt, Pseudomonas aeruginosa PA01
ggccgcagcgcagccgauc

SEQ ID NO: 3476409 - RNA, 20 nt, Pseudomonas aeruginosa PA01
ggccgcagcgcagccgaucg

SEQ ID NO: 3476410 - RNA, 13 nt, Pseudomonas aeruginosa PA01
ggccgcaggcagc

SEQ ID NO: 3476411 - RNA, 14 nt, Pseudomonas aeruginosa PA01
ggccgcaggcagca

SEQ ID NO: 3476412 - RNA, 11 nt, Pseudomonas aeruginosa PA01
ggccgcagggg

SEQ ID NO: 3476413 - RNA, 14 nt, Pseudomonas aeruginosa PA01
ggccgcaggugaag

SEQ ID NO: 3476414 - RNA, 18 nt, Pseudomonas aeruginosa PA01
ggccgcaggugaagcuuu

SEQ ID NO: 3476415 - RNA, 20 nt, Pseudomonas aeruginosa PA01
ggccgcaucgcgggcgugcu

SEQ ID NO: 3476416 - RNA, 13 nt, Pseudomonas aeruginosa PA01
ggccgccacggcg

SEQ ID NO: 3476417 - RNA, 15 nt, Pseudomonas aeruginosa PA01
ggccgccacggcggu

SEQ ID NO: 3476418 - RNA, 23 nt, Pseudomonas aeruginosa PA01
ggccgccacggcgguuucgucga

SEQ ID NO: 3476419 - RNA, 13 nt, Pseudomonas aeruginosa PA01
ggccgccagcagg

SEQ ID NO: 3476420 - RNA, 14 nt, Pseudomonas aeruginosa PA01
ggccgccagcaggc

SEQ ID NO: 3476421 - RNA, 16 nt, Pseudomonas aeruginosa PA01
ggccgccagcaggccg

SEQ ID NO: 3476422 - RNA, 14 nt, Pseudomonas aeruginosa PA01
ggccgccagcaggu

SEQ ID NO: 3476423 - RNA, 11 nt, Pseudomonas aeruginosa PA01
ggccgccagcc

SEQ ID NO: 3476424 - RNA, 13 nt, Pseudomonas aeruginosa PA01
ggccgccagccgc

SEQ ID NO: 3476425 - RNA, 19 nt, Pseudomonas aeruginosa PA01
ggccgccagccgccaggac

SEQ ID NO: 3476426 - RNA, 13 nt, Pseudomonas aeruginosa PA01
ggccgccaggccu

SEQ ID NO: 3476427 - RNA, 14 nt, Pseudomonas aeruginosa PA01
ggccgccaggccuc

SEQ ID NO: 3476428 - RNA, 21 nt, Pseudomonas aeruginosa PA01
ggccgccaggccucggcgcgg

SEQ ID NO: 3476429 - RNA, 14 nt, Pseudomonas aeruginosa PA01
ggccgccaggcgcg

SEQ ID NO: 3476430 - RNA, 15 nt, Pseudomonas aeruginosa PA01
ggccgccaggcgcgu

SEQ ID NO: 3476431 - RNA, 15 nt, Pseudomonas aeruginosa PA01
ggccgccaggcuggg

SEQ ID NO: 3476432 - RNA, 22 nt, Pseudomonas aeruginosa PA01
ggccgccagggcgucggagaga

SEQ ID NO: 3476433 - RNA, 17 nt, Pseudomonas aeruginosa PA01
ggccgccagggucagcu

SEQ ID NO: 3476434 - RNA, 15 nt, Pseudomonas aeruginosa PA01
ggccgccaugcucgg

SEQ ID NO: 3476435 - RNA, 18 nt, Pseudomonas aeruginosa PA01
ggccgccaugcucggcca

SEQ ID NO: 3476436 - RNA, 18 nt, Pseudomonas aeruginosa PA01
ggccgccauuccggaacu

SEQ ID NO: 3476437 - RNA, 15 nt, Pseudomonas aeruginosa PA01
ggccgcccagcgcag

SEQ ID NO: 3476438 - RNA, 16 nt, Pseudomonas aeruginosa PA01
ggccgcccagcgcagc

SEQ ID NO: 3476439 - RNA, 13 nt, Pseudomonas aeruginosa PA01
ggccgcccagcgg

SEQ ID NO: 3476440 - RNA, 20 nt, Pseudomonas aeruginosa PA01
ggccgcccagcggaugcgcg

SEQ ID NO: 3476441 - RNA, 12 nt, Pseudomonas aeruginosa PA01
ggccgcccaggu

SEQ ID NO: 3476442 - RNA, 16 nt, Pseudomonas aeruginosa PA01
ggccgcccgagccgcu

SEQ ID NO: 3476443 - RNA, 17 nt, Pseudomonas aeruginosa PA01
ggccgcccgagccgcug

SEQ ID NO: 3476444 - RNA, 13 nt, Pseudomonas aeruginosa PA01
ggccgcccuggcc

SEQ ID NO: 3476445 - RNA, 14 nt, Pseudomonas aeruginosa PA01
ggccgcccuggccg

SEQ ID NO: 3476446 - RNA, 17 nt, Pseudomonas aeruginosa PA01
ggccgcccuggccgagc

SEQ ID NO: 3476447 - RNA, 16 nt, Pseudomonas aeruginosa PA01
ggccgcccuugacccc

SEQ ID NO: 3476448 - RNA, 21 nt, Pseudomonas aeruginosa PA01
ggccgccgaaaugcugcaggc

SEQ ID NO: 3476449 - RNA, 13 nt, Pseudomonas aeruginosa PA01
ggccgccgaagaa

SEQ ID NO: 3476450 - RNA, 20 nt, Pseudomonas aeruginosa PA01
ggccgccgaagaacucggcg

SEQ ID NO: 3476451 - RNA, 21 nt, Pseudomonas aeruginosa PA01
ggccgccgaagaacucggcgc

SEQ ID NO: 3476452 - RNA, 22 nt, Pseudomonas aeruginosa PA01
ggccgccgaagaacucggcgcu

SEQ ID NO: 3476453 - RNA, 21 nt, Pseudomonas aeruginosa PA01
ggcauccucgccccgccggga

SEQ ID NO: 3476454 - RNA, 22 nt, Pseudomonas aeruginosa PA01
ggcauccucgccccgccgggag

SEQ ID NO: 3476455 - RNA, 19 nt, Pseudomonas aeruginosa PA01
ggcauccuguggcugcagg

SEQ ID NO: 3476456 - RNA, 22 nt, Pseudomonas aeruginosa PA01
ggcauccuguggcugcagguag

SEQ ID NO: 3476457 - RNA, 18 nt, Pseudomonas aeruginosa PA01
ggcaucgaacucacagau

SEQ ID NO: 3476458 - RNA, 12 nt, Pseudomonas aeruginosa PA01
ggcaucgaccag

SEQ ID NO: 3476459 - RNA, 13 nt, Pseudomonas aeruginosa PA01
ggcaucgaccagc

SEQ ID NO: 3476460 - RNA, 21 nt, Pseudomonas aeruginosa PA01
ggcaucgaccagcagcggcuc

SEQ ID NO: 3476461 - RNA, 17 nt, Pseudomonas aeruginosa PA01
ggcaucgaccagggccg

SEQ ID NO: 3476462 - RNA, 19 nt, Pseudomonas aeruginosa PA01
ggcaucgaccagggccggg

SEQ ID NO: 3476463 - RNA, 20 nt, Pseudomonas aeruginosa PA01
ggcaucgaccagggccgggu

SEQ ID NO: 3476464 - RNA, 16 nt, Pseudomonas aeruginosa PA01
ggcaucgaccaugccg

SEQ ID NO: 3476465 - RNA, 18 nt, Pseudomonas aeruginosa PA01
ggcaucgacgccagcggc

SEQ ID NO: 3476466 - RNA, 19 nt, Pseudomonas aeruginosa PA01
ggcaucgacgccagcggcg

SEQ ID NO: 3476467 - RNA, 17 nt, Pseudomonas aeruginosa PA01
ggcaucgaucuugccca

SEQ ID NO: 3476468 - RNA, 17 nt, Pseudomonas aeruginosa PA01
ggcaucgccauggcgcu

SEQ ID NO: 3476469 - RNA, 19 nt, Pseudomonas aeruginosa PA01
ggcaucgccauggcgcugc

SEQ ID NO: 3476470 - RNA, 12 nt, Pseudomonas aeruginosa PA01
ggcaucgccgac

SEQ ID NO: 3476471 - RNA, 13 nt, Pseudomonas aeruginosa PA01
ggcaucgccgaca

SEQ ID NO: 3476472 - RNA, 13 nt, Pseudomonas aeruginosa PA01
ggcaucgccgccc

SEQ ID NO: 3476473 - RNA, 14 nt, Pseudomonas aeruginosa PA01
ggcaucgccgccca

SEQ ID NO: 3476474 - RNA, 12 nt, Pseudomonas aeruginosa PA01
ggcaucgcgaaa

SEQ ID NO: 3476475 - RNA, 15 nt, Pseudomonas aeruginosa PA01
ggcaucgcguagggc

SEQ ID NO: 3476476 - RNA, 13 nt, Pseudomonas aeruginosa PA01
ggcaucggccacu

SEQ ID NO: 3476477 - RNA, 15 nt, Pseudomonas aeruginosa PA01
ggcaucggcgccgcg

SEQ ID NO: 3476478 - RNA, 16 nt, Pseudomonas aeruginosa PA01
ggcaucggcgccgcgc

SEQ ID NO: 3476479 - RNA, 20 nt, Pseudomonas aeruginosa PA01
ggcaucgucgaagcugaggu

SEQ ID NO: 3476480 - RNA, 15 nt, Pseudomonas aeruginosa PA01
ggcaucguggccaug

SEQ ID NO: 3476481 - RNA, 19 nt, Pseudomonas aeruginosa PA01
ggcaucguggccaugggua

SEQ ID NO: 3476482 - RNA, 16 nt, Pseudomonas aeruginosa PA01
ggcaucucggccaccu

SEQ ID NO: 3476483 - RNA, 17 nt, Pseudomonas aeruginosa PA01
ggcaucuucaaucgcgc

SEQ ID NO: 3476484 - RNA, 21 nt, Pseudomonas aeruginosa PA01
ggcaucuuucagcugagucgc

SEQ ID NO: 3476485 - RNA, 22 nt, Pseudomonas aeruginosa PA01
ggcaugaacgaaaacgccgcuu

SEQ ID NO: 3476486 - RNA, 21 nt, Pseudomonas aeruginosa PA01
ggcaugaagcuuuuccagcgc

SEQ ID NO: 3476487 - RNA, 22 nt, Pseudomonas aeruginosa PA01
ggcaugaagcuuuuccagcgca

SEQ ID NO: 3476488 - RNA, 16 nt, Pseudomonas aeruginosa PA01
ggcaugaccgauggcg

SEQ ID NO: 3476489 - RNA, 21 nt, Pseudomonas aeruginosa PA01
ggcaugaccgauggcgccgcg

SEQ ID NO: 3476490 - RNA, 22 nt, Pseudomonas aeruginosa PA01
ggcaugaccgauggcgccgcga

SEQ ID NO: 3476491 - RNA, 21 nt, Pseudomonas aeruginosa PA01
ggcaugaggggaaucgccguc

SEQ ID NO: 3476492 - RNA, 15 nt, Pseudomonas aeruginosa PA01
ggcaugcaccuacca

SEQ ID NO: 3476493 - RNA, 15 nt, Pseudomonas aeruginosa PA01
ggcaugcacgcccug

SEQ ID NO: 3476494 - RNA, 21 nt, Pseudomonas aeruginosa PA01
ggcaugcacgcccuggagcgg

SEQ ID NO: 3476495 - RNA, 13 nt, Pseudomonas aeruginosa PA01
ggcaugcaggugg

SEQ ID NO: 3476496 - RNA, 16 nt, Pseudomonas aeruginosa PA01
ggcaugcccaggcucg

SEQ ID NO: 3476497 - RNA, 12 nt, Pseudomonas aeruginosa PA01
ggcaugcccugc

SEQ ID NO: 3476498 - RNA, 15 nt, Pseudomonas aeruginosa PA01
ggcaugcccugccgg

SEQ ID NO: 3476499 - RNA, 18 nt, Pseudomonas aeruginosa PA01
ggcaugcccugccggcgc

SEQ ID NO: 3476500 - RNA, 22 nt, Pseudomonas aeruginosa PA01
ggcaugccgugggcgccgccgg

SEQ ID NO: 3476501 - RNA, 18 nt, Pseudomonas aeruginosa PA01
ggcaugccguugggccag

SEQ ID NO: 3476502 - RNA, 19 nt, Pseudomonas aeruginosa PA01
ggcaugccguugggccagg

SEQ ID NO: 3476503 - RNA, 23 nt, Pseudomonas aeruginosa PA01
ggcaugccguugggccagggccu

SEQ ID NO: 3476504 - RNA, 14 nt, Pseudomonas aeruginosa PA01
ggcaugcggccccg

SEQ ID NO: 3476505 - RNA, 19 nt, Pseudomonas aeruginosa PA01
ggcaugcggccccggcgcu

SEQ ID NO: 3476506 - RNA, 16 nt, Pseudomonas aeruginosa PA01
ggcaugcgggcgcgag

SEQ ID NO: 3476507 - RNA, 17 nt, Pseudomonas aeruginosa PA01
ggcaugcucagccgcgc

SEQ ID NO: 3476508 - RNA, 15 nt, Pseudomonas aeruginosa PA01
ggcaugcucggccag

SEQ ID NO: 3476509 - RNA, 15 nt, Pseudomonas aeruginosa PA01
ggcauggccgaccgc

SEQ ID NO: 3476510 - RNA, 14 nt, Pseudomonas aeruginosa PA01
ggcauggccgcucc

SEQ ID NO: 3476511 - RNA, 21 nt, Pseudomonas aeruginosa PA01
ggcauggccgcucccaccgcu

SEQ ID NO: 3476512 - RNA, 11 nt, Pseudomonas aeruginosa PA01
ggcauggcgau

SEQ ID NO: 3476513 - RNA, 23 nt, Pseudomonas aeruginosa PA01
ggcauggcuggcgcuaccgcgca

SEQ ID NO: 3476514 - RNA, 13 nt, Pseudomonas aeruginosa PA01
ggcauggcuguag

SEQ ID NO: 3476515 - RNA, 22 nt, Pseudomonas aeruginosa PA01
ggcauggcuuuccaggcgccgc

SEQ ID NO: 3476516 - RNA, 24 nt, Pseudomonas aeruginosa PA01
ggcauggcuuuccaggcgccgcuu

SEQ ID NO: 3476517 - RNA, 22 nt, Pseudomonas aeruginosa PA01
ggcaugggcauccugccgccug

SEQ ID NO: 3476518 - RNA, 14 nt, Pseudomonas aeruginosa PA01
ggcaugggcgcggg

SEQ ID NO: 3476519 - RNA, 17 nt, Pseudomonas aeruginosa PA01
ggcaugggucagcgcca

SEQ ID NO: 3476520 - RNA, 19 nt, Pseudomonas aeruginosa PA01
ggcaugggucagcgccagc

SEQ ID NO: 3476521 - RNA, 18 nt, Pseudomonas aeruginosa PA01
ggcaugguccguucggcg

SEQ ID NO: 3476522 - RNA, 15 nt, Pseudomonas aeruginosa PA01
ggcaugguguccggc

SEQ ID NO: 3476523 - RNA, 17 nt, Pseudomonas aeruginosa PA01
ggcauguccaccgccgc

SEQ ID NO: 3476524 - RNA, 19 nt, Pseudomonas aeruginosa PA01
ggcauguccaccgccgcca

SEQ ID NO: 3476525 - RNA, 21 nt, Pseudomonas aeruginosa PA01
ggcauguccaccgccgccagc

SEQ ID NO: 3476526 - RNA, 22 nt, Pseudomonas aeruginosa PA01
ggcauguccaccgccgccagca

SEQ ID NO: 3476527 - RNA, 15 nt, Pseudomonas aeruginosa PA01
ggcauguuccuccag

SEQ ID NO: 3476528 - RNA, 16 nt, Pseudomonas aeruginosa PA01
ggcauguuggcgccuu

SEQ ID NO: 3476529 - RNA, 18 nt, Pseudomonas aeruginosa PA01
ggcauguuggcgccuucg

SEQ ID NO: 3476530 - RNA, 21 nt, Pseudomonas aeruginosa PA01
ggcauuccagaaacggcugcc

SEQ ID NO: 3476531 - RNA, 18 nt, Pseudomonas aeruginosa PA01
ggcauuccgggcgaaagc

SEQ ID NO: 3476532 - RNA, 13 nt, Pseudomonas aeruginosa PA01
ggcauuccuccag

SEQ ID NO: 3476533 - RNA, 18 nt, Pseudomonas aeruginosa PA01
ggcauuccuccagggucg

SEQ ID NO: 3476534 - RNA, 20 nt, Pseudomonas aeruginosa PA01
ggcauuccuccagggucgcc

SEQ ID NO: 3476535 - RNA, 19 nt, Pseudomonas aeruginosa PA01
ggcauuccugguccagcca

SEQ ID NO: 3476536 - RNA, 15 nt, Pseudomonas aeruginosa PA01
ggcauucgacccgcc

SEQ ID NO: 3476537 - RNA, 20 nt, Pseudomonas aeruginosa PA01
ggcauucgacccgccgacca

SEQ ID NO: 3476538 - RNA, 15 nt, Pseudomonas aeruginosa PA01
ggcauucgcagcggc

SEQ ID NO: 3476539 - RNA, 17 nt, Pseudomonas aeruginosa PA01
ggcauucgcagcggccc

SEQ ID NO: 3476540 - RNA, 12 nt, Pseudomonas aeruginosa PA01
ggcauucgccgg

SEQ ID NO: 3476541 - RNA, 15 nt, Pseudomonas aeruginosa PA01
ggcauucgccgggcu

SEQ ID NO: 3476542 - RNA, 13 nt, Pseudomonas aeruginosa PA01
ggcauucguccag

SEQ ID NO: 3476543 - RNA, 17 nt, Pseudomonas aeruginosa PA01
ggcauucguccagccgc

SEQ ID NO: 3476544 - RNA, 19 nt, Pseudomonas aeruginosa PA01
ggcauucguccagccgccg

SEQ ID NO: 3476545 - RNA, 20 nt, Pseudomonas aeruginosa PA01
ggcauucguccagccgccgc

SEQ ID NO: 3476546 - RNA, 16 nt, Pseudomonas aeruginosa PA01
ggcauucgucgccgcu

SEQ ID NO: 3476547 - RNA, 23 nt, Pseudomonas aeruginosa PA01
ggcauucucgcgacccuggccgc

SEQ ID NO: 3476548 - RNA, 16 nt, Pseudomonas aeruginosa PA01
ggcauucucucuucag

SEQ ID NO: 3476549 - RNA, 17 nt, Pseudomonas aeruginosa PA01
ggcauucucucuucagc

SEQ ID NO: 3476550 - RNA, 14 nt, Pseudomonas aeruginosa PA01
ggcauugagggcga

SEQ ID NO: 3476551 - RNA, 21 nt, Pseudomonas aeruginosa PA01
ggcauugcacaacgggugcug

SEQ ID NO: 3476552 - RNA, 15 nt, Pseudomonas aeruginosa PA01
ggcauugccguccgu

SEQ ID NO: 3476553 - RNA, 15 nt, Pseudomonas aeruginosa PA01
ggcauuggcacccug

SEQ ID NO: 3476554 - RNA, 21 nt, Pseudomonas aeruginosa PA01
ggcauuggcacccuggacccg

SEQ ID NO: 3476555 - RNA, 22 nt, Pseudomonas aeruginosa PA01
ggcauuggcacccuggacccgg

SEQ ID NO: 3476556 - RNA, 20 nt, Pseudomonas aeruginosa PA01
ggcauuggccaucagcgccg

SEQ ID NO: 3476557 - RNA, 23 nt, Pseudomonas aeruginosa PA01
ggcauuggugcugccgaugcuga

SEQ ID NO: 3476558 - RNA, 14 nt, Pseudomonas aeruginosa PA01
ggccaaccaccggc

SEQ ID NO: 3476559 - RNA, 13 nt, Pseudomonas aeruginosa PA01
ggccaacggccgc

SEQ ID NO: 3476560 - RNA, 16 nt, Pseudomonas aeruginosa PA01
ggccaacggccgcuug

SEQ ID NO: 3476561 - RNA, 22 nt, Pseudomonas aeruginosa PA01
ggccaacgguagcggaucagcc

SEQ ID NO: 3476562 - RNA, 23 nt, Pseudomonas aeruginosa PA01
ggccaacgguagcggaucagccg

SEQ ID NO: 3476563 - RNA, 14 nt, Pseudomonas aeruginosa PA01
ggccaacugggccu

SEQ ID NO: 3476564 - RNA, 15 nt, Pseudomonas aeruginosa PA01
ggccaagucggccgc

SEQ ID NO: 3476565 - RNA, 13 nt, Pseudomonas aeruginosa PA01
ggccaauccacaa

SEQ ID NO: 3476566 - RNA, 12 nt, Pseudomonas aeruginosa PA01
ggccaccagagc

SEQ ID NO: 3476567 - RNA, 16 nt, Pseudomonas aeruginosa PA01
ggccaccagagccagc

SEQ ID NO: 3476568 - RNA, 17 nt, Pseudomonas aeruginosa PA01
ggccaccagagccagcc

SEQ ID NO: 3476569 - RNA, 18 nt, Pseudomonas aeruginosa PA01
ggccaccagagccagccg

SEQ ID NO: 3476570 - RNA, 12 nt, Pseudomonas aeruginosa PA01
ggccaccagcac

SEQ ID NO: 3476571 - RNA, 13 nt, Pseudomonas aeruginosa PA01
ggccaccagcacc

SEQ ID NO: 3476572 - RNA, 14 nt, Pseudomonas aeruginosa PA01
ggccaccagcaccu

SEQ ID NO: 3476573 - RNA, 17 nt, Pseudomonas aeruginosa PA01
ggccaccagcaccugcg

SEQ ID NO: 3476574 - RNA, 14 nt, Pseudomonas aeruginosa PA01
ggccaccagcagca

SEQ ID NO: 3476575 - RNA, 14 nt, Pseudomonas aeruginosa PA01
ggccaccagcgaaa

SEQ ID NO: 3476576 - RNA, 15 nt, Pseudomonas aeruginosa PA01
ggccaccagggugcg

SEQ ID NO: 3476577 - RNA, 20 nt, Pseudomonas aeruginosa PA01
ggccaccaucacgucgcgca

SEQ ID NO: 3476578 - RNA, 22 nt, Pseudomonas aeruginosa PA01
ggccaccaucacgucgcgcacc

SEQ ID NO: 3476579 - RNA, 17 nt, Pseudomonas aeruginosa PA01
ggccaccaucagguaga

SEQ ID NO: 3476580 - RNA, 17 nt, Pseudomonas aeruginosa PA01
ggccacccgccucgucg

SEQ ID NO: 3476581 - RNA, 20 nt, Pseudomonas aeruginosa PA01
ggccacccgccucgucgcca

SEQ ID NO: 3476582 - RNA, 15 nt, Pseudomonas aeruginosa PA01
ggccacccuugcgcc

SEQ ID NO: 3476583 - RNA, 16 nt, Pseudomonas aeruginosa PA01
ggccacccuugcgccc

SEQ ID NO: 3476584 - RNA, 18 nt, Pseudomonas aeruginosa PA01
ggccacccuugcgcccgg

SEQ ID NO: 3476585 - RNA, 19 nt, Pseudomonas aeruginosa PA01
ggccacccuugcgcccggc

SEQ ID NO: 3476586 - RNA, 19 nt, Pseudomonas aeruginosa PA01
ggccacccuuguggccgau

SEQ ID NO: 3476587 - RNA, 21 nt, Pseudomonas aeruginosa PA01
ggccaccgaaucgaugcugua

SEQ ID NO: 3476588 - RNA, 14 nt, Pseudomonas aeruginosa PA01
ggccaccgccagga

SEQ ID NO: 3476589 - RNA, 18 nt, Pseudomonas aeruginosa PA01
ggccaccgccaggaccuc

SEQ ID NO: 3476590 - RNA, 14 nt, Pseudomonas aeruginosa PA01
ggccaccgcgcagc

SEQ ID NO: 3476591 - RNA, 12 nt, Pseudomonas aeruginosa PA01
ggccaccgcggc

SEQ ID NO: 3476592 - RNA, 15 nt, Pseudomonas aeruginosa PA01
ggccaccgcggcguc

SEQ ID NO: 3476593 - RNA, 17 nt, Pseudomonas aeruginosa PA01
ggccaccgcggcguccg

SEQ ID NO: 3476594 - RNA, 18 nt, Pseudomonas aeruginosa PA01
ggccaccgcggcguccgc

SEQ ID NO: 3476595 - RNA, 20 nt, Pseudomonas aeruginosa PA01
ggccaccgcggcguccgcgu

SEQ ID NO: 3476596 - RNA, 16 nt, Pseudomonas aeruginosa PA01
ggccaccgggaucagc

SEQ ID NO: 3476597 - RNA, 19 nt, Pseudomonas aeruginosa PA01
ggccaccgucggauggccg

SEQ ID NO: 3476598 - RNA, 11 nt, Pseudomonas aeruginosa PA01
ggccaccugcg

SEQ ID NO: 3476599 - RNA, 19 nt, Pseudomonas aeruginosa PA01
ggccaccugcggguggccu

SEQ ID NO: 3476600 - RNA, 20 nt, Pseudomonas aeruginosa PA01
ggccaccugcuccggcguac

SEQ ID NO: 3476601 - RNA, 14 nt, Pseudomonas aeruginosa PA01
ggccaccuggcucu

SEQ ID NO: 3476602 - RNA, 14 nt, Pseudomonas aeruginosa PA01
ggccaccuucgccc

SEQ ID NO: 3476603 - RNA, 17 nt, Pseudomonas aeruginosa PA01
ggccacgaacaggcugu

SEQ ID NO: 3476604 - RNA, 20 nt, Pseudomonas aeruginosa PA01
ggccacgaacugcauggccu

SEQ ID NO: 3476605 - RNA, 21 nt, Pseudomonas aeruginosa PA01
ggccacgaacugcauggccuu

SEQ ID NO: 3476606 - RNA, 14 nt, Pseudomonas aeruginosa PA01
ggccacgacccugc

SEQ ID NO: 3476607 - RNA, 19 nt, Pseudomonas aeruginosa PA01
ggccacgcaccagcucccg

SEQ ID NO: 3476608 - RNA, 20 nt, Pseudomonas aeruginosa PA01
ggccacgccauucgaauggc

SEQ ID NO: 3476609 - RNA, 15 nt, Pseudomonas aeruginosa PA01
ggccacgcccaugcc

SEQ ID NO: 3476610 - RNA, 12 nt, Pseudomonas aeruginosa PA01
ggccacgcccgg

SEQ ID NO: 3476611 - RNA, 17 nt, Pseudomonas aeruginosa PA01
ggccacgcccggugucg

SEQ ID NO: 3476612 - RNA, 15 nt, Pseudomonas aeruginosa PA01
ggccacgccgccguc

SEQ ID NO: 3476613 - RNA, 13 nt, Pseudomonas aeruginosa PA01
ggccacgccuucg

SEQ ID NO: 3476614 - RNA, 16 nt, Pseudomonas aeruginosa PA01
ggccacgcgaccagcg

SEQ ID NO: 3476615 - RNA, 18 nt, Pseudomonas aeruginosa PA01
ggccacgcgaccagcgcc

SEQ ID NO: 3476616 - RNA, 19 nt, Pseudomonas aeruginosa PA01
ggccacgcgaccagcgcca

SEQ ID NO: 3476617 - RNA, 23 nt, Pseudomonas aeruginosa PA01
ggccacgcucucgaacagcagca

SEQ ID NO: 3476618 - RNA, 16 nt, Pseudomonas aeruginosa PA01
ggccacggcaucggag

SEQ ID NO: 3476619 - RNA, 13 nt, Pseudomonas aeruginosa PA01
ggccacggccgcu

SEQ ID NO: 3476620 - RNA, 14 nt, Pseudomonas aeruginosa PA01
ggccacggccgcug

SEQ ID NO: 3476621 - RNA, 13 nt, Pseudomonas aeruginosa PA01
ggccacggccggc

SEQ ID NO: 3476622 - RNA, 17 nt, Pseudomonas aeruginosa PA01
ggccacggccggcgagg

SEQ ID NO: 3476623 - RNA, 17 nt, Pseudomonas aeruginosa PA01
ggccacggcggaagucg

SEQ ID NO: 3476624 - RNA, 15 nt, Pseudomonas aeruginosa PA01
ggccacgucgcccca

SEQ ID NO: 3476625 - RNA, 15 nt, Pseudomonas aeruginosa PA01
ggccacuccagcccc

SEQ ID NO: 3476626 - RNA, 17 nt, Pseudomonas aeruginosa PA01
ggccacuccgggcuggu

SEQ ID NO: 3476627 - RNA, 20 nt, Pseudomonas aeruginosa PA01
ggccacuccgggcuggucgu

SEQ ID NO: 3476628 - RNA, 16 nt, Pseudomonas aeruginosa PA01
ggccacucgcagccgc

SEQ ID NO: 3476629 - RNA, 15 nt, Pseudomonas aeruginosa PA01
ggccacuucccggcg

SEQ ID NO: 3476630 - RNA, 22 nt, Pseudomonas aeruginosa PA01
ggccacuucguccggccgcccg

SEQ ID NO: 3476631 - RNA, 18 nt, Pseudomonas aeruginosa PA01
ggccagaauuccagcagg

SEQ ID NO: 3476632 - RNA, 19 nt, Pseudomonas aeruginosa PA01
ggccagaauuccagcaggu

SEQ ID NO: 3476633 - RNA, 18 nt, Pseudomonas aeruginosa PA01
ggccagagcacgaaagcg

SEQ ID NO: 3476634 - RNA, 18 nt, Pseudomonas aeruginosa PA01
ggccagagcuucugcugg

SEQ ID NO: 3476635 - RNA, 21 nt, Pseudomonas aeruginosa PA01
ggccagcaauacccgccgcug

SEQ ID NO: 3476636 - RNA, 20 nt, Pseudomonas aeruginosa PA01
ggccagcaaugcccgcgccu

SEQ ID NO: 3476637 - RNA, 23 nt, Pseudomonas aeruginosa PA01
ggccagcaaugcccgcgccuggg

SEQ ID NO: 3476638 - RNA, 21 nt, Pseudomonas aeruginosa PA01
ggccagcaccagucccuggcc

SEQ ID NO: 3476639 - RNA, 22 nt, Pseudomonas aeruginosa PA01
ggccagcaccagucccuggccg

SEQ ID NO: 3476640 - RNA, 23 nt, Pseudomonas aeruginosa PA01
ggccagcaccagucccuggccgg

SEQ ID NO: 3476641 - RNA, 17 nt, Pseudomonas aeruginosa PA01
ggccagcaccucgacgc

SEQ ID NO: 3476642 - RNA, 20 nt, Pseudomonas aeruginosa PA01
ggccagcaccucgacgcccg

SEQ ID NO: 3476643 - RNA, 22 nt, Pseudomonas aeruginosa PA01
ggccagcaccucgacgcccgcu

SEQ ID NO: 3476644 - RNA, 13 nt, Pseudomonas aeruginosa PA01
ggccagcagcacg

SEQ ID NO: 3476645 - RNA, 16 nt, Pseudomonas aeruginosa PA01
ggccagcagcacggcg

SEQ ID NO: 3476646 - RNA, 21 nt, Pseudomonas aeruginosa PA01
ggccagcagcaucggaccggu

SEQ ID NO: 3476647 - RNA, 14 nt, Pseudomonas aeruginosa PA01
ggccagcagcgccu

SEQ ID NO: 3476648 - RNA, 14 nt, Pseudomonas aeruginosa PA01
ggccagcagcgcug

SEQ ID NO: 3476649 - RNA, 15 nt, Pseudomonas aeruginosa PA01
ggccagcagcggcgg

SEQ ID NO: 3476650 - RNA, 19 nt, Pseudomonas aeruginosa PA01
ggccagcagcggcggcgcc

SEQ ID NO: 3476651 - RNA, 20 nt, Pseudomonas aeruginosa PA01
ggccagcagcggcggcgccg

SEQ ID NO: 3476652 - RNA, 11 nt, Pseudomonas aeruginosa PA01
ggccagcagcu

SEQ ID NO: 3476653 - RNA, 14 nt, Pseudomonas aeruginosa PA01
ggccagcagcuccg

SEQ ID NO: 3476654 - RNA, 15 nt, Pseudomonas aeruginosa PA01
ggccagcagcuccgg

SEQ ID NO: 3476655 - RNA, 17 nt, Pseudomonas aeruginosa PA01
ggccagcagcuccgggc

SEQ ID NO: 3476656 - RNA, 18 nt, Pseudomonas aeruginosa PA01
ggccagcagcuccgggcu

SEQ ID NO: 3476657 - RNA, 22 nt, Pseudomonas aeruginosa PA01
ggccagcaggaugcugcacagc

SEQ ID NO: 3476658 - RNA, 13 nt, Pseudomonas aeruginosa PA01
ggccagcaggccg

SEQ ID NO: 3476659 - RNA, 14 nt, Pseudomonas aeruginosa PA01
ggccagcaggccga

SEQ ID NO: 3476660 - RNA, 15 nt, Pseudomonas aeruginosa PA01
ggccagcaggccgag

SEQ ID NO: 3476661 - RNA, 16 nt, Pseudomonas aeruginosa PA01
ggccagcaggccgagc

SEQ ID NO: 3476662 - RNA, 19 nt, Pseudomonas aeruginosa PA01
ggccagcaggccgagcgug

SEQ ID NO: 3476663 - RNA, 15 nt, Pseudomonas aeruginosa PA01
ggccagcaggccgau

SEQ ID NO: 3476664 - RNA, 23 nt, Pseudomonas aeruginosa PA01
ggccagcaggccgaucagcggcg

SEQ ID NO: 3476665 - RNA, 16 nt, Pseudomonas aeruginosa PA01
ggccagcaggccgugg

SEQ ID NO: 3476666 - RNA, 13 nt, Pseudomonas aeruginosa PA01
ggccagcaggcgc

SEQ ID NO: 3476667 - RNA, 14 nt, Pseudomonas aeruginosa PA01
ggccagcaggcgcc

SEQ ID NO: 3476668 - RNA, 15 nt, Pseudomonas aeruginosa PA01
ggccagcaggcgccg

SEQ ID NO: 3476669 - RNA, 16 nt, Pseudomonas aeruginosa PA01
ggccagcaggcgccgc

SEQ ID NO: 3476670 - RNA, 18 nt, Pseudomonas aeruginosa PA01
ggccagcaggcgccgcgc

SEQ ID NO: 3476671 - RNA, 19 nt, Pseudomonas aeruginosa PA01
ggccagcaggcgccgcgca

SEQ ID NO: 3476672 - RNA, 20 nt, Pseudomonas aeruginosa PA01
ggccagcaggcgccgcgcau

SEQ ID NO: 3476673 - RNA, 14 nt, Pseudomonas aeruginosa PA01
ggccagcaggcgcu

SEQ ID NO: 3476674 - RNA, 16 nt, Pseudomonas aeruginosa PA01
ggccagcaggcgcucg

SEQ ID NO: 3476675 - RNA, 18 nt, Pseudomonas aeruginosa PA01
ggccagcaggcgcucggc

SEQ ID NO: 3476676 - RNA, 19 nt, Pseudomonas aeruginosa PA01
ggccagcaggcgcucggcg

SEQ ID NO: 3476677 - RNA, 20 nt, Pseudomonas aeruginosa PA01
ggccagcaggcuggcggcau

SEQ ID NO: 3476678 - RNA, 14 nt, Pseudomonas aeruginosa PA01
ggccagcagggccg

SEQ ID NO: 3476679 - RNA, 17 nt, Pseudomonas aeruginosa PA01
ggccagcagggccgccg

SEQ ID NO: 3476680 - RNA, 20 nt, Pseudomonas aeruginosa PA01
ggccagcagggccgccgagg

SEQ ID NO: 3476681 - RNA, 14 nt, Pseudomonas aeruginosa PA01
ggccagcagggugg

SEQ ID NO: 3476682 - RNA, 22 nt, Pseudomonas aeruginosa PA01
ggccagcaggguggccaggguc

SEQ ID NO: 3476683 - RNA, 16 nt, Pseudomonas aeruginosa PA01
ggccagcagguagccu

SEQ ID NO: 3476684 - RNA, 20 nt, Pseudomonas aeruginosa PA01
ggccagcagguagccugcgg

SEQ ID NO: 3476685 - RNA, 22 nt, Pseudomonas aeruginosa PA01
ggccagcagguagccugcggcc

SEQ ID NO: 3476686 - RNA, 24 nt, Pseudomonas aeruginosa PA01
ggccagcagguagccugcggccag

SEQ ID NO: 3476687 - RNA, 15 nt, Pseudomonas aeruginosa PA01
ggccagccagagcca

SEQ ID NO: 3476688 - RNA, 17 nt, Pseudomonas aeruginosa PA01
ggccagccagggcagca

SEQ ID NO: 3476689 - RNA, 12 nt, Pseudomonas aeruginosa PA01
ggccagcccaga

SEQ ID NO: 3476690 - RNA, 18 nt, Pseudomonas aeruginosa PA01
ggccagcccagaacagca

SEQ ID NO: 3476691 - RNA, 17 nt, Pseudomonas aeruginosa PA01
ggccagccccagauggg

SEQ ID NO: 3476692 - RNA, 11 nt, Pseudomonas aeruginosa PA01
ggccagccccc

SEQ ID NO: 3476693 - RNA, 17 nt, Pseudomonas aeruginosa PA01
ggccagcccccucgccc

SEQ ID NO: 3476694 - RNA, 20 nt, Pseudomonas aeruginosa PA01
ggccagcccccucgcccucg

SEQ ID NO: 3476695 - RNA, 14 nt, Pseudomonas aeruginosa PA01
ggccagccccugcg

SEQ ID NO: 3476696 - RNA, 17 nt, Pseudomonas aeruginosa PA01
ggccagccccugcggac

SEQ ID NO: 3476697 - RNA, 18 nt, Pseudomonas aeruginosa PA01
ggccagccccugcggacc

SEQ ID NO: 3476698 - RNA, 11 nt, Pseudomonas aeruginosa PA01
ggccagcccgg

SEQ ID NO: 3476699 - RNA, 19 nt, Pseudomonas aeruginosa PA01
ggccagcccggccucgccg

SEQ ID NO: 3476700 - RNA, 22 nt, Pseudomonas aeruginosa PA01
ggccagcccggccucgccgguc

SEQ ID NO: 3476701 - RNA, 23 nt, Pseudomonas aeruginosa PA01
ggccagcccuuucagcggcugcc

SEQ ID NO: 3476702 - RNA, 12 nt, Pseudomonas aeruginosa PA01
ggccagccgcgc

SEQ ID NO: 3476703 - RNA, 14 nt, Pseudomonas aeruginosa PA01
ggccagccgcgcca

SEQ ID NO: 3476704 - RNA, 18 nt, Pseudomonas aeruginosa PA01
ggccagccgcgccagugc

SEQ ID NO: 3476705 - RNA, 20 nt, Pseudomonas aeruginosa PA01
ggccagccgcgccagugccu

SEQ ID NO: 3476706 - RNA, 17 nt, Pseudomonas aeruginosa PA01
ggccagccgcgcggcau

SEQ ID NO: 3476707 - RNA, 22 nt, Pseudomonas aeruginosa PA01
ggccagccgcgcggcauagcgc

SEQ ID NO: 3476708 - RNA, 15 nt, Pseudomonas aeruginosa PA01
ggccagccgcuagcg

SEQ ID NO: 3476709 - RNA, 14 nt, Pseudomonas aeruginosa PA01
ggccagccguucgc

SEQ ID NO: 3476710 - RNA, 24 nt, Pseudomonas aeruginosa PA01
ggccagccguucgcuggacaggcg

SEQ ID NO: 3476711 - RNA, 14 nt, Pseudomonas aeruginosa PA01
ggccagccuggcca

SEQ ID NO: 3476712 - RNA, 22 nt, Pseudomonas aeruginosa PA01
ggccagccuggccagcgcuucg

SEQ ID NO: 3476713 - RNA, 16 nt, Pseudomonas aeruginosa PA01
ggccagccuucccggc

SEQ ID NO: 3476714 - RNA, 17 nt, Pseudomonas aeruginosa PA01
ggccagccuucccggcg

SEQ ID NO: 3476715 - RNA, 15 nt, Pseudomonas aeruginosa PA01
ggccagccuuccucg

SEQ ID NO: 3476716 - RNA, 17 nt, Pseudomonas aeruginosa PA01
ggccagcgaacccaggc

SEQ ID NO: 3476717 - RNA, 19 nt, Pseudomonas aeruginosa PA01
ggccagcgaacccaggccg

SEQ ID NO: 3476718 - RNA, 20 nt, Pseudomonas aeruginosa PA01
ggccagcgaacccaggccgc

SEQ ID NO: 3476719 - RNA, 19 nt, Pseudomonas aeruginosa PA01
ggccagcgaacgcacuucg

SEQ ID NO: 3476720 - RNA, 22 nt, Pseudomonas aeruginosa PA01
ggccagcgaacgcacuucgucc

SEQ ID NO: 3476721 - RNA, 21 nt, Pseudomonas aeruginosa PA01
ggccagcgcaucgaggccggc

SEQ ID NO: 3476722 - RNA, 11 nt, Pseudomonas aeruginosa PA01
ggccagcgcca

SEQ ID NO: 3476723 - RNA, 14 nt, Pseudomonas aeruginosa PA01
ggccagcgccacca

SEQ ID NO: 3476724 - RNA, 13 nt, Pseudomonas aeruginosa PA01
ggccagcgccagg

SEQ ID NO: 3476725 - RNA, 16 nt, Pseudomonas aeruginosa PA01
ggccagcgccaggagc

SEQ ID NO: 3476726 - RNA, 17 nt, Pseudomonas aeruginosa PA01
ggccagcgccaggagca

SEQ ID NO: 3476727 - RNA, 22 nt, Pseudomonas aeruginosa PA01
ggccagcgccaggagcagggcg

SEQ ID NO: 3476728 - RNA, 23 nt, Pseudomonas aeruginosa PA01
ggccagcgccagguuggccuggc

SEQ ID NO: 3476729 - RNA, 15 nt, Pseudomonas aeruginosa PA01
ggccagcgcccaggc

SEQ ID NO: 3476730 - RNA, 17 nt, Pseudomonas aeruginosa PA01
ggccagcgcccaggccg

SEQ ID NO: 3476731 - RNA, 18 nt, Pseudomonas aeruginosa PA01
ggccagcgcccaggccgg

SEQ ID NO: 3476732 - RNA, 14 nt, Pseudomonas aeruginosa PA01
ggccagcgccgccg

SEQ ID NO: 3476733 - RNA, 18 nt, Pseudomonas aeruginosa PA01
ggccagcgccuggcgcaa

SEQ ID NO: 3476734 - RNA, 13 nt, Pseudomonas aeruginosa PA01
ggccagcgcggcc

SEQ ID NO: 3476735 - RNA, 15 nt, Pseudomonas aeruginosa PA01
ggccagcgcggccgc

SEQ ID NO: 3476736 - RNA, 16 nt, Pseudomonas aeruginosa PA01
ggccagcgcggccgcc

SEQ ID NO: 3476737 - RNA, 17 nt, Pseudomonas aeruginosa PA01
ggccagcgcggccgccg

SEQ ID NO: 3476738 - RNA, 18 nt, Pseudomonas aeruginosa PA01
ggccagcgcggccgccgc

SEQ ID NO: 3476739 - RNA, 19 nt, Pseudomonas aeruginosa PA01
ggccagcgcggccgccgcc

SEQ ID NO: 3476740 - RNA, 16 nt, Pseudomonas aeruginosa PA01
ggccagcgcggcgcgc

SEQ ID NO: 3476741 - RNA, 18 nt, Pseudomonas aeruginosa PA01
ggccagcgcggcgcgcug

SEQ ID NO: 3476742 - RNA, 16 nt, Pseudomonas aeruginosa PA01
ggccagcgcggcggac

SEQ ID NO: 3476743 - RNA, 22 nt, Pseudomonas aeruginosa PA01
ggccagcgcggugcgcgccauc

SEQ ID NO: 3476744 - RNA, 12 nt, Pseudomonas aeruginosa PA01
ggccagcgcgua

SEQ ID NO: 3476745 - RNA, 16 nt, Pseudomonas aeruginosa PA01
ggccagcgcuucgcga

SEQ ID NO: 3476746 - RNA, 22 nt, Pseudomonas aeruginosa PA01
ggccagcgcuucgcgaucggcg

SEQ ID NO: 3476747 - RNA, 18 nt, Pseudomonas aeruginosa PA01
ggccagcggcauccgccg

SEQ ID NO: 3476748 - RNA, 18 nt, Pseudomonas aeruginosa PA01
ggccagcguccuucggcg

SEQ ID NO: 3476749 - RNA, 20 nt, Pseudomonas aeruginosa PA01
ggccagcguccuucggcgcu

SEQ ID NO: 3476750 - RNA, 21 nt, Pseudomonas aeruginosa PA01
ggccagcgucgccugccaggc

SEQ ID NO: 3476751 - RNA, 22 nt, Pseudomonas aeruginosa PA01
ggccagcgucgccugccaggcg

SEQ ID NO: 3476752 - RNA, 20 nt, Pseudomonas aeruginosa PA01
ggccagcgugaagaccuggu

SEQ ID NO: 3476753 - RNA, 24 nt, Pseudomonas aeruginosa PA01
ggccagcgugaagaccugguccaa

SEQ ID NO: 3476754 - RNA, 14 nt, Pseudomonas aeruginosa PA01
ggccagcuccagca

SEQ ID NO: 3476755 - RNA, 19 nt, Pseudomonas aeruginosa PA01
ggccagcuccagcaccggc

SEQ ID NO: 3476756 - RNA, 21 nt, Pseudomonas aeruginosa PA01
ggccagcuccagcaccggcgg

SEQ ID NO: 3476757 - RNA, 13 nt, Pseudomonas aeruginosa PA01
ggccagcuccgcc

SEQ ID NO: 3476758 - RNA, 16 nt, Pseudomonas aeruginosa PA01
ggccagcucgaccuug

SEQ ID NO: 3476759 - RNA, 13 nt, Pseudomonas aeruginosa PA01
ggccagcucgccc

SEQ ID NO: 3476760 - RNA, 20 nt, Pseudomonas aeruginosa PA01
ggccagcucgccgaacagga

SEQ ID NO: 3476761 - RNA, 16 nt, Pseudomonas aeruginosa PA01
ggccagcucgccgguc

SEQ ID NO: 3476762 - RNA, 23 nt, Pseudomonas aeruginosa PA01
ggccagcucgccggucaacagcg

SEQ ID NO: 3476763 - RNA, 14 nt, Pseudomonas aeruginosa PA01
ggccagcucgucgc

SEQ ID NO: 3476764 - RNA, 17 nt, Pseudomonas aeruginosa PA01
ggccagcuggcgacggc

SEQ ID NO: 3476765 - RNA, 19 nt, Pseudomonas aeruginosa PA01
ggccagcuuccaggcgcgc

SEQ ID NO: 3476766 - RNA, 22 nt, Pseudomonas aeruginosa PA01
ggccagcuuccaggcgcgcugg

SEQ ID NO: 3476767 - RNA, 23 nt, Pseudomonas aeruginosa PA01
ggccagcuuccaggcgcgcugga

SEQ ID NO: 3476768 - RNA, 19 nt, Pseudomonas aeruginosa PA01
ggccagcuucuccagcagg

SEQ ID NO: 3476769 - RNA, 22 nt, Pseudomonas aeruginosa PA01
ggccagcuuggucgggauggcg

SEQ ID NO: 3476770 - RNA, 13 nt, Pseudomonas aeruginosa PA01
ggccagcuugucg

SEQ ID NO: 3476771 - RNA, 14 nt, Pseudomonas aeruginosa PA01
ggccagcuugucgg

SEQ ID NO: 3476772 - RNA, 20 nt, Pseudomonas aeruginosa PA01
ggccaggaaaucgagcgcca

SEQ ID NO: 3476773 - RNA, 13 nt, Pseudomonas aeruginosa PA01
ggccaggaagcgg

SEQ ID NO: 3476774 - RNA, 15 nt, Pseudomonas aeruginosa PA01
ggccaggaaggccgc

SEQ ID NO: 3476775 - RNA, 22 nt, Pseudomonas aeruginosa PA01
ggccaggaaggccgcuucgccg

SEQ ID NO: 3476776 - RNA, 14 nt, Pseudomonas aeruginosa PA01
ggccaggaccaggg

SEQ ID NO: 3476777 - RNA, 19 nt, Pseudomonas aeruginosa PA01
ggccaggaccagggcgggc

SEQ ID NO: 3476778 - RNA, 14 nt, Pseudomonas aeruginosa PA01
ggccaggaccaucg

SEQ ID NO: 3476779 - RNA, 19 nt, Pseudomonas aeruginosa PA01
ggccaggaccaucggcacc

SEQ ID NO: 3476780 - RNA, 15 nt, Pseudomonas aeruginosa PA01
ggccaggacgccacc

SEQ ID NO: 3476781 - RNA, 21 nt, Pseudomonas aeruginosa PA01
ggccaggagcaucggcgcggc

SEQ ID NO: 3476782 - RNA, 20 nt, Pseudomonas aeruginosa PA01
ggccaggaucgucggcccgc

SEQ ID NO: 3476783 - RNA, 19 nt, Pseudomonas aeruginosa PA01
ggccaggaugaccaggcug

SEQ ID NO: 3476784 - RNA, 21 nt, Pseudomonas aeruginosa PA01
ggccaggaugaccaggcugau

SEQ ID NO: 3476785 - RNA, 18 nt, Pseudomonas aeruginosa PA01
ggccaggauguucgccga

SEQ ID NO: 3476786 - RNA, 18 nt, Pseudomonas aeruginosa PA01
ggccaggcaaucgaucgc

SEQ ID NO: 3476787 - RNA, 15 nt, Pseudomonas aeruginosa PA01
ggccaggcaaugucg

SEQ ID NO: 3476788 - RNA, 19 nt, Pseudomonas aeruginosa PA01
ggccaggcagaccagcgca

SEQ ID NO: 3476789 - RNA, 16 nt, Pseudomonas aeruginosa PA01
ggccaggcauccagca

SEQ ID NO: 3476790 - RNA, 17 nt, Pseudomonas aeruginosa PA01
ggccaggcauccagcac

SEQ ID NO: 3476791 - RNA, 18 nt, Pseudomonas aeruginosa PA01
ggccaggcauccagcacc

SEQ ID NO: 3476792 - RNA, 19 nt, Pseudomonas aeruginosa PA01
ggccaggcauccagcaccg

SEQ ID NO: 3476793 - RNA, 20 nt, Pseudomonas aeruginosa PA01
ggccaggcauccagcaccgc

SEQ ID NO: 3476794 - RNA, 14 nt, Pseudomonas aeruginosa PA01
ggccaggcauuccu

SEQ ID NO: 3476795 - RNA, 22 nt, Pseudomonas aeruginosa PA01
ggccaggcauuccuccaggguc

SEQ ID NO: 3476796 - RNA, 16 nt, Pseudomonas aeruginosa PA01
ggccaggccacggccg

SEQ ID NO: 3476797 - RNA, 19 nt, Pseudomonas aeruginosa PA01
ggccaggccacggccggcg

SEQ ID NO: 3476798 - RNA, 20 nt, Pseudomonas aeruginosa PA01
ggccaggccccagggccggc

SEQ ID NO: 3476799 - RNA, 12 nt, Pseudomonas aeruginosa PA01
ggccaggcccuu

SEQ ID NO: 3476800 - RNA, 23 nt, Pseudomonas aeruginosa PA01
ggccaggcccuuggucaggccga

SEQ ID NO: 3476801 - RNA, 17 nt, Pseudomonas aeruginosa PA01
ggccaggccgagcgcgc

SEQ ID NO: 3476802 - RNA, 19 nt, Pseudomonas aeruginosa PA01
ggccaggccgagcgcgccg

SEQ ID NO: 3476803 - RNA, 12 nt, Pseudomonas aeruginosa PA01
ggccaggccgcc

SEQ ID NO: 3476804 - RNA, 15 nt, Pseudomonas aeruginosa PA01
ggccaggccgcccag

SEQ ID NO: 3476805 - RNA, 17 nt, Pseudomonas aeruginosa PA01
ggccaggccgcccagga

SEQ ID NO: 3476806 - RNA, 13 nt, Pseudomonas aeruginosa PA01
ggccaggccggcg

SEQ ID NO: 3476807 - RNA, 14 nt, Pseudomonas aeruginosa PA01
ggccaggccggcgc

SEQ ID NO: 3476808 - RNA, 15 nt, Pseudomonas aeruginosa PA01
ggccaggccggcgcc

SEQ ID NO: 3476809 - RNA, 21 nt, Pseudomonas aeruginosa PA01
ggccaggcgcaccagcaggcg

SEQ ID NO: 3476810 - RNA, 17 nt, Pseudomonas aeruginosa PA01
ggccaggcgcagugccu

SEQ ID NO: 3476811 - RNA, 14 nt, Pseudomonas aeruginosa PA01
ggccaggcgccagg

SEQ ID NO: 3476812 - RNA, 16 nt, Pseudomonas aeruginosa PA01
ggccaggcgccagggc

SEQ ID NO: 3476813 - RNA, 11 nt, Pseudomonas aeruginosa PA01
ggccaggcgcg

SEQ ID NO: 3476814 - RNA, 12 nt, Pseudomonas aeruginosa PA01
ggccaggcgcga

SEQ ID NO: 3476815 - RNA, 15 nt, Pseudomonas aeruginosa PA01
ggccaggcgcgacag

SEQ ID NO: 3476816 - RNA, 14 nt, Pseudomonas aeruginosa PA01
ggccaggcgcggcg

SEQ ID NO: 3476817 - RNA, 14 nt, Pseudomonas aeruginosa PA01
ggccaggcgcuccu

SEQ ID NO: 3476818 - RNA, 20 nt, Pseudomonas aeruginosa PA01
ggccaggcgcuccuccagcg

SEQ ID NO: 3476819 - RNA, 15 nt, Pseudomonas aeruginosa PA01
ggccaggcggccgac

SEQ ID NO: 3476820 - RNA, 13 nt, Pseudomonas aeruginosa PA01
ggccaggcgguau

SEQ ID NO: 3476821 - RNA, 17 nt, Pseudomonas aeruginosa PA01
ggccaggcucgcgaugc

SEQ ID NO: 3476822 - RNA, 22 nt, Pseudomonas aeruginosa PA01
ggccagggaaaagcccaggugg

SEQ ID NO: 3476823 - RNA, 16 nt, Pseudomonas aeruginosa PA01
ggccagggagucgcug

SEQ ID NO: 3476824 - RNA, 23 nt, Pseudomonas aeruginosa PA01
ggccagggagucgcuggccaucu

SEQ ID NO: 3476825 - RNA, 21 nt, Pseudomonas aeruginosa PA01
ggccagggauuccuuggucag

SEQ ID NO: 3476826 - RNA, 22 nt, Pseudomonas aeruginosa PA01
ggccagggccgcucgagggcga

SEQ ID NO: 3476827 - RNA, 19 nt, Pseudomonas aeruginosa PA01
ggccagggcgaacagcgcc

SEQ ID NO: 3476828 - RNA, 13 nt, Pseudomonas aeruginosa PA01
ggccagggcgagg

SEQ ID NO: 3476829 - RNA, 17 nt, Pseudomonas aeruginosa PA01
ggccagggcgaggauca

SEQ ID NO: 3476830 - RNA, 13 nt, Pseudomonas aeruginosa PA01
ggccagggcggcg

SEQ ID NO: 3476831 - RNA, 17 nt, Pseudomonas aeruginosa PA01
ggccagggcggcgccga

SEQ ID NO: 3476832 - RNA, 15 nt, Pseudomonas aeruginosa PA01
ggccaggggagcgcc

SEQ ID NO: 3476833 - RNA, 17 nt, Pseudomonas aeruginosa PA01
ggccaggggagcgccgg

SEQ ID NO: 3476834 - RNA, 19 nt, Pseudomonas aeruginosa PA01
ggccaggggagcgccggcg

SEQ ID NO: 3476835 - RNA, 20 nt, Pseudomonas aeruginosa PA01
ggccaggggcugaacagcgc

SEQ ID NO: 3476836 - RNA, 22 nt, Pseudomonas aeruginosa PA01
ggccaggggcugaacagcgcca

SEQ ID NO: 3476837 - RNA, 20 nt, Pseudomonas aeruginosa PA01
ggccagggggccuggcucga

SEQ ID NO: 3476838 - RNA, 22 nt, Pseudomonas aeruginosa PA01
ggccagggggccuggcucgauc

SEQ ID NO: 3476839 - RNA, 18 nt, Pseudomonas aeruginosa PA01
ggccagggucacgccaga

SEQ ID NO: 3476840 - RNA, 22 nt, Pseudomonas aeruginosa PA01
ggccaggguccgcuucagcgcg

SEQ ID NO: 3476841 - RNA, 23 nt, Pseudomonas aeruginosa PA01
ggccaggguccgcuucagcgcgc

SEQ ID NO: 3476842 - RNA, 16 nt, Pseudomonas aeruginosa PA01
ggccagggucgccagc

SEQ ID NO: 3476843 - RNA, 17 nt, Pseudomonas aeruginosa PA01
ggccagggucgccagca

SEQ ID NO: 3476844 - RNA, 15 nt, Pseudomonas aeruginosa PA01
ggccagguaccggcc

SEQ ID NO: 3476845 - RNA, 17 nt, Pseudomonas aeruginosa PA01
ggccagguaccggccag

SEQ ID NO: 3476846 - RNA, 19 nt, Pseudomonas aeruginosa PA01
ggccagguacuuggccacg

SEQ ID NO: 3476847 - RNA, 22 nt, Pseudomonas aeruginosa PA01
ggccagguacuuggccacgccu

SEQ ID NO: 3476848 - RNA, 15 nt, Pseudomonas aeruginosa PA01
ggccagguagcggac

SEQ ID NO: 3476849 - RNA, 21 nt, Pseudomonas aeruginosa PA01
ggccagguagcggaccccggc

SEQ ID NO: 3476850 - RNA, 16 nt, Pseudomonas aeruginosa PA01
ggccagguagcggcgu

SEQ ID NO: 3476851 - RNA, 22 nt, Pseudomonas aeruginosa PA01
ggccagguagcggcguucgccg

SEQ ID NO: 3476852 - RNA, 23 nt, Pseudomonas aeruginosa PA01
ggccagguagcggcguucgccga

SEQ ID NO: 3476853 - RNA, 14 nt, Pseudomonas aeruginosa PA01
ggccagguaggcga

SEQ ID NO: 3476854 - RNA, 15 nt, Pseudomonas aeruginosa PA01
ggccagguaggcgac

SEQ ID NO: 3476855 - RNA, 21 nt, Pseudomonas aeruginosa PA01
ggccagguauucgcgcucggc

SEQ ID NO: 3476856 - RNA, 22 nt, Pseudomonas aeruginosa PA01
ggccagguauucgcgcucggcg

SEQ ID NO: 3476857 - RNA, 14 nt, Pseudomonas aeruginosa PA01
ggccagguccgaac

SEQ ID NO: 3476858 - RNA, 23 nt, Pseudomonas aeruginosa PA01
ggccaggucgagguucuccaggc

SEQ ID NO: 3476859 - RNA, 13 nt, Pseudomonas aeruginosa PA01
ggccaggucgcga

SEQ ID NO: 3476860 - RNA, 20 nt, Pseudomonas aeruginosa PA01
ggccaggucgcgacugacca

SEQ ID NO: 3476861 - RNA, 15 nt, Pseudomonas aeruginosa PA01
ggccaggucgcgcag

SEQ ID NO: 3476862 - RNA, 18 nt, Pseudomonas aeruginosa PA01
ggccaggucgcgcagggc

SEQ ID NO: 3476863 - RNA, 21 nt, Pseudomonas aeruginosa PA01
ggccaggucgcgcagggccag

SEQ ID NO: 3476864 - RNA, 22 nt, Pseudomonas aeruginosa PA01
ggccaggucgguccgccgaugc

SEQ ID NO: 3476865 - RNA, 21 nt, Pseudomonas aeruginosa PA01
ggccaggucguugcgccggcc

SEQ ID NO: 3476866 - RNA, 16 nt, Pseudomonas aeruginosa PA01
ggccagguugaccagu

SEQ ID NO: 3476867 - RNA, 11 nt, Pseudomonas aeruginosa PA01
ggccaguucga

SEQ ID NO: 3476868 - RNA, 17 nt, Pseudomonas aeruginosa PA01
ggccaguucgcggcgca

SEQ ID NO: 3476869 - RNA, 15 nt, Pseudomonas aeruginosa PA01
ggccaguucgcugac

SEQ ID NO: 3476870 - RNA, 16 nt, Pseudomonas aeruginosa PA01
ggccaguucggggucg

SEQ ID NO: 3476871 - RNA, 21 nt, Pseudomonas aeruginosa PA01
ggccaguucggggucggccug

SEQ ID NO: 3476872 - RNA, 16 nt, Pseudomonas aeruginosa PA01
ggccaguucgucgagc

SEQ ID NO: 3476873 - RNA, 22 nt, Pseudomonas aeruginosa PA01
ggccaguucgucgagcaugccg

SEQ ID NO: 3476874 - RNA, 16 nt, Pseudomonas aeruginosa PA01
ggccaguuggugcacg

SEQ ID NO: 3476875 - RNA, 23 nt, Pseudomonas aeruginosa PA01
ggccaguuggugcacgcgccggg

SEQ ID NO: 3476876 - RNA, 19 nt, Pseudomonas aeruginosa PA01
ggccaguuguuccggcugg

SEQ ID NO: 3476877 - RNA, 18 nt, Pseudomonas aeruginosa PA01
ggccauaccuccagccag

SEQ ID NO: 3476878 - RNA, 20 nt, Pseudomonas aeruginosa PA01
ggccauaccuccagccagca

SEQ ID NO: 3476879 - RNA, 12 nt, Pseudomonas aeruginosa PA01
ggccaucagcac

SEQ ID NO: 3476880 - RNA, 16 nt, Pseudomonas aeruginosa PA01
ggccaucagcaccagg

SEQ ID NO: 3476881 - RNA, 17 nt, Pseudomonas aeruginosa PA01
ggccaucagcaccagga

SEQ ID NO: 3476882 - RNA, 15 nt, Pseudomonas aeruginosa PA01
ggccaucagcacguc

SEQ ID NO: 3476883 - RNA, 13 nt, Pseudomonas aeruginosa PA01
ggccaucagcgcc

SEQ ID NO: 3476884 - RNA, 18 nt, Pseudomonas aeruginosa PA01
ggccaucagcgccagggc

SEQ ID NO: 3476885 - RNA, 14 nt, Pseudomonas aeruginosa PA01
ggccaucagcgccg

SEQ ID NO: 3476886 - RNA, 19 nt, Pseudomonas aeruginosa PA01
ggccaucagcgccgccucg

SEQ ID NO: 3476887 - RNA, 15 nt, Pseudomonas aeruginosa PA01
ggccaucaggcgcug

SEQ ID NO: 3476888 - RNA, 14 nt, Pseudomonas aeruginosa PA01
ggccaucagggcga

SEQ ID NO: 3476889 - RNA, 23 nt, Pseudomonas aeruginosa PA01
ggccaucagggcgaaagccuuca

SEQ ID NO: 3476890 - RNA, 18 nt, Pseudomonas aeruginosa PA01
ggccaucagggucggccc

SEQ ID NO: 3476891 - RNA, 13 nt, Pseudomonas aeruginosa PA01
ggccaucaggucc

SEQ ID NO: 3476892 - RNA, 15 nt, Pseudomonas aeruginosa PA01
ggccaucagguccac

SEQ ID NO: 3476893 - RNA, 19 nt, Pseudomonas aeruginosa PA01
ggccauccagccaggcgcu

SEQ ID NO: 3476894 - RNA, 20 nt, Pseudomonas aeruginosa PA01
ggccauccauaucggccacc

SEQ ID NO: 3476895 - RNA, 16 nt, Pseudomonas aeruginosa PA01
ggccauccccgaggcg

SEQ ID NO: 3476896 - RNA, 17 nt, Pseudomonas aeruginosa PA01
ggccauccccgaggcga

SEQ ID NO: 3476897 - RNA, 18 nt, Pseudomonas aeruginosa PA01
ggccauccccgaggcgac

SEQ ID NO: 3476898 - RNA, 22 nt, Pseudomonas aeruginosa PA01
ggccauccccgaggcgacgccc

SEQ ID NO: 3476899 - RNA, 15 nt, Pseudomonas aeruginosa PA01
ggccauccuggccgg

SEQ ID NO: 3476900 - RNA, 23 nt, Pseudomonas aeruginosa PA01
ggccaucgaaaucgcccaccagg

SEQ ID NO: 3476901 - RNA, 14 nt, Pseudomonas aeruginosa PA01
ggccaucgccggcc

SEQ ID NO: 3476902 - RNA, 22 nt, Pseudomonas aeruginosa PA01
ggccaucgccggcccgcgcggc

SEQ ID NO: 3476903 - RNA, 17 nt, Pseudomonas aeruginosa PA01
ggccaucggcgaagcgg

SEQ ID NO: 3476904 - RNA, 16 nt, Pseudomonas aeruginosa PA01
ggccaucuggcugccg

SEQ ID NO: 3476905 - RNA, 20 nt, Pseudomonas aeruginosa PA01
ggccaucuggcugccgaggg

SEQ ID NO: 3476906 - RNA, 18 nt, Pseudomonas aeruginosa PA01
ggccaucuucucgaagcg

SEQ ID NO: 3476907 - RNA, 19 nt, Pseudomonas aeruginosa PA01
ggccaucuucucgaagcgc

SEQ ID NO: 3476908 - RNA, 20 nt, Pseudomonas aeruginosa PA01
ggccaugaccucggccagcc

SEQ ID NO: 3476909 - RNA, 18 nt, Pseudomonas aeruginosa PA01
ggccaugagcagggcgga

SEQ ID NO: 3476910 - RNA, 19 nt, Pseudomonas aeruginosa PA01
ggccaugagguuggccacg

SEQ ID NO: 3476911 - RNA, 23 nt, Pseudomonas aeruginosa PA01
ggccaugagguuggccacguagg

SEQ ID NO: 3476912 - RNA, 17 nt, Pseudomonas aeruginosa PA01
ggccaugaucaucgccu

SEQ ID NO: 3476913 - RNA, 21 nt, Pseudomonas aeruginosa PA01
ggccaugaucaucgccugcug

SEQ ID NO: 3476914 - RNA, 23 nt, Pseudomonas aeruginosa PA01
ggccaugauccggugcaggccga

SEQ ID NO: 3476915 - RNA, 13 nt, Pseudomonas aeruginosa PA01
ggccaugccgccg

SEQ ID NO: 3476916 - RNA, 15 nt, Pseudomonas aeruginosa PA01
ggccaugccgccgac

SEQ ID NO: 3476917 - RNA, 19 nt, Pseudomonas aeruginosa PA01
ggccaugccgccgacgccg

SEQ ID NO: 3476918 - RNA, 22 nt, Pseudomonas aeruginosa PA01
ggccaugccggccaggaaggcc

SEQ ID NO: 3476919 - RNA, 13 nt, Pseudomonas aeruginosa PA01
ggccaugcgcucg

SEQ ID NO: 3476920 - RNA, 14 nt, Pseudomonas aeruginosa PA01
ggccaugcgcucgg

SEQ ID NO: 3476921 - RNA, 19 nt, Pseudomonas aeruginosa PA01
ggccaugcgcucggggucg

SEQ ID NO: 3476922 - RNA, 19 nt, Pseudomonas aeruginosa PA01
ggccaugcuggcgcucucg

SEQ ID NO: 3476923 - RNA, 15 nt, Pseudomonas aeruginosa PA01
ggccauggcagagcu

SEQ ID NO: 3476924 - RNA, 16 nt, Pseudomonas aeruginosa PA01
ggccauggcagagcug

SEQ ID NO: 3476925 - RNA, 23 nt, Pseudomonas aeruginosa PA01
ggccauggcagagcuggaagucg

SEQ ID NO: 3476926 - RNA, 15 nt, Pseudomonas aeruginosa PA01
ggccauggccgagcc

SEQ ID NO: 3476927 - RNA, 18 nt, Pseudomonas aeruginosa PA01
ggccauggcgcuugcgca

SEQ ID NO: 3476928 - RNA, 15 nt, Pseudomonas aeruginosa PA01
ggccaugggcacgcc

SEQ ID NO: 3476929 - RNA, 16 nt, Pseudomonas aeruginosa PA01
ggccaugggcacgccg

SEQ ID NO: 3476930 - RNA, 17 nt, Pseudomonas aeruginosa PA01
ggccaugggcacgccgg

SEQ ID NO: 3476931 - RNA, 23 nt, Pseudomonas aeruginosa PA01
ggccauggguaucguugaucggc

SEQ ID NO: 3476932 - RNA, 14 nt, Pseudomonas aeruginosa PA01
ggccaugggugucg

SEQ ID NO: 3476933 - RNA, 18 nt, Pseudomonas aeruginosa PA01
ggccaugggugucggcga

SEQ ID NO: 3476934 - RNA, 20 nt, Pseudomonas aeruginosa PA01
ggccaugggugucggcgauc

SEQ ID NO: 3476935 - RNA, 22 nt, Pseudomonas aeruginosa PA01
ggccauguacguaucccagcgc

SEQ ID NO: 3476936 - RNA, 13 nt, Pseudomonas aeruginosa PA01
ggccaugucccgg

SEQ ID NO: 3476937 - RNA, 16 nt, Pseudomonas aeruginosa PA01
ggccaugucccgggug

SEQ ID NO: 3476938 - RNA, 17 nt, Pseudomonas aeruginosa PA01
ggccauuacgccgagca

SEQ ID NO: 3476939 - RNA, 16 nt, Pseudomonas aeruginosa PA01
ggccauuccuuccagg

SEQ ID NO: 3476940 - RNA, 17 nt, Pseudomonas aeruginosa PA01
ggccauuccuuccaggg

SEQ ID NO: 3476941 - RNA, 21 nt, Pseudomonas aeruginosa PA01
ggccauucgcuucggccacca

SEQ ID NO: 3476942 - RNA, 14 nt, Pseudomonas aeruginosa PA01
ggccauucggccug

SEQ ID NO: 3476943 - RNA, 15 nt, Pseudomonas aeruginosa PA01
ggccauucggccugg

SEQ ID NO: 3476944 - RNA, 17 nt, Pseudomonas aeruginosa PA01
ggccauugaaggccgac

SEQ ID NO: 3476945 - RNA, 18 nt, Pseudomonas aeruginosa PA01
ggccauugcccgguggcc

SEQ ID NO: 3476946 - RNA, 22 nt, Pseudomonas aeruginosa PA01
ggccauugcccgguggccuccu

SEQ ID NO: 3476947 - RNA, 15 nt, Pseudomonas aeruginosa PA01
ggccauugccgccag

SEQ ID NO: 3476948 - RNA, 15 nt, Pseudomonas aeruginosa PA01
ggcccaagccgagcg

SEQ ID NO: 3476949 - RNA, 17 nt, Pseudomonas aeruginosa PA01
ggcccaagccgagcggc

SEQ ID NO: 3476950 - RNA, 19 nt, Pseudomonas aeruginosa PA01
ggcccaagccgagcggcaa

SEQ ID NO: 3476951 - RNA, 16 nt, Pseudomonas aeruginosa PA01
ggcccaauccgcgccg

SEQ ID NO: 3476952 - RNA, 21 nt, Pseudomonas aeruginosa PA01
ggcccaccagaggcugaccuu

SEQ ID NO: 3476953 - RNA, 18 nt, Pseudomonas aeruginosa PA01
ggcccacgcccaucggcg

SEQ ID NO: 3476954 - RNA, 14 nt, Pseudomonas aeruginosa PA01
ggcccacggcgccu

SEQ ID NO: 3476955 - RNA, 14 nt, Pseudomonas aeruginosa PA01
ggcccacgggcggc

SEQ ID NO: 3476956 - RNA, 15 nt, Pseudomonas aeruginosa PA01
ggcccagaccuugga

SEQ ID NO: 3476957 - RNA, 20 nt, Pseudomonas aeruginosa PA01
ggcccagagcagcaccagca

SEQ ID NO: 3476958 - RNA, 18 nt, Pseudomonas aeruginosa PA01
ggcccagauauccagggc

SEQ ID NO: 3476959 - RNA, 19 nt, Pseudomonas aeruginosa PA01
ggcccagauauccagggcc

SEQ ID NO: 3476960 - RNA, 12 nt, Pseudomonas aeruginosa PA01
ggcccagaugau

SEQ ID NO: 3476961 - RNA, 22 nt, Pseudomonas aeruginosa PA01
ggcccagaugaucaggccgagc

SEQ ID NO: 3476962 - RNA, 23 nt, Pseudomonas aeruginosa PA01
ggcccagaugaucaggccgagca

SEQ ID NO: 3476963 - RNA, 13 nt, Pseudomonas aeruginosa PA01
ggcccagcagcgc

SEQ ID NO: 3476964 - RNA, 14 nt, Pseudomonas aeruginosa PA01
ggcccagcagcgcu

SEQ ID NO: 3476965 - RNA, 15 nt, Pseudomonas aeruginosa PA01
ggcccagcaggccgg

SEQ ID NO: 3476966 - RNA, 18 nt, Pseudomonas aeruginosa PA01
ggcccagccauugcgcca

SEQ ID NO: 3476967 - RNA, 20 nt, Pseudomonas aeruginosa PA01
ggcccagccauugcgccagg

SEQ ID NO: 3476968 - RNA, 15 nt, Pseudomonas aeruginosa PA01
ggcccagccgcggcg

SEQ ID NO: 3476969 - RNA, 17 nt, Pseudomonas aeruginosa PA01
ggcccagccgcggcgcc

SEQ ID NO: 3476970 - RNA, 18 nt, Pseudomonas aeruginosa PA01
ggcccagccgcggcgcca

SEQ ID NO: 3476971 - RNA, 16 nt, Pseudomonas aeruginosa PA01
ggcccagcgacuccgc

SEQ ID NO: 3476972 - RNA, 19 nt, Pseudomonas aeruginosa PA01
ggcccagcgacuccgccag

SEQ ID NO: 3476973 - RNA, 19 nt, Pseudomonas aeruginosa PA01
ggcccagcgccccgccuac

SEQ ID NO: 3476974 - RNA, 20 nt, Pseudomonas aeruginosa PA01
ggcccagcgcggcgccccag

SEQ ID NO: 3476975 - RNA, 20 nt, Pseudomonas aeruginosa PA01
ggcccagcguucggcgcugg

SEQ ID NO: 3476976 - RNA, 13 nt, Pseudomonas aeruginosa PA01
ggcccagcuucuu

SEQ ID NO: 3476977 - RNA, 22 nt, Pseudomonas aeruginosa PA01
ggcccagcuucuuggcccggug

SEQ ID NO: 3476978 - RNA, 12 nt, Pseudomonas aeruginosa PA01
ggcccaggccgg

SEQ ID NO: 3476979 - RNA, 13 nt, Pseudomonas aeruginosa PA01
ggcccaggccggg

SEQ ID NO: 3476980 - RNA, 23 nt, Pseudomonas aeruginosa PA01
ggcccaguucgcguagccccucg

SEQ ID NO: 3476981 - RNA, 17 nt, Pseudomonas aeruginosa PA01
ggcccaguucgcugccg

SEQ ID NO: 3476982 - RNA, 16 nt, Pseudomonas aeruginosa PA01
ggcccaguugcccggc

SEQ ID NO: 3476983 - RNA, 23 nt, Pseudomonas aeruginosa PA01
ggcccaucauguagacgaugccg

SEQ ID NO: 3476984 - RNA, 15 nt, Pseudomonas aeruginosa PA01
ggcccauccgccgca

SEQ ID NO: 3476985 - RNA, 16 nt, Pseudomonas aeruginosa PA01
ggcccauccuggcgau

SEQ ID NO: 3476986 - RNA, 24 nt, Pseudomonas aeruginosa PA01
ggcccauccuggcgaucaggccaa

SEQ ID NO: 3476987 - RNA, 20 nt, Pseudomonas aeruginosa PA01
ggcccaugauggucggcacg

SEQ ID NO: 3476988 - RNA, 20 nt, Pseudomonas aeruginosa PA01
ggcccaugccuccgacgauc

SEQ ID NO: 3476989 - RNA, 21 nt, Pseudomonas aeruginosa PA01
ggcccauucguagaggcuguc

SEQ ID NO: 3476990 - RNA, 21 nt, Pseudomonas aeruginosa PA01
ggcccauuucguagcccaggc

SEQ ID NO: 3476991 - RNA, 22 nt, Pseudomonas aeruginosa PA01
ggcccauuucguagcccaggcg

SEQ ID NO: 3476992 - RNA, 14 nt, Pseudomonas aeruginosa PA01
ggccccaggccgcc

SEQ ID NO: 3476993 - RNA, 20 nt, Pseudomonas aeruginosa PA01
ggccccaggccgccgccugc

SEQ ID NO: 3476994 - RNA, 13 nt, Pseudomonas aeruginosa PA01
ggccccaggcgau

SEQ ID NO: 3476995 - RNA, 14 nt, Pseudomonas aeruginosa PA01
ggccccaggcugcc

SEQ ID NO: 3476996 - RNA, 13 nt, Pseudomonas aeruginosa PA01
ggccccagggccg

SEQ ID NO: 3476997 - RNA, 17 nt, Pseudomonas aeruginosa PA01
ggccccagggccggcgc

SEQ ID NO: 3476998 - RNA, 23 nt, Pseudomonas aeruginosa PA01
ggccccagggccggcgcccuucg

SEQ ID NO: 3476999 - RNA, 19 nt, Pseudomonas aeruginosa PA01
ggccccgccgaggaagccg

SEQ ID NO: 3477000 - RNA, 20 nt, Pseudomonas aeruginosa PA01
ggccccgcgguacccggcag

SEQ ID NO: 3477001 - RNA, 19 nt, Pseudomonas aeruginosa PA01
ggccccggcaagggccugc

SEQ ID NO: 3477002 - RNA, 21 nt, Pseudomonas aeruginosa PA01
ggccccggcaagggccugcuc

SEQ ID NO: 3477003 - RNA, 23 nt, Pseudomonas aeruginosa PA01
ggccccggcaagggccugcucag

SEQ ID NO: 3477004 - RNA, 14 nt, Pseudomonas aeruginosa PA01
ggccccggccaggu

SEQ ID NO: 3477005 - RNA, 16 nt, Pseudomonas aeruginosa PA01
ggccccggccagguac

SEQ ID NO: 3477006 - RNA, 14 nt, Pseudomonas aeruginosa PA01
ggccccggccggca

SEQ ID NO: 3477007 - RNA, 15 nt, Pseudomonas aeruginosa PA01
ggccccggccggcag

SEQ ID NO: 3477008 - RNA, 18 nt, Pseudomonas aeruginosa PA01
ggccccggcgauccgcgc

SEQ ID NO: 3477009 - RNA, 13 nt, Pseudomonas aeruginosa PA01
ggccccggcgccg

SEQ ID NO: 3477010 - RNA, 13 nt, Pseudomonas aeruginosa PA01
ggccccuccaccu

SEQ ID NO: 3477011 - RNA, 22 nt, Pseudomonas aeruginosa PA01
ggccccuucagcuccagcaguc

SEQ ID NO: 3477012 - RNA, 12 nt, Pseudomonas aeruginosa PA01
ggcccgaaggcc

SEQ ID NO: 3477013 - RNA, 13 nt, Pseudomonas aeruginosa PA01
ggcccgacgccgc

SEQ ID NO: 3477014 - RNA, 14 nt, Pseudomonas aeruginosa PA01
ggcccgacgccgcc

SEQ ID NO: 3477015 - RNA, 19 nt, Pseudomonas aeruginosa PA01
ggcccgacgccgcccggca

SEQ ID NO: 3477016 - RNA, 16 nt, Pseudomonas aeruginosa PA01
ggcccgagcaggcugc

SEQ ID NO: 3477017 - RNA, 16 nt, Pseudomonas aeruginosa PA01
ggcccgagccggacga

SEQ ID NO: 3477018 - RNA, 14 nt, Pseudomonas aeruginosa PA01
ggcccgagggcggc

SEQ ID NO: 3477019 - RNA, 15 nt, Pseudomonas aeruginosa PA01
ggcccgagggcggca

SEQ ID NO: 3477020 - RNA, 16 nt, Pseudomonas aeruginosa PA01
ggcccgcaaucagcgg

SEQ ID NO: 3477021 - RNA, 17 nt, Pseudomonas aeruginosa PA01
ggcccgcaaucagcggg

SEQ ID NO: 3477022 - RNA, 20 nt, Pseudomonas aeruginosa PA01
ggcccgcaugaacgccucgc

SEQ ID NO: 3477023 - RNA, 23 nt, Pseudomonas aeruginosa PA01
ggcccgcaugaacgccucgccaa

SEQ ID NO: 3477024 - RNA, 19 nt, Pseudomonas aeruginosa PA01
ggcccgccacagaucgcca

SEQ ID NO: 3477025 - RNA, 23 nt, Pseudomonas aeruginosa PA01
ggcccgccacagaucgccagcuc

SEQ ID NO: 3477026 - RNA, 12 nt, Pseudomonas aeruginosa PA01
ggcccgccgccg

SEQ ID NO: 3477027 - RNA, 17 nt, Pseudomonas aeruginosa PA01
ggcccgccgccggggcg

SEQ ID NO: 3477028 - RNA, 13 nt, Pseudomonas aeruginosa PA01
ggcccgccgcggc

SEQ ID NO: 3477029 - RNA, 14 nt, Pseudomonas aeruginosa PA01
ggcccgccgcggcg

SEQ ID NO: 3477030 - RNA, 15 nt, Pseudomonas aeruginosa PA01
ggcccgccgcggcga

SEQ ID NO: 3477031 - RNA, 16 nt, Pseudomonas aeruginosa PA01
ggcccgccggucaacc

SEQ ID NO: 3477032 - RNA, 21 nt, Pseudomonas aeruginosa PA01
ggcccgccggucaaccgcggg

SEQ ID NO: 3477033 - RNA, 16 nt, Pseudomonas aeruginosa PA01
ggcccgccucggcggc

SEQ ID NO: 3477034 - RNA, 22 nt, Pseudomonas aeruginosa PA01
ggcccgcgagccgcgcagcagu

SEQ ID NO: 3477035 - RNA, 13 nt, Pseudomonas aeruginosa PA01
ggcccgcgccgcc

SEQ ID NO: 3477036 - RNA, 14 nt, Pseudomonas aeruginosa PA01
ggcccgcgccgccg

SEQ ID NO: 3477037 - RNA, 17 nt, Pseudomonas aeruginosa PA01
ggcccgcgccgccggua

SEQ ID NO: 3477038 - RNA, 12 nt, Pseudomonas aeruginosa PA01
ggcccgcgcggc

SEQ ID NO: 3477039 - RNA, 14 nt, Pseudomonas aeruginosa PA01
ggcccgcggaucgc

SEQ ID NO: 3477040 - RNA, 21 nt, Pseudomonas aeruginosa PA01
ggcccgcggaucgcgccgucg

SEQ ID NO: 3477041 - RNA, 22 nt, Pseudomonas aeruginosa PA01
ggcccgcggaucgcgccgucgc

SEQ ID NO: 3477042 - RNA, 17 nt, Pseudomonas aeruginosa PA01
ggcccggagaccgugcc

SEQ ID NO: 3477043 - RNA, 22 nt, Pseudomonas aeruginosa PA01
ggcccggagccaacgcccgggc

SEQ ID NO: 3477044 - RNA, 19 nt, Pseudomonas aeruginosa PA01
ggcccggagcgcgaggcga

SEQ ID NO: 3477045 - RNA, 21 nt, Pseudomonas aeruginosa PA01
ggcccggagugugucggggcc

SEQ ID NO: 3477046 - RNA, 14 nt, Pseudomonas aeruginosa PA01
ggcccggcaggcag

SEQ ID NO: 3477047 - RNA, 13 nt, Pseudomonas aeruginosa PA01
ggcccggcaggcg

SEQ ID NO: 3477048 - RNA, 14 nt, Pseudomonas aeruginosa PA01
ggcccggcaggcgc

SEQ ID NO: 3477049 - RNA, 18 nt, Pseudomonas aeruginosa PA01
ggcccggcaggcgcacgc

SEQ ID NO: 3477050 - RNA, 22 nt, Pseudomonas aeruginosa PA01
ggcccggccagguaggcgacga

SEQ ID NO: 3477051 - RNA, 23 nt, Pseudomonas aeruginosa PA01
ggcccggccagguaggcgacgaa

SEQ ID NO: 3477052 - RNA, 12 nt, Pseudomonas aeruginosa PA01
ggcccggccgcc

SEQ ID NO: 3477053 - RNA, 21 nt, Pseudomonas aeruginosa PA01
ggcccggcgcggcggccgccu

SEQ ID NO: 3477054 - RNA, 22 nt, Pseudomonas aeruginosa PA01
ggcccggcgcgguuucgcagcg

SEQ ID NO: 3477055 - RNA, 16 nt, Pseudomonas aeruginosa PA01
ggcccggcgcugcccg

SEQ ID NO: 3477056 - RNA, 17 nt, Pseudomonas aeruginosa PA01
ggcccggcgcugcccgg

SEQ ID NO: 3477057 - RNA, 22 nt, Pseudomonas aeruginosa PA01
ggcccggcgcugcuucuugucg

SEQ ID NO: 3477058 - RNA, 14 nt, Pseudomonas aeruginosa PA01
ggcccggcgugagc

SEQ ID NO: 3477059 - RNA, 14 nt, Pseudomonas aeruginosa PA01
ggcccggcgugccg

SEQ ID NO: 3477060 - RNA, 18 nt, Pseudomonas aeruginosa PA01
ggcccggcuccagccggg

SEQ ID NO: 3477061 - RNA, 13 nt, Pseudomonas aeruginosa PA01
ggcccgggccugg

SEQ ID NO: 3477062 - RNA, 12 nt, Pseudomonas aeruginosa PA01
ggcccgggcgcc

SEQ ID NO: 3477063 - RNA, 13 nt, Pseudomonas aeruginosa PA01
ggcccgggcgcca

SEQ ID NO: 3477064 - RNA, 15 nt, Pseudomonas aeruginosa PA01
ggcccgggcgccacc

SEQ ID NO: 3477065 - RNA, 16 nt, Pseudomonas aeruginosa PA01
ggcccgggcgccaccg

SEQ ID NO: 3477066 - RNA, 19 nt, Pseudomonas aeruginosa PA01
ggcccgggcgccaccgcgu

SEQ ID NO: 3477067 - RNA, 17 nt, Pseudomonas aeruginosa PA01
ggcccggggcucugccg

SEQ ID NO: 3477068 - RNA, 18 nt, Pseudomonas aeruginosa PA01
ggcccggggcucugccgg

SEQ ID NO: 3477069 - RNA, 21 nt, Pseudomonas aeruginosa PA01
ggcccggggcucugccggugu

SEQ ID NO: 3477070 - RNA, 13 nt, Pseudomonas aeruginosa PA01
ggcccggucagcu

SEQ ID NO: 3477071 - RNA, 21 nt, Pseudomonas aeruginosa PA01
ggcccggucagcuucgccgcc

SEQ ID NO: 3477072 - RNA, 22 nt, Pseudomonas aeruginosa PA01
ggcccggucagcuucgccgccc

SEQ ID NO: 3477073 - RNA, 23 nt, Pseudomonas aeruginosa PA01
ggcccggucagcuucgccgcccu

SEQ ID NO: 3477074 - RNA, 22 nt, Pseudomonas aeruginosa PA01
ggcccgguggaauaccgcugcg

SEQ ID NO: 3477075 - RNA, 23 nt, Pseudomonas aeruginosa PA01
ggcccgguugagauccuggccgg

SEQ ID NO: 3477076 - RNA, 12 nt, Pseudomonas aeruginosa PA01
uagccggcgaug

SEQ ID NO: 3477077 - RNA, 23 nt, Pseudomonas aeruginosa PA01
uagccggcgaugccgcccagcac

SEQ ID NO: 3477078 - RNA, 16 nt, Pseudomonas aeruginosa PA01
uagccggcgaugugcg

SEQ ID NO: 3477079 - RNA, 17 nt, Pseudomonas aeruginosa PA01
uagccggcgccgucgac

SEQ ID NO: 3477080 - RNA, 15 nt, Pseudomonas aeruginosa PA01
uagccggcgcggcgc

SEQ ID NO: 3477081 - RNA, 16 nt, Pseudomonas aeruginosa PA01
uagccggcgcggcgca

SEQ ID NO: 3477082 - RNA, 22 nt, Pseudomonas aeruginosa PA01
uagccggcgcggcgcagcggcg

SEQ ID NO: 3477083 - RNA, 16 nt, Pseudomonas aeruginosa PA01
uagccggcuuccucgc

SEQ ID NO: 3477084 - RNA, 17 nt, Pseudomonas aeruginosa PA01
uagccggcuuccucgcc

SEQ ID NO: 3477085 - RNA, 20 nt, Pseudomonas aeruginosa PA01
uagccggcuuccucgcccuc

SEQ ID NO: 3477086 - RNA, 19 nt, Pseudomonas aeruginosa PA01
uagccguagauggucagca

SEQ ID NO: 3477087 - RNA, 21 nt, Pseudomonas aeruginosa PA01
uagccgucaagcaacggcgaa

SEQ ID NO: 3477088 - RNA, 15 nt, Pseudomonas aeruginosa PA01
uagccguccgggucg

SEQ ID NO: 3477089 - RNA, 13 nt, Pseudomonas aeruginosa PA01
uagccgugcagca

SEQ ID NO: 3477090 - RNA, 15 nt, Pseudomonas aeruginosa PA01
uagccgugcagcagc

SEQ ID NO: 3477091 - RNA, 15 nt, Pseudomonas aeruginosa PA01
uagccucccgccgcg

SEQ ID NO: 3477092 - RNA, 14 nt, Pseudomonas aeruginosa PA01
uagccuccuccggc

SEQ ID NO: 3477093 - RNA, 19 nt, Pseudomonas aeruginosa PA01
uagccugcggccagcgcca

SEQ ID NO: 3477094 - RNA, 21 nt, Pseudomonas aeruginosa PA01
uagccugcggccagcgccagg

SEQ ID NO: 3477095 - RNA, 23 nt, Pseudomonas aeruginosa PA01
uagccugcggccagcgccaggag

SEQ ID NO: 3477096 - RNA, 22 nt, Pseudomonas aeruginosa PA01
uagcgaaagaacaacuccugca

SEQ ID NO: 3477097 - RNA, 16 nt, Pseudomonas aeruginosa PA01
uagcgacggaaggugc

SEQ ID NO: 3477098 - RNA, 19 nt, Pseudomonas aeruginosa PA01
uagcgaugcgguuccuggc

SEQ ID NO: 3477099 - RNA, 15 nt, Pseudomonas aeruginosa PA01
uagcgcagcaccggc

SEQ ID NO: 3477100 - RNA, 17 nt, Pseudomonas aeruginosa PA01
uagcgcagccgcucggc

SEQ ID NO: 3477101 - RNA, 22 nt, Pseudomonas aeruginosa PA01
uagcgcagccgcucggccgcca

SEQ ID NO: 3477102 - RNA, 13 nt, Pseudomonas aeruginosa PA01
uagcgcagcggca

SEQ ID NO: 3477103 - RNA, 14 nt, Pseudomonas aeruginosa PA01
uagcgcagcggcag

SEQ ID NO: 3477104 - RNA, 15 nt, Pseudomonas aeruginosa PA01
uagcgcagcggcagg

SEQ ID NO: 3477105 - RNA, 16 nt, Pseudomonas aeruginosa PA01
uagcgcagcggcaggc

SEQ ID NO: 3477106 - RNA, 20 nt, Pseudomonas aeruginosa PA01
uagcgcagguugcgcuggcg

SEQ ID NO: 3477107 - RNA, 22 nt, Pseudomonas aeruginosa PA01
uagcgcaguccgguagcgcgcc

SEQ ID NO: 3477108 - RNA, 18 nt, Pseudomonas aeruginosa PA01
uagcgcaguucgccgccg

SEQ ID NO: 3477109 - RNA, 21 nt, Pseudomonas aeruginosa PA01
uagcgcaguucgccgccgagc

SEQ ID NO: 3477110 - RNA, 16 nt, Pseudomonas aeruginosa PA01
uagcgcaugccguugg

SEQ ID NO: 3477111 - RNA, 22 nt, Pseudomonas aeruginosa PA01
uagcgcaugccguuggccgagc

SEQ ID NO: 3477112 - RNA, 21 nt, Pseudomonas aeruginosa PA01
uagcgccccggccgcgccagc

SEQ ID NO: 3477113 - RNA, 18 nt, Pseudomonas aeruginosa PA01
uagcgccccuuggccagc

SEQ ID NO: 3477114 - RNA, 14 nt, Pseudomonas aeruginosa PA01
uagcgccgcaggcg

SEQ ID NO: 3477115 - RNA, 22 nt, Pseudomonas aeruginosa PA01
uagcgccgguaguucgcugacc

SEQ ID NO: 3477116 - RNA, 20 nt, Pseudomonas aeruginosa PA01
uagcgcgaaggcgccuucca

SEQ ID NO: 3477117 - RNA, 17 nt, Pseudomonas aeruginosa PA01
uagcgcgcggcgagccg

SEQ ID NO: 3477118 - RNA, 19 nt, Pseudomonas aeruginosa PA01
uagcgcgcuguagccggcg

SEQ ID NO: 3477119 - RNA, 13 nt, Pseudomonas aeruginosa PA01
uagcgcuccucgc

SEQ ID NO: 3477120 - RNA, 17 nt, Pseudomonas aeruginosa PA01
uagcgcuccucgcgcug

SEQ ID NO: 3477121 - RNA, 23 nt, Pseudomonas aeruginosa PA01
uagcgcucgauagcguccaggug

SEQ ID NO: 3477122 - RNA, 16 nt, Pseudomonas aeruginosa PA01
uagcgcugcgccaggc

SEQ ID NO: 3477123 - RNA, 20 nt, Pseudomonas aeruginosa PA01
uagcgcuucccgcggcucca

SEQ ID NO: 3477124 - RNA, 23 nt, Pseudomonas aeruginosa PA01
uagcggaagcacggcucggcgag

SEQ ID NO: 3477125 - RNA, 16 nt, Pseudomonas aeruginosa PA01
uagcggaucaggccca

SEQ ID NO: 3477126 - RNA, 14 nt, Pseudomonas aeruginosa PA01
uagcggcaggagca

SEQ ID NO: 3477127 - RNA, 18 nt, Pseudomonas aeruginosa PA01
uagcggcucgccgaaagg

SEQ ID NO: 3477128 - RNA, 14 nt, Pseudomonas aeruginosa PA01
uagcggcugcuguc

SEQ ID NO: 3477129 - RNA, 15 nt, Pseudomonas aeruginosa PA01
uagcgggccagcagc

SEQ ID NO: 3477130 - RNA, 16 nt, Pseudomonas aeruginosa PA01
uagcgggccagcagcu

SEQ ID NO: 3477131 - RNA, 21 nt, Pseudomonas aeruginosa PA01
uagcggguggcaacugccgcc

SEQ ID NO: 3477132 - RNA, 19 nt, Pseudomonas aeruginosa PA01
uagcggucgugcagcagcg

SEQ ID NO: 3477133 - RNA, 14 nt, Pseudomonas aeruginosa PA01
uagcguccagcucg

SEQ ID NO: 3477134 - RNA, 22 nt, Pseudomonas aeruginosa PA01
uagcguguaauugacgaugaag

SEQ ID NO: 3477135 - RNA, 16 nt, Pseudomonas aeruginosa PA01
uagcguugcaggcagu

SEQ ID NO: 3477136 - RNA, 15 nt, Pseudomonas aeruginosa PA01
uagcucagcuggaua

SEQ ID NO: 3477137 - RNA, 21 nt, Pseudomonas aeruginosa PA01
uagcucagucgguagagcagu

SEQ ID NO: 3477138 - RNA, 15 nt, Pseudomonas aeruginosa PA01
uagcucugccgaucc

SEQ ID NO: 3477139 - RNA, 12 nt, Pseudomonas aeruginosa PA01
uagcucugcugg

SEQ ID NO: 3477140 - RNA, 21 nt, Pseudomonas aeruginosa PA01
uagcugagcaggccgacggcg

SEQ ID NO: 3477141 - RNA, 14 nt, Pseudomonas aeruginosa PA01
uagcugcagcgccc

SEQ ID NO: 3477142 - RNA, 14 nt, Pseudomonas aeruginosa PA01
uagcugccggcguc

SEQ ID NO: 3477143 - RNA, 13 nt, Pseudomonas aeruginosa PA01
uagcugcgcgccu

SEQ ID NO: 3477144 - RNA, 14 nt, Pseudomonas aeruginosa PA01
uagcugcuccagcc

SEQ ID NO: 3477145 - RNA, 12 nt, Pseudomonas aeruginosa PA01
uagcuuuccagg

SEQ ID NO: 3477146 - RNA, 13 nt, Pseudomonas aeruginosa PA01
uagcuuuccaggg

SEQ ID NO: 3477147 - RNA, 16 nt, Pseudomonas aeruginosa PA01
uaggaacaguugcgga

SEQ ID NO: 3477148 - RNA, 13 nt, Pseudomonas aeruginosa PA01
uaggacaggccga

SEQ ID NO: 3477149 - RNA, 19 nt, Pseudomonas aeruginosa PA01
uaggacgaacaaccgcuug

SEQ ID NO: 3477150 - RNA, 18 nt, Pseudomonas aeruginosa PA01
uaggagcgagagcgcugc

SEQ ID NO: 3477151 - RNA, 22 nt, Pseudomonas aeruginosa PA01
uaggaucgcuauccaccgucgc

SEQ ID NO: 3477152 - RNA, 22 nt, Pseudomonas aeruginosa PA01
uaggcacaggacccuuccagcg

SEQ ID NO: 3477153 - RNA, 21 nt, Pseudomonas aeruginosa PA01
uaggcaucgacgccagcggcg

SEQ ID NO: 3477154 - RNA, 16 nt, Pseudomonas aeruginosa PA01
uaggccagcaccucga

SEQ ID NO: 3477155 - RNA, 18 nt, Pseudomonas aeruginosa PA01
uaggccagcaccucgacg

SEQ ID NO: 3477156 - RNA, 23 nt, Pseudomonas aeruginosa PA01
uaggccagcggcuccucggccug

SEQ ID NO: 3477157 - RNA, 12 nt, Pseudomonas aeruginosa PA01
uaggccaggcaa

SEQ ID NO: 3477158 - RNA, 13 nt, Pseudomonas aeruginosa PA01
uaggccaggcaga

SEQ ID NO: 3477159 - RNA, 22 nt, Pseudomonas aeruginosa PA01
uaggccaggcagaccagcgcaa

SEQ ID NO: 3477160 - RNA, 15 nt, Pseudomonas aeruginosa PA01
uaggccaugaucauc

SEQ ID NO: 3477161 - RNA, 22 nt, Pseudomonas aeruginosa PA01
uaggccaugaucaucgccugcu

SEQ ID NO: 3477162 - RNA, 18 nt, Pseudomonas aeruginosa PA01
uaggccgcuuccggcccg

SEQ ID NO: 3477163 - RNA, 18 nt, Pseudomonas aeruginosa PA01
uaggccucgaugaucgcc

SEQ ID NO: 3477164 - RNA, 21 nt, Pseudomonas aeruginosa PA01
uaggccucgaugaucgccggg

SEQ ID NO: 3477165 - RNA, 16 nt, Pseudomonas aeruginosa PA01
uaggccugguagaucu

SEQ ID NO: 3477166 - RNA, 15 nt, Pseudomonas aeruginosa PA01
uaggcgaagcggcuc

SEQ ID NO: 3477167 - RNA, 16 nt, Pseudomonas aeruginosa PA01
uaggcgaagcggcucg

SEQ ID NO: 3477168 - RNA, 12 nt, Pseudomonas aeruginosa PA01
uaggcgacccgg

SEQ ID NO: 3477169 - RNA, 16 nt, Pseudomonas aeruginosa PA01
uaggcgacgaucagcc

SEQ ID NO: 3477170 - RNA, 16 nt, Pseudomonas aeruginosa PA01
uaggcgagcagcggca

SEQ ID NO: 3477171 - RNA, 18 nt, Pseudomonas aeruginosa PA01
uaggcgagcagcggcacg

SEQ ID NO: 3477172 - RNA, 13 nt, Pseudomonas aeruginosa PA01
uaggcgcaccagg

SEQ ID NO: 3477173 - RNA, 14 nt, Pseudomonas aeruginosa PA01
uaggcgccggcgcg

SEQ ID NO: 3477174 - RNA, 19 nt, Pseudomonas aeruginosa PA01
uaggcgccggcgcgcggcg

SEQ ID NO: 3477175 - RNA, 23 nt, Pseudomonas aeruginosa PA01
uaggcgcgccaaggccgccaggc

SEQ ID NO: 3477176 - RNA, 21 nt, Pseudomonas aeruginosa PA01
uaggcgcugcaaucgcugccg

SEQ ID NO: 3477177 - RNA, 16 nt, Pseudomonas aeruginosa PA01
uaggcgcugccguaga

SEQ ID NO: 3477178 - RNA, 22 nt, Pseudomonas aeruginosa PA01
uaggcgcugcgguaccagcgca

SEQ ID NO: 3477179 - RNA, 14 nt, Pseudomonas aeruginosa PA01
uaggcgcuggugcu

SEQ ID NO: 3477180 - RNA, 19 nt, Pseudomonas aeruginosa PA01
uaggcggauaacgccagga

SEQ ID NO: 3477181 - RNA, 14 nt, Pseudomonas aeruginosa PA01
uaggcggccagccu

SEQ ID NO: 3477182 - RNA, 18 nt, Pseudomonas aeruginosa PA01
uaggcggcggauaaccgc

SEQ ID NO: 3477183 - RNA, 21 nt, Pseudomonas aeruginosa PA01
uaggcggugcguucgcgggcg

SEQ ID NO: 3477184 - RNA, 15 nt, Pseudomonas aeruginosa PA01
uaggcgguggcgauc

SEQ ID NO: 3477185 - RNA, 14 nt, Pseudomonas aeruginosa PA01
uaggcguccuggcg

SEQ ID NO: 3477186 - RNA, 12 nt, Pseudomonas aeruginosa PA01
uaggcuggaagc

SEQ ID NO: 3477187 - RNA, 15 nt, Pseudomonas aeruginosa PA01
uagggacggugcagg

SEQ ID NO: 3477188 - RNA, 19 nt, Pseudomonas aeruginosa PA01
uagggacggugcaggccga

SEQ ID NO: 3477189 - RNA, 19 nt, Pseudomonas aeruginosa PA01
uagggcaucagccccucgg

SEQ ID NO: 3477190 - RNA, 22 nt, Pseudomonas aeruginosa PA01
uagggcaucgccgacaggucgg

SEQ ID NO: 3477191 - RNA, 19 nt, Pseudomonas aeruginosa PA01
uagggccgguucggauccg

SEQ ID NO: 3477192 - RNA, 19 nt, Pseudomonas aeruginosa PA01
uagggcgaauaaccgcauc

SEQ ID NO: 3477193 - RNA, 20 nt, Pseudomonas aeruginosa PA01
uagggcgaauaaccgcugcg

SEQ ID NO: 3477194 - RNA, 21 nt, Pseudomonas aeruginosa PA01
uagggcgaauaacgccacagg

SEQ ID NO: 3477195 - RNA, 23 nt, Pseudomonas aeruginosa PA01
uagggcgaauaacgccaccggcg

SEQ ID NO: 3477196 - RNA, 21 nt, Pseudomonas aeruginosa PA01
uagggcgaauaacgccgcagg

SEQ ID NO: 3477197 - RNA, 21 nt, Pseudomonas aeruginosa PA01
uagggcgaauagcgccgcagg

SEQ ID NO: 3477198 - RNA, 22 nt, Pseudomonas aeruginosa PA01
uagggcgaauaucgcggcgcga

SEQ ID NO: 3477199 - RNA, 14 nt, Pseudomonas aeruginosa PA01
uagggcgacgcccg

SEQ ID NO: 3477200 - RNA, 17 nt, Pseudomonas aeruginosa PA01
uagggcggauagcgcgc

SEQ ID NO: 3477201 - RNA, 14 nt, Pseudomonas aeruginosa PA01
uagggcuucgccca

SEQ ID NO: 3477202 - RNA, 23 nt, Pseudomonas aeruginosa PA01
uaggggcagaccuggugggcggc

SEQ ID NO: 3477203 - RNA, 17 nt, Pseudomonas aeruginosa PA01
uagggggugaagcgcag

SEQ ID NO: 3477204 - RNA, 15 nt, Pseudomonas aeruginosa PA01
uagggguggccaggc

SEQ ID NO: 3477205 - RNA, 14 nt, Pseudomonas aeruginosa PA01
uaggguucgccgac

SEQ ID NO: 3477206 - RNA, 15 nt, Pseudomonas aeruginosa PA01
uaggguucgccgacg

SEQ ID NO: 3477207 - RNA, 16 nt, Pseudomonas aeruginosa PA01
uagguauccgccggcc

SEQ ID NO: 3477208 - RNA, 11 nt, Pseudomonas aeruginosa PA01
uaggucaccgc

SEQ ID NO: 3477209 - RNA, 24 nt, Pseudomonas aeruginosa PA01
uaggucagcgguaugccgcaggca

SEQ ID NO: 3477210 - RNA, 13 nt, Pseudomonas aeruginosa PA01
uaggucaugccca

SEQ ID NO: 3477211 - RNA, 14 nt, Pseudomonas aeruginosa PA01
uaggucaugcccag

SEQ ID NO: 3477212 - RNA, 18 nt, Pseudomonas aeruginosa PA01
uagguccaggcgucggcg

SEQ ID NO: 3477213 - RNA, 18 nt, Pseudomonas aeruginosa PA01
uagguggcgccgccggcg

SEQ ID NO: 3477214 - RNA, 17 nt, Pseudomonas aeruginosa PA01
uagguuuccccguggcg

SEQ ID NO: 3477215 - RNA, 21 nt, Pseudomonas aeruginosa PA01
uaguacaugacgaagcgcacc

SEQ ID NO: 3477216 - RNA, 14 nt, Pseudomonas aeruginosa PA01
uaguagcauucuug

SEQ ID NO: 3477217 - RNA, 16 nt, Pseudomonas aeruginosa PA01
uaguagugccccuuga

SEQ ID NO: 3477218 - RNA, 12 nt, Pseudomonas aeruginosa PA01
uaguccagccag

SEQ ID NO: 3477219 - RNA, 15 nt, Pseudomonas aeruginosa PA01
uaguccagcgccgcg

SEQ ID NO: 3477220 - RNA, 14 nt, Pseudomonas aeruginosa PA01
uaguccagcuccuc

SEQ ID NO: 3477221 - RNA, 13 nt, Pseudomonas aeruginosa PA01
uagucgaccggaa

SEQ ID NO: 3477222 - RNA, 13 nt, Pseudomonas aeruginosa PA01
uagucgccccggu

SEQ ID NO: 3477223 - RNA, 14 nt, Pseudomonas aeruginosa PA01
uagucgcgcagcgc

SEQ ID NO: 3477224 - RNA, 15 nt, Pseudomonas aeruginosa PA01
uagucgcggggcgga

SEQ ID NO: 3477225 - RNA, 22 nt, Pseudomonas aeruginosa PA01
uagucggcagucgccgcaccgg

SEQ ID NO: 3477226 - RNA, 19 nt, Pseudomonas aeruginosa PA01
uagucggugaccuccucga

SEQ ID NO: 3477227 - RNA, 22 nt, Pseudomonas aeruginosa PA01
uagugaaaguccuucuucgcua

SEQ ID NO: 3477228 - RNA, 21 nt, Pseudomonas aeruginosa PA01
uagugcaacaccuggcgcucg

SEQ ID NO: 3477229 - RNA, 14 nt, Pseudomonas aeruginosa PA01
uagugcggccaggc

SEQ ID NO: 3477230 - RNA, 15 nt, Pseudomonas aeruginosa PA01
uagugcggccaggcg

SEQ ID NO: 3477231 - RNA, 13 nt, Pseudomonas aeruginosa PA01
uagugcucggcca

SEQ ID NO: 3477232 - RNA, 12 nt, Pseudomonas aeruginosa PA01
uagugcuggaau

SEQ ID NO: 3477233 - RNA, 14 nt, Pseudomonas aeruginosa PA01
uagugcuggaaucg

SEQ ID NO: 3477234 - RNA, 12 nt, Pseudomonas aeruginosa PA01
uagugcuggcgc

SEQ ID NO: 3477235 - RNA, 15 nt, Pseudomonas aeruginosa PA01
uagugggcgaggcgc

SEQ ID NO: 3477236 - RNA, 13 nt, Pseudomonas aeruginosa PA01
uaguguugaagcc

SEQ ID NO: 3477237 - RNA, 16 nt, Pseudomonas aeruginosa PA01
uaguucuccaggccca

SEQ ID NO: 3477238 - RNA, 16 nt, Pseudomonas aeruginosa PA01
uaguugacgucgccga

SEQ ID NO: 3477239 - RNA, 14 nt, Pseudomonas aeruginosa PA01
uaguugagccccag

SEQ ID NO: 3477240 - RNA, 18 nt, Pseudomonas aeruginosa PA01
uauaacgcgagccacauc

SEQ ID NO: 3477241 - RNA, 22 nt, Pseudomonas aeruginosa PA01
uauagaccagcaccgccugcaa

SEQ ID NO: 3477242 - RNA, 21 nt, Pseudomonas aeruginosa PA01
uauagcccugggcgccgccgg

SEQ ID NO: 3477243 - RNA, 15 nt, Pseudomonas aeruginosa PA01
uauagguggugcugg

SEQ ID NO: 3477244 - RNA, 13 nt, Pseudomonas aeruginosa PA01
uauccagcggccg

SEQ ID NO: 3477245 - RNA, 15 nt, Pseudomonas aeruginosa PA01
uauccagggccagga

SEQ ID NO: 3477246 - RNA, 15 nt, Pseudomonas aeruginosa PA01
uauccaugucagcgg

SEQ ID NO: 3477247 - RNA, 20 nt, Pseudomonas aeruginosa PA01
uaucccagcgcgugcaggcg

SEQ ID NO: 3477248 - RNA, 13 nt, Pseudomonas aeruginosa PA01
uauccccccaccc

SEQ ID NO: 3477249 - RNA, 13 nt, Pseudomonas aeruginosa PA01
uauccccguaucc

SEQ ID NO: 3477250 - RNA, 15 nt, Pseudomonas aeruginosa PA01
uaucccgugccgggc

SEQ ID NO: 3477251 - RNA, 12 nt, Pseudomonas aeruginosa PA01
uauccgccgccg

SEQ ID NO: 3477252 - RNA, 13 nt, Pseudomonas aeruginosa PA01
uauccgccgccga

SEQ ID NO: 3477253 - RNA, 21 nt, Pseudomonas aeruginosa PA01
uauccgccgccgacgucacgg

SEQ ID NO: 3477254 - RNA, 13 nt, Pseudomonas aeruginosa PA01
uauccgccgccgg

SEQ ID NO: 3477255 - RNA, 15 nt, Pseudomonas aeruginosa PA01
uauccgccgccgggc

SEQ ID NO: 3477256 - RNA, 20 nt, Pseudomonas aeruginosa PA01
uauccgccgcuacugcgcgg

SEQ ID NO: 3477257 - RNA, 23 nt, Pseudomonas aeruginosa PA01
uauccgccgcucacccuguccca

SEQ ID NO: 3477258 - RNA, 21 nt, Pseudomonas aeruginosa PA01
uauccgccggaaccugcaugu

SEQ ID NO: 3477259 - RNA, 12 nt, Pseudomonas aeruginosa PA01
uauccgccggcc

SEQ ID NO: 3477260 - RNA, 14 nt, Pseudomonas aeruginosa PA01
uauccgccggccgg

SEQ ID NO: 3477261 - RNA, 14 nt, Pseudomonas aeruginosa PA01
uauccgccgggccg

SEQ ID NO: 3477262 - RNA, 13 nt, Pseudomonas aeruginosa PA01
uauccgggcccag

SEQ ID NO: 3477263 - RNA, 13 nt, Pseudomonas aeruginosa PA01
uauccuccaggcc

SEQ ID NO: 3477264 - RNA, 14 nt, Pseudomonas aeruginosa PA01
uauccuccaggccg

SEQ ID NO: 3477265 - RNA, 22 nt, Pseudomonas aeruginosa PA01
uauccucgcggaagucggcggg

SEQ ID NO: 3477266 - RNA, 14 nt, Pseudomonas aeruginosa PA01
uaucgaucucgauc

SEQ ID NO: 3477267 - RNA, 13 nt, Pseudomonas aeruginosa PA01
uaucgaugcgcgc

SEQ ID NO: 3477268 - RNA, 19 nt, Pseudomonas aeruginosa PA01
uaucgaugcgcgcggcgag

SEQ ID NO: 3477269 - RNA, 15 nt, Pseudomonas aeruginosa PA01
uaucgcaggccaggc

SEQ ID NO: 3477270 - RNA, 13 nt, Pseudomonas aeruginosa PA01
uaucgcccuggcc

SEQ ID NO: 3477271 - RNA, 15 nt, Pseudomonas aeruginosa PA01
uaucgccgccgcagc

SEQ ID NO: 3477272 - RNA, 17 nt, Pseudomonas aeruginosa PA01
uaucgccgguccucgac

SEQ ID NO: 3477273 - RNA, 13 nt, Pseudomonas aeruginosa PA01
uaucgcggcgcga

SEQ ID NO: 3477274 - RNA, 13 nt, Pseudomonas aeruginosa PA01
uaucgcgugguga

SEQ ID NO: 3477275 - RNA, 17 nt, Pseudomonas aeruginosa PA01
uaucgcuggcgcagccg

SEQ ID NO: 3477276 - RNA, 17 nt, Pseudomonas aeruginosa PA01
uaucggcuugccggcgg

SEQ ID NO: 3477277 - RNA, 22 nt, Pseudomonas aeruginosa PA01
uaucggcuugccggcggcgcug

SEQ ID NO: 3477278 - RNA, 21 nt, Pseudomonas aeruginosa PA01
uaucgggcagggcagccgccg

SEQ ID NO: 3477279 - RNA, 15 nt, Pseudomonas aeruginosa PA01
uaucgggccgaucga

SEQ ID NO: 3477280 - RNA, 21 nt, Pseudomonas aeruginosa PA01
uaucgucgggacgcaugcgcg

SEQ ID NO: 3477281 - RNA, 20 nt, Pseudomonas aeruginosa PA01
uaucucgcugucuaucccgu

SEQ ID NO: 3477282 - RNA, 20 nt, Pseudomonas aeruginosa PA01
uaucucuuuuuaagagaaug

SEQ ID NO: 3477283 - RNA, 19 nt, Pseudomonas aeruginosa PA01
uaugccgcaggcaguggcg

SEQ ID NO: 3477284 - RNA, 15 nt, Pseudomonas aeruginosa PA01
uaugccucggcggcg

SEQ ID NO: 3477285 - RNA, 19 nt, Pseudomonas aeruginosa PA01
uaugccucggcggcggccu

SEQ ID NO: 3477286 - RNA, 23 nt, Pseudomonas aeruginosa PA01
uaugccugugcaccgaagggaau

SEQ ID NO: 3477287 - RNA, 21 nt, Pseudomonas aeruginosa PA01
uaugcgcccuaccugucccgg

SEQ ID NO: 3477288 - RNA, 13 nt, Pseudomonas aeruginosa PA01
uaugcgccgggcc

SEQ ID NO: 3477289 - RNA, 16 nt, Pseudomonas aeruginosa PA01
uaugcgcggucaccag

SEQ ID NO: 3477290 - RNA, 21 nt, Pseudomonas aeruginosa PA01
uauggaagaggaucuccuggc

SEQ ID NO: 3477291 - RNA, 16 nt, Pseudomonas aeruginosa PA01
uauggcgggccuugcg

SEQ ID NO: 3477292 - RNA, 18 nt, Pseudomonas aeruginosa PA01
uauggcggucggccaggc

SEQ ID NO: 3477293 - RNA, 17 nt, Pseudomonas aeruginosa PA01
uauguauucgaacagcu

SEQ ID NO: 3477294 - RNA, 23 nt, Pseudomonas aeruginosa PA01
uauuaccccgcccacucuucagu

SEQ ID NO: 3477295 - RNA, 11 nt, Pseudomonas aeruginosa PA01
uauuccucagu

SEQ ID NO: 3477296 - RNA, 20 nt, Pseudomonas aeruginosa PA01
uauucgacgguauguuucug

SEQ ID NO: 3477297 - RNA, 22 nt, Pseudomonas aeruginosa PA01
uauucgacgguauguuucuggc

SEQ ID NO: 3477298 - RNA, 23 nt, Pseudomonas aeruginosa PA01
uauucgcccuaccccccaauugc

SEQ ID NO: 3477299 - RNA, 22 nt, Pseudomonas aeruginosa PA01
uauucgcccuaccgcccacccu

SEQ ID NO: 3477300 - RNA, 17 nt, Pseudomonas aeruginosa PA01
uauucggcgaccagccc

SEQ ID NO: 3477301 - RNA, 21 nt, Pseudomonas aeruginosa PA01
uauugaggauccacuugccgu

SEQ ID NO: 3477302 - RNA, 19 nt, Pseudomonas aeruginosa PA01
uauugcuccacccgcagcc

SEQ ID NO: 3477303 - RNA, 16 nt, Pseudomonas aeruginosa PA01
uauugguauccagguu

SEQ ID NO: 3477304 - RNA, 22 nt, Pseudomonas aeruginosa PA01
uauuggucaccacguugcgccg

SEQ ID NO: 3477305 - RNA, 18 nt, Pseudomonas aeruginosa PA01
uauugucgaugggcagga

SEQ ID NO: 3477306 - RNA, 16 nt, Pseudomonas aeruginosa PA01
uauuucucgacuuccg

SEQ ID NO: 3477307 - RNA, 20 nt, Pseudomonas aeruginosa PA01
ucaaaggaaucuucggcgcc

SEQ ID NO: 3477308 - RNA, 17 nt, Pseudomonas aeruginosa PA01
ucaacaccagcgccgcc

SEQ ID NO: 3477309 - RNA, 23 nt, Pseudomonas aeruginosa PA01
ucaacaccagcgccgccaggcag

SEQ ID NO: 3477310 - RNA, 18 nt, Pseudomonas aeruginosa PA01
ucaacagcgaagcuggcg

SEQ ID NO: 3477311 - RNA, 19 nt, Pseudomonas aeruginosa PA01
ucaacagcgaagcuggcgc

SEQ ID NO: 3477312 - RNA, 12 nt, Pseudomonas aeruginosa PA01
ucaaccaggcga

SEQ ID NO: 3477313 - RNA, 20 nt, Pseudomonas aeruginosa PA01
ucaacccuugcucccgccgc

SEQ ID NO: 3477314 - RNA, 22 nt, Pseudomonas aeruginosa PA01
ucaacccuugcucccgccgcuc

SEQ ID NO: 3477315 - RNA, 13 nt, Pseudomonas aeruginosa PA01
ucaaccgcgggcg

SEQ ID NO: 3477316 - RNA, 15 nt, Pseudomonas aeruginosa PA01
ucaaccgcuggucgg

SEQ ID NO: 3477317 - RNA, 17 nt, Pseudomonas aeruginosa PA01
ucaaccgcuggucggca

SEQ ID NO: 3477318 - RNA, 14 nt, Pseudomonas aeruginosa PA01
ucaacgagccgagc

SEQ ID NO: 3477319 - RNA, 19 nt, Pseudomonas aeruginosa PA01
ucaacgagccgagcaggcc

SEQ ID NO: 3477320 - RNA, 16 nt, Pseudomonas aeruginosa PA01
ucaacgcggccagcag

SEQ ID NO: 3477321 - RNA, 14 nt, Pseudomonas aeruginosa PA01
ucaacggcgaccgc

SEQ ID NO: 3477322 - RNA, 19 nt, Pseudomonas aeruginosa PA01
ucaacggcgaccgcuggac

SEQ ID NO: 3477323 - RNA, 23 nt, Pseudomonas aeruginosa PA01
ucaacggcgauuccacgggccug

SEQ ID NO: 3477324 - RNA, 22 nt, Pseudomonas aeruginosa PA01
ucaacggugacguuggccgggg

SEQ ID NO: 3477325 - RNA, 14 nt, Pseudomonas aeruginosa PA01
ucaacgucggcguc

SEQ ID NO: 3477326 - RNA, 16 nt, Pseudomonas aeruginosa PA01
ucaacuccgccaggcg

SEQ ID NO: 3477327 - RNA, 17 nt, Pseudomonas aeruginosa PA01
ucaacugcuuaccuugc

SEQ ID NO: 3477328 - RNA, 18 nt, Pseudomonas aeruginosa PA01
ucaacuggucgcagccgc

SEQ ID NO: 3477329 - RNA, 19 nt, Pseudomonas aeruginosa PA01
ucaacugguuggccgccug

SEQ ID NO: 3477330 - RNA, 22 nt, Pseudomonas aeruginosa PA01
ucaacugguuggccgccuggcg

SEQ ID NO: 3477331 - RNA, 19 nt, Pseudomonas aeruginosa PA01
ucaagacggcccgcagauc

SEQ ID NO: 3477332 - RNA, 22 nt, Pseudomonas aeruginosa PA01
ucaagcaacggcgaaucgucga

SEQ ID NO: 3477333 - RNA, 23 nt, Pseudomonas aeruginosa PA01
ucaagcaauucgugugggugcuu

SEQ ID NO: 3477334 - RNA, 23 nt, Pseudomonas aeruginosa PA01
ucaagcggguauugcagacgcug

SEQ ID NO: 3477335 - RNA, 20 nt, Pseudomonas aeruginosa PA01
ucaaggcagaaaaacccagc

SEQ ID NO: 3477336 - RNA, 18 nt, Pseudomonas aeruginosa PA01
ucaagggccaggaaaucg

SEQ ID NO: 3477337 - RNA, 14 nt, Pseudomonas aeruginosa PA01
ucaagggcuggcag

SEQ ID NO: 3477338 - RNA, 18 nt, Pseudomonas aeruginosa PA01
ucaaggugaagugaucga

SEQ ID NO: 3477339 - RNA, 16 nt, Pseudomonas aeruginosa PA01
ucaaucgcgcaacggc

SEQ ID NO: 3477340 - RNA, 16 nt, Pseudomonas aeruginosa PA01
ucaaugcggccugcaa

SEQ ID NO: 3477341 - RNA, 15 nt, Pseudomonas aeruginosa PA01
ucaauucgcggacgc

SEQ ID NO: 3477342 - RNA, 14 nt, Pseudomonas aeruginosa PA01
ucacaccaccagca

SEQ ID NO: 3477343 - RNA, 14 nt, Pseudomonas aeruginosa PA01
ucacaccgaacuuc

SEQ ID NO: 3477344 - RNA, 18 nt, Pseudomonas aeruginosa PA01
ucacaccgaagucgcccg

SEQ ID NO: 3477345 - RNA, 15 nt, Pseudomonas aeruginosa PA01
ucacauacaccuugc

SEQ ID NO: 3477346 - RNA, 15 nt, Pseudomonas aeruginosa PA01
ucacaugcaccaggc

SEQ ID NO: 3477347 - RNA, 17 nt, Pseudomonas aeruginosa PA01
ucacaugcaccaggccc

SEQ ID NO: 3477348 - RNA, 12 nt, Pseudomonas aeruginosa PA01
ucacaugguggg

SEQ ID NO: 3477349 - RNA, 21 nt, Pseudomonas aeruginosa PA01
ucacauggugggcgccgcugu

SEQ ID NO: 3477350 - RNA, 20 nt, Pseudomonas aeruginosa PA01
ucacauuggcuuccgagcag

SEQ ID NO: 3477351 - RNA, 14 nt, Pseudomonas aeruginosa PA01
ucaccaccaccguc

SEQ ID NO: 3477352 - RNA, 15 nt, Pseudomonas aeruginosa PA01
ucaccaccacgccgu

SEQ ID NO: 3477353 - RNA, 17 nt, Pseudomonas aeruginosa PA01
ucaccaccacgccgucg

SEQ ID NO: 3477354 - RNA, 20 nt, Pseudomonas aeruginosa PA01
ucaccaccagcaucagcagg

SEQ ID NO: 3477355 - RNA, 15 nt, Pseudomonas aeruginosa PA01
ucaccaccagcgccg

SEQ ID NO: 3477356 - RNA, 15 nt, Pseudomonas aeruginosa PA01
ucaccacccagccgc

SEQ ID NO: 3477357 - RNA, 18 nt, Pseudomonas aeruginosa PA01
ucaccacccagccgcggc

SEQ ID NO: 3477358 - RNA, 13 nt, Pseudomonas aeruginosa PA01
ucaccaccccaca

SEQ ID NO: 3477359 - RNA, 18 nt, Pseudomonas aeruginosa PA01
ucaccaccggcuggcggc

SEQ ID NO: 3477360 - RNA, 22 nt, Pseudomonas aeruginosa PA01
ucaccaccggcuggcggcucgg

SEQ ID NO: 3477361 - RNA, 23 nt, Pseudomonas aeruginosa PA01
ucaccaccggcuggcggcucggc

SEQ ID NO: 3477362 - RNA, 15 nt, Pseudomonas aeruginosa PA01
ucaccaccucgugcu

SEQ ID NO: 3477363 - RNA, 21 nt, Pseudomonas aeruginosa PA01
ucaccacgcgauauccgccag

SEQ ID NO: 3477364 - RNA, 17 nt, Pseudomonas aeruginosa PA01
ucaccacguugcgccgc

SEQ ID NO: 3477365 - RNA, 17 nt, Pseudomonas aeruginosa PA01
ucaccacucgccagcgc

SEQ ID NO: 3477366 - RNA, 13 nt, Pseudomonas aeruginosa PA01
ucaccacuggaaa

SEQ ID NO: 3477367 - RNA, 19 nt, Pseudomonas aeruginosa PA01
ucaccacuggaaacgccca

SEQ ID NO: 3477368 - RNA, 18 nt, Pseudomonas aeruginosa PA01
ucaccagcaauugccggc

SEQ ID NO: 3477369 - RNA, 14 nt, Pseudomonas aeruginosa PA01
ucaccagcgccagg

SEQ ID NO: 3477370 - RNA, 14 nt, Pseudomonas aeruginosa PA01
ucaccagcgccggg

SEQ ID NO: 3477371 - RNA, 12 nt, Pseudomonas aeruginosa PA01
ucaccagcgcug

SEQ ID NO: 3477372 - RNA, 16 nt, Pseudomonas aeruginosa PA01
ucaccagcgcugccuc

SEQ ID NO: 3477373 - RNA, 22 nt, Pseudomonas aeruginosa PA01
ucaccagcggguaguagaucag

SEQ ID NO: 3477374 - RNA, 12 nt, Pseudomonas aeruginosa PA01
ucaccaggaucg

SEQ ID NO: 3477375 - RNA, 17 nt, Pseudomonas aeruginosa PA01
ucaccaggaucgccggg

SEQ ID NO: 3477376 - RNA, 19 nt, Pseudomonas aeruginosa PA01
ucaccaggaucgccgggcu

SEQ ID NO: 3477377 - RNA, 16 nt, Pseudomonas aeruginosa PA01
ucaccaggcccgccgg

SEQ ID NO: 3477378 - RNA, 13 nt, Pseudomonas aeruginosa PA01
ucaccaggcugcc

SEQ ID NO: 3477379 - RNA, 17 nt, Pseudomonas aeruginosa PA01
ucaccaggcugccgccg

SEQ ID NO: 3477380 - RNA, 18 nt, Pseudomonas aeruginosa PA01
ucaccaggcugccgccgu

SEQ ID NO: 3477381 - RNA, 19 nt, Pseudomonas aeruginosa PA01
ucaccaggcugccgccgua

SEQ ID NO: 3477382 - RNA, 15 nt, Pseudomonas aeruginosa PA01
ucaccagggucacgc

SEQ ID NO: 3477383 - RNA, 19 nt, Pseudomonas aeruginosa PA01
ucaccagggucacgccgcg

SEQ ID NO: 3477384 - RNA, 21 nt, Pseudomonas aeruginosa PA01
ucaccagggucacgccgcggc

SEQ ID NO: 3477385 - RNA, 15 nt, Pseudomonas aeruginosa PA01
ucaccagggucgcca

SEQ ID NO: 3477386 - RNA, 17 nt, Pseudomonas aeruginosa PA01
ucaccagggucgccagg

SEQ ID NO: 3477387 - RNA, 20 nt, Pseudomonas aeruginosa PA01
ucaccagggucggcaccugc

SEQ ID NO: 3477388 - RNA, 23 nt, Pseudomonas aeruginosa PA01
ucaccagggucggcaccugcaga

SEQ ID NO: 3477389 - RNA, 17 nt, Pseudomonas aeruginosa PA01
ucaccagguugcccggc

SEQ ID NO: 3477390 - RNA, 15 nt, Pseudomonas aeruginosa PA01
ucaccaugaucaucg

SEQ ID NO: 3477391 - RNA, 21 nt, Pseudomonas aeruginosa PA01
ucacccacauggcgguccagg

SEQ ID NO: 3477392 - RNA, 19 nt, Pseudomonas aeruginosa PA01
ucacccagagcaccagggu

SEQ ID NO: 3477393 - RNA, 19 nt, Pseudomonas aeruginosa PA01
ucacccauucgaugccgcg

SEQ ID NO: 3477394 - RNA, 22 nt, Pseudomonas aeruginosa PA01
ucacccauucgaugccgcgcgc

SEQ ID NO: 3477395 - RNA, 23 nt, Pseudomonas aeruginosa PA01
ucaccccacgggcgacccaggcc

SEQ ID NO: 3477396 - RNA, 19 nt, Pseudomonas aeruginosa PA01
ucaccccaggaaaacauca

SEQ ID NO: 3477397 - RNA, 14 nt, Pseudomonas aeruginosa PA01
ucaccccgaccagc

SEQ ID NO: 3477398 - RNA, 19 nt, Pseudomonas aeruginosa PA01
ucaccccgaccagcgcgcu

SEQ ID NO: 3477399 - RNA, 16 nt, Pseudomonas aeruginosa PA01
ucaccccgcaaccgca

SEQ ID NO: 3477400 - RNA, 22 nt, Pseudomonas aeruginosa PA01
ucaccccgcaaccgcagacucc

SEQ ID NO: 3477401 - RNA, 22 nt, Pseudomonas aeruginosa PA01
ucaccccgcccuuggcggcgcc

SEQ ID NO: 3477402 - RNA, 14 nt, Pseudomonas aeruginosa PA01
ucacccgcagcggc

SEQ ID NO: 3477403 - RNA, 12 nt, Pseudomonas aeruginosa PA01
ucacccgcccgc

SEQ ID NO: 3477404 - RNA, 18 nt, Pseudomonas aeruginosa PA01
ucacccgcgaggccggcc

SEQ ID NO: 3477405 - RNA, 17 nt, Pseudomonas aeruginosa PA01
ucacccgcgccugcagg

SEQ ID NO: 3477406 - RNA, 20 nt, Pseudomonas aeruginosa PA01
ucacccggcgaagcuccucg

SEQ ID NO: 3477407 - RNA, 14 nt, Pseudomonas aeruginosa PA01
ucacccugcugggc

SEQ ID NO: 3477408 - RNA, 16 nt, Pseudomonas aeruginosa PA01
ucacccugcugggcgg

SEQ ID NO: 3477409 - RNA, 19 nt, Pseudomonas aeruginosa PA01
ucacccuggcaccgauggc

SEQ ID NO: 3477410 - RNA, 18 nt, Pseudomonas aeruginosa PA01
ucaccgacagucccaggc

SEQ ID NO: 3477411 - RNA, 12 nt, Pseudomonas aeruginosa PA01
ucaccgaccagu

SEQ ID NO: 3477412 - RNA, 19 nt, Pseudomonas aeruginosa PA01
ucaccgagcguuuuuggca

SEQ ID NO: 3477413 - RNA, 15 nt, Pseudomonas aeruginosa PA01
ucaccgcauagucgc

SEQ ID NO: 3477414 - RNA, 18 nt, Pseudomonas aeruginosa PA01
ucaccgcaucgaaggcgc

SEQ ID NO: 3477415 - RNA, 23 nt, Pseudomonas aeruginosa PA01
ucaccgcaucgaaggcgccggca

SEQ ID NO: 3477416 - RNA, 19 nt, Pseudomonas aeruginosa PA01
ucaccgccaaggccucggc

SEQ ID NO: 3477417 - RNA, 15 nt, Pseudomonas aeruginosa PA01
ucaccgccaccccgc

SEQ ID NO: 3477418 - RNA, 15 nt, Pseudomonas aeruginosa PA01
ucaccgccaccuugc

SEQ ID NO: 3477419 - RNA, 11 nt, Pseudomonas aeruginosa PA01
ucaccgccagc

SEQ ID NO: 3477420 - RNA, 14 nt, Pseudomonas aeruginosa PA01
ucaccgccaucagc

SEQ ID NO: 3477421 - RNA, 15 nt, Pseudomonas aeruginosa PA01
ucaccgccaucagca

SEQ ID NO: 3477422 - RNA, 13 nt, Pseudomonas aeruginosa PA01
ucaccgcccugcg

SEQ ID NO: 3477423 - RNA, 15 nt, Pseudomonas aeruginosa PA01
ucaccgccucggaga

SEQ ID NO: 3477424 - RNA, 22 nt, Pseudomonas aeruginosa PA01
ucaccgccuuggcaucgccgcc

SEQ ID NO: 3477425 - RNA, 21 nt, Pseudomonas aeruginosa PA01
ucaccgcgcaaaccggcagca

SEQ ID NO: 3477426 - RNA, 12 nt, Pseudomonas aeruginosa PA01
ucaccgcgccgc

SEQ ID NO: 3477427 - RNA, 13 nt, Pseudomonas aeruginosa PA01
ucaccgcgccgcg

SEQ ID NO: 3477428 - RNA, 12 nt, Pseudomonas aeruginosa PA01
ucaccgcgccgg

SEQ ID NO: 3477429 - RNA, 13 nt, Pseudomonas aeruginosa PA01
ucaccgcggccuu

SEQ ID NO: 3477430 - RNA, 20 nt, Pseudomonas aeruginosa PA01
ucaccgcggcgcugaaggcg

SEQ ID NO: 3477431 - RNA, 22 nt, Pseudomonas aeruginosa PA01
ucaccgcggcgcugaaggcggu

SEQ ID NO: 3477432 - RNA, 21 nt, Pseudomonas aeruginosa PA01
ucaccgcggugugcuugucca

SEQ ID NO: 3477433 - RNA, 22 nt, Pseudomonas aeruginosa PA01
ucaccgcguccauccccgccuc

SEQ ID NO: 3477434 - RNA, 23 nt, Pseudomonas aeruginosa PA01
ucaccgcguccauccccgccucg

SEQ ID NO: 3477435 - RNA, 22 nt, Pseudomonas aeruginosa PA01
ucaccgcgucgggaaaggccgc

SEQ ID NO: 3477436 - RNA, 18 nt, Pseudomonas aeruginosa PA01
ucaccgcguucugcggac

SEQ ID NO: 3477437 - RNA, 22 nt, Pseudomonas aeruginosa PA01
ucaccgcucaagacggcccgca

SEQ ID NO: 3477438 - RNA, 11 nt, Pseudomonas aeruginosa PA01
ucaccgcucgc

SEQ ID NO: 3477439 - RNA, 18 nt, Pseudomonas aeruginosa PA01
ucaccggacggcugaggc

SEQ ID NO: 3477440 - RNA, 21 nt, Pseudomonas aeruginosa PA01
ucaccggacggcugaggcugg

SEQ ID NO: 3477441 - RNA, 20 nt, Pseudomonas aeruginosa PA01
ucaccggaucgaugcccggc

SEQ ID NO: 3477442 - RNA, 15 nt, Pseudomonas aeruginosa PA01
ucaccggcagcagcg

SEQ ID NO: 3477443 - RNA, 13 nt, Pseudomonas aeruginosa PA01
ucaccggcagggc

SEQ ID NO: 3477444 - RNA, 14 nt, Pseudomonas aeruginosa PA01
ucaccggcagggcg

SEQ ID NO: 3477445 - RNA, 20 nt, Pseudomonas aeruginosa PA01
ucaccggcgccacccucggc

SEQ ID NO: 3477446 - RNA, 11 nt, Pseudomonas aeruginosa PA01
ucaccggcgga

SEQ ID NO: 3477447 - RNA, 21 nt, Pseudomonas aeruginosa PA01
ucaccggggccuucaggcgcu

SEQ ID NO: 3477448 - RNA, 16 nt, Pseudomonas aeruginosa PA01
ucaccguccuucggcc

SEQ ID NO: 3477449 - RNA, 21 nt, Pseudomonas aeruginosa PA01
ucaccguccuucggccgcacc

SEQ ID NO: 3477450 - RNA, 12 nt, Pseudomonas aeruginosa PA01
ucaccgugaucc

SEQ ID NO: 3477451 - RNA, 21 nt, Pseudomonas aeruginosa PA01
ucaccguggagaggucgccga

SEQ ID NO: 3477452 - RNA, 19 nt, Pseudomonas aeruginosa PA01
ucaccguggucauggcgca

SEQ ID NO: 3477453 - RNA, 18 nt, Pseudomonas aeruginosa PA01
ucaccguucccagcagcg

SEQ ID NO: 3477454 - RNA, 19 nt, Pseudomonas aeruginosa PA01
ucaccguucccagcagcgc

SEQ ID NO: 3477455 - RNA, 20 nt, Pseudomonas aeruginosa PA01
ucaccguucuugaucaccgc

SEQ ID NO: 3477456 - RNA, 23 nt, Pseudomonas aeruginosa PA01
ucaccguucuugaucaccgcggu

SEQ ID NO: 3477457 - RNA, 13 nt, Pseudomonas aeruginosa PA01
ucaccucggcgcc

SEQ ID NO: 3477458 - RNA, 20 nt, Pseudomonas aeruginosa PA01
ucaccuggccgugcucgaug

SEQ ID NO: 3477459 - RNA, 16 nt, Pseudomonas aeruginosa PA01
ucaccuguucggcgcu

SEQ ID NO: 3477460 - RNA, 18 nt, Pseudomonas aeruginosa PA01
ucaccuguucggcgcuga

SEQ ID NO: 3477461 - RNA, 16 nt, Pseudomonas aeruginosa PA01
ucaccuuccucgcgcc

SEQ ID NO: 3477462 - RNA, 21 nt, Pseudomonas aeruginosa PA01
ucaccuucgcccucagcagcg

SEQ ID NO: 3477463 - RNA, 19 nt, Pseudomonas aeruginosa PA01
ucaccuucucguagcgcuc

SEQ ID NO: 3477464 - RNA, 20 nt, Pseudomonas aeruginosa PA01
ucaccuucucguagcgcucg

SEQ ID NO: 3477465 - RNA, 17 nt, Pseudomonas aeruginosa PA01
ucaccuugccaucaucg

SEQ ID NO: 3477466 - RNA, 14 nt, Pseudomonas aeruginosa PA01
ucaccuugcccucg

SEQ ID NO: 3477467 - RNA, 15 nt, Pseudomonas aeruginosa PA01
ucaccuuggugccga

SEQ ID NO: 3477468 - RNA, 18 nt, Pseudomonas aeruginosa PA01
ucaccuuggugccgaccu

SEQ ID NO: 3477469 - RNA, 21 nt, Pseudomonas aeruginosa PA01
ucaccuuguacggcagcggcg

SEQ ID NO: 3477470 - RNA, 20 nt, Pseudomonas aeruginosa PA01
ucaccuugucgcaccagccu

SEQ ID NO: 3477471 - RNA, 12 nt, Pseudomonas aeruginosa PA01
ucaccuugucgu

SEQ ID NO: 3477472 - RNA, 13 nt, Pseudomonas aeruginosa PA01
ucaccuugucguu

SEQ ID NO: 3477473 - RNA, 16 nt, Pseudomonas aeruginosa PA01
ucacgaacagcuugcc

SEQ ID NO: 3477474 - RNA, 18 nt, Pseudomonas aeruginosa PA01
ucacgaacagcuugccgu

SEQ ID NO: 3477475 - RNA, 19 nt, Pseudomonas aeruginosa PA01
ucacgaagcggucgccggc

SEQ ID NO: 3477476 - RNA, 21 nt, Pseudomonas aeruginosa PA01
ucacgaagcggucgccggcgc

SEQ ID NO: 3477477 - RNA, 16 nt, Pseudomonas aeruginosa PA01
ucacgacaggcggcgg

SEQ ID NO: 3477478 - RNA, 23 nt, Pseudomonas aeruginosa PA01
ucacgacaggcggcgggccggcg

SEQ ID NO: 3477479 - RNA, 17 nt, Pseudomonas aeruginosa PA01
ucacgaucggcaccauc

SEQ ID NO: 3477480 - RNA, 20 nt, Pseudomonas aeruginosa PA01
ucacgauggccggcagcagc

SEQ ID NO: 3477481 - RNA, 21 nt, Pseudomonas aeruginosa PA01
ucacgauggccggcagcagcg

SEQ ID NO: 3477482 - RNA, 23 nt, Pseudomonas aeruginosa PA01
ucacgcagcaggcgacggucagg

SEQ ID NO: 3477483 - RNA, 16 nt, Pseudomonas aeruginosa PA01
ucacgcaggcgcuggc

SEQ ID NO: 3477484 - RNA, 18 nt, Pseudomonas aeruginosa PA01
ucacgcaggcgcuggccg

SEQ ID NO: 3477485 - RNA, 13 nt, Pseudomonas aeruginosa PA01
ucacgcaggcuuu

SEQ ID NO: 3477486 - RNA, 20 nt, Pseudomonas aeruginosa PA01
ucacgcaggcuuuccagccc

SEQ ID NO: 3477487 - RNA, 14 nt, Pseudomonas aeruginosa PA01
ucacgcccugcccc

SEQ ID NO: 3477488 - RNA, 15 nt, Pseudomonas aeruginosa PA01
ucacgcccugccccu

SEQ ID NO: 3477489 - RNA, 11 nt, Pseudomonas aeruginosa PA01
ucacgccgaag

SEQ ID NO: 3477490 - RNA, 18 nt, Pseudomonas aeruginosa PA01
ucacgccgagggcgcggc

SEQ ID NO: 3477491 - RNA, 17 nt, Pseudomonas aeruginosa PA01
ucacgccgaucccggcg

SEQ ID NO: 3477492 - RNA, 22 nt, Pseudomonas aeruginosa PA01
ucacgccgaucccggcggcgac

SEQ ID NO: 3477493 - RNA, 17 nt, Pseudomonas aeruginosa PA01
ucacgccgcgcaccagc

SEQ ID NO: 3477494 - RNA, 14 nt, Pseudomonas aeruginosa PA01
ucacgccggugaug

SEQ ID NO: 3477495 - RNA, 14 nt, Pseudomonas aeruginosa PA01
ucacgccuggcggc

SEQ ID NO: 3477496 - RNA, 24 nt, Pseudomonas aeruginosa PA01
ucacgcguugcgagggcucgggcg

SEQ ID NO: 3477497 - RNA, 14 nt, Pseudomonas aeruginosa PA01
ucacgcucggcaug

SEQ ID NO: 3477498 - RNA, 17 nt, Pseudomonas aeruginosa PA01
ucacgcugcucgcagcc

SEQ ID NO: 3477499 - RNA, 16 nt, Pseudomonas aeruginosa PA01
ucacgcuuuccggcuu

SEQ ID NO: 3477500 - RNA, 20 nt, Pseudomonas aeruginosa PA01
ucacggaacggguccuuggc

SEQ ID NO: 3477501 - RNA, 16 nt, Pseudomonas aeruginosa PA01
ucacggacccgcucgg

SEQ ID NO: 3477502 - RNA, 16 nt, Pseudomonas aeruginosa PA01
ucacggaugccgggcg

SEQ ID NO: 3477503 - RNA, 15 nt, Pseudomonas aeruginosa PA01
ucacggcauccuggc

SEQ ID NO: 3477504 - RNA, 18 nt, Pseudomonas aeruginosa PA01
ucacggccuccgguggcg

SEQ ID NO: 3477505 - RNA, 22 nt, Pseudomonas aeruginosa PA01
ucacggcgaaaccggccagcgc

SEQ ID NO: 3477506 - RNA, 15 nt, Pseudomonas aeruginosa PA01
ucacggcgaagcggc

SEQ ID NO: 3477507 - RNA, 15 nt, Pseudomonas aeruginosa PA01
ucacggcgcagccgc

SEQ ID NO: 3477508 - RNA, 14 nt, Pseudomonas aeruginosa PA01
ucacggcgccccgg

SEQ ID NO: 3477509 - RNA, 17 nt, Pseudomonas aeruginosa PA01
ucacggcggauaaccgc

SEQ ID NO: 3477510 - RNA, 21 nt, Pseudomonas aeruginosa PA01
ucacggcggauaaccgcgagc

SEQ ID NO: 3477511 - RNA, 15 nt, Pseudomonas aeruginosa PA01
ucacggcgugccgca

SEQ ID NO: 3477512 - RNA, 17 nt, Pseudomonas aeruginosa PA01
ucacggcgugccgcagg

SEQ ID NO: 3477513 - RNA, 19 nt, Pseudomonas aeruginosa PA01
ucacggguguuucggccgc

SEQ ID NO: 3477514 - RNA, 21 nt, Pseudomonas aeruginosa PA01
ucacggguguuucggccgcug

SEQ ID NO: 3477515 - RNA, 22 nt, Pseudomonas aeruginosa PA01
ucacggguguuucggccgcugc

SEQ ID NO: 3477516 - RNA, 16 nt, Pseudomonas aeruginosa PA01
ucacggucgcaggggc

SEQ ID NO: 3477517 - RNA, 18 nt, Pseudomonas aeruginosa PA01
ucacggucuuggcggcga

SEQ ID NO: 3477518 - RNA, 20 nt, Pseudomonas aeruginosa PA01
ucacggucuuggcggcgauc

SEQ ID NO: 3477519 - RNA, 21 nt, Pseudomonas aeruginosa PA01
ucacggucuuggcggcgaucg

SEQ ID NO: 3477520 - RNA, 23 nt, Pseudomonas aeruginosa PA01
ucacggucuuggcggcgaucgcc

SEQ ID NO: 3477521 - RNA, 18 nt, Pseudomonas aeruginosa PA01
ucacggugacggugcagc

SEQ ID NO: 3477522 - RNA, 22 nt, Pseudomonas aeruginosa PA01
ucacggugaugguaucgccguc

SEQ ID NO: 3477523 - RNA, 20 nt, Pseudomonas aeruginosa PA01
ucacggugccauccgcaguc

SEQ ID NO: 3477524 - RNA, 18 nt, Pseudomonas aeruginosa PA01
ucacguagcccccgccgc

SEQ ID NO: 3477525 - RNA, 20 nt, Pseudomonas aeruginosa PA01
ucacguagcccccgccgcug

SEQ ID NO: 3477526 - RNA, 17 nt, Pseudomonas aeruginosa PA01
ucacguaggagccggcc

SEQ ID NO: 3477527 - RNA, 21 nt, Pseudomonas aeruginosa PA01
ucacguaggagccggccaggc

SEQ ID NO: 3477528 - RNA, 18 nt, Pseudomonas aeruginosa PA01
ucacguaguugacccgcc

SEQ ID NO: 3477529 - RNA, 20 nt, Pseudomonas aeruginosa PA01
ucacguaguugacccgcccc

SEQ ID NO: 3477530 - RNA, 15 nt, Pseudomonas aeruginosa PA01
ucacguccggcgaga

SEQ ID NO: 3477531 - RNA, 19 nt, Pseudomonas aeruginosa PA01
ucacguccuugaccacgac

SEQ ID NO: 3477532 - RNA, 16 nt, Pseudomonas aeruginosa PA01
ucacgucgagcacgcc

SEQ ID NO: 3477533 - RNA, 19 nt, Pseudomonas aeruginosa PA01
ucacgucgaucugcucguc

SEQ ID NO: 3477534 - RNA, 13 nt, Pseudomonas aeruginosa PA01
ucacgucgcgcac

SEQ ID NO: 3477535 - RNA, 15 nt, Pseudomonas aeruginosa PA01
ucacgucgcgcaccu

SEQ ID NO: 3477536 - RNA, 16 nt, Pseudomonas aeruginosa PA01
ucacgucgcgcaccug

SEQ ID NO: 3477537 - RNA, 17 nt, Pseudomonas aeruginosa PA01
ucacgucguacucggcg

SEQ ID NO: 3477538 - RNA, 18 nt, Pseudomonas aeruginosa PA01
ucacucauccucgccgcu

SEQ ID NO: 3477539 - RNA, 15 nt, Pseudomonas aeruginosa PA01
ucacucgacaggcca

SEQ ID NO: 3477540 - RNA, 20 nt, Pseudomonas aeruginosa PA01
ucacucgacaggccauucuu

SEQ ID NO: 3477541 - RNA, 15 nt, Pseudomonas aeruginosa PA01
ucacucgccgccguc

SEQ ID NO: 3477542 - RNA, 18 nt, Pseudomonas aeruginosa PA01
ucacugccuggcaggucc

SEQ ID NO: 3477543 - RNA, 17 nt, Pseudomonas aeruginosa PA01
ucacuucacgacaggcg

SEQ ID NO: 3477544 - RNA, 21 nt, Pseudomonas aeruginosa PA01
ucacuucgcgcgggguggccg

SEQ ID NO: 3477545 - RNA, 16 nt, Pseudomonas aeruginosa PA01
ucacuugaggaagugc

SEQ ID NO: 3477546 - RNA, 20 nt, Pseudomonas aeruginosa PA01
ucagaacacacgaauggcuu

SEQ ID NO: 3477547 - RNA, 15 nt, Pseudomonas aeruginosa PA01
ucagaacagcggcag

SEQ ID NO: 3477548 - RNA, 17 nt, Pseudomonas aeruginosa PA01
ucagaacagcggcagcu

SEQ ID NO: 3477549 - RNA, 19 nt, Pseudomonas aeruginosa PA01
ucagaacagcggcagcuca

SEQ ID NO: 3477550 - RNA, 15 nt, Pseudomonas aeruginosa PA01
ucagaacugcucggc

SEQ ID NO: 3477551 - RNA, 17 nt, Pseudomonas aeruginosa PA01
ucagaacugcucggcgu

SEQ ID NO: 3477552 - RNA, 15 nt, Pseudomonas aeruginosa PA01
ucagaccagcccugg

SEQ ID NO: 3477553 - RNA, 17 nt, Pseudomonas aeruginosa PA01
ucagaccagcccuggcg

SEQ ID NO: 3477554 - RNA, 14 nt, Pseudomonas aeruginosa PA01
ucagacgcaccgag

SEQ ID NO: 3477555 - RNA, 17 nt, Pseudomonas aeruginosa PA01
ucagagcuggacgacgc

SEQ ID NO: 3477556 - RNA, 18 nt, Pseudomonas aeruginosa PA01
ucagaggcgaccagccgg

SEQ ID NO: 3477557 - RNA, 19 nt, Pseudomonas aeruginosa PA01
ucagaggcgaccagccggg

SEQ ID NO: 3477558 - RNA, 15 nt, Pseudomonas aeruginosa PA01
ucagagucgcaccgg

SEQ ID NO: 3477559 - RNA, 19 nt, Pseudomonas aeruginosa PA01
ucagaugcgguaggugcuc

SEQ ID NO: 3477560 - RNA, 16 nt, Pseudomonas aeruginosa PA01
ucagcaacucuuccag

SEQ ID NO: 3477561 - RNA, 17 nt, Pseudomonas aeruginosa PA01
ucagcaccagggccagg

SEQ ID NO: 3477562 - RNA, 19 nt, Pseudomonas aeruginosa PA01
ucagcaccagggccagggc

SEQ ID NO: 3477563 - RNA, 14 nt, Pseudomonas aeruginosa PA01
ucagcacccuggcc

SEQ ID NO: 3477564 - RNA, 17 nt, Pseudomonas aeruginosa PA01
ucagcacccuggccacg

SEQ ID NO: 3477565 - RNA, 16 nt, Pseudomonas aeruginosa PA01
ucagcaccgccaccag

SEQ ID NO: 3477566 - RNA, 18 nt, Pseudomonas aeruginosa PA01
ucagcaccugcgccgaag

SEQ ID NO: 3477567 - RNA, 18 nt, Pseudomonas aeruginosa PA01
ucagcaccuugugcugcc

SEQ ID NO: 3477568 - RNA, 22 nt, Pseudomonas aeruginosa PA01
ucagcacgccuuccagaucguc

SEQ ID NO: 3477569 - RNA, 21 nt, Pseudomonas aeruginosa PA01
ucagcacgucguccagcgccg

SEQ ID NO: 3477570 - RNA, 22 nt, Pseudomonas aeruginosa PA01
ucagcacuucggcgcgcggcag

SEQ ID NO: 3477571 - RNA, 11 nt, Pseudomonas aeruginosa PA01
ucagcagcacc

SEQ ID NO: 3477572 - RNA, 18 nt, Pseudomonas aeruginosa PA01
ucagcagcaccgcgagca

SEQ ID NO: 3477573 - RNA, 17 nt, Pseudomonas aeruginosa PA01
ucagcagcaccgcgcgc

SEQ ID NO: 3477574 - RNA, 13 nt, Pseudomonas aeruginosa PA01
ucagcagcaggcg

SEQ ID NO: 3477575 - RNA, 19 nt, Pseudomonas aeruginosa PA01
ucagcagcaugucgccggg

SEQ ID NO: 3477576 - RNA, 12 nt, Pseudomonas aeruginosa PA01
ucagcagcgcca

SEQ ID NO: 3477577 - RNA, 13 nt, Pseudomonas aeruginosa PA01
ucagcagcgccac

SEQ ID NO: 3477578 - RNA, 16 nt, Pseudomonas aeruginosa PA01
ucagcagcgccacgcu

SEQ ID NO: 3477579 - RNA, 14 nt, Pseudomonas aeruginosa PA01
ucagcagcgccagc

SEQ ID NO: 3477580 - RNA, 22 nt, Pseudomonas aeruginosa PA01
ucagcagcgccagcaggucgcg

SEQ ID NO: 3477581 - RNA, 16 nt, Pseudomonas aeruginosa PA01
ucagcagcgccgcccu

SEQ ID NO: 3477582 - RNA, 18 nt, Pseudomonas aeruginosa PA01
ucagcagcgccgcccugu

SEQ ID NO: 3477583 - RNA, 13 nt, Pseudomonas aeruginosa PA01
ucagcagcgggcg

SEQ ID NO: 3477584 - RNA, 20 nt, Pseudomonas aeruginosa PA01
ucagcagcgggcguccggcg

SEQ ID NO: 3477585 - RNA, 22 nt, Pseudomonas aeruginosa PA01
ucagcagcgggcguccggcgag

SEQ ID NO: 3477586 - RNA, 22 nt, Pseudomonas aeruginosa PA01
ucagcaggaauucgggaaggga

SEQ ID NO: 3477587 - RNA, 23 nt, Pseudomonas aeruginosa PA01
ucagcaggaugcagucggcaccg

SEQ ID NO: 3477588 - RNA, 23 nt, Pseudomonas aeruginosa PA01
ucagcaggcccgagccggacgag

SEQ ID NO: 3477589 - RNA, 20 nt, Pseudomonas aeruginosa PA01
ucagcaggccgaggucggcg

SEQ ID NO: 3477590 - RNA, 23 nt, Pseudomonas aeruginosa PA01
ucagcaggccgaggucggcggcg

SEQ ID NO: 3477591 - RNA, 14 nt, Pseudomonas aeruginosa PA01
ucagcagggucagg

SEQ ID NO: 3477592 - RNA, 18 nt, Pseudomonas aeruginosa PA01
ucagcaggucgcggcccc

SEQ ID NO: 3477593 - RNA, 19 nt, Pseudomonas aeruginosa PA01
ucagcaggucgcggugcag

SEQ ID NO: 3477594 - RNA, 15 nt, Pseudomonas aeruginosa PA01
ucagcagugcggggc

SEQ ID NO: 3477595 - RNA, 18 nt, Pseudomonas aeruginosa PA01
ucagccacggacgcgcag

SEQ ID NO: 3477596 - RNA, 18 nt, Pseudomonas aeruginosa PA01
ucagccacgggcgccagc

SEQ ID NO: 3477597 - RNA, 19 nt, Pseudomonas aeruginosa PA01
ucagccacgggcgccagcg

SEQ ID NO: 3477598 - RNA, 14 nt, Pseudomonas aeruginosa PA01
ucagccagaccggc

SEQ ID NO: 3477599 - RNA, 12 nt, Pseudomonas aeruginosa PA01
ucagccagccca

SEQ ID NO: 3477600 - RNA, 14 nt, Pseudomonas aeruginosa PA01
ucagccagcccagu

SEQ ID NO: 3477601 - RNA, 13 nt, Pseudomonas aeruginosa PA01
ucagccagccgag

SEQ ID NO: 3477602 - RNA, 17 nt, Pseudomonas aeruginosa PA01
ucagccagccgagcaac

SEQ ID NO: 3477603 - RNA, 13 nt, Pseudomonas aeruginosa PA01
ucagccagccggc

SEQ ID NO: 3477604 - RNA, 14 nt, Pseudomonas aeruginosa PA01
ucagccagccggcg

SEQ ID NO: 3477605 - RNA, 23 nt, Pseudomonas aeruginosa PA01
ucagccagggcaacgccaggcug

SEQ ID NO: 3477606 - RNA, 17 nt, Pseudomonas aeruginosa PA01
ucagccauagaguugcu

SEQ ID NO: 3477607 - RNA, 16 nt, Pseudomonas aeruginosa PA01
ucagccauuggccgac

SEQ ID NO: 3477608 - RNA, 22 nt, Pseudomonas aeruginosa PA01
ucagcccacccccagcccggcc

SEQ ID NO: 3477609 - RNA, 17 nt, Pseudomonas aeruginosa PA01
ucagcccacccccggcc

SEQ ID NO: 3477610 - RNA, 22 nt, Pseudomonas aeruginosa PA01
ucagcccacccccggcccggcc

SEQ ID NO: 3477611 - RNA, 16 nt, Pseudomonas aeruginosa PA01
ucagcccacgcgccug

SEQ ID NO: 3477612 - RNA, 17 nt, Pseudomonas aeruginosa PA01
ucagcccaggcgccgcu

SEQ ID NO: 3477613 - RNA, 18 nt, Pseudomonas aeruginosa PA01
ucagcccaggcgccgcuc

SEQ ID NO: 3477614 - RNA, 19 nt, Pseudomonas aeruginosa PA01
ucagcccauacaccaggcc

SEQ ID NO: 3477615 - RNA, 23 nt, Pseudomonas aeruginosa PA01
ucagcccauacaccaggccggcg

SEQ ID NO: 3477616 - RNA, 23 nt, Pseudomonas aeruginosa PA01
ucagccccagcacgccgagcaac

SEQ ID NO: 3477617 - RNA, 15 nt, Pseudomonas aeruginosa PA01
ucagccccgaucgcc

SEQ ID NO: 3477618 - RNA, 17 nt, Pseudomonas aeruginosa PA01
ucagccccgaucgccuc

SEQ ID NO: 3477619 - RNA, 20 nt, Pseudomonas aeruginosa PA01
ucagccccgaucgccucggc

SEQ ID NO: 3477620 - RNA, 16 nt, Pseudomonas aeruginosa PA01
ucagccccucgccauu

SEQ ID NO: 3477621 - RNA, 16 nt, Pseudomonas aeruginosa PA01
ucagccccucggccag

SEQ ID NO: 3477622 - RNA, 18 nt, Pseudomonas aeruginosa PA01
ucagcccgccgugcgcuc

SEQ ID NO: 3477623 - RNA, 21 nt, Pseudomonas aeruginosa PA01
ucagcccgccgugcgcuccgc

SEQ ID NO: 3477624 - RNA, 23 nt, Pseudomonas aeruginosa PA01
ucagcccgccgugcgcuccgcca

SEQ ID NO: 3477625 - RNA, 12 nt, Pseudomonas aeruginosa PA01
ucagcccgcuga

SEQ ID NO: 3477626 - RNA, 14 nt, Pseudomonas aeruginosa PA01
ucagcccgcugacc

SEQ ID NO: 3477627 - RNA, 13 nt, Pseudomonas aeruginosa PA01
ucagcccgucggc

SEQ ID NO: 3477628 - RNA, 20 nt, Pseudomonas aeruginosa PA01
ucagcccuucgcgcucgacg

SEQ ID NO: 3477629 - RNA, 18 nt, Pseudomonas aeruginosa PA01
ucagccgaggucgccgcc

SEQ ID NO: 3477630 - RNA, 21 nt, Pseudomonas aeruginosa PA01
ucagccgaugcucgcgccagc

SEQ ID NO: 3477631 - RNA, 15 nt, Pseudomonas aeruginosa PA01
ucagccgcaggccgu

SEQ ID NO: 3477632 - RNA, 20 nt, Pseudomonas aeruginosa PA01
ucagccgcgacgacugcggc

SEQ ID NO: 3477633 - RNA, 18 nt, Pseudomonas aeruginosa PA01
ucagccgcgacucggcug

SEQ ID NO: 3477634 - RNA, 14 nt, Pseudomonas aeruginosa PA01
ucagccgcgccggg

SEQ ID NO: 3477635 - RNA, 12 nt, Pseudomonas aeruginosa PA01
ucagccgcgcgc

SEQ ID NO: 3477636 - RNA, 19 nt, Pseudomonas aeruginosa PA01
ucagccgcggccggggaac

SEQ ID NO: 3477637 - RNA, 18 nt, Pseudomonas aeruginosa PA01
ucagccgcuccaggaucg

SEQ ID NO: 3477638 - RNA, 13 nt, Pseudomonas aeruginosa PA01
ucagccgcuggcg

SEQ ID NO: 3477639 - RNA, 16 nt, Pseudomonas aeruginosa PA01
ucagccgcuggcgucg

SEQ ID NO: 3477640 - RNA, 20 nt, Pseudomonas aeruginosa PA01
ucagccggcccauccgccgc

SEQ ID NO: 3477641 - RNA, 15 nt, Pseudomonas aeruginosa PA01
ucagccggccgaucu

SEQ ID NO: 3477642 - RNA, 22 nt, Pseudomonas aeruginosa PA01
ucagccguggcacccaggccac

SEQ ID NO: 3477643 - RNA, 14 nt, Pseudomonas aeruginosa PA01
ucagccuggccagc

SEQ ID NO: 3477644 - RNA, 20 nt, Pseudomonas aeruginosa PA01
ucagccuggggugcagcagg

SEQ ID NO: 3477645 - RNA, 21 nt, Pseudomonas aeruginosa PA01
ucagccuggucauccuggccc

SEQ ID NO: 3477646 - RNA, 22 nt, Pseudomonas aeruginosa PA01
ucagccuggucauccuggcccu

SEQ ID NO: 3477647 - RNA, 17 nt, Pseudomonas aeruginosa PA01
ucagcgaaauggucacc

SEQ ID NO: 3477648 - RNA, 23 nt, Pseudomonas aeruginosa PA01
ucagcgaguugaccuuggccaug

SEQ ID NO: 3477649 - RNA, 22 nt, Pseudomonas aeruginosa PA01
ucagcgauucccgaggguggcg

SEQ ID NO: 3477650 - RNA, 14 nt, Pseudomonas aeruginosa PA01
ucagcgcaccgccc

SEQ ID NO: 3477651 - RNA, 16 nt, Pseudomonas aeruginosa PA01
ucagcgcaugcggaag

SEQ ID NO: 3477652 - RNA, 19 nt, Pseudomonas aeruginosa PA01
ucagcgccagcaacccgcc

SEQ ID NO: 3477653 - RNA, 20 nt, Pseudomonas aeruginosa PA01
ucagcgccagcaacccgccc

SEQ ID NO: 3477654 - RNA, 14 nt, Pseudomonas aeruginosa PA01
ucagcgccagcagg

SEQ ID NO: 3477655 - RNA, 15 nt, Pseudomonas aeruginosa PA01
ucagcgccagcaggc

SEQ ID NO: 3477656 - RNA, 20 nt, Pseudomonas aeruginosa PA01
ucagcgccagcaggcgauac

SEQ ID NO: 3477657 - RNA, 13 nt, Pseudomonas aeruginosa PA01
ucagcgccagggc

SEQ ID NO: 3477658 - RNA, 13 nt, Pseudomonas aeruginosa PA01
ucagcgcccggca

SEQ ID NO: 3477659 - RNA, 14 nt, Pseudomonas aeruginosa PA01
ucagcgcccggcac

SEQ ID NO: 3477660 - RNA, 21 nt, Pseudomonas aeruginosa PA01
ucagcgcccggcugugcucga

SEQ ID NO: 3477661 - RNA, 22 nt, Pseudomonas aeruginosa PA01
ucagcgcccggcugugcucgac

SEQ ID NO: 3477662 - RNA, 16 nt, Pseudomonas aeruginosa PA01
ucagcgccgcucggcg

SEQ ID NO: 3477663 - RNA, 18 nt, Pseudomonas aeruginosa PA01
ucagcgccgcucggcgag

SEQ ID NO: 3477664 - RNA, 20 nt, Pseudomonas aeruginosa PA01
ucagcgccgcucggcgagcc

SEQ ID NO: 3477665 - RNA, 22 nt, Pseudomonas aeruginosa PA01
ucagcgccgcucggcgagccgc

SEQ ID NO: 3477666 - RNA, 19 nt, Pseudomonas aeruginosa PA01
ucagcgccgcuucuucccg

SEQ ID NO: 3477667 - RNA, 21 nt, Pseudomonas aeruginosa PA01
ucagcgccgcuucuucccgcc

SEQ ID NO: 3477668 - RNA, 22 nt, Pseudomonas aeruginosa PA01
ucagcgccgcuucuucccgccc

SEQ ID NO: 3477669 - RNA, 14 nt, Pseudomonas aeruginosa PA01
ucagcgccgggucg

SEQ ID NO: 3477670 - RNA, 17 nt, Pseudomonas aeruginosa PA01
ucagcgccgguagcggc

SEQ ID NO: 3477671 - RNA, 19 nt, Pseudomonas aeruginosa PA01
ucagcgccguugcggcagc

SEQ ID NO: 3477672 - RNA, 20 nt, Pseudomonas aeruginosa PA01
ucagcgccguugcggcagca

SEQ ID NO: 3477673 - RNA, 13 nt, Pseudomonas aeruginosa PA01
ucagcgccuccau

SEQ ID NO: 3477674 - RNA, 16 nt, Pseudomonas aeruginosa PA01
ucagcgccucgaccuc

SEQ ID NO: 3477675 - RNA, 20 nt, Pseudomonas aeruginosa PA01
ucagcgccucgaccucggcc

SEQ ID NO: 3477676 - RNA, 22 nt, Pseudomonas aeruginosa PA01
ucagcgccucgaccucggccgc

SEQ ID NO: 3477677 - RNA, 15 nt, Pseudomonas aeruginosa PA01
ucagcgccucgcggg

SEQ ID NO: 3477678 - RNA, 17 nt, Pseudomonas aeruginosa PA01
ucagcgccucggcgcag

SEQ ID NO: 3477679 - RNA, 23 nt, Pseudomonas aeruginosa PA01
ucagcgcgaaggccacgccgacg

SEQ ID NO: 3477680 - RNA, 13 nt, Pseudomonas aeruginosa PA01
ucagcgcgacagg

SEQ ID NO: 3477681 - RNA, 18 nt, Pseudomonas aeruginosa PA01
ucagcgcgacaggcuggc

SEQ ID NO: 3477682 - RNA, 16 nt, Pseudomonas aeruginosa PA01
ucagcgcgccccggcg

SEQ ID NO: 3477683 - RNA, 19 nt, Pseudomonas aeruginosa PA01
ucagcgcgccccggcgagc

SEQ ID NO: 3477684 - RNA, 15 nt, Pseudomonas aeruginosa PA01
ucagcgcgccuucga

SEQ ID NO: 3477685 - RNA, 22 nt, Pseudomonas aeruginosa PA01
ucagcgcgcguagcgugccgcc

SEQ ID NO: 3477686 - RNA, 15 nt, Pseudomonas aeruginosa PA01
ucagcgcgcucgcug

SEQ ID NO: 3477687 - RNA, 13 nt, Pseudomonas aeruginosa PA01
ucagcgcggccac

SEQ ID NO: 3477688 - RNA, 23 nt, Pseudomonas aeruginosa PA01
ucagcgcggccacuucguccggc

SEQ ID NO: 3477689 - RNA, 16 nt, Pseudomonas aeruginosa PA01
ucagcgcggcggcggc

SEQ ID NO: 3477690 - RNA, 20 nt, Pseudomonas aeruginosa PA01
ucagcgcguucaccccgccc

SEQ ID NO: 3477691 - RNA, 15 nt, Pseudomonas aeruginosa PA01
ucagcgcuuccaggg

SEQ ID NO: 3477692 - RNA, 18 nt, Pseudomonas aeruginosa PA01
ucagcgcuuccuugcccu

SEQ ID NO: 3477693 - RNA, 17 nt, Pseudomonas aeruginosa PA01
ucagcgcuugcuggcgc

SEQ ID NO: 3477694 - RNA, 23 nt, Pseudomonas aeruginosa PA01
ucagcgcuugcuggcgcgauccg

SEQ ID NO: 3477695 - RNA, 21 nt, Pseudomonas aeruginosa PA01
ucagcggacaaccgccguagc

SEQ ID NO: 3477696 - RNA, 15 nt, Pseudomonas aeruginosa PA01
ucagcggaccgguga

SEQ ID NO: 3477697 - RNA, 16 nt, Pseudomonas aeruginosa PA01
ucagcggaccggugag

SEQ ID NO: 3477698 - RNA, 22 nt, Pseudomonas aeruginosa PA01
ucagcggcacggucauggccag

SEQ ID NO: 3477699 - RNA, 20 nt, Pseudomonas aeruginosa PA01
ucagcggcccagcgccccgc

SEQ ID NO: 3477700 - RNA, 16 nt, Pseudomonas aeruginosa PA01
ucagcggcccgagcag

SEQ ID NO: 3477701 - RNA, 17 nt, Pseudomonas aeruginosa PA01
ucagcggcccgagcagg

SEQ ID NO: 3477702 - RNA, 18 nt, Pseudomonas aeruginosa PA01
ucagcggcccgagcaggc

SEQ ID NO: 3477703 - RNA, 18 nt, Pseudomonas aeruginosa PA01
ucagcggccgagcaggcg

SEQ ID NO: 3477704 - RNA, 21 nt, Pseudomonas aeruginosa PA01
ucagcggccgagcaggcgcgc

SEQ ID NO: 3477705 - RNA, 21 nt, Pseudomonas aeruginosa PA01
ucagcggcgcgucgaccacga

SEQ ID NO: 3477706 - RNA, 18 nt, Pseudomonas aeruginosa PA01
ucagcggcggucccauca

SEQ ID NO: 3477707 - RNA, 19 nt, Pseudomonas aeruginosa PA01
ucagcggcggugcgccggc

SEQ ID NO: 3477708 - RNA, 17 nt, Pseudomonas aeruginosa PA01
ucagcggcuggcgaugc

SEQ ID NO: 3477709 - RNA, 19 nt, Pseudomonas aeruginosa PA01
ucagcggcuggcgaugcug

SEQ ID NO: 3477710 - RNA, 15 nt, Pseudomonas aeruginosa PA01
ucagcgggccgaucc

SEQ ID NO: 3477711 - RNA, 22 nt, Pseudomonas aeruginosa PA01
ucagcgggccuuuucuuuggcg

SEQ ID NO: 3477712 - RNA, 15 nt, Pseudomonas aeruginosa PA01
ucagcgggcgcggua

SEQ ID NO: 3477713 - RNA, 22 nt, Pseudomonas aeruginosa PA01
ucagcgggcgcuugaagccggc

SEQ ID NO: 3477714 - RNA, 14 nt, Pseudomonas aeruginosa PA01
ucagcgggucgagc

SEQ ID NO: 3477715 - RNA, 17 nt, Pseudomonas aeruginosa PA01
ucagcgggucgagccag

SEQ ID NO: 3477716 - RNA, 18 nt, Pseudomonas aeruginosa PA01
ucagcgggucgagccagg

SEQ ID NO: 3477717 - RNA, 20 nt, Pseudomonas aeruginosa PA01
ucagcggguucuugccgcug

SEQ ID NO: 3477718 - RNA, 21 nt, Pseudomonas aeruginosa PA01
ucagcgguggcguugucggca

SEQ ID NO: 3477719 - RNA, 22 nt, Pseudomonas aeruginosa PA01
ucagcgguggcguugucggcaa

SEQ ID NO: 3477720 - RNA, 19 nt, Pseudomonas aeruginosa PA01
ucagcguagcuguucucuu

SEQ ID NO: 3477721 - RNA, 19 nt, Pseudomonas aeruginosa PA01
ucagcuccacgucggcccg

SEQ ID NO: 3477722 - RNA, 13 nt, Pseudomonas aeruginosa PA01
ucagcucccaggc

SEQ ID NO: 3477723 - RNA, 15 nt, Pseudomonas aeruginosa PA01
ucagcuccgagccac

SEQ ID NO: 3477724 - RNA, 17 nt, Pseudomonas aeruginosa PA01
ucagcucgaucagcccg

SEQ ID NO: 3477725 - RNA, 18 nt, Pseudomonas aeruginosa PA01
ucagcucgaucagcccgc

SEQ ID NO: 3477726 - RNA, 22 nt, Pseudomonas aeruginosa PA01
ucagcucgaucucauggucggg

SEQ ID NO: 3477727 - RNA, 19 nt, Pseudomonas aeruginosa PA01
ucagcucgcgguaggccag

SEQ ID NO: 3477728 - RNA, 20 nt, Pseudomonas aeruginosa PA01
ucagcucgcgguaggccagc

SEQ ID NO: 3477729 - RNA, 21 nt, Pseudomonas aeruginosa PA01
ucagcucgcgguaggccagcu

SEQ ID NO: 3477730 - RNA, 19 nt, Pseudomonas aeruginosa PA01
ucagcucggcaucgucgaa

SEQ ID NO: 3477731 - RNA, 22 nt, Pseudomonas aeruginosa PA01
ucagcucggcgaugccgccggg

SEQ ID NO: 3477732 - RNA, 13 nt, Pseudomonas aeruginosa PA01
ucagcucggcgua

SEQ ID NO: 3477733 - RNA, 13 nt, Pseudomonas aeruginosa PA01
ucagcucugucuc

SEQ ID NO: 3477734 - RNA, 14 nt, Pseudomonas aeruginosa PA01
ucagcucuuccagg

SEQ ID NO: 3477735 - RNA, 15 nt, Pseudomonas aeruginosa PA01
ucagcucuuccaggu

SEQ ID NO: 3477736 - RNA, 19 nt, Pseudomonas aeruginosa PA01
ucagcugagucgcuucacu

SEQ ID NO: 3477737 - RNA, 15 nt, Pseudomonas aeruginosa PA01
ucagcuggauagagu

SEQ ID NO: 3477738 - RNA, 22 nt, Pseudomonas aeruginosa PA01
ucagcuggauagaguacucggc

SEQ ID NO: 3477739 - RNA, 17 nt, Pseudomonas aeruginosa PA01
ucagcuggcgcgccucc

SEQ ID NO: 3477740 - RNA, 21 nt, Pseudomonas aeruginosa PA01
ucagcuucaggguggcgcugc

SEQ ID NO: 3477741 - RNA, 16 nt, Pseudomonas aeruginosa PA01
ucagcuucgccgcccu

SEQ ID NO: 3477742 - RNA, 19 nt, Pseudomonas aeruginosa PA01
ucagcuuguggucguggcg

SEQ ID NO: 3477743 - RNA, 18 nt, Pseudomonas aeruginosa PA01
ucaggaaauaaccggcgu

SEQ ID NO: 3477744 - RNA, 18 nt, Pseudomonas aeruginosa PA01
ucaggaacgaagaacccc

SEQ ID NO: 3477745 - RNA, 22 nt, Pseudomonas aeruginosa PA01
ucaggaacgaagaaccccggcu

SEQ ID NO: 3477746 - RNA, 17 nt, Pseudomonas aeruginosa PA01
ucaggaacgcgccacgg

SEQ ID NO: 3477747 - RNA, 17 nt, Pseudomonas aeruginosa PA01
ucaggaagguccaggcc

SEQ ID NO: 3477748 - RNA, 18 nt, Pseudomonas aeruginosa PA01
ucaggaagguccaggccc

SEQ ID NO: 3477749 - RNA, 19 nt, Pseudomonas aeruginosa PA01
ucaggaagguccaggccca

SEQ ID NO: 3477750 - RNA, 18 nt, Pseudomonas aeruginosa PA01
ucaggaaggucucgccgc

SEQ ID NO: 3477751 - RNA, 19 nt, Pseudomonas aeruginosa PA01
ucaggaaggucucgccgcc

SEQ ID NO: 3477752 - RNA, 22 nt, Pseudomonas aeruginosa PA01
ucaggacgagcguccgccgccg

SEQ ID NO: 3477753 - RNA, 15 nt, Pseudomonas aeruginosa PA01
ucaggacgcuacgcu

SEQ ID NO: 3477754 - RNA, 21 nt, Pseudomonas aeruginosa PA01
ucaggacgcuccugcgccggc

SEQ ID NO: 3477755 - RNA, 24 nt, Pseudomonas aeruginosa PA01
ucaggacgcuccugcgccggcucg

SEQ ID NO: 3477756 - RNA, 15 nt, Pseudomonas aeruginosa PA01
ucaggagcgccgcgc

SEQ ID NO: 3477757 - RNA, 14 nt, Pseudomonas aeruginosa PA01
ucaggaggaucgcc

SEQ ID NO: 3477758 - RNA, 22 nt, Pseudomonas aeruginosa PA01
ucaggagggaacgucuggccag

SEQ ID NO: 3477759 - RNA, 20 nt, Pseudomonas aeruginosa PA01
ucaggaguuucaucucggcg

SEQ ID NO: 3477760 - RNA, 21 nt, Pseudomonas aeruginosa PA01
ucaggaguuucaucucggcgc

SEQ ID NO: 3477761 - RNA, 23 nt, Pseudomonas aeruginosa PA01
ucaggaguuucaucucggcgcag

SEQ ID NO: 3477762 - RNA, 15 nt, Pseudomonas aeruginosa PA01
ucaggauagccggcg

SEQ ID NO: 3477763 - RNA, 16 nt, Pseudomonas aeruginosa PA01
ucaggauagccggcgc

SEQ ID NO: 3477764 - RNA, 13 nt, Pseudomonas aeruginosa PA01
ucaggaucacauc

SEQ ID NO: 3477765 - RNA, 16 nt, Pseudomonas aeruginosa PA01
ucaggaucacaucgcc

SEQ ID NO: 3477766 - RNA, 14 nt, Pseudomonas aeruginosa PA01
ucaggaucggcgcc

SEQ ID NO: 3477767 - RNA, 15 nt, Pseudomonas aeruginosa PA01
ucaggaucggcgccc

SEQ ID NO: 3477768 - RNA, 19 nt, Pseudomonas aeruginosa PA01
ucaggaucggcgcccagca

SEQ ID NO: 3477769 - RNA, 23 nt, Pseudomonas aeruginosa PA01
ucaggaugcgaugcugucagcgc

SEQ ID NO: 3477770 - RNA, 18 nt, Pseudomonas aeruginosa PA01
ucaggauguggccgucgc

SEQ ID NO: 3477771 - RNA, 19 nt, Pseudomonas aeruginosa PA01
ucaggauguggccgucgcg

SEQ ID NO: 3477772 - RNA, 22 nt, Pseudomonas aeruginosa PA01
ucaggauguugacgauggccca

SEQ ID NO: 3477773 - RNA, 19 nt, Pseudomonas aeruginosa PA01
ucaggcacucgaugaacag

SEQ ID NO: 3477774 - RNA, 19 nt, Pseudomonas aeruginosa PA01
ucaggcagcgaucgccgcc

SEQ ID NO: 3477775 - RNA, 20 nt, Pseudomonas aeruginosa PA01
ucaggcagcgaucgccgcca

SEQ ID NO: 3477776 - RNA, 16 nt, Pseudomonas aeruginosa PA01
ucaggcagcgcgcggc

SEQ ID NO: 3477777 - RNA, 18 nt, Pseudomonas aeruginosa PA01
ucaggcauccccggacca

SEQ ID NO: 3477778 - RNA, 14 nt, Pseudomonas aeruginosa PA01
ucaggcaugcgggc

SEQ ID NO: 3477779 - RNA, 16 nt, Pseudomonas aeruginosa PA01
ucaggccaagcaugaa

SEQ ID NO: 3477780 - RNA, 23 nt, Pseudomonas aeruginosa PA01
ucaggcccuugagggccucggcg

SEQ ID NO: 3477781 - RNA, 21 nt, Pseudomonas aeruginosa PA01
ucaggcccuuuuccaccggcc

SEQ ID NO: 3477782 - RNA, 22 nt, Pseudomonas aeruginosa PA01
ucaggccgaagcugucgagcac

SEQ ID NO: 3477783 - RNA, 14 nt, Pseudomonas aeruginosa PA01
ucaggccgaccagc

SEQ ID NO: 3477784 - RNA, 17 nt, Pseudomonas aeruginosa PA01
ucaggccgagcaccggc

SEQ ID NO: 3477785 - RNA, 18 nt, Pseudomonas aeruginosa PA01
ucaggccgagcaccggca

SEQ ID NO: 3477786 - RNA, 21 nt, Pseudomonas aeruginosa PA01
ucaggccgagcaccggcagga

SEQ ID NO: 3477787 - RNA, 14 nt, Pseudomonas aeruginosa PA01
ucaggccgagcagc

SEQ ID NO: 3477788 - RNA, 17 nt, Pseudomonas aeruginosa PA01
ucaggccgaggaugcuc

SEQ ID NO: 3477789 - RNA, 14 nt, Pseudomonas aeruginosa PA01
ucaggccgaggcgc

SEQ ID NO: 3477790 - RNA, 19 nt, Pseudomonas aeruginosa PA01
ucaggccgaggcgcuucug

SEQ ID NO: 3477791 - RNA, 21 nt, Pseudomonas aeruginosa PA01
ucaggccgaggcgcuucugcu

SEQ ID NO: 3477792 - RNA, 12 nt, Pseudomonas aeruginosa PA01
ucaggccgaggg

SEQ ID NO: 3477793 - RNA, 15 nt, Pseudomonas aeruginosa PA01
ucaggccgagggcug

SEQ ID NO: 3477794 - RNA, 21 nt, Pseudomonas aeruginosa PA01
ucaggccgagggcugccgccc

SEQ ID NO: 3477795 - RNA, 19 nt, Pseudomonas aeruginosa PA01
ucaggccgaguccgcgcgc

SEQ ID NO: 3477796 - RNA, 18 nt, Pseudomonas aeruginosa PA01
ucaggccgaucaccacca

SEQ ID NO: 3477797 - RNA, 20 nt, Pseudomonas aeruginosa PA01
ucaggccgaucaccaccagc

SEQ ID NO: 3477798 - RNA, 21 nt, Pseudomonas aeruginosa PA01
ucaggccgaucaccaccagcg

SEQ ID NO: 3477799 - RNA, 15 nt, Pseudomonas aeruginosa PA01
ucaggccggcgccgc

SEQ ID NO: 3477800 - RNA, 19 nt, Pseudomonas aeruginosa PA01
ucaggccggcgccgccgaa

SEQ ID NO: 3477801 - RNA, 20 nt, Pseudomonas aeruginosa PA01
ucaggccggcgccgccgaac

SEQ ID NO: 3477802 - RNA, 22 nt, Pseudomonas aeruginosa PA01
ucaggccggcgcgauccuggcg

SEQ ID NO: 3477803 - RNA, 17 nt, Pseudomonas aeruginosa PA01
ucaggccgggcaccccg

SEQ ID NO: 3477804 - RNA, 17 nt, Pseudomonas aeruginosa PA01
ucaggccgggcaggccg

SEQ ID NO: 3477805 - RNA, 21 nt, Pseudomonas aeruginosa PA01
ucaggccgggcaggccgaggc

SEQ ID NO: 3477806 - RNA, 17 nt, Pseudomonas aeruginosa PA01
ucaggccuggcgcaaca

SEQ ID NO: 3477807 - RNA, 18 nt, Pseudomonas aeruginosa PA01
ucaggccuugcgcggcgc

SEQ ID NO: 3477808 - RNA, 17 nt, Pseudomonas aeruginosa PA01
ucaggcgaaccuggaga

SEQ ID NO: 3477809 - RNA, 17 nt, Pseudomonas aeruginosa PA01
ucaggcgacgccgcgcu

SEQ ID NO: 3477810 - RNA, 18 nt, Pseudomonas aeruginosa PA01
ucaggcgacgccgcgcug

SEQ ID NO: 3477811 - RNA, 19 nt, Pseudomonas aeruginosa PA01
ucaggcgacgccgcgcugc

SEQ ID NO: 3477812 - RNA, 19 nt, Pseudomonas aeruginosa PA01
ucaggcgcaguaacgccug

SEQ ID NO: 3477813 - RNA, 13 nt, Pseudomonas aeruginosa PA01
ucaggcgccggcc

SEQ ID NO: 3477814 - RNA, 13 nt, Pseudomonas aeruginosa PA01
ucaggcgcgcggc

SEQ ID NO: 3477815 - RNA, 14 nt, Pseudomonas aeruginosa PA01
ucaggcgcggauac

SEQ ID NO: 3477816 - RNA, 15 nt, Pseudomonas aeruginosa PA01
ucaggcgcuccgggc

SEQ ID NO: 3477817 - RNA, 21 nt, Pseudomonas aeruginosa PA01
ucaggcgcuccgggcuccacc

SEQ ID NO: 3477818 - RNA, 16 nt, Pseudomonas aeruginosa PA01
ucaggcgcugcgcggc

SEQ ID NO: 3477819 - RNA, 19 nt, Pseudomonas aeruginosa PA01
ucaggcgcugcgcggccug

SEQ ID NO: 3477820 - RNA, 19 nt, Pseudomonas aeruginosa PA01
ucaggcggcacucggcgac

SEQ ID NO: 3477821 - RNA, 20 nt, Pseudomonas aeruginosa PA01
ucaggcggcacucggcgacc

SEQ ID NO: 3477822 - RNA, 17 nt, Pseudomonas aeruginosa PA01
ucaggcgggcgucgucg

SEQ ID NO: 3477823 - RNA, 17 nt, Pseudomonas aeruginosa PA01
ucaggcgggcuccgccg

SEQ ID NO: 3477824 - RNA, 18 nt, Pseudomonas aeruginosa PA01
ucaggcgggcuccgccgc

SEQ ID NO: 3477825 - RNA, 19 nt, Pseudomonas aeruginosa PA01
ucaggcgggcuccgccgcc

SEQ ID NO: 3477826 - RNA, 17 nt, Pseudomonas aeruginosa PA01
ucaggcguacgucgaua

SEQ ID NO: 3477827 - RNA, 17 nt, Pseudomonas aeruginosa PA01
ucaggcguaggccgucg

SEQ ID NO: 3477828 - RNA, 16 nt, Pseudomonas aeruginosa PA01
ucaggcgucccgcucc

SEQ ID NO: 3477829 - RNA, 18 nt, Pseudomonas aeruginosa PA01
ucaggcgugggccagccc

SEQ ID NO: 3477830 - RNA, 20 nt, Pseudomonas aeruginosa PA01
ucaggcgugggccagcccag

SEQ ID NO: 3477831 - RNA, 20 nt, Pseudomonas aeruginosa PA01
ucaggcguucgucguggcca

SEQ ID NO: 3477832 - RNA, 12 nt, Pseudomonas aeruginosa PA01
ucaggcucagcu

SEQ ID NO: 3477833 - RNA, 17 nt, Pseudomonas aeruginosa PA01
ucaggcucagcucggcg

SEQ ID NO: 3477834 - RNA, 13 nt, Pseudomonas aeruginosa PA01
ucaggcucaggcg

SEQ ID NO: 3477835 - RNA, 18 nt, Pseudomonas aeruginosa PA01
ucaggcucuuugcgacug

SEQ ID NO: 3477836 - RNA, 23 nt, Pseudomonas aeruginosa PA01
ucaggcugacgucgacgcagcgc

SEQ ID NO: 3477837 - RNA, 14 nt, Pseudomonas aeruginosa PA01
ucaggcugccgagc

SEQ ID NO: 3477838 - RNA, 15 nt, Pseudomonas aeruginosa PA01
ucaggcugccgagca

SEQ ID NO: 3477839 - RNA, 18 nt, Pseudomonas aeruginosa PA01
ucaggcugccgagcaggg

SEQ ID NO: 3477840 - RNA, 21 nt, Pseudomonas aeruginosa PA01
ucaggcugccgagcaggguca

SEQ ID NO: 3477841 - RNA, 14 nt, Pseudomonas aeruginosa PA01
ucaggcugcgcacc

SEQ ID NO: 3477842 - RNA, 16 nt, Pseudomonas aeruginosa PA01
ucaggcugcgcaccuc

SEQ ID NO: 3477843 - RNA, 22 nt, Pseudomonas aeruginosa PA01
ucaggcugcgcaccucggccag

SEQ ID NO: 3477844 - RNA, 15 nt, Pseudomonas aeruginosa PA01
ucaggcugcggcgga

SEQ ID NO: 3477845 - RNA, 21 nt, Pseudomonas aeruginosa PA01
ucaggcugggguugcggcgcc

SEQ ID NO: 3477846 - RNA, 17 nt, Pseudomonas aeruginosa PA01
ucaggcuggugccgcug

SEQ ID NO: 3477847 - RNA, 20 nt, Pseudomonas aeruginosa PA01
ucaggcugguggucaccgcc

SEQ ID NO: 3477848 - RNA, 22 nt, Pseudomonas aeruginosa PA01
ucaggcugguggucaccgccag

SEQ ID NO: 3477849 - RNA, 20 nt, Pseudomonas aeruginosa PA01
ucaggcuguagccucccgcc

SEQ ID NO: 3477850 - RNA, 15 nt, Pseudomonas aeruginosa PA01
ucaggcuguccacgc

SEQ ID NO: 3477851 - RNA, 16 nt, Pseudomonas aeruginosa PA01
ucaggcugugcaggaa

SEQ ID NO: 3477852 - RNA, 22 nt, Pseudomonas aeruginosa PA01
ucaggcugugcaggaaggcgac

SEQ ID NO: 3477853 - RNA, 19 nt, Pseudomonas aeruginosa PA01
ucagggaagaugcacacca

SEQ ID NO: 3477854 - RNA, 22 nt, Pseudomonas aeruginosa PA01
ucagggaagaugcacaccagcu

SEQ ID NO: 3477855 - RNA, 21 nt, Pseudomonas aeruginosa PA01
ucagggaauggaugcgcggca

SEQ ID NO: 3477856 - RNA, 22 nt, Pseudomonas aeruginosa PA01
ucagggacaccccgucucgcug

SEQ ID NO: 3477857 - RNA, 18 nt, Pseudomonas aeruginosa PA01
ucagggacaugucgaggg

SEQ ID NO: 3477858 - RNA, 13 nt, Pseudomonas aeruginosa PA01
ucagggcaccgcc

SEQ ID NO: 3477859 - RNA, 12 nt, Pseudomonas aeruginosa PA01
ucagggccacgc

SEQ ID NO: 3477860 - RNA, 12 nt, Pseudomonas aeruginosa PA01
ucagggccgcgc

SEQ ID NO: 3477861 - RNA, 23 nt, Pseudomonas aeruginosa PA01
ucagggccgcgccgagccggcug

SEQ ID NO: 3477862 - RNA, 16 nt, Pseudomonas aeruginosa PA01
ucagggccucgccacg

SEQ ID NO: 3477863 - RNA, 17 nt, Pseudomonas aeruginosa PA01
ucagggccucgccacgc

SEQ ID NO: 3477864 - RNA, 14 nt, Pseudomonas aeruginosa PA01
ucagggcgagcagg

SEQ ID NO: 3477865 - RNA, 18 nt, Pseudomonas aeruginosa PA01
ucagggcgagcagggcac

SEQ ID NO: 3477866 - RNA, 19 nt, Pseudomonas aeruginosa PA01
ucagggcgcgaaguagcgg

SEQ ID NO: 3477867 - RNA, 19 nt, Pseudomonas aeruginosa PA01
ucagggcuugcgcgccacc

SEQ ID NO: 3477868 - RNA, 18 nt, Pseudomonas aeruginosa PA01
ucaggggccgacgcgcug

SEQ ID NO: 3477869 - RNA, 14 nt, Pseudomonas aeruginosa PA01
ucagggucggcccg

SEQ ID NO: 3477870 - RNA, 20 nt, Pseudomonas aeruginosa PA01
ucagggucggcccggagacc

SEQ ID NO: 3477871 - RNA, 16 nt, Pseudomonas aeruginosa PA01
ucagggucucgcgggc

SEQ ID NO: 3477872 - RNA, 23 nt, Pseudomonas aeruginosa PA01
ucagggugaucuguucgaccagu

SEQ ID NO: 3477873 - RNA, 14 nt, Pseudomonas aeruginosa PA01
ucaggguggcgacc

SEQ ID NO: 3477874 - RNA, 17 nt, Pseudomonas aeruginosa PA01
ucaggguggcgaucacg

SEQ ID NO: 3477875 - RNA, 17 nt, Pseudomonas aeruginosa PA01
ucagguaaggcaccacc

SEQ ID NO: 3477876 - RNA, 14 nt, Pseudomonas aeruginosa PA01
ucagguacaggcgg

SEQ ID NO: 3477877 - RNA, 17 nt, Pseudomonas aeruginosa PA01
ucagguaggcgcgggcg

SEQ ID NO: 3477878 - RNA, 23 nt, Pseudomonas aeruginosa PA01
ucagguaggcgcgggcguagccu

SEQ ID NO: 3477879 - RNA, 17 nt, Pseudomonas aeruginosa PA01
ucagguagucgcccggc

SEQ ID NO: 3477880 - RNA, 17 nt, Pseudomonas aeruginosa PA01
ucagguauucgccggcc

SEQ ID NO: 3477881 - RNA, 23 nt, Pseudomonas aeruginosa PA01
ucagguccaccagccaguagucu

SEQ ID NO: 3477882 - RNA, 16 nt, Pseudomonas aeruginosa PA01
ucagguccuugaucac

SEQ ID NO: 3477883 - RNA, 17 nt, Pseudomonas aeruginosa PA01
ucagguccuugaucacg

SEQ ID NO: 3477884 - RNA, 16 nt, Pseudomonas aeruginosa PA01
ucagguccuuguuccu

SEQ ID NO: 3477885 - RNA, 21 nt, Pseudomonas aeruginosa PA01
ucaggucgaacugcacccgcc

SEQ ID NO: 3477886 - RNA, 16 nt, Pseudomonas aeruginosa PA01
ucaggucgacgccgcc

SEQ ID NO: 3477887 - RNA, 17 nt, Pseudomonas aeruginosa PA01
ucaggucgaggccgcgg

SEQ ID NO: 3477888 - RNA, 15 nt, Pseudomonas aeruginosa PA01
ucaggucgccagcgc

SEQ ID NO: 3477889 - RNA, 16 nt, Pseudomonas aeruginosa PA01
ucaggucgccagcgcc

SEQ ID NO: 3477890 - RNA, 12 nt, Pseudomonas aeruginosa PA01
ucaggucgccgc

SEQ ID NO: 3477891 - RNA, 13 nt, Pseudomonas aeruginosa PA01
ucaggucgccgcc

SEQ ID NO: 3477892 - RNA, 14 nt, Pseudomonas aeruginosa PA01
ucaggucgccgcug

SEQ ID NO: 3477893 - RNA, 20 nt, Pseudomonas aeruginosa PA01
ucaggucgcgcgccuucagc

SEQ ID NO: 3477894 - RNA, 13 nt, Pseudomonas aeruginosa PA01
ucaggucggccgc

SEQ ID NO: 3477895 - RNA, 15 nt, Pseudomonas aeruginosa PA01
ucaggucggcgccug

SEQ ID NO: 3477896 - RNA, 18 nt, Pseudomonas aeruginosa PA01
ucaggucggcgcgcaccu

SEQ ID NO: 3477897 - RNA, 18 nt, Pseudomonas aeruginosa PA01
ucaggucggucuggcggc

SEQ ID NO: 3477898 - RNA, 20 nt, Pseudomonas aeruginosa PA01
ucaggucggucuggcggccc

SEQ ID NO: 3477899 - RNA, 16 nt, Pseudomonas aeruginosa PA01
ucaggucgucgggcag

SEQ ID NO: 3477900 - RNA, 22 nt, Pseudomonas aeruginosa PA01
ucaggugcguacuuggcccggc

SEQ ID NO: 3477901 - RNA, 15 nt, Pseudomonas aeruginosa PA01
ucagguucggcagcg

SEQ ID NO: 3477902 - RNA, 14 nt, Pseudomonas aeruginosa PA01
ucagguugccggcg

SEQ ID NO: 3477903 - RNA, 17 nt, Pseudomonas aeruginosa PA01
ucagguugccggcgugc

SEQ ID NO: 3477904 - RNA, 12 nt, Pseudomonas aeruginosa PA01
ucaguaccugca

SEQ ID NO: 3477905 - RNA, 23 nt, Pseudomonas aeruginosa PA01
ucaguagcggcaggguacggguc

SEQ ID NO: 3477906 - RNA, 21 nt, Pseudomonas aeruginosa PA01
ucagucccuugaucagcgcgc

SEQ ID NO: 3477907 - RNA, 17 nt, Pseudomonas aeruginosa PA01
ucagucgucguccagcg

SEQ ID NO: 3477908 - RNA, 22 nt, Pseudomonas aeruginosa PA01
ucagugagccccggcgucggcg

SEQ ID NO: 3477909 - RNA, 15 nt, Pseudomonas aeruginosa PA01
ucagugcaucggccg

SEQ ID NO: 3477910 - RNA, 19 nt, Pseudomonas aeruginosa PA01
ucagugcaucggccgccag

SEQ ID NO: 3477911 - RNA, 21 nt, Pseudomonas aeruginosa PA01
ucagugcgggcaguccuggcg

SEQ ID NO: 3477912 - RNA, 23 nt, Pseudomonas aeruginosa PA01
ucagugcgggcaguccuggcggu

SEQ ID NO: 3477913 - RNA, 14 nt, Pseudomonas aeruginosa PA01
ucaguucagccggu

SEQ ID NO: 3477914 - RNA, 17 nt, Pseudomonas aeruginosa PA01
ucaguuccucgcggaag

SEQ ID NO: 3477915 - RNA, 17 nt, Pseudomonas aeruginosa PA01
ucaguucggugccgccg

SEQ ID NO: 3477916 - RNA, 22 nt, Pseudomonas aeruginosa PA01
ucaguucgugccaggcgacauc

SEQ ID NO: 3477917 - RNA, 18 nt, Pseudomonas aeruginosa PA01
ucaguucguugggccgga

SEQ ID NO: 3477918 - RNA, 20 nt, Pseudomonas aeruginosa PA01
ucaguucguugggccggaac

SEQ ID NO: 3477919 - RNA, 14 nt, Pseudomonas aeruginosa PA01
ucaguucugggcgg

SEQ ID NO: 3477920 - RNA, 13 nt, Pseudomonas aeruginosa PA01
ucaguugcgcgcg

SEQ ID NO: 3477921 - RNA, 21 nt, Pseudomonas aeruginosa PA01
ucauacgaaaaaaaggcgcug

SEQ ID NO: 3477922 - RNA, 20 nt, Pseudomonas aeruginosa PA01
ucauagcucagcuggauaga

SEQ ID NO: 3477923 - RNA, 20 nt, Pseudomonas aeruginosa PA01
ucauauggccucuugaaaac

SEQ ID NO: 3477924 - RNA, 12 nt, Pseudomonas aeruginosa PA01
ucaucaccagcu

SEQ ID NO: 3477925 - RNA, 13 nt, Pseudomonas aeruginosa PA01
ucaucaccggcag

SEQ ID NO: 3477926 - RNA, 19 nt, Pseudomonas aeruginosa PA01
ucaucaccuucgccagcag

SEQ ID NO: 3477927 - RNA, 13 nt, Pseudomonas aeruginosa PA01
ucaucacgcuuuc

SEQ ID NO: 3477928 - RNA, 13 nt, Pseudomonas aeruginosa PA01
ucaucaggaucag

SEQ ID NO: 3477929 - RNA, 13 nt, Pseudomonas aeruginosa PA01
ucaucaggcgcuu

SEQ ID NO: 3477930 - RNA, 12 nt, Pseudomonas aeruginosa PA01
ucaucaggcuca

SEQ ID NO: 3477931 - RNA, 16 nt, Pseudomonas aeruginosa PA01
ucaucaggcugccgag

SEQ ID NO: 3477932 - RNA, 16 nt, Pseudomonas aeruginosa PA01
ucaucaggcugcuguc

SEQ ID NO: 3477933 - RNA, 18 nt, Pseudomonas aeruginosa PA01
ucauccacaggcggcuca

SEQ ID NO: 3477934 - RNA, 13 nt, Pseudomonas aeruginosa PA01
ucauccagccccc

SEQ ID NO: 3477935 - RNA, 16 nt, Pseudomonas aeruginosa PA01
ucaucccgguuuccgc

SEQ ID NO: 3477936 - RNA, 21 nt, Pseudomonas aeruginosa PA01
ucaucccguagaugugcuggg

SEQ ID NO: 3477937 - RNA, 21 nt, Pseudomonas aeruginosa PA01
ucauccgcccugcgucgcaga

SEQ ID NO: 3477938 - RNA, 13 nt, Pseudomonas aeruginosa PA01
ucauccgccggcg

SEQ ID NO: 3477939 - RNA, 22 nt, Pseudomonas aeruginosa PA01
ucauccgcugguagcccaggcc

SEQ ID NO: 3477940 - RNA, 17 nt, Pseudomonas aeruginosa PA01
ucauccgucccagcaau

SEQ ID NO: 3477941 - RNA, 18 nt, Pseudomonas aeruginosa PA01
ucauccucgccgcuggcg

SEQ ID NO: 3477942 - RNA, 23 nt, Pseudomonas aeruginosa PA01
ucauccugcgcgccucuuccugg

SEQ ID NO: 3477943 - RNA, 16 nt, Pseudomonas aeruginosa PA01
ucaucgagcaguucca

SEQ ID NO: 3477944 - RNA, 15 nt, Pseudomonas aeruginosa PA01
ucaucgagcggcggc

SEQ ID NO: 3477945 - RNA, 17 nt, Pseudomonas aeruginosa PA01
ucaucgagcggcggccg

SEQ ID NO: 3477946 - RNA, 21 nt, Pseudomonas aeruginosa PA01
ucaucgcacggucguccugcg

SEQ ID NO: 3477947 - RNA, 14 nt, Pseudomonas aeruginosa PA01
ucaucgccaccggu

SEQ ID NO: 3477948 - RNA, 13 nt, Pseudomonas aeruginosa PA01
ucaucgccagcgg

SEQ ID NO: 3477949 - RNA, 20 nt, Pseudomonas aeruginosa PA01
ucaucgcccgcccucgucgc

SEQ ID NO: 3477950 - RNA, 16 nt, Pseudomonas aeruginosa PA01
ucaucgccgccaggca

SEQ ID NO: 3477951 - RNA, 12 nt, Pseudomonas aeruginosa PA01
ucaucgccggcg

SEQ ID NO: 3477952 - RNA, 12 nt, Pseudomonas aeruginosa PA01
ucaucgcgccgc

SEQ ID NO: 3477953 - RNA, 12 nt, Pseudomonas aeruginosa PA01
ucaucggcccga

SEQ ID NO: 3477954 - RNA, 15 nt, Pseudomonas aeruginosa PA01
ucaucggcccgacgc

SEQ ID NO: 3477955 - RNA, 19 nt, Pseudomonas aeruginosa PA01
ucaucggcccgacgccgcc

SEQ ID NO: 3477956 - RNA, 23 nt, Pseudomonas aeruginosa PA01
ucaucggcccgacgccgcccggc

SEQ ID NO: 3477957 - RNA, 16 nt, Pseudomonas aeruginosa PA01
ucaucggcggcaggcc

SEQ ID NO: 3477958 - RNA, 18 nt, Pseudomonas aeruginosa PA01
ucaucggcuggccgaggg

SEQ ID NO: 3477959 - RNA, 18 nt, Pseudomonas aeruginosa PA01
ucaucggcuggucgucgc

SEQ ID NO: 3477960 - RNA, 14 nt, Pseudomonas aeruginosa PA01
ucaucguccagcuc

SEQ ID NO: 3477961 - RNA, 21 nt, Pseudomonas aeruginosa PA01
ucaucgucggcagccaucgca

SEQ ID NO: 3477962 - RNA, 19 nt, Pseudomonas aeruginosa PA01
ucaucucagcaacccgcuc

SEQ ID NO: 3477963 - RNA, 15 nt, Pseudomonas aeruginosa PA01
ucaucucgccgucgg

SEQ ID NO: 3477964 - RNA, 15 nt, Pseudomonas aeruginosa PA01
ucaucucggcgcagg

SEQ ID NO: 3477965 - RNA, 17 nt, Pseudomonas aeruginosa PA01
ucaucucuucguugaug

SEQ ID NO: 3477966 - RNA, 20 nt, Pseudomonas aeruginosa PA01
ucaucugaccuuucaccggu

SEQ ID NO: 3477967 - RNA, 11 nt, Pseudomonas aeruginosa PA01
ucaucugcacc

SEQ ID NO: 3477968 - RNA, 22 nt, Pseudomonas aeruginosa PA01
ucaucugggccaucgccggccc

SEQ ID NO: 3477969 - RNA, 15 nt, Pseudomonas aeruginosa PA01
ucaugaaagccagca

SEQ ID NO: 3477970 - RNA, 18 nt, Pseudomonas aeruginosa PA01
ucaugaccagagccgccg

SEQ ID NO: 3477971 - RNA, 21 nt, Pseudomonas aeruginosa PA01
ucaugagguucaggccgggca

SEQ ID NO: 3477972 - RNA, 15 nt, Pseudomonas aeruginosa PA01
ucaugaucugguaga

SEQ ID NO: 3477973 - RNA, 20 nt, Pseudomonas aeruginosa PA01
ucaugaugcgcccggagcuu

SEQ ID NO: 3477974 - RNA, 16 nt, Pseudomonas aeruginosa PA01
ucaugcaggccgaagc

SEQ ID NO: 3477975 - RNA, 21 nt, Pseudomonas aeruginosa PA01
ucaugcccagcuucaccggug

SEQ ID NO: 3477976 - RNA, 18 nt, Pseudomonas aeruginosa PA01
ucaugcccagcuuggcca

SEQ ID NO: 3477977 - RNA, 14 nt, Pseudomonas aeruginosa PA01
ucaugcccuggccg

SEQ ID NO: 3477978 - RNA, 18 nt, Pseudomonas aeruginosa PA01
ucaugcccuggccgacgc

SEQ ID NO: 3477979 - RNA, 21 nt, Pseudomonas aeruginosa PA01
ucaugcccuggccgacgcuga

SEQ ID NO: 3477980 - RNA, 17 nt, Pseudomonas aeruginosa PA01
ucaugccgaacuucucc

SEQ ID NO: 3477981 - RNA, 19 nt, Pseudomonas aeruginosa PA01
ucaugccgccaucgaccag

SEQ ID NO: 3477982 - RNA, 20 nt, Pseudomonas aeruginosa PA01
ucaugccgccaucgaccagg

SEQ ID NO: 3477983 - RNA, 19 nt, Pseudomonas aeruginosa PA01
ucaugccgccgucgcggcc

SEQ ID NO: 3477984 - RNA, 11 nt, Pseudomonas aeruginosa PA01
ucaugcgcggg

SEQ ID NO: 3477985 - RNA, 16 nt, Pseudomonas aeruginosa PA01
ucaugcugcgcgggac

SEQ ID NO: 3477986 - RNA, 16 nt, Pseudomonas aeruginosa PA01
ucauggaacagcagcc

SEQ ID NO: 3477987 - RNA, 18 nt, Pseudomonas aeruginosa PA01
ucauggaacagcagccag

SEQ ID NO: 3477988 - RNA, 19 nt, Pseudomonas aeruginosa PA01
ucauggaacagcagccagg

SEQ ID NO: 3477989 - RNA, 20 nt, Pseudomonas aeruginosa PA01
ucauggaacagcagccaggc

SEQ ID NO: 3477990 - RNA, 19 nt, Pseudomonas aeruginosa PA01
ucauggaacugcagggcau

SEQ ID NO: 3477991 - RNA, 14 nt, Pseudomonas aeruginosa PA01
ucauggcauggcca

SEQ ID NO: 3477992 - RNA, 19 nt, Pseudomonas aeruginosa PA01
ucauggccagcucgaccuu

SEQ ID NO: 3477993 - RNA, 21 nt, Pseudomonas aeruginosa PA01
ucauggccaggucagccaccu

SEQ ID NO: 3477994 - RNA, 22 nt, Pseudomonas aeruginosa PA01
ucauggccaggucagccaccug

SEQ ID NO: 3477995 - RNA, 15 nt, Pseudomonas aeruginosa PA01
ucauggccuggcgcu

SEQ ID NO: 3477996 - RNA, 19 nt, Pseudomonas aeruginosa PA01
ucauggcgcacgccgcgga

SEQ ID NO: 3477997 - RNA, 20 nt, Pseudomonas aeruginosa PA01
ucauggcgccacucggcgug

SEQ ID NO: 3477998 - RNA, 21 nt, Pseudomonas aeruginosa PA01
ucauggcggcaucaguagcgg

SEQ ID NO: 3477999 - RNA, 13 nt, Pseudomonas aeruginosa PA01
ucauggcguccgg

SEQ ID NO: 3478000 - RNA, 14 nt, Pseudomonas aeruginosa PA01
ucaugggcgcgcgc

SEQ ID NO: 3478001 - RNA, 17 nt, Pseudomonas aeruginosa PA01
ucaugggcgcgcgccgg

SEQ ID NO: 3478002 - RNA, 14 nt, Pseudomonas aeruginosa PA01
ucaugggggccagc

SEQ ID NO: 3478003 - RNA, 18 nt, Pseudomonas aeruginosa PA01
ucaugggucgauugcugg

SEQ ID NO: 3478004 - RNA, 21 nt, Pseudomonas aeruginosa PA01
ucaugggugaagaccagucgg

SEQ ID NO: 3478005 - RNA, 14 nt, Pseudomonas aeruginosa PA01
ucauggucgggcag

SEQ ID NO: 3478006 - RNA, 15 nt, Pseudomonas aeruginosa PA01
ucauggugaagccca

SEQ ID NO: 3478007 - RNA, 17 nt, Pseudomonas aeruginosa PA01
ucauggugaagcccacc

SEQ ID NO: 3478008 - RNA, 21 nt, Pseudomonas aeruginosa PA01
ucauggugaagcccaccacca

SEQ ID NO: 3478009 - RNA, 17 nt, Pseudomonas aeruginosa PA01
ucauguucaguucggcg

SEQ ID NO: 3478010 - RNA, 20 nt, Pseudomonas aeruginosa PA01
ucauuacgaaugagcugcuc

SEQ ID NO: 3478011 - RNA, 23 nt, Pseudomonas aeruginosa PA01
ucauugaaaucaucggcccuggg

SEQ ID NO: 3478012 - RNA, 16 nt, Pseudomonas aeruginosa PA01
ucauugcgccgccggc

SEQ ID NO: 3478013 - RNA, 14 nt, Pseudomonas aeruginosa PA01
ucauugggcagcca

SEQ ID NO: 3478014 - RNA, 22 nt, Pseudomonas aeruginosa PA01
ucauuucuacuucccugccggc

SEQ ID NO: 3478015 - RNA, 12 nt, Pseudomonas aeruginosa PA01
uccaaagaaaag

SEQ ID NO: 3478016 - RNA, 19 nt, Pseudomonas aeruginosa PA01
uccaaagccuggagcaggg

SEQ ID NO: 3478017 - RNA, 12 nt, Pseudomonas aeruginosa PA01
uccaacagcagg

SEQ ID NO: 3478018 - RNA, 13 nt, Pseudomonas aeruginosa PA01
uccaacagcaggu

SEQ ID NO: 3478019 - RNA, 20 nt, Pseudomonas aeruginosa PA01
uccaacccauguggcgcagc

SEQ ID NO: 3478020 - RNA, 21 nt, Pseudomonas aeruginosa PA01
uccaaccgauauccguagccg

SEQ ID NO: 3478021 - RNA, 20 nt, Pseudomonas aeruginosa PA01
uccaagagagcgccagcgag

SEQ ID NO: 3478022 - RNA, 17 nt, Pseudomonas aeruginosa PA01
uccaaggugcugccgau

SEQ ID NO: 3478023 - RNA, 16 nt, Pseudomonas aeruginosa PA01
uccacagcgugcagac

SEQ ID NO: 3478024 - RNA, 19 nt, Pseudomonas aeruginosa PA01
uccacagcgugcagaccag

SEQ ID NO: 3478025 - RNA, 15 nt, Pseudomonas aeruginosa PA01
uccacagcugccagc

SEQ ID NO: 3478026 - RNA, 16 nt, Pseudomonas aeruginosa PA01
uccacagcugccagcc

SEQ ID NO: 3478027 - RNA, 17 nt, Pseudomonas aeruginosa PA01
uccacagggucggcagg

SEQ ID NO: 3478028 - RNA, 19 nt, Pseudomonas aeruginosa PA01
uccacagggucggcaggac

SEQ ID NO: 3478029 - RNA, 15 nt, Pseudomonas aeruginosa PA01
uccaccaccagcagg

SEQ ID NO: 3478030 - RNA, 17 nt, Pseudomonas aeruginosa PA01
uccaccaccagcaggcc

SEQ ID NO: 3478031 - RNA, 13 nt, Pseudomonas aeruginosa PA01
uccaccagccagc

SEQ ID NO: 3478032 - RNA, 15 nt, Pseudomonas aeruginosa PA01
uccaccagccagcuc

SEQ ID NO: 3478033 - RNA, 18 nt, Pseudomonas aeruginosa PA01
uccaccagccaguagucu

SEQ ID NO: 3478034 - RNA, 15 nt, Pseudomonas aeruginosa PA01
uccaccagcccgcag

SEQ ID NO: 3478035 - RNA, 14 nt, Pseudomonas aeruginosa PA01
uccaccagcgcccg

SEQ ID NO: 3478036 - RNA, 15 nt, Pseudomonas aeruginosa PA01
uccaccagcgccggc

SEQ ID NO: 3478037 - RNA, 20 nt, Pseudomonas aeruginosa PA01
uccaccaggccauagcgcgc

SEQ ID NO: 3478038 - RNA, 21 nt, Pseudomonas aeruginosa PA01
uccaccaggccauagcgcgcc

SEQ ID NO: 3478039 - RNA, 23 nt, Pseudomonas aeruginosa PA01
uccaccaggcgccgggucgaugg

SEQ ID NO: 3478040 - RNA, 20 nt, Pseudomonas aeruginosa PA01
uccaccaggcgucgcaccug

SEQ ID NO: 3478041 - RNA, 19 nt, Pseudomonas aeruginosa PA01
uccaccagggccucggggc

SEQ ID NO: 3478042 - RNA, 19 nt, Pseudomonas aeruginosa PA01
uccaccauaaagcccacac

SEQ ID NO: 3478043 - RNA, 12 nt, Pseudomonas aeruginosa PA01
uccacccaggcg

SEQ ID NO: 3478044 - RNA, 18 nt, Pseudomonas aeruginosa PA01
uccacccgaaagccgaag

SEQ ID NO: 3478045 - RNA, 15 nt, Pseudomonas aeruginosa PA01
uccacccgcagccgc

SEQ ID NO: 3478046 - RNA, 20 nt, Pseudomonas aeruginosa PA01
uccaccgaguggcgcagcgc

SEQ ID NO: 3478047 - RNA, 15 nt, Pseudomonas aeruginosa PA01
uccaccgauggcgcg

SEQ ID NO: 3478048 - RNA, 23 nt, Pseudomonas aeruginosa PA01
uccaccgccaccugccccgggcg

SEQ ID NO: 3478049 - RNA, 16 nt, Pseudomonas aeruginosa PA01
uccaccgccagcaccc

SEQ ID NO: 3478050 - RNA, 14 nt, Pseudomonas aeruginosa PA01
uccaccgccagggc

SEQ ID NO: 3478051 - RNA, 15 nt, Pseudomonas aeruginosa PA01
uccaccgccagggcg

SEQ ID NO: 3478052 - RNA, 14 nt, Pseudomonas aeruginosa PA01
uccaccgcccccgg

SEQ ID NO: 3478053 - RNA, 16 nt, Pseudomonas aeruginosa PA01
uccaccgcccccggcg

SEQ ID NO: 3478054 - RNA, 19 nt, Pseudomonas aeruginosa PA01
uccaccgcccccggcgcca

SEQ ID NO: 3478055 - RNA, 21 nt, Pseudomonas aeruginosa PA01
uccaccgcccccggcgccacc

SEQ ID NO: 3478056 - RNA, 15 nt, Pseudomonas aeruginosa PA01
uccaccgccgccagc

SEQ ID NO: 3478057 - RNA, 19 nt, Pseudomonas aeruginosa PA01
uccaccgcggccucgcugg

SEQ ID NO: 3478058 - RNA, 21 nt, Pseudomonas aeruginosa PA01
uccaccgcggccucgcuggcg

SEQ ID NO: 3478059 - RNA, 16 nt, Pseudomonas aeruginosa PA01
uccaccgcuccggcgc

SEQ ID NO: 3478060 - RNA, 16 nt, Pseudomonas aeruginosa PA01
uccaccggaucgcccu

SEQ ID NO: 3478061 - RNA, 17 nt, Pseudomonas aeruginosa PA01
uccaccggaucgcccug

SEQ ID NO: 3478062 - RNA, 20 nt, Pseudomonas aeruginosa PA01
uccaccggaucgcccuggcg

SEQ ID NO: 3478063 - RNA, 21 nt, Pseudomonas aeruginosa PA01
uccaccggaucgcccuggcgc

SEQ ID NO: 3478064 - RNA, 22 nt, Pseudomonas aeruginosa PA01
uccaccggcguccacuccggca

SEQ ID NO: 3478065 - RNA, 15 nt, Pseudomonas aeruginosa PA01
uccaccggcuggccg

SEQ ID NO: 3478066 - RNA, 19 nt, Pseudomonas aeruginosa PA01
uccaccguuccgacccggc

SEQ ID NO: 3478067 - RNA, 14 nt, Pseudomonas aeruginosa PA01
uccaccucgcccuc

SEQ ID NO: 3478068 - RNA, 15 nt, Pseudomonas aeruginosa PA01
uccaccucgcccucg

SEQ ID NO: 3478069 - RNA, 12 nt, Pseudomonas aeruginosa PA01
uccaccuggcgc

SEQ ID NO: 3478070 - RNA, 13 nt, Pseudomonas aeruginosa PA01
uccaccuggcgca

SEQ ID NO: 3478071 - RNA, 14 nt, Pseudomonas aeruginosa PA01
uccaccuggcgcag

SEQ ID NO: 3478072 - RNA, 15 nt, Pseudomonas aeruginosa PA01
uccaccuggcgcagg

SEQ ID NO: 3478073 - RNA, 18 nt, Pseudomonas aeruginosa PA01
uccaccuggcgcagguag

SEQ ID NO: 3478074 - RNA, 22 nt, Pseudomonas aeruginosa PA01
uccaccuggcgcagguagaagg

SEQ ID NO: 3478075 - RNA, 22 nt, Pseudomonas aeruginosa PA01
uccaccuugccgcgcccggccu

SEQ ID NO: 3478076 - RNA, 21 nt, Pseudomonas aeruginosa PA01
uccaccuugcgguagcgcucg

SEQ ID NO: 3478077 - RNA, 19 nt, Pseudomonas aeruginosa PA01
uccacgaaaaagcccggca

SEQ ID NO: 3478078 - RNA, 19 nt, Pseudomonas aeruginosa PA01
uccacgaagaacgccagcc

SEQ ID NO: 3478079 - RNA, 18 nt, Pseudomonas aeruginosa PA01
uccacgaggaugucggcg

SEQ ID NO: 3478080 - RNA, 17 nt, Pseudomonas aeruginosa PA01
uccacgccauaggcggc

SEQ ID NO: 3478081 - RNA, 20 nt, Pseudomonas aeruginosa PA01
uccacgccauaggcggcgca

SEQ ID NO: 3478082 - RNA, 13 nt, Pseudomonas aeruginosa PA01
uccacgccccagu

SEQ ID NO: 3478083 - RNA, 17 nt, Pseudomonas aeruginosa PA01
uccacgccgaagucggc

SEQ ID NO: 3478084 - RNA, 18 nt, Pseudomonas aeruginosa PA01
uccacgccgaagucggcg

SEQ ID NO: 3478085 - RNA, 13 nt, Pseudomonas aeruginosa PA01
uccacgccgggca

SEQ ID NO: 3478086 - RNA, 16 nt, Pseudomonas aeruginosa PA01
uccacgccuggcccug

SEQ ID NO: 3478087 - RNA, 18 nt, Pseudomonas aeruginosa PA01
uccacgccuucgcggccg

SEQ ID NO: 3478088 - RNA, 20 nt, Pseudomonas aeruginosa PA01
uccacgccuucgcggccgag

SEQ ID NO: 3478089 - RNA, 22 nt, Pseudomonas aeruginosa PA01
uccacgcgguuccacucccaug

SEQ ID NO: 3478090 - RNA, 21 nt, Pseudomonas aeruginosa PA01
uccacgcugugcggcagcagg

SEQ ID NO: 3478091 - RNA, 23 nt, Pseudomonas aeruginosa PA01
uccacgcugugcggcagcaggcu

SEQ ID NO: 3478092 - RNA, 17 nt, Pseudomonas aeruginosa PA01
uccacggcgcgucggcg

SEQ ID NO: 3478093 - RNA, 13 nt, Pseudomonas aeruginosa PA01
uccacggcggccu

SEQ ID NO: 3478094 - RNA, 17 nt, Pseudomonas aeruginosa PA01
uccacgggucgcagccg

SEQ ID NO: 3478095 - RNA, 19 nt, Pseudomonas aeruginosa PA01
uccacgggucgcagccgag

SEQ ID NO: 3478096 - RNA, 22 nt, Pseudomonas aeruginosa PA01
uccacgucgagcgggcggucgu

SEQ ID NO: 3478097 - RNA, 17 nt, Pseudomonas aeruginosa PA01
uccacgucgccgaccag

SEQ ID NO: 3478098 - RNA, 22 nt, Pseudomonas aeruginosa PA01
uccacgucgccgaccaggcggc

SEQ ID NO: 3478099 - RNA, 18 nt, Pseudomonas aeruginosa PA01
uccacguugagcaucacc

SEQ ID NO: 3478100 - RNA, 20 nt, Pseudomonas aeruginosa PA01
uccacguugcaguccaggcc

SEQ ID NO: 3478101 - RNA, 13 nt, Pseudomonas aeruginosa PA01
uccacuccaggcg

SEQ ID NO: 3478102 - RNA, 17 nt, Pseudomonas aeruginosa PA01
uccacucccaugccagg

SEQ ID NO: 3478103 - RNA, 18 nt, Pseudomonas aeruginosa PA01
uccacucccaugccagga

SEQ ID NO: 3478104 - RNA, 21 nt, Pseudomonas aeruginosa PA01
uccacucgcccuugaccaguc

SEQ ID NO: 3478105 - RNA, 14 nt, Pseudomonas aeruginosa PA01
uccacucgccgacc

SEQ ID NO: 3478106 - RNA, 17 nt, Pseudomonas aeruginosa PA01
uccacucgccgaccagc

SEQ ID NO: 3478107 - RNA, 15 nt, Pseudomonas aeruginosa PA01
uccacucguuaaccu

SEQ ID NO: 3478108 - RNA, 20 nt, Pseudomonas aeruginosa PA01
uccacugcguccuggucgcu

SEQ ID NO: 3478109 - RNA, 17 nt, Pseudomonas aeruginosa PA01
uccacugcuuggccagg

SEQ ID NO: 3478110 - RNA, 18 nt, Pseudomonas aeruginosa PA01
uccacugcuuggccaggc

SEQ ID NO: 3478111 - RNA, 18 nt, Pseudomonas aeruginosa PA01
uccacuggcccacggcgc

SEQ ID NO: 3478112 - RNA, 23 nt, Pseudomonas aeruginosa PA01
uccacuggcccacggcgccuucc

SEQ ID NO: 3478113 - RNA, 17 nt, Pseudomonas aeruginosa PA01
uccacuuccaccggcuu

SEQ ID NO: 3478114 - RNA, 18 nt, Pseudomonas aeruginosa PA01
uccagaacgccgcgcacc

SEQ ID NO: 3478115 - RNA, 20 nt, Pseudomonas aeruginosa PA01
uccagaaggcuucuuccugg

SEQ ID NO: 3478116 - RNA, 12 nt, Pseudomonas aeruginosa PA01
uccagaccucga

SEQ ID NO: 3478117 - RNA, 17 nt, Pseudomonas aeruginosa PA01
uccagaccucgagcagg

SEQ ID NO: 3478118 - RNA, 17 nt, Pseudomonas aeruginosa PA01
uccagacucuccagguc

SEQ ID NO: 3478119 - RNA, 19 nt, Pseudomonas aeruginosa PA01
uccagacucuccaggucgg

SEQ ID NO: 3478120 - RNA, 21 nt, Pseudomonas aeruginosa PA01
uccagagccaugggccggccg

SEQ ID NO: 3478121 - RNA, 22 nt, Pseudomonas aeruginosa PA01
uccagaggaacaguucggcgag

SEQ ID NO: 3478122 - RNA, 22 nt, Pseudomonas aeruginosa PA01
uccagaggcauucaucaccagc

SEQ ID NO: 3478123 - RNA, 14 nt, Pseudomonas aeruginosa PA01
uccagagugcgcag

SEQ ID NO: 3478124 - RNA, 19 nt, Pseudomonas aeruginosa PA01
uccagagugcgcagcagcg

SEQ ID NO: 3478125 - RNA, 15 nt, Pseudomonas aeruginosa PA01
uccagaucgccguuc

SEQ ID NO: 3478126 - RNA, 17 nt, Pseudomonas aeruginosa PA01
uccagaugaaacugccc

SEQ ID NO: 3478127 - RNA, 20 nt, Pseudomonas aeruginosa PA01
uccagaugaaacugcccggc

SEQ ID NO: 3478128 - RNA, 22 nt, Pseudomonas aeruginosa PA01
uccagaugaaacugcccggcuc

SEQ ID NO: 3478129 - RNA, 20 nt, Pseudomonas aeruginosa PA01
uccagaugcuugcacaccug

SEQ ID NO: 3478130 - RNA, 20 nt, Pseudomonas aeruginosa PA01
uccagcaacccaugccgcaa

SEQ ID NO: 3478131 - RNA, 14 nt, Pseudomonas aeruginosa PA01
uccagcaacgccgc

SEQ ID NO: 3478132 - RNA, 20 nt, Pseudomonas aeruginosa PA01
uccagcaacgccgcccccag

SEQ ID NO: 3478133 - RNA, 21 nt, Pseudomonas aeruginosa PA01
uccagcaacgugaagcccuuc

SEQ ID NO: 3478134 - RNA, 13 nt, Pseudomonas aeruginosa PA01
uccagcaaggcgu

SEQ ID NO: 3478135 - RNA, 13 nt, Pseudomonas aeruginosa PA01
uccagcaaugcca

SEQ ID NO: 3478136 - RNA, 21 nt, Pseudomonas aeruginosa PA01
uccagcaaugccagcgccacg

SEQ ID NO: 3478137 - RNA, 23 nt, Pseudomonas aeruginosa PA01
uccagcaaugccagcgccacgcc

SEQ ID NO: 3478138 - RNA, 19 nt, Pseudomonas aeruginosa PA01
uccagcaccagcacgcccu

SEQ ID NO: 3478139 - RNA, 16 nt, Pseudomonas aeruginosa PA01
uccagcacccagguag

SEQ ID NO: 3478140 - RNA, 17 nt, Pseudomonas aeruginosa PA01
uccagcacccgcaccgg

SEQ ID NO: 3478141 - RNA, 12 nt, Pseudomonas aeruginosa PA01
uccagcaccgcc

SEQ ID NO: 3478142 - RNA, 18 nt, Pseudomonas aeruginosa PA01
uccagcaccgccuggcgc

SEQ ID NO: 3478143 - RNA, 20 nt, Pseudomonas aeruginosa PA01
uccagcaccgccuggcgcaa

SEQ ID NO: 3478144 - RNA, 13 nt, Pseudomonas aeruginosa PA01
uccagcaccggcg

SEQ ID NO: 3478145 - RNA, 19 nt, Pseudomonas aeruginosa PA01
uccagcaccggcggcgcca

SEQ ID NO: 3478146 - RNA, 20 nt, Pseudomonas aeruginosa PA01
uccagcaccggcggcgccag

SEQ ID NO: 3478147 - RNA, 20 nt, Pseudomonas aeruginosa PA01
uccagcaccgggauggucga

SEQ ID NO: 3478148 - RNA, 23 nt, Pseudomonas aeruginosa PA01
uccagcaccgggauggucgaggg

SEQ ID NO: 3478149 - RNA, 18 nt, Pseudomonas aeruginosa PA01
uccagcaccguggcgcca

SEQ ID NO: 3478150 - RNA, 16 nt, Pseudomonas aeruginosa PA01
uccagcacgcggaggg

SEQ ID NO: 3478151 - RNA, 13 nt, Pseudomonas aeruginosa PA01
uccagcacgcugg

SEQ ID NO: 3478152 - RNA, 14 nt, Pseudomonas aeruginosa PA01
uccagcacgcuggc

SEQ ID NO: 3478153 - RNA, 15 nt, Pseudomonas aeruginosa PA01
uccagcacgcuggcg

SEQ ID NO: 3478154 - RNA, 21 nt, Pseudomonas aeruginosa PA01
uccagcacgcuggcgaggacg

SEQ ID NO: 3478155 - RNA, 19 nt, Pseudomonas aeruginosa PA01
uccagcacggugaaccagg

SEQ ID NO: 3478156 - RNA, 21 nt, Pseudomonas aeruginosa PA01
uccagcacggugaaccaggcg

SEQ ID NO: 3478157 - RNA, 17 nt, Pseudomonas aeruginosa PA01
uccagcacucgcuccuc

SEQ ID NO: 3478158 - RNA, 22 nt, Pseudomonas aeruginosa PA01
uccagcacucgcuccuccgggc

SEQ ID NO: 3478159 - RNA, 15 nt, Pseudomonas aeruginosa PA01
uccagcagacggcug

SEQ ID NO: 3478160 - RNA, 18 nt, Pseudomonas aeruginosa PA01
uccagcagcgcacgcuuc

SEQ ID NO: 3478161 - RNA, 12 nt, Pseudomonas aeruginosa PA01
uccagcaggccc

SEQ ID NO: 3478162 - RNA, 16 nt, Pseudomonas aeruginosa PA01
uccagcaggcccagcc

SEQ ID NO: 3478163 - RNA, 11 nt, Pseudomonas aeruginosa PA01
uccagcaggcu

SEQ ID NO: 3478164 - RNA, 14 nt, Pseudomonas aeruginosa PA01
uccagcagggccag

SEQ ID NO: 3478165 - RNA, 15 nt, Pseudomonas aeruginosa PA01
uccagcagggccagc

SEQ ID NO: 3478166 - RNA, 20 nt, Pseudomonas aeruginosa PA01
uccagcagggccagcgccug

SEQ ID NO: 3478167 - RNA, 19 nt, Pseudomonas aeruginosa PA01
uccagcagggucgccuggg

SEQ ID NO: 3478168 - RNA, 18 nt, Pseudomonas aeruginosa PA01
uccagcagguacagcgac

SEQ ID NO: 3478169 - RNA, 13 nt, Pseudomonas aeruginosa PA01
uccagcaggucga

SEQ ID NO: 3478170 - RNA, 20 nt, Pseudomonas aeruginosa PA01
uccagcaggucgagggcguc

SEQ ID NO: 3478171 - RNA, 13 nt, Pseudomonas aeruginosa PA01
uccagcaggucgg

SEQ ID NO: 3478172 - RNA, 21 nt, Pseudomonas aeruginosa PA01
uccagcagguggcgcacugcc

SEQ ID NO: 3478173 - RNA, 18 nt, Pseudomonas aeruginosa PA01
uccagcagucgcacagcc

SEQ ID NO: 3478174 - RNA, 15 nt, Pseudomonas aeruginosa PA01
uccagcagucgcggc

SEQ ID NO: 3478175 - RNA, 20 nt, Pseudomonas aeruginosa PA01
uccagcaucaccuugcggaa

SEQ ID NO: 3478176 - RNA, 16 nt, Pseudomonas aeruginosa PA01
uccagcaugcucgggc

SEQ ID NO: 3478177 - RNA, 19 nt, Pseudomonas aeruginosa PA01
uccagcaugcucgggcugc

SEQ ID NO: 3478178 - RNA, 21 nt, Pseudomonas aeruginosa PA01
uccagcauuaccccgaccagg

SEQ ID NO: 3478179 - RNA, 21 nt, Pseudomonas aeruginosa PA01
uccagccagacguccggcagg

SEQ ID NO: 3478180 - RNA, 14 nt, Pseudomonas aeruginosa PA01
uccagccagcagcc

SEQ ID NO: 3478181 - RNA, 16 nt, Pseudomonas aeruginosa PA01
uccagccagcagcccg

SEQ ID NO: 3478182 - RNA, 18 nt, Pseudomonas aeruginosa PA01
uccagccagcagcccggc

SEQ ID NO: 3478183 - RNA, 16 nt, Pseudomonas aeruginosa PA01
uccagccagcccucgg

SEQ ID NO: 3478184 - RNA, 12 nt, Pseudomonas aeruginosa PA01
uccagccaggcc

SEQ ID NO: 3478185 - RNA, 14 nt, Pseudomonas aeruginosa PA01
uccagccagugcau

SEQ ID NO: 3478186 - RNA, 22 nt, Pseudomonas aeruginosa PA01
uccagccccgcgauugcagcuc

SEQ ID NO: 3478187 - RNA, 16 nt, Pseudomonas aeruginosa PA01
uccagcccggcucggc

SEQ ID NO: 3478188 - RNA, 12 nt, Pseudomonas aeruginosa PA01
uccagcccugga

SEQ ID NO: 3478189 - RNA, 13 nt, Pseudomonas aeruginosa PA01
uccagcccuucga

SEQ ID NO: 3478190 - RNA, 12 nt, Pseudomonas aeruginosa PA01
uccagccgcccu

SEQ ID NO: 3478191 - RNA, 17 nt, Pseudomonas aeruginosa PA01
uccagccgcugcagggc

SEQ ID NO: 3478192 - RNA, 18 nt, Pseudomonas aeruginosa PA01
uccagccggcauccagca

SEQ ID NO: 3478193 - RNA, 20 nt, Pseudomonas aeruginosa PA01
uccagccggcauccagcauc

SEQ ID NO: 3478194 - RNA, 19 nt, Pseudomonas aeruginosa PA01
uccagccggccauccagcc

SEQ ID NO: 3478195 - RNA, 23 nt, Pseudomonas aeruginosa PA01
uccagccggcgcuucugcgagcc

SEQ ID NO: 3478196 - RNA, 12 nt, Pseudomonas aeruginosa PA01
uccagccgggcu

SEQ ID NO: 3478197 - RNA, 20 nt, Pseudomonas aeruginosa PA01
uccagccgggcuccgccgcg

SEQ ID NO: 3478198 - RNA, 23 nt, Pseudomonas aeruginosa PA01
uccagccgggcuccgccgcgagc

SEQ ID NO: 3478199 - RNA, 12 nt, Pseudomonas aeruginosa PA01
uccagccggggc

SEQ ID NO: 3478200 - RNA, 14 nt, Pseudomonas aeruginosa PA01
uccagcgaauggac

SEQ ID NO: 3478201 - RNA, 13 nt, Pseudomonas aeruginosa PA01
uccagcgcccagg

SEQ ID NO: 3478202 - RNA, 14 nt, Pseudomonas aeruginosa PA01
uccagcgcccaggu

SEQ ID NO: 3478203 - RNA, 17 nt, Pseudomonas aeruginosa PA01
uccagcgccgccaggcg

SEQ ID NO: 3478204 - RNA, 23 nt, Pseudomonas aeruginosa PA01
uccagcgccgccucgaaggccgg

SEQ ID NO: 3478205 - RNA, 14 nt, Pseudomonas aeruginosa PA01
uccagcgccgcgcu

SEQ ID NO: 3478206 - RNA, 13 nt, Pseudomonas aeruginosa PA01
uccagcgccguuc

SEQ ID NO: 3478207 - RNA, 18 nt, Pseudomonas aeruginosa PA01
uccagcgccucgaccaga

SEQ ID NO: 3478208 - RNA, 19 nt, Pseudomonas aeruginosa PA01
uccagcgccucgccgagca

SEQ ID NO: 3478209 - RNA, 17 nt, Pseudomonas aeruginosa PA01
uccagcgccucgggccg

SEQ ID NO: 3478210 - RNA, 21 nt, Pseudomonas aeruginosa PA01
uccagcgccucgggccggagc

SEQ ID NO: 3478211 - RNA, 14 nt, Pseudomonas aeruginosa PA01
uccagcgccuggau

SEQ ID NO: 3478212 - RNA, 24 nt, Pseudomonas aeruginosa PA01
uccagcgccuggaugaucgcgugg

SEQ ID NO: 3478213 - RNA, 15 nt, Pseudomonas aeruginosa PA01
uccagcgccuggcgc

SEQ ID NO: 3478214 - RNA, 16 nt, Pseudomonas aeruginosa PA01
uccagcgcgcccggcg

SEQ ID NO: 3478215 - RNA, 17 nt, Pseudomonas aeruginosa PA01
uccagcgcgcccggcgc

SEQ ID NO: 3478216 - RNA, 12 nt, Pseudomonas aeruginosa PA01
uccagcgcgccg

SEQ ID NO: 3478217 - RNA, 15 nt, Pseudomonas aeruginosa PA01
uccagcgcgccgcgc

SEQ ID NO: 3478218 - RNA, 16 nt, Pseudomonas aeruginosa PA01
uccagcgcgccgcgca

SEQ ID NO: 3478219 - RNA, 19 nt, Pseudomonas aeruginosa PA01
uccagcgcuccuugcgcca

SEQ ID NO: 3478220 - RNA, 15 nt, Pseudomonas aeruginosa PA01
uccagcgcuggcagg

SEQ ID NO: 3478221 - RNA, 18 nt, Pseudomonas aeruginosa PA01
uccagcgcuugaacgcgc

SEQ ID NO: 3478222 - RNA, 21 nt, Pseudomonas aeruginosa PA01
uccagcgcuugaacgcgcgcc

SEQ ID NO: 3478223 - RNA, 20 nt, Pseudomonas aeruginosa PA01
uccagcggaaucgcgcccuu

SEQ ID NO: 3478224 - RNA, 19 nt, Pseudomonas aeruginosa PA01
uccagcggacgcuuguccu

SEQ ID NO: 3478225 - RNA, 16 nt, Pseudomonas aeruginosa PA01
uccagcggcacuuccc

SEQ ID NO: 3478226 - RNA, 19 nt, Pseudomonas aeruginosa PA01
uccagcggcacuucccgcc

SEQ ID NO: 3478227 - RNA, 17 nt, Pseudomonas aeruginosa PA01
uccagcggcagcucggc

SEQ ID NO: 3478228 - RNA, 19 nt, Pseudomonas aeruginosa PA01
uccagcggcagcucggcga

SEQ ID NO: 3478229 - RNA, 20 nt, Pseudomonas aeruginosa PA01
uccagcggcagcucggcgac

SEQ ID NO: 3478230 - RNA, 18 nt, Pseudomonas aeruginosa PA01
uccagcggcaugccguag

SEQ ID NO: 3478231 - RNA, 16 nt, Pseudomonas aeruginosa PA01
uccagcggccacggcg

SEQ ID NO: 3478232 - RNA, 18 nt, Pseudomonas aeruginosa PA01
uccagcggccacggcgga

SEQ ID NO: 3478233 - RNA, 14 nt, Pseudomonas aeruginosa PA01
uccagcggccgcga

SEQ ID NO: 3478234 - RNA, 16 nt, Pseudomonas aeruginosa PA01
uccagcggccgcgagc

SEQ ID NO: 3478235 - RNA, 17 nt, Pseudomonas aeruginosa PA01
uccagcggccgcgagga

SEQ ID NO: 3478236 - RNA, 17 nt, Pseudomonas aeruginosa PA01
uccagcggccgcgccuu

SEQ ID NO: 3478237 - RNA, 12 nt, Pseudomonas aeruginosa PA01
uccagcggcggg

SEQ ID NO: 3478238 - RNA, 21 nt, Pseudomonas aeruginosa PA01
uccagcggcuuguccuggcgc

SEQ ID NO: 3478239 - RNA, 20 nt, Pseudomonas aeruginosa PA01
uccagcgggaaggucggcag

SEQ ID NO: 3478240 - RNA, 18 nt, Pseudomonas aeruginosa PA01
uccagcgggcccauggcg

SEQ ID NO: 3478241 - RNA, 19 nt, Pseudomonas aeruginosa PA01
uccagcgggguggcgcgga

SEQ ID NO: 3478242 - RNA, 17 nt, Pseudomonas aeruginosa PA01
uccagcgguaccagcag

SEQ ID NO: 3478243 - RNA, 18 nt, Pseudomonas aeruginosa PA01
uccagcgguaccagcagc

SEQ ID NO: 3478244 - RNA, 20 nt, Pseudomonas aeruginosa PA01
uccagcgguaccagcagcgc

SEQ ID NO: 3478245 - RNA, 19 nt, Pseudomonas aeruginosa PA01
uccagcgucugccgcuggc

SEQ ID NO: 3478246 - RNA, 22 nt, Pseudomonas aeruginosa PA01
uccagcgucugccgcuggcggc

SEQ ID NO: 3478247 - RNA, 23 nt, Pseudomonas aeruginosa PA01
uccagcguggcggacaacccggc

SEQ ID NO: 3478248 - RNA, 14 nt, Pseudomonas aeruginosa PA01
uccagcguguggcg

SEQ ID NO: 3478249 - RNA, 23 nt, Pseudomonas aeruginosa PA01
uccagcuccgucuguucggccag

SEQ ID NO: 3478250 - RNA, 17 nt, Pseudomonas aeruginosa PA01
uccagcucgacccgccc

SEQ ID NO: 3478251 - RNA, 18 nt, Pseudomonas aeruginosa PA01
uccagcucgacccgcccg

SEQ ID NO: 3478252 - RNA, 14 nt, Pseudomonas aeruginosa PA01
uccagcucggcgag

SEQ ID NO: 3478253 - RNA, 14 nt, Pseudomonas aeruginosa PA01
uccagcucggucag

SEQ ID NO: 3478254 - RNA, 15 nt, Pseudomonas aeruginosa PA01
uccagcucggucagc

SEQ ID NO: 3478255 - RNA, 19 nt, Pseudomonas aeruginosa PA01
uccagcucggucagcggcg

SEQ ID NO: 3478256 - RNA, 17 nt, Pseudomonas aeruginosa PA01
uccagcucgucgaugau

SEQ ID NO: 3478257 - RNA, 14 nt, Pseudomonas aeruginosa PA01
uccagcucucgcug

SEQ ID NO: 3478258 - RNA, 18 nt, Pseudomonas aeruginosa PA01
uccagcugccagugcucg

SEQ ID NO: 3478259 - RNA, 12 nt, Pseudomonas aeruginosa PA01
uccagcuggcgc

SEQ ID NO: 3478260 - RNA, 16 nt, Pseudomonas aeruginosa PA01
uccagcuggcgcagcc

SEQ ID NO: 3478261 - RNA, 17 nt, Pseudomonas aeruginosa PA01
uccagcuggcgcagccg

SEQ ID NO: 3478262 - RNA, 19 nt, Pseudomonas aeruginosa PA01
uccagcuucuucugcagcu

SEQ ID NO: 3478263 - RNA, 16 nt, Pseudomonas aeruginosa PA01
uccagcuugcgccaga

SEQ ID NO: 3478264 - RNA, 18 nt, Pseudomonas aeruginosa PA01
uccagcuuggcacggccg

SEQ ID NO: 3478265 - RNA, 21 nt, Pseudomonas aeruginosa PA01
uccagcuuggcacggccggcg

SEQ ID NO: 3478266 - RNA, 23 nt, Pseudomonas aeruginosa PA01
uccagcuuggcacggccggcggu

SEQ ID NO: 3478267 - RNA, 22 nt, Pseudomonas aeruginosa PA01
uccaggaaccaggggucgacgc

SEQ ID NO: 3478268 - RNA, 15 nt, Pseudomonas aeruginosa PA01
uccaggaaccggcca

SEQ ID NO: 3478269 - RNA, 19 nt, Pseudomonas aeruginosa PA01
uccaggaauccuccgccag

SEQ ID NO: 3478270 - RNA, 21 nt, Pseudomonas aeruginosa PA01
uccaggaauccuccgccagcg

SEQ ID NO: 3478271 - RNA, 19 nt, Pseudomonas aeruginosa PA01
uccaggagggcugcugucc

SEQ ID NO: 3478272 - RNA, 14 nt, Pseudomonas aeruginosa PA01
uccaggaucgccuc

SEQ ID NO: 3478273 - RNA, 19 nt, Pseudomonas aeruginosa PA01
uccaggaugcaaccgcccu

SEQ ID NO: 3478274 - RNA, 21 nt, Pseudomonas aeruginosa PA01
uccaggaugcaaccgcccugg

SEQ ID NO: 3478275 - RNA, 17 nt, Pseudomonas aeruginosa PA01
uccaggcccgccgcggc

SEQ ID NO: 3478276 - RNA, 18 nt, Pseudomonas aeruginosa PA01
uccaggcccgccgcggcg

SEQ ID NO: 3478277 - RNA, 16 nt, Pseudomonas aeruginosa PA01
uccaggccgaagccgc

SEQ ID NO: 3478278 - RNA, 21 nt, Pseudomonas aeruginosa PA01
uccaggccgaagccgccggga

SEQ ID NO: 3478279 - RNA, 21 nt, Pseudomonas aeruginosa PA01
uccaggccgacgaagaccuug

SEQ ID NO: 3478280 - RNA, 19 nt, Pseudomonas aeruginosa PA01
uccaggccgcaggugaagc

SEQ ID NO: 3478281 - RNA, 18 nt, Pseudomonas aeruginosa PA01
uccaggccgcucaccgcc

SEQ ID NO: 3478282 - RNA, 17 nt, Pseudomonas aeruginosa PA01
uccaggcgaaagucggc

SEQ ID NO: 3478283 - RNA, 23 nt, Pseudomonas aeruginosa PA01
uccaggcgacgaaacggcucugc

SEQ ID NO: 3478284 - RNA, 23 nt, Pseudomonas aeruginosa PA01
uccaggcgcgaacgcucccagcc

SEQ ID NO: 3478285 - RNA, 14 nt, Pseudomonas aeruginosa PA01
uccaggcgcgccgu

SEQ ID NO: 3478286 - RNA, 16 nt, Pseudomonas aeruginosa PA01
uccaggcgcgccgugc

SEQ ID NO: 3478287 - RNA, 21 nt, Pseudomonas aeruginosa PA01
uccaggcgcgccgugcggcgu

SEQ ID NO: 3478288 - RNA, 17 nt, Pseudomonas aeruginosa PA01
uccaggcgcgcuggaug

SEQ ID NO: 3478289 - RNA, 18 nt, Pseudomonas aeruginosa PA01
uccaggcgcugcucgaug

SEQ ID NO: 3478290 - RNA, 14 nt, Pseudomonas aeruginosa PA01
uccaggcggcggua

SEQ ID NO: 3478291 - RNA, 21 nt, Pseudomonas aeruginosa PA01
uccaggcggcgguagccgagg

SEQ ID NO: 3478292 - RNA, 22 nt, Pseudomonas aeruginosa PA01
uccaggcggcgguagccgaggc

SEQ ID NO: 3478293 - RNA, 23 nt, Pseudomonas aeruginosa PA01
uccaggcguccgcuggccugcag

SEQ ID NO: 3478294 - RNA, 15 nt, Pseudomonas aeruginosa PA01
uccaggcgucggcgc

SEQ ID NO: 3478295 - RNA, 15 nt, Pseudomonas aeruginosa PA01
uccaggcgugcugca

SEQ ID NO: 3478296 - RNA, 20 nt, Pseudomonas aeruginosa PA01
uccaggcgugcugcacggag

SEQ ID NO: 3478297 - RNA, 14 nt, Pseudomonas aeruginosa PA01
uccaggcuggccuu

SEQ ID NO: 3478298 - RNA, 15 nt, Pseudomonas aeruginosa PA01
uccaggcuggccuug

SEQ ID NO: 3478299 - RNA, 21 nt, Pseudomonas aeruginosa PA01
uccaggcuggccuuggccaug

SEQ ID NO: 3478300 - RNA, 18 nt, Pseudomonas aeruginosa PA01
uccaggcuguagccggcg

SEQ ID NO: 3478301 - RNA, 21 nt, Pseudomonas aeruginosa PA01
uccaggcuguagccggcgaug

SEQ ID NO: 3478302 - RNA, 23 nt, Pseudomonas aeruginosa PA01
uccaggcugugggcgacuuccuu

SEQ ID NO: 3478303 - RNA, 22 nt, Pseudomonas aeruginosa PA01
uccaggcuuuccaccgccagca

SEQ ID NO: 3478304 - RNA, 19 nt, Pseudomonas aeruginosa PA01
uccagggagaacagcaggg

SEQ ID NO: 3478305 - RNA, 20 nt, Pseudomonas aeruginosa PA01
uccagggagaacagcagggu

SEQ ID NO: 3478306 - RNA, 15 nt, Pseudomonas aeruginosa PA01
uccagggagcgcucg

SEQ ID NO: 3478307 - RNA, 20 nt, Pseudomonas aeruginosa PA01
uccagggagcgcucgcgcag

SEQ ID NO: 3478308 - RNA, 22 nt, Pseudomonas aeruginosa PA01
uccagggagcgcucgcgcagcc

SEQ ID NO: 3478309 - RNA, 16 nt, Pseudomonas aeruginosa PA01
uccagggcaccacgga

SEQ ID NO: 3478310 - RNA, 16 nt, Pseudomonas aeruginosa PA01
uccagggccugcucca

SEQ ID NO: 3478311 - RNA, 14 nt, Pseudomonas aeruginosa PA01
uccagggccuggcg

SEQ ID NO: 3478312 - RNA, 23 nt, Pseudomonas aeruginosa PA01
uccagggcgaagucggcgcgcca

SEQ ID NO: 3478313 - RNA, 13 nt, Pseudomonas aeruginosa PA01
uccagggcgaugg

SEQ ID NO: 3478314 - RNA, 15 nt, Pseudomonas aeruginosa PA01
uccagggcgauggcg

SEQ ID NO: 3478315 - RNA, 13 nt, Pseudomonas aeruginosa PA01
uccagggcgcuga

SEQ ID NO: 3478316 - RNA, 18 nt, Pseudomonas aeruginosa PA01
uccagggcgcugaccagg

SEQ ID NO: 3478317 - RNA, 14 nt, Pseudomonas aeruginosa PA01
uccagggcggcgcg

SEQ ID NO: 3478318 - RNA, 19 nt, Pseudomonas aeruginosa PA01
uccaggguagcgccgcggg

SEQ ID NO: 3478319 - RNA, 15 nt, Pseudomonas aeruginosa PA01
uccagggucgagggc

SEQ ID NO: 3478320 - RNA, 23 nt, Pseudomonas aeruginosa PA01
uccagggucgcccgugccucggc

SEQ ID NO: 3478321 - RNA, 14 nt, Pseudomonas aeruginosa PA01
uccagggucggcac

SEQ ID NO: 3478322 - RNA, 15 nt, Pseudomonas aeruginosa PA01
uccagggugccgacc

SEQ ID NO: 3478323 - RNA, 16 nt, Pseudomonas aeruginosa PA01
uccagggugccgacca

SEQ ID NO: 3478324 - RNA, 17 nt, Pseudomonas aeruginosa PA01
uccagggugcugaccuu

SEQ ID NO: 3478325 - RNA, 20 nt, Pseudomonas aeruginosa PA01
uccagggugggcggugcggc

SEQ ID NO: 3478326 - RNA, 14 nt, Pseudomonas aeruginosa PA01
uccaggguuuccag

SEQ ID NO: 3478327 - RNA, 16 nt, Pseudomonas aeruginosa PA01
uccaggguuuccagca

SEQ ID NO: 3478328 - RNA, 20 nt, Pseudomonas aeruginosa PA01
uccagguacaccaggguggc

SEQ ID NO: 3478329 - RNA, 21 nt, Pseudomonas aeruginosa PA01
uccaggucaugcccuggccga

SEQ ID NO: 3478330 - RNA, 20 nt, Pseudomonas aeruginosa PA01
uccaggucgaucagcagcag

SEQ ID NO: 3478331 - RNA, 19 nt, Pseudomonas aeruginosa PA01
uccaggucggcggcacgcu

SEQ ID NO: 3478332 - RNA, 16 nt, Pseudomonas aeruginosa PA01
uccaggugcgcggcag

SEQ ID NO: 3478333 - RNA, 21 nt, Pseudomonas aeruginosa PA01
uccagguucgcguggcccggc

SEQ ID NO: 3478334 - RNA, 14 nt, Pseudomonas aeruginosa PA01
uccagguucggcgc

SEQ ID NO: 3478335 - RNA, 19 nt, Pseudomonas aeruginosa PA01
uccagguucggcgccagcu

SEQ ID NO: 3478336 - RNA, 16 nt, Pseudomonas aeruginosa PA01
uccaguacacccaggg

SEQ ID NO: 3478337 - RNA, 18 nt, Pseudomonas aeruginosa PA01
uccaguacacccagggca

SEQ ID NO: 3478338 - RNA, 14 nt, Pseudomonas aeruginosa PA01
uccaguagcgccug

SEQ ID NO: 3478339 - RNA, 17 nt, Pseudomonas aeruginosa PA01
uccaguagcgccugguu

SEQ ID NO: 3478340 - RNA, 14 nt, Pseudomonas aeruginosa PA01
uccaguagcggaag

SEQ ID NO: 3478341 - RNA, 17 nt, Pseudomonas aeruginosa PA01
uccagucggggcaggcg

SEQ ID NO: 3478342 - RNA, 23 nt, Pseudomonas aeruginosa PA01
uccagucggggcaggcgcaggcg

SEQ ID NO: 3478343 - RNA, 20 nt, Pseudomonas aeruginosa PA01
uccagucuucgccggccugc

SEQ ID NO: 3478344 - RNA, 14 nt, Pseudomonas aeruginosa PA01
uccagugcggcagu

SEQ ID NO: 3478345 - RNA, 15 nt, Pseudomonas aeruginosa PA01
uccagugcggcaguc

SEQ ID NO: 3478346 - RNA, 11 nt, Pseudomonas aeruginosa PA01
uccaguuccug

SEQ ID NO: 3478347 - RNA, 15 nt, Pseudomonas aeruginosa PA01
uccaguuccugcacc

SEQ ID NO: 3478348 - RNA, 15 nt, Pseudomonas aeruginosa PA01
uccaguuccugcucc

SEQ ID NO: 3478349 - RNA, 23 nt, Pseudomonas aeruginosa PA01
uccaguucggccgcggcuggcag

SEQ ID NO: 3478350 - RNA, 15 nt, Pseudomonas aeruginosa PA01
uccaguucggcgaug

SEQ ID NO: 3478351 - RNA, 15 nt, Pseudomonas aeruginosa PA01
uccaguucguugacc

SEQ ID NO: 3478352 - RNA, 18 nt, Pseudomonas aeruginosa PA01
uccaguucguugaccacg

SEQ ID NO: 3478353 - RNA, 20 nt, Pseudomonas aeruginosa PA01
uccaguucguugaccacgcu

SEQ ID NO: 3478354 - RNA, 15 nt, Pseudomonas aeruginosa PA01
uccaguuggccgggc

SEQ ID NO: 3478355 - RNA, 17 nt, Pseudomonas aeruginosa PA01
uccaguuggccgggcag

SEQ ID NO: 3478356 - RNA, 15 nt, Pseudomonas aeruginosa PA01
uccauagggcggcgc

SEQ ID NO: 3478357 - RNA, 23 nt, Pseudomonas aeruginosa PA01
uccauaguagagaugcaccggcc

SEQ ID NO: 3478358 - RNA, 13 nt, Pseudomonas aeruginosa PA01
uccaucagcucca

SEQ ID NO: 3478359 - RNA, 16 nt, Pseudomonas aeruginosa PA01
uccaucaguugcgcgc

SEQ ID NO: 3478360 - RNA, 21 nt, Pseudomonas aeruginosa PA01
uccauccagucggcgcuggag

SEQ ID NO: 3478361 - RNA, 17 nt, Pseudomonas aeruginosa PA01
uccauccagucuucgcc

SEQ ID NO: 3478362 - RNA, 22 nt, Pseudomonas aeruginosa PA01
uccauccccgccucgaccagcg

SEQ ID NO: 3478363 - RNA, 23 nt, Pseudomonas aeruginosa PA01
uccaucccuucgugcuggcggau

SEQ ID NO: 3478364 - RNA, 22 nt, Pseudomonas aeruginosa PA01
uccaucgacagggucgucuggg

SEQ ID NO: 3478365 - RNA, 21 nt, Pseudomonas aeruginosa PA01
uccaucguggggcggcgcaga

SEQ ID NO: 3478366 - RNA, 12 nt, Pseudomonas aeruginosa PA01
uccaugaacucu

SEQ ID NO: 3478367 - RNA, 16 nt, Pseudomonas aeruginosa PA01
uccaugaaugccuuga

SEQ ID NO: 3478368 - RNA, 21 nt, Pseudomonas aeruginosa PA01
uccaugcgcaccaggucgcgc

SEQ ID NO: 3478369 - RNA, 21 nt, Pseudomonas aeruginosa PA01
uccauggaccgagaccgacgc

SEQ ID NO: 3478370 - RNA, 14 nt, Pseudomonas aeruginosa PA01
uccauggcggcgau

SEQ ID NO: 3478371 - RNA, 21 nt, Pseudomonas aeruginosa PA01
uccauguagcguugcaggcag

SEQ ID NO: 3478372 - RNA, 15 nt, Pseudomonas aeruginosa PA01
uccaugucgcuggcc

SEQ ID NO: 3478373 - RNA, 19 nt, Pseudomonas aeruginosa PA01
uccauuagcgucgcgcggc

SEQ ID NO: 3478374 - RNA, 20 nt, Pseudomonas aeruginosa PA01
ucccaacagucgucgcgcag

SEQ ID NO: 3478375 - RNA, 19 nt, Pseudomonas aeruginosa PA01
ucccacuccagcgcgggca

SEQ ID NO: 3478376 - RNA, 15 nt, Pseudomonas aeruginosa PA01
ucccagaaaaucggc

SEQ ID NO: 3478377 - RNA, 19 nt, Pseudomonas aeruginosa PA01
ucccagaaggccagggcau

SEQ ID NO: 3478378 - RNA, 17 nt, Pseudomonas aeruginosa PA01
ucccagaagucgcuggc

SEQ ID NO: 3478379 - RNA, 22 nt, Pseudomonas aeruginosa PA01
ucccagaagucgcuggccuggg

SEQ ID NO: 3478380 - RNA, 14 nt, Pseudomonas aeruginosa PA01
ucccagaccacccg

SEQ ID NO: 3478381 - RNA, 13 nt, Pseudomonas aeruginosa PA01
ucccagaccagca

SEQ ID NO: 3478382 - RNA, 14 nt, Pseudomonas aeruginosa PA01
ucccagaccagcag

SEQ ID NO: 3478383 - RNA, 17 nt, Pseudomonas aeruginosa PA01
ucccagaccagcagcgg

SEQ ID NO: 3478384 - RNA, 18 nt, Pseudomonas aeruginosa PA01
ucccagaccagcagcggc

SEQ ID NO: 3478385 - RNA, 16 nt, Pseudomonas aeruginosa PA01
ucccagaccuggccgc

SEQ ID NO: 3478386 - RNA, 18 nt, Pseudomonas aeruginosa PA01
ucccagacguccagcgcc

SEQ ID NO: 3478387 - RNA, 16 nt, Pseudomonas aeruginosa PA01
ucccagcagcgccucg

SEQ ID NO: 3478388 - RNA, 12 nt, Pseudomonas aeruginosa PA01
ucccagccacag

SEQ ID NO: 3478389 - RNA, 16 nt, Pseudomonas aeruginosa PA01
ucccagccgaggcagc

SEQ ID NO: 3478390 - RNA, 23 nt, Pseudomonas aeruginosa PA01
ucccagccgaggcagccgucggu

SEQ ID NO: 3478391 - RNA, 19 nt, Pseudomonas aeruginosa PA01
ucccagccgugggcguaga

SEQ ID NO: 3478392 - RNA, 19 nt, Pseudomonas aeruginosa PA01
ucccagcgagugcugaaca

SEQ ID NO: 3478393 - RNA, 19 nt, Pseudomonas aeruginosa PA01
ucccagcguuguccucggc

SEQ ID NO: 3478394 - RNA, 22 nt, Pseudomonas aeruginosa PA01
ucccagcguuguccucggcggc

SEQ ID NO: 3478395 - RNA, 15 nt, Pseudomonas aeruginosa PA01
ucccagcucgccgaa

SEQ ID NO: 3478396 - RNA, 17 nt, Pseudomonas aeruginosa PA01
ucccaggccagcgggcu

SEQ ID NO: 3478397 - RNA, 17 nt, Pseudomonas aeruginosa PA01
ucccaggcgucgccgac

SEQ ID NO: 3478398 - RNA, 15 nt, Pseudomonas aeruginosa PA01
ucccaggcuggcggc

SEQ ID NO: 3478399 - RNA, 16 nt, Pseudomonas aeruginosa PA01
ucccaggcuggcggca

SEQ ID NO: 3478400 - RNA, 16 nt, Pseudomonas aeruginosa PA01
ucccagguagcgcugc

SEQ ID NO: 3478401 - RNA, 18 nt, Pseudomonas aeruginosa PA01
ucccaggucggcgggcac

SEQ ID NO: 3478402 - RNA, 20 nt, Pseudomonas aeruginosa PA01
ucccaggucggcgggcaccg

SEQ ID NO: 3478403 - RNA, 16 nt, Pseudomonas aeruginosa PA01
ucccaggugcccugga

SEQ ID NO: 3478404 - RNA, 15 nt, Pseudomonas aeruginosa PA01
ucccagguuggcgaa

SEQ ID NO: 3478405 - RNA, 12 nt, Pseudomonas aeruginosa PA01
ucccagucggcg

SEQ ID NO: 3478406 - RNA, 21 nt, Pseudomonas aeruginosa PA01
ucccagucggcguccgccucg

SEQ ID NO: 3478407 - RNA, 21 nt, Pseudomonas aeruginosa PA01
ucccaugaccgucagccaggc

SEQ ID NO: 3478408 - RNA, 21 nt, Pseudomonas aeruginosa PA01
ucccaugagcgacccaacggg

SEQ ID NO: 3478409 - RNA, 14 nt, Pseudomonas aeruginosa PA01
ucccaugccaggag

SEQ ID NO: 3478410 - RNA, 20 nt, Pseudomonas aeruginosa PA01
ucccauucgcugucgucggc

SEQ ID NO: 3478411 - RNA, 13 nt, Pseudomonas aeruginosa PA01
uccccaacccggc

SEQ ID NO: 3478412 - RNA, 14 nt, Pseudomonas aeruginosa PA01
uccccaaccuucuc

SEQ ID NO: 3478413 - RNA, 16 nt, Pseudomonas aeruginosa PA01
uccccaaggcacgccc

SEQ ID NO: 3478414 - RNA, 20 nt, Pseudomonas aeruginosa PA01
uccccaaggcacgccccauc

SEQ ID NO: 3478415 - RNA, 21 nt, Pseudomonas aeruginosa PA01
uccccaaggcacgccccaucc

SEQ ID NO: 3478416 - RNA, 22 nt, Pseudomonas aeruginosa PA01
uccccaccaacucagucgaggu

SEQ ID NO: 3478417 - RNA, 15 nt, Pseudomonas aeruginosa PA01
uccccagacccucuc

SEQ ID NO: 3478418 - RNA, 16 nt, Pseudomonas aeruginosa PA01
uccccagacccucucc

SEQ ID NO: 3478419 - RNA, 15 nt, Pseudomonas aeruginosa PA01
uccccagcaggcagg

SEQ ID NO: 3478420 - RNA, 20 nt, Pseudomonas aeruginosa PA01
ucccccacguacuccagcaa

SEQ ID NO: 3478421 - RNA, 12 nt, Pseudomonas aeruginosa PA01
ucccccagcacc

SEQ ID NO: 3478422 - RNA, 13 nt, Pseudomonas aeruginosa PA01
ucccccagcaccu

SEQ ID NO: 3478423 - RNA, 13 nt, Pseudomonas aeruginosa PA01
ucccccagcgggc

SEQ ID NO: 3478424 - RNA, 14 nt, Pseudomonas aeruginosa PA01
uccccccacccguc

SEQ ID NO: 3478425 - RNA, 15 nt, Pseudomonas aeruginosa PA01
uccccccacccgucc

SEQ ID NO: 3478426 - RNA, 21 nt, Pseudomonas aeruginosa PA01
uccccccgcgaagcgacggcg

SEQ ID NO: 3478427 - RNA, 16 nt, Pseudomonas aeruginosa PA01
uccccccuacgaaagc

SEQ ID NO: 3478428 - RNA, 14 nt, Pseudomonas aeruginosa PA01
ucccccgccccuca

SEQ ID NO: 3478429 - RNA, 12 nt, Pseudomonas aeruginosa PA01
ucccccgcgccg

SEQ ID NO: 3478430 - RNA, 15 nt, Pseudomonas aeruginosa PA01
ucccccgcgccgccg

SEQ ID NO: 3478431 - RNA, 17 nt, Pseudomonas aeruginosa PA01
uccccgcaccugccguc

SEQ ID NO: 3478432 - RNA, 18 nt, Pseudomonas aeruginosa PA01
uccccgcaccugccguca

SEQ ID NO: 3478433 - RNA, 15 nt, Pseudomonas aeruginosa PA01
uccccgccacuucca

SEQ ID NO: 3478434 - RNA, 19 nt, Pseudomonas aeruginosa PA01
uccccgccacuuccagcac

SEQ ID NO: 3478435 - RNA, 14 nt, Pseudomonas aeruginosa PA01
uccccgccgccagg

SEQ ID NO: 3478436 - RNA, 16 nt, Pseudomonas aeruginosa PA01
uccccggaccagggcg

SEQ ID NO: 3478437 - RNA, 15 nt, Pseudomonas aeruginosa PA01
uccccggccagcagc

SEQ ID NO: 3478438 - RNA, 19 nt, Pseudomonas aeruginosa PA01
uccccggccagcagcgccu

SEQ ID NO: 3478439 - RNA, 14 nt, Pseudomonas aeruginosa PA01
uccccguccuggcg

SEQ ID NO: 3478440 - RNA, 13 nt, Pseudomonas aeruginosa PA01
uccccucacggcg

SEQ ID NO: 3478441 - RNA, 15 nt, Pseudomonas aeruginosa PA01
uccccucacggcgcg

SEQ ID NO: 3478442 - RNA, 16 nt, Pseudomonas aeruginosa PA01
uccccucaggcgccgc

SEQ ID NO: 3478443 - RNA, 20 nt, Pseudomonas aeruginosa PA01
uccccucaggcgccgcuguc

SEQ ID NO: 3478444 - RNA, 14 nt, Pseudomonas aeruginosa PA01
uccccuccagguag

SEQ ID NO: 3478445 - RNA, 18 nt, Pseudomonas aeruginosa PA01
uccccugcaugccggccg

SEQ ID NO: 3478446 - RNA, 18 nt, Pseudomonas aeruginosa PA01
uccccugccgaaccgccu

SEQ ID NO: 3478447 - RNA, 22 nt, Pseudomonas aeruginosa PA01
uccccugccgaaccgccucaga

SEQ ID NO: 3478448 - RNA, 16 nt, Pseudomonas aeruginosa PA01
uccccuggagcccccg

SEQ ID NO: 3478449 - RNA, 23 nt, Pseudomonas aeruginosa PA01
uccccuguggucaggcgccagga

SEQ ID NO: 3478450 - RNA, 20 nt, Pseudomonas aeruginosa PA01
uccccuuccuccucgccgcu

SEQ ID NO: 3478451 - RNA, 18 nt, Pseudomonas aeruginosa PA01
uccccuucgucuaguggc

SEQ ID NO: 3478452 - RNA, 23 nt, Pseudomonas aeruginosa PA01
uccccuuuuucaugcgcgggccg

SEQ ID NO: 3478453 - RNA, 14 nt, Pseudomonas aeruginosa PA01
uccccuuuuuucag

SEQ ID NO: 3478454 - RNA, 13 nt, Pseudomonas aeruginosa PA01
ucccgacgcccuc

SEQ ID NO: 3478455 - RNA, 23 nt, Pseudomonas aeruginosa PA01
ucccgagcaccggccucaagcaa

SEQ ID NO: 3478456 - RNA, 15 nt, Pseudomonas aeruginosa PA01
ucccgaggcgaucgc

SEQ ID NO: 3478457 - RNA, 18 nt, Pseudomonas aeruginosa PA01
ucccgaggcgaucgccgc

SEQ ID NO: 3478458 - RNA, 22 nt, Pseudomonas aeruginosa PA01
ucccgaggcgaucgccgcggcg

SEQ ID NO: 3478459 - RNA, 18 nt, Pseudomonas aeruginosa PA01
ucccgaggguggcgcugg

SEQ ID NO: 3478460 - RNA, 19 nt, Pseudomonas aeruginosa PA01
ucccgaggguggcgcuggc

SEQ ID NO: 3478461 - RNA, 15 nt, Pseudomonas aeruginosa PA01
ucccgaguucaccac

SEQ ID NO: 3478462 - RNA, 19 nt, Pseudomonas aeruginosa PA01
ucccgaucucgguuuccag

SEQ ID NO: 3478463 - RNA, 12 nt, Pseudomonas aeruginosa PA01
ucccgcaccggc

SEQ ID NO: 3478464 - RNA, 14 nt, Pseudomonas aeruginosa PA01
ucccgcaccggcgc

SEQ ID NO: 3478465 - RNA, 15 nt, Pseudomonas aeruginosa PA01
ucccgcaccggcgcg

SEQ ID NO: 3478466 - RNA, 18 nt, Pseudomonas aeruginosa PA01
ucccgcaccggcgcgccg

SEQ ID NO: 3478467 - RNA, 19 nt, Pseudomonas aeruginosa PA01
ucccgcaccggcgcgccgg

SEQ ID NO: 3478468 - RNA, 22 nt, Pseudomonas aeruginosa PA01
ucccgcaccggcgcgccggaca

SEQ ID NO: 3478469 - RNA, 21 nt, Pseudomonas aeruginosa PA01
ucccgcagcgaucagcaccag

SEQ ID NO: 3478470 - RNA, 22 nt, Pseudomonas aeruginosa PA01
ucccgcagcgaucagcaccagc

SEQ ID NO: 3478471 - RNA, 21 nt, Pseudomonas aeruginosa PA01
ucccgcaguagcucgccgagg

SEQ ID NO: 3478472 - RNA, 22 nt, Pseudomonas aeruginosa PA01
ucccgcaguagcucgccgaggu

SEQ ID NO: 3478473 - RNA, 23 nt, Pseudomonas aeruginosa PA01
ucccgcccaucaacgagccgagc

SEQ ID NO: 3478474 - RNA, 12 nt, Pseudomonas aeruginosa PA01
ucccgcccccuc

SEQ ID NO: 3478475 - RNA, 19 nt, Pseudomonas aeruginosa PA01
ucccgccccuccaguuccu

SEQ ID NO: 3478476 - RNA, 20 nt, Pseudomonas aeruginosa PA01
ucccgcccggucucagccgg

SEQ ID NO: 3478477 - RNA, 22 nt, Pseudomonas aeruginosa PA01
ucccgcccggucucagccggcg

SEQ ID NO: 3478478 - RNA, 13 nt, Pseudomonas aeruginosa PA01
ucccgccgcgccg

SEQ ID NO: 3478479 - RNA, 18 nt, Pseudomonas aeruginosa PA01
ucccgccgcucugcuggc

SEQ ID NO: 3478480 - RNA, 22 nt, Pseudomonas aeruginosa PA01
ucccgcgauaucacgccccucc

SEQ ID NO: 3478481 - RNA, 15 nt, Pseudomonas aeruginosa PA01
ucccgcgauucgccg

SEQ ID NO: 3478482 - RNA, 18 nt, Pseudomonas aeruginosa PA01
ucccgcgauucgccgggc

SEQ ID NO: 3478483 - RNA, 14 nt, Pseudomonas aeruginosa PA01
ucccgcgccagcuc

SEQ ID NO: 3478484 - RNA, 17 nt, Pseudomonas aeruginosa PA01
ucccgcgcgcugugcac

SEQ ID NO: 3478485 - RNA, 17 nt, Pseudomonas aeruginosa PA01
ucccgcgcggcccuucg

SEQ ID NO: 3478486 - RNA, 12 nt, Pseudomonas aeruginosa PA01
ucccgcggcgcg

SEQ ID NO: 3478487 - RNA, 17 nt, Pseudomonas aeruginosa PA01
ucccgcggcuccagccg

SEQ ID NO: 3478488 - RNA, 13 nt, Pseudomonas aeruginosa PA01
ucccgcuccagcc

SEQ ID NO: 3478489 - RNA, 17 nt, Pseudomonas aeruginosa PA01
ucccgcuccagccggca

SEQ ID NO: 3478490 - RNA, 13 nt, Pseudomonas aeruginosa PA01
ucccgcuccaggc

SEQ ID NO: 3478491 - RNA, 18 nt, Pseudomonas aeruginosa PA01
ucccgcuccgauggcgcu

SEQ ID NO: 3478492 - RNA, 16 nt, Pseudomonas aeruginosa PA01
ucccggagaucggcug

SEQ ID NO: 3478493 - RNA, 13 nt, Pseudomonas aeruginosa PA01
ucccggaggcggc

SEQ ID NO: 3478494 - RNA, 15 nt, Pseudomonas aeruginosa PA01
ucccggaggcggcga

SEQ ID NO: 3478495 - RNA, 22 nt, Pseudomonas aeruginosa PA01
ucccggaucagcucgcguagcg

SEQ ID NO: 3478496 - RNA, 16 nt, Pseudomonas aeruginosa PA01
ucccggauucgccgag

SEQ ID NO: 3478497 - RNA, 17 nt, Pseudomonas aeruginosa PA01
ucccggauucgccgagg

SEQ ID NO: 3478498 - RNA, 14 nt, Pseudomonas aeruginosa PA01
ucccggccuggcgc

SEQ ID NO: 3478499 - RNA, 22 nt, Pseudomonas aeruginosa PA01
ucccggccuggcgcgcgcgcca

SEQ ID NO: 3478500 - RNA, 14 nt, Pseudomonas aeruginosa PA01
ucccggcgcggccg

SEQ ID NO: 3478501 - RNA, 23 nt, Pseudomonas aeruginosa PA01
ucccggcgcggcuacccucuccc

SEQ ID NO: 3478502 - RNA, 13 nt, Pseudomonas aeruginosa PA01
ucccggcggcgac

SEQ ID NO: 3478503 - RNA, 15 nt, Pseudomonas aeruginosa PA01
ucccggcgguuucgc

SEQ ID NO: 3478504 - RNA, 15 nt, Pseudomonas aeruginosa PA01
ucccggcucgccgac

SEQ ID NO: 3478505 - RNA, 14 nt, Pseudomonas aeruginosa PA01
ucccggcucggcac

SEQ ID NO: 3478506 - RNA, 16 nt, Pseudomonas aeruginosa PA01
ucccggcugagcgcca

SEQ ID NO: 3478507 - RNA, 19 nt, Pseudomonas aeruginosa PA01
ucccggcugagcgccaggc

SEQ ID NO: 3478508 - RNA, 20 nt, Pseudomonas aeruginosa PA01
ucccggcugagcgccaggcg

SEQ ID NO: 3478509 - RNA, 16 nt, Pseudomonas aeruginosa PA01
ucccggcuugccggca

SEQ ID NO: 3478510 - RNA, 17 nt, Pseudomonas aeruginosa PA01
ucccggcuugccggcag

SEQ ID NO: 3478511 - RNA, 21 nt, Pseudomonas aeruginosa PA01
ucccggcuugccggcagcgac

SEQ ID NO: 3478512 - RNA, 17 nt, Pseudomonas aeruginosa PA01
ucccggcuugcugacga

SEQ ID NO: 3478513 - RNA, 17 nt, Pseudomonas aeruginosa PA01
ucccgggaaaccaccag

SEQ ID NO: 3478514 - RNA, 18 nt, Pseudomonas aeruginosa PA01
ucccgggaaaccaccagg

SEQ ID NO: 3478515 - RNA, 19 nt, Pseudomonas aeruginosa PA01
ucccgggaaaccaccagga

SEQ ID NO: 3478516 - RNA, 19 nt, Pseudomonas aeruginosa PA01
ucccgggccagcuccgccu

SEQ ID NO: 3478517 - RNA, 23 nt, Pseudomonas aeruginosa PA01
ucccgggcuccggguugucgucg

SEQ ID NO: 3478518 - RNA, 18 nt, Pseudomonas aeruginosa PA01
ucccggucgagguugcgc

SEQ ID NO: 3478519 - RNA, 21 nt, Pseudomonas aeruginosa PA01
ucccggucgagguugcgcggc

SEQ ID NO: 3478520 - RNA, 17 nt, Pseudomonas aeruginosa PA01
ucccgguuuccgcagcg

SEQ ID NO: 3478521 - RNA, 16 nt, Pseudomonas aeruginosa PA01
ucccguaaggccaggc

SEQ ID NO: 3478522 - RNA, 18 nt, Pseudomonas aeruginosa PA01
ucccguaaggccaggcuc

SEQ ID NO: 3478523 - RNA, 14 nt, Pseudomonas aeruginosa PA01
ucccguaccagcgc

SEQ ID NO: 3478524 - RNA, 16 nt, Pseudomonas aeruginosa PA01
ucccguaccagcgcga

SEQ ID NO: 3478525 - RNA, 14 nt, Pseudomonas aeruginosa PA01
ucccguagaccggc

SEQ ID NO: 3478526 - RNA, 15 nt, Pseudomonas aeruginosa PA01
ucccguagaccggcu

SEQ ID NO: 3478527 - RNA, 12 nt, Pseudomonas aeruginosa PA01
ucccguccagcg

SEQ ID NO: 3478528 - RNA, 14 nt, Pseudomonas aeruginosa PA01
ucccguccgcugcg

SEQ ID NO: 3478529 - RNA, 15 nt, Pseudomonas aeruginosa PA01
ucccguccgggcacg

SEQ ID NO: 3478530 - RNA, 23 nt, Pseudomonas aeruginosa PA01
ucccgugggucguugagggcacg

SEQ ID NO: 3478531 - RNA, 14 nt, Pseudomonas aeruginosa PA01
ucccguguaccacg

SEQ ID NO: 3478532 - RNA, 20 nt, Pseudomonas aeruginosa PA01
ucccguguaccacgcccgcg

SEQ ID NO: 3478533 - RNA, 17 nt, Pseudomonas aeruginosa PA01
ucccguuccggcgcagc

SEQ ID NO: 3478534 - RNA, 23 nt, Pseudomonas aeruginosa PA01
ucccguuggggaugcgccguacg

SEQ ID NO: 3478535 - RNA, 15 nt, Pseudomonas aeruginosa PA01
ucccuaccagcgcaa

SEQ ID NO: 3478536 - RNA, 13 nt, Pseudomonas aeruginosa PA01
ucccucaaccggc

SEQ ID NO: 3478537 - RNA, 15 nt, Pseudomonas aeruginosa PA01
ucccucaaccggcgu

SEQ ID NO: 3478538 - RNA, 15 nt, Pseudomonas aeruginosa PA01
ucccucaggauagcc

SEQ ID NO: 3478539 - RNA, 19 nt, Pseudomonas aeruginosa PA01
ucccucgucaucauccuga

SEQ ID NO: 3478540 - RNA, 17 nt, Pseudomonas aeruginosa PA01
ucccugaagggagaggg

SEQ ID NO: 3478541 - RNA, 14 nt, Pseudomonas aeruginosa PA01
ucccugaccagcag

SEQ ID NO: 3478542 - RNA, 23 nt, Pseudomonas aeruginosa PA01
ucccugcacagggacgcggcguu

SEQ ID NO: 3478543 - RNA, 16 nt, Pseudomonas aeruginosa PA01
ucccugcccgcucggg

SEQ ID NO: 3478544 - RNA, 14 nt, Pseudomonas aeruginosa PA01
ucccugccggcggu

SEQ ID NO: 3478545 - RNA, 17 nt, Pseudomonas aeruginosa PA01
ucccugcuucgaccagg

SEQ ID NO: 3478546 - RNA, 14 nt, Pseudomonas aeruginosa PA01
ucccuggagcaggg

SEQ ID NO: 3478547 - RNA, 15 nt, Pseudomonas aeruginosa PA01
ucccuggagcagggc

SEQ ID NO: 3478548 - RNA, 20 nt, Pseudomonas aeruginosa PA01
ucccuggagcagggcgauga

SEQ ID NO: 3478549 - RNA, 12 nt, Pseudomonas aeruginosa PA01
ucccuggccggc

SEQ ID NO: 3478550 - RNA, 19 nt, Pseudomonas aeruginosa PA01
ucccuggcgacgucccuuc

SEQ ID NO: 3478551 - RNA, 17 nt, Pseudomonas aeruginosa PA01
ucccugggccugcaggu

SEQ ID NO: 3478552 - RNA, 16 nt, Pseudomonas aeruginosa PA01
ucccuguacgcaggag

SEQ ID NO: 3478553 - RNA, 15 nt, Pseudomonas aeruginosa PA01
ucccuucgugcuggc

SEQ ID NO: 3478554 - RNA, 12 nt, Pseudomonas aeruginosa PA01
ucccuucuuuua

SEQ ID NO: 3478555 - RNA, 21 nt, Pseudomonas aeruginosa PA01
ucccuucuuuuuuucaccgcu

SEQ ID NO: 3478556 - RNA, 22 nt, Pseudomonas aeruginosa PA01
ucccuucuuuuuuucaccgcuc

SEQ ID NO: 3478557 - RNA, 14 nt, Pseudomonas aeruginosa PA01
ucccuuggcugcuc

SEQ ID NO: 3478558 - RNA, 19 nt, Pseudomonas aeruginosa PA01
ucccuuguuuuccuggccc

SEQ ID NO: 3478559 - RNA, 21 nt, Pseudomonas aeruginosa PA01
ucccuuguuuuccuggcccug

SEQ ID NO: 3478560 - RNA, 12 nt, Pseudomonas aeruginosa PA01
ucccuuuuucau

SEQ ID NO: 3478561 - RNA, 14 nt, Pseudomonas aeruginosa PA01
uccgaaaccaggau

SEQ ID NO: 3478562 - RNA, 22 nt, Pseudomonas aeruginosa PA01
uccgaagggaacccgcggcgcg

SEQ ID NO: 3478563 - RNA, 19 nt, Pseudomonas aeruginosa PA01
uccgaauacugcacgccca

SEQ ID NO: 3478564 - RNA, 17 nt, Pseudomonas aeruginosa PA01
uccgaaucgccuaccag

SEQ ID NO: 3478565 - RNA, 20 nt, Pseudomonas aeruginosa PA01
uccgacaaggagcgcgagcg

SEQ ID NO: 3478566 - RNA, 14 nt, Pseudomonas aeruginosa PA01
uccgacaaucagcg

SEQ ID NO: 3478567 - RNA, 21 nt, Pseudomonas aeruginosa PA01
uccgaccagguagagcagccc

SEQ ID NO: 3478568 - RNA, 18 nt, Pseudomonas aeruginosa PA01
uccgacccggccgaccag

SEQ ID NO: 3478569 - RNA, 19 nt, Pseudomonas aeruginosa PA01
uccgacgccggcuuccacc

SEQ ID NO: 3478570 - RNA, 22 nt, Pseudomonas aeruginosa PA01
uccgacggaaauaggcgucguc

SEQ ID NO: 3478571 - RNA, 21 nt, Pseudomonas aeruginosa PA01
uccgacucuccgcgccgcggc

SEQ ID NO: 3478572 - RNA, 14 nt, Pseudomonas aeruginosa PA01
uccgagacgcugca

SEQ ID NO: 3478573 - RNA, 21 nt, Pseudomonas aeruginosa PA01
uccgagacgcugcaccgcggc

SEQ ID NO: 3478574 - RNA, 12 nt, Pseudomonas aeruginosa PA01
uccgagcaggcc

SEQ ID NO: 3478575 - RNA, 13 nt, Pseudomonas aeruginosa PA01
uccgagcaggccu

SEQ ID NO: 3478576 - RNA, 22 nt, Pseudomonas aeruginosa PA01
uccgagcaggccuugcagggcc

SEQ ID NO: 3478577 - RNA, 23 nt, Pseudomonas aeruginosa PA01
uccgagcaggccuugcagggccg

SEQ ID NO: 3478578 - RNA, 19 nt, Pseudomonas aeruginosa PA01
uccgagcaggucgcggaac

SEQ ID NO: 3478579 - RNA, 23 nt, Pseudomonas aeruginosa PA01
uccgagcaggucgcggaacucga

SEQ ID NO: 3478580 - RNA, 14 nt, Pseudomonas aeruginosa PA01
uccgaggccaccac

SEQ ID NO: 3478581 - RNA, 21 nt, Pseudomonas aeruginosa PA01
uccgagggaggaggcgccggg

SEQ ID NO: 3478582 - RNA, 23 nt, Pseudomonas aeruginosa PA01
uccgagggaggaggcgccgggua

SEQ ID NO: 3478583 - RNA, 18 nt, Pseudomonas aeruginosa PA01
uccgagggccgcgccgac

SEQ ID NO: 3478584 - RNA, 21 nt, Pseudomonas aeruginosa PA01
uccgagggccgcgccgaccca

SEQ ID NO: 3478585 - RNA, 16 nt, Pseudomonas aeruginosa PA01
uccgaugaagcaggcg

SEQ ID NO: 3478586 - RNA, 13 nt, Pseudomonas aeruginosa PA01
uccgaugcgacgc

SEQ ID NO: 3478587 - RNA, 20 nt, Pseudomonas aeruginosa PA01
uccgcaaggagcccuuuuca

SEQ ID NO: 3478588 - RNA, 12 nt, Pseudomonas aeruginosa PA01
uccgcacccgcg

SEQ ID NO: 3478589 - RNA, 14 nt, Pseudomonas aeruginosa PA01
uccgcacccgggca

SEQ ID NO: 3478590 - RNA, 14 nt, Pseudomonas aeruginosa PA01
uccgcagcacagcc

SEQ ID NO: 3478591 - RNA, 15 nt, Pseudomonas aeruginosa PA01
uccgcagcacagccc

SEQ ID NO: 3478592 - RNA, 15 nt, Pseudomonas aeruginosa PA01
uccgcagccuuggca

SEQ ID NO: 3478593 - RNA, 21 nt, Pseudomonas aeruginosa PA01
uccgcagcgccacuuccagcu

SEQ ID NO: 3478594 - RNA, 17 nt, Pseudomonas aeruginosa PA01
uccgcaggcaggucgcu

SEQ ID NO: 3478595 - RNA, 21 nt, Pseudomonas aeruginosa PA01
uccgcagguagcugagcaggc

SEQ ID NO: 3478596 - RNA, 18 nt, Pseudomonas aeruginosa PA01
uccgcagucuucucggug

SEQ ID NO: 3478597 - RNA, 22 nt, Pseudomonas aeruginosa PA01
uccgcaguucgccccgccgcca

SEQ ID NO: 3478598 - RNA, 18 nt, Pseudomonas aeruginosa PA01
uccgcaucggccaccuuc

SEQ ID NO: 3478599 - RNA, 15 nt, Pseudomonas aeruginosa PA01
uccgcaucggccgac

SEQ ID NO: 3478600 - RNA, 23 nt, Pseudomonas aeruginosa PA01
uccgcaucggccgacagagcggc

SEQ ID NO: 3478601 - RNA, 18 nt, Pseudomonas aeruginosa PA01
uccgccaccacggcgaag

SEQ ID NO: 3478602 - RNA, 22 nt, Pseudomonas aeruginosa PA01
uccgccaccagccagucgagac

SEQ ID NO: 3478603 - RNA, 22 nt, Pseudomonas aeruginosa PA01
uccgccacccguuccuugcgcg

SEQ ID NO: 3478604 - RNA, 22 nt, Pseudomonas aeruginosa PA01
uccgccacuucaagcuggcgca

SEQ ID NO: 3478605 - RNA, 23 nt, Pseudomonas aeruginosa PA01
uccgccagaugcgcgucgccgaa

SEQ ID NO: 3478606 - RNA, 17 nt, Pseudomonas aeruginosa PA01
uccgccagcaccacccg

SEQ ID NO: 3478607 - RNA, 19 nt, Pseudomonas aeruginosa PA01
uccgccagcaccacccggc

SEQ ID NO: 3478608 - RNA, 16 nt, Pseudomonas aeruginosa PA01
uccgccagcaggcgcg

SEQ ID NO: 3478609 - RNA, 16 nt, Pseudomonas aeruginosa PA01
uccgccagcaggcguu

SEQ ID NO: 3478610 - RNA, 17 nt, Pseudomonas aeruginosa PA01
uccgccagccccaggcc

SEQ ID NO: 3478611 - RNA, 13 nt, Pseudomonas aeruginosa PA01
uccgccagccggc

SEQ ID NO: 3478612 - RNA, 14 nt, Pseudomonas aeruginosa PA01
uccgccagcuuguc

SEQ ID NO: 3478613 - RNA, 12 nt, Pseudomonas aeruginosa PA01
uccgccaggccg

SEQ ID NO: 3478614 - RNA, 15 nt, Pseudomonas aeruginosa PA01
uccgccaggccgcgc

SEQ ID NO: 3478615 - RNA, 19 nt, Pseudomonas aeruginosa PA01
uccgccaggcgcagccagc

SEQ ID NO: 3478616 - RNA, 21 nt, Pseudomonas aeruginosa PA01
uccgccaggcgcagccagcac

SEQ ID NO: 3478617 - RNA, 14 nt, Pseudomonas aeruginosa PA01
uccgccaggcggag

SEQ ID NO: 3478618 - RNA, 15 nt, Pseudomonas aeruginosa PA01
uccgccaggcggccg

SEQ ID NO: 3478619 - RNA, 15 nt, Pseudomonas aeruginosa PA01
uccgccagguccagg

SEQ ID NO: 3478620 - RNA, 16 nt, Pseudomonas aeruginosa PA01
uccgccagguccaggc

SEQ ID NO: 3478621 - RNA, 17 nt, Pseudomonas aeruginosa PA01
uccgccagguccaggcu

SEQ ID NO: 3478622 - RNA, 13 nt, Pseudomonas aeruginosa PA01
uccgccaguuccg

SEQ ID NO: 3478623 - RNA, 21 nt, Pseudomonas aeruginosa PA01
uccgccaguuccggggucagc

SEQ ID NO: 3478624 - RNA, 18 nt, Pseudomonas aeruginosa PA01
uccgcccaguucgccggc

SEQ ID NO: 3478625 - RNA, 19 nt, Pseudomonas aeruginosa PA01
uccgcccaguucgccggcc

SEQ ID NO: 3478626 - RNA, 20 nt, Pseudomonas aeruginosa PA01
uccgcccaguucgccggcca

SEQ ID NO: 3478627 - RNA, 22 nt, Pseudomonas aeruginosa PA01
uccgcccaguucgccggccagc

SEQ ID NO: 3478628 - RNA, 21 nt, Pseudomonas aeruginosa PA01
uccgcccaguucuucgccgcc

SEQ ID NO: 3478629 - RNA, 17 nt, Pseudomonas aeruginosa PA01
uccgcccauugcccggc

SEQ ID NO: 3478630 - RNA, 19 nt, Pseudomonas aeruginosa PA01
uccgcccauugcccggcca

SEQ ID NO: 3478631 - RNA, 16 nt, Pseudomonas aeruginosa PA01
uccgccccaccccagg

SEQ ID NO: 3478632 - RNA, 18 nt, Pseudomonas aeruginosa PA01
uccgccccaccccagggu

SEQ ID NO: 3478633 - RNA, 21 nt, Pseudomonas aeruginosa PA01
uccgcccuacggaccggugcc

SEQ ID NO: 3478634 - RNA, 23 nt, Pseudomonas aeruginosa PA01
uccgcccuuuuucgucgccagcc

SEQ ID NO: 3478635 - RNA, 22 nt, Pseudomonas aeruginosa PA01
uccgccgaacgccaccagggcc

SEQ ID NO: 3478636 - RNA, 22 nt, Pseudomonas aeruginosa PA01
uccgccgacugcaacuggccga

SEQ ID NO: 3478637 - RNA, 19 nt, Pseudomonas aeruginosa PA01
uccgccgauugugcagggc

SEQ ID NO: 3478638 - RNA, 20 nt, Pseudomonas aeruginosa PA01
uccgccgauugugcagggcc

SEQ ID NO: 3478639 - RNA, 13 nt, Pseudomonas aeruginosa PA01
uccgccgcagacc

SEQ ID NO: 3478640 - RNA, 16 nt, Pseudomonas aeruginosa PA01
uccgccgcagaccagc

SEQ ID NO: 3478641 - RNA, 14 nt, Pseudomonas aeruginosa PA01
uccgccgccgacgu

SEQ ID NO: 3478642 - RNA, 14 nt, Pseudomonas aeruginosa PA01
uccgccgccgggcu

SEQ ID NO: 3478643 - RNA, 16 nt, Pseudomonas aeruginosa PA01
uccgccgccgggcuuc

SEQ ID NO: 3478644 - RNA, 13 nt, Pseudomonas aeruginosa PA01
uccgccgccgugg

SEQ ID NO: 3478645 - RNA, 15 nt, Pseudomonas aeruginosa PA01
uccgccgccguggcu

SEQ ID NO: 3478646 - RNA, 18 nt, Pseudomonas aeruginosa PA01
uccgccgcgccucgucgc

SEQ ID NO: 3478647 - RNA, 19 nt, Pseudomonas aeruginosa PA01
uccgccgcgccucgucgcg

SEQ ID NO: 3478648 - RNA, 12 nt, Pseudomonas aeruginosa PA01
uccgccgcggca

SEQ ID NO: 3478649 - RNA, 23 nt, Pseudomonas aeruginosa PA01
uccgccgcggcaaugcggcgaug

SEQ ID NO: 3478650 - RNA, 18 nt, Pseudomonas aeruginosa PA01
uccgccgcgugcgcgccc

SEQ ID NO: 3478651 - RNA, 19 nt, Pseudomonas aeruginosa PA01
uccgccgcuaucgccgccg

SEQ ID NO: 3478652 - RNA, 13 nt, Pseudomonas aeruginosa PA01
uccgccgcucacc

SEQ ID NO: 3478653 - RNA, 18 nt, Pseudomonas aeruginosa PA01
uccgccgcucccggcuug

SEQ ID NO: 3478654 - RNA, 21 nt, Pseudomonas aeruginosa PA01
uccgccgcucccggcuugcug

SEQ ID NO: 3478655 - RNA, 14 nt, Pseudomonas aeruginosa PA01
uccgccgcugggga

SEQ ID NO: 3478656 - RNA, 18 nt, Pseudomonas aeruginosa PA01
uccgccgcuuccgccggc

SEQ ID NO: 3478657 - RNA, 16 nt, Pseudomonas aeruginosa PA01
uccgccggaaccugca

SEQ ID NO: 3478658 - RNA, 22 nt, Pseudomonas aeruginosa PA01
uccgccggacccugccguucgu

SEQ ID NO: 3478659 - RNA, 16 nt, Pseudomonas aeruginosa PA01
uccgccggccggggcg

SEQ ID NO: 3478660 - RNA, 13 nt, Pseudomonas aeruginosa PA01
uccgccggcgaug

SEQ ID NO: 3478661 - RNA, 14 nt, Pseudomonas aeruginosa PA01
uccgccggcgaugc

SEQ ID NO: 3478662 - RNA, 21 nt, Pseudomonas aeruginosa PA01
uccgccggcgaugcccaggcc

SEQ ID NO: 3478663 - RNA, 22 nt, Pseudomonas aeruginosa PA01
uccgccggcgaugcccaggccg

SEQ ID NO: 3478664 - RNA, 15 nt, Pseudomonas aeruginosa PA01
uccgccggcgccgcc

SEQ ID NO: 3478665 - RNA, 17 nt, Pseudomonas aeruginosa PA01
uccgccggcgccgccuc

SEQ ID NO: 3478666 - RNA, 19 nt, Pseudomonas aeruginosa PA01
uccgccggcugugcagggc

SEQ ID NO: 3478667 - RNA, 16 nt, Pseudomonas aeruginosa PA01
uccgccgucgggcuuc

SEQ ID NO: 3478668 - RNA, 23 nt, Pseudomonas aeruginosa PA01
uccgccguuccuccucgccgccg

SEQ ID NO: 3478669 - RNA, 15 nt, Pseudomonas aeruginosa PA01
uccgccucgcgccgu

SEQ ID NO: 3478670 - RNA, 16 nt, Pseudomonas aeruginosa PA01
uccgccucgcugagca

SEQ ID NO: 3478671 - RNA, 20 nt, Pseudomonas aeruginosa PA01
uccgccucgcugagcaccgg

SEQ ID NO: 3478672 - RNA, 12 nt, Pseudomonas aeruginosa PA01
uccgccugggac

SEQ ID NO: 3478673 - RNA, 14 nt, Pseudomonas aeruginosa PA01
uccgccuguccacc

SEQ ID NO: 3478674 - RNA, 13 nt, Pseudomonas aeruginosa PA01
uccgccuuguccu

SEQ ID NO: 3478675 - RNA, 21 nt, Pseudomonas aeruginosa PA01
uccgccuuuuuugugcccggc

SEQ ID NO: 3478676 - RNA, 18 nt, Pseudomonas aeruginosa PA01
uccgcgacggaccgcgac

SEQ ID NO: 3478677 - RNA, 22 nt, Pseudomonas aeruginosa PA01
uccgcgaggcauucucgcgacc

SEQ ID NO: 3478678 - RNA, 19 nt, Pseudomonas aeruginosa PA01
uccgcgaugcguuccaggg

SEQ ID NO: 3478679 - RNA, 16 nt, Pseudomonas aeruginosa PA01
uccgcgauguccccgg

SEQ ID NO: 3478680 - RNA, 16 nt, Pseudomonas aeruginosa PA01
uccgcgcaacccuuca

SEQ ID NO: 3478681 - RNA, 20 nt, Pseudomonas aeruginosa PA01
uccgcgcaccuugcuggaca

SEQ ID NO: 3478682 - RNA, 23 nt, Pseudomonas aeruginosa PA01
uccgcgcaggaccacgcugguca

SEQ ID NO: 3478683 - RNA, 16 nt, Pseudomonas aeruginosa PA01
uccgcgccaugccggc

SEQ ID NO: 3478684 - RNA, 17 nt, Pseudomonas aeruginosa PA01
uccgcgccaugccggcg

SEQ ID NO: 3478685 - RNA, 20 nt, Pseudomonas aeruginosa PA01
uccgcgcccaggcgcaccuc

SEQ ID NO: 3478686 - RNA, 15 nt, Pseudomonas aeruginosa PA01
uccgcgcccaggcug

SEQ ID NO: 3478687 - RNA, 16 nt, Pseudomonas aeruginosa PA01
uccgcgcccaggcugc

SEQ ID NO: 3478688 - RNA, 20 nt, Pseudomonas aeruginosa PA01
uccgcgcccaggcugccggc

SEQ ID NO: 3478689 - RNA, 22 nt, Pseudomonas aeruginosa PA01
uccgcgcccaggcugccggcca

SEQ ID NO: 3478690 - RNA, 16 nt, Pseudomonas aeruginosa PA01
uccgcgcccggcuggc

SEQ ID NO: 3478691 - RNA, 12 nt, Pseudomonas aeruginosa PA01
uccgcgccgacc

SEQ ID NO: 3478692 - RNA, 13 nt, Pseudomonas aeruginosa PA01
uccgcgccgcgcg

SEQ ID NO: 3478693 - RNA, 13 nt, Pseudomonas aeruginosa PA01
uccgcgccgcggc

SEQ ID NO: 3478694 - RNA, 14 nt, Pseudomonas aeruginosa PA01
uccgcgccgcggcg

SEQ ID NO: 3478695 - RNA, 16 nt, Pseudomonas aeruginosa PA01
uccgcgccgcgucgcc

SEQ ID NO: 3478696 - RNA, 13 nt, Pseudomonas aeruginosa PA01
uccgcgccgggcu

SEQ ID NO: 3478697 - RNA, 17 nt, Pseudomonas aeruginosa PA01
uccgcgccgggcuggcc

SEQ ID NO: 3478698 - RNA, 18 nt, Pseudomonas aeruginosa PA01
uccgcgccgggcuggccg

SEQ ID NO: 3478699 - RNA, 20 nt, Pseudomonas aeruginosa PA01
uccgcgccgggcuggccguc

SEQ ID NO: 3478700 - RNA, 14 nt, Pseudomonas aeruginosa PA01
uccgcgccgguggc

SEQ ID NO: 3478701 - RNA, 19 nt, Pseudomonas aeruginosa PA01
uccgcgccgguggccagga

SEQ ID NO: 3478702 - RNA, 15 nt, Pseudomonas aeruginosa PA01
uccgcgcgcgcgcuc

SEQ ID NO: 3478703 - RNA, 23 nt, Pseudomonas aeruginosa PA01
uccgcgcggcgcccugccgggcu

SEQ ID NO: 3478704 - RNA, 21 nt, Pseudomonas aeruginosa PA01
uccgcggagaggaucagcgaa

SEQ ID NO: 3478705 - RNA, 15 nt, Pseudomonas aeruginosa PA01
uccgcggaucguccg

SEQ ID NO: 3478706 - RNA, 14 nt, Pseudomonas aeruginosa PA01
uccgcggccccggc

SEQ ID NO: 3478707 - RNA, 17 nt, Pseudomonas aeruginosa PA01
uccgcggccccggcguc

SEQ ID NO: 3478708 - RNA, 10 nt, Pseudomonas aeruginosa PA01
uccgcggccg

SEQ ID NO: 3478709 - RNA, 16 nt, Pseudomonas aeruginosa PA01
uccgcggccggcaggc

SEQ ID NO: 3478710 - RNA, 19 nt, Pseudomonas aeruginosa PA01
uccgcggccggcaggccga

SEQ ID NO: 3478711 - RNA, 21 nt, Pseudomonas aeruginosa PA01
uccgcggccggcaggccgaug

SEQ ID NO: 3478712 - RNA, 14 nt, Pseudomonas aeruginosa PA01
uccgcggccggcuu

SEQ ID NO: 3478713 - RNA, 15 nt, Pseudomonas aeruginosa PA01
uccgcggccggcuuc

SEQ ID NO: 3478714 - RNA, 17 nt, Pseudomonas aeruginosa PA01
uccgcggccugcucggc

SEQ ID NO: 3478715 - RNA, 21 nt, Pseudomonas aeruginosa PA01
uccgcggcgacggcucuuccc

SEQ ID NO: 3478716 - RNA, 19 nt, Pseudomonas aeruginosa PA01
uccgcggcguaaucgcgcc

SEQ ID NO: 3478717 - RNA, 16 nt, Pseudomonas aeruginosa PA01
uccgcgggacgcggcg

SEQ ID NO: 3478718 - RNA, 12 nt, Pseudomonas aeruginosa PA01
uccgcgucccuu

SEQ ID NO: 3478719 - RNA, 14 nt, Pseudomonas aeruginosa PA01
uccgcgucgccuuc

SEQ ID NO: 3478720 - RNA, 20 nt, Pseudomonas aeruginosa PA01
uccgcgucgccuucggagaa

SEQ ID NO: 3478721 - RNA, 14 nt, Pseudomonas aeruginosa PA01
uccgcguggcgaug

SEQ ID NO: 3478722 - RNA, 15 nt, Pseudomonas aeruginosa PA01
uccgcguggcgaugc

SEQ ID NO: 3478723 - RNA, 16 nt, Pseudomonas aeruginosa PA01
uccgcguggcgaugcc

SEQ ID NO: 3478724 - RNA, 22 nt, Pseudomonas aeruginosa PA01
uccgcguggcgaugcccuggcu

SEQ ID NO: 3478725 - RNA, 12 nt, Pseudomonas aeruginosa PA01
uccgcguggcgu

SEQ ID NO: 3478726 - RNA, 19 nt, Pseudomonas aeruginosa PA01
uccgcguggcgugcucggc

SEQ ID NO: 3478727 - RNA, 13 nt, Pseudomonas aeruginosa PA01
uccgcguguucgc

SEQ ID NO: 3478728 - RNA, 18 nt, Pseudomonas aeruginosa PA01
uccgcguguucgcggcuc

SEQ ID NO: 3478729 - RNA, 19 nt, Pseudomonas aeruginosa PA01
uccgcguuaccguccgcgc

SEQ ID NO: 3478730 - RNA, 21 nt, Pseudomonas aeruginosa PA01
uccgcguuaccguccgcgccg

SEQ ID NO: 3478731 - RNA, 14 nt, Pseudomonas aeruginosa PA01
uccgcucaccaggc

SEQ ID NO: 3478732 - RNA, 12 nt, Pseudomonas aeruginosa PA01
uccgcuccagcg

SEQ ID NO: 3478733 - RNA, 15 nt, Pseudomonas aeruginosa PA01
uccgcuccagcgccu

SEQ ID NO: 3478734 - RNA, 14 nt, Pseudomonas aeruginosa PA01
uccgcuccaggcug

SEQ ID NO: 3478735 - RNA, 18 nt, Pseudomonas aeruginosa PA01
uccgcucgaucccggcgc

SEQ ID NO: 3478736 - RNA, 12 nt, Pseudomonas aeruginosa PA01
uccgcucggcga

SEQ ID NO: 3478737 - RNA, 16 nt, Pseudomonas aeruginosa PA01
uccgcucugcuggcca

SEQ ID NO: 3478738 - RNA, 17 nt, Pseudomonas aeruginosa PA01
uccgcucugcuggccac

SEQ ID NO: 3478739 - RNA, 18 nt, Pseudomonas aeruginosa PA01
uccgcucugcuggccacc

SEQ ID NO: 3478740 - RNA, 22 nt, Pseudomonas aeruginosa PA01
uccgcucuggaucacguaggac

SEQ ID NO: 3478741 - RNA, 23 nt, Pseudomonas aeruginosa PA01
uccgcucuguagggucgcagcag

SEQ ID NO: 3478742 - RNA, 21 nt, Pseudomonas aeruginosa PA01
uccgcugaggauguagccggc

SEQ ID NO: 3478743 - RNA, 18 nt, Pseudomonas aeruginosa PA01
uccgcugccguacagccc

SEQ ID NO: 3478744 - RNA, 13 nt, Pseudomonas aeruginosa PA01
uccgcuggccugc

SEQ ID NO: 3478745 - RNA, 15 nt, Pseudomonas aeruginosa PA01
uccgcuggccugcag

SEQ ID NO: 3478746 - RNA, 18 nt, Pseudomonas aeruginosa PA01
uccgcugguagcccaggc

SEQ ID NO: 3478747 - RNA, 22 nt, Pseudomonas aeruginosa PA01
uccgcugguagcccaggccgaa

SEQ ID NO: 3478748 - RNA, 19 nt, Pseudomonas aeruginosa PA01
uccgcuguccgccgccgcg

SEQ ID NO: 3478749 - RNA, 16 nt, Pseudomonas aeruginosa PA01
uccgcuuacuggcgaa

SEQ ID NO: 3478750 - RNA, 21 nt, Pseudomonas aeruginosa PA01
uccgcuucagcgcgccgagcc

SEQ ID NO: 3478751 - RNA, 14 nt, Pseudomonas aeruginosa PA01
uccgcuuccgccca

SEQ ID NO: 3478752 - RNA, 14 nt, Pseudomonas aeruginosa PA01
uccggaacgccugc

SEQ ID NO: 3478753 - RNA, 14 nt, Pseudomonas aeruginosa PA01
uccggagccgggca

SEQ ID NO: 3478754 - RNA, 16 nt, Pseudomonas aeruginosa PA01
uccggaggcgcacagg

SEQ ID NO: 3478755 - RNA, 19 nt, Pseudomonas aeruginosa PA01
uccggaggcgcacaggcgg

SEQ ID NO: 3478756 - RNA, 17 nt, Pseudomonas aeruginosa PA01
uccggaguucgcccgcc

SEQ ID NO: 3478757 - RNA, 18 nt, Pseudomonas aeruginosa PA01
uccggaguucgcccgccc

SEQ ID NO: 3478758 - RNA, 19 nt, Pseudomonas aeruginosa PA01
uccggauacaugcugcuca

SEQ ID NO: 3478759 - RNA, 20 nt, Pseudomonas aeruginosa PA01
uccggaugcagauccagcgg

SEQ ID NO: 3478760 - RNA, 21 nt, Pseudomonas aeruginosa PA01
uccggauugguggucaccagc

SEQ ID NO: 3478761 - RNA, 22 nt, Pseudomonas aeruginosa PA01
uccggauugguggucaccagcg

SEQ ID NO: 3478762 - RNA, 16 nt, Pseudomonas aeruginosa PA01
uccggcaacaggucga

SEQ ID NO: 3478763 - RNA, 23 nt, Pseudomonas aeruginosa PA01
uccggcaacaguucugccgcaga

SEQ ID NO: 3478764 - RNA, 21 nt, Pseudomonas aeruginosa PA01
uccggcaccaccagcgcgcgc

SEQ ID NO: 3478765 - RNA, 14 nt, Pseudomonas aeruginosa PA01
uccggcacgcugcc

SEQ ID NO: 3478766 - RNA, 15 nt, Pseudomonas aeruginosa PA01
uccggcacgcugccg

SEQ ID NO: 3478767 - RNA, 21 nt, Pseudomonas aeruginosa PA01
uccggcagcagggucagcagc

SEQ ID NO: 3478768 - RNA, 22 nt, Pseudomonas aeruginosa PA01
uccggcagcagggucagcagcg

SEQ ID NO: 3478769 - RNA, 13 nt, Pseudomonas aeruginosa PA01
uccggcagccagc

SEQ ID NO: 3478770 - RNA, 21 nt, Pseudomonas aeruginosa PA01
uccggcagccagccgccgaag

SEQ ID NO: 3478771 - RNA, 22 nt, Pseudomonas aeruginosa PA01
uccggcagccagccgccgaagg

SEQ ID NO: 3478772 - RNA, 14 nt, Pseudomonas aeruginosa PA01
uccggcagcgccuu

SEQ ID NO: 3478773 - RNA, 15 nt, Pseudomonas aeruginosa PA01
uccggcaggcgcucc

SEQ ID NO: 3478774 - RNA, 13 nt, Pseudomonas aeruginosa PA01
uccggcaggcuca

SEQ ID NO: 3478775 - RNA, 14 nt, Pseudomonas aeruginosa PA01
uccggcagggccuc

SEQ ID NO: 3478776 - RNA, 17 nt, Pseudomonas aeruginosa PA01
uccggcagggccucggg

SEQ ID NO: 3478777 - RNA, 21 nt, Pseudomonas aeruginosa PA01
uccggcagggccucgggcggg

SEQ ID NO: 3478778 - RNA, 17 nt, Pseudomonas aeruginosa PA01
uccggccagccuggcca

SEQ ID NO: 3478779 - RNA, 19 nt, Pseudomonas aeruginosa PA01
uccggccagccuggccagc

SEQ ID NO: 3478780 - RNA, 15 nt, Pseudomonas aeruginosa PA01
uccggccaggcgcgg

SEQ ID NO: 3478781 - RNA, 11 nt, Pseudomonas aeruginosa PA01
uccggccaugu

SEQ ID NO: 3478782 - RNA, 15 nt, Pseudomonas aeruginosa PA01
uccggcccggccagg

SEQ ID NO: 3478783 - RNA, 17 nt, Pseudomonas aeruginosa PA01
uccggcccggccaggcg

SEQ ID NO: 3478784 - RNA, 19 nt, Pseudomonas aeruginosa PA01
uccggcccggccagguagg

SEQ ID NO: 3478785 - RNA, 19 nt, Pseudomonas aeruginosa PA01
uccggccgaucuccuggcg

SEQ ID NO: 3478786 - RNA, 12 nt, Pseudomonas aeruginosa PA01
uccggccgcccg

SEQ ID NO: 3478787 - RNA, 13 nt, Pseudomonas aeruginosa PA01
uccggccgcccga

SEQ ID NO: 3478788 - RNA, 18 nt, Pseudomonas aeruginosa PA01
uccggccggcggccugag

SEQ ID NO: 3478789 - RNA, 18 nt, Pseudomonas aeruginosa PA01
uccggcgaaguccggguu

SEQ ID NO: 3478790 - RNA, 18 nt, Pseudomonas aeruginosa PA01
uccggcgagcacggcgaa

SEQ ID NO: 3478791 - RNA, 17 nt, Pseudomonas aeruginosa PA01
uccggcgcagcccagcc

SEQ ID NO: 3478792 - RNA, 13 nt, Pseudomonas aeruginosa PA01
uccggcgcagcgg

SEQ ID NO: 3478793 - RNA, 19 nt, Pseudomonas aeruginosa PA01
uccggcgcagcggaggauu

SEQ ID NO: 3478794 - RNA, 14 nt, Pseudomonas aeruginosa PA01
uccggcgccaggcc

SEQ ID NO: 3478795 - RNA, 20 nt, Pseudomonas aeruginosa PA01
uccggcgccaggcccucggc

SEQ ID NO: 3478796 - RNA, 14 nt, Pseudomonas aeruginosa PA01
uccggcgccgaggu

SEQ ID NO: 3478797 - RNA, 19 nt, Pseudomonas aeruginosa PA01
uccggcgccgagguaguag

SEQ ID NO: 3478798 - RNA, 13 nt, Pseudomonas aeruginosa PA01
uccggcgccggca

SEQ ID NO: 3478799 - RNA, 16 nt, Pseudomonas aeruginosa PA01
uccggcgccggcagga

SEQ ID NO: 3478800 - RNA, 14 nt, Pseudomonas aeruginosa PA01
uccggcgccgggcu

SEQ ID NO: 3478801 - RNA, 15 nt, Pseudomonas aeruginosa PA01
uccggcgccgggcug

SEQ ID NO: 3478802 - RNA, 18 nt, Pseudomonas aeruginosa PA01
uccggcgcguuggcuggc

SEQ ID NO: 3478803 - RNA, 17 nt, Pseudomonas aeruginosa PA01
uccggcgcugagcgaga

SEQ ID NO: 3478804 - RNA, 11 nt, Pseudomonas aeruginosa PA01
uccggcgcugc

SEQ ID NO: 3478805 - RNA, 21 nt, Pseudomonas aeruginosa PA01
uccggcgcugccgaacagcag

SEQ ID NO: 3478806 - RNA, 21 nt, Pseudomonas aeruginosa PA01
uccggcggcgaugaagcugau

SEQ ID NO: 3478807 - RNA, 14 nt, Pseudomonas aeruginosa PA01
uccggcggcugcug

SEQ ID NO: 3478808 - RNA, 21 nt, Pseudomonas aeruginosa PA01
uccggcguaccguuggcgaug

SEQ ID NO: 3478809 - RNA, 23 nt, Pseudomonas aeruginosa PA01
uccggcguacgaaccccgggccg

SEQ ID NO: 3478810 - RNA, 13 nt, Pseudomonas aeruginosa PA01
uccggcgucccgc

SEQ ID NO: 3478811 - RNA, 21 nt, Pseudomonas aeruginosa PA01
uccggcgugguggcggggaac

SEQ ID NO: 3478812 - RNA, 14 nt, Pseudomonas aeruginosa PA01
uccggcucagccgc

SEQ ID NO: 3478813 - RNA, 16 nt, Pseudomonas aeruginosa PA01
uccggcucagccgcug

SEQ ID NO: 3478814 - RNA, 13 nt, Pseudomonas aeruginosa PA01
uccggcucgccgc

SEQ ID NO: 3478815 - RNA, 16 nt, Pseudomonas aeruginosa PA01
uccggcucgcugacgc

SEQ ID NO: 3478816 - RNA, 14 nt, Pseudomonas aeruginosa PA01
uccggcugcgcgga

SEQ ID NO: 3478817 - RNA, 13 nt, Pseudomonas aeruginosa PA01
uccggcuggcgcc

SEQ ID NO: 3478818 - RNA, 19 nt, Pseudomonas aeruginosa PA01
uccggcuggcgccggugca

SEQ ID NO: 3478819 - RNA, 20 nt, Pseudomonas aeruginosa PA01
uccggcugucgacgcagccg

SEQ ID NO: 3478820 - RNA, 18 nt, Pseudomonas aeruginosa PA01
uccggcuugaccgccgcc

SEQ ID NO: 3478821 - RNA, 19 nt, Pseudomonas aeruginosa PA01
uccggcuugaccgccgccg

SEQ ID NO: 3478822 - RNA, 21 nt, Pseudomonas aeruginosa PA01
uccggcuugccgaugucgccg

SEQ ID NO: 3478823 - RNA, 17 nt, Pseudomonas aeruginosa PA01
uccgggaaguccgggcg

SEQ ID NO: 3478824 - RNA, 22 nt, Pseudomonas aeruginosa PA01
uccgggcacgcauagcgcgcug

SEQ ID NO: 3478825 - RNA, 12 nt, Pseudomonas aeruginosa PA01
uccgggcccagg

SEQ ID NO: 3478826 - RNA, 13 nt, Pseudomonas aeruginosa PA01
uccgggcccaggc

SEQ ID NO: 3478827 - RNA, 22 nt, Pseudomonas aeruginosa PA01
uccgggcccaggcuggcggcca

SEQ ID NO: 3478828 - RNA, 17 nt, Pseudomonas aeruginosa PA01
uccgggcccgugcggca

SEQ ID NO: 3478829 - RNA, 16 nt, Pseudomonas aeruginosa PA01
uccgggccgagggcug

SEQ ID NO: 3478830 - RNA, 17 nt, Pseudomonas aeruginosa PA01
uccgggccgagggcuga

SEQ ID NO: 3478831 - RNA, 21 nt, Pseudomonas aeruginosa PA01
uccgggcggaggcgaggucgc

SEQ ID NO: 3478832 - RNA, 17 nt, Pseudomonas aeruginosa PA01
uccgggcguaacggcuc

SEQ ID NO: 3478833 - RNA, 13 nt, Pseudomonas aeruginosa PA01
uccgggcguaggg

SEQ ID NO: 3478834 - RNA, 20 nt, Pseudomonas aeruginosa PA01
uccgggcuccaccaguagcc

SEQ ID NO: 3478835 - RNA, 18 nt, Pseudomonas aeruginosa PA01
uccgggcugcgcucggcg

SEQ ID NO: 3478836 - RNA, 13 nt, Pseudomonas aeruginosa PA01
uccgggcuggcca

SEQ ID NO: 3478837 - RNA, 16 nt, Pseudomonas aeruginosa PA01
uccgggcuggccacca

SEQ ID NO: 3478838 - RNA, 22 nt, Pseudomonas aeruginosa PA01
uccgggcuggucguagcagcgg

SEQ ID NO: 3478839 - RNA, 13 nt, Pseudomonas aeruginosa PA01
uccggggacgcug

SEQ ID NO: 3478840 - RNA, 20 nt, Pseudomonas aeruginosa PA01
uccggggacgcugucccggc

SEQ ID NO: 3478841 - RNA, 22 nt, Pseudomonas aeruginosa PA01
uccggggacgcugucccggcca

SEQ ID NO: 3478842 - RNA, 22 nt, Pseudomonas aeruginosa PA01
uccggggagauguccaucagcc

SEQ ID NO: 3478843 - RNA, 14 nt, Pseudomonas aeruginosa PA01
uccggggcccggca

SEQ ID NO: 3478844 - RNA, 19 nt, Pseudomonas aeruginosa PA01
uccggggcccggcaggcag

SEQ ID NO: 3478845 - RNA, 22 nt, Pseudomonas aeruginosa PA01
uccggggcgcuguuggccuggg

SEQ ID NO: 3478846 - RNA, 23 nt, Pseudomonas aeruginosa PA01
uccggggcgcuguuggccugggc

SEQ ID NO: 3478847 - RNA, 14 nt, Pseudomonas aeruginosa PA01
uccggggugggcau

SEQ ID NO: 3478848 - RNA, 16 nt, Pseudomonas aeruginosa PA01
uccggguacuggcgcu

SEQ ID NO: 3478849 - RNA, 15 nt, Pseudomonas aeruginosa PA01
uccgggucauuggcg

SEQ ID NO: 3478850 - RNA, 17 nt, Pseudomonas aeruginosa PA01
uccgggucauuggcgaa

SEQ ID NO: 3478851 - RNA, 16 nt, Pseudomonas aeruginosa PA01
uccggguccagcggcc

SEQ ID NO: 3478852 - RNA, 17 nt, Pseudomonas aeruginosa PA01
uccgggucgaggcugcc

SEQ ID NO: 3478853 - RNA, 14 nt, Pseudomonas aeruginosa PA01
uccgggucgcugcc

SEQ ID NO: 3478854 - RNA, 15 nt, Pseudomonas aeruginosa PA01
uccgggucgcugccc

SEQ ID NO: 3478855 - RNA, 23 nt, Pseudomonas aeruginosa PA01
uccgggucggucacgaaggcgau

SEQ ID NO: 3478856 - RNA, 17 nt, Pseudomonas aeruginosa PA01
uccgggugccccaggcg

SEQ ID NO: 3478857 - RNA, 18 nt, Pseudomonas aeruginosa PA01
uccgggugccccaggcga

SEQ ID NO: 3478858 - RNA, 18 nt, Pseudomonas aeruginosa PA01
uccggguggagaggcgug

SEQ ID NO: 3478859 - RNA, 15 nt, Pseudomonas aeruginosa PA01
uccggguugaaggcg

SEQ ID NO: 3478860 - RNA, 19 nt, Pseudomonas aeruginosa PA01
uccggguugacccagagcc

SEQ ID NO: 3478861 - RNA, 22 nt, Pseudomonas aeruginosa PA01
uccggguugacccagagccgcu

SEQ ID NO: 3478862 - RNA, 16 nt, Pseudomonas aeruginosa PA01
uccggguugagcaccc

SEQ ID NO: 3478863 - RNA, 21 nt, Pseudomonas aeruginosa PA01
uccgguacccguacgcugcca

SEQ ID NO: 3478864 - RNA, 16 nt, Pseudomonas aeruginosa PA01
uccgguaggagcgaga

SEQ ID NO: 3478865 - RNA, 16 nt, Pseudomonas aeruginosa PA01
uccggucaaggcagaa

SEQ ID NO: 3478866 - RNA, 16 nt, Pseudomonas aeruginosa PA01
uccggucacgcaggcg

SEQ ID NO: 3478867 - RNA, 20 nt, Pseudomonas aeruginosa PA01
uccggucacgcaggcgcugg

SEQ ID NO: 3478868 - RNA, 14 nt, Pseudomonas aeruginosa PA01
uccggucagcagca

SEQ ID NO: 3478869 - RNA, 15 nt, Pseudomonas aeruginosa PA01
uccggucagcagcag

SEQ ID NO: 3478870 - RNA, 16 nt, Pseudomonas aeruginosa PA01
uccggucagcagcagg

SEQ ID NO: 3478871 - RNA, 19 nt, Pseudomonas aeruginosa PA01
uccggucagcagcaggguc

SEQ ID NO: 3478872 - RNA, 18 nt, Pseudomonas aeruginosa PA01
uccggucgcaccgccagc

SEQ ID NO: 3478873 - RNA, 20 nt, Pseudomonas aeruginosa PA01
uccggucgcaccgccagcag

SEQ ID NO: 3478874 - RNA, 21 nt, Pseudomonas aeruginosa PA01
uccggucggacuccgcccagu

SEQ ID NO: 3478875 - RNA, 13 nt, Pseudomonas aeruginosa PA01
uccggugcaccug

SEQ ID NO: 3478876 - RNA, 14 nt, Pseudomonas aeruginosa PA01
uccggugcaccugg

SEQ ID NO: 3478877 - RNA, 15 nt, Pseudomonas aeruginosa PA01
uccggugccagggcg

SEQ ID NO: 3478878 - RNA, 20 nt, Pseudomonas aeruginosa PA01
uccggugucaggccgagguu

SEQ ID NO: 3478879 - RNA, 18 nt, Pseudomonas aeruginosa PA01
uccgguucggcaaggcgc

SEQ ID NO: 3478880 - RNA, 23 nt, Pseudomonas aeruginosa PA01
uccgguucggcaaggcgcagcug

SEQ ID NO: 3478881 - RNA, 19 nt, Pseudomonas aeruginosa PA01
uccguaaaauggcgcgccu

SEQ ID NO: 3478882 - RNA, 20 nt, Pseudomonas aeruginosa PA01
uccguacuggcgccaggccg

SEQ ID NO: 3478883 - RNA, 20 nt, Pseudomonas aeruginosa PA01
uccguccagcgcgcccggcg

SEQ ID NO: 3478884 - RNA, 21 nt, Pseudomonas aeruginosa PA01
uccgucuguucggccagggag

SEQ ID NO: 3478885 - RNA, 15 nt, Pseudomonas aeruginosa PA01
uccgugacgucggcg

SEQ ID NO: 3478886 - RNA, 18 nt, Pseudomonas aeruginosa PA01
uccgugccaggcgcucgc

SEQ ID NO: 3478887 - RNA, 20 nt, Pseudomonas aeruginosa PA01
uccgugcggaaaccgcggcc

SEQ ID NO: 3478888 - RNA, 23 nt, Pseudomonas aeruginosa PA01
uccgugcggaaaccgcggccggc

SEQ ID NO: 3478889 - RNA, 19 nt, Pseudomonas aeruginosa PA01
uccgugcuggccggcagca

SEQ ID NO: 3478890 - RNA, 15 nt, Pseudomonas aeruginosa PA01
uccgugugcagcagg

SEQ ID NO: 3478891 - RNA, 15 nt, Pseudomonas aeruginosa PA01
uccguucggcgccca

SEQ ID NO: 3478892 - RNA, 14 nt, Pseudomonas aeruginosa PA01
uccguugcgcagca

SEQ ID NO: 3478893 - RNA, 17 nt, Pseudomonas aeruginosa PA01
uccguuguggcggcgcu

SEQ ID NO: 3478894 - RNA, 16 nt, Pseudomonas aeruginosa PA01
uccuacacgacccacc

SEQ ID NO: 3478895 - RNA, 15 nt, Pseudomonas aeruginosa PA01
uccuacaucuuggca

SEQ ID NO: 3478896 - RNA, 15 nt, Pseudomonas aeruginosa PA01
uccucacggcgcagc

SEQ ID NO: 3478897 - RNA, 18 nt, Pseudomonas aeruginosa PA01
uccucacggcgcagccgc

SEQ ID NO: 3478898 - RNA, 17 nt, Pseudomonas aeruginosa PA01
uccucagaggcgaccag

SEQ ID NO: 3478899 - RNA, 19 nt, Pseudomonas aeruginosa PA01
uccucagccucacccugcu

SEQ ID NO: 3478900 - RNA, 10 nt, Pseudomonas aeruginosa PA01
uccucagugc

SEQ ID NO: 3478901 - RNA, 18 nt, Pseudomonas aeruginosa PA01
uccucagugcgggcaguc

SEQ ID NO: 3478902 - RNA, 22 nt, Pseudomonas aeruginosa PA01
uccucagugcgggcaguccugg

SEQ ID NO: 3478903 - RNA, 14 nt, Pseudomonas aeruginosa PA01
uccuccaaagccug

SEQ ID NO: 3478904 - RNA, 15 nt, Pseudomonas aeruginosa PA01
uccuccacccccgca

SEQ ID NO: 3478905 - RNA, 18 nt, Pseudomonas aeruginosa PA01
uccuccaccgcuccggcg

SEQ ID NO: 3478906 - RNA, 23 nt, Pseudomonas aeruginosa PA01
uccuccagcagacggcuguuguc

SEQ ID NO: 3478907 - RNA, 17 nt, Pseudomonas aeruginosa PA01
uccuccagcaggaccug

SEQ ID NO: 3478908 - RNA, 22 nt, Pseudomonas aeruginosa PA01
uccuccagcaggaccuggccgu

SEQ ID NO: 3478909 - RNA, 13 nt, Pseudomonas aeruginosa PA01
uccuccagccggc

SEQ ID NO: 3478910 - RNA, 14 nt, Pseudomonas aeruginosa PA01
uccuccagccggcg

SEQ ID NO: 3478911 - RNA, 15 nt, Pseudomonas aeruginosa PA01
uccuccagcgccgca

SEQ ID NO: 3478912 - RNA, 16 nt, Pseudomonas aeruginosa PA01
uccuccagcgccgcca

SEQ ID NO: 3478913 - RNA, 18 nt, Pseudomonas aeruginosa PA01
uccuccagcgccgccagg

SEQ ID NO: 3478914 - RNA, 13 nt, Pseudomonas aeruginosa PA01
uccuccagcggcg

SEQ ID NO: 3478915 - RNA, 15 nt, Pseudomonas aeruginosa PA01
uccuccagcguggcg

SEQ ID NO: 3478916 - RNA, 18 nt, Pseudomonas aeruginosa PA01
uccuccagggugccgacc

SEQ ID NO: 3478917 - RNA, 22 nt, Pseudomonas aeruginosa PA01
uccuccauuagcgucgcgcggc

SEQ ID NO: 3478918 - RNA, 14 nt, Pseudomonas aeruginosa PA01
uccuccgccccggc

SEQ ID NO: 3478919 - RNA, 18 nt, Pseudomonas aeruginosa PA01
uccuccgcgacggaccgc

SEQ ID NO: 3478920 - RNA, 20 nt, Pseudomonas aeruginosa PA01
uccuccgggcgugccaggag

SEQ ID NO: 3478921 - RNA, 15 nt, Pseudomonas aeruginosa PA01
uccuccuccaucucg

SEQ ID NO: 3478922 - RNA, 14 nt, Pseudomonas aeruginosa PA01
uccuccucgccgcc

SEQ ID NO: 3478923 - RNA, 21 nt, Pseudomonas aeruginosa PA01
uccuccucgcuccagaggaac

SEQ ID NO: 3478924 - RNA, 15 nt, Pseudomonas aeruginosa PA01
uccuccucgcucugc

SEQ ID NO: 3478925 - RNA, 13 nt, Pseudomonas aeruginosa PA01
uccuccucggcgg

SEQ ID NO: 3478926 - RNA, 19 nt, Pseudomonas aeruginosa PA01
uccuccucggcggcuuccu

SEQ ID NO: 3478927 - RNA, 12 nt, Pseudomonas aeruginosa PA01
uccuccugggcc

SEQ ID NO: 3478928 - RNA, 20 nt, Pseudomonas aeruginosa PA01
uccuccugggccgacgcuuc

SEQ ID NO: 3478929 - RNA, 14 nt, Pseudomonas aeruginosa PA01
uccucgaaagccgc

SEQ ID NO: 3478930 - RNA, 23 nt, Pseudomonas aeruginosa PA01
uccucgaaagccgccgccgcgcc

SEQ ID NO: 3478931 - RNA, 15 nt, Pseudomonas aeruginosa PA01
uccucgaacaacugg

SEQ ID NO: 3478932 - RNA, 15 nt, Pseudomonas aeruginosa PA01
uccucgaucacccgc

SEQ ID NO: 3478933 - RNA, 19 nt, Pseudomonas aeruginosa PA01
uccucgaugauccgcucga

SEQ ID NO: 3478934 - RNA, 18 nt, Pseudomonas aeruginosa PA01
uccucgauggugacguug

SEQ ID NO: 3478935 - RNA, 13 nt, Pseudomonas aeruginosa PA01
uccucgccccgcc

SEQ ID NO: 3478936 - RNA, 17 nt, Pseudomonas aeruginosa PA01
uccucgccccgccggga

SEQ ID NO: 3478937 - RNA, 16 nt, Pseudomonas aeruginosa PA01
uccucgcccucauggc

SEQ ID NO: 3478938 - RNA, 15 nt, Pseudomonas aeruginosa PA01
uccucgccgcugcug

SEQ ID NO: 3478939 - RNA, 16 nt, Pseudomonas aeruginosa PA01
uccucgccgcuggcgc

SEQ ID NO: 3478940 - RNA, 15 nt, Pseudomonas aeruginosa PA01
uccucgcgcagcggc

SEQ ID NO: 3478941 - RNA, 18 nt, Pseudomonas aeruginosa PA01
uccucgcgcugcccggcg

SEQ ID NO: 3478942 - RNA, 22 nt, Pseudomonas aeruginosa PA01
uccucgcgcugcccggcgcgac

SEQ ID NO: 3478943 - RNA, 22 nt, Pseudomonas aeruginosa PA01
uccucgcggaagcguugcucga

SEQ ID NO: 3478944 - RNA, 23 nt, Pseudomonas aeruginosa PA01
uccucgcggaagcguugcucgag

SEQ ID NO: 3478945 - RNA, 16 nt, Pseudomonas aeruginosa PA01
uccucgcggaagucgg

SEQ ID NO: 3478946 - RNA, 18 nt, Pseudomonas aeruginosa PA01
uccucgcuccagaggaac

SEQ ID NO: 3478947 - RNA, 14 nt, Pseudomonas aeruginosa PA01
uccucgcucugcgc

SEQ ID NO: 3478948 - RNA, 14 nt, Pseudomonas aeruginosa PA01
uccucggagagcag

SEQ ID NO: 3478949 - RNA, 16 nt, Pseudomonas aeruginosa PA01
uccucggagagcagcc

SEQ ID NO: 3478950 - RNA, 23 nt, Pseudomonas aeruginosa PA01
uccucggagagcagccaagccac

SEQ ID NO: 3478951 - RNA, 18 nt, Pseudomonas aeruginosa PA01
uccucggccaacggccgc

SEQ ID NO: 3478952 - RNA, 19 nt, Pseudomonas aeruginosa PA01
uccucggccaugccggcca

SEQ ID NO: 3478953 - RNA, 12 nt, Pseudomonas aeruginosa PA01
uccucggccgac

SEQ ID NO: 3478954 - RNA, 18 nt, Pseudomonas aeruginosa PA01
uccucggccgacaggcug

SEQ ID NO: 3478955 - RNA, 14 nt, Pseudomonas aeruginosa PA01
uccucggccgccag

SEQ ID NO: 3478956 - RNA, 17 nt, Pseudomonas aeruginosa PA01
uccucggccgccaggcg

SEQ ID NO: 3478957 - RNA, 14 nt, Pseudomonas aeruginosa PA01
uccucggccuugcu

SEQ ID NO: 3478958 - RNA, 21 nt, Pseudomonas aeruginosa PA01
uccucggccuugcuggcgaca

SEQ ID NO: 3478959 - RNA, 21 nt, Pseudomonas aeruginosa PA01
uccucggcgaacuccgccagc

SEQ ID NO: 3478960 - RNA, 18 nt, Pseudomonas aeruginosa PA01
uccucggcgaccaccgcg

SEQ ID NO: 3478961 - RNA, 19 nt, Pseudomonas aeruginosa PA01
uccucggcguagccggcca

SEQ ID NO: 3478962 - RNA, 22 nt, Pseudomonas aeruginosa PA01
uccucggcguagccggccaggg

SEQ ID NO: 3478963 - RNA, 18 nt, Pseudomonas aeruginosa PA01
uccucggggaagcgcggc

SEQ ID NO: 3478964 - RNA, 21 nt, Pseudomonas aeruginosa PA01
uccucggucuuuuucgcgugc

SEQ ID NO: 3478965 - RNA, 16 nt, Pseudomonas aeruginosa PA01
uccucggugucggcca

SEQ ID NO: 3478966 - RNA, 14 nt, Pseudomonas aeruginosa PA01
uccucguccagcag

SEQ ID NO: 3478967 - RNA, 16 nt, Pseudomonas aeruginosa PA01
uccucguccgacagca

SEQ ID NO: 3478968 - RNA, 20 nt, Pseudomonas aeruginosa PA01
uccucgucgauccgcggauc

SEQ ID NO: 3478969 - RNA, 17 nt, Pseudomonas aeruginosa PA01
uccucgucguacuggcg

SEQ ID NO: 3478970 - RNA, 14 nt, Pseudomonas aeruginosa PA01
uccucguggcgcgc

SEQ ID NO: 3478971 - RNA, 19 nt, Pseudomonas aeruginosa PA01
uccucguggcgcgccgcua

SEQ ID NO: 3478972 - RNA, 13 nt, Pseudomonas aeruginosa PA01
uccucugccugcg

SEQ ID NO: 3478973 - RNA, 16 nt, Pseudomonas aeruginosa PA01
uccugaaggaccagcu

SEQ ID NO: 3478974 - RNA, 15 nt, Pseudomonas aeruginosa PA01
uccugaaggcgcggg

SEQ ID NO: 3478975 - RNA, 20 nt, Pseudomonas aeruginosa PA01
uccugaaggcgcggggcgag

SEQ ID NO: 3478976 - RNA, 15 nt, Pseudomonas aeruginosa PA01
uccugaccccggccu

SEQ ID NO: 3478977 - RNA, 17 nt, Pseudomonas aeruginosa PA01
uccugaccguccuggcc

SEQ ID NO: 3478978 - RNA, 22 nt, Pseudomonas aeruginosa PA01
uccugcaacagggcauuggcca

SEQ ID NO: 3478979 - RNA, 23 nt, Pseudomonas aeruginosa PA01
uccugcaacagggcauuggccau

SEQ ID NO: 3478980 - RNA, 16 nt, Pseudomonas aeruginosa PA01
uccugcaacugcucga

SEQ ID NO: 3478981 - RNA, 20 nt, Pseudomonas aeruginosa PA01
uccugcaacuggaaggccgc

SEQ ID NO: 3478982 - RNA, 17 nt, Pseudomonas aeruginosa PA01
uccugcacgcugcgccg

SEQ ID NO: 3478983 - RNA, 18 nt, Pseudomonas aeruginosa PA01
uccugcagauaaagcugg

SEQ ID NO: 3478984 - RNA, 22 nt, Pseudomonas aeruginosa PA01
uccugcagauaaagcuggacca

SEQ ID NO: 3478985 - RNA, 13 nt, Pseudomonas aeruginosa PA01
uccugcauggcuu

SEQ ID NO: 3478986 - RNA, 18 nt, Pseudomonas aeruginosa PA01
uccugccagcgcgucggc

SEQ ID NO: 3478987 - RNA, 22 nt, Pseudomonas aeruginosa PA01
uccugccccgugcaccgaggcg

SEQ ID NO: 3478988 - RNA, 14 nt, Pseudomonas aeruginosa PA01
uccugcccgaccgg

SEQ ID NO: 3478989 - RNA, 22 nt, Pseudomonas aeruginosa PA01
uccugcccgaccgguuccagcg

SEQ ID NO: 3478990 - RNA, 16 nt, Pseudomonas aeruginosa PA01
uccugcccguaccacg

SEQ ID NO: 3478991 - RNA, 23 nt, Pseudomonas aeruginosa PA01
uccugccgccgauagggaaacac

SEQ ID NO: 3478992 - RNA, 14 nt, Pseudomonas aeruginosa PA01
uccugcgcggcgac

SEQ ID NO: 3478993 - RNA, 23 nt, Pseudomonas aeruginosa PA01
uccugcggauucaucggcggcag

SEQ ID NO: 3478994 - RNA, 15 nt, Pseudomonas aeruginosa PA01
uccugcggccgggug

SEQ ID NO: 3478995 - RNA, 22 nt, Pseudomonas aeruginosa PA01
uccugcggccggguguuguucu

SEQ ID NO: 3478996 - RNA, 22 nt, Pseudomonas aeruginosa PA01
uccugcggccguucgcccuuca

SEQ ID NO: 3478997 - RNA, 19 nt, Pseudomonas aeruginosa PA01
uccugcggcuggcgaacca

SEQ ID NO: 3478998 - RNA, 21 nt, Pseudomonas aeruginosa PA01
uccugcggcuggcgaaccagu

SEQ ID NO: 3478999 - RNA, 23 nt, Pseudomonas aeruginosa PA01
uccugcggcuggcgaaccagucc

SEQ ID NO: 3479000 - RNA, 16 nt, Pseudomonas aeruginosa PA01
uccugcggcuugccca

SEQ ID NO: 3479001 - RNA, 23 nt, Pseudomonas aeruginosa PA01
uccugcucagcggcccagcgccc

SEQ ID NO: 3479002 - RNA, 17 nt, Pseudomonas aeruginosa PA01
uccugcucccuggcgga

SEQ ID NO: 3479003 - RNA, 13 nt, Pseudomonas aeruginosa PA01
uccugcuccuccg

SEQ ID NO: 3479004 - RNA, 17 nt, Pseudomonas aeruginosa PA01
uccugcuccuccgacgc

SEQ ID NO: 3479005 - RNA, 23 nt, Pseudomonas aeruginosa PA01
uccugcugagcagucgccuggcc

SEQ ID NO: 3479006 - RNA, 11 nt, Pseudomonas aeruginosa PA01
uccugcugcug

SEQ ID NO: 3479007 - RNA, 15 nt, Pseudomonas aeruginosa PA01
uccugcugcuggccu

SEQ ID NO: 3479008 - RNA, 23 nt, Pseudomonas aeruginosa PA01
uccugcugcuggccuucgucggc

SEQ ID NO: 3479009 - RNA, 13 nt, Pseudomonas aeruginosa PA01
uccugcuggcgaa

SEQ ID NO: 3479010 - RNA, 20 nt, Pseudomonas aeruginosa PA01
uccugcugguugaccaggcc

SEQ ID NO: 3479011 - RNA, 16 nt, Pseudomonas aeruginosa PA01
uccuggaaagaccggc

SEQ ID NO: 3479012 - RNA, 18 nt, Pseudomonas aeruginosa PA01
uccuggaaagaccggcgc

SEQ ID NO: 3479013 - RNA, 20 nt, Pseudomonas aeruginosa PA01
uccuggaaagaccggcgccc

SEQ ID NO: 3479014 - RNA, 18 nt, Pseudomonas aeruginosa PA01
uccuggaacaggaagcgg

SEQ ID NO: 3479015 - RNA, 19 nt, Pseudomonas aeruginosa PA01
uccuggaagaacaggcgcu

SEQ ID NO: 3479016 - RNA, 19 nt, Pseudomonas aeruginosa PA01
uccuggaccccgcccuagc

SEQ ID NO: 3479017 - RNA, 20 nt, Pseudomonas aeruginosa PA01
uccuggacccguugccgacc

SEQ ID NO: 3479018 - RNA, 15 nt, Pseudomonas aeruginosa PA01
uccuggauaagccgc

SEQ ID NO: 3479019 - RNA, 17 nt, Pseudomonas aeruginosa PA01
uccuggauaagccgcgc

SEQ ID NO: 3479020 - RNA, 19 nt, Pseudomonas aeruginosa PA01
uccuggauaagccgcgcca

SEQ ID NO: 3479021 - RNA, 21 nt, Pseudomonas aeruginosa PA01
uccuggauaagccgcgccauc

SEQ ID NO: 3479022 - RNA, 19 nt, Pseudomonas aeruginosa PA01
uccuggauacgcucggcca

SEQ ID NO: 3479023 - RNA, 12 nt, Pseudomonas aeruginosa PA01
uccuggcaggcu

SEQ ID NO: 3479024 - RNA, 19 nt, Pseudomonas aeruginosa PA01
uccuggcaggcucaccgcg

SEQ ID NO: 3479025 - RNA, 15 nt, Pseudomonas aeruginosa PA01
uccuggcccuggaua

SEQ ID NO: 3479026 - RNA, 14 nt, Pseudomonas aeruginosa PA01
uccuggccgagcau

SEQ ID NO: 3479027 - RNA, 19 nt, Pseudomonas aeruginosa PA01
uccuggccgagcaucagca

SEQ ID NO: 3479028 - RNA, 13 nt, Pseudomonas aeruginosa PA01
uccuggccgagcc

SEQ ID NO: 3479029 - RNA, 19 nt, Pseudomonas aeruginosa PA01
uccuggccgggaaccagca

SEQ ID NO: 3479030 - RNA, 22 nt, Pseudomonas aeruginosa PA01
uccuggccgggggucgcggcga

SEQ ID NO: 3479031 - RNA, 22 nt, Pseudomonas aeruginosa PA01
uccuggccggugacgaaaccgg

SEQ ID NO: 3479032 - RNA, 17 nt, Pseudomonas aeruginosa PA01
uccuggcgcaugucgcg

SEQ ID NO: 3479033 - RNA, 12 nt, Pseudomonas aeruginosa PA01
uccuggcgcgag

SEQ ID NO: 3479034 - RNA, 23 nt, Pseudomonas aeruginosa PA01
uccuggcgcgagaagccagccag

SEQ ID NO: 3479035 - RNA, 13 nt, Pseudomonas aeruginosa PA01
uccuggcgcgcgg

SEQ ID NO: 3479036 - RNA, 18 nt, Pseudomonas aeruginosa PA01
uccuggcgcguacgcccg

SEQ ID NO: 3479037 - RNA, 19 nt, Pseudomonas aeruginosa PA01
uccuggcgcguacgcccgc

SEQ ID NO: 3479038 - RNA, 21 nt, Pseudomonas aeruginosa PA01
uccuggcgcguacgcccgcag

SEQ ID NO: 3479039 - RNA, 21 nt, Pseudomonas aeruginosa PA01
uccuggcgcgucaugccgccg

SEQ ID NO: 3479040 - RNA, 18 nt, Pseudomonas aeruginosa PA01
uccuggcgguagcccggc

SEQ ID NO: 3479041 - RNA, 19 nt, Pseudomonas aeruginosa PA01
uccugggccaccuggcucu

SEQ ID NO: 3479042 - RNA, 14 nt, Pseudomonas aeruginosa PA01
uccugggccgacgc

SEQ ID NO: 3479043 - RNA, 15 nt, Pseudomonas aeruginosa PA01
uccugggccgguugc

SEQ ID NO: 3479044 - RNA, 19 nt, Pseudomonas aeruginosa PA01
uccugggcgauuuccaccg

SEQ ID NO: 3479045 - RNA, 21 nt, Pseudomonas aeruginosa PA01
uccugggcgauuuccaccggc

SEQ ID NO: 3479046 - RNA, 19 nt, Pseudomonas aeruginosa PA01
uccugggcgccagccgcca

SEQ ID NO: 3479047 - RNA, 20 nt, Pseudomonas aeruginosa PA01
uccugggcgccagccgccau

SEQ ID NO: 3479048 - RNA, 19 nt, Pseudomonas aeruginosa PA01
uccugggcggucucggcgg

SEQ ID NO: 3479049 - RNA, 19 nt, Pseudomonas aeruginosa PA01
uccugggcgugcuuggcga

SEQ ID NO: 3479050 - RNA, 22 nt, Pseudomonas aeruginosa PA01
uccugggcgugcuuggcgaggc

SEQ ID NO: 3479051 - RNA, 16 nt, Pseudomonas aeruginosa PA01
uccugggcuucguccg

SEQ ID NO: 3479052 - RNA, 20 nt, Pseudomonas aeruginosa PA01
uccuggggaaucugcgccag

SEQ ID NO: 3479053 - RNA, 22 nt, Pseudomonas aeruginosa PA01
uccuggguagauuuacaagccc

SEQ ID NO: 3479054 - RNA, 22 nt, Pseudomonas aeruginosa PA01
uccuggguauagaccagcaccg

SEQ ID NO: 3479055 - RNA, 21 nt, Pseudomonas aeruginosa PA01
uccuggguccgguacugcugg

SEQ ID NO: 3479056 - RNA, 17 nt, Pseudomonas aeruginosa PA01
uccugggucgacugcug

SEQ ID NO: 3479057 - RNA, 18 nt, Pseudomonas aeruginosa PA01
uccugggucgacugcugg

SEQ ID NO: 3479058 - RNA, 20 nt, Pseudomonas aeruginosa PA01
uccugggucgcguacagcgg

SEQ ID NO: 3479059 - RNA, 12 nt, Pseudomonas aeruginosa PA01
uccugggugccg

SEQ ID NO: 3479060 - RNA, 16 nt, Pseudomonas aeruginosa PA01
uccuggguggcgacgc

SEQ ID NO: 3479061 - RNA, 19 nt, Pseudomonas aeruginosa PA01
uccugguacucguccuccc

SEQ ID NO: 3479062 - RNA, 20 nt, Pseudomonas aeruginosa PA01
uccugguagaacuccuugcc

SEQ ID NO: 3479063 - RNA, 15 nt, Pseudomonas aeruginosa PA01
uccugguccagccag

SEQ ID NO: 3479064 - RNA, 15 nt, Pseudomonas aeruginosa PA01
uccuggucgcggggc

SEQ ID NO: 3479065 - RNA, 19 nt, Pseudomonas aeruginosa PA01
uccuggucgcguuccagcu

SEQ ID NO: 3479066 - RNA, 22 nt, Pseudomonas aeruginosa PA01
uccuggugcggcaccagccagg

SEQ ID NO: 3479067 - RNA, 20 nt, Pseudomonas aeruginosa PA01
uccugguggaacagccgcag

SEQ ID NO: 3479068 - RNA, 22 nt, Pseudomonas aeruginosa PA01
uccugguggaacagccgcagcg

SEQ ID NO: 3479069 - RNA, 13 nt, Pseudomonas aeruginosa PA01
uccuguaccaggg

SEQ ID NO: 3479070 - RNA, 20 nt, Pseudomonas aeruginosa PA01
uccuguaguacaugacgaag

SEQ ID NO: 3479071 - RNA, 15 nt, Pseudomonas aeruginosa PA01
uccuguccauuucca

SEQ ID NO: 3479072 - RNA, 19 nt, Pseudomonas aeruginosa PA01
uccugucgaggccucgucg

SEQ ID NO: 3479073 - RNA, 19 nt, Pseudomonas aeruginosa PA01
uccugugcgaggcuggccu

SEQ ID NO: 3479074 - RNA, 19 nt, Pseudomonas aeruginosa PA01
uccuguggauaaaaaggcc

SEQ ID NO: 3479075 - RNA, 20 nt, Pseudomonas aeruginosa PA01
uccuguuucugcuguggagc

SEQ ID NO: 3479076 - RNA, 15 nt, Pseudomonas aeruginosa PA01
uccuucaaccacucc

SEQ ID NO: 3479077 - RNA, 16 nt, Pseudomonas aeruginosa PA01
uccuucagcugguucc

SEQ ID NO: 3479078 - RNA, 19 nt, Pseudomonas aeruginosa PA01
uccuuccaggguuuccagc

SEQ ID NO: 3479079 - RNA, 23 nt, Pseudomonas aeruginosa PA01
uccuuccaggguuuccagcagca

SEQ ID NO: 3479080 - RNA, 21 nt, Pseudomonas aeruginosa PA01
uccuucgagccuggccaggcg

SEQ ID NO: 3479081 - RNA, 24 nt, Pseudomonas aeruginosa PA01
uccuucgcggcggcgcgucggugc

SEQ ID NO: 3479082 - RNA, 14 nt, Pseudomonas aeruginosa PA01
uccuucggaggucg

SEQ ID NO: 3479083 - RNA, 16 nt, Pseudomonas aeruginosa PA01
uccuucggccgcacca

SEQ ID NO: 3479084 - RNA, 17 nt, Pseudomonas aeruginosa PA01
uccuucggccgcaccag

SEQ ID NO: 3479085 - RNA, 21 nt, Pseudomonas aeruginosa PA01
uccuucggcgcauagccaccg

SEQ ID NO: 3479086 - RNA, 14 nt, Pseudomonas aeruginosa PA01
uccuucucgaagcc

SEQ ID NO: 3479087 - RNA, 23 nt, Pseudomonas aeruginosa PA01
uccuucuuguauaccagcggcug

SEQ ID NO: 3479088 - RNA, 20 nt, Pseudomonas aeruginosa PA01
uccuugaaggcuuccuggaa

SEQ ID NO: 3479089 - RNA, 20 nt, Pseudomonas aeruginosa PA01
uccuugacccucugguuggc

SEQ ID NO: 3479090 - RNA, 13 nt, Pseudomonas aeruginosa PA01
uccuugagcaucc

SEQ ID NO: 3479091 - RNA, 17 nt, Pseudomonas aeruginosa PA01
uccuugagcgccagcag

SEQ ID NO: 3479092 - RNA, 20 nt, Pseudomonas aeruginosa PA01
uccuugaguucccagaccug

SEQ ID NO: 3479093 - RNA, 13 nt, Pseudomonas aeruginosa PA01
uccuugauccacu

SEQ ID NO: 3479094 - RNA, 19 nt, Pseudomonas aeruginosa PA01
uccuugauccacucgcccu

SEQ ID NO: 3479095 - RNA, 16 nt, Pseudomonas aeruginosa PA01
uccuugcccggcgcca

SEQ ID NO: 3479096 - RNA, 15 nt, Pseudomonas aeruginosa PA01
uccuugcgccaggcc

SEQ ID NO: 3479097 - RNA, 15 nt, Pseudomonas aeruginosa PA01
uccuugcgcggcagg

SEQ ID NO: 3479098 - RNA, 20 nt, Pseudomonas aeruginosa PA01
uccuugcugaagcccaggcg

SEQ ID NO: 3479099 - RNA, 17 nt, Pseudomonas aeruginosa PA01
uccuugggaucggcgau

SEQ ID NO: 3479100 - RNA, 22 nt, Pseudomonas aeruginosa PA01
uccuugggccaggcauccagca

SEQ ID NO: 3479101 - RNA, 20 nt, Pseudomonas aeruginosa PA01
uccuuggucaggucgacgcc

SEQ ID NO: 3479102 - RNA, 23 nt, Pseudomonas aeruginosa PA01
uccuugguguuggucaggcccug

SEQ ID NO: 3479103 - RNA, 16 nt, Pseudomonas aeruginosa PA01
uccuuguccagggccg

SEQ ID NO: 3479104 - RNA, 18 nt, Pseudomonas aeruginosa PA01
uccuugucgaucaggaac

SEQ ID NO: 3479105 - RNA, 17 nt, Pseudomonas aeruginosa PA01
uccuuguucggcuggac

SEQ ID NO: 3479106 - RNA, 21 nt, Pseudomonas aeruginosa PA01
uccuuucacaugcaccaggcc

SEQ ID NO: 3479107 - RNA, 19 nt, Pseudomonas aeruginosa PA01
uccuuucggaacagcgccu

SEQ ID NO: 3479108 - RNA, 20 nt, Pseudomonas aeruginosa PA01
ucgaaaaaaggcgccuucgg

SEQ ID NO: 3479109 - RNA, 13 nt, Pseudomonas aeruginosa PA01
ucgaaacgaagcu

SEQ ID NO: 3479110 - RNA, 20 nt, Pseudomonas aeruginosa PA01
ucgaaacgcuggcggccgag

SEQ ID NO: 3479111 - RNA, 17 nt, Pseudomonas aeruginosa PA01
ucgaaacggaacaggaa

SEQ ID NO: 3479112 - RNA, 20 nt, Pseudomonas aeruginosa PA01
ucgaaacgggcgcucuggcc

SEQ ID NO: 3479113 - RNA, 21 nt, Pseudomonas aeruginosa PA01
ucgaaagccgccgccgcgccg

SEQ ID NO: 3479114 - RNA, 22 nt, Pseudomonas aeruginosa PA01
ucgaaagccgccgccgcgccgg

SEQ ID NO: 3479115 - RNA, 19 nt, Pseudomonas aeruginosa PA01
ucgaaagccuccagcagcu

SEQ ID NO: 3479116 - RNA, 15 nt, Pseudomonas aeruginosa PA01
ucgaaagccugccgg

SEQ ID NO: 3479117 - RNA, 21 nt, Pseudomonas aeruginosa PA01
ucgaaagcuucgucgcgcagg

SEQ ID NO: 3479118 - RNA, 13 nt, Pseudomonas aeruginosa PA01
ucgaaaucgccca

SEQ ID NO: 3479119 - RNA, 20 nt, Pseudomonas aeruginosa PA01
ucgaaaucgcccaccagguc

SEQ ID NO: 3479120 - RNA, 18 nt, Pseudomonas aeruginosa PA01
ucgaaaugcucgugcagg

SEQ ID NO: 3479121 - RNA, 22 nt, Pseudomonas aeruginosa PA01
ucgaacaaucccagcucgccga

SEQ ID NO: 3479122 - RNA, 19 nt, Pseudomonas aeruginosa PA01
ucgaacaccaggcgccagg

SEQ ID NO: 3479123 - RNA, 16 nt, Pseudomonas aeruginosa PA01
ucgaacaccggcgagc

SEQ ID NO: 3479124 - RNA, 18 nt, Pseudomonas aeruginosa PA01
ucgaacaccggcgccgcc

SEQ ID NO: 3479125 - RNA, 17 nt, Pseudomonas aeruginosa PA01
ucgaacacuugaccguc

SEQ ID NO: 3479126 - RNA, 23 nt, Pseudomonas aeruginosa PA01
ucgaacacuugaccgucggcaag

SEQ ID NO: 3479127 - RNA, 23 nt, Pseudomonas aeruginosa PA01
ucgaacagcaccgagcaggcacc

SEQ ID NO: 3479128 - RNA, 14 nt, Pseudomonas aeruginosa PA01
ucgaacagcagcaa

SEQ ID NO: 3479129 - RNA, 22 nt, Pseudomonas aeruginosa PA01
ucgaacagcagcaagccgauga

SEQ ID NO: 3479130 - RNA, 13 nt, Pseudomonas aeruginosa PA01
ucgaacagcagcu

SEQ ID NO: 3479131 - RNA, 20 nt, Pseudomonas aeruginosa PA01
ucgaacagcagcucgccgcu

SEQ ID NO: 3479132 - RNA, 19 nt, Pseudomonas aeruginosa PA01
ucgaacagcuugacgaucu

SEQ ID NO: 3479133 - RNA, 18 nt, Pseudomonas aeruginosa PA01
ucgaacagcuugccgcug

SEQ ID NO: 3479134 - RNA, 21 nt, Pseudomonas aeruginosa PA01
ucgaacagguaguugaggucg

SEQ ID NO: 3479135 - RNA, 21 nt, Pseudomonas aeruginosa PA01
ucgaacagguggcuuuccagc

SEQ ID NO: 3479136 - RNA, 22 nt, Pseudomonas aeruginosa PA01
ucgaacagguggcuuuccagca

SEQ ID NO: 3479137 - RNA, 13 nt, Pseudomonas aeruginosa PA01
ucgaaccagccgc

SEQ ID NO: 3479138 - RNA, 18 nt, Pseudomonas aeruginosa PA01
ucgaaccccuggcgcucg

SEQ ID NO: 3479139 - RNA, 21 nt, Pseudomonas aeruginosa PA01
ucgaacccgcccucguggcgg

SEQ ID NO: 3479140 - RNA, 20 nt, Pseudomonas aeruginosa PA01
ucgaaccguggcggccgccg

SEQ ID NO: 3479141 - RNA, 21 nt, Pseudomonas aeruginosa PA01
ucgaacgccgcccgucgcgcc

SEQ ID NO: 3479142 - RNA, 14 nt, Pseudomonas aeruginosa PA01
ucgaacgugcgcgc

SEQ ID NO: 3479143 - RNA, 16 nt, Pseudomonas aeruginosa PA01
ucgaacugaccaccag

SEQ ID NO: 3479144 - RNA, 23 nt, Pseudomonas aeruginosa PA01
ucgaacugcacccgccgaccgga

SEQ ID NO: 3479145 - RNA, 18 nt, Pseudomonas aeruginosa PA01
ucgaagaagcgcaccacc

SEQ ID NO: 3479146 - RNA, 21 nt, Pseudomonas aeruginosa PA01
ucgaagaaugccuucaccggc

SEQ ID NO: 3479147 - RNA, 17 nt, Pseudomonas aeruginosa PA01
ucgaagaccaggguggg

SEQ ID NO: 3479148 - RNA, 15 nt, Pseudomonas aeruginosa PA01
ucgaagacccccugc

SEQ ID NO: 3479149 - RNA, 21 nt, Pseudomonas aeruginosa PA01
ucgaagacccccugccgcccu

SEQ ID NO: 3479150 - RNA, 21 nt, Pseudomonas aeruginosa PA01
ucgaagauuccgcugaggaug

SEQ ID NO: 3479151 - RNA, 18 nt, Pseudomonas aeruginosa PA01
ucgaagcagcccagcgcu

SEQ ID NO: 3479152 - RNA, 21 nt, Pseudomonas aeruginosa PA01
ucgaagcagcccagcgcuucc

SEQ ID NO: 3479153 - RNA, 13 nt, Pseudomonas aeruginosa PA01
ucgaagcccagcg

SEQ ID NO: 3479154 - RNA, 14 nt, Pseudomonas aeruginosa PA01
ucgaagcccaucga

SEQ ID NO: 3479155 - RNA, 23 nt, Pseudomonas aeruginosa PA01
ucgaagcccgaauguuccaaggu

SEQ ID NO: 3479156 - RNA, 12 nt, Pseudomonas aeruginosa PA01
ucgaagcccugc

SEQ ID NO: 3479157 - RNA, 18 nt, Pseudomonas aeruginosa PA01
ucgaagccgagcugccgg

SEQ ID NO: 3479158 - RNA, 21 nt, Pseudomonas aeruginosa PA01
ucgaagccgagcugccgggcg

SEQ ID NO: 3479159 - RNA, 12 nt, Pseudomonas aeruginosa PA01
ucgaagccgagg

SEQ ID NO: 3479160 - RNA, 17 nt, Pseudomonas aeruginosa PA01
ucgaagccgaggcuuuc

SEQ ID NO: 3479161 - RNA, 14 nt, Pseudomonas aeruginosa PA01
ucgaagccgccgcc

SEQ ID NO: 3479162 - RNA, 17 nt, Pseudomonas aeruginosa PA01
ucgaagccgccgccgag

SEQ ID NO: 3479163 - RNA, 22 nt, Pseudomonas aeruginosa PA01
ucgaagccggauucgcgcagca

SEQ ID NO: 3479164 - RNA, 13 nt, Pseudomonas aeruginosa PA01
ucgaagcgcagca

SEQ ID NO: 3479165 - RNA, 13 nt, Pseudomonas aeruginosa PA01
ucgaagcgccagg

SEQ ID NO: 3479166 - RNA, 14 nt, Pseudomonas aeruginosa PA01
ucgaagcgcgccug

SEQ ID NO: 3479167 - RNA, 17 nt, Pseudomonas aeruginosa PA01
ucgaagcuccagcgugc

SEQ ID NO: 3479168 - RNA, 17 nt, Pseudomonas aeruginosa PA01
ucgaagcucucgccgcg

SEQ ID NO: 3479169 - RNA, 18 nt, Pseudomonas aeruginosa PA01
ucgaagcucucgccgcgc

SEQ ID NO: 3479170 - RNA, 17 nt, Pseudomonas aeruginosa PA01
ucgaagcuggccaguug

SEQ ID NO: 3479171 - RNA, 24 nt, Pseudomonas aeruginosa PA01
ucgaagcugucggcccgcgccaug

SEQ ID NO: 3479172 - RNA, 23 nt, Pseudomonas aeruginosa PA01
ucgaagcugucguaguccugggc

SEQ ID NO: 3479173 - RNA, 15 nt, Pseudomonas aeruginosa PA01
ucgaaggaucgccuu

SEQ ID NO: 3479174 - RNA, 13 nt, Pseudomonas aeruginosa PA01
ucgaaggccagcu

SEQ ID NO: 3479175 - RNA, 14 nt, Pseudomonas aeruginosa PA01
ucgaaggccagcuc

SEQ ID NO: 3479176 - RNA, 17 nt, Pseudomonas aeruginosa PA01
ucgaaggccucggucag

SEQ ID NO: 3479177 - RNA, 15 nt, Pseudomonas aeruginosa PA01
ucgaaggcgcggcgg

SEQ ID NO: 3479178 - RNA, 14 nt, Pseudomonas aeruginosa PA01
ucgaaggcggcgcg

SEQ ID NO: 3479179 - RNA, 16 nt, Pseudomonas aeruginosa PA01
ucgaaggcggcgcggc

SEQ ID NO: 3479180 - RNA, 18 nt, Pseudomonas aeruginosa PA01
ucgaaggcggcgcggcgg

SEQ ID NO: 3479181 - RNA, 23 nt, Pseudomonas aeruginosa PA01
ucgaaggcguucucguccucggc

SEQ ID NO: 3479182 - RNA, 17 nt, Pseudomonas aeruginosa PA01
ucgaaggguuggccgca

SEQ ID NO: 3479183 - RNA, 19 nt, Pseudomonas aeruginosa PA01
ucgaaggguuggccgcagc

SEQ ID NO: 3479184 - RNA, 23 nt, Pseudomonas aeruginosa PA01
ucgaaggguuggccgcagcagcg

SEQ ID NO: 3479185 - RNA, 16 nt, Pseudomonas aeruginosa PA01
ucgaagguagcggucg

SEQ ID NO: 3479186 - RNA, 22 nt, Pseudomonas aeruginosa PA01
ucgaaggugaagcugccgucga

SEQ ID NO: 3479187 - RNA, 17 nt, Pseudomonas aeruginosa PA01
ucgaaguagucggcgua

SEQ ID NO: 3479188 - RNA, 23 nt, Pseudomonas aeruginosa PA01
ucgaaguccacugucucgccgau

SEQ ID NO: 3479189 - RNA, 16 nt, Pseudomonas aeruginosa PA01
ucgaaguccugcagga

SEQ ID NO: 3479190 - RNA, 16 nt, Pseudomonas aeruginosa PA01
ucgaaguucuccagca

SEQ ID NO: 3479191 - RNA, 17 nt, Pseudomonas aeruginosa PA01
ucgaaguucuccagcaa

SEQ ID NO: 3479192 - RNA, 24 nt, Pseudomonas aeruginosa PA01
ucgaaguuggaaggaucgagccag

SEQ ID NO: 3479193 - RNA, 15 nt, Pseudomonas aeruginosa PA01
ucgaaugcugcccgg

SEQ ID NO: 3479194 - RNA, 19 nt, Pseudomonas aeruginosa PA01
ucgaaugcuguuccucguc

SEQ ID NO: 3479195 - RNA, 13 nt, Pseudomonas aeruginosa PA01
ucgaauggcgccg

SEQ ID NO: 3479196 - RNA, 14 nt, Pseudomonas aeruginosa PA01
ucgaauggcgccgg

SEQ ID NO: 3479197 - RNA, 19 nt, Pseudomonas aeruginosa PA01
ucgaauggcgccggccaga

SEQ ID NO: 3479198 - RNA, 24 nt, Pseudomonas aeruginosa PA01
ucgaauuggacagcaggcugccga

SEQ ID NO: 3479199 - RNA, 23 nt, Pseudomonas aeruginosa PA01
ucgacaaggagacucagcgcgac

SEQ ID NO: 3479200 - RNA, 20 nt, Pseudomonas aeruginosa PA01
ucgacaccccggucaggccg

SEQ ID NO: 3479201 - RNA, 14 nt, Pseudomonas aeruginosa PA01
ucgacaccgaucac

SEQ ID NO: 3479202 - RNA, 15 nt, Pseudomonas aeruginosa PA01
ucgacaccgaucacc

SEQ ID NO: 3479203 - RNA, 16 nt, Pseudomonas aeruginosa PA01
ucgacaccgaucaccu

SEQ ID NO: 3479204 - RNA, 22 nt, Pseudomonas aeruginosa PA01
ucgacaccgaucaccuggccgg

SEQ ID NO: 3479205 - RNA, 13 nt, Pseudomonas aeruginosa PA01
ucgacagcagcgc

SEQ ID NO: 3479206 - RNA, 17 nt, Pseudomonas aeruginosa PA01
ucgacagcagcgccagg

SEQ ID NO: 3479207 - RNA, 20 nt, Pseudomonas aeruginosa PA01
ucgacagcagcgccagggcc

SEQ ID NO: 3479208 - RNA, 17 nt, Pseudomonas aeruginosa PA01
ucgacagcagguggcug

SEQ ID NO: 3479209 - RNA, 19 nt, Pseudomonas aeruginosa PA01
ucgacagcgcggaucaguc

SEQ ID NO: 3479210 - RNA, 21 nt, Pseudomonas aeruginosa PA01
ucgacagcgucguaguggcgc

SEQ ID NO: 3479211 - RNA, 14 nt, Pseudomonas aeruginosa PA01
ucgacaggccgccg

SEQ ID NO: 3479212 - RNA, 13 nt, Pseudomonas aeruginosa PA01
ucgacaggucggc

SEQ ID NO: 3479213 - RNA, 22 nt, Pseudomonas aeruginosa PA01
ucgacaggucggcgaaauccuc

SEQ ID NO: 3479214 - RNA, 17 nt, Pseudomonas aeruginosa PA01
ucgacauagcgcagcac

SEQ ID NO: 3479215 - RNA, 18 nt, Pseudomonas aeruginosa PA01
ucgacauaggacugccaa

SEQ ID NO: 3479216 - RNA, 19 nt, Pseudomonas aeruginosa PA01
ucgacaucgauaacaccag

SEQ ID NO: 3479217 - RNA, 18 nt, Pseudomonas aeruginosa PA01
ucgacaucgucucgcgac

SEQ ID NO: 3479218 - RNA, 20 nt, Pseudomonas aeruginosa PA01
ucgacaucgucucgcgacac

SEQ ID NO: 3479219 - RNA, 16 nt, Pseudomonas aeruginosa PA01
ucgacaugcaccaggc

SEQ ID NO: 3479220 - RNA, 20 nt, Pseudomonas aeruginosa PA01
ucgacaugcaccaggccgcc

SEQ ID NO: 3479221 - RNA, 15 nt, Pseudomonas aeruginosa PA01
ucgacaugcaggccg

SEQ ID NO: 3479222 - RNA, 16 nt, Pseudomonas aeruginosa PA01
ucgacaugcaggccgg

SEQ ID NO: 3479223 - RNA, 18 nt, Pseudomonas aeruginosa PA01
ucgacaugggccgcgcag

SEQ ID NO: 3479224 - RNA, 17 nt, Pseudomonas aeruginosa PA01
ucgacauugcugccgag

SEQ ID NO: 3479225 - RNA, 14 nt, Pseudomonas aeruginosa PA01
ucgaccaccgcgug

SEQ ID NO: 3479226 - RNA, 15 nt, Pseudomonas aeruginosa PA01
ucgaccacgcucuug

SEQ ID NO: 3479227 - RNA, 20 nt, Pseudomonas aeruginosa PA01
ucgaccacggccuucggcag

SEQ ID NO: 3479228 - RNA, 18 nt, Pseudomonas aeruginosa PA01
ucgaccagacgcagcagc

SEQ ID NO: 3479229 - RNA, 14 nt, Pseudomonas aeruginosa PA01
ucgaccagaucggc

SEQ ID NO: 3479230 - RNA, 15 nt, Pseudomonas aeruginosa PA01
ucgaccagcagcggc

SEQ ID NO: 3479231 - RNA, 13 nt, Pseudomonas aeruginosa PA01
ucgaccagccagu

SEQ ID NO: 3479232 - RNA, 15 nt, Pseudomonas aeruginosa PA01
ucgaccagcgccgcg

SEQ ID NO: 3479233 - RNA, 13 nt, Pseudomonas aeruginosa PA01
ucgaccagcggcg

SEQ ID NO: 3479234 - RNA, 14 nt, Pseudomonas aeruginosa PA01
ucgaccagcggcgg

SEQ ID NO: 3479235 - RNA, 15 nt, Pseudomonas aeruginosa PA01
ucgaccagcggcggu

SEQ ID NO: 3479236 - RNA, 23 nt, Pseudomonas aeruginosa PA01
ucgaccagcggcgguagcuccag

SEQ ID NO: 3479237 - RNA, 21 nt, Pseudomonas aeruginosa PA01
ucgaccaggaauuccuggccg

SEQ ID NO: 3479238 - RNA, 22 nt, Pseudomonas aeruginosa PA01
ucgaccaggcguuccaccaggc

SEQ ID NO: 3479239 - RNA, 19 nt, Pseudomonas aeruginosa PA01
ucgaccagggcauccaggg

SEQ ID NO: 3479240 - RNA, 15 nt, Pseudomonas aeruginosa PA01
ucgaccagggccggg

SEQ ID NO: 3479241 - RNA, 21 nt, Pseudomonas aeruginosa PA01
ucgaccagguccggcagcgcc

SEQ ID NO: 3479242 - RNA, 21 nt, Pseudomonas aeruginosa PA01
ucgaccaggucgccaugcccg

SEQ ID NO: 3479243 - RNA, 15 nt, Pseudomonas aeruginosa PA01
ucgaccaucaccagc

SEQ ID NO: 3479244 - RNA, 16 nt, Pseudomonas aeruginosa PA01
ucgaccaucaccagcg

SEQ ID NO: 3479245 - RNA, 18 nt, Pseudomonas aeruginosa PA01
ucgaccaucggcggcggc

SEQ ID NO: 3479246 - RNA, 20 nt, Pseudomonas aeruginosa PA01
ucgaccaugccguagaucag

SEQ ID NO: 3479247 - RNA, 20 nt, Pseudomonas aeruginosa PA01
ucgaccaugguguuggcggc

SEQ ID NO: 3479248 - RNA, 18 nt, Pseudomonas aeruginosa PA01
ucgacccagccgcacgcc

SEQ ID NO: 3479249 - RNA, 20 nt, Pseudomonas aeruginosa PA01
ucgacccaugccgcuagccc

SEQ ID NO: 3479250 - RNA, 16 nt, Pseudomonas aeruginosa PA01
ucgaccccgccggggc

SEQ ID NO: 3479251 - RNA, 23 nt, Pseudomonas aeruginosa PA01
ucgaccccgccggggcgugcagg

SEQ ID NO: 3479252 - RNA, 13 nt, Pseudomonas aeruginosa PA01
ucgacccgcccgc

SEQ ID NO: 3479253 - RNA, 15 nt, Pseudomonas aeruginosa PA01
ucgacccgcccgccg

SEQ ID NO: 3479254 - RNA, 19 nt, Pseudomonas aeruginosa PA01
ucgacccgccgaccagcac

SEQ ID NO: 3479255 - RNA, 22 nt, Pseudomonas aeruginosa PA01
ucgacccgccgaccagcacggc

SEQ ID NO: 3479256 - RNA, 23 nt, Pseudomonas aeruginosa PA01
ucgacccgccgaccagcacggcg

SEQ ID NO: 3479257 - RNA, 20 nt, Pseudomonas aeruginosa PA01
ucgacccgcucgaggguguc

SEQ ID NO: 3479258 - RNA, 16 nt, Pseudomonas aeruginosa PA01
ucgacccuggcgccga

SEQ ID NO: 3479259 - RNA, 17 nt, Pseudomonas aeruginosa PA01
ucgacccuggcgccgac

SEQ ID NO: 3479260 - RNA, 20 nt, Pseudomonas aeruginosa PA01
ucgacccuggcgccgaccuc

SEQ ID NO: 3479261 - RNA, 15 nt, Pseudomonas aeruginosa PA01
ucgaccgccugccag

SEQ ID NO: 3479262 - RNA, 18 nt, Pseudomonas aeruginosa PA01
ucgaccgccugccagacc

SEQ ID NO: 3479263 - RNA, 15 nt, Pseudomonas aeruginosa PA01
ucgaccgcgccggcg

SEQ ID NO: 3479264 - RNA, 18 nt, Pseudomonas aeruginosa PA01
ucgaccgcgccggcgaua

SEQ ID NO: 3479265 - RNA, 14 nt, Pseudomonas aeruginosa PA01
ucgaccggcgcgcc

SEQ ID NO: 3479266 - RNA, 16 nt, Pseudomonas aeruginosa PA01
ucgaccggcgcgccuu

SEQ ID NO: 3479267 - RNA, 13 nt, Pseudomonas aeruginosa PA01
ucgaccgucgcca

SEQ ID NO: 3479268 - RNA, 14 nt, Pseudomonas aeruginosa PA01
ucgaccuccaggcc

SEQ ID NO: 3479269 - RNA, 17 nt, Pseudomonas aeruginosa PA01
ucgaccuccaggccgaa

SEQ ID NO: 3479270 - RNA, 17 nt, Pseudomonas aeruginosa PA01
ucgaccucgauggcgau

SEQ ID NO: 3479271 - RNA, 21 nt, Pseudomonas aeruginosa PA01
ucgaccugcggguuggucggc

SEQ ID NO: 3479272 - RNA, 14 nt, Pseudomonas aeruginosa PA01
ucgaccuggccacg

SEQ ID NO: 3479273 - RNA, 16 nt, Pseudomonas aeruginosa PA01
ucgaccuggccacgcc

SEQ ID NO: 3479274 - RNA, 17 nt, Pseudomonas aeruginosa PA01
ucgaccuggcuccacug

SEQ ID NO: 3479275 - RNA, 18 nt, Pseudomonas aeruginosa PA01
ucgaccuugcccucggcg

SEQ ID NO: 3479276 - RNA, 20 nt, Pseudomonas aeruginosa PA01
ucgaccuugccgacgccgcg

SEQ ID NO: 3479277 - RNA, 20 nt, Pseudomonas aeruginosa PA01
ucgacgaaauaaugcggcgc

SEQ ID NO: 3479278 - RNA, 21 nt, Pseudomonas aeruginosa PA01
ucgacgaacaggaagcgcggg

SEQ ID NO: 3479279 - RNA, 16 nt, Pseudomonas aeruginosa PA01
ucgacgaacucgacgc

SEQ ID NO: 3479280 - RNA, 21 nt, Pseudomonas aeruginosa PA01
ucgacgaacucgacgcgccag

SEQ ID NO: 3479281 - RNA, 23 nt, Pseudomonas aeruginosa PA01
ucgacgaaggcgcgcucgaucag

SEQ ID NO: 3479282 - RNA, 17 nt, Pseudomonas aeruginosa PA01
ucgacgaagggcucagc

SEQ ID NO: 3479283 - RNA, 22 nt, Pseudomonas aeruginosa PA01
ucgacgaagggcucagcccagg

SEQ ID NO: 3479284 - RNA, 23 nt, Pseudomonas aeruginosa PA01
ucgacgaagggcucagcccaggc

SEQ ID NO: 3479285 - RNA, 20 nt, Pseudomonas aeruginosa PA01
ucgacgacgaaaggccgcgc

SEQ ID NO: 3479286 - RNA, 22 nt, Pseudomonas aeruginosa PA01
ucgacgacgaaaggccgcgccg

SEQ ID NO: 3479287 - RNA, 14 nt, Pseudomonas aeruginosa PA01
ucgacgagccgcga

SEQ ID NO: 3479288 - RNA, 17 nt, Pseudomonas aeruginosa PA01
ucgacgagccgcgacgc

SEQ ID NO: 3479289 - RNA, 19 nt, Pseudomonas aeruginosa PA01
ucgacgaucaggugcagga

SEQ ID NO: 3479290 - RNA, 23 nt, Pseudomonas aeruginosa PA01
ucgacgaucaggugcaggaacag

SEQ ID NO: 3479291 - RNA, 19 nt, Pseudomonas aeruginosa PA01
ucgacgaugcugaacuguu

SEQ ID NO: 3479292 - RNA, 18 nt, Pseudomonas aeruginosa PA01
ucgacgcagagcgccaug

SEQ ID NO: 3479293 - RNA, 19 nt, Pseudomonas aeruginosa PA01
ucgacgcagagcgccauga

SEQ ID NO: 3479294 - RNA, 23 nt, Pseudomonas aeruginosa PA01
ucgacgcagccgggccgcagcgc

SEQ ID NO: 3479295 - RNA, 14 nt, Pseudomonas aeruginosa PA01
ucgacgcagcgcgc

SEQ ID NO: 3479296 - RNA, 17 nt, Pseudomonas aeruginosa PA01
ucgacgcagcgcgcgcc

SEQ ID NO: 3479297 - RNA, 19 nt, Pseudomonas aeruginosa PA01
ucgacgcagcgcgcgccga

SEQ ID NO: 3479298 - RNA, 21 nt, Pseudomonas aeruginosa PA01
ucgacgcagcgcgcgccgagc

SEQ ID NO: 3479299 - RNA, 12 nt, Pseudomonas aeruginosa PA01
ucgacgcagggc

SEQ ID NO: 3479300 - RNA, 15 nt, Pseudomonas aeruginosa PA01
ucgacgcagggcggc

SEQ ID NO: 3479301 - RNA, 21 nt, Pseudomonas aeruginosa PA01
ucgacgcagggcggcgccugg

SEQ ID NO: 3479302 - RNA, 22 nt, Pseudomonas aeruginosa PA01
ucgacgcagggcggcgccugga

SEQ ID NO: 3479303 - RNA, 14 nt, Pseudomonas aeruginosa PA01
ucgacgccagcggc

SEQ ID NO: 3479304 - RNA, 15 nt, Pseudomonas aeruginosa PA01
ucgacgccagcggcg

SEQ ID NO: 3479305 - RNA, 21 nt, Pseudomonas aeruginosa PA01
ucgacgcccgcuugcgccgcc

SEQ ID NO: 3479306 - RNA, 23 nt, Pseudomonas aeruginosa PA01
ucgacgcccgcuugcgccgccuc

SEQ ID NO: 3479307 - RNA, 15 nt, Pseudomonas aeruginosa PA01
ucgacgcccucggcg

SEQ ID NO: 3479308 - RNA, 16 nt, Pseudomonas aeruginosa PA01
ucgacgcccucggcga

SEQ ID NO: 3479309 - RNA, 17 nt, Pseudomonas aeruginosa PA01
ucgacgcccucggcgac

SEQ ID NO: 3479310 - RNA, 12 nt, Pseudomonas aeruginosa PA01
ucgacgccgaaa

SEQ ID NO: 3479311 - RNA, 12 nt, Pseudomonas aeruginosa PA01
ucgacgccgaag

SEQ ID NO: 3479312 - RNA, 19 nt, Pseudomonas aeruginosa PA01
ucgacgccgagccagccgc

SEQ ID NO: 3479313 - RNA, 23 nt, Pseudomonas aeruginosa PA01
ucgacgccgagccagccgcggau

SEQ ID NO: 3479314 - RNA, 16 nt, Pseudomonas aeruginosa PA01
ucgacgccgccgagca

SEQ ID NO: 3479315 - RNA, 18 nt, Pseudomonas aeruginosa PA01
ucgacgccgccgagcaug

SEQ ID NO: 3479316 - RNA, 19 nt, Pseudomonas aeruginosa PA01
ucgacgccgcuggcggcgc

SEQ ID NO: 3479317 - RNA, 22 nt, Pseudomonas aeruginosa PA01
ucgacgccgcuggcggcgcuca

SEQ ID NO: 3479318 - RNA, 13 nt, Pseudomonas aeruginosa PA01
ucgacgccuucgu

SEQ ID NO: 3479319 - RNA, 18 nt, Pseudomonas aeruginosa PA01
ucgacgccuugcccggcg

SEQ ID NO: 3479320 - RNA, 19 nt, Pseudomonas aeruginosa PA01
ucgacgccuugcccggcgc

SEQ ID NO: 3479321 - RNA, 20 nt, Pseudomonas aeruginosa PA01
ucgacgccuugcccggcgcg

SEQ ID NO: 3479322 - RNA, 14 nt, Pseudomonas aeruginosa PA01
ucgacgcgccaggu

SEQ ID NO: 3479323 - RNA, 13 nt, Pseudomonas aeruginosa PA01
ucgacgcgcggcu

SEQ ID NO: 3479324 - RNA, 20 nt, Pseudomonas aeruginosa PA01
ucgacgcucugcucggccag

SEQ ID NO: 3479325 - RNA, 22 nt, Pseudomonas aeruginosa PA01
ucgacgcugcuaggcuggaagc

SEQ ID NO: 3479326 - RNA, 14 nt, Pseudomonas aeruginosa PA01
ucgacggcaccagc

SEQ ID NO: 3479327 - RNA, 15 nt, Pseudomonas aeruginosa PA01
ucgacggcgugcagg

SEQ ID NO: 3479328 - RNA, 13 nt, Pseudomonas aeruginosa PA01
ucgacggcuucca

SEQ ID NO: 3479329 - RNA, 16 nt, Pseudomonas aeruginosa PA01
ucgacggcuuccaggg

SEQ ID NO: 3479330 - RNA, 22 nt, Pseudomonas aeruginosa PA01
ucgacgguauguuucuggccgu

SEQ ID NO: 3479331 - RNA, 15 nt, Pseudomonas aeruginosa PA01
ucgacgguuucaggc

SEQ ID NO: 3479332 - RNA, 17 nt, Pseudomonas aeruginosa PA01
ucgacguaccgccugcc

SEQ ID NO: 3479333 - RNA, 20 nt, Pseudomonas aeruginosa PA01
ucgacguagaggaucucgcc

SEQ ID NO: 3479334 - RNA, 20 nt, Pseudomonas aeruginosa PA01
ucgacguaggcggcgaaggc

SEQ ID NO: 3479335 - RNA, 17 nt, Pseudomonas aeruginosa PA01
ucgacguaggcggcgag

SEQ ID NO: 3479336 - RNA, 14 nt, Pseudomonas aeruginosa PA01
ucgacgucgaucuu

SEQ ID NO: 3479337 - RNA, 17 nt, Pseudomonas aeruginosa PA01
ucgacuuccgccuuguc

SEQ ID NO: 3479338 - RNA, 19 nt, Pseudomonas aeruginosa PA01
ucgacuuccgccuuguccu

SEQ ID NO: 3479339 - RNA, 16 nt, Pseudomonas aeruginosa PA01
ucgacuucgcaccagc

SEQ ID NO: 3479340 - RNA, 14 nt, Pseudomonas aeruginosa PA01
ucgacuucgucgaa

SEQ ID NO: 3479341 - RNA, 16 nt, Pseudomonas aeruginosa PA01
ucgacuucgucgaaga

SEQ ID NO: 3479342 - RNA, 21 nt, Pseudomonas aeruginosa PA01
ucgacuucgucgaagaccagg

SEQ ID NO: 3479343 - RNA, 17 nt, Pseudomonas aeruginosa PA01
ucgagaaauaggcgcug

SEQ ID NO: 3479344 - RNA, 18 nt, Pseudomonas aeruginosa PA01
ucgagaaauaggcgcugc

SEQ ID NO: 3479345 - RNA, 21 nt, Pseudomonas aeruginosa PA01
ucgagaaggaagucgagcugg

SEQ ID NO: 3479346 - RNA, 22 nt, Pseudomonas aeruginosa PA01
ucgagaaggaagucgagcuggu

SEQ ID NO: 3479347 - RNA, 19 nt, Pseudomonas aeruginosa PA01
ucgagaaggcugccgggcu

SEQ ID NO: 3479348 - RNA, 15 nt, Pseudomonas aeruginosa PA01
ucgagacccgcaaca

SEQ ID NO: 3479349 - RNA, 21 nt, Pseudomonas aeruginosa PA01
ucgagacccgcaacaccugua

SEQ ID NO: 3479350 - RNA, 14 nt, Pseudomonas aeruginosa PA01
ucgagacgccagcc

SEQ ID NO: 3479351 - RNA, 17 nt, Pseudomonas aeruginosa PA01
ucgagacgccguagcgc

SEQ ID NO: 3479352 - RNA, 20 nt, Pseudomonas aeruginosa PA01
ucgagacgccguagcgcagu

SEQ ID NO: 3479353 - RNA, 22 nt, Pseudomonas aeruginosa PA01
ucgagacgccguagcgcaguuc

SEQ ID NO: 3479354 - RNA, 22 nt, Pseudomonas aeruginosa PA01
ucgagaugcugcgggcgccgcc

SEQ ID NO: 3479355 - RNA, 23 nt, Pseudomonas aeruginosa PA01
ucgagauugucgcguccggccag

SEQ ID NO: 3479356 - RNA, 19 nt, Pseudomonas aeruginosa PA01
ucgagcaccagcaggucgg

SEQ ID NO: 3479357 - RNA, 23 nt, Pseudomonas aeruginosa PA01
ucgagcaccccgagcccggccgg

SEQ ID NO: 3479358 - RNA, 13 nt, Pseudomonas aeruginosa PA01
ucgagcacggcgc

SEQ ID NO: 3479359 - RNA, 16 nt, Pseudomonas aeruginosa PA01
ucgagcacggcgcugg

SEQ ID NO: 3479360 - RNA, 20 nt, Pseudomonas aeruginosa PA01
ucgagcagaguuuagccgcc

SEQ ID NO: 3479361 - RNA, 13 nt, Pseudomonas aeruginosa PA01
ucgagcagcgccg

SEQ ID NO: 3479362 - RNA, 13 nt, Pseudomonas aeruginosa PA01
ucgagcagcgcgc

SEQ ID NO: 3479363 - RNA, 21 nt, Pseudomonas aeruginosa PA01
ucgagcagcucguucgcccag

SEQ ID NO: 3479364 - RNA, 12 nt, Pseudomonas aeruginosa PA01
ucgagcaggccg

SEQ ID NO: 3479365 - RNA, 22 nt, Pseudomonas aeruginosa PA01
ucgagcagggagaaccaggcgg

SEQ ID NO: 3479366 - RNA, 16 nt, Pseudomonas aeruginosa PA01
ucgagcaguuccaggc

SEQ ID NO: 3479367 - RNA, 18 nt, Pseudomonas aeruginosa PA01
ucgagcaguuccaggcgu

SEQ ID NO: 3479368 - RNA, 21 nt, Pseudomonas aeruginosa PA01
ucgagcaguucccccagcacc

SEQ ID NO: 3479369 - RNA, 18 nt, Pseudomonas aeruginosa PA01
ucgagcaguugcuggaug

SEQ ID NO: 3479370 - RNA, 17 nt, Pseudomonas aeruginosa PA01
ucgagcaucuccggcac

SEQ ID NO: 3479371 - RNA, 18 nt, Pseudomonas aeruginosa PA01
ucgagcaucugccgggcg

SEQ ID NO: 3479372 - RNA, 20 nt, Pseudomonas aeruginosa PA01
ucgagcaucugccgggcgcg

SEQ ID NO: 3479373 - RNA, 16 nt, Pseudomonas aeruginosa PA01
ucgagcaugccgagga

SEQ ID NO: 3479374 - RNA, 18 nt, Pseudomonas aeruginosa PA01
ucgagccagcccagcggc

SEQ ID NO: 3479375 - RNA, 19 nt, Pseudomonas aeruginosa PA01
ucgagccagcccagcggcg

SEQ ID NO: 3479376 - RNA, 20 nt, Pseudomonas aeruginosa PA01
ucgagccaggcguauucggc

SEQ ID NO: 3479377 - RNA, 13 nt, Pseudomonas aeruginosa PA01
ucgagcccugguc

SEQ ID NO: 3479378 - RNA, 18 nt, Pseudomonas aeruginosa PA01
ucgagcccuugcgcggcg

SEQ ID NO: 3479379 - RNA, 12 nt, Pseudomonas aeruginosa PA01
ucgagccgccgg

SEQ ID NO: 3479380 - RNA, 13 nt, Pseudomonas aeruginosa PA01
ucgagccguucca

SEQ ID NO: 3479381 - RNA, 13 nt, Pseudomonas aeruginosa PA01
ucgagccuggcca

SEQ ID NO: 3479382 - RNA, 17 nt, Pseudomonas aeruginosa PA01
ucgagccuggccaggcg

SEQ ID NO: 3479383 - RNA, 14 nt, Pseudomonas aeruginosa PA01
ucgagcgcagcgac

SEQ ID NO: 3479384 - RNA, 16 nt, Pseudomonas aeruginosa PA01
ucgagcgcagcgacac

SEQ ID NO: 3479385 - RNA, 19 nt, Pseudomonas aeruginosa PA01
ucgagcgcuccaccgcgcu

SEQ ID NO: 3479386 - RNA, 14 nt, Pseudomonas aeruginosa PA01
ucgagcucggccag

SEQ ID NO: 3479387 - RNA, 17 nt, Pseudomonas aeruginosa PA01
ucgagcucggccaggca

SEQ ID NO: 3479388 - RNA, 13 nt, Pseudomonas aeruginosa PA01
ucgagcugcgagg

SEQ ID NO: 3479389 - RNA, 15 nt, Pseudomonas aeruginosa PA01
ucgagcugcucggcg

SEQ ID NO: 3479390 - RNA, 23 nt, Pseudomonas aeruginosa PA01
ucgagcuguccaucucgccgcgc

SEQ ID NO: 3479391 - RNA, 22 nt, Pseudomonas aeruginosa PA01
ucgagcuuguuggccagcagcc

SEQ ID NO: 3479392 - RNA, 23 nt, Pseudomonas aeruginosa PA01
ucgagcuuguuggccagcagcca

SEQ ID NO: 3479393 - RNA, 19 nt, Pseudomonas aeruginosa PA01
ucgaggaacaggucgacgc

SEQ ID NO: 3479394 - RNA, 20 nt, Pseudomonas aeruginosa PA01
ucgaggaacaggucgacgcc

SEQ ID NO: 3479395 - RNA, 17 nt, Pseudomonas aeruginosa PA01
ucgaggaaggccagcag

SEQ ID NO: 3479396 - RNA, 15 nt, Pseudomonas aeruginosa PA01
ucgaggaccgacggc

SEQ ID NO: 3479397 - RNA, 16 nt, Pseudomonas aeruginosa PA01
ucgaggacgugcacca

SEQ ID NO: 3479398 - RNA, 19 nt, Pseudomonas aeruginosa PA01
ucgaggaucuugcgcccgg

SEQ ID NO: 3479399 - RNA, 21 nt, Pseudomonas aeruginosa PA01
ucgaggaucuugcgcccggcg

SEQ ID NO: 3479400 - RNA, 22 nt, Pseudomonas aeruginosa PA01
ucgaggaucuugcgcccggcgc

SEQ ID NO: 3479401 - RNA, 13 nt, Pseudomonas aeruginosa PA01
ucgaggaugaucg

SEQ ID NO: 3479402 - RNA, 20 nt, Pseudomonas aeruginosa PA01
ucgaggauguaguagacguc

SEQ ID NO: 3479403 - RNA, 19 nt, Pseudomonas aeruginosa PA01
ucgaggcaaucugcccggc

SEQ ID NO: 3479404 - RNA, 23 nt, Pseudomonas aeruginosa PA01
ucgaggccaggaucgucggcccg

SEQ ID NO: 3479405 - RNA, 20 nt, Pseudomonas aeruginosa PA01
ucgaggccgagccggcaucc

SEQ ID NO: 3479406 - RNA, 15 nt, Pseudomonas aeruginosa PA01
ucgaggccgcccagc

SEQ ID NO: 3479407 - RNA, 19 nt, Pseudomonas aeruginosa PA01
ucgaggccgcccagcgcag

SEQ ID NO: 3479408 - RNA, 20 nt, Pseudomonas aeruginosa PA01
ucgaggccgcccagcgcagc

SEQ ID NO: 3479409 - RNA, 21 nt, Pseudomonas aeruginosa PA01
ucgaggccgcccagcgcagcc

SEQ ID NO: 3479410 - RNA, 13 nt, Pseudomonas aeruginosa PA01
ucgaggccucguc

SEQ ID NO: 3479411 - RNA, 14 nt, Pseudomonas aeruginosa PA01
ucgaggcgccgacc

SEQ ID NO: 3479412 - RNA, 19 nt, Pseudomonas aeruginosa PA01
ucgaggcgccgaccacgac

SEQ ID NO: 3479413 - RNA, 15 nt, Pseudomonas aeruginosa PA01
ucgaggcgcuccacc

SEQ ID NO: 3479414 - RNA, 23 nt, Pseudomonas aeruginosa PA01
ucgagggaggucgcacgcagcgc

SEQ ID NO: 3479415 - RNA, 18 nt, Pseudomonas aeruginosa PA01
ucgagggcgaccgccagg

SEQ ID NO: 3479416 - RNA, 19 nt, Pseudomonas aeruginosa PA01
ucgagggcgaccgccaggc

SEQ ID NO: 3479417 - RNA, 19 nt, Pseudomonas aeruginosa PA01
ucgagggcgcguugcccag

SEQ ID NO: 3479418 - RNA, 21 nt, Pseudomonas aeruginosa PA01
ucgagggcguccuugcccggc

SEQ ID NO: 3479419 - RNA, 17 nt, Pseudomonas aeruginosa PA01
ucgagggguaaggcaug

SEQ ID NO: 3479420 - RNA, 22 nt, Pseudomonas aeruginosa PA01
ucgagggguaaggcaugcccag

SEQ ID NO: 3479421 - RNA, 23 nt, Pseudomonas aeruginosa PA01
ucgagggguaaggcaugcccagg

SEQ ID NO: 3479422 - RNA, 14 nt, Pseudomonas aeruginosa PA01
ucgagggucugcug

SEQ ID NO: 3479423 - RNA, 21 nt, Pseudomonas aeruginosa PA01
ucgaggguggcgccgagcagc

SEQ ID NO: 3479424 - RNA, 22 nt, Pseudomonas aeruginosa PA01
ucgagggugguuuccaggcuca

SEQ ID NO: 3479425 - RNA, 22 nt, Pseudomonas aeruginosa PA01
ucgagggugucguagaggcugu

SEQ ID NO: 3479426 - RNA, 17 nt, Pseudomonas aeruginosa PA01
ucgaggguugucaccgg

SEQ ID NO: 3479427 - RNA, 17 nt, Pseudomonas aeruginosa PA01
ucgagguagguccaggc

SEQ ID NO: 3479428 - RNA, 18 nt, Pseudomonas aeruginosa PA01
ucgagguagguccaggcg

SEQ ID NO: 3479429 - RNA, 21 nt, Pseudomonas aeruginosa PA01
ucgagguagguccaggcgacg

SEQ ID NO: 3479430 - RNA, 17 nt, Pseudomonas aeruginosa PA01
ucgaggucgacggcggc

SEQ ID NO: 3479431 - RNA, 19 nt, Pseudomonas aeruginosa PA01
ucgaggucgagguccacgu

SEQ ID NO: 3479432 - RNA, 14 nt, Pseudomonas aeruginosa PA01
ucgaggucggccug

SEQ ID NO: 3479433 - RNA, 15 nt, Pseudomonas aeruginosa PA01
ucgagguugcgcggc

SEQ ID NO: 3479434 - RNA, 18 nt, Pseudomonas aeruginosa PA01
ucgagguugcgcggcagg

SEQ ID NO: 3479435 - RNA, 18 nt, Pseudomonas aeruginosa PA01
ucgaguaagugccgacca

SEQ ID NO: 3479436 - RNA, 20 nt, Pseudomonas aeruginosa PA01
ucgaguaauuuuguggagua

SEQ ID NO: 3479437 - RNA, 19 nt, Pseudomonas aeruginosa PA01
ucgagucccguccgcugcg

SEQ ID NO: 3479438 - RNA, 13 nt, Pseudomonas aeruginosa PA01
ucgagucgccggc

SEQ ID NO: 3479439 - RNA, 16 nt, Pseudomonas aeruginosa PA01
ucgagucgccggcgaa

SEQ ID NO: 3479440 - RNA, 13 nt, Pseudomonas aeruginosa PA01
ucgagucgcgcag

SEQ ID NO: 3479441 - RNA, 14 nt, Pseudomonas aeruginosa PA01
ucgaguucgcgcgg

SEQ ID NO: 3479442 - RNA, 22 nt, Pseudomonas aeruginosa PA01
ucgauaacaccaggagcgccag

SEQ ID NO: 3479443 - RNA, 23 nt, Pseudomonas aeruginosa PA01
ucgauauagcccugggcgccgcc

SEQ ID NO: 3479444 - RNA, 21 nt, Pseudomonas aeruginosa PA01
ucgaucaauugccgguagccg

SEQ ID NO: 3479445 - RNA, 14 nt, Pseudomonas aeruginosa PA01
ucgaucaccaccac

SEQ ID NO: 3479446 - RNA, 23 nt, Pseudomonas aeruginosa PA01
ucgaucaccuuaguuaucacaac

SEQ ID NO: 3479447 - RNA, 15 nt, Pseudomonas aeruginosa PA01
ucgaucacugccugg

SEQ ID NO: 3479448 - RNA, 13 nt, Pseudomonas aeruginosa PA01
ucgaucagcagca

SEQ ID NO: 3479449 - RNA, 17 nt, Pseudomonas aeruginosa PA01
ucgaucagccguugaag

SEQ ID NO: 3479450 - RNA, 21 nt, Pseudomonas aeruginosa PA01
ucgaucagcgagcuucgccgc

SEQ ID NO: 3479451 - RNA, 23 nt, Pseudomonas aeruginosa PA01
ucgaucagcgagcuucgccgcgc

SEQ ID NO: 3479452 - RNA, 22 nt, Pseudomonas aeruginosa PA01
ucgaucagcgccgggugaccgu

SEQ ID NO: 3479453 - RNA, 16 nt, Pseudomonas aeruginosa PA01
ucgaucagcgcgcgga

SEQ ID NO: 3479454 - RNA, 22 nt, Pseudomonas aeruginosa PA01
ucgaucagcggguaacccaggg

SEQ ID NO: 3479455 - RNA, 17 nt, Pseudomonas aeruginosa PA01
ucgaucaggaacacccg

SEQ ID NO: 3479456 - RNA, 23 nt, Pseudomonas aeruginosa PA01
ucgaucaggcgcaugcccagggc

SEQ ID NO: 3479457 - RNA, 20 nt, Pseudomonas aeruginosa PA01
ucgaucaggcgggcgucguc

SEQ ID NO: 3479458 - RNA, 19 nt, Pseudomonas aeruginosa PA01
ucgaucagguaggcgccgu

SEQ ID NO: 3479459 - RNA, 18 nt, Pseudomonas aeruginosa PA01
ucgaucaucgccagcggc

SEQ ID NO: 3479460 - RNA, 14 nt, Pseudomonas aeruginosa PA01
ucgauccagccggc

SEQ ID NO: 3479461 - RNA, 23 nt, Pseudomonas aeruginosa PA01
ucgauccagccggcauccagcau

SEQ ID NO: 3479462 - RNA, 21 nt, Pseudomonas aeruginosa PA01
ucgauccccaacccggccagc

SEQ ID NO: 3479463 - RNA, 13 nt, Pseudomonas aeruginosa PA01
ucgaucccggcgc

SEQ ID NO: 3479464 - RNA, 15 nt, Pseudomonas aeruginosa PA01
ucgauccgaccuggg

SEQ ID NO: 3479465 - RNA, 16 nt, Pseudomonas aeruginosa PA01
ucgauccgcuccagca

SEQ ID NO: 3479466 - RNA, 17 nt, Pseudomonas aeruginosa PA01
ucgauccgcuccagcag

SEQ ID NO: 3479467 - RNA, 16 nt, Pseudomonas aeruginosa PA01
ucgaucgagucgccga

SEQ ID NO: 3479468 - RNA, 14 nt, Pseudomonas aeruginosa PA01
ucgaucggcagggc

SEQ ID NO: 3479469 - RNA, 18 nt, Pseudomonas aeruginosa PA01
ucgaucuccuccucggcg

SEQ ID NO: 3479470 - RNA, 14 nt, Pseudomonas aeruginosa PA01
ucgaucuccucgcg

SEQ ID NO: 3479471 - RNA, 16 nt, Pseudomonas aeruginosa PA01
ucgaucuccucgcgca

SEQ ID NO: 3479472 - RNA, 15 nt, Pseudomonas aeruginosa PA01
ucgaucucgagcaug

SEQ ID NO: 3479473 - RNA, 18 nt, Pseudomonas aeruginosa PA01
ucgaucucguccucggcg

SEQ ID NO: 3479474 - RNA, 15 nt, Pseudomonas aeruginosa PA01
ucgaucucgucggcg

SEQ ID NO: 3479475 - RNA, 14 nt, Pseudomonas aeruginosa PA01
ucgaucugcucguc

SEQ ID NO: 3479476 - RNA, 18 nt, Pseudomonas aeruginosa PA01
ucgaucuggcugcccagg

SEQ ID NO: 3479477 - RNA, 22 nt, Pseudomonas aeruginosa PA01
ucgaucuggcugcccaggcuga

SEQ ID NO: 3479478 - RNA, 22 nt, Pseudomonas aeruginosa PA01
ucgaucuucgaguagguccagg

SEQ ID NO: 3479479 - RNA, 17 nt, Pseudomonas aeruginosa PA01
ucgaucuugcccaugug

SEQ ID NO: 3479480 - RNA, 17 nt, Pseudomonas aeruginosa PA01
ucgaugaaacgcagggc

SEQ ID NO: 3479481 - RNA, 18 nt, Pseudomonas aeruginosa PA01
ucgaugaaacgcagggcc

SEQ ID NO: 3479482 - RNA, 13 nt, Pseudomonas aeruginosa PA01
ucgaugaacgccc

SEQ ID NO: 3479483 - RNA, 14 nt, Pseudomonas aeruginosa PA01
ucgaugaacgcccu

SEQ ID NO: 3479484 - RNA, 15 nt, Pseudomonas aeruginosa PA01
ucgaugaacgcccug

SEQ ID NO: 3479485 - RNA, 22 nt, Pseudomonas aeruginosa PA01
ucgaugaacgcccugacccgca

SEQ ID NO: 3479486 - RNA, 16 nt, Pseudomonas aeruginosa PA01
ucgaugaacgcgcgga

SEQ ID NO: 3479487 - RNA, 22 nt, Pseudomonas aeruginosa PA01
ucgaugacgccauccuucggcg

SEQ ID NO: 3479488 - RNA, 18 nt, Pseudomonas aeruginosa PA01
ucgaugacguugcugccc

SEQ ID NO: 3479489 - RNA, 21 nt, Pseudomonas aeruginosa PA01
ucgaugacguugcugcccugg

SEQ ID NO: 3479490 - RNA, 18 nt, Pseudomonas aeruginosa PA01
ucgaugagcaugccgcag

SEQ ID NO: 3479491 - RNA, 18 nt, Pseudomonas aeruginosa PA01
ucgaugagccagccugca

SEQ ID NO: 3479492 - RNA, 16 nt, Pseudomonas aeruginosa PA01
ucgaugagcuucgccg

SEQ ID NO: 3479493 - RNA, 17 nt, Pseudomonas aeruginosa PA01
ucgaugaguugcagggc

SEQ ID NO: 3479494 - RNA, 18 nt, Pseudomonas aeruginosa PA01
ucgaugaguugcagggcu

SEQ ID NO: 3479495 - RNA, 20 nt, Pseudomonas aeruginosa PA01
ucgaugauccacuugccgcc

SEQ ID NO: 3479496 - RNA, 20 nt, Pseudomonas aeruginosa PA01
ucgaugauccgcucgauccc

SEQ ID NO: 3479497 - RNA, 14 nt, Pseudomonas aeruginosa PA01
ucgaugaucgacug

SEQ ID NO: 3479498 - RNA, 15 nt, Pseudomonas aeruginosa PA01
ucgaugaugaucgcc

SEQ ID NO: 3479499 - RNA, 23 nt, Pseudomonas aeruginosa PA01
ucgaugcccagccagggccgcga

SEQ ID NO: 3479500 - RNA, 16 nt, Pseudomonas aeruginosa PA01
ucgaugcccgccagca

SEQ ID NO: 3479501 - RNA, 18 nt, Pseudomonas aeruginosa PA01
ucgaugcccgccagcagg

SEQ ID NO: 3479502 - RNA, 17 nt, Pseudomonas aeruginosa PA01
ucgaugcccucgcggcg

SEQ ID NO: 3479503 - RNA, 18 nt, Pseudomonas aeruginosa PA01
ucgaugcccucgcggcgg

SEQ ID NO: 3479504 - RNA, 19 nt, Pseudomonas aeruginosa PA01
ucgaugcccucgcggcggc

SEQ ID NO: 3479505 - RNA, 14 nt, Pseudomonas aeruginosa PA01
ucgaugccgcgcgc

SEQ ID NO: 3479506 - RNA, 15 nt, Pseudomonas aeruginosa PA01
ucgaugccgcgcgcc

SEQ ID NO: 3479507 - RNA, 17 nt, Pseudomonas aeruginosa PA01
ucgaugccuucggcggc

SEQ ID NO: 3479508 - RNA, 13 nt, Pseudomonas aeruginosa PA01
ucgaugcgccuca

SEQ ID NO: 3479509 - RNA, 14 nt, Pseudomonas aeruginosa PA01
ucgaugcgcgcggc

SEQ ID NO: 3479510 - RNA, 15 nt, Pseudomonas aeruginosa PA01
ucgaugcgcgcggcg

SEQ ID NO: 3479511 - RNA, 15 nt, Pseudomonas aeruginosa PA01
ucgaugcugccguag

SEQ ID NO: 3479512 - RNA, 19 nt, Pseudomonas aeruginosa PA01
ucgauggcagccuuggcca

SEQ ID NO: 3479513 - RNA, 20 nt, Pseudomonas aeruginosa PA01
ucgauggcgaagcgcuugcc

SEQ ID NO: 3479514 - RNA, 18 nt, Pseudomonas aeruginosa PA01
ucgauggcggccgccauu

SEQ ID NO: 3479515 - RNA, 14 nt, Pseudomonas aeruginosa PA01
ucgauggcggccug

SEQ ID NO: 3479516 - RNA, 13 nt, Pseudomonas aeruginosa PA01
ucgauggcguggg

SEQ ID NO: 3479517 - RNA, 12 nt, Pseudomonas aeruginosa PA01
ucgauggcugga

SEQ ID NO: 3479518 - RNA, 22 nt, Pseudomonas aeruginosa PA01
ucgaugggcaggauaucgccca

SEQ ID NO: 3479519 - RNA, 23 nt, Pseudomonas aeruginosa PA01
ucgaugggccguaggugaccgcc

SEQ ID NO: 3479520 - RNA, 19 nt, Pseudomonas aeruginosa PA01
ucgauggucuugaucccag

SEQ ID NO: 3479521 - RNA, 18 nt, Pseudomonas aeruginosa PA01
ucgauggugaacgccagg

SEQ ID NO: 3479522 - RNA, 22 nt, Pseudomonas aeruginosa PA01
ucgauggugacguugcgccgca

SEQ ID NO: 3479523 - RNA, 21 nt, Pseudomonas aeruginosa PA01
ucgauggugaucacgucggcg

SEQ ID NO: 3479524 - RNA, 18 nt, Pseudomonas aeruginosa PA01
ucgauguaggccucggcc

SEQ ID NO: 3479525 - RNA, 19 nt, Pseudomonas aeruginosa PA01
ucgauguccugggccaccu

SEQ ID NO: 3479526 - RNA, 24 nt, Pseudomonas aeruginosa PA01
ucgaugucgaacaacccgccagca

SEQ ID NO: 3479527 - RNA, 23 nt, Pseudomonas aeruginosa PA01
ucgaugucgcggcugaaggccga

SEQ ID NO: 3479528 - RNA, 12 nt, Pseudomonas aeruginosa PA01
ucgauuccuguc

SEQ ID NO: 3479529 - RNA, 15 nt, Pseudomonas aeruginosa PA01
ucgauugcugggugc

SEQ ID NO: 3479530 - RNA, 16 nt, Pseudomonas aeruginosa PA01
ucgcaaagcgagcgcc

SEQ ID NO: 3479531 - RNA, 18 nt, Pseudomonas aeruginosa PA01
ucgcaaagcucgcgcaag

SEQ ID NO: 3479532 - RNA, 13 nt, Pseudomonas aeruginosa PA01
ucgcaaccggccu

SEQ ID NO: 3479533 - RNA, 18 nt, Pseudomonas aeruginosa PA01
ucgcaagauuaucagcaa

SEQ ID NO: 3479534 - RNA, 21 nt, Pseudomonas aeruginosa PA01
ucgcaaguuacgcgcagcggu

SEQ ID NO: 3479535 - RNA, 16 nt, Pseudomonas aeruginosa PA01
ucgcacagccaggggc

SEQ ID NO: 3479536 - RNA, 17 nt, Pseudomonas aeruginosa PA01
ucgcaccagccggccgc

SEQ ID NO: 3479537 - RNA, 14 nt, Pseudomonas aeruginosa PA01
ucgcaccaggccag

SEQ ID NO: 3479538 - RNA, 16 nt, Pseudomonas aeruginosa PA01
ucgcaccaggccaggu

SEQ ID NO: 3479539 - RNA, 18 nt, Pseudomonas aeruginosa PA01
ucgcaccaggccaggugg

SEQ ID NO: 3479540 - RNA, 21 nt, Pseudomonas aeruginosa PA01
ucgcacccggcccauggcgac

SEQ ID NO: 3479541 - RNA, 23 nt, Pseudomonas aeruginosa PA01
ucgcacccggcccauggcgacgc

SEQ ID NO: 3479542 - RNA, 13 nt, Pseudomonas aeruginosa PA01
ucgcaccgccagc

SEQ ID NO: 3479543 - RNA, 14 nt, Pseudomonas aeruginosa PA01
ucgcaccgccagca

SEQ ID NO: 3479544 - RNA, 15 nt, Pseudomonas aeruginosa PA01
ucgcaccgccagcag

SEQ ID NO: 3479545 - RNA, 20 nt, Pseudomonas aeruginosa PA01
ucgcaccgggaggcgccgcg

SEQ ID NO: 3479546 - RNA, 23 nt, Pseudomonas aeruginosa PA01
ucgcaccgggaggcgccgcgcca

SEQ ID NO: 3479547 - RNA, 19 nt, Pseudomonas aeruginosa PA01
ucgcaccuguuccagcaac

SEQ ID NO: 3479548 - RNA, 14 nt, Pseudomonas aeruginosa PA01
ucgcacgcagcgcc

SEQ ID NO: 3479549 - RNA, 14 nt, Pseudomonas aeruginosa PA01
ucgcacggcgggac

SEQ ID NO: 3479550 - RNA, 20 nt, Pseudomonas aeruginosa PA01
ucgcacggucguccugcgga

SEQ ID NO: 3479551 - RNA, 23 nt, Pseudomonas aeruginosa PA01
ucgcacggucguccugcggauuc

SEQ ID NO: 3479552 - RNA, 14 nt, Pseudomonas aeruginosa PA01
ucgcacucuuccug

SEQ ID NO: 3479553 - RNA, 21 nt, Pseudomonas aeruginosa PA01
ucgcacuggucggccaguucc

SEQ ID NO: 3479554 - RNA, 22 nt, Pseudomonas aeruginosa PA01
ucgcacuggucggccaguuccu

SEQ ID NO: 3479555 - RNA, 16 nt, Pseudomonas aeruginosa PA01
ucgcagaacgcggaaa

SEQ ID NO: 3479556 - RNA, 19 nt, Pseudomonas aeruginosa PA01
ucgcagaacgcggaaaccu

SEQ ID NO: 3479557 - RNA, 18 nt, Pseudomonas aeruginosa PA01
ucgcagagacgcagcgcu

SEQ ID NO: 3479558 - RNA, 14 nt, Pseudomonas aeruginosa PA01
ucgcagagaucggc

SEQ ID NO: 3479559 - RNA, 20 nt, Pseudomonas aeruginosa PA01
ucgcagagaucggcggcgcg

SEQ ID NO: 3479560 - RNA, 15 nt, Pseudomonas aeruginosa PA01
ucgcagagcgccagc

SEQ ID NO: 3479561 - RNA, 16 nt, Pseudomonas aeruginosa PA01
ucgcagagcgccagcc

SEQ ID NO: 3479562 - RNA, 16 nt, Pseudomonas aeruginosa PA01
ucgcagagggcgaugc

SEQ ID NO: 3479563 - RNA, 21 nt, Pseudomonas aeruginosa PA01
ucgcagcaggccgcuggcgac

SEQ ID NO: 3479564 - RNA, 21 nt, Pseudomonas aeruginosa PA01
ucgcagcaggcguucggcgau

SEQ ID NO: 3479565 - RNA, 23 nt, Pseudomonas aeruginosa PA01
ucgcagccgguggucuucagcac

SEQ ID NO: 3479566 - RNA, 22 nt, Pseudomonas aeruginosa PA01
ucgcagcgcuccuuucccagcg

SEQ ID NO: 3479567 - RNA, 22 nt, Pseudomonas aeruginosa PA01
ucgcagcgggcauauggaucgg

SEQ ID NO: 3479568 - RNA, 16 nt, Pseudomonas aeruginosa PA01
ucgcagcguuccagcg

SEQ ID NO: 3479569 - RNA, 21 nt, Pseudomonas aeruginosa PA01
ucgcagcguuccagcgcuggc

SEQ ID NO: 3479570 - RNA, 24 nt, Pseudomonas aeruginosa PA01
ucgcagcguuccagcgcuggcagg

SEQ ID NO: 3479571 - RNA, 15 nt, Pseudomonas aeruginosa PA01
ucgcaggcagcgcgc

SEQ ID NO: 3479572 - RNA, 12 nt, Pseudomonas aeruginosa PA01
ucgcaggccagg

SEQ ID NO: 3479573 - RNA, 16 nt, Pseudomonas aeruginosa PA01
ucgcaggccaggcccc

SEQ ID NO: 3479574 - RNA, 22 nt, Pseudomonas aeruginosa PA01
ucgcaggccaggccccagggcc

SEQ ID NO: 3479575 - RNA, 14 nt, Pseudomonas aeruginosa PA01
ucgcaggccaggcg

SEQ ID NO: 3479576 - RNA, 18 nt, Pseudomonas aeruginosa PA01
ucgcaggccaggcgcagu

SEQ ID NO: 3479577 - RNA, 21 nt, Pseudomonas aeruginosa PA01
ucgcaggccaggcgcagugcc

SEQ ID NO: 3479578 - RNA, 13 nt, Pseudomonas aeruginosa PA01
ucgcaggcgaugc

SEQ ID NO: 3479579 - RNA, 14 nt, Pseudomonas aeruginosa PA01
ucgcaggcgaugcc

SEQ ID NO: 3479580 - RNA, 18 nt, Pseudomonas aeruginosa PA01
ucgcaggcucaguucggc

SEQ ID NO: 3479581 - RNA, 21 nt, Pseudomonas aeruginosa PA01
ucgcaggcucaguucggccag

SEQ ID NO: 3479582 - RNA, 18 nt, Pseudomonas aeruginosa PA01
ucgcagguaacccgcggc

SEQ ID NO: 3479583 - RNA, 19 nt, Pseudomonas aeruginosa PA01
ucgcagguaacccgcggcg

SEQ ID NO: 3479584 - RNA, 20 nt, Pseudomonas aeruginosa PA01
ucgcagguaacccgcggcga

SEQ ID NO: 3479585 - RNA, 18 nt, Pseudomonas aeruginosa PA01
ucgcaguacagcucggcg

SEQ ID NO: 3479586 - RNA, 21 nt, Pseudomonas aeruginosa PA01
ucgcaguacagcucggcgccc

SEQ ID NO: 3479587 - RNA, 22 nt, Pseudomonas aeruginosa PA01
ucgcaguacagcucggcgcccu

SEQ ID NO: 3479588 - RNA, 15 nt, Pseudomonas aeruginosa PA01
ucgcagucguagcgc

SEQ ID NO: 3479589 - RNA, 15 nt, Pseudomonas aeruginosa PA01
ucgcauagccggcgc

SEQ ID NO: 3479590 - RNA, 14 nt, Pseudomonas aeruginosa PA01
ucgcauccaccagc

SEQ ID NO: 3479591 - RNA, 15 nt, Pseudomonas aeruginosa PA01
ucgcauccaccagcg

SEQ ID NO: 3479592 - RNA, 15 nt, Pseudomonas aeruginosa PA01
ucgcaucggcgaccu

SEQ ID NO: 3479593 - RNA, 17 nt, Pseudomonas aeruginosa PA01
ucgccaaaaaaagcccc

SEQ ID NO: 3479594 - RNA, 20 nt, Pseudomonas aeruginosa PA01
ucgccaacgccaccgcgcgc

SEQ ID NO: 3479595 - RNA, 19 nt, Pseudomonas aeruginosa PA01
ucgccaacgcgccgucgcg

SEQ ID NO: 3479596 - RNA, 14 nt, Pseudomonas aeruginosa PA01
ucgccaagcccggc

SEQ ID NO: 3479597 - RNA, 15 nt, Pseudomonas aeruginosa PA01
ucgccaagcccggcg

SEQ ID NO: 3479598 - RNA, 18 nt, Pseudomonas aeruginosa PA01
ucgccaagcccggcgaga

SEQ ID NO: 3479599 - RNA, 20 nt, Pseudomonas aeruginosa PA01
ucgccaagguacggggcugc

SEQ ID NO: 3479600 - RNA, 14 nt, Pseudomonas aeruginosa PA01
ucgccaccagcagg

SEQ ID NO: 3479601 - RNA, 15 nt, Pseudomonas aeruginosa PA01
ucgccaccccgccgc

SEQ ID NO: 3479602 - RNA, 21 nt, Pseudomonas aeruginosa PA01
ucgccaccccgcuccgcucag

SEQ ID NO: 3479603 - RNA, 13 nt, Pseudomonas aeruginosa PA01
ucgccaccgcgga

SEQ ID NO: 3479604 - RNA, 14 nt, Pseudomonas aeruginosa PA01
ucgccaccgcggau

SEQ ID NO: 3479605 - RNA, 20 nt, Pseudomonas aeruginosa PA01
ucgccaccuguagcagggug

SEQ ID NO: 3479606 - RNA, 19 nt, Pseudomonas aeruginosa PA01
ucgccaccuguuccacgag

SEQ ID NO: 3479607 - RNA, 18 nt, Pseudomonas aeruginosa PA01
ucgccacgaucaugguga

SEQ ID NO: 3479608 - RNA, 20 nt, Pseudomonas aeruginosa PA01
ucgccacgcaguucgcgggc

SEQ ID NO: 3479609 - RNA, 13 nt, Pseudomonas aeruginosa PA01
ucgccacgcccgc

SEQ ID NO: 3479610 - RNA, 12 nt, Pseudomonas aeruginosa PA01
ucgccacgccgg

SEQ ID NO: 3479611 - RNA, 16 nt, Pseudomonas aeruginosa PA01
ucgccacgccggcgcu

SEQ ID NO: 3479612 - RNA, 18 nt, Pseudomonas aeruginosa PA01
ucgccacgccggcgcucc

SEQ ID NO: 3479613 - RNA, 14 nt, Pseudomonas aeruginosa PA01
ucgccacgcucucc

SEQ ID NO: 3479614 - RNA, 17 nt, Pseudomonas aeruginosa PA01
ucgccacgcugcugccg

SEQ ID NO: 3479615 - RNA, 18 nt, Pseudomonas aeruginosa PA01
ucgccacgcugcugccgg

SEQ ID NO: 3479616 - RNA, 22 nt, Pseudomonas aeruginosa PA01
ucgccacgcuucugcgccuccu

SEQ ID NO: 3479617 - RNA, 21 nt, Pseudomonas aeruginosa PA01
ucgccacugauaccgcuggcc

SEQ ID NO: 3479618 - RNA, 22 nt, Pseudomonas aeruginosa PA01
ucgccacugauaccgcuggcca

SEQ ID NO: 3479619 - RNA, 11 nt, Pseudomonas aeruginosa PA01
ucgccagcaau

SEQ ID NO: 3479620 - RNA, 22 nt, Pseudomonas aeruginosa PA01
ucgccagcaggcucaugcccag

SEQ ID NO: 3479621 - RNA, 13 nt, Pseudomonas aeruginosa PA01
ucgccagcccggc

SEQ ID NO: 3479622 - RNA, 13 nt, Pseudomonas aeruginosa PA01
ucgccagcccggu

SEQ ID NO: 3479623 - RNA, 18 nt, Pseudomonas aeruginosa PA01
ucgccagcccgguucagc

SEQ ID NO: 3479624 - RNA, 17 nt, Pseudomonas aeruginosa PA01
ucgccagcccguagucg

SEQ ID NO: 3479625 - RNA, 13 nt, Pseudomonas aeruginosa PA01
ucgccagcgccag

SEQ ID NO: 3479626 - RNA, 14 nt, Pseudomonas aeruginosa PA01
ucgccagcgccagc

SEQ ID NO: 3479627 - RNA, 20 nt, Pseudomonas aeruginosa PA01
ucgccagcgccagcagguac

SEQ ID NO: 3479628 - RNA, 23 nt, Pseudomonas aeruginosa PA01
ucgccagcgccagcagguacagc

SEQ ID NO: 3479629 - RNA, 12 nt, Pseudomonas aeruginosa PA01
ucgccagcgccu

SEQ ID NO: 3479630 - RNA, 19 nt, Pseudomonas aeruginosa PA01
ucgccagcgccuucgugac

SEQ ID NO: 3479631 - RNA, 21 nt, Pseudomonas aeruginosa PA01
ucgccagcgccuucgugacca

SEQ ID NO: 3479632 - RNA, 11 nt, Pseudomonas aeruginosa PA01
ucgccagcgcg

SEQ ID NO: 3479633 - RNA, 14 nt, Pseudomonas aeruginosa PA01
ucgccagcgcgcgc

SEQ ID NO: 3479634 - RNA, 15 nt, Pseudomonas aeruginosa PA01
ucgccagcgcgcgcc

SEQ ID NO: 3479635 - RNA, 18 nt, Pseudomonas aeruginosa PA01
ucgccagcgcgcgccgac

SEQ ID NO: 3479636 - RNA, 15 nt, Pseudomonas aeruginosa PA01
ucgccagcggccagg

SEQ ID NO: 3479637 - RNA, 16 nt, Pseudomonas aeruginosa PA01
ucgccagcggccaggg

SEQ ID NO: 3479638 - RNA, 12 nt, Pseudomonas aeruginosa PA01
ucgccagcggcg

SEQ ID NO: 3479639 - RNA, 13 nt, Pseudomonas aeruginosa PA01
ucgccagcggcgu

SEQ ID NO: 3479640 - RNA, 23 nt, Pseudomonas aeruginosa PA01
ucgccagcgguacccgccggcca

SEQ ID NO: 3479641 - RNA, 14 nt, Pseudomonas aeruginosa PA01
ucgccaggacgcuc

SEQ ID NO: 3479642 - RNA, 12 nt, Pseudomonas aeruginosa PA01
ucgccaggccgu

SEQ ID NO: 3479643 - RNA, 23 nt, Pseudomonas aeruginosa PA01
ucgccaggccguagaccaccagc

SEQ ID NO: 3479644 - RNA, 15 nt, Pseudomonas aeruginosa PA01
ucgccaggcugaucc

SEQ ID NO: 3479645 - RNA, 22 nt, Pseudomonas aeruginosa PA01
ucgccaggcugauccgcgacag

SEQ ID NO: 3479646 - RNA, 14 nt, Pseudomonas aeruginosa PA01
ucgccagggaggcg

SEQ ID NO: 3479647 - RNA, 18 nt, Pseudomonas aeruginosa PA01
ucgccagggaggcgauuc

SEQ ID NO: 3479648 - RNA, 20 nt, Pseudomonas aeruginosa PA01
ucgccagggggaucgcgaag

SEQ ID NO: 3479649 - RNA, 19 nt, Pseudomonas aeruginosa PA01
ucgccagggucuugccgac

SEQ ID NO: 3479650 - RNA, 18 nt, Pseudomonas aeruginosa PA01
ucgccagguggaagcgcg

SEQ ID NO: 3479651 - RNA, 21 nt, Pseudomonas aeruginosa PA01
ucgccagguggaagcgcgcgu

SEQ ID NO: 3479652 - RNA, 17 nt, Pseudomonas aeruginosa PA01
ucgccaguuccgugucg

SEQ ID NO: 3479653 - RNA, 23 nt, Pseudomonas aeruginosa PA01
ucgccaguuccgugucgagggcg

SEQ ID NO: 3479654 - RNA, 20 nt, Pseudomonas aeruginosa PA01
ucgccaguucucgcagcagg

SEQ ID NO: 3479655 - RNA, 21 nt, Pseudomonas aeruginosa PA01
ucgccaguucucgcagcaggc

SEQ ID NO: 3479656 - RNA, 22 nt, Pseudomonas aeruginosa PA01
ucgccaguucucgcagcaggcg

SEQ ID NO: 3479657 - RNA, 19 nt, Pseudomonas aeruginosa PA01
ucgccaguugcagggauuc

SEQ ID NO: 3479658 - RNA, 22 nt, Pseudomonas aeruginosa PA01
ucgccaguugcagggauuccgg

SEQ ID NO: 3479659 - RNA, 18 nt, Pseudomonas aeruginosa PA01
ucgccauaggaugccgag

SEQ ID NO: 3479660 - RNA, 14 nt, Pseudomonas aeruginosa PA01
ucgccaugcggcag

SEQ ID NO: 3479661 - RNA, 16 nt, Pseudomonas aeruginosa PA01
ucgccaugcggcaggc

SEQ ID NO: 3479662 - RNA, 20 nt, Pseudomonas aeruginosa PA01
ucgccaugcggcaggccuuc

SEQ ID NO: 3479663 - RNA, 12 nt, Pseudomonas aeruginosa PA01
ucgccauggcgc

SEQ ID NO: 3479664 - RNA, 14 nt, Pseudomonas aeruginosa PA01
ucgccauggcgcug

SEQ ID NO: 3479665 - RNA, 13 nt, Pseudomonas aeruginosa PA01
ucgccauggcgga

SEQ ID NO: 3479666 - RNA, 14 nt, Pseudomonas aeruginosa PA01
ucgccauggcggac

SEQ ID NO: 3479667 - RNA, 15 nt, Pseudomonas aeruginosa PA01
ucgccauucggcgac

SEQ ID NO: 3479668 - RNA, 13 nt, Pseudomonas aeruginosa PA01
ucgccauuggcca

SEQ ID NO: 3479669 - RNA, 15 nt, Pseudomonas aeruginosa PA01
ucgccauuggccagg

SEQ ID NO: 3479670 - RNA, 16 nt, Pseudomonas aeruginosa PA01
ucgccauuggccaggg

SEQ ID NO: 3479671 - RNA, 18 nt, Pseudomonas aeruginosa PA01
ucgccauuggccaggguc

SEQ ID NO: 3479672 - RNA, 12 nt, Pseudomonas aeruginosa PA01
ucgcccaccagg

SEQ ID NO: 3479673 - RNA, 13 nt, Pseudomonas aeruginosa PA01
ucgcccaccaggu

SEQ ID NO: 3479674 - RNA, 14 nt, Pseudomonas aeruginosa PA01
ucgcccaccagguc

SEQ ID NO: 3479675 - RNA, 15 nt, Pseudomonas aeruginosa PA01
ucgcccaccaggucg

SEQ ID NO: 3479676 - RNA, 18 nt, Pseudomonas aeruginosa PA01
ucgcccaccuugcgggug

SEQ ID NO: 3479677 - RNA, 14 nt, Pseudomonas aeruginosa PA01
ucgcccagcaggcg

SEQ ID NO: 3479678 - RNA, 16 nt, Pseudomonas aeruginosa PA01
ucgcccagcaggcgcg

SEQ ID NO: 3479679 - RNA, 19 nt, Pseudomonas aeruginosa PA01
ucgcccagcaggcgcgccc

SEQ ID NO: 3479680 - RNA, 13 nt, Pseudomonas aeruginosa PA01
ucgcccagcggcu

SEQ ID NO: 3479681 - RNA, 17 nt, Pseudomonas aeruginosa PA01
ucgcccagcucgccgcu

SEQ ID NO: 3479682 - RNA, 20 nt, Pseudomonas aeruginosa PA01
ucgcccagcucgccgcucca

SEQ ID NO: 3479683 - RNA, 23 nt, Pseudomonas aeruginosa PA01
ucgcccagcucuucacauggugg

SEQ ID NO: 3479684 - RNA, 12 nt, Pseudomonas aeruginosa PA01
ucgcccaggccg

SEQ ID NO: 3479685 - RNA, 15 nt, Pseudomonas aeruginosa PA01
ucgcccaggccgcug

SEQ ID NO: 3479686 - RNA, 17 nt, Pseudomonas aeruginosa PA01
ucgcccaggccgcuggc

SEQ ID NO: 3479687 - RNA, 19 nt, Pseudomonas aeruginosa PA01
ucgcccaggccgcuggcgg

SEQ ID NO: 3479688 - RNA, 12 nt, Pseudomonas aeruginosa PA01
ucgcccagggcc

SEQ ID NO: 3479689 - RNA, 17 nt, Pseudomonas aeruginosa PA01
ucgcccagggccagcgg

SEQ ID NO: 3479690 - RNA, 18 nt, Pseudomonas aeruginosa PA01
ucgcccagggccagcggg

SEQ ID NO: 3479691 - RNA, 20 nt, Pseudomonas aeruginosa PA01
ucgcccagggcguggucggc

SEQ ID NO: 3479692 - RNA, 19 nt, Pseudomonas aeruginosa PA01
ucgcccagguaggcgaugc

SEQ ID NO: 3479693 - RNA, 20 nt, Pseudomonas aeruginosa PA01
ucgcccaggugcgccgagcg

SEQ ID NO: 3479694 - RNA, 18 nt, Pseudomonas aeruginosa PA01
ucgcccaguaccacgcag

SEQ ID NO: 3479695 - RNA, 15 nt, Pseudomonas aeruginosa PA01
ucgcccaucgccagg

SEQ ID NO: 3479696 - RNA, 16 nt, Pseudomonas aeruginosa PA01
ucgcccaucgccaggg

SEQ ID NO: 3479697 - RNA, 21 nt, Pseudomonas aeruginosa PA01
ucgcccaugaaaaagccccgc

SEQ ID NO: 3479698 - RNA, 15 nt, Pseudomonas aeruginosa PA01
ucgcccaugcgcggc

SEQ ID NO: 3479699 - RNA, 16 nt, Pseudomonas aeruginosa PA01
ucgcccaugcgcggcg

SEQ ID NO: 3479700 - RNA, 19 nt, Pseudomonas aeruginosa PA01
ucgcccaugcgcggcgaga

SEQ ID NO: 3479701 - RNA, 15 nt, Pseudomonas aeruginosa PA01
ucgccccacagcggu

SEQ ID NO: 3479702 - RNA, 16 nt, Pseudomonas aeruginosa PA01
ucgccccacagcggug

SEQ ID NO: 3479703 - RNA, 12 nt, Pseudomonas aeruginosa PA01
ucgcccccuuca

SEQ ID NO: 3479704 - RNA, 13 nt, Pseudomonas aeruginosa PA01
ucgccccgccgcc

SEQ ID NO: 3479705 - RNA, 18 nt, Pseudomonas aeruginosa PA01
ucgccccgccgccaggcg

SEQ ID NO: 3479706 - RNA, 13 nt, Pseudomonas aeruginosa PA01
ucgccccgccggg

SEQ ID NO: 3479707 - RNA, 19 nt, Pseudomonas aeruginosa PA01
ucgccccgccgggagcggc

SEQ ID NO: 3479708 - RNA, 14 nt, Pseudomonas aeruginosa PA01
ucgccccggcggcg

SEQ ID NO: 3479709 - RNA, 16 nt, Pseudomonas aeruginosa PA01
ucgccccggcggcgau

SEQ ID NO: 3479710 - RNA, 17 nt, Pseudomonas aeruginosa PA01
ucgccccggcggcgauc

SEQ ID NO: 3479711 - RNA, 20 nt, Pseudomonas aeruginosa PA01
ucgccccgguuggcgcccca

SEQ ID NO: 3479712 - RNA, 19 nt, Pseudomonas aeruginosa PA01
ucgcccgaccccacgccgg

SEQ ID NO: 3479713 - RNA, 21 nt, Pseudomonas aeruginosa PA01
ucgcccgaccccacgccggcc

SEQ ID NO: 3479714 - RNA, 12 nt, Pseudomonas aeruginosa PA01
ucgcccgcagcc

SEQ ID NO: 3479715 - RNA, 21 nt, Pseudomonas aeruginosa PA01
ucgcccgcaguuccucgccgc

SEQ ID NO: 3479716 - RNA, 22 nt, Pseudomonas aeruginosa PA01
ucgcccgcaguuccucgccgcu

SEQ ID NO: 3479717 - RNA, 24 nt, Pseudomonas aeruginosa PA01
ucgcccgcaguuccucgccgcugc

SEQ ID NO: 3479718 - RNA, 14 nt, Pseudomonas aeruginosa PA01
ucgcccgccgccug

SEQ ID NO: 3479719 - RNA, 12 nt, Pseudomonas aeruginosa PA01
ucgcccgccggc

SEQ ID NO: 3479720 - RNA, 13 nt, Pseudomonas aeruginosa PA01
ucgcccgccggcg

SEQ ID NO: 3479721 - RNA, 17 nt, Pseudomonas aeruginosa PA01
ucgcccgccggcgugcc

SEQ ID NO: 3479722 - RNA, 13 nt, Pseudomonas aeruginosa PA01
ucgcccgcgccuc

SEQ ID NO: 3479723 - RNA, 13 nt, Pseudomonas aeruginosa PA01
ucgcccggcagca

SEQ ID NO: 3479724 - RNA, 13 nt, Pseudomonas aeruginosa PA01
ucgcccggcgcuc

SEQ ID NO: 3479725 - RNA, 13 nt, Pseudomonas aeruginosa PA01
ucgcccggcugca

SEQ ID NO: 3479726 - RNA, 19 nt, Pseudomonas aeruginosa PA01
ucgcccggcugcacagguu

SEQ ID NO: 3479727 - RNA, 21 nt, Pseudomonas aeruginosa PA01
ucgcccgucacuucacgacag

SEQ ID NO: 3479728 - RNA, 19 nt, Pseudomonas aeruginosa PA01
ucgcccgugccucggcgga

SEQ ID NO: 3479729 - RNA, 14 nt, Pseudomonas aeruginosa PA01
ucgcccuacccccc

SEQ ID NO: 3479730 - RNA, 16 nt, Pseudomonas aeruginosa PA01
ucgcccuacccgacag

SEQ ID NO: 3479731 - RNA, 17 nt, Pseudomonas aeruginosa PA01
ucgcccuacccgacagg

SEQ ID NO: 3479732 - RNA, 20 nt, Pseudomonas aeruginosa PA01
ucgcccuacccgacaggcag

SEQ ID NO: 3479733 - RNA, 18 nt, Pseudomonas aeruginosa PA01
ucgcccuaccgcccaccc

SEQ ID NO: 3479734 - RNA, 21 nt, Pseudomonas aeruginosa PA01
ucgcccuaccgcccacccugc

SEQ ID NO: 3479735 - RNA, 14 nt, Pseudomonas aeruginosa PA01
ucgcccuacggggc

SEQ ID NO: 3479736 - RNA, 18 nt, Pseudomonas aeruginosa PA01
ucgcccucgaagcccugc

SEQ ID NO: 3479737 - RNA, 14 nt, Pseudomonas aeruginosa PA01
ucgcccucgaucuu

SEQ ID NO: 3479738 - RNA, 14 nt, Pseudomonas aeruginosa PA01
ucgcccucgcggag

SEQ ID NO: 3479739 - RNA, 22 nt, Pseudomonas aeruginosa PA01
ucgcccucgcuccaacgcaggc

SEQ ID NO: 3479740 - RNA, 23 nt, Pseudomonas aeruginosa PA01
ucgcccucgcuccaacgcaggcg

SEQ ID NO: 3479741 - RNA, 13 nt, Pseudomonas aeruginosa PA01
ucgcccucggcca

SEQ ID NO: 3479742 - RNA, 16 nt, Pseudomonas aeruginosa PA01
ucgcccucggcgcugg

SEQ ID NO: 3479743 - RNA, 17 nt, Pseudomonas aeruginosa PA01
ucgcccucggcgcuggc

SEQ ID NO: 3479744 - RNA, 14 nt, Pseudomonas aeruginosa PA01
ucgcccugcagcgc

SEQ ID NO: 3479745 - RNA, 15 nt, Pseudomonas aeruginosa PA01
ucgcccugcagcgcg

SEQ ID NO: 3479746 - RNA, 19 nt, Pseudomonas aeruginosa PA01
ucgcccugcagcgcgcgcu

SEQ ID NO: 3479747 - RNA, 20 nt, Pseudomonas aeruginosa PA01
ucgcccugcagcgcgcgcug

SEQ ID NO: 3479748 - RNA, 23 nt, Pseudomonas aeruginosa PA01
ucgcccugcggauggcgcggggc

SEQ ID NO: 3479749 - RNA, 22 nt, Pseudomonas aeruginosa PA01
ucgcccugcguggaaccgcggc

SEQ ID NO: 3479750 - RNA, 21 nt, Pseudomonas aeruginosa PA01
ucgcccugcuuggccagcgcg

SEQ ID NO: 3479751 - RNA, 22 nt, Pseudomonas aeruginosa PA01
ucgcccuggccgaucagcuugg

SEQ ID NO: 3479752 - RNA, 12 nt, Pseudomonas aeruginosa PA01
ucgcccuggccu

SEQ ID NO: 3479753 - RNA, 17 nt, Pseudomonas aeruginosa PA01
ucgcccuggcgccagcg

SEQ ID NO: 3479754 - RNA, 12 nt, Pseudomonas aeruginosa PA01
ucgcccuggugc

SEQ ID NO: 3479755 - RNA, 17 nt, Pseudomonas aeruginosa PA01
ucgcccuggugcacggc

SEQ ID NO: 3479756 - RNA, 20 nt, Pseudomonas aeruginosa PA01
ucgcccuggugcacggcgac

SEQ ID NO: 3479757 - RNA, 15 nt, Pseudomonas aeruginosa PA01
ucgcccuugaccagu

SEQ ID NO: 3479758 - RNA, 18 nt, Pseudomonas aeruginosa PA01
ucgcccuugaccaguccc

SEQ ID NO: 3479759 - RNA, 21 nt, Pseudomonas aeruginosa PA01
ucgcccuugaccagucccggc

SEQ ID NO: 3479760 - RNA, 21 nt, Pseudomonas aeruginosa PA01
ucgcccuugcugcccaguacc

SEQ ID NO: 3479761 - RNA, 19 nt, Pseudomonas aeruginosa PA01
ucgcccuugggaccgggca

SEQ ID NO: 3479762 - RNA, 23 nt, Pseudomonas aeruginosa PA01
ucgccgaaaaauucagcgcagcg

SEQ ID NO: 3479763 - RNA, 22 nt, Pseudomonas aeruginosa PA01
ucgccgaaaagaagccccgcag

SEQ ID NO: 3479764 - RNA, 18 nt, Pseudomonas aeruginosa PA01
ucgccgaaagcacgcgca

SEQ ID NO: 3479765 - RNA, 18 nt, Pseudomonas aeruginosa PA01
ucgccgaaauagcgcgcc

SEQ ID NO: 3479766 - RNA, 19 nt, Pseudomonas aeruginosa PA01
ucgccgaaauagcgcgccc

SEQ ID NO: 3479767 - RNA, 20 nt, Pseudomonas aeruginosa PA01
ucgccgaaauagcgcgccca

SEQ ID NO: 3479768 - RNA, 16 nt, Pseudomonas aeruginosa PA01
ucgccgaagacgccug

SEQ ID NO: 3479769 - RNA, 21 nt, Pseudomonas aeruginosa PA01
ucgccgaagauccgcuccagg

SEQ ID NO: 3479770 - RNA, 16 nt, Pseudomonas aeruginosa PA01
ucgccgaaggugcagg

SEQ ID NO: 3479771 - RNA, 22 nt, Pseudomonas aeruginosa PA01
ucgccgaaggugcaggccgcgc

SEQ ID NO: 3479772 - RNA, 23 nt, Pseudomonas aeruginosa PA01
ucgccgacacgugugucgacacc

SEQ ID NO: 3479773 - RNA, 12 nt, Pseudomonas aeruginosa PA01
ucgccgacaggu

SEQ ID NO: 3479774 - RNA, 20 nt, Pseudomonas aeruginosa PA01
ucgccgacaggucggccggc

SEQ ID NO: 3479775 - RNA, 16 nt, Pseudomonas aeruginosa PA01
ucgccgaccacuucca

SEQ ID NO: 3479776 - RNA, 17 nt, Pseudomonas aeruginosa PA01
ucgccgaccacuuccag

SEQ ID NO: 3479777 - RNA, 14 nt, Pseudomonas aeruginosa PA01
ucgccgaccaggcg

SEQ ID NO: 3479778 - RNA, 15 nt, Pseudomonas aeruginosa PA01
ucgccgaccaggcgg

SEQ ID NO: 3479779 - RNA, 16 nt, Pseudomonas aeruginosa PA01
ucgccgaccaggcggc

SEQ ID NO: 3479780 - RNA, 20 nt, Pseudomonas aeruginosa PA01
ucgccgaccaggcggccguc

SEQ ID NO: 3479781 - RNA, 23 nt, Pseudomonas aeruginosa PA01
ucgccgaccaggcggccgucggc

SEQ ID NO: 3479782 - RNA, 16 nt, Pseudomonas aeruginosa PA01
ucgccgacccugcacc

SEQ ID NO: 3479783 - RNA, 21 nt, Pseudomonas aeruginosa PA01
ucgccgaccgccaaggucggu

SEQ ID NO: 3479784 - RNA, 20 nt, Pseudomonas aeruginosa PA01
ucgccgacggcuucgaccac

SEQ ID NO: 3479785 - RNA, 21 nt, Pseudomonas aeruginosa PA01
ucgccgacggcuucgaccacg

SEQ ID NO: 3479786 - RNA, 22 nt, Pseudomonas aeruginosa PA01
ucgccgacggcuucgaccacga

SEQ ID NO: 3479787 - RNA, 21 nt, Pseudomonas aeruginosa PA01
ucgccgacguccuccaggacc

SEQ ID NO: 3479788 - RNA, 23 nt, Pseudomonas aeruginosa PA01
ucgccgacuuccaggcgcaggcg

SEQ ID NO: 3479789 - RNA, 15 nt, Pseudomonas aeruginosa PA01
ucgccgagcgccgcc

SEQ ID NO: 3479790 - RNA, 19 nt, Pseudomonas aeruginosa PA01
ucgccgagcgccgccaggc

SEQ ID NO: 3479791 - RNA, 18 nt, Pseudomonas aeruginosa PA01
ucgccgaggcccagcgac

SEQ ID NO: 3479792 - RNA, 15 nt, Pseudomonas aeruginosa PA01
ucgccgaggcggaag

SEQ ID NO: 3479793 - RNA, 18 nt, Pseudomonas aeruginosa PA01
ucgccgaggcggcgcagc

SEQ ID NO: 3479794 - RNA, 16 nt, Pseudomonas aeruginosa PA01
ucgccgaggggcggga

SEQ ID NO: 3479795 - RNA, 15 nt, Pseudomonas aeruginosa PA01
ucgccgagguugcug

SEQ ID NO: 3479796 - RNA, 15 nt, Pseudomonas aeruginosa PA01
ucgccgaguggccgc

SEQ ID NO: 3479797 - RNA, 17 nt, Pseudomonas aeruginosa PA01
ucgccgaguggccgcug

SEQ ID NO: 3479798 - RNA, 19 nt, Pseudomonas aeruginosa PA01
ucgccgaguggccgcugag

SEQ ID NO: 3479799 - RNA, 20 nt, Pseudomonas aeruginosa PA01
ucgccgaguggccgcugagc

SEQ ID NO: 3479800 - RNA, 13 nt, Pseudomonas aeruginosa PA01
ucgccgaugcccg

SEQ ID NO: 3479801 - RNA, 16 nt, Pseudomonas aeruginosa PA01
ucgccgaugcccgggc

SEQ ID NO: 3479802 - RNA, 19 nt, Pseudomonas aeruginosa PA01
ucgccgaugcgccgacgcc

SEQ ID NO: 3479803 - RNA, 20 nt, Pseudomonas aeruginosa PA01
ucgccgaugucguagccgcg

SEQ ID NO: 3479804 - RNA, 22 nt, Pseudomonas aeruginosa PA01
ucgccgaugucguagccgcgcg

SEQ ID NO: 3479805 - RNA, 17 nt, Pseudomonas aeruginosa PA01
ucgccgcacaccgcgcg

SEQ ID NO: 3479806 - RNA, 14 nt, Pseudomonas aeruginosa PA01
ucgccgcaccggcg

SEQ ID NO: 3479807 - RNA, 16 nt, Pseudomonas aeruginosa PA01
ucgccgcaccggcgau

SEQ ID NO: 3479808 - RNA, 20 nt, Pseudomonas aeruginosa PA01
ucgccgccaccacgaucagg

SEQ ID NO: 3479809 - RNA, 13 nt, Pseudomonas aeruginosa PA01
ucgccgccagcag

SEQ ID NO: 3479810 - RNA, 15 nt, Pseudomonas aeruginosa PA01
ucgccgccagcgccg

SEQ ID NO: 3479811 - RNA, 17 nt, Pseudomonas aeruginosa PA01
ucgccgccagcgccggc

SEQ ID NO: 3479812 - RNA, 18 nt, Pseudomonas aeruginosa PA01
ucgccgccagcgccggcc

SEQ ID NO: 3479813 - RNA, 14 nt, Pseudomonas aeruginosa PA01
ucgccgccagcuac

SEQ ID NO: 3479814 - RNA, 16 nt, Pseudomonas aeruginosa PA01
ucgccgccagcuaccg

SEQ ID NO: 3479815 - RNA, 20 nt, Pseudomonas aeruginosa PA01
ucgccgccagcuaccggcag

SEQ ID NO: 3479816 - RNA, 20 nt, Pseudomonas aeruginosa PA01
ucgccgccaggcagaccugc

SEQ ID NO: 3479817 - RNA, 22 nt, Pseudomonas aeruginosa PA01
ucgccgccaggcagaccugcag

SEQ ID NO: 3479818 - RNA, 16 nt, Pseudomonas aeruginosa PA01
ucgccgccaguucggc

SEQ ID NO: 3479819 - RNA, 14 nt, Pseudomonas aeruginosa PA01
ucgccgcccacgcc

SEQ ID NO: 3479820 - RNA, 23 nt, Pseudomonas aeruginosa PA01
ucgccgcccacgccuugcagcac

SEQ ID NO: 3479821 - RNA, 18 nt, Pseudomonas aeruginosa PA01
ucgccgcccgaggcgacc

SEQ ID NO: 3479822 - RNA, 13 nt, Pseudomonas aeruginosa PA01
ucgccgcccgcgc

SEQ ID NO: 3479823 - RNA, 19 nt, Pseudomonas aeruginosa PA01
ucgccgcccgcgccuccag

SEQ ID NO: 3479824 - RNA, 21 nt, Pseudomonas aeruginosa PA01
ucgccgcccgcgccuccaggc

SEQ ID NO: 3479825 - RNA, 13 nt, Pseudomonas aeruginosa PA01
ucgccgcccggca

SEQ ID NO: 3479826 - RNA, 20 nt, Pseudomonas aeruginosa PA01
ucgccgcccggcagcggcug

SEQ ID NO: 3479827 - RNA, 20 nt, Pseudomonas aeruginosa PA01
ucgccgcccucgcaguacag

SEQ ID NO: 3479828 - RNA, 13 nt, Pseudomonas aeruginosa PA01
ucgccgcccugga

SEQ ID NO: 3479829 - RNA, 13 nt, Pseudomonas aeruginosa PA01
ucgccgccgacac

SEQ ID NO: 3479830 - RNA, 18 nt, Pseudomonas aeruginosa PA01
ucgccgccgacacccgcg

SEQ ID NO: 3479831 - RNA, 23 nt, Pseudomonas aeruginosa PA01
ucgccgccgacacccgcgccgcc

SEQ ID NO: 3479832 - RNA, 12 nt, Pseudomonas aeruginosa PA01
ucgccgccgacc

SEQ ID NO: 3479833 - RNA, 16 nt, Pseudomonas aeruginosa PA01
ucgccgccgaccgggc

SEQ ID NO: 3479834 - RNA, 17 nt, Pseudomonas aeruginosa PA01
ucgccgccgaccgggcg

SEQ ID NO: 3479835 - RNA, 17 nt, Pseudomonas aeruginosa PA01
ucgccgccgagcgccug

SEQ ID NO: 3479836 - RNA, 19 nt, Pseudomonas aeruginosa PA01
ucgccgccgagcgccuggc

SEQ ID NO: 3479837 - RNA, 14 nt, Pseudomonas aeruginosa PA01
ucgccgccgaggcg

SEQ ID NO: 3479838 - RNA, 17 nt, Pseudomonas aeruginosa PA01
ucgccgccgaggcgcgc

SEQ ID NO: 3479839 - RNA, 19 nt, Pseudomonas aeruginosa PA01
ucgccgccgaggcgcgcca

SEQ ID NO: 3479840 - RNA, 16 nt, Pseudomonas aeruginosa PA01
ucgccgccgcagccgu

SEQ ID NO: 3479841 - RNA, 17 nt, Pseudomonas aeruginosa PA01
ucgccgccgcagccgug

SEQ ID NO: 3479842 - RNA, 18 nt, Pseudomonas aeruginosa PA01
ucgccgccgcagccgugg

SEQ ID NO: 3479843 - RNA, 12 nt, Pseudomonas aeruginosa PA01
ucgccgccgcca

SEQ ID NO: 3479844 - RNA, 13 nt, Pseudomonas aeruginosa PA01
ucgccgccgccag

SEQ ID NO: 3479845 - RNA, 15 nt, Pseudomonas aeruginosa PA01
ucgccgccgccggga

SEQ ID NO: 3479846 - RNA, 20 nt, Pseudomonas aeruginosa PA01
ucgccgccggccagccgcgc

SEQ ID NO: 3479847 - RNA, 12 nt, Pseudomonas aeruginosa PA01
ucgccgccggcg

SEQ ID NO: 3479848 - RNA, 14 nt, Pseudomonas aeruginosa PA01
ucgccgccggcgaa

SEQ ID NO: 3479849 - RNA, 14 nt, Pseudomonas aeruginosa PA01
ucgccgccggcgag

SEQ ID NO: 3479850 - RNA, 15 nt, Pseudomonas aeruginosa PA01
ucgccgccggcgagg

SEQ ID NO: 3479851 - RNA, 18 nt, Pseudomonas aeruginosa PA01
ucgccgccggcgaggauc

SEQ ID NO: 3479852 - RNA, 23 nt, Pseudomonas aeruginosa PA01
ucgccgccguccuguuucugcug

SEQ ID NO: 3479853 - RNA, 20 nt, Pseudomonas aeruginosa PA01
ucgccgccuucggcaggacc

SEQ ID NO: 3479854 - RNA, 13 nt, Pseudomonas aeruginosa PA01
ucgccgccuugcg

SEQ ID NO: 3479855 - RNA, 10 nt, Pseudomonas aeruginosa PA01
ucgccgcgac

SEQ ID NO: 3479856 - RNA, 14 nt, Pseudomonas aeruginosa PA01
ucgccgcgaccugc

SEQ ID NO: 3479857 - RNA, 19 nt, Pseudomonas aeruginosa PA01
ucgccgcgacgcuccagcg

SEQ ID NO: 3479858 - RNA, 18 nt, Pseudomonas aeruginosa PA01
ucgccgcgagcaccaugc

SEQ ID NO: 3479859 - RNA, 12 nt, Pseudomonas aeruginosa PA01
ucgccgcgccgc

SEQ ID NO: 3479860 - RNA, 13 nt, Pseudomonas aeruginosa PA01
ucgccgcgccgcc

SEQ ID NO: 3479861 - RNA, 14 nt, Pseudomonas aeruginosa PA01
ucgccgcgccgccg

SEQ ID NO: 3479862 - RNA, 15 nt, Pseudomonas aeruginosa PA01
ucgccgcgccgccga

SEQ ID NO: 3479863 - RNA, 18 nt, Pseudomonas aeruginosa PA01
ucgccgcgccgccgaggg

SEQ ID NO: 3479864 - RNA, 12 nt, Pseudomonas aeruginosa PA01
ucgccgcgccgu

SEQ ID NO: 3479865 - RNA, 12 nt, Pseudomonas aeruginosa PA01
ucgccgcgcgcc

SEQ ID NO: 3479866 - RNA, 22 nt, Pseudomonas aeruginosa PA01
ucgccgcgcggucgagcucggc

SEQ ID NO: 3479867 - RNA, 18 nt, Pseudomonas aeruginosa PA01
ucgccgcggacggccggc

SEQ ID NO: 3479868 - RNA, 19 nt, Pseudomonas aeruginosa PA01
ucgccgcggacggccggcu

SEQ ID NO: 3479869 - RNA, 16 nt, Pseudomonas aeruginosa PA01
ucgccgcggcagaucc

SEQ ID NO: 3479870 - RNA, 11 nt, Pseudomonas aeruginosa PA01
ucgccgcggcg

SEQ ID NO: 3479871 - RNA, 23 nt, Pseudomonas aeruginosa PA01
ucgccgcggcgaagcguugcagc

SEQ ID NO: 3479872 - RNA, 15 nt, Pseudomonas aeruginosa PA01
ucgccgcggcguagg

SEQ ID NO: 3479873 - RNA, 23 nt, Pseudomonas aeruginosa PA01
ucgccgcgggcguugcgcgccuc

SEQ ID NO: 3479874 - RNA, 15 nt, Pseudomonas aeruginosa PA01
ucgccgcucauccgc

SEQ ID NO: 3479875 - RNA, 14 nt, Pseudomonas aeruginosa PA01
ucgccgcuccacac

SEQ ID NO: 3479876 - RNA, 14 nt, Pseudomonas aeruginosa PA01
ucgccgcugaaguc

SEQ ID NO: 3479877 - RNA, 24 nt, Pseudomonas aeruginosa PA01
ucgccgcugaaguccuggccgagc

SEQ ID NO: 3479878 - RNA, 12 nt, Pseudomonas aeruginosa PA01
ucgccgcuggcg

SEQ ID NO: 3479879 - RNA, 13 nt, Pseudomonas aeruginosa PA01
ucgccgcugggca

SEQ ID NO: 3479880 - RNA, 16 nt, Pseudomonas aeruginosa PA01
ucgccgcugggcagca

SEQ ID NO: 3479881 - RNA, 21 nt, Pseudomonas aeruginosa PA01
ucgccgcugggcagcacgcug

SEQ ID NO: 3479882 - RNA, 14 nt, Pseudomonas aeruginosa PA01
ucgccggaagcuuc

SEQ ID NO: 3479883 - RNA, 21 nt, Pseudomonas aeruginosa PA01
ucgccggaagcuucaggcucg

SEQ ID NO: 3479884 - RNA, 22 nt, Pseudomonas aeruginosa PA01
ucgccggagccuucuagcgaag

SEQ ID NO: 3479885 - RNA, 12 nt, Pseudomonas aeruginosa PA01
ucgccggagggg

SEQ ID NO: 3479886 - RNA, 24 nt, Pseudomonas aeruginosa PA01
ucgccggagucguagcgcgcggcg

SEQ ID NO: 3479887 - RNA, 12 nt, Pseudomonas aeruginosa PA01
ucgccggcagcg

SEQ ID NO: 3479888 - RNA, 14 nt, Pseudomonas aeruginosa PA01
ucgccggcagcgcc

SEQ ID NO: 3479889 - RNA, 16 nt, Pseudomonas aeruginosa PA01
ucgccggcagcgccgc

SEQ ID NO: 3479890 - RNA, 19 nt, Pseudomonas aeruginosa PA01
ucgccggcauuggcacccu

SEQ ID NO: 3479891 - RNA, 14 nt, Pseudomonas aeruginosa PA01
ucgccggccaccag

SEQ ID NO: 3479892 - RNA, 16 nt, Pseudomonas aeruginosa PA01
ucgccggccaccaggc

SEQ ID NO: 3479893 - RNA, 13 nt, Pseudomonas aeruginosa PA01
ucgccggccaggu

SEQ ID NO: 3479894 - RNA, 22 nt, Pseudomonas aeruginosa PA01
ucgccggccaguuggugcacgc

SEQ ID NO: 3479895 - RNA, 23 nt, Pseudomonas aeruginosa PA01
ucgccggccaguuggugcacgcg

SEQ ID NO: 3479896 - RNA, 14 nt, Pseudomonas aeruginosa PA01
ucgccggcccgcgc

SEQ ID NO: 3479897 - RNA, 13 nt, Pseudomonas aeruginosa PA01
ucgccggccgcug

SEQ ID NO: 3479898 - RNA, 23 nt, Pseudomonas aeruginosa PA01
ucgccggccuggaucucggcggc

SEQ ID NO: 3479899 - RNA, 19 nt, Pseudomonas aeruginosa PA01
ucgccggcgagccgcuggc

SEQ ID NO: 3479900 - RNA, 13 nt, Pseudomonas aeruginosa PA01
ucgccggcgaucu

SEQ ID NO: 3479901 - RNA, 15 nt, Pseudomonas aeruginosa PA01
ucgccggcgaucucc

SEQ ID NO: 3479902 - RNA, 21 nt, Pseudomonas aeruginosa PA01
ucgccggcgaucuccgccagg

SEQ ID NO: 3479903 - RNA, 22 nt, Pseudomonas aeruginosa PA01
ucgccggcgaucuccgccaggc

SEQ ID NO: 3479904 - RNA, 14 nt, Pseudomonas aeruginosa PA01
ucgccggcgcgcac

SEQ ID NO: 3479905 - RNA, 19 nt, Pseudomonas aeruginosa PA01
ucgccggcgcgggcggccu

SEQ ID NO: 3479906 - RNA, 20 nt, Pseudomonas aeruginosa PA01
ucgccggcgcgggcggccuc

SEQ ID NO: 3479907 - RNA, 11 nt, Pseudomonas aeruginosa PA01
ucgccggcguc

SEQ ID NO: 3479908 - RNA, 20 nt, Pseudomonas aeruginosa PA01
ucgccgggaaucgccagcag

SEQ ID NO: 3479909 - RNA, 21 nt, Pseudomonas aeruginosa PA01
ucgccggggccuacugcugga

SEQ ID NO: 3479910 - RNA, 15 nt, Pseudomonas aeruginosa PA01
ucgccgggucgccgc

SEQ ID NO: 3479911 - RNA, 22 nt, Pseudomonas aeruginosa PA01
ucgccggguggaacgaggcgac

SEQ ID NO: 3479912 - RNA, 19 nt, Pseudomonas aeruginosa PA01
ucgccggguguuuuuccuc

SEQ ID NO: 3479913 - RNA, 20 nt, Pseudomonas aeruginosa PA01
ucgccggguugccgcuggcc

SEQ ID NO: 3479914 - RNA, 19 nt, Pseudomonas aeruginosa PA01
ucgccggguuguccaggcg

SEQ ID NO: 3479915 - RNA, 20 nt, Pseudomonas aeruginosa PA01
ucgccggguuguccaggcga

SEQ ID NO: 3479916 - RNA, 16 nt, Pseudomonas aeruginosa PA01
ucgccggucaggcugc

SEQ ID NO: 3479917 - RNA, 19 nt, Pseudomonas aeruginosa PA01
ucgccggucgcgcucaggc

SEQ ID NO: 3479918 - RNA, 17 nt, Pseudomonas aeruginosa PA01
ucgccggugacgcugcu

SEQ ID NO: 3479919 - RNA, 20 nt, Pseudomonas aeruginosa PA01
ucgccggugaggaugcggau

SEQ ID NO: 3479920 - RNA, 22 nt, Pseudomonas aeruginosa PA01
ucgccggugcggguaucgaucu

SEQ ID NO: 3479921 - RNA, 16 nt, Pseudomonas aeruginosa PA01
ucgccguacagcaggc

SEQ ID NO: 3479922 - RNA, 17 nt, Pseudomonas aeruginosa PA01
ucgccguacagcaggca

SEQ ID NO: 3479923 - RNA, 19 nt, Pseudomonas aeruginosa PA01
ucgccguacagcaggcagg

SEQ ID NO: 3479924 - RNA, 14 nt, Pseudomonas aeruginosa PA01
ucgccgucaccgcg

SEQ ID NO: 3479925 - RNA, 16 nt, Pseudomonas aeruginosa PA01
ucgccgucaucgagca

SEQ ID NO: 3479926 - RNA, 18 nt, Pseudomonas aeruginosa PA01
ucgccgucaucgagcagu

SEQ ID NO: 3479927 - RNA, 16 nt, Pseudomonas aeruginosa PA01
ucgccguccaccaagc

SEQ ID NO: 3479928 - RNA, 17 nt, Pseudomonas aeruginosa PA01
ucgccguccgcgaugcg

SEQ ID NO: 3479929 - RNA, 22 nt, Pseudomonas aeruginosa PA01
ucgccguccuugucgcagcggc

SEQ ID NO: 3479930 - RNA, 23 nt, Pseudomonas aeruginosa PA01
ucgccguccuugucgcagcggcc

SEQ ID NO: 3479931 - RNA, 19 nt, Pseudomonas aeruginosa PA01
ucgccgucgagccagccca

SEQ ID NO: 3479932 - RNA, 22 nt, Pseudomonas aeruginosa PA01
ucgccgucgagccagcccagcg

SEQ ID NO: 3479933 - RNA, 18 nt, Pseudomonas aeruginosa PA01
ucgccgucgucacggaac

SEQ ID NO: 3479934 - RNA, 22 nt, Pseudomonas aeruginosa PA01
ucgccgucgucgggaucgagca

SEQ ID NO: 3479935 - RNA, 16 nt, Pseudomonas aeruginosa PA01
ucgccgucucguagac

SEQ ID NO: 3479936 - RNA, 17 nt, Pseudomonas aeruginosa PA01
ucgccgucuuccaccag

SEQ ID NO: 3479937 - RNA, 21 nt, Pseudomonas aeruginosa PA01
ucgccguggaugucgaggaac

SEQ ID NO: 3479938 - RNA, 11 nt, Pseudomonas aeruginosa PA01
ucgccgugggc

SEQ ID NO: 3479939 - RNA, 20 nt, Pseudomonas aeruginosa PA01
ucgccgugguggccguggcg

SEQ ID NO: 3479940 - RNA, 21 nt, Pseudomonas aeruginosa PA01
ucgccguucagcucccaggcg

SEQ ID NO: 3479941 - RNA, 24 nt, Pseudomonas aeruginosa PA01
ucgccguugccuucgccgucgagc

SEQ ID NO: 3479942 - RNA, 14 nt, Pseudomonas aeruginosa PA01
ucgccguuggccuu

SEQ ID NO: 3479943 - RNA, 18 nt, Pseudomonas aeruginosa PA01
ucgccguuggcgaggacu

SEQ ID NO: 3479944 - RNA, 23 nt, Pseudomonas aeruginosa PA01
ucgccguuggcgaggacuuucuu

SEQ ID NO: 3479945 - RNA, 13 nt, Pseudomonas aeruginosa PA01
ucgccuaccagac

SEQ ID NO: 3479946 - RNA, 18 nt, Pseudomonas aeruginosa PA01
ucgccuaccagaccgcag

SEQ ID NO: 3479947 - RNA, 13 nt, Pseudomonas aeruginosa PA01
ucgccuaccggcg

SEQ ID NO: 3479948 - RNA, 16 nt, Pseudomonas aeruginosa PA01
ucgccuaccggcgccg

SEQ ID NO: 3479949 - RNA, 16 nt, Pseudomonas aeruginosa PA01
ucgccuccaccagcgc

SEQ ID NO: 3479950 - RNA, 18 nt, Pseudomonas aeruginosa PA01
ucgccuccaccagcgccg

SEQ ID NO: 3479951 - RNA, 21 nt, Pseudomonas aeruginosa PA01
ucgccuccaccagcgccggcg

SEQ ID NO: 3479952 - RNA, 23 nt, Pseudomonas aeruginosa PA01
ucgccuccaccagcgccggcggc

SEQ ID NO: 3479953 - RNA, 14 nt, Pseudomonas aeruginosa PA01
ucgccuccacggcg

SEQ ID NO: 3479954 - RNA, 16 nt, Pseudomonas aeruginosa PA01
ucgccuccacggcggc

SEQ ID NO: 3479955 - RNA, 17 nt, Pseudomonas aeruginosa PA01
ucgccucccggcucgcc

SEQ ID NO: 3479956 - RNA, 19 nt, Pseudomonas aeruginosa PA01
ucgccucccggcucgccga

SEQ ID NO: 3479957 - RNA, 15 nt, Pseudomonas aeruginosa PA01
ucgccucgccggcca

SEQ ID NO: 3479958 - RNA, 23 nt, Pseudomonas aeruginosa PA01
ucgccucggcgggagagggcggc

SEQ ID NO: 3479959 - RNA, 15 nt, Pseudomonas aeruginosa PA01
ucgccucgggccaug

SEQ ID NO: 3479960 - RNA, 23 nt, Pseudomonas aeruginosa PA01
ucgccucgggccaugagcagggc

SEQ ID NO: 3479961 - RNA, 20 nt, Pseudomonas aeruginosa PA01
ucgccucgggcgagcgcaga

SEQ ID NO: 3479962 - RNA, 21 nt, Pseudomonas aeruginosa PA01
ucgccucgucgagcgcagcga

SEQ ID NO: 3479963 - RNA, 22 nt, Pseudomonas aeruginosa PA01
ucgccucguucagcagcaugcc

SEQ ID NO: 3479964 - RNA, 14 nt, Pseudomonas aeruginosa PA01
ucgccugccaggcg

SEQ ID NO: 3479965 - RNA, 15 nt, Pseudomonas aeruginosa PA01
ucgccugccaggcgg

SEQ ID NO: 3479966 - RNA, 14 nt, Pseudomonas aeruginosa PA01
ucgccugcuggccg

SEQ ID NO: 3479967 - RNA, 15 nt, Pseudomonas aeruginosa PA01
ucgccugcuggccgg

SEQ ID NO: 3479968 - RNA, 18 nt, Pseudomonas aeruginosa PA01
ucgccuggcccuggaccu

SEQ ID NO: 3479969 - RNA, 14 nt, Pseudomonas aeruginosa PA01
ucgccuggcgcgac

SEQ ID NO: 3479970 - RNA, 21 nt, Pseudomonas aeruginosa PA01
ucgccuggcgcgacgaggcgc

SEQ ID NO: 3479971 - RNA, 15 nt, Pseudomonas aeruginosa PA01
ucgccugggccggcg

SEQ ID NO: 3479972 - RNA, 17 nt, Pseudomonas aeruginosa PA01
ucgccugggccggcgua

SEQ ID NO: 3479973 - RNA, 18 nt, Pseudomonas aeruginosa PA01
ucgccugguaggcggcga

SEQ ID NO: 3479974 - RNA, 23 nt, Pseudomonas aeruginosa PA01
ucgccugguaggcggcgacgaag

SEQ ID NO: 3479975 - RNA, 14 nt, Pseudomonas aeruginosa PA01
ucgccuuccaccac

SEQ ID NO: 3479976 - RNA, 23 nt, Pseudomonas aeruginosa PA01
ucgccuucccagacguccagcgc

SEQ ID NO: 3479977 - RNA, 22 nt, Pseudomonas aeruginosa PA01
ucgccuuccggcagguucagca

SEQ ID NO: 3479978 - RNA, 14 nt, Pseudomonas aeruginosa PA01
ucgccuuccucggc

SEQ ID NO: 3479979 - RNA, 13 nt, Pseudomonas aeruginosa PA01
ucgccuucgcuga

SEQ ID NO: 3479980 - RNA, 17 nt, Pseudomonas aeruginosa PA01
ucgccuugaccagcggc

SEQ ID NO: 3479981 - RNA, 17 nt, Pseudomonas aeruginosa PA01
ucgccuugcccuggccg

SEQ ID NO: 3479982 - RNA, 17 nt, Pseudomonas aeruginosa PA01
ucgccuugcgcgugcug

SEQ ID NO: 3479983 - RNA, 20 nt, Pseudomonas aeruginosa PA01
ucgccuugcggggcggcgca

SEQ ID NO: 3479984 - RNA, 17 nt, Pseudomonas aeruginosa PA01
ucgcgaaaacucccggc

SEQ ID NO: 3479985 - RNA, 19 nt, Pseudomonas aeruginosa PA01
ucgcgaaaacucccggccu

SEQ ID NO: 3479986 - RNA, 19 nt, Pseudomonas aeruginosa PA01
ucgcgaaccacauccuugc

SEQ ID NO: 3479987 - RNA, 16 nt, Pseudomonas aeruginosa PA01
ucgcgaagaccggccg

SEQ ID NO: 3479988 - RNA, 20 nt, Pseudomonas aeruginosa PA01
ucgcgaagaccggccggcuc

SEQ ID NO: 3479989 - RNA, 22 nt, Pseudomonas aeruginosa PA01
ucgcgacacaccgacaaucgcc

SEQ ID NO: 3479990 - RNA, 22 nt, Pseudomonas aeruginosa PA01
ucgcgacagguucaggacgcuc

SEQ ID NO: 3479991 - RNA, 22 nt, Pseudomonas aeruginosa PA01
ucgcgacccucagucgccccca

SEQ ID NO: 3479992 - RNA, 14 nt, Pseudomonas aeruginosa PA01
ucgcgacccuggcc

SEQ ID NO: 3479993 - RNA, 19 nt, Pseudomonas aeruginosa PA01
ucgcgacccuggccgcgcg

SEQ ID NO: 3479994 - RNA, 21 nt, Pseudomonas aeruginosa PA01
ucgcgacccuggccgcgcggc

SEQ ID NO: 3479995 - RNA, 21 nt, Pseudomonas aeruginosa PA01
ucgcgaccgguaacuggccag

SEQ ID NO: 3479996 - RNA, 16 nt, Pseudomonas aeruginosa PA01
ucgcgacugaccacgc

SEQ ID NO: 3479997 - RNA, 15 nt, Pseudomonas aeruginosa PA01
ucgcgacugccgucg

SEQ ID NO: 3479998 - RNA, 17 nt, Pseudomonas aeruginosa PA01
ucgcgacugccgucggc

SEQ ID NO: 3479999 - RNA, 18 nt, Pseudomonas aeruginosa PA01
ucgcgacugccgucggcg

SEQ ID NO: 3480000 - RNA, 16 nt, Pseudomonas aeruginosa PA01
ucgcgacugcugauca

SEQ ID NO: 3480001 - RNA, 20 nt, Pseudomonas aeruginosa PA01
ucgcgagauggcgucgaucc

SEQ ID NO: 3480002 - RNA, 17 nt, Pseudomonas aeruginosa PA01
ucgcgagcagggcgaug

SEQ ID NO: 3480003 - RNA, 18 nt, Pseudomonas aeruginosa PA01
ucgcgagcagggcgaugc

SEQ ID NO: 3480004 - RNA, 19 nt, Pseudomonas aeruginosa PA01
ucgcgagcagggcgaugcc

SEQ ID NO: 3480005 - RNA, 17 nt, Pseudomonas aeruginosa PA01
ucgcgauacucgugggc

SEQ ID NO: 3480006 - RNA, 19 nt, Pseudomonas aeruginosa PA01
ucgcgauagacgccggcga

SEQ ID NO: 3480007 - RNA, 14 nt, Pseudomonas aeruginosa PA01
ucgcgauccaccgc

SEQ ID NO: 3480008 - RNA, 21 nt, Pseudomonas aeruginosa PA01
ucgcgauccaccgccagggcg

SEQ ID NO: 3480009 - RNA, 15 nt, Pseudomonas aeruginosa PA01
ucgcgaucgaucggc

SEQ ID NO: 3480010 - RNA, 20 nt, Pseudomonas aeruginosa PA01
ucgcgauuggagaugcucag

SEQ ID NO: 3480011 - RNA, 23 nt, Pseudomonas aeruginosa PA01
ucgcgauuggagaugcucaggcg

SEQ ID NO: 3480012 - RNA, 15 nt, Pseudomonas aeruginosa PA01
ucgcgcaaccagccg

SEQ ID NO: 3480013 - RNA, 17 nt, Pseudomonas aeruginosa PA01
ucgcgcaacgccgacgg

SEQ ID NO: 3480014 - RNA, 19 nt, Pseudomonas aeruginosa PA01
ucgcgcaacgccgacggcg

SEQ ID NO: 3480015 - RNA, 22 nt, Pseudomonas aeruginosa PA01
ucgcgcaacgccgacggcgugc

SEQ ID NO: 3480016 - RNA, 14 nt, Pseudomonas aeruginosa PA01
ucgcgcaacgccuu

SEQ ID NO: 3480017 - RNA, 15 nt, Pseudomonas aeruginosa PA01
ucgcgcaacggcagc

SEQ ID NO: 3480018 - RNA, 16 nt, Pseudomonas aeruginosa PA01
ucgcgcaacggcagcg

SEQ ID NO: 3480019 - RNA, 18 nt, Pseudomonas aeruginosa PA01
ucgcgcaacggcagcgcu

SEQ ID NO: 3480020 - RNA, 21 nt, Pseudomonas aeruginosa PA01
ucgcgcaacggcagcgcuucg

SEQ ID NO: 3480021 - RNA, 20 nt, Pseudomonas aeruginosa PA01
ucgcgcaacugcggggcgcu

SEQ ID NO: 3480022 - RNA, 24 nt, Pseudomonas aeruginosa PA01
ucgcgcaacugcggggcgcucagg

SEQ ID NO: 3480023 - RNA, 18 nt, Pseudomonas aeruginosa PA01
ucgcgcaagcgcccggcg

SEQ ID NO: 3480024 - RNA, 16 nt, Pseudomonas aeruginosa PA01
ucgcgcaaugccgcgu

SEQ ID NO: 3480025 - RNA, 18 nt, Pseudomonas aeruginosa PA01
ucgcgcacaugccgagcg

SEQ ID NO: 3480026 - RNA, 19 nt, Pseudomonas aeruginosa PA01
ucgcgcacaugccgagcga

SEQ ID NO: 3480027 - RNA, 15 nt, Pseudomonas aeruginosa PA01
ucgcgcaccgcggcc

SEQ ID NO: 3480028 - RNA, 18 nt, Pseudomonas aeruginosa PA01
ucgcgcaccgcggccagu

SEQ ID NO: 3480029 - RNA, 14 nt, Pseudomonas aeruginosa PA01
ucgcgcaccuggcg

SEQ ID NO: 3480030 - RNA, 20 nt, Pseudomonas aeruginosa PA01
ucgcgcaccuggcggucgcc

SEQ ID NO: 3480031 - RNA, 22 nt, Pseudomonas aeruginosa PA01
ucgcgcaccuggcggucgccgc

SEQ ID NO: 3480032 - RNA, 14 nt, Pseudomonas aeruginosa PA01
ucgcgcacgcugua

SEQ ID NO: 3480033 - RNA, 21 nt, Pseudomonas aeruginosa PA01
ucgcgcacgcuguagaccagc

SEQ ID NO: 3480034 - RNA, 12 nt, Pseudomonas aeruginosa PA01
ucgcgcacggcg

SEQ ID NO: 3480035 - RNA, 23 nt, Pseudomonas aeruginosa PA01
ucgcgcacuuccggacugcccag

SEQ ID NO: 3480036 - RNA, 17 nt, Pseudomonas aeruginosa PA01
ucgcgcagcaggaucca

SEQ ID NO: 3480037 - RNA, 16 nt, Pseudomonas aeruginosa PA01
ucgcgcagcaggcggc

SEQ ID NO: 3480038 - RNA, 19 nt, Pseudomonas aeruginosa PA01
ucgcgcagcaggcggccca

SEQ ID NO: 3480039 - RNA, 14 nt, Pseudomonas aeruginosa PA01
ucgcgcagccaggc

SEQ ID NO: 3480040 - RNA, 13 nt, Pseudomonas aeruginosa PA01
ucgcgcagccagu

SEQ ID NO: 3480041 - RNA, 16 nt, Pseudomonas aeruginosa PA01
ucgcgcagcgccucca

SEQ ID NO: 3480042 - RNA, 13 nt, Pseudomonas aeruginosa PA01
ucgcgcagcggcg

SEQ ID NO: 3480043 - RNA, 15 nt, Pseudomonas aeruginosa PA01
ucgcgcagcggcgga

SEQ ID NO: 3480044 - RNA, 18 nt, Pseudomonas aeruginosa PA01
ucgcgcagcuccucggcg

SEQ ID NO: 3480045 - RNA, 17 nt, Pseudomonas aeruginosa PA01
ucgcgcagcucggccaa

SEQ ID NO: 3480046 - RNA, 13 nt, Pseudomonas aeruginosa PA01
ucgcgcaggcgcu

SEQ ID NO: 3480047 - RNA, 17 nt, Pseudomonas aeruginosa PA01
ucgcgcaggcgcuggcg

SEQ ID NO: 3480048 - RNA, 19 nt, Pseudomonas aeruginosa PA01
ucgcgcaggcgcuggcggg

SEQ ID NO: 3480049 - RNA, 20 nt, Pseudomonas aeruginosa PA01
ucgcgcaggcgcuggcgggc

SEQ ID NO: 3480050 - RNA, 17 nt, Pseudomonas aeruginosa PA01
ucgcgcaggcgggcggc

SEQ ID NO: 3480051 - RNA, 12 nt, Pseudomonas aeruginosa PA01
ucgcgcagggca

SEQ ID NO: 3480052 - RNA, 16 nt, Pseudomonas aeruginosa PA01
ucgcgcagggcagcgc

SEQ ID NO: 3480053 - RNA, 15 nt, Pseudomonas aeruginosa PA01
ucgcgcagggccagg

SEQ ID NO: 3480054 - RNA, 23 nt, Pseudomonas aeruginosa PA01
ucgcgcaggugcuuggcaccgcg

SEQ ID NO: 3480055 - RNA, 14 nt, Pseudomonas aeruginosa PA01
ucgcgcaguucguc

SEQ ID NO: 3480056 - RNA, 19 nt, Pseudomonas aeruginosa PA01
ucgcgcaguucgucuucca

SEQ ID NO: 3480057 - RNA, 15 nt, Pseudomonas aeruginosa PA01
ucgcgcaucgcggac

SEQ ID NO: 3480058 - RNA, 18 nt, Pseudomonas aeruginosa PA01
ucgcgcaucgcggacacc

SEQ ID NO: 3480059 - RNA, 23 nt, Pseudomonas aeruginosa PA01
ucgcgcaucuggcugcgcgccac

SEQ ID NO: 3480060 - RNA, 20 nt, Pseudomonas aeruginosa PA01
ucgcgcaugaccuucagcac

SEQ ID NO: 3480061 - RNA, 15 nt, Pseudomonas aeruginosa PA01
ucgcgcaugaucgcc

SEQ ID NO: 3480062 - RNA, 21 nt, Pseudomonas aeruginosa PA01
ucgcgcaugaucgccucggcg

SEQ ID NO: 3480063 - RNA, 13 nt, Pseudomonas aeruginosa PA01
ucgcgccagagau

SEQ ID NO: 3480064 - RNA, 21 nt, Pseudomonas aeruginosa PA01
ucgcgccagagaucgcccagc

SEQ ID NO: 3480065 - RNA, 12 nt, Pseudomonas aeruginosa PA01
ucgcgccagcac

SEQ ID NO: 3480066 - RNA, 14 nt, Pseudomonas aeruginosa PA01
ucgcgccagcaccg

SEQ ID NO: 3480067 - RNA, 12 nt, Pseudomonas aeruginosa PA01
ucgcgccagccc

SEQ ID NO: 3480068 - RNA, 21 nt, Pseudomonas aeruginosa PA01
ucgcgccagccccaggcgcgg

SEQ ID NO: 3480069 - RNA, 13 nt, Pseudomonas aeruginosa PA01
ucgcgccaggcga

SEQ ID NO: 3480070 - RNA, 15 nt, Pseudomonas aeruginosa PA01
ucgcgccaggcgaag

SEQ ID NO: 3480071 - RNA, 19 nt, Pseudomonas aeruginosa PA01
ucgcgcccagugcccggca

SEQ ID NO: 3480072 - RNA, 21 nt, Pseudomonas aeruginosa PA01
ucgcgccccgggaccaucacc

SEQ ID NO: 3480073 - RNA, 13 nt, Pseudomonas aeruginosa PA01
ucgcgccgacgac

SEQ ID NO: 3480074 - RNA, 22 nt, Pseudomonas aeruginosa PA01
ucgcgccgcccggcucgccgcc

SEQ ID NO: 3480075 - RNA, 13 nt, Pseudomonas aeruginosa PA01
ucgcgccgucgcu

SEQ ID NO: 3480076 - RNA, 13 nt, Pseudomonas aeruginosa PA01
ucgcgcgaggcgc

SEQ ID NO: 3480077 - RNA, 19 nt, Pseudomonas aeruginosa PA01
ucgcgcgccuucagcccca

SEQ ID NO: 3480078 - RNA, 15 nt, Pseudomonas aeruginosa PA01
ucgcgcgcggcaucc

SEQ ID NO: 3480079 - RNA, 13 nt, Pseudomonas aeruginosa PA01
ucgcgcgcggcca

SEQ ID NO: 3480080 - RNA, 17 nt, Pseudomonas aeruginosa PA01
ucgcgcgcggccagcuc

SEQ ID NO: 3480081 - RNA, 20 nt, Pseudomonas aeruginosa PA01
ucgcgcggagugcugaguuu

SEQ ID NO: 3480082 - RNA, 11 nt, Pseudomonas aeruginosa PA01
ucgcgcggcca

SEQ ID NO: 3480083 - RNA, 15 nt, Pseudomonas aeruginosa PA01
ucgcgcggccagcgu

SEQ ID NO: 3480084 - RNA, 15 nt, Pseudomonas aeruginosa PA01
ucgcgcggcgccugc

SEQ ID NO: 3480085 - RNA, 23 nt, Pseudomonas aeruginosa PA01
ucgcgcgggguggccgugcagcc

SEQ ID NO: 3480086 - RNA, 13 nt, Pseudomonas aeruginosa PA01
ucgcgcgggugcg

SEQ ID NO: 3480087 - RNA, 20 nt, Pseudomonas aeruginosa PA01
ucgcgcguccagccgguagg

SEQ ID NO: 3480088 - RNA, 19 nt, Pseudomonas aeruginosa PA01
ucgcgcgugccccguggcg

SEQ ID NO: 3480089 - RNA, 22 nt, Pseudomonas aeruginosa PA01
ucgcgcgugccccguggcgggc

SEQ ID NO: 3480090 - RNA, 15 nt, Pseudomonas aeruginosa PA01
ucgcgcguggccgcc

SEQ ID NO: 3480091 - RNA, 17 nt, Pseudomonas aeruginosa PA01
ucgcgcucagcgcgagg

SEQ ID NO: 3480092 - RNA, 13 nt, Pseudomonas aeruginosa PA01
ucgcgcucaggcg

SEQ ID NO: 3480093 - RNA, 18 nt, Pseudomonas aeruginosa PA01
ucgcgcucaggcgcagcg

SEQ ID NO: 3480094 - RNA, 20 nt, Pseudomonas aeruginosa PA01
ucgcgcucaggcgcagcguc

SEQ ID NO: 3480095 - RNA, 14 nt, Pseudomonas aeruginosa PA01
ucgcgcuccaggcc

SEQ ID NO: 3480096 - RNA, 21 nt, Pseudomonas aeruginosa PA01
ucgcgcuccaggcccggcagg

SEQ ID NO: 3480097 - RNA, 18 nt, Pseudomonas aeruginosa PA01
ucgcgcucgacgaugcug

SEQ ID NO: 3480098 - RNA, 14 nt, Pseudomonas aeruginosa PA01
ucgcgcucggcgag

SEQ ID NO: 3480099 - RNA, 16 nt, Pseudomonas aeruginosa PA01
ucgcgcucggcggccu

SEQ ID NO: 3480100 - RNA, 14 nt, Pseudomonas aeruginosa PA01
ucgcgcugcccggc

SEQ ID NO: 3480101 - RNA, 16 nt, Pseudomonas aeruginosa PA01
ucgcgcugcccggcgc

SEQ ID NO: 3480102 - RNA, 21 nt, Pseudomonas aeruginosa PA01
ucgcgcugcccggcgcgacgc

SEQ ID NO: 3480103 - RNA, 17 nt, Pseudomonas aeruginosa PA01
ucgcgcuggacccgcac

SEQ ID NO: 3480104 - RNA, 22 nt, Pseudomonas aeruginosa PA01
ucgcgcuggacccgcaccugga

SEQ ID NO: 3480105 - RNA, 13 nt, Pseudomonas aeruginosa PA01
ucgcgcuggaccu

SEQ ID NO: 3480106 - RNA, 18 nt, Pseudomonas aeruginosa PA01
ucgcgcuggaccuggccg

SEQ ID NO: 3480107 - RNA, 17 nt, Pseudomonas aeruginosa PA01
ucgcgcugggcgcagcc

SEQ ID NO: 3480108 - RNA, 18 nt, Pseudomonas aeruginosa PA01
ucgcgcugggcgcagccc

SEQ ID NO: 3480109 - RNA, 18 nt, Pseudomonas aeruginosa PA01
ucgcgcugguugcccagg

SEQ ID NO: 3480110 - RNA, 16 nt, Pseudomonas aeruginosa PA01
ucgcgcuguugccgcg

SEQ ID NO: 3480111 - RNA, 14 nt, Pseudomonas aeruginosa PA01
ucgcgcuuccggcu

SEQ ID NO: 3480112 - RNA, 15 nt, Pseudomonas aeruginosa PA01
ucgcgcuuccggcuu

SEQ ID NO: 3480113 - RNA, 15 nt, Pseudomonas aeruginosa PA01
ucgcgcuucucgacg

SEQ ID NO: 3480114 - RNA, 13 nt, Pseudomonas aeruginosa PA01
ucgcgcuuggaca

SEQ ID NO: 3480115 - RNA, 18 nt, Pseudomonas aeruginosa PA01
ucgcgcuuguugaucacc

SEQ ID NO: 3480116 - RNA, 23 nt, Pseudomonas aeruginosa PA01
ucgcggaaggcgucgaaggccuc

SEQ ID NO: 3480117 - RNA, 17 nt, Pseudomonas aeruginosa PA01
ucgcggaaguaggcggc

SEQ ID NO: 3480118 - RNA, 14 nt, Pseudomonas aeruginosa PA01
ucgcggaagucggc

SEQ ID NO: 3480119 - RNA, 17 nt, Pseudomonas aeruginosa PA01
ucgcggacaccgcggug

SEQ ID NO: 3480120 - RNA, 15 nt, Pseudomonas aeruginosa PA01
ucgcggaccagcucc

SEQ ID NO: 3480121 - RNA, 14 nt, Pseudomonas aeruginosa PA01
ucgcggaccuccag

SEQ ID NO: 3480122 - RNA, 16 nt, Pseudomonas aeruginosa PA01
ucgcggaccucugcgu

SEQ ID NO: 3480123 - RNA, 14 nt, Pseudomonas aeruginosa PA01
ucgcggacgccgaa

SEQ ID NO: 3480124 - RNA, 15 nt, Pseudomonas aeruginosa PA01
ucgcggacgccgaag

SEQ ID NO: 3480125 - RNA, 21 nt, Pseudomonas aeruginosa PA01
ucgcggacuccggaggcgcac

SEQ ID NO: 3480126 - RNA, 24 nt, Pseudomonas aeruginosa PA01
ucgcggacuccggaggcgcacagg

SEQ ID NO: 3480127 - RNA, 20 nt, Pseudomonas aeruginosa PA01
ucgcggagaauccgcucggu

SEQ ID NO: 3480128 - RNA, 16 nt, Pseudomonas aeruginosa PA01
ucgcggaucaggcugg

SEQ ID NO: 3480129 - RNA, 17 nt, Pseudomonas aeruginosa PA01
ucgcggaucucaggacc

SEQ ID NO: 3480130 - RNA, 20 nt, Pseudomonas aeruginosa PA01
ucgcggaucugcuccugcag

SEQ ID NO: 3480131 - RNA, 16 nt, Pseudomonas aeruginosa PA01
ucgcggcaucccgccc

SEQ ID NO: 3480132 - RNA, 19 nt, Pseudomonas aeruginosa PA01
ucgcggccagccgcuagcg

SEQ ID NO: 3480133 - RNA, 20 nt, Pseudomonas aeruginosa PA01
ucgcggccagccgcuagcgg

SEQ ID NO: 3480134 - RNA, 17 nt, Pseudomonas aeruginosa PA01
ucgcggccaucggcgaa

SEQ ID NO: 3480135 - RNA, 13 nt, Pseudomonas aeruginosa PA01
ucgcggcccuggu

SEQ ID NO: 3480136 - RNA, 19 nt, Pseudomonas aeruginosa PA01
ucgcggccucuucgucggc

SEQ ID NO: 3480137 - RNA, 21 nt, Pseudomonas aeruginosa PA01
ucgcggccucuucgucggcga

SEQ ID NO: 3480138 - RNA, 22 nt, Pseudomonas aeruginosa PA01
ucgcggccuucucgucgccgcc

SEQ ID NO: 3480139 - RNA, 22 nt, Pseudomonas aeruginosa PA01
ucgcggcgacgaucacccccag

SEQ ID NO: 3480140 - RNA, 13 nt, Pseudomonas aeruginosa PA01
ucgcggcgaugcg

SEQ ID NO: 3480141 - RNA, 12 nt, Pseudomonas aeruginosa PA01
ucgcggcgcagu

SEQ ID NO: 3480142 - RNA, 14 nt, Pseudomonas aeruginosa PA01
ucgcggcgcaguuc

SEQ ID NO: 3480143 - RNA, 12 nt, Pseudomonas aeruginosa PA01
ucgcggcgcgag

SEQ ID NO: 3480144 - RNA, 22 nt, Pseudomonas aeruginosa PA01
ucgcggcgcgauauccgccagg

SEQ ID NO: 3480145 - RNA, 12 nt, Pseudomonas aeruginosa PA01
ucgcggcgcggc

SEQ ID NO: 3480146 - RNA, 15 nt, Pseudomonas aeruginosa PA01
ucgcggcgcggcggg

SEQ ID NO: 3480147 - RNA, 20 nt, Pseudomonas aeruginosa PA01
ucgcggcggaugccggcgcu

SEQ ID NO: 3480148 - RNA, 12 nt, Pseudomonas aeruginosa PA01
ucgcggcggcag

SEQ ID NO: 3480149 - RNA, 17 nt, Pseudomonas aeruginosa PA01
ucgcggcguaggcgcgc

SEQ ID NO: 3480150 - RNA, 21 nt, Pseudomonas aeruginosa PA01
ucgcggcguaggcgcgccaag

SEQ ID NO: 3480151 - RNA, 12 nt, Pseudomonas aeruginosa PA01
ucgcggcugaag

SEQ ID NO: 3480152 - RNA, 17 nt, Pseudomonas aeruginosa PA01
ucgcggcugaagaagcu

SEQ ID NO: 3480153 - RNA, 14 nt, Pseudomonas aeruginosa PA01
ucgcggcugaaggc

SEQ ID NO: 3480154 - RNA, 16 nt, Pseudomonas aeruginosa PA01
ucgcggcugcgcgccg

SEQ ID NO: 3480155 - RNA, 13 nt, Pseudomonas aeruginosa PA01
ucgcggcuggccg

SEQ ID NO: 3480156 - RNA, 14 nt, Pseudomonas aeruginosa PA01
ucgcggcuggccgc

SEQ ID NO: 3480157 - RNA, 22 nt, Pseudomonas aeruginosa PA01
ucgcggcuggccgccuggccgg

SEQ ID NO: 3480158 - RNA, 17 nt, Pseudomonas aeruginosa PA01
ucgcggcuuucuuccag

SEQ ID NO: 3480159 - RNA, 16 nt, Pseudomonas aeruginosa PA01
ucgcgggaacggcgua

SEQ ID NO: 3480160 - RNA, 18 nt, Pseudomonas aeruginosa PA01
ucgcgggccaggccgagc

SEQ ID NO: 3480161 - RNA, 13 nt, Pseudomonas aeruginosa PA01
ucgcgggccgccu

SEQ ID NO: 3480162 - RNA, 15 nt, Pseudomonas aeruginosa PA01
ucgcgggccgcggcg

SEQ ID NO: 3480163 - RNA, 16 nt, Pseudomonas aeruginosa PA01
ucgcgggccugggcau

SEQ ID NO: 3480164 - RNA, 22 nt, Pseudomonas aeruginosa PA01
ucgcgggcgauggcccguucca

SEQ ID NO: 3480165 - RNA, 20 nt, Pseudomonas aeruginosa PA01
ucgcgggcgugcuccagcac

SEQ ID NO: 3480166 - RNA, 17 nt, Pseudomonas aeruginosa PA01
ucgcgggcuaccaggaa

SEQ ID NO: 3480167 - RNA, 20 nt, Pseudomonas aeruginosa PA01
ucgcggggcuugcgccccca

SEQ ID NO: 3480168 - RNA, 19 nt, Pseudomonas aeruginosa PA01
ucgcggggcuuuccgucuc

SEQ ID NO: 3480169 - RNA, 21 nt, Pseudomonas aeruginosa PA01
ucgcggggcuuuucauuaccg

SEQ ID NO: 3480170 - RNA, 16 nt, Pseudomonas aeruginosa PA01
ucgcgggucaccaccg

SEQ ID NO: 3480171 - RNA, 18 nt, Pseudomonas aeruginosa PA01
ucgcgggugaccuggccg

SEQ ID NO: 3480172 - RNA, 20 nt, Pseudomonas aeruginosa PA01
ucgcggguucgagucccguc

SEQ ID NO: 3480173 - RNA, 17 nt, Pseudomonas aeruginosa PA01
ucgcgguaggccagcuc

SEQ ID NO: 3480174 - RNA, 17 nt, Pseudomonas aeruginosa PA01
ucgcggucaucgccggc

SEQ ID NO: 3480175 - RNA, 21 nt, Pseudomonas aeruginosa PA01
ucgcgguccagggugaucgac

SEQ ID NO: 3480176 - RNA, 23 nt, Pseudomonas aeruginosa PA01
ucgcggucccgggaaaccaccag

SEQ ID NO: 3480177 - RNA, 18 nt, Pseudomonas aeruginosa PA01
ucgcggucuuccgccgac

SEQ ID NO: 3480178 - RNA, 21 nt, Pseudomonas aeruginosa PA01
ucgcggugcaguucgccguuc

SEQ ID NO: 3480179 - RNA, 22 nt, Pseudomonas aeruginosa PA01
ucgcgguggaugccgguggcgc

SEQ ID NO: 3480180 - RNA, 17 nt, Pseudomonas aeruginosa PA01
ucgcgguuauccgccgc

SEQ ID NO: 3480181 - RNA, 18 nt, Pseudomonas aeruginosa PA01
ucgcgguuauccgccgcc

SEQ ID NO: 3480182 - RNA, 19 nt, Pseudomonas aeruginosa PA01
ucgcgguuauccgccgccu

SEQ ID NO: 3480183 - RNA, 20 nt, Pseudomonas aeruginosa PA01
ucgcgguuauccgccgccua

SEQ ID NO: 3480184 - RNA, 13 nt, Pseudomonas aeruginosa PA01
ucgcgguucugcu

SEQ ID NO: 3480185 - RNA, 17 nt, Pseudomonas aeruginosa PA01
ucgcgguugcgcugcuu

SEQ ID NO: 3480186 - RNA, 16 nt, Pseudomonas aeruginosa PA01
ucgcguacagcgggcc

SEQ ID NO: 3480187 - RNA, 21 nt, Pseudomonas aeruginosa PA01
ucgcguacagcgggccgggga

SEQ ID NO: 3480188 - RNA, 15 nt, Pseudomonas aeruginosa PA01
ucgcguagcugggcg

SEQ ID NO: 3480189 - RNA, 20 nt, Pseudomonas aeruginosa PA01
ucgcguagggcgacggcgcu

SEQ ID NO: 3480190 - RNA, 21 nt, Pseudomonas aeruginosa PA01
ucgcguagggcgacggcgcuu

SEQ ID NO: 3480191 - RNA, 21 nt, Pseudomonas aeruginosa PA01
ucgcguagggcgcauaaccgc

SEQ ID NO: 3480192 - RNA, 21 nt, Pseudomonas aeruginosa PA01
ucgcguagggcguauaaccgc

SEQ ID NO: 3480193 - RNA, 15 nt, Pseudomonas aeruginosa PA01
ucgcguagguggcgc

SEQ ID NO: 3480194 - RNA, 19 nt, Pseudomonas aeruginosa PA01
ucgcguagguggcgccgcc

SEQ ID NO: 3480195 - RNA, 12 nt, Pseudomonas aeruginosa PA01
ucgcguccaggg

SEQ ID NO: 3480196 - RNA, 20 nt, Pseudomonas aeruginosa PA01
ucgcguccgcaguucgcccc

SEQ ID NO: 3480197 - RNA, 17 nt, Pseudomonas aeruginosa PA01
ucgcgucgcaggcgaug

SEQ ID NO: 3480198 - RNA, 21 nt, Pseudomonas aeruginosa PA01
ucgcgucgcaggcgaugccga

SEQ ID NO: 3480199 - RNA, 22 nt, Pseudomonas aeruginosa PA01
ucgcgucgccgaacuccgagca

SEQ ID NO: 3480200 - RNA, 20 nt, Pseudomonas aeruginosa PA01
ucgcgucggccuggcgcagc

SEQ ID NO: 3480201 - RNA, 21 nt, Pseudomonas aeruginosa PA01
ucgcgucggccuggcgcagcg

SEQ ID NO: 3480202 - RNA, 14 nt, Pseudomonas aeruginosa PA01
ucgcgugcgcuggu

SEQ ID NO: 3480203 - RNA, 15 nt, Pseudomonas aeruginosa PA01
ucgcgugcgcuggua

SEQ ID NO: 3480204 - RNA, 22 nt, Pseudomonas aeruginosa PA01
ucgcgugcuccgugucggcggc

SEQ ID NO: 3480205 - RNA, 14 nt, Pseudomonas aeruginosa PA01
ucgcguggcccggc

SEQ ID NO: 3480206 - RNA, 15 nt, Pseudomonas aeruginosa PA01
ucgcguggcccggcg

SEQ ID NO: 3480207 - RNA, 21 nt, Pseudomonas aeruginosa PA01
ucgcguggcccggcgcggcgg

SEQ ID NO: 3480208 - RNA, 14 nt, Pseudomonas aeruginosa PA01
ucgcguggcugccg

SEQ ID NO: 3480209 - RNA, 13 nt, Pseudomonas aeruginosa PA01
ucgcgugggccac

SEQ ID NO: 3480210 - RNA, 17 nt, Pseudomonas aeruginosa PA01
ucgcgugggccaccauc

SEQ ID NO: 3480211 - RNA, 19 nt, Pseudomonas aeruginosa PA01
ucgcgugggccaccaucag

SEQ ID NO: 3480212 - RNA, 15 nt, Pseudomonas aeruginosa PA01
ucgcgugggccaggg

SEQ ID NO: 3480213 - RNA, 20 nt, Pseudomonas aeruginosa PA01
ucgcguuccagcaacggcuu

SEQ ID NO: 3480214 - RNA, 22 nt, Pseudomonas aeruginosa PA01
ucgcguuccagcaacggcuuga

SEQ ID NO: 3480215 - RNA, 14 nt, Pseudomonas aeruginosa PA01
ucgcguuccagcac

SEQ ID NO: 3480216 - RNA, 15 nt, Pseudomonas aeruginosa PA01
ucgcguucgcuccgg

SEQ ID NO: 3480217 - RNA, 16 nt, Pseudomonas aeruginosa PA01
ucgcguucgcuccggg

SEQ ID NO: 3480218 - RNA, 14 nt, Pseudomonas aeruginosa PA01
ucgcguucgucggc

SEQ ID NO: 3480219 - RNA, 17 nt, Pseudomonas aeruginosa PA01
ucgcguugcaggcgacg

SEQ ID NO: 3480220 - RNA, 17 nt, Pseudomonas aeruginosa PA01
ucgcguuggcggugccg

SEQ ID NO: 3480221 - RNA, 16 nt, Pseudomonas aeruginosa PA01
ucgcucaacggcgugc

SEQ ID NO: 3480222 - RNA, 18 nt, Pseudomonas aeruginosa PA01
ucgcucaacggcgugccg

SEQ ID NO: 3480223 - RNA, 16 nt, Pseudomonas aeruginosa PA01
ucgcucaggccucgag

SEQ ID NO: 3480224 - RNA, 19 nt, Pseudomonas aeruginosa PA01
ucgcuccaacgcaggcgca

SEQ ID NO: 3480225 - RNA, 17 nt, Pseudomonas aeruginosa PA01
ucgcuccagaccuccag

SEQ ID NO: 3480226 - RNA, 21 nt, Pseudomonas aeruginosa PA01
ucgcuccagccccacuggaag

SEQ ID NO: 3480227 - RNA, 15 nt, Pseudomonas aeruginosa PA01
ucgcucccaggcuca

SEQ ID NO: 3480228 - RNA, 12 nt, Pseudomonas aeruginosa PA01
ucgcuccgagca

SEQ ID NO: 3480229 - RNA, 15 nt, Pseudomonas aeruginosa PA01
ucgcuccgagcaggc

SEQ ID NO: 3480230 - RNA, 16 nt, Pseudomonas aeruginosa PA01
ucgcuccgagcaggcc

SEQ ID NO: 3480231 - RNA, 23 nt, Pseudomonas aeruginosa PA01
ucgcuccgcuaagcgucacuccc

SEQ ID NO: 3480232 - RNA, 12 nt, Pseudomonas aeruginosa PA01
ucgcuccgggcc

SEQ ID NO: 3480233 - RNA, 23 nt, Pseudomonas aeruginosa PA01
ucgcuccucagaggcgaccagcc

SEQ ID NO: 3480234 - RNA, 11 nt, Pseudomonas aeruginosa PA01
ucgcucgcgca

SEQ ID NO: 3480235 - RNA, 12 nt, Pseudomonas aeruginosa PA01
ucgcucgcgcag

SEQ ID NO: 3480236 - RNA, 18 nt, Pseudomonas aeruginosa PA01
ucgcucgcuucagcgagc

SEQ ID NO: 3480237 - RNA, 19 nt, Pseudomonas aeruginosa PA01
ucgcucucgaacaccggcg

SEQ ID NO: 3480238 - RNA, 17 nt, Pseudomonas aeruginosa PA01
ucgcucugcgccaggcg

SEQ ID NO: 3480239 - RNA, 15 nt, Pseudomonas aeruginosa PA01
ucgcucugcgccgcg

SEQ ID NO: 3480240 - RNA, 17 nt, Pseudomonas aeruginosa PA01
ucgcucugcgccgcggc

SEQ ID NO: 3480241 - RNA, 18 nt, Pseudomonas aeruginosa PA01
ucgcucugcgccgcggcg

SEQ ID NO: 3480242 - RNA, 11 nt, Pseudomonas aeruginosa PA01
ucgcucugcug

SEQ ID NO: 3480243 - RNA, 13 nt, Pseudomonas aeruginosa PA01
ucgcucugcugaa

SEQ ID NO: 3480244 - RNA, 18 nt, Pseudomonas aeruginosa PA01
ucgcugaaauccaccagc

SEQ ID NO: 3480245 - RNA, 20 nt, Pseudomonas aeruginosa PA01
ucgcugaaauccaccagcac

SEQ ID NO: 3480246 - RNA, 21 nt, Pseudomonas aeruginosa PA01
ucgcugaaauccaccagcacg

SEQ ID NO: 3480247 - RNA, 20 nt, Pseudomonas aeruginosa PA01
ucgcugaaggucgccgcgcu

SEQ ID NO: 3480248 - RNA, 17 nt, Pseudomonas aeruginosa PA01
ucgcugaccagcccggc

SEQ ID NO: 3480249 - RNA, 20 nt, Pseudomonas aeruginosa PA01
ucgcugaccagcccggcggc

SEQ ID NO: 3480250 - RNA, 22 nt, Pseudomonas aeruginosa PA01
ucgcugaccagcccggcggcgg

SEQ ID NO: 3480251 - RNA, 21 nt, Pseudomonas aeruginosa PA01
ucgcugaccggccgcagcagg

SEQ ID NO: 3480252 - RNA, 19 nt, Pseudomonas aeruginosa PA01
ucgcugacgccauucaggc

SEQ ID NO: 3480253 - RNA, 22 nt, Pseudomonas aeruginosa PA01
ucgcugacgccauucaggcgga

SEQ ID NO: 3480254 - RNA, 19 nt, Pseudomonas aeruginosa PA01
ucgcugacuuccaucagcu

SEQ ID NO: 3480255 - RNA, 20 nt, Pseudomonas aeruginosa PA01
ucgcugagaccgauccagca

SEQ ID NO: 3480256 - RNA, 22 nt, Pseudomonas aeruginosa PA01
ucgcugagcaguugcgggcgca

SEQ ID NO: 3480257 - RNA, 14 nt, Pseudomonas aeruginosa PA01
ucgcugagcggcug

SEQ ID NO: 3480258 - RNA, 19 nt, Pseudomonas aeruginosa PA01
ucgcugaguuugcccagcg

SEQ ID NO: 3480259 - RNA, 13 nt, Pseudomonas aeruginosa PA01
ucgcugaucucgg

SEQ ID NO: 3480260 - RNA, 18 nt, Pseudomonas aeruginosa PA01
ucgcugaugugccgcacg

SEQ ID NO: 3480261 - RNA, 20 nt, Pseudomonas aeruginosa PA01
ucgcugcacgcacgcgccug

SEQ ID NO: 3480262 - RNA, 17 nt, Pseudomonas aeruginosa PA01
ucgcugcccaucgccuc

SEQ ID NO: 3480263 - RNA, 17 nt, Pseudomonas aeruginosa PA01
ucgcugcccucgaccag

SEQ ID NO: 3480264 - RNA, 22 nt, Pseudomonas aeruginosa PA01
ucgcugccgaacagacgggaca

SEQ ID NO: 3480265 - RNA, 14 nt, Pseudomonas aeruginosa PA01
ucgcugccgccgca

SEQ ID NO: 3480266 - RNA, 16 nt, Pseudomonas aeruginosa PA01
ucgcugccgccgcaga

SEQ ID NO: 3480267 - RNA, 15 nt, Pseudomonas aeruginosa PA01
ucgcugccgccgcgc

SEQ ID NO: 3480268 - RNA, 16 nt, Pseudomonas aeruginosa PA01
ucgcugccgccgcgcu

SEQ ID NO: 3480269 - RNA, 13 nt, Pseudomonas aeruginosa PA01
ucgcugccggcgc

SEQ ID NO: 3480270 - RNA, 23 nt, Pseudomonas aeruginosa PA01
ucgcugccggucaggcuggugcc

SEQ ID NO: 3480271 - RNA, 14 nt, Pseudomonas aeruginosa PA01
ucgcugccugggga

SEQ ID NO: 3480272 - RNA, 13 nt, Pseudomonas aeruginosa PA01
ucgcugcgcgcca

SEQ ID NO: 3480273 - RNA, 22 nt, Pseudomonas aeruginosa PA01
ucgcugcgcgccaucuccucgc

SEQ ID NO: 3480274 - RNA, 12 nt, Pseudomonas aeruginosa PA01
ucgcugcgcggg

SEQ ID NO: 3480275 - RNA, 15 nt, Pseudomonas aeruginosa PA01
ucgcugcucagggcc

SEQ ID NO: 3480276 - RNA, 19 nt, Pseudomonas aeruginosa PA01
ucgcugcucagggccgcgc

SEQ ID NO: 3480277 - RNA, 12 nt, Pseudomonas aeruginosa PA01
ucgcuggccagc

SEQ ID NO: 3480278 - RNA, 14 nt, Pseudomonas aeruginosa PA01
ucgcuggccugcag

SEQ ID NO: 3480279 - RNA, 18 nt, Pseudomonas aeruginosa PA01
ucgcuggccugcaggucc

SEQ ID NO: 3480280 - RNA, 22 nt, Pseudomonas aeruginosa PA01
ucgcuggccugggguagccggc

SEQ ID NO: 3480281 - RNA, 13 nt, Pseudomonas aeruginosa PA01
ucgcuggcggaga

SEQ ID NO: 3480282 - RNA, 16 nt, Pseudomonas aeruginosa PA01
ucgcuggcgucgaccg

SEQ ID NO: 3480283 - RNA, 21 nt, Pseudomonas aeruginosa PA01
ucgcugggcgccggcaggccu

SEQ ID NO: 3480284 - RNA, 17 nt, Pseudomonas aeruginosa PA01
ucgcugggcgccucguc

SEQ ID NO: 3480285 - RNA, 15 nt, Pseudomonas aeruginosa PA01
ucgcuggggugcaga

SEQ ID NO: 3480286 - RNA, 17 nt, Pseudomonas aeruginosa PA01
ucgcuguagcggcucgc

SEQ ID NO: 3480287 - RNA, 21 nt, Pseudomonas aeruginosa PA01
ucgcuguagcggcucgccgaa

SEQ ID NO: 3480288 - RNA, 22 nt, Pseudomonas aeruginosa PA01
ucgcuguagcggcucgccgaaa

SEQ ID NO: 3480289 - RNA, 13 nt, Pseudomonas aeruginosa PA01
ucgcugucagggc

SEQ ID NO: 3480290 - RNA, 16 nt, Pseudomonas aeruginosa PA01
ucgcugucagggcuug

SEQ ID NO: 3480291 - RNA, 16 nt, Pseudomonas aeruginosa PA01
ucgcugucgagcaggg

SEQ ID NO: 3480292 - RNA, 18 nt, Pseudomonas aeruginosa PA01
ucgcugucgccgagcacc

SEQ ID NO: 3480293 - RNA, 14 nt, Pseudomonas aeruginosa PA01
ucgcuguucuucag

SEQ ID NO: 3480294 - RNA, 14 nt, Pseudomonas aeruginosa PA01
ucgcuguuggucug

SEQ ID NO: 3480295 - RNA, 23 nt, Pseudomonas aeruginosa PA01
ucgcuuagaacggaaugucgucg

SEQ ID NO: 3480296 - RNA, 16 nt, Pseudomonas aeruginosa PA01
ucgcuucggccaccag

SEQ ID NO: 3480297 - RNA, 22 nt, Pseudomonas aeruginosa PA01
ucgcuuucagcaaucaggaacg

SEQ ID NO: 3480298 - RNA, 24 nt, Pseudomonas aeruginosa PA01
ucgcuuuccuggccgacccgcagc

SEQ ID NO: 3480299 - RNA, 14 nt, Pseudomonas aeruginosa PA01
ucgcuuuuuccgcu

SEQ ID NO: 3480300 - RNA, 18 nt, Pseudomonas aeruginosa PA01
ucggaaagcagggcgaug

SEQ ID NO: 3480301 - RNA, 19 nt, Pseudomonas aeruginosa PA01
ucggaaagcagggcgaugg

SEQ ID NO: 3480302 - RNA, 15 nt, Pseudomonas aeruginosa PA01
ucggaaucggcgauc

SEQ ID NO: 3480303 - RNA, 16 nt, Pseudomonas aeruginosa PA01
ucggacaagggccaga

SEQ ID NO: 3480304 - RNA, 20 nt, Pseudomonas aeruginosa PA01
ucggacaagggccagagcac

SEQ ID NO: 3480305 - RNA, 18 nt, Pseudomonas aeruginosa PA01
ucggaccagaggcugacc

SEQ ID NO: 3480306 - RNA, 12 nt, Pseudomonas aeruginosa PA01
ucggaccugucc

SEQ ID NO: 3480307 - RNA, 13 nt, Pseudomonas aeruginosa PA01
ucggacgaucgac

SEQ ID NO: 3480308 - RNA, 16 nt, Pseudomonas aeruginosa PA01
ucggacggcucgcgca

SEQ ID NO: 3480309 - RNA, 22 nt, Pseudomonas aeruginosa PA01
ucggacggcucgcgcagcggcg

SEQ ID NO: 3480310 - RNA, 14 nt, Pseudomonas aeruginosa PA01
ucggagaacagcag

SEQ ID NO: 3480311 - RNA, 18 nt, Pseudomonas aeruginosa PA01
ucggagaacagcagcggc

SEQ ID NO: 3480312 - RNA, 15 nt, Pseudomonas aeruginosa PA01
ucggagaaguaguca

SEQ ID NO: 3480313 - RNA, 22 nt, Pseudomonas aeruginosa PA01
ucggagagcagccaagccacca

SEQ ID NO: 3480314 - RNA, 23 nt, Pseudomonas aeruginosa PA01
ucggagagcagccaagccaccag

SEQ ID NO: 3480315 - RNA, 18 nt, Pseudomonas aeruginosa PA01
ucggagauagccuccucc

SEQ ID NO: 3480316 - RNA, 20 nt, Pseudomonas aeruginosa PA01
ucggagugaggccgagccga

SEQ ID NO: 3480317 - RNA, 16 nt, Pseudomonas aeruginosa PA01
ucggagugcaugccgg

SEQ ID NO: 3480318 - RNA, 22 nt, Pseudomonas aeruginosa PA01
ucggauaccagaucaccaccac

SEQ ID NO: 3480319 - RNA, 22 nt, Pseudomonas aeruginosa PA01
ucggauacggcaggguagccac

SEQ ID NO: 3480320 - RNA, 15 nt, Pseudomonas aeruginosa PA01
ucggauagucggaac

SEQ ID NO: 3480321 - RNA, 20 nt, Pseudomonas aeruginosa PA01
ucggaucaggcgggcuccgc

SEQ ID NO: 3480322 - RNA, 19 nt, Pseudomonas aeruginosa PA01
ucggaucggauagccgugc

SEQ ID NO: 3480323 - RNA, 23 nt, Pseudomonas aeruginosa PA01
ucggaucggauagccgugcagca

SEQ ID NO: 3480324 - RNA, 18 nt, Pseudomonas aeruginosa PA01
ucggaugcacgugcagcu

SEQ ID NO: 3480325 - RNA, 13 nt, Pseudomonas aeruginosa PA01
ucggaugccgcac

SEQ ID NO: 3480326 - RNA, 22 nt, Pseudomonas aeruginosa PA01
ucggauggccguccaggcugcc

SEQ ID NO: 3480327 - RNA, 13 nt, Pseudomonas aeruginosa PA01
ucggcaaccgggc

SEQ ID NO: 3480328 - RNA, 15 nt, Pseudomonas aeruginosa PA01
ucggcaacgagcagg

SEQ ID NO: 3480329 - RNA, 16 nt, Pseudomonas aeruginosa PA01
ucggcaacuggcuggc

SEQ ID NO: 3480330 - RNA, 16 nt, Pseudomonas aeruginosa PA01
ucggcaagcaggccgc

SEQ ID NO: 3480331 - RNA, 18 nt, Pseudomonas aeruginosa PA01
ucggcaauucuucaaggu

SEQ ID NO: 3480332 - RNA, 22 nt, Pseudomonas aeruginosa PA01
ucggcaauucuucaaggucugc

SEQ ID NO: 3480333 - RNA, 22 nt, Pseudomonas aeruginosa PA01
ucggcaccagggcuucgcgcag

SEQ ID NO: 3480334 - RNA, 19 nt, Pseudomonas aeruginosa PA01
ucggcaccaucaccgacag

SEQ ID NO: 3480335 - RNA, 20 nt, Pseudomonas aeruginosa PA01
ucggcaccccuucgagcaac

SEQ ID NO: 3480336 - RNA, 18 nt, Pseudomonas aeruginosa PA01
ucggcaccgaucgcccgc

SEQ ID NO: 3480337 - RNA, 19 nt, Pseudomonas aeruginosa PA01
ucggcaccgaucgcccgcg

SEQ ID NO: 3480338 - RNA, 22 nt, Pseudomonas aeruginosa PA01
ucggcaccgaucgcccgcgccu

SEQ ID NO: 3480339 - RNA, 13 nt, Pseudomonas aeruginosa PA01
ucggcaccugcag

SEQ ID NO: 3480340 - RNA, 19 nt, Pseudomonas aeruginosa PA01
ucggcacgaugucgaccug

SEQ ID NO: 3480341 - RNA, 14 nt, Pseudomonas aeruginosa PA01
ucggcacgcagcag

SEQ ID NO: 3480342 - RNA, 15 nt, Pseudomonas aeruginosa PA01
ucggcacgcagcagc

SEQ ID NO: 3480343 - RNA, 18 nt, Pseudomonas aeruginosa PA01
ucggcacgcagcagcuuc

SEQ ID NO: 3480344 - RNA, 19 nt, Pseudomonas aeruginosa PA01
ucggcacucagccagcggc

SEQ ID NO: 3480345 - RNA, 20 nt, Pseudomonas aeruginosa PA01
ucggcacucagccagcggcg

SEQ ID NO: 3480346 - RNA, 22 nt, Pseudomonas aeruginosa PA01
ucggcacucagccagcggcgcu

SEQ ID NO: 3480347 - RNA, 14 nt, Pseudomonas aeruginosa PA01
ucggcacucaggaa

SEQ ID NO: 3480348 - RNA, 19 nt, Pseudomonas aeruginosa PA01
ucggcacuccguugaccug

SEQ ID NO: 3480349 - RNA, 17 nt, Pseudomonas aeruginosa PA01
ucggcagcaucagccgc

SEQ ID NO: 3480350 - RNA, 18 nt, Pseudomonas aeruginosa PA01
ucggcagcaucagccgcg

SEQ ID NO: 3480351 - RNA, 22 nt, Pseudomonas aeruginosa PA01
ucggcagcaucagccgcgacga

SEQ ID NO: 3480352 - RNA, 18 nt, Pseudomonas aeruginosa PA01
ucggcagccguccgccca

SEQ ID NO: 3480353 - RNA, 13 nt, Pseudomonas aeruginosa PA01
ucggcagcgcugg

SEQ ID NO: 3480354 - RNA, 15 nt, Pseudomonas aeruginosa PA01
ucggcagcgcuggcg

SEQ ID NO: 3480355 - RNA, 19 nt, Pseudomonas aeruginosa PA01
ucggcagcggauccgggug

SEQ ID NO: 3480356 - RNA, 18 nt, Pseudomonas aeruginosa PA01
ucggcagcgucgagcugg

SEQ ID NO: 3480357 - RNA, 21 nt, Pseudomonas aeruginosa PA01
ucggcagcucgcuaugcagca

SEQ ID NO: 3480358 - RNA, 23 nt, Pseudomonas aeruginosa PA01
ucggcagcucuaccgagaucacc

SEQ ID NO: 3480359 - RNA, 18 nt, Pseudomonas aeruginosa PA01
ucggcaggaaggccugga

SEQ ID NO: 3480360 - RNA, 15 nt, Pseudomonas aeruginosa PA01
ucggcagggcgcccg

SEQ ID NO: 3480361 - RNA, 18 nt, Pseudomonas aeruginosa PA01
ucggcagggcgcccgccc

SEQ ID NO: 3480362 - RNA, 19 nt, Pseudomonas aeruginosa PA01
ucggcagggcgcccgcccg

SEQ ID NO: 3480363 - RNA, 15 nt, Pseudomonas aeruginosa PA01
ucggcagggcgccga

SEQ ID NO: 3480364 - RNA, 17 nt, Pseudomonas aeruginosa PA01
ucggcagguugcucgcc

SEQ ID NO: 3480365 - RNA, 18 nt, Pseudomonas aeruginosa PA01
ucggcagguugcucgccu

SEQ ID NO: 3480366 - RNA, 19 nt, Pseudomonas aeruginosa PA01
ucggcagguugcucgccuu

SEQ ID NO: 3480367 - RNA, 16 nt, Pseudomonas aeruginosa PA01
ucggcaguacgcucug

SEQ ID NO: 3480368 - RNA, 13 nt, Pseudomonas aeruginosa PA01
ucggcagucgccg

SEQ ID NO: 3480369 - RNA, 15 nt, Pseudomonas aeruginosa PA01
ucggcagucgccgca

SEQ ID NO: 3480370 - RNA, 17 nt, Pseudomonas aeruginosa PA01
ucggcagucgccgcacc

SEQ ID NO: 3480371 - RNA, 17 nt, Pseudomonas aeruginosa PA01
ucggcaucaaucgcugg

SEQ ID NO: 3480372 - RNA, 20 nt, Pseudomonas aeruginosa PA01
ucggcauccaguucguucug

SEQ ID NO: 3480373 - RNA, 12 nt, Pseudomonas aeruginosa PA01
ucggcauccggc

SEQ ID NO: 3480374 - RNA, 17 nt, Pseudomonas aeruginosa PA01
ucggcauccggcaggcg

SEQ ID NO: 3480375 - RNA, 13 nt, Pseudomonas aeruginosa PA01
ucggcauccucgc

SEQ ID NO: 3480376 - RNA, 19 nt, Pseudomonas aeruginosa PA01
ucggcauccucgccccgcc

SEQ ID NO: 3480377 - RNA, 15 nt, Pseudomonas aeruginosa PA01
ucggcaucgaccagg

SEQ ID NO: 3480378 - RNA, 16 nt, Pseudomonas aeruginosa PA01
ucggcaucgaccaggg

SEQ ID NO: 3480379 - RNA, 20 nt, Pseudomonas aeruginosa PA01
ucggcaucgaccagggccgg

SEQ ID NO: 3480380 - RNA, 23 nt, Pseudomonas aeruginosa PA01
ucggcaucgaccagggccggguc

SEQ ID NO: 3480381 - RNA, 21 nt, Pseudomonas aeruginosa PA01
ucggcaucgucgaagcugagg

SEQ ID NO: 3480382 - RNA, 14 nt, Pseudomonas aeruginosa PA01
ucggcauggccacg

SEQ ID NO: 3480383 - RNA, 15 nt, Pseudomonas aeruginosa PA01
ucggcauggccacgc

SEQ ID NO: 3480384 - RNA, 17 nt, Pseudomonas aeruginosa PA01
ucggcauggccgaccgc

SEQ ID NO: 3480385 - RNA, 18 nt, Pseudomonas aeruginosa PA01
ucggcauggccgaccgcc

SEQ ID NO: 3480386 - RNA, 13 nt, Pseudomonas aeruginosa PA01
ucggcaugguccg

SEQ ID NO: 3480387 - RNA, 21 nt, Pseudomonas aeruginosa PA01
ucggcauucgacccgccgacc

SEQ ID NO: 3480388 - RNA, 17 nt, Pseudomonas aeruginosa PA01
ucggcauuggugcugcc

SEQ ID NO: 3480389 - RNA, 15 nt, Pseudomonas aeruginosa PA01
ucggccaacggccgc

SEQ ID NO: 3480390 - RNA, 12 nt, Pseudomonas aeruginosa PA01
ucggccaccacc

SEQ ID NO: 3480391 - RNA, 14 nt, Pseudomonas aeruginosa PA01
ucggccaccaccac

SEQ ID NO: 3480392 - RNA, 20 nt, Pseudomonas aeruginosa PA01
ucggccaccagggugcgaug

SEQ ID NO: 3480393 - RNA, 21 nt, Pseudomonas aeruginosa PA01
ucggccaccgaaucgaugcug

SEQ ID NO: 3480394 - RNA, 18 nt, Pseudomonas aeruginosa PA01
ucggccaccugcuccggc

SEQ ID NO: 3480395 - RNA, 17 nt, Pseudomonas aeruginosa PA01
ucggccaccuucgcccg

SEQ ID NO: 3480396 - RNA, 22 nt, Pseudomonas aeruginosa PA01
ucggccaccuucgcccgcugcg

SEQ ID NO: 3480397 - RNA, 15 nt, Pseudomonas aeruginosa PA01
ucggccacuaucgcc

SEQ ID NO: 3480398 - RNA, 15 nt, Pseudomonas aeruginosa PA01
ucggccacuccagcc

SEQ ID NO: 3480399 - RNA, 18 nt, Pseudomonas aeruginosa PA01
ucggccacuccagccccg

SEQ ID NO: 3480400 - RNA, 19 nt, Pseudomonas aeruginosa PA01
ucggccacuccagccccgc

SEQ ID NO: 3480401 - RNA, 13 nt, Pseudomonas aeruginosa PA01
ucggccagcagca

SEQ ID NO: 3480402 - RNA, 19 nt, Pseudomonas aeruginosa PA01
ucggccagcagcaugggau

SEQ ID NO: 3480403 - RNA, 16 nt, Pseudomonas aeruginosa PA01
ucggccagccagggca

SEQ ID NO: 3480404 - RNA, 19 nt, Pseudomonas aeruginosa PA01
ucggccagccagggcagca

SEQ ID NO: 3480405 - RNA, 15 nt, Pseudomonas aeruginosa PA01
ucggccagccccugc

SEQ ID NO: 3480406 - RNA, 16 nt, Pseudomonas aeruginosa PA01
ucggccagccccugcg

SEQ ID NO: 3480407 - RNA, 15 nt, Pseudomonas aeruginosa PA01
ucggccagcgccgcc

SEQ ID NO: 3480408 - RNA, 16 nt, Pseudomonas aeruginosa PA01
ucggccagcgccgccg

SEQ ID NO: 3480409 - RNA, 21 nt, Pseudomonas aeruginosa PA01
ucggccagcgccgccgcugcg

SEQ ID NO: 3480410 - RNA, 12 nt, Pseudomonas aeruginosa PA01
ucggccagcgcg

SEQ ID NO: 3480411 - RNA, 14 nt, Pseudomonas aeruginosa PA01
ucggccagcgcggc

SEQ ID NO: 3480412 - RNA, 15 nt, Pseudomonas aeruginosa PA01
ucggccagcgcggcg

SEQ ID NO: 3480413 - RNA, 13 nt, Pseudomonas aeruginosa PA01
ucggccagcggca

SEQ ID NO: 3480414 - RNA, 15 nt, Pseudomonas aeruginosa PA01
ucggccagcggcaga

SEQ ID NO: 3480415 - RNA, 10 nt, Pseudomonas aeruginosa PA01
ucggccagga

SEQ ID NO: 3480416 - RNA, 17 nt, Pseudomonas aeruginosa PA01
ucggccaggcgccaggu

SEQ ID NO: 3480417 - RNA, 12 nt, Pseudomonas aeruginosa PA01
ucggccaggcgg

SEQ ID NO: 3480418 - RNA, 20 nt, Pseudomonas aeruginosa PA01
ucggccaggcggccgacgau

SEQ ID NO: 3480419 - RNA, 19 nt, Pseudomonas aeruginosa PA01
ucggccagggagucgcugg

SEQ ID NO: 3480420 - RNA, 20 nt, Pseudomonas aeruginosa PA01
ucggccagggagucgcuggc

SEQ ID NO: 3480421 - RNA, 21 nt, Pseudomonas aeruginosa PA01
ucggccagggagucgcuggcc

SEQ ID NO: 3480422 - RNA, 19 nt, Pseudomonas aeruginosa PA01
ucggccagggccgcucgag

SEQ ID NO: 3480423 - RNA, 22 nt, Pseudomonas aeruginosa PA01
ucggccaggggagcgccggcgc

SEQ ID NO: 3480424 - RNA, 22 nt, Pseudomonas aeruginosa PA01
ucggccagguacuuggccacgc

SEQ ID NO: 3480425 - RNA, 13 nt, Pseudomonas aeruginosa PA01
ucggccaggucgc

SEQ ID NO: 3480426 - RNA, 14 nt, Pseudomonas aeruginosa PA01
ucggccaggucgcg

SEQ ID NO: 3480427 - RNA, 21 nt, Pseudomonas aeruginosa PA01
ucggccaggucgcgggugaag

SEQ ID NO: 3480428 - RNA, 18 nt, Pseudomonas aeruginosa PA01
ucggccaguccggucagc

SEQ ID NO: 3480429 - RNA, 16 nt, Pseudomonas aeruginosa PA01
ucggccaguucgcggc

SEQ ID NO: 3480430 - RNA, 17 nt, Pseudomonas aeruginosa PA01
ucggccaguucgcggcg

SEQ ID NO: 3480431 - RNA, 21 nt, Pseudomonas aeruginosa PA01
ucggccaguucgucgagcaug

SEQ ID NO: 3480432 - RNA, 20 nt, Pseudomonas aeruginosa PA01
ucggccauaccuccagccag

SEQ ID NO: 3480433 - RNA, 13 nt, Pseudomonas aeruginosa PA01
ucggccaucagca

SEQ ID NO: 3480434 - RNA, 18 nt, Pseudomonas aeruginosa PA01
ucggccaucagcgccagg

SEQ ID NO: 3480435 - RNA, 21 nt, Pseudomonas aeruginosa PA01
ucggccaucagcgccagggca

SEQ ID NO: 3480436 - RNA, 14 nt, Pseudomonas aeruginosa PA01
ucggccaucgccgu

SEQ ID NO: 3480437 - RNA, 17 nt, Pseudomonas aeruginosa PA01
ucggccaucuggcugcc

SEQ ID NO: 3480438 - RNA, 18 nt, Pseudomonas aeruginosa PA01
ucggccaugccggccagg

SEQ ID NO: 3480439 - RNA, 13 nt, Pseudomonas aeruginosa PA01
ucggccauggcau

SEQ ID NO: 3480440 - RNA, 22 nt, Pseudomonas aeruginosa PA01
ucggcccaugaaaaagcccggc

SEQ ID NO: 3480441 - RNA, 15 nt, Pseudomonas aeruginosa PA01
ucggccccaccuggc

SEQ ID NO: 3480442 - RNA, 18 nt, Pseudomonas aeruginosa PA01
ucggccccaccuggcgac

SEQ ID NO: 3480443 - RNA, 15 nt, Pseudomonas aeruginosa PA01
ucggccccaggaagg

SEQ ID NO: 3480444 - RNA, 17 nt, Pseudomonas aeruginosa PA01
ucggccccaggaaggag

SEQ ID NO: 3480445 - RNA, 13 nt, Pseudomonas aeruginosa PA01
ucggccccggcca

SEQ ID NO: 3480446 - RNA, 15 nt, Pseudomonas aeruginosa PA01
ucggccccggccagg

SEQ ID NO: 3480447 - RNA, 16 nt, Pseudomonas aeruginosa PA01
ucggcccgacgccgcc

SEQ ID NO: 3480448 - RNA, 18 nt, Pseudomonas aeruginosa PA01
ucggcccgacgccgcccg

SEQ ID NO: 3480449 - RNA, 20 nt, Pseudomonas aeruginosa PA01
ucggcccgcaugaacgccuc

SEQ ID NO: 3480450 - RNA, 17 nt, Pseudomonas aeruginosa PA01
ucggcccggagaccgug

SEQ ID NO: 3480451 - RNA, 16 nt, Pseudomonas aeruginosa PA01
ucggcccgggccuggu

SEQ ID NO: 3480452 - RNA, 17 nt, Pseudomonas aeruginosa PA01
ucggcccgggcgccacc

SEQ ID NO: 3480453 - RNA, 20 nt, Pseudomonas aeruginosa PA01
ucggcccgggcgccaccgcg

SEQ ID NO: 3480454 - RNA, 18 nt, Pseudomonas aeruginosa PA01
ucggcccggggcucugcc

SEQ ID NO: 3480455 - RNA, 12 nt, Pseudomonas aeruginosa PA01
ucggcccuggcg

SEQ ID NO: 3480456 - RNA, 14 nt, Pseudomonas aeruginosa PA01
ucggcccuggcggc

SEQ ID NO: 3480457 - RNA, 16 nt, Pseudomonas aeruginosa PA01
ucggcccuucgacaug

SEQ ID NO: 3480458 - RNA, 21 nt, Pseudomonas aeruginosa PA01
ucggccgacagagcggccggc

SEQ ID NO: 3480459 - RNA, 18 nt, Pseudomonas aeruginosa PA01
ucggccgacaggcuggug

SEQ ID NO: 3480460 - RNA, 22 nt, Pseudomonas aeruginosa PA01
ucggccgaugugaaaacggcgc

SEQ ID NO: 3480461 - RNA, 14 nt, Pseudomonas aeruginosa PA01
ucggccgcaccagg

SEQ ID NO: 3480462 - RNA, 13 nt, Pseudomonas aeruginosa PA01
ucggccgccaggc

SEQ ID NO: 3480463 - RNA, 16 nt, Pseudomonas aeruginosa PA01
ucggccgccaggcugg

SEQ ID NO: 3480464 - RNA, 16 nt, Pseudomonas aeruginosa PA01
ucggccgccagggcgu

SEQ ID NO: 3480465 - RNA, 17 nt, Pseudomonas aeruginosa PA01
ucggccgcccagcggau

SEQ ID NO: 3480466 - RNA, 16 nt, Pseudomonas aeruginosa PA01
ucggccgccuggcgug

SEQ ID NO: 3480467 - RNA, 17 nt, Pseudomonas aeruginosa PA01
ucggccgccuggcgugc

SEQ ID NO: 3480468 - RNA, 18 nt, Pseudomonas aeruginosa PA01
ucggccgccuggcgugcc

SEQ ID NO: 3480469 - RNA, 22 nt, Pseudomonas aeruginosa PA01
ucggccgccuggcgugccgcca

SEQ ID NO: 3480470 - RNA, 13 nt, Pseudomonas aeruginosa PA01
ucggccggcagcu

SEQ ID NO: 3480471 - RNA, 14 nt, Pseudomonas aeruginosa PA01
ucggccggcagcuc

SEQ ID NO: 3480472 - RNA, 16 nt, Pseudomonas aeruginosa PA01
ucggccggcagcuccg

SEQ ID NO: 3480473 - RNA, 19 nt, Pseudomonas aeruginosa PA01
ucggccggcagcuccggcg

SEQ ID NO: 3480474 - RNA, 16 nt, Pseudomonas aeruginosa PA01
ucggccggcaggcugu

SEQ ID NO: 3480475 - RNA, 20 nt, Pseudomonas aeruginosa PA01
ucggccgggauacagcagcc

SEQ ID NO: 3480476 - RNA, 18 nt, Pseudomonas aeruginosa PA01
ucggccggggucaggccg

SEQ ID NO: 3480477 - RNA, 21 nt, Pseudomonas aeruginosa PA01
ucggccggggucaggccgagg

SEQ ID NO: 3480478 - RNA, 22 nt, Pseudomonas aeruginosa PA01
ucggccggggucaggccgaggc

SEQ ID NO: 3480479 - RNA, 23 nt, Pseudomonas aeruginosa PA01
ucggccggggucaggccgaggcg

SEQ ID NO: 3480480 - RNA, 13 nt, Pseudomonas aeruginosa PA01
ucggccucgacga

SEQ ID NO: 3480481 - RNA, 23 nt, Pseudomonas aeruginosa PA01
ucggccucgaucucguccucggc

SEQ ID NO: 3480482 - RNA, 14 nt, Pseudomonas aeruginosa PA01
ucggccucgcggcg

SEQ ID NO: 3480483 - RNA, 15 nt, Pseudomonas aeruginosa PA01
ucggccucgcggcgc

SEQ ID NO: 3480484 - RNA, 12 nt, Pseudomonas aeruginosa PA01
ucggccucggcg

SEQ ID NO: 3480485 - RNA, 14 nt, Pseudomonas aeruginosa PA01
ucggccucggcguc

SEQ ID NO: 3480486 - RNA, 16 nt, Pseudomonas aeruginosa PA01
ucggccucgucgagca

SEQ ID NO: 3480487 - RNA, 20 nt, Pseudomonas aeruginosa PA01
ucggccugaucaucugggcc

SEQ ID NO: 3480488 - RNA, 14 nt, Pseudomonas aeruginosa PA01
ucggccugcaccag

SEQ ID NO: 3480489 - RNA, 15 nt, Pseudomonas aeruginosa PA01
ucggccugcaccagc

SEQ ID NO: 3480490 - RNA, 19 nt, Pseudomonas aeruginosa PA01
ucggccugcucgaacggcg

SEQ ID NO: 3480491 - RNA, 18 nt, Pseudomonas aeruginosa PA01
ucggccugcugcgccggc

SEQ ID NO: 3480492 - RNA, 19 nt, Pseudomonas aeruginosa PA01
ucggccugcugcgccggca

SEQ ID NO: 3480493 - RNA, 18 nt, Pseudomonas aeruginosa PA01
ucggccugcugcucgacc

SEQ ID NO: 3480494 - RNA, 19 nt, Pseudomonas aeruginosa PA01
ucggccugcugcucgaccg

SEQ ID NO: 3480495 - RNA, 15 nt, Pseudomonas aeruginosa PA01
ucggccuggaucgcc

SEQ ID NO: 3480496 - RNA, 19 nt, Pseudomonas aeruginosa PA01
ucggccuggaucgccuugc

SEQ ID NO: 3480497 - RNA, 18 nt, Pseudomonas aeruginosa PA01
ucggccuggcugccgagc

SEQ ID NO: 3480498 - RNA, 19 nt, Pseudomonas aeruginosa PA01
ucggccuggcugccgagca

SEQ ID NO: 3480499 - RNA, 21 nt, Pseudomonas aeruginosa PA01
ucggccuggcugccgagcagg

SEQ ID NO: 3480500 - RNA, 16 nt, Pseudomonas aeruginosa PA01
ucggccugggcgcagg

SEQ ID NO: 3480501 - RNA, 20 nt, Pseudomonas aeruginosa PA01
ucggccugggcgcaggccga

SEQ ID NO: 3480502 - RNA, 21 nt, Pseudomonas aeruginosa PA01
ucggccuggguacgcaccggc

SEQ ID NO: 3480503 - RNA, 22 nt, Pseudomonas aeruginosa PA01
ucggccuggguacgcaccggcu

SEQ ID NO: 3480504 - RNA, 13 nt, Pseudomonas aeruginosa PA01
ucggccugguccg

SEQ ID NO: 3480505 - RNA, 17 nt, Pseudomonas aeruginosa PA01
ucggccugguccggcac

SEQ ID NO: 3480506 - RNA, 17 nt, Pseudomonas aeruginosa PA01
ucggccuggucgucgua

SEQ ID NO: 3480507 - RNA, 17 nt, Pseudomonas aeruginosa PA01
ucggccuggugcaccug

SEQ ID NO: 3480508 - RNA, 19 nt, Pseudomonas aeruginosa PA01
ucggccuggugcaccuggc

SEQ ID NO: 3480509 - RNA, 23 nt, Pseudomonas aeruginosa PA01
ucggccugguuguaggcgccgcc

SEQ ID NO: 3480510 - RNA, 13 nt, Pseudomonas aeruginosa PA01
ucggccuguucgc

SEQ ID NO: 3480511 - RNA, 17 nt, Pseudomonas aeruginosa PA01
ucggccuguucgcccaa

SEQ ID NO: 3480512 - RNA, 16 nt, Pseudomonas aeruginosa PA01
ucggccuuagcgguug

SEQ ID NO: 3480513 - RNA, 21 nt, Pseudomonas aeruginosa PA01
ucggccuugagcgccgaaggc

SEQ ID NO: 3480514 - RNA, 23 nt, Pseudomonas aeruginosa PA01
ucggccuugagcgccgaaggcgu

SEQ ID NO: 3480515 - RNA, 15 nt, Pseudomonas aeruginosa PA01
ucggccuugcuggcg

SEQ ID NO: 3480516 - RNA, 16 nt, Pseudomonas aeruginosa PA01
ucggccuugcuggcga

SEQ ID NO: 3480517 - RNA, 23 nt, Pseudomonas aeruginosa PA01
ucggccuuguccgcgcgcuucca

SEQ ID NO: 3480518 - RNA, 19 nt, Pseudomonas aeruginosa PA01
ucggcgaaaugcaggccgg

SEQ ID NO: 3480519 - RNA, 21 nt, Pseudomonas aeruginosa PA01
ucggcgaacccggcgcggcgc

SEQ ID NO: 3480520 - RNA, 13 nt, Pseudomonas aeruginosa PA01
ucggcgaagcgga

SEQ ID NO: 3480521 - RNA, 15 nt, Pseudomonas aeruginosa PA01
ucggcgaagcggaag

SEQ ID NO: 3480522 - RNA, 16 nt, Pseudomonas aeruginosa PA01
ucggcgaaggcgaacc

SEQ ID NO: 3480523 - RNA, 21 nt, Pseudomonas aeruginosa PA01
ucggcgaaggcgaaccacacc

SEQ ID NO: 3480524 - RNA, 18 nt, Pseudomonas aeruginosa PA01
ucggcgaaguccaccagg

SEQ ID NO: 3480525 - RNA, 16 nt, Pseudomonas aeruginosa PA01
ucggcgaagucgccgu

SEQ ID NO: 3480526 - RNA, 14 nt, Pseudomonas aeruginosa PA01
ucggcgaccaacag

SEQ ID NO: 3480527 - RNA, 19 nt, Pseudomonas aeruginosa PA01
ucggcgaccacccggcggu

SEQ ID NO: 3480528 - RNA, 23 nt, Pseudomonas aeruginosa PA01
ucggcgaccacccggcgguccgc

SEQ ID NO: 3480529 - RNA, 20 nt, Pseudomonas aeruginosa PA01
ucggcgaccagcccgcgcga

SEQ ID NO: 3480530 - RNA, 23 nt, Pseudomonas aeruginosa PA01
ucggcgaccagcccgcgcgacag

SEQ ID NO: 3480531 - RNA, 18 nt, Pseudomonas aeruginosa PA01
ucggcgaccuugucgaug

SEQ ID NO: 3480532 - RNA, 14 nt, Pseudomonas aeruginosa PA01
ucggcgacgaugcc

SEQ ID NO: 3480533 - RNA, 16 nt, Pseudomonas aeruginosa PA01
ucggcgacgcggauac

SEQ ID NO: 3480534 - RNA, 13 nt, Pseudomonas aeruginosa PA01
ucggcgacgcuga

SEQ ID NO: 3480535 - RNA, 19 nt, Pseudomonas aeruginosa PA01
ucggcgacgggaagcgaac

SEQ ID NO: 3480536 - RNA, 23 nt, Pseudomonas aeruginosa PA01
ucggcgacgggaagcgaaccagg

SEQ ID NO: 3480537 - RNA, 13 nt, Pseudomonas aeruginosa PA01
ucggcgagagguc

SEQ ID NO: 3480538 - RNA, 15 nt, Pseudomonas aeruginosa PA01
ucggcgagaggucgg

SEQ ID NO: 3480539 - RNA, 16 nt, Pseudomonas aeruginosa PA01
ucggcgagaggucggc

SEQ ID NO: 3480540 - RNA, 12 nt, Pseudomonas aeruginosa PA01
ucggcgagcagg

SEQ ID NO: 3480541 - RNA, 14 nt, Pseudomonas aeruginosa PA01
ucggcgagcaggcg

SEQ ID NO: 3480542 - RNA, 15 nt, Pseudomonas aeruginosa PA01
ucggcgagcaggcgg

SEQ ID NO: 3480543 - RNA, 23 nt, Pseudomonas aeruginosa PA01
ucggcgagcagguagaccgccuc

SEQ ID NO: 3480544 - RNA, 21 nt, Pseudomonas aeruginosa PA01
ucggcgagccgcagcggcucg

SEQ ID NO: 3480545 - RNA, 15 nt, Pseudomonas aeruginosa PA01
ucggcgagccgccgg

SEQ ID NO: 3480546 - RNA, 13 nt, Pseudomonas aeruginosa PA01
ucggcgagccggc

SEQ ID NO: 3480547 - RNA, 14 nt, Pseudomonas aeruginosa PA01
ucggcgagccggcg

SEQ ID NO: 3480548 - RNA, 15 nt, Pseudomonas aeruginosa PA01
ucggcgagccggcgc

SEQ ID NO: 3480549 - RNA, 19 nt, Pseudomonas aeruginosa PA01
ucggcgagccggcgcauca

SEQ ID NO: 3480550 - RNA, 23 nt, Pseudomonas aeruginosa PA01
ucggcgaggaucagucgcugcuc

SEQ ID NO: 3480551 - RNA, 13 nt, Pseudomonas aeruginosa PA01
ucggcgaggccgg

SEQ ID NO: 3480552 - RNA, 14 nt, Pseudomonas aeruginosa PA01
ucggcgaggccggc

SEQ ID NO: 3480553 - RNA, 18 nt, Pseudomonas aeruginosa PA01
ucggcgaggccggcgauc

SEQ ID NO: 3480554 - RNA, 19 nt, Pseudomonas aeruginosa PA01
ucggcgaggccggcgauca

SEQ ID NO: 3480555 - RNA, 21 nt, Pseudomonas aeruginosa PA01
ucggcgaggguugcacaagcc

SEQ ID NO: 3480556 - RNA, 18 nt, Pseudomonas aeruginosa PA01
ucggcgaguucgcgcagg

SEQ ID NO: 3480557 - RNA, 17 nt, Pseudomonas aeruginosa PA01
ucggcgaucacccggcg

SEQ ID NO: 3480558 - RNA, 23 nt, Pseudomonas aeruginosa PA01
ucggcgaucacccggcgaagcuc

SEQ ID NO: 3480559 - RNA, 15 nt, Pseudomonas aeruginosa PA01
ucggcgaucagcggg

SEQ ID NO: 3480560 - RNA, 16 nt, Pseudomonas aeruginosa PA01
ucggcgaucagcgggc

SEQ ID NO: 3480561 - RNA, 17 nt, Pseudomonas aeruginosa PA01
ucggcgaucagcgggcg

SEQ ID NO: 3480562 - RNA, 15 nt, Pseudomonas aeruginosa PA01
ucggcgaucaggccg

SEQ ID NO: 3480563 - RNA, 21 nt, Pseudomonas aeruginosa PA01
ucggcgaucaggccgaugcgc

SEQ ID NO: 3480564 - RNA, 14 nt, Pseudomonas aeruginosa PA01
ucggcgauccgcgc

SEQ ID NO: 3480565 - RNA, 18 nt, Pseudomonas aeruginosa PA01
ucggcgauccgcgcuucc

SEQ ID NO: 3480566 - RNA, 14 nt, Pseudomonas aeruginosa PA01
ucggcgaucgccag

SEQ ID NO: 3480567 - RNA, 16 nt, Pseudomonas aeruginosa PA01
ucggcgaucgccaggu

SEQ ID NO: 3480568 - RNA, 14 nt, Pseudomonas aeruginosa PA01
ucggcgaucucgcc

SEQ ID NO: 3480569 - RNA, 17 nt, Pseudomonas aeruginosa PA01
ucggcgaucucgcccag

SEQ ID NO: 3480570 - RNA, 19 nt, Pseudomonas aeruginosa PA01
ucggcgaugccgccgggca

SEQ ID NO: 3480571 - RNA, 18 nt, Pseudomonas aeruginosa PA01
ucggcgaugccgcgccag

SEQ ID NO: 3480572 - RNA, 19 nt, Pseudomonas aeruginosa PA01
ucggcgaugccgcgccagg

SEQ ID NO: 3480573 - RNA, 20 nt, Pseudomonas aeruginosa PA01
ucggcgaugccgcgccaggc

SEQ ID NO: 3480574 - RNA, 21 nt, Pseudomonas aeruginosa PA01
ucggcgaugccgcgccaggcg

SEQ ID NO: 3480575 - RNA, 12 nt, Pseudomonas aeruginosa PA01
ucggcgauggcc

SEQ ID NO: 3480576 - RNA, 23 nt, Pseudomonas aeruginosa PA01
ucggcgauggccaucagggucgg

SEQ ID NO: 3480577 - RNA, 23 nt, Pseudomonas aeruginosa PA01
ucggcgauguugcgcagggugcc

SEQ ID NO: 3480578 - RNA, 16 nt, Pseudomonas aeruginosa PA01
ucggcgauucgcggcg

SEQ ID NO: 3480579 - RNA, 23 nt, Pseudomonas aeruginosa PA01
ucggcgauucguucgagcagcuc

SEQ ID NO: 3480580 - RNA, 13 nt, Pseudomonas aeruginosa PA01
ucggcgccauagg

SEQ ID NO: 3480581 - RNA, 14 nt, Pseudomonas aeruginosa PA01
ucggcgcccagcac

SEQ ID NO: 3480582 - RNA, 19 nt, Pseudomonas aeruginosa PA01
ucggcgcccagcaccacag

SEQ ID NO: 3480583 - RNA, 12 nt, Pseudomonas aeruginosa PA01
ucggcgcccagg

SEQ ID NO: 3480584 - RNA, 17 nt, Pseudomonas aeruginosa PA01
ucggcgcccgccugcag

SEQ ID NO: 3480585 - RNA, 14 nt, Pseudomonas aeruginosa PA01
ucggcgcccuggcc

SEQ ID NO: 3480586 - RNA, 21 nt, Pseudomonas aeruginosa PA01
ucggcgcccuggguggucugc

SEQ ID NO: 3480587 - RNA, 13 nt, Pseudomonas aeruginosa PA01
ucggcgccgagca

SEQ ID NO: 3480588 - RNA, 15 nt, Pseudomonas aeruginosa PA01
ucggcgccgaucucc

SEQ ID NO: 3480589 - RNA, 12 nt, Pseudomonas aeruginosa PA01
ucggcgccggcc

SEQ ID NO: 3480590 - RNA, 15 nt, Pseudomonas aeruginosa PA01
ucggcgccggugcug

SEQ ID NO: 3480591 - RNA, 21 nt, Pseudomonas aeruginosa PA01
ucggcgccggugcuggcgagc

SEQ ID NO: 3480592 - RNA, 14 nt, Pseudomonas aeruginosa PA01
ucggcgcgacggcc

SEQ ID NO: 3480593 - RNA, 17 nt, Pseudomonas aeruginosa PA01
ucggcgcgauccuccgc

SEQ ID NO: 3480594 - RNA, 21 nt, Pseudomonas aeruginosa PA01
ucggcgcgauccuccgccagc

SEQ ID NO: 3480595 - RNA, 22 nt, Pseudomonas aeruginosa PA01
ucggcgcgauccuccgccagcc

SEQ ID NO: 3480596 - RNA, 19 nt, Pseudomonas aeruginosa PA01
ucggcgcgaugaugccgcc

SEQ ID NO: 3480597 - RNA, 12 nt, Pseudomonas aeruginosa PA01
ucggcgcgcagg

SEQ ID NO: 3480598 - RNA, 13 nt, Pseudomonas aeruginosa PA01
ucggcgcgccaga

SEQ ID NO: 3480599 - RNA, 19 nt, Pseudomonas aeruginosa PA01
ucggcgcgccagaagcggc

SEQ ID NO: 3480600 - RNA, 12 nt, Pseudomonas aeruginosa PA01
ucggcgcgccga

SEQ ID NO: 3480601 - RNA, 13 nt, Pseudomonas aeruginosa PA01
ucggcgcgccggc

SEQ ID NO: 3480602 - RNA, 13 nt, Pseudomonas aeruginosa PA01
ucggcgcgccggu

SEQ ID NO: 3480603 - RNA, 16 nt, Pseudomonas aeruginosa PA01
ucggcgcgccggugau

SEQ ID NO: 3480604 - RNA, 22 nt, Pseudomonas aeruginosa PA01
ucggcgcgcgacacauggucgg

SEQ ID NO: 3480605 - RNA, 23 nt, Pseudomonas aeruginosa PA01
ucggcgcgcgacacauggucggc

SEQ ID NO: 3480606 - RNA, 16 nt, Pseudomonas aeruginosa PA01
ucggcgcgcgcccccu

SEQ ID NO: 3480607 - RNA, 22 nt, Pseudomonas aeruginosa PA01
ucggcgcgcgcccccuggccgu

SEQ ID NO: 3480608 - RNA, 12 nt, Pseudomonas aeruginosa PA01
ucggcgcgcggc

SEQ ID NO: 3480609 - RNA, 14 nt, Pseudomonas aeruginosa PA01
ucggcgcgcggcag

SEQ ID NO: 3480610 - RNA, 18 nt, Pseudomonas aeruginosa PA01
ucggcgcgcggcagcacc

SEQ ID NO: 3480611 - RNA, 23 nt, Pseudomonas aeruginosa PA01
ucggcgcgcggggucuggccggc

SEQ ID NO: 3480612 - RNA, 15 nt, Pseudomonas aeruginosa PA01
ucggcgcggccggcg

SEQ ID NO: 3480613 - RNA, 16 nt, Pseudomonas aeruginosa PA01
ucggcgcggccggcgc

SEQ ID NO: 3480614 - RNA, 13 nt, Pseudomonas aeruginosa PA01
ucggcgcggcgcu

SEQ ID NO: 3480615 - RNA, 14 nt, Pseudomonas aeruginosa PA01
ucggcgcggcgcuc

SEQ ID NO: 3480616 - RNA, 20 nt, Pseudomonas aeruginosa PA01
ucggcgcggcgcuccaggcg

SEQ ID NO: 3480617 - RNA, 20 nt, Pseudomonas aeruginosa PA01
ucggcgcgggcgccgaugcc

SEQ ID NO: 3480618 - RNA, 20 nt, Pseudomonas aeruginosa PA01
ucggcgcggguucgugccag

SEQ ID NO: 3480619 - RNA, 23 nt, Pseudomonas aeruginosa PA01
ucggcgcggguucgugccaggcg

SEQ ID NO: 3480620 - RNA, 20 nt, Pseudomonas aeruginosa PA01
ucggcgcuccgccgaacgcc

SEQ ID NO: 3480621 - RNA, 19 nt, Pseudomonas aeruginosa PA01
ucggcgcucggcuccagcc

SEQ ID NO: 3480622 - RNA, 17 nt, Pseudomonas aeruginosa PA01
ucggcgcucuucagcac

SEQ ID NO: 3480623 - RNA, 22 nt, Pseudomonas aeruginosa PA01
ucggcgcucuucagcacgccca

SEQ ID NO: 3480624 - RNA, 18 nt, Pseudomonas aeruginosa PA01
ucggcgcugaccucgaug

SEQ ID NO: 3480625 - RNA, 18 nt, Pseudomonas aeruginosa PA01
ucggcgcugccggccagg

SEQ ID NO: 3480626 - RNA, 11 nt, Pseudomonas aeruginosa PA01
ucggcgcuggc

SEQ ID NO: 3480627 - RNA, 13 nt, Pseudomonas aeruginosa PA01
ucggcgcuggcca

SEQ ID NO: 3480628 - RNA, 22 nt, Pseudomonas aeruginosa PA01
ucggcgcuggcgcggaugucgg

SEQ ID NO: 3480629 - RNA, 23 nt, Pseudomonas aeruginosa PA01
ucggcggaacaaugaaaaagggc

SEQ ID NO: 3480630 - RNA, 24 nt, Pseudomonas aeruginosa PA01
ucggcggacagcccgcgcucggcc

SEQ ID NO: 3480631 - RNA, 17 nt, Pseudomonas aeruginosa PA01
ucggcggauaacgccgc

SEQ ID NO: 3480632 - RNA, 18 nt, Pseudomonas aeruginosa PA01
ucggcggauaacgccggu

SEQ ID NO: 3480633 - RNA, 22 nt, Pseudomonas aeruginosa PA01
ucggcggcacccucuuccgcgc

SEQ ID NO: 3480634 - RNA, 16 nt, Pseudomonas aeruginosa PA01
ucggcggcacgcucca

SEQ ID NO: 3480635 - RNA, 15 nt, Pseudomonas aeruginosa PA01
ucggcggcagcugcg

SEQ ID NO: 3480636 - RNA, 14 nt, Pseudomonas aeruginosa PA01
ucggcggcaggccg

SEQ ID NO: 3480637 - RNA, 23 nt, Pseudomonas aeruginosa PA01
ucggcggcaggcugcgccgcugc

SEQ ID NO: 3480638 - RNA, 18 nt, Pseudomonas aeruginosa PA01
ucggcggccagcggaugc

SEQ ID NO: 3480639 - RNA, 12 nt, Pseudomonas aeruginosa PA01
ucggcggccagg

SEQ ID NO: 3480640 - RNA, 14 nt, Pseudomonas aeruginosa PA01
ucggcggccaggcg

SEQ ID NO: 3480641 - RNA, 15 nt, Pseudomonas aeruginosa PA01
ucggcggccaggcgg

SEQ ID NO: 3480642 - RNA, 21 nt, Pseudomonas aeruginosa PA01
ucggcggccauugccgcgggc

SEQ ID NO: 3480643 - RNA, 19 nt, Pseudomonas aeruginosa PA01
ucggcggccgggucgaggu

SEQ ID NO: 3480644 - RNA, 13 nt, Pseudomonas aeruginosa PA01
ucggcggccucgc

SEQ ID NO: 3480645 - RNA, 14 nt, Pseudomonas aeruginosa PA01
ucggcggccucgcg

SEQ ID NO: 3480646 - RNA, 14 nt, Pseudomonas aeruginosa PA01
ucggcggccucggc

SEQ ID NO: 3480647 - RNA, 11 nt, Pseudomonas aeruginosa PA01
ucggcggccuu

SEQ ID NO: 3480648 - RNA, 23 nt, Pseudomonas aeruginosa PA01
ucggcggccuuuucggcggccag

SEQ ID NO: 3480649 - RNA, 15 nt, Pseudomonas aeruginosa PA01
ucggcggcgagcgcc

SEQ ID NO: 3480650 - RNA, 22 nt, Pseudomonas aeruginosa PA01
ucggcggcgagcgccgcggcga

SEQ ID NO: 3480651 - RNA, 13 nt, Pseudomonas aeruginosa PA01
ucggcggcgccgg

SEQ ID NO: 3480652 - RNA, 18 nt, Pseudomonas aeruginosa PA01
ucggcggcgccuucgccg

SEQ ID NO: 3480653 - RNA, 21 nt, Pseudomonas aeruginosa PA01
ucggcggcgccuucgccggaa

SEQ ID NO: 3480654 - RNA, 15 nt, Pseudomonas aeruginosa PA01
ucggcggcgccuugc

SEQ ID NO: 3480655 - RNA, 14 nt, Pseudomonas aeruginosa PA01
ucggcggcgcgaac

SEQ ID NO: 3480656 - RNA, 22 nt, Pseudomonas aeruginosa PA01
ucggcggcgcgaaccagcagca

SEQ ID NO: 3480657 - RNA, 13 nt, Pseudomonas aeruginosa PA01
ucggcggcgcgca

SEQ ID NO: 3480658 - RNA, 14 nt, Pseudomonas aeruginosa PA01
ucggcggcgcgcag

SEQ ID NO: 3480659 - RNA, 13 nt, Pseudomonas aeruginosa PA01
ucggcggcgcggc

SEQ ID NO: 3480660 - RNA, 14 nt, Pseudomonas aeruginosa PA01
ucggcggcgcggcg

SEQ ID NO: 3480661 - RNA, 15 nt, Pseudomonas aeruginosa PA01
ucggcggcgcggcgu

SEQ ID NO: 3480662 - RNA, 17 nt, Pseudomonas aeruginosa PA01
ucggcggcgcggcguac

SEQ ID NO: 3480663 - RNA, 20 nt, Pseudomonas aeruginosa PA01
ucggcggcggauaacgccug

SEQ ID NO: 3480664 - RNA, 14 nt, Pseudomonas aeruginosa PA01
ucggcggcggccug

SEQ ID NO: 3480665 - RNA, 15 nt, Pseudomonas aeruginosa PA01
ucggcggcggccugc

SEQ ID NO: 3480666 - RNA, 20 nt, Pseudomonas aeruginosa PA01
ucggcggcgguucgccgagc

SEQ ID NO: 3480667 - RNA, 15 nt, Pseudomonas aeruginosa PA01
ucggcggcgugcagg

SEQ ID NO: 3480668 - RNA, 15 nt, Pseudomonas aeruginosa PA01
ucggcggcucugguc

SEQ ID NO: 3480669 - RNA, 13 nt, Pseudomonas aeruginosa PA01
ucggcggcuuccu

SEQ ID NO: 3480670 - RNA, 21 nt, Pseudomonas aeruginosa PA01
ucggcggcuuccuccaucgcc

SEQ ID NO: 3480671 - RNA, 18 nt, Pseudomonas aeruginosa PA01
ucggcgggaacgccgggc

SEQ ID NO: 3480672 - RNA, 19 nt, Pseudomonas aeruginosa PA01
ucggcgggaacgccgggca

SEQ ID NO: 3480673 - RNA, 16 nt, Pseudomonas aeruginosa PA01
ucggcgggacggcgca

SEQ ID NO: 3480674 - RNA, 18 nt, Pseudomonas aeruginosa PA01
ucggcgggagagggcggc

SEQ ID NO: 3480675 - RNA, 16 nt, Pseudomonas aeruginosa PA01
ucggcgggaucgacgc

SEQ ID NO: 3480676 - RNA, 19 nt, Pseudomonas aeruginosa PA01
ucggcgggcaccgccagcc

SEQ ID NO: 3480677 - RNA, 13 nt, Pseudomonas aeruginosa PA01
ucggcgggcugcc

SEQ ID NO: 3480678 - RNA, 20 nt, Pseudomonas aeruginosa PA01
ucggcgggcugccgcggaag

SEQ ID NO: 3480679 - RNA, 23 nt, Pseudomonas aeruginosa PA01
ucggcgggcugccgcggaagugc

SEQ ID NO: 3480680 - RNA, 18 nt, Pseudomonas aeruginosa PA01
ucggcggggcgcaccgcc

SEQ ID NO: 3480681 - RNA, 20 nt, Pseudomonas aeruginosa PA01
ucggcggggcgcaccgccuc

SEQ ID NO: 3480682 - RNA, 23 nt, Pseudomonas aeruginosa PA01
ucggcggggcgcaccgccucgac

SEQ ID NO: 3480683 - RNA, 19 nt, Pseudomonas aeruginosa PA01
ucggcggggcgcagcagga

SEQ ID NO: 3480684 - RNA, 17 nt, Pseudomonas aeruginosa PA01
ucggcggggugaucacc

SEQ ID NO: 3480685 - RNA, 22 nt, Pseudomonas aeruginosa PA01
ucggcggguauccgccgggccg

SEQ ID NO: 3480686 - RNA, 13 nt, Pseudomonas aeruginosa PA01
ucggcggguccgc

SEQ ID NO: 3480687 - RNA, 18 nt, Pseudomonas aeruginosa PA01
ucggcgggugugguccgc

SEQ ID NO: 3480688 - RNA, 16 nt, Pseudomonas aeruginosa PA01
ucggcgguacgcccuc

SEQ ID NO: 3480689 - RNA, 17 nt, Pseudomonas aeruginosa PA01
ucggcgguacgcccucc

SEQ ID NO: 3480690 - RNA, 13 nt, Pseudomonas aeruginosa PA01
ucggcggucaggc

SEQ ID NO: 3480691 - RNA, 18 nt, Pseudomonas aeruginosa PA01
ucggcggucaggccaagc

SEQ ID NO: 3480692 - RNA, 19 nt, Pseudomonas aeruginosa PA01
ucggcggucaggccaagcu

SEQ ID NO: 3480693 - RNA, 13 nt, Pseudomonas aeruginosa PA01
ucggcggucaggu

SEQ ID NO: 3480694 - RNA, 14 nt, Pseudomonas aeruginosa PA01
ucggcgguccaggg

SEQ ID NO: 3480695 - RNA, 18 nt, Pseudomonas aeruginosa PA01
ucggcggucucgaacgcc

SEQ ID NO: 3480696 - RNA, 15 nt, Pseudomonas aeruginosa PA01
ucggcgguggagcag

SEQ ID NO: 3480697 - RNA, 13 nt, Pseudomonas aeruginosa PA01
ucggcgguggggc

SEQ ID NO: 3480698 - RNA, 14 nt, Pseudomonas aeruginosa PA01
ucggcguagccggc

SEQ ID NO: 3480699 - RNA, 16 nt, Pseudomonas aeruginosa PA01
ucggcguagccggcca

SEQ ID NO: 3480700 - RNA, 17 nt, Pseudomonas aeruginosa PA01
ucggcguagccggccag

SEQ ID NO: 3480701 - RNA, 18 nt, Pseudomonas aeruginosa PA01
ucggcguagccggccagg

SEQ ID NO: 3480702 - RNA, 15 nt, Pseudomonas aeruginosa PA01
ucggcguagccggcg

SEQ ID NO: 3480703 - RNA, 18 nt, Pseudomonas aeruginosa PA01
ucggcguagccggcgauc

SEQ ID NO: 3480704 - RNA, 19 nt, Pseudomonas aeruginosa PA01
ucggcguagccggcgaucc

SEQ ID NO: 3480705 - RNA, 22 nt, Pseudomonas aeruginosa PA01
ucggcguaggccaguucgcuga

SEQ ID NO: 3480706 - RNA, 23 nt, Pseudomonas aeruginosa PA01
ucggcguagugcuggguggaggc

SEQ ID NO: 3480707 - RNA, 15 nt, Pseudomonas aeruginosa PA01
ucggcguccagcagg

SEQ ID NO: 3480708 - RNA, 14 nt, Pseudomonas aeruginosa PA01
ucggcguccgcggc

SEQ ID NO: 3480709 - RNA, 15 nt, Pseudomonas aeruginosa PA01
ucggcguccgcggcc

SEQ ID NO: 3480710 - RNA, 15 nt, Pseudomonas aeruginosa PA01
ucggcgucgcgcagg

SEQ ID NO: 3480711 - RNA, 18 nt, Pseudomonas aeruginosa PA01
ucggcgucgcgcuugccu

SEQ ID NO: 3480712 - RNA, 15 nt, Pseudomonas aeruginosa PA01
ucggcgucggcaugg

SEQ ID NO: 3480713 - RNA, 21 nt, Pseudomonas aeruginosa PA01
ucggcgucgggcagggcaucc

SEQ ID NO: 3480714 - RNA, 19 nt, Pseudomonas aeruginosa PA01
ucggcgucuggggugaggc

SEQ ID NO: 3480715 - RNA, 17 nt, Pseudomonas aeruginosa PA01
ucggcgucuucggcggc

SEQ ID NO: 3480716 - RNA, 18 nt, Pseudomonas aeruginosa PA01
ucggcgucuugucgaagc

SEQ ID NO: 3480717 - RNA, 20 nt, Pseudomonas aeruginosa PA01
ucggcgugauccgcagguag

SEQ ID NO: 3480718 - RNA, 18 nt, Pseudomonas aeruginosa PA01
ucggcgugcauggccggg

SEQ ID NO: 3480719 - RNA, 20 nt, Pseudomonas aeruginosa PA01
ucggcgugcauggccgggcc

SEQ ID NO: 3480720 - RNA, 21 nt, Pseudomonas aeruginosa PA01
ucggcgugcauggccgggccg

SEQ ID NO: 3480721 - RNA, 22 nt, Pseudomonas aeruginosa PA01
ucggcgugccgggccggccagg

SEQ ID NO: 3480722 - RNA, 22 nt, Pseudomonas aeruginosa PA01
ucggcguugcugaucgcuccgc

SEQ ID NO: 3480723 - RNA, 16 nt, Pseudomonas aeruginosa PA01
ucggcguuguccaggc

SEQ ID NO: 3480724 - RNA, 17 nt, Pseudomonas aeruginosa PA01
ucggcguuguccaggcu

SEQ ID NO: 3480725 - RNA, 18 nt, Pseudomonas aeruginosa PA01
ucggcguuguccaggcug

SEQ ID NO: 3480726 - RNA, 18 nt, Pseudomonas aeruginosa PA01
ucggcuaaccgccuucgc

SEQ ID NO: 3480727 - RNA, 14 nt, Pseudomonas aeruginosa PA01
ucggcucagccgac

SEQ ID NO: 3480728 - RNA, 16 nt, Pseudomonas aeruginosa PA01
ucggcucagccgacca

SEQ ID NO: 3480729 - RNA, 19 nt, Pseudomonas aeruginosa PA01
ucggcucagccgaccaccu

SEQ ID NO: 3480730 - RNA, 16 nt, Pseudomonas aeruginosa PA01
ucggcuccagcaccag

SEQ ID NO: 3480731 - RNA, 19 nt, Pseudomonas aeruginosa PA01
ucggcuccagcaccagcac

SEQ ID NO: 3480732 - RNA, 14 nt, Pseudomonas aeruginosa PA01
ucggcuccagccag

SEQ ID NO: 3480733 - RNA, 15 nt, Pseudomonas aeruginosa PA01
ucggcuccagccagg

SEQ ID NO: 3480734 - RNA, 16 nt, Pseudomonas aeruginosa PA01
ucggcuccaggaccgg

SEQ ID NO: 3480735 - RNA, 19 nt, Pseudomonas aeruginosa PA01
ucggcuccaggaccggcag

SEQ ID NO: 3480736 - RNA, 14 nt, Pseudomonas aeruginosa PA01
ucggcucgcgccgg

SEQ ID NO: 3480737 - RNA, 15 nt, Pseudomonas aeruginosa PA01
ucggcucgcgccggc

SEQ ID NO: 3480738 - RNA, 18 nt, Pseudomonas aeruginosa PA01
ucggcucgguuccagcuc

SEQ ID NO: 3480739 - RNA, 13 nt, Pseudomonas aeruginosa PA01
ucggcugaccggc

SEQ ID NO: 3480740 - RNA, 19 nt, Pseudomonas aeruginosa PA01
ucggcugaccggcaucgac

SEQ ID NO: 3480741 - RNA, 22 nt, Pseudomonas aeruginosa PA01
ucggcugaccggcaucgaccag

SEQ ID NO: 3480742 - RNA, 23 nt, Pseudomonas aeruginosa PA01
ucggcugaccggcaucgaccagc

SEQ ID NO: 3480743 - RNA, 15 nt, Pseudomonas aeruginosa PA01
ucggcugcaacgccg

SEQ ID NO: 3480744 - RNA, 18 nt, Pseudomonas aeruginosa PA01
ucggcugcaacgccggcc

SEQ ID NO: 3480745 - RNA, 13 nt, Pseudomonas aeruginosa PA01
ucggcugccgcca

SEQ ID NO: 3480746 - RNA, 14 nt, Pseudomonas aeruginosa PA01
ucggcugccgccag

SEQ ID NO: 3480747 - RNA, 21 nt, Pseudomonas aeruginosa PA01
ucggcugcgucguuggccggc

SEQ ID NO: 3480748 - RNA, 19 nt, Pseudomonas aeruginosa PA01
ucggcuggaccuccuggcg

SEQ ID NO: 3480749 - RNA, 15 nt, Pseudomonas aeruginosa PA01
ucggcuggcagggcg

SEQ ID NO: 3480750 - RNA, 12 nt, Pseudomonas aeruginosa PA01
ucggcuggccga

SEQ ID NO: 3480751 - RNA, 15 nt, Pseudomonas aeruginosa PA01
ucggcugggccagga

SEQ ID NO: 3480752 - RNA, 14 nt, Pseudomonas aeruginosa PA01
ucggcuuccugggc

SEQ ID NO: 3480753 - RNA, 17 nt, Pseudomonas aeruginosa PA01
ucggcuucguccugcug

SEQ ID NO: 3480754 - RNA, 17 nt, Pseudomonas aeruginosa PA01
ucggcuugccggcggcg

SEQ ID NO: 3480755 - RNA, 15 nt, Pseudomonas aeruginosa PA01
ucggcuugggucagc

SEQ ID NO: 3480756 - RNA, 19 nt, Pseudomonas aeruginosa PA01
ucgggaaaggccgccacgg

SEQ ID NO: 3480757 - RNA, 22 nt, Pseudomonas aeruginosa PA01
ucgggaaccacgacgaagcgcc

SEQ ID NO: 3480758 - RNA, 20 nt, Pseudomonas aeruginosa PA01
ucgggacgcaugcgcggcgu

SEQ ID NO: 3480759 - RNA, 18 nt, Pseudomonas aeruginosa PA01
ucgggagagcccgggcgc

SEQ ID NO: 3480760 - RNA, 17 nt, Pseudomonas aeruginosa PA01
ucgggauaccggccauc

SEQ ID NO: 3480761 - RNA, 15 nt, Pseudomonas aeruginosa PA01
ucgggaucguaggcg

SEQ ID NO: 3480762 - RNA, 22 nt, Pseudomonas aeruginosa PA01
ucgggaucguaggcgcgcaccu

SEQ ID NO: 3480763 - RNA, 17 nt, Pseudomonas aeruginosa PA01
ucgggaucuuguagaac

SEQ ID NO: 3480764 - RNA, 13 nt, Pseudomonas aeruginosa PA01
ucgggcaccagca

SEQ ID NO: 3480765 - RNA, 14 nt, Pseudomonas aeruginosa PA01
ucgggcaccagcac

SEQ ID NO: 3480766 - RNA, 15 nt, Pseudomonas aeruginosa PA01
ucgggcaccagcacg

SEQ ID NO: 3480767 - RNA, 19 nt, Pseudomonas aeruginosa PA01
ucgggcagaguggcgcggc

SEQ ID NO: 3480768 - RNA, 19 nt, Pseudomonas aeruginosa PA01
ucgggcagauguccaggca

SEQ ID NO: 3480769 - RNA, 20 nt, Pseudomonas aeruginosa PA01
ucgggcagggcagccgccgc

SEQ ID NO: 3480770 - RNA, 17 nt, Pseudomonas aeruginosa PA01
ucgggcagguggacggc

SEQ ID NO: 3480771 - RNA, 18 nt, Pseudomonas aeruginosa PA01
ucgggcaguuccgccaga

SEQ ID NO: 3480772 - RNA, 15 nt, Pseudomonas aeruginosa PA01
ucgggcauggcgauc

SEQ ID NO: 3480773 - RNA, 16 nt, Pseudomonas aeruginosa PA01
ucgggccaugagcagg

SEQ ID NO: 3480774 - RNA, 19 nt, Pseudomonas aeruginosa PA01
ucgggccaugagcagggcg

SEQ ID NO: 3480775 - RNA, 21 nt, Pseudomonas aeruginosa PA01
ucgggccaugagcagggcgga

SEQ ID NO: 3480776 - RNA, 16 nt, Pseudomonas aeruginosa PA01
ucgggcccucccaagg

SEQ ID NO: 3480777 - RNA, 17 nt, Pseudomonas aeruginosa PA01
ucgggccgaucgagcgg

SEQ ID NO: 3480778 - RNA, 18 nt, Pseudomonas aeruginosa PA01
ucgggccgaucgagcggc

SEQ ID NO: 3480779 - RNA, 21 nt, Pseudomonas aeruginosa PA01
ucgggccgaucgagcggcccg

SEQ ID NO: 3480780 - RNA, 22 nt, Pseudomonas aeruginosa PA01
ucgggccgaucgagcggcccgc

SEQ ID NO: 3480781 - RNA, 16 nt, Pseudomonas aeruginosa PA01
ucgggccgcgcucggu

SEQ ID NO: 3480782 - RNA, 20 nt, Pseudomonas aeruginosa PA01
ucgggccgcgcucgguccag

SEQ ID NO: 3480783 - RNA, 18 nt, Pseudomonas aeruginosa PA01
ucgggccggagcaggcca

SEQ ID NO: 3480784 - RNA, 21 nt, Pseudomonas aeruginosa PA01
ucgggccggagcaggccaugg

SEQ ID NO: 3480785 - RNA, 18 nt, Pseudomonas aeruginosa PA01
ucgggcgaaacggcaggc

SEQ ID NO: 3480786 - RNA, 21 nt, Pseudomonas aeruginosa PA01
ucgggcgaaacggcaggccag

SEQ ID NO: 3480787 - RNA, 22 nt, Pseudomonas aeruginosa PA01
ucgggcgagaaucgccgaggcg

SEQ ID NO: 3480788 - RNA, 12 nt, Pseudomonas aeruginosa PA01
ucgggcgaugcg

SEQ ID NO: 3480789 - RNA, 13 nt, Pseudomonas aeruginosa PA01
ucgggcgccgcgc

SEQ ID NO: 3480790 - RNA, 15 nt, Pseudomonas aeruginosa PA01
ucgggcgccgcgccu

SEQ ID NO: 3480791 - RNA, 17 nt, Pseudomonas aeruginosa PA01
ucgggcggaucgagcag

SEQ ID NO: 3480792 - RNA, 15 nt, Pseudomonas aeruginosa PA01
ucgggcggcaagggc

SEQ ID NO: 3480793 - RNA, 15 nt, Pseudomonas aeruginosa PA01
ucgggcguagaccuu

SEQ ID NO: 3480794 - RNA, 16 nt, Pseudomonas aeruginosa PA01
ucgggcgucuccugcc

SEQ ID NO: 3480795 - RNA, 16 nt, Pseudomonas aeruginosa PA01
ucgggcuucagcgccg

SEQ ID NO: 3480796 - RNA, 16 nt, Pseudomonas aeruginosa PA01
ucgggcuucggcagca

SEQ ID NO: 3480797 - RNA, 22 nt, Pseudomonas aeruginosa PA01
ucggggaaacccucaggucggc

SEQ ID NO: 3480798 - RNA, 17 nt, Pseudomonas aeruginosa PA01
ucggggaacacgcgcug

SEQ ID NO: 3480799 - RNA, 16 nt, Pseudomonas aeruginosa PA01
ucggggaacagcgcca

SEQ ID NO: 3480800 - RNA, 18 nt, Pseudomonas aeruginosa PA01
ucggggauguccgccgcc

SEQ ID NO: 3480801 - RNA, 20 nt, Pseudomonas aeruginosa PA01
ucggggauguccgccgccca

SEQ ID NO: 3480802 - RNA, 12 nt, Pseudomonas aeruginosa PA01
ucggggcaggcg

SEQ ID NO: 3480803 - RNA, 21 nt, Pseudomonas aeruginosa PA01
ucggggcauucguccagccgc

SEQ ID NO: 3480804 - RNA, 21 nt, Pseudomonas aeruginosa PA01
ucggggccgaggucgaccagc

SEQ ID NO: 3480805 - RNA, 12 nt, Pseudomonas aeruginosa PA01
ucggggccggcg

SEQ ID NO: 3480806 - RNA, 13 nt, Pseudomonas aeruginosa PA01
ucggggccguagu

SEQ ID NO: 3480807 - RNA, 19 nt, Pseudomonas aeruginosa PA01
ucggggccguccgccaggu

SEQ ID NO: 3480808 - RNA, 14 nt, Pseudomonas aeruginosa PA01
ucggggccgugagc

SEQ ID NO: 3480809 - RNA, 18 nt, Pseudomonas aeruginosa PA01
ucggggccgugagcacga

SEQ ID NO: 3480810 - RNA, 12 nt, Pseudomonas aeruginosa PA01
ucggggcugcuc

SEQ ID NO: 3480811 - RNA, 14 nt, Pseudomonas aeruginosa PA01
ucggggucggccug

SEQ ID NO: 3480812 - RNA, 20 nt, Pseudomonas aeruginosa PA01
ucgggguucgacccgcacuu

SEQ ID NO: 3480813 - RNA, 22 nt, Pseudomonas aeruginosa PA01
ucgggguuuuuuuugccuggaa

SEQ ID NO: 3480814 - RNA, 21 nt, Pseudomonas aeruginosa PA01
ucggguaguaguggaagccgu

SEQ ID NO: 3480815 - RNA, 15 nt, Pseudomonas aeruginosa PA01
ucggguagucuucga

SEQ ID NO: 3480816 - RNA, 21 nt, Pseudomonas aeruginosa PA01
ucggguagucuucgaugcgcc

SEQ ID NO: 3480817 - RNA, 13 nt, Pseudomonas aeruginosa PA01
ucggguccaggcg

SEQ ID NO: 3480818 - RNA, 17 nt, Pseudomonas aeruginosa PA01
ucggguccgggcccugc

SEQ ID NO: 3480819 - RNA, 13 nt, Pseudomonas aeruginosa PA01
ucgggucgagcuu

SEQ ID NO: 3480820 - RNA, 15 nt, Pseudomonas aeruginosa PA01
ucgggucgcggcuga

SEQ ID NO: 3480821 - RNA, 20 nt, Pseudomonas aeruginosa PA01
ucgggucgcguucgucggcc

SEQ ID NO: 3480822 - RNA, 13 nt, Pseudomonas aeruginosa PA01
ucgggucggcgaa

SEQ ID NO: 3480823 - RNA, 22 nt, Pseudomonas aeruginosa PA01
ucgggugggacauggagaccug

SEQ ID NO: 3480824 - RNA, 20 nt, Pseudomonas aeruginosa PA01
ucggguugaucgacgccagc

SEQ ID NO: 3480825 - RNA, 21 nt, Pseudomonas aeruginosa PA01
ucgguaggcucugcuccagca

SEQ ID NO: 3480826 - RNA, 21 nt, Pseudomonas aeruginosa PA01
ucgguauccaccggacccggc

SEQ ID NO: 3480827 - RNA, 22 nt, Pseudomonas aeruginosa PA01
ucgguaucgcuuccaaggguau

SEQ ID NO: 3480828 - RNA, 21 nt, Pseudomonas aeruginosa PA01
ucgguauggaagaacaucgcc

SEQ ID NO: 3480829 - RNA, 19 nt, Pseudomonas aeruginosa PA01
ucggucaccguggucaugg

SEQ ID NO: 3480830 - RNA, 17 nt, Pseudomonas aeruginosa PA01
ucggucacgaaggcgau

SEQ ID NO: 3480831 - RNA, 17 nt, Pseudomonas aeruginosa PA01
ucggucagcggcgcagc

SEQ ID NO: 3480832 - RNA, 19 nt, Pseudomonas aeruginosa PA01
ucggucagcggcgcagccu

SEQ ID NO: 3480833 - RNA, 14 nt, Pseudomonas aeruginosa PA01
ucggucaggcgcug

SEQ ID NO: 3480834 - RNA, 16 nt, Pseudomonas aeruginosa PA01
ucggucaggcgcuggu

SEQ ID NO: 3480835 - RNA, 17 nt, Pseudomonas aeruginosa PA01
ucggucaggcgcuggug

SEQ ID NO: 3480836 - RNA, 13 nt, Pseudomonas aeruginosa PA01
ucggucaggcuga

SEQ ID NO: 3480837 - RNA, 19 nt, Pseudomonas aeruginosa PA01
ucggucagguauucgccgg

SEQ ID NO: 3480838 - RNA, 21 nt, Pseudomonas aeruginosa PA01
ucggucagguauucgccggcc

SEQ ID NO: 3480839 - RNA, 15 nt, Pseudomonas aeruginosa PA01
ucggucaucacgcuu

SEQ ID NO: 3480840 - RNA, 16 nt, Pseudomonas aeruginosa PA01
ucggucaucacgcuuu

SEQ ID NO: 3480841 - RNA, 22 nt, Pseudomonas aeruginosa PA01
ucggucauguccggggcgaucu

SEQ ID NO: 3480842 - RNA, 19 nt, Pseudomonas aeruginosa PA01
ucgguccccuccagguagg

SEQ ID NO: 3480843 - RNA, 16 nt, Pseudomonas aeruginosa PA01
ucggucgcccucggcc

SEQ ID NO: 3480844 - RNA, 15 nt, Pseudomonas aeruginosa PA01
ucggucgcgccccca

SEQ ID NO: 3480845 - RNA, 14 nt, Pseudomonas aeruginosa PA01
ucggucggccagga

SEQ ID NO: 3480846 - RNA, 15 nt, Pseudomonas aeruginosa PA01
ucggucggccaggac

SEQ ID NO: 3480847 - RNA, 16 nt, Pseudomonas aeruginosa PA01
ucggucggccaggacg

SEQ ID NO: 3480848 - RNA, 15 nt, Pseudomonas aeruginosa PA01
ucggucggcggcggu

SEQ ID NO: 3480849 - RNA, 20 nt, Pseudomonas aeruginosa PA01
ucggugaacgagcccaggca

SEQ ID NO: 3480850 - RNA, 15 nt, Pseudomonas aeruginosa PA01
ucggugaccaccagg

SEQ ID NO: 3480851 - RNA, 17 nt, Pseudomonas aeruginosa PA01
ucggugaccaccaggcg

SEQ ID NO: 3480852 - RNA, 18 nt, Pseudomonas aeruginosa PA01
ucggugacccgcacggcg

SEQ ID NO: 3480853 - RNA, 22 nt, Pseudomonas aeruginosa PA01
ucggugagguagaagcggccgc

SEQ ID NO: 3480854 - RNA, 22 nt, Pseudomonas aeruginosa PA01
ucggugauaccgccggcggcga

SEQ ID NO: 3480855 - RNA, 17 nt, Pseudomonas aeruginosa PA01
ucggugcccucgcggac

SEQ ID NO: 3480856 - RNA, 19 nt, Pseudomonas aeruginosa PA01
ucggugcccucgcggacgc

SEQ ID NO: 3480857 - RNA, 13 nt, Pseudomonas aeruginosa PA01
ucggugccgcccg

SEQ ID NO: 3480858 - RNA, 16 nt, Pseudomonas aeruginosa PA01
ucggugccgcccggcg

SEQ ID NO: 3480859 - RNA, 17 nt, Pseudomonas aeruginosa PA01
ucggugccgcccggcgc

SEQ ID NO: 3480860 - RNA, 17 nt, Pseudomonas aeruginosa PA01
ucggugccuucccagcc

SEQ ID NO: 3480861 - RNA, 21 nt, Pseudomonas aeruginosa PA01
ucggugccuucccagccgagg

SEQ ID NO: 3480862 - RNA, 22 nt, Pseudomonas aeruginosa PA01
ucggugccuucccagccgaggc

SEQ ID NO: 3480863 - RNA, 23 nt, Pseudomonas aeruginosa PA01
ucggugccuucccagccgaggca

SEQ ID NO: 3480864 - RNA, 15 nt, Pseudomonas aeruginosa PA01
ucggugcgggcagac

SEQ ID NO: 3480865 - RNA, 14 nt, Pseudomonas aeruginosa PA01
ucggugcguagcga

SEQ ID NO: 3480866 - RNA, 20 nt, Pseudomonas aeruginosa PA01
ucggugcucaggcggccgaa

SEQ ID NO: 3480867 - RNA, 20 nt, Pseudomonas aeruginosa PA01
ucgguggcaugguguccggc

SEQ ID NO: 3480868 - RNA, 18 nt, Pseudomonas aeruginosa PA01
ucggugguguagcgaucc

SEQ ID NO: 3480869 - RNA, 23 nt, Pseudomonas aeruginosa PA01
ucgguguaguucaccguccacug

SEQ ID NO: 3480870 - RNA, 18 nt, Pseudomonas aeruginosa PA01
ucgguguaucggcggaua

SEQ ID NO: 3480871 - RNA, 14 nt, Pseudomonas aeruginosa PA01
ucggugucggccaa

SEQ ID NO: 3480872 - RNA, 22 nt, Pseudomonas aeruginosa PA01
ucgguucugcgcaccaugcccg

SEQ ID NO: 3480873 - RNA, 17 nt, Pseudomonas aeruginosa PA01
ucgguugccaggccggc

SEQ ID NO: 3480874 - RNA, 13 nt, Pseudomonas aeruginosa PA01
ucgguugcggccu

SEQ ID NO: 3480875 - RNA, 17 nt, Pseudomonas aeruginosa PA01
ucgguugcggccugauc

SEQ ID NO: 3480876 - RNA, 14 nt, Pseudomonas aeruginosa PA01
ucgguuuccaggau

SEQ ID NO: 3480877 - RNA, 17 nt, Pseudomonas aeruginosa PA01
ucgguuuccggccaggc

SEQ ID NO: 3480878 - RNA, 15 nt, Pseudomonas aeruginosa PA01
ucgguuugcgccgaa

SEQ ID NO: 3480879 - RNA, 16 nt, Pseudomonas aeruginosa PA01
ucguacaccgcgcggc

SEQ ID NO: 3480880 - RNA, 23 nt, Pseudomonas aeruginosa PA01
ucguacacguuggccgucuccag

SEQ ID NO: 3480881 - RNA, 15 nt, Pseudomonas aeruginosa PA01
ucguacuggcggauc

SEQ ID NO: 3480882 - RNA, 22 nt, Pseudomonas aeruginosa PA01
ucguagagauauucccgcgaca

SEQ ID NO: 3480883 - RNA, 13 nt, Pseudomonas aeruginosa PA01
ucguagaggcugu

SEQ ID NO: 3480884 - RNA, 21 nt, Pseudomonas aeruginosa PA01
ucguagaggcuguagcgcucc

SEQ ID NO: 3480885 - RNA, 23 nt, Pseudomonas aeruginosa PA01
ucguagaggcugucgucgagggu

SEQ ID NO: 3480886 - RNA, 19 nt, Pseudomonas aeruginosa PA01
ucguagcagguccgcgccu

SEQ ID NO: 3480887 - RNA, 15 nt, Pseudomonas aeruginosa PA01
ucguagccaggcacc

SEQ ID NO: 3480888 - RNA, 20 nt, Pseudomonas aeruginosa PA01
ucguagcccuucuccgccag

SEQ ID NO: 3480889 - RNA, 15 nt, Pseudomonas aeruginosa PA01
ucguagccgcgcgcc

SEQ ID NO: 3480890 - RNA, 18 nt, Pseudomonas aeruginosa PA01
ucguagccggcgcggcgc

SEQ ID NO: 3480891 - RNA, 21 nt, Pseudomonas aeruginosa PA01
ucguagcgacccuucaacggc

SEQ ID NO: 3480892 - RNA, 15 nt, Pseudomonas aeruginosa PA01
ucguagcgcagcggc

SEQ ID NO: 3480893 - RNA, 21 nt, Pseudomonas aeruginosa PA01
ucguagcgcagcggcaggcca

SEQ ID NO: 3480894 - RNA, 20 nt, Pseudomonas aeruginosa PA01
ucguagcgcaugccguuggc

SEQ ID NO: 3480895 - RNA, 18 nt, Pseudomonas aeruginosa PA01
ucguagcggucgugcagc

SEQ ID NO: 3480896 - RNA, 21 nt, Pseudomonas aeruginosa PA01
ucguagcggucgugcagcagc

SEQ ID NO: 3480897 - RNA, 22 nt, Pseudomonas aeruginosa PA01
ucguagcggucgugcagcagcg

SEQ ID NO: 3480898 - RNA, 19 nt, Pseudomonas aeruginosa PA01
ucguaggcaggcgcggcau

SEQ ID NO: 3480899 - RNA, 14 nt, Pseudomonas aeruginosa PA01
ucguaggcgcgcac

SEQ ID NO: 3480900 - RNA, 14 nt, Pseudomonas aeruginosa PA01
ucguaggcgcgggc

SEQ ID NO: 3480901 - RNA, 20 nt, Pseudomonas aeruginosa PA01
ucguaggcgcgggcggcggc

SEQ ID NO: 3480902 - RNA, 23 nt, Pseudomonas aeruginosa PA01
ucguaggcgcgggcggcggcgcg

SEQ ID NO: 3480903 - RNA, 19 nt, Pseudomonas aeruginosa PA01
ucguagggcgucaguucca

SEQ ID NO: 3480904 - RNA, 15 nt, Pseudomonas aeruginosa PA01
ucguagucguagcgc

SEQ ID NO: 3480905 - RNA, 17 nt, Pseudomonas aeruginosa PA01
ucguaguugccucucga

SEQ ID NO: 3480906 - RNA, 20 nt, Pseudomonas aeruginosa PA01
ucguaguugccucucgacuu

SEQ ID NO: 3480907 - RNA, 20 nt, Pseudomonas aeruginosa PA01
ucguauaggcgcuggugcug

SEQ ID NO: 3480908 - RNA, 18 nt, Pseudomonas aeruginosa PA01
ucguauuccacgucgccg

SEQ ID NO: 3480909 - RNA, 14 nt, Pseudomonas aeruginosa PA01
ucgucaaccagcac

SEQ ID NO: 3480910 - RNA, 15 nt, Pseudomonas aeruginosa PA01
ucgucacgcaggcuu

SEQ ID NO: 3480911 - RNA, 14 nt, Pseudomonas aeruginosa PA01
ucgucacggcgugc

SEQ ID NO: 3480912 - RNA, 15 nt, Pseudomonas aeruginosa PA01
ucgucacggcgugcc

SEQ ID NO: 3480913 - RNA, 16 nt, Pseudomonas aeruginosa PA01
ucgucacggcgugccg

SEQ ID NO: 3480914 - RNA, 20 nt, Pseudomonas aeruginosa PA01
ucgucacuguuuuccauggc

SEQ ID NO: 3480915 - RNA, 15 nt, Pseudomonas aeruginosa PA01
ucgucauuggccgaa

SEQ ID NO: 3480916 - RNA, 20 nt, Pseudomonas aeruginosa PA01
ucguccagcaggcccagcca

SEQ ID NO: 3480917 - RNA, 15 nt, Pseudomonas aeruginosa PA01
ucguccagccgccgc

SEQ ID NO: 3480918 - RNA, 19 nt, Pseudomonas aeruginosa PA01
ucguccagccgccgcugca

SEQ ID NO: 3480919 - RNA, 16 nt, Pseudomonas aeruginosa PA01
ucguccagcggcucgc

SEQ ID NO: 3480920 - RNA, 22 nt, Pseudomonas aeruginosa PA01
ucguccagcgggcccauggcgg

SEQ ID NO: 3480921 - RNA, 14 nt, Pseudomonas aeruginosa PA01
ucguccagcucggc

SEQ ID NO: 3480922 - RNA, 19 nt, Pseudomonas aeruginosa PA01
ucguccagcucggccauca

SEQ ID NO: 3480923 - RNA, 20 nt, Pseudomonas aeruginosa PA01
ucguccagcucggccaucag

SEQ ID NO: 3480924 - RNA, 13 nt, Pseudomonas aeruginosa PA01
ucguccaggcaag

SEQ ID NO: 3480925 - RNA, 13 nt, Pseudomonas aeruginosa PA01
ucguccaggccgc

SEQ ID NO: 3480926 - RNA, 14 nt, Pseudomonas aeruginosa PA01
ucguccaggccgca

SEQ ID NO: 3480927 - RNA, 21 nt, Pseudomonas aeruginosa PA01
ucguccaguucagggccacgc

SEQ ID NO: 3480928 - RNA, 15 nt, Pseudomonas aeruginosa PA01
ucguccaucgacagg

SEQ ID NO: 3480929 - RNA, 22 nt, Pseudomonas aeruginosa PA01
ucguccaucgacagggucgucu

SEQ ID NO: 3480930 - RNA, 16 nt, Pseudomonas aeruginosa PA01
ucguccaucgccaggc

SEQ ID NO: 3480931 - RNA, 17 nt, Pseudomonas aeruginosa PA01
ucguccaucgccgcggc

SEQ ID NO: 3480932 - RNA, 19 nt, Pseudomonas aeruginosa PA01
ucguccauguugcggccca

SEQ ID NO: 3480933 - RNA, 16 nt, Pseudomonas aeruginosa PA01
ucgucccacuugucca

SEQ ID NO: 3480934 - RNA, 23 nt, Pseudomonas aeruginosa PA01
ucgucccaugaccgucagccagg

SEQ ID NO: 3480935 - RNA, 19 nt, Pseudomonas aeruginosa PA01
ucgucccgagcaccggccu

SEQ ID NO: 3480936 - RNA, 23 nt, Pseudomonas aeruginosa PA01
ucguccggcgccaacugcuugcc

SEQ ID NO: 3480937 - RNA, 18 nt, Pseudomonas aeruginosa PA01
ucguccuccucgaucacc

SEQ ID NO: 3480938 - RNA, 21 nt, Pseudomonas aeruginosa PA01
ucguccucgaaagccgccgcc

SEQ ID NO: 3480939 - RNA, 12 nt, Pseudomonas aeruginosa PA01
ucguccucggcg

SEQ ID NO: 3480940 - RNA, 16 nt, Pseudomonas aeruginosa PA01
ucguccucggcguagc

SEQ ID NO: 3480941 - RNA, 18 nt, Pseudomonas aeruginosa PA01
ucguccucggcguagccg

SEQ ID NO: 3480942 - RNA, 18 nt, Pseudomonas aeruginosa PA01
ucguccucggcguagugc

SEQ ID NO: 3480943 - RNA, 17 nt, Pseudomonas aeruginosa PA01
ucguccucggggaagcg

SEQ ID NO: 3480944 - RNA, 15 nt, Pseudomonas aeruginosa PA01
ucguccugcgcggcg

SEQ ID NO: 3480945 - RNA, 24 nt, Pseudomonas aeruginosa PA01
ucguccugcggauucaucggcggc

SEQ ID NO: 3480946 - RNA, 14 nt, Pseudomonas aeruginosa PA01
ucguccugcugcug

SEQ ID NO: 3480947 - RNA, 16 nt, Pseudomonas aeruginosa PA01
ucgucgaaacgcuggc

SEQ ID NO: 3480948 - RNA, 19 nt, Pseudomonas aeruginosa PA01
ucgucgaaacgcuggcggc

SEQ ID NO: 3480949 - RNA, 22 nt, Pseudomonas aeruginosa PA01
ucgucgaaacgcuggcggccga

SEQ ID NO: 3480950 - RNA, 18 nt, Pseudomonas aeruginosa PA01
ucgucgaacgacucuucg

SEQ ID NO: 3480951 - RNA, 20 nt, Pseudomonas aeruginosa PA01
ucgucgaagaccaggguggg

SEQ ID NO: 3480952 - RNA, 15 nt, Pseudomonas aeruginosa PA01
ucgucgaagcgcagc

SEQ ID NO: 3480953 - RNA, 16 nt, Pseudomonas aeruginosa PA01
ucgucgaagcgcagca

SEQ ID NO: 3480954 - RNA, 22 nt, Pseudomonas aeruginosa PA01
ucgucgaagcgcaguacccggc

SEQ ID NO: 3480955 - RNA, 15 nt, Pseudomonas aeruginosa PA01
ucgucgaagcucggc

SEQ ID NO: 3480956 - RNA, 21 nt, Pseudomonas aeruginosa PA01
ucgucgaagcucggcgcgaug

SEQ ID NO: 3480957 - RNA, 18 nt, Pseudomonas aeruginosa PA01
ucgucgaagcugucguag

SEQ ID NO: 3480958 - RNA, 20 nt, Pseudomonas aeruginosa PA01
ucgucgaaggugaagcugcc

SEQ ID NO: 3480959 - RNA, 20 nt, Pseudomonas aeruginosa PA01
ucgucgaaguuuuccacgaa

SEQ ID NO: 3480960 - RNA, 21 nt, Pseudomonas aeruginosa PA01
ucgucgaccucgauggcgaua

SEQ ID NO: 3480961 - RNA, 15 nt, Pseudomonas aeruginosa PA01
ucgucgacgcccugg

SEQ ID NO: 3480962 - RNA, 14 nt, Pseudomonas aeruginosa PA01
ucgucgagcagcgc

SEQ ID NO: 3480963 - RNA, 16 nt, Pseudomonas aeruginosa PA01
ucgucgagcagcgcgc

SEQ ID NO: 3480964 - RNA, 19 nt, Pseudomonas aeruginosa PA01
ucgucgagcagcgcgcggc

SEQ ID NO: 3480965 - RNA, 19 nt, Pseudomonas aeruginosa PA01
ucgucgagcugcucggcgg

SEQ ID NO: 3480966 - RNA, 19 nt, Pseudomonas aeruginosa PA01
ucgucgaggaucuucuccg

SEQ ID NO: 3480967 - RNA, 19 nt, Pseudomonas aeruginosa PA01
ucgucgaggguggcgccga

SEQ ID NO: 3480968 - RNA, 22 nt, Pseudomonas aeruginosa PA01
ucgucgaggguugucaccggca

SEQ ID NO: 3480969 - RNA, 23 nt, Pseudomonas aeruginosa PA01
ucgucgaucagguccuggccgaa

SEQ ID NO: 3480970 - RNA, 17 nt, Pseudomonas aeruginosa PA01
ucgucgauccgcggauc

SEQ ID NO: 3480971 - RNA, 17 nt, Pseudomonas aeruginosa PA01
ucgucgaucucgccgaa

SEQ ID NO: 3480972 - RNA, 18 nt, Pseudomonas aeruginosa PA01
ucgucgaugaacagcgac

SEQ ID NO: 3480973 - RNA, 20 nt, Pseudomonas aeruginosa PA01
ucgucgaugaggucgcagcg

SEQ ID NO: 3480974 - RNA, 20 nt, Pseudomonas aeruginosa PA01
ucgucgaugcguccgcgcag

SEQ ID NO: 3480975 - RNA, 20 nt, Pseudomonas aeruginosa PA01
ucgucgaugcugccguagcg

SEQ ID NO: 3480976 - RNA, 20 nt, Pseudomonas aeruginosa PA01
ucgucgcaccuguuccagca

SEQ ID NO: 3480977 - RNA, 20 nt, Pseudomonas aeruginosa PA01
ucgucgccaaagaaaaggcc

SEQ ID NO: 3480978 - RNA, 17 nt, Pseudomonas aeruginosa PA01
ucgucgccaagcccggc

SEQ ID NO: 3480979 - RNA, 19 nt, Pseudomonas aeruginosa PA01
ucgucgccacgcccgccgu

SEQ ID NO: 3480980 - RNA, 19 nt, Pseudomonas aeruginosa PA01
ucgucgccaucgcucaccg

SEQ ID NO: 3480981 - RNA, 15 nt, Pseudomonas aeruginosa PA01
ucgucgcccuggccg

SEQ ID NO: 3480982 - RNA, 20 nt, Pseudomonas aeruginosa PA01
ucgucgcccuucaggucgac

SEQ ID NO: 3480983 - RNA, 16 nt, Pseudomonas aeruginosa PA01
ucgucgccgccgaggc

SEQ ID NO: 3480984 - RNA, 19 nt, Pseudomonas aeruginosa PA01
ucgucgccggaggggcggc

SEQ ID NO: 3480985 - RNA, 14 nt, Pseudomonas aeruginosa PA01
ucgucgcgcagcuc

SEQ ID NO: 3480986 - RNA, 13 nt, Pseudomonas aeruginosa PA01
ucgucgcgccagg

SEQ ID NO: 3480987 - RNA, 15 nt, Pseudomonas aeruginosa PA01
ucgucgcgccaggcg

SEQ ID NO: 3480988 - RNA, 15 nt, Pseudomonas aeruginosa PA01
ucgucgcggacuccg

SEQ ID NO: 3480989 - RNA, 12 nt, Pseudomonas aeruginosa PA01
ucgucgcggcgc

SEQ ID NO: 3480990 - RNA, 14 nt, Pseudomonas aeruginosa PA01
ucgucgcucugggu

SEQ ID NO: 3480991 - RNA, 16 nt, Pseudomonas aeruginosa PA01
ucgucgcuuccggcgc

SEQ ID NO: 3480992 - RNA, 18 nt, Pseudomonas aeruginosa PA01
ucgucgcuuccggcgcca

SEQ ID NO: 3480993 - RNA, 15 nt, Pseudomonas aeruginosa PA01
ucgucggcgaccuug

SEQ ID NO: 3480994 - RNA, 15 nt, Pseudomonas aeruginosa PA01
ucgucggcgcggccg

SEQ ID NO: 3480995 - RNA, 12 nt, Pseudomonas aeruginosa PA01
ucgucgggcaga

SEQ ID NO: 3480996 - RNA, 22 nt, Pseudomonas aeruginosa PA01
ucgucgggcagaguggcgcggc

SEQ ID NO: 3480997 - RNA, 16 nt, Pseudomonas aeruginosa PA01
ucgucggggugccgcc

SEQ ID NO: 3480998 - RNA, 18 nt, Pseudomonas aeruginosa PA01
ucgucggggugccgccag

SEQ ID NO: 3480999 - RNA, 21 nt, Pseudomonas aeruginosa PA01
ucgucggggugccgccagucg

SEQ ID NO: 3481000 - RNA, 17 nt, Pseudomonas aeruginosa PA01
ucgucggucgcgacggg

SEQ ID NO: 3481001 - RNA, 17 nt, Pseudomonas aeruginosa PA01
ucgucggucggccagga

SEQ ID NO: 3481002 - RNA, 17 nt, Pseudomonas aeruginosa PA01
ucgucguaguggccguc

SEQ ID NO: 3481003 - RNA, 13 nt, Pseudomonas aeruginosa PA01
ucgucguccagcg

SEQ ID NO: 3481004 - RNA, 16 nt, Pseudomonas aeruginosa PA01
ucgucguccagcgggc

SEQ ID NO: 3481005 - RNA, 17 nt, Pseudomonas aeruginosa PA01
ucgucguccaucgccgc

SEQ ID NO: 3481006 - RNA, 13 nt, Pseudomonas aeruginosa PA01
ucgucuggcgccu

SEQ ID NO: 3481007 - RNA, 16 nt, Pseudomonas aeruginosa PA01
ucgucuggcgccuggc

SEQ ID NO: 3481008 - RNA, 19 nt, Pseudomonas aeruginosa PA01
ucgucuggcgccuggccug

SEQ ID NO: 3481009 - RNA, 22 nt, Pseudomonas aeruginosa PA01
ucgucuuccagcggccacggcg

SEQ ID NO: 3481010 - RNA, 13 nt, Pseudomonas aeruginosa PA01
ucgucuuccggag

SEQ ID NO: 3481011 - RNA, 14 nt, Pseudomonas aeruginosa PA01
ucgucuucggccag

SEQ ID NO: 3481012 - RNA, 13 nt, Pseudomonas aeruginosa PA01
ucgucuuucaggu

SEQ ID NO: 3481013 - RNA, 15 nt, Pseudomonas aeruginosa PA01
ucgucuuucaggugg

SEQ ID NO: 3481014 - RNA, 20 nt, Pseudomonas aeruginosa PA01
ucgugcagcaagccgcagcg

SEQ ID NO: 3481015 - RNA, 13 nt, Pseudomonas aeruginosa PA01
ucgugcagcagcg

SEQ ID NO: 3481016 - RNA, 22 nt, Pseudomonas aeruginosa PA01
ucgugcagcccggucacgccgg

SEQ ID NO: 3481017 - RNA, 18 nt, Pseudomonas aeruginosa PA01
ucgugcagguagccgcgc

SEQ ID NO: 3481018 - RNA, 13 nt, Pseudomonas aeruginosa PA01
ucgugccacaggc

SEQ ID NO: 3481019 - RNA, 19 nt, Pseudomonas aeruginosa PA01
ucgugccacaggcccugga

SEQ ID NO: 3481020 - RNA, 20 nt, Pseudomonas aeruginosa PA01
ucgugccacaggcccuggau

SEQ ID NO: 3481021 - RNA, 15 nt, Pseudomonas aeruginosa PA01
ucgugcccgagcgac

SEQ ID NO: 3481022 - RNA, 13 nt, Pseudomonas aeruginosa PA01
ucgugcgccggcc

SEQ ID NO: 3481023 - RNA, 21 nt, Pseudomonas aeruginosa PA01
ucgugcuugcagucgcggaag

SEQ ID NO: 3481024 - RNA, 22 nt, Pseudomonas aeruginosa PA01
ucgugcuuggugucggccgcca

SEQ ID NO: 3481025 - RNA, 13 nt, Pseudomonas aeruginosa PA01
ucguggaaaaaga

SEQ ID NO: 3481026 - RNA, 17 nt, Pseudomonas aeruginosa PA01
ucguggaacagcgcguc

SEQ ID NO: 3481027 - RNA, 19 nt, Pseudomonas aeruginosa PA01
ucguggaacagcgcgucgc

SEQ ID NO: 3481028 - RNA, 21 nt, Pseudomonas aeruginosa PA01
ucguggaaguauugcuccacc

SEQ ID NO: 3481029 - RNA, 17 nt, Pseudomonas aeruginosa PA01
ucguggacauacaggcg

SEQ ID NO: 3481030 - RNA, 23 nt, Pseudomonas aeruginosa PA01
ucguggaugcugauaagcucggc

SEQ ID NO: 3481031 - RNA, 12 nt, Pseudomonas aeruginosa PA01
ucguggccgcgg

SEQ ID NO: 3481032 - RNA, 15 nt, Pseudomonas aeruginosa PA01
ucguggcggaagguc

SEQ ID NO: 3481033 - RNA, 14 nt, Pseudomonas aeruginosa PA01
ucguggucgccguc

SEQ ID NO: 3481034 - RNA, 19 nt, Pseudomonas aeruginosa PA01
ucguguaggguucgcugcc

SEQ ID NO: 3481035 - RNA, 23 nt, Pseudomonas aeruginosa PA01
ucguuacacagcuugggauggcc

SEQ ID NO: 3481036 - RNA, 23 nt, Pseudomonas aeruginosa PA01
ucguuaugcacguucuugaccuu

SEQ ID NO: 3481037 - RNA, 13 nt, Pseudomonas aeruginosa PA01
ucguucagcagca

SEQ ID NO: 3481038 - RNA, 16 nt, Pseudomonas aeruginosa PA01
ucguucagcccacccc

SEQ ID NO: 3481039 - RNA, 14 nt, Pseudomonas aeruginosa PA01
ucguucaguugccu

SEQ ID NO: 3481040 - RNA, 18 nt, Pseudomonas aeruginosa PA01
ucguucauguagcgcucc

SEQ ID NO: 3481041 - RNA, 18 nt, Pseudomonas aeruginosa PA01
ucguuccggcucagccgc

SEQ ID NO: 3481042 - RNA, 19 nt, Pseudomonas aeruginosa PA01
ucguuccggcucagccgcu

SEQ ID NO: 3481043 - RNA, 23 nt, Pseudomonas aeruginosa PA01
ucguucgcccagaccugcaauuc

SEQ ID NO: 3481044 - RNA, 22 nt, Pseudomonas aeruginosa PA01
ucguucggcuguuucaggccgg

SEQ ID NO: 3481045 - RNA, 23 nt, Pseudomonas aeruginosa PA01
ucguucguagaucccuucguccu

SEQ ID NO: 3481046 - RNA, 18 nt, Pseudomonas aeruginosa PA01
ucguucgucgccgacugc

SEQ ID NO: 3481047 - RNA, 16 nt, Pseudomonas aeruginosa PA01
ucguugaccacgcuca

SEQ ID NO: 3481048 - RNA, 13 nt, Pseudomonas aeruginosa PA01
ucguugcaggcac

SEQ ID NO: 3481049 - RNA, 23 nt, Pseudomonas aeruginosa PA01
ucguugcaggcacggaagcgcug

SEQ ID NO: 3481050 - RNA, 18 nt, Pseudomonas aeruginosa PA01
ucguugccagccggccuu

SEQ ID NO: 3481051 - RNA, 15 nt, Pseudomonas aeruginosa PA01
ucguugccauagccg

SEQ ID NO: 3481052 - RNA, 14 nt, Pseudomonas aeruginosa PA01
ucguugcccggcuu

SEQ ID NO: 3481053 - RNA, 19 nt, Pseudomonas aeruginosa PA01
ucguugcccggcuugccgu

SEQ ID NO: 3481054 - RNA, 17 nt, Pseudomonas aeruginosa PA01
ucguugccgucgagcac

SEQ ID NO: 3481055 - RNA, 21 nt, Pseudomonas aeruginosa PA01
ucguugcgaugggugccgcgc

SEQ ID NO: 3481056 - RNA, 12 nt, Pseudomonas aeruginosa PA01
ucguugcgcagc

SEQ ID NO: 3481057 - RNA, 15 nt, Pseudomonas aeruginosa PA01
ucguugcgccccggg

SEQ ID NO: 3481058 - RNA, 13 nt, Pseudomonas aeruginosa PA01
ucguugcgcgcca

SEQ ID NO: 3481059 - RNA, 19 nt, Pseudomonas aeruginosa PA01
ucguugcgcuaucggcccg

SEQ ID NO: 3481060 - RNA, 17 nt, Pseudomonas aeruginosa PA01
ucguugcggaacgcggc

SEQ ID NO: 3481061 - RNA, 19 nt, Pseudomonas aeruginosa PA01
ucguuggcaaagcccgcuu

SEQ ID NO: 3481062 - RNA, 14 nt, Pseudomonas aeruginosa PA01
ucguuggccaggcg

SEQ ID NO: 3481063 - RNA, 13 nt, Pseudomonas aeruginosa PA01
ucguuggcccaga

SEQ ID NO: 3481064 - RNA, 16 nt, Pseudomonas aeruginosa PA01
ucguuggcccagaccu

SEQ ID NO: 3481065 - RNA, 18 nt, Pseudomonas aeruginosa PA01
ucguuggcccagaccuug

SEQ ID NO: 3481066 - RNA, 20 nt, Pseudomonas aeruginosa PA01
ucguuggcgaaguucccgcc

SEQ ID NO: 3481067 - RNA, 13 nt, Pseudomonas aeruginosa PA01
ucguuggcgcgac

SEQ ID NO: 3481068 - RNA, 15 nt, Pseudomonas aeruginosa PA01
ucguuggcggccagc

SEQ ID NO: 3481069 - RNA, 21 nt, Pseudomonas aeruginosa PA01
ucguugggccggaacggcuug

SEQ ID NO: 3481070 - RNA, 17 nt, Pseudomonas aeruginosa PA01
ucguuguacuggccgaa

SEQ ID NO: 3481071 - RNA, 14 nt, Pseudomonas aeruginosa PA01
ucguuucagcgcca

SEQ ID NO: 3481072 - RNA, 18 nt, Pseudomonas aeruginosa PA01
ucguuucccggcgcggcu

SEQ ID NO: 3481073 - RNA, 19 nt, Pseudomonas aeruginosa PA01
ucuaaggggcggcucggcu

SEQ ID NO: 3481074 - RNA, 19 nt, Pseudomonas aeruginosa PA01
ucuaauuucaugucugcaa

SEQ ID NO: 3481075 - RNA, 20 nt, Pseudomonas aeruginosa PA01
ucuaccaggcgguuggcccg

SEQ ID NO: 3481076 - RNA, 14 nt, Pseudomonas aeruginosa PA01
ucuaccccgaccac

SEQ ID NO: 3481077 - RNA, 17 nt, Pseudomonas aeruginosa PA01
ucuaccgagaucaccuu

SEQ ID NO: 3481078 - RNA, 20 nt, Pseudomonas aeruginosa PA01
ucuacuaccgccagcgcacc

SEQ ID NO: 3481079 - RNA, 12 nt, Pseudomonas aeruginosa PA01
ucuacuucggcu

SEQ ID NO: 3481080 - RNA, 16 nt, Pseudomonas aeruginosa PA01
ucuagcgaaggcuccg

SEQ ID NO: 3481081 - RNA, 14 nt, Pseudomonas aeruginosa PA01
ucuagugaaagucc

SEQ ID NO: 3481082 - RNA, 13 nt, Pseudomonas aeruginosa PA01
ucuauaaugcgcc

SEQ ID NO: 3481083 - RNA, 20 nt, Pseudomonas aeruginosa PA01
ucuaucacacuguccagggc

SEQ ID NO: 3481084 - RNA, 20 nt, Pseudomonas aeruginosa PA01
ucucagcccucggcccggag

SEQ ID NO: 3481085 - RNA, 22 nt, Pseudomonas aeruginosa PA01
ucucagcgccguugcggcagca

SEQ ID NO: 3481086 - RNA, 22 nt, Pseudomonas aeruginosa PA01
ucucaggaccuuccgccagcag

SEQ ID NO: 3481087 - RNA, 15 nt, Pseudomonas aeruginosa PA01
ucucaggagcgccgc

SEQ ID NO: 3481088 - RNA, 14 nt, Pseudomonas aeruginosa PA01
ucucaggcgccagg

SEQ ID NO: 3481089 - RNA, 16 nt, Pseudomonas aeruginosa PA01
ucucauugcgccgccg

SEQ ID NO: 3481090 - RNA, 20 nt, Pseudomonas aeruginosa PA01
ucuccaacuggcggcugggc

SEQ ID NO: 3481091 - RNA, 18 nt, Pseudomonas aeruginosa PA01
ucuccacccguucgccgg

SEQ ID NO: 3481092 - RNA, 22 nt, Pseudomonas aeruginosa PA01
ucuccacccguucgccggccuc

SEQ ID NO: 3481093 - RNA, 22 nt, Pseudomonas aeruginosa PA01
ucuccaccggaucgcccuggcg

SEQ ID NO: 3481094 - RNA, 23 nt, Pseudomonas aeruginosa PA01
ucuccaccggaucgcccuggcgc

SEQ ID NO: 3481095 - RNA, 21 nt, Pseudomonas aeruginosa PA01
ucuccacgucguccggcgcca

SEQ ID NO: 3481096 - RNA, 13 nt, Pseudomonas aeruginosa PA01
ucuccagcaggcu

SEQ ID NO: 3481097 - RNA, 13 nt, Pseudomonas aeruginosa PA01
ucuccagcucggc

SEQ ID NO: 3481098 - RNA, 20 nt, Pseudomonas aeruginosa PA01
ucuccaggaccaguucgccg

SEQ ID NO: 3481099 - RNA, 21 nt, Pseudomonas aeruginosa PA01
ucuccaggaccaguucgccgc

SEQ ID NO: 3481100 - RNA, 15 nt, Pseudomonas aeruginosa PA01
ucuccaggcccaucc

SEQ ID NO: 3481101 - RNA, 20 nt, Pseudomonas aeruginosa PA01
ucuccaggcccauccuggcg

SEQ ID NO: 3481102 - RNA, 22 nt, Pseudomonas aeruginosa PA01
ucuccaggcgcgccgugcggcg

SEQ ID NO: 3481103 - RNA, 20 nt, Pseudomonas aeruginosa PA01
ucuccaggucgaacagcggc

SEQ ID NO: 3481104 - RNA, 21 nt, Pseudomonas aeruginosa PA01
ucuccaggucgaacagcggcu

SEQ ID NO: 3481105 - RNA, 23 nt, Pseudomonas aeruginosa PA01
ucuccaggucggucggcggcggu

SEQ ID NO: 3481106 - RNA, 18 nt, Pseudomonas aeruginosa PA01
ucuccaguucggcgauga

SEQ ID NO: 3481107 - RNA, 22 nt, Pseudomonas aeruginosa PA01
ucucccaggaguggugaagcgc

SEQ ID NO: 3481108 - RNA, 20 nt, Pseudomonas aeruginosa PA01
ucuccccaaccuucucccuu

SEQ ID NO: 3481109 - RNA, 18 nt, Pseudomonas aeruginosa PA01
ucuccccagacccucucc

SEQ ID NO: 3481110 - RNA, 21 nt, Pseudomonas aeruginosa PA01
ucucccgaggcgaucgccgcg

SEQ ID NO: 3481111 - RNA, 18 nt, Pseudomonas aeruginosa PA01
ucucccgcuccgauggcg

SEQ ID NO: 3481112 - RNA, 15 nt, Pseudomonas aeruginosa PA01
ucuccgagacgcugc

SEQ ID NO: 3481113 - RNA, 15 nt, Pseudomonas aeruginosa PA01
ucuccgccagccagc

SEQ ID NO: 3481114 - RNA, 17 nt, Pseudomonas aeruginosa PA01
ucuccgccagccagccg

SEQ ID NO: 3481115 - RNA, 15 nt, Pseudomonas aeruginosa PA01
ucuccgccaggcggc

SEQ ID NO: 3481116 - RNA, 20 nt, Pseudomonas aeruginosa PA01
ucuccgccgcuaucgccgcc

SEQ ID NO: 3481117 - RNA, 23 nt, Pseudomonas aeruginosa PA01
ucuccgccgcuaucgccgccgca

SEQ ID NO: 3481118 - RNA, 23 nt, Pseudomonas aeruginosa PA01
ucuccgccggggguguugaaagc

SEQ ID NO: 3481119 - RNA, 14 nt, Pseudomonas aeruginosa PA01
ucuccgcgccacgc

SEQ ID NO: 3481120 - RNA, 18 nt, Pseudomonas aeruginosa PA01
ucuccgcgccgggcuggc

SEQ ID NO: 3481121 - RNA, 14 nt, Pseudomonas aeruginosa PA01
ucuccgcggagagg

SEQ ID NO: 3481122 - RNA, 22 nt, Pseudomonas aeruginosa PA01
ucuccgcucgggguucgacccg

SEQ ID NO: 3481123 - RNA, 17 nt, Pseudomonas aeruginosa PA01
ucuccggcaccguggug

SEQ ID NO: 3481124 - RNA, 15 nt, Pseudomonas aeruginosa PA01
ucuccggcgccgggc

SEQ ID NO: 3481125 - RNA, 15 nt, Pseudomonas aeruginosa PA01
ucuccggggcccggc

SEQ ID NO: 3481126 - RNA, 16 nt, Pseudomonas aeruginosa PA01
ucuccgucaaugcggc

SEQ ID NO: 3481127 - RNA, 16 nt, Pseudomonas aeruginosa PA01
ucuccgugcuggccgg

SEQ ID NO: 3481128 - RNA, 19 nt, Pseudomonas aeruginosa PA01
ucuccgugcuggccggcag

SEQ ID NO: 3481129 - RNA, 15 nt, Pseudomonas aeruginosa PA01
ucuccucccgccccu

SEQ ID NO: 3481130 - RNA, 23 nt, Pseudomonas aeruginosa PA01
ucuccucccgccccuccaguucc

SEQ ID NO: 3481131 - RNA, 21 nt, Pseudomonas aeruginosa PA01
ucuccucgauccgcugggccu

SEQ ID NO: 3481132 - RNA, 19 nt, Pseudomonas aeruginosa PA01
ucuccucgcugaugugccg

SEQ ID NO: 3481133 - RNA, 13 nt, Pseudomonas aeruginosa PA01
ucuccucggccaa

SEQ ID NO: 3481134 - RNA, 18 nt, Pseudomonas aeruginosa PA01
ucuccucggccgacaggc

SEQ ID NO: 3481135 - RNA, 15 nt, Pseudomonas aeruginosa PA01
ucuccugccgcggcg

SEQ ID NO: 3481136 - RNA, 13 nt, Pseudomonas aeruginosa PA01
ucuccugcuggac

SEQ ID NO: 3481137 - RNA, 22 nt, Pseudomonas aeruginosa PA01
ucuccuggcgcgucaugccgcc

SEQ ID NO: 3481138 - RNA, 14 nt, Pseudomonas aeruginosa PA01
ucucgaacaccggc

SEQ ID NO: 3481139 - RNA, 16 nt, Pseudomonas aeruginosa PA01
ucucgaacaccggcga

SEQ ID NO: 3481140 - RNA, 13 nt, Pseudomonas aeruginosa PA01
ucucgaacagcag

SEQ ID NO: 3481141 - RNA, 16 nt, Pseudomonas aeruginosa PA01
ucucgaagaccagcgg

SEQ ID NO: 3481142 - RNA, 22 nt, Pseudomonas aeruginosa PA01
ucucgaagccgaggcuuuccag

SEQ ID NO: 3481143 - RNA, 15 nt, Pseudomonas aeruginosa PA01
ucucgaagcgcgccu

SEQ ID NO: 3481144 - RNA, 17 nt, Pseudomonas aeruginosa PA01
ucucgacccgcucgagg

SEQ ID NO: 3481145 - RNA, 23 nt, Pseudomonas aeruginosa PA01
ucucgacgaaggcgcgcucgauc

SEQ ID NO: 3481146 - RNA, 20 nt, Pseudomonas aeruginosa PA01
ucucgacguaggcggcgaag

SEQ ID NO: 3481147 - RNA, 15 nt, Pseudomonas aeruginosa PA01
ucucgagcaugucgg

SEQ ID NO: 3481148 - RNA, 21 nt, Pseudomonas aeruginosa PA01
ucucgaucaucgccagcggcg

SEQ ID NO: 3481149 - RNA, 14 nt, Pseudomonas aeruginosa PA01
ucucgcagcaggcg

SEQ ID NO: 3481150 - RNA, 21 nt, Pseudomonas aeruginosa PA01
ucucgcagcaggcguucggcg

SEQ ID NO: 3481151 - RNA, 19 nt, Pseudomonas aeruginosa PA01
ucucgccaccccgcuccgc

SEQ ID NO: 3481152 - RNA, 17 nt, Pseudomonas aeruginosa PA01
ucucgccagcccggcag

SEQ ID NO: 3481153 - RNA, 15 nt, Pseudomonas aeruginosa PA01
ucucgcccagggcgu

SEQ ID NO: 3481154 - RNA, 21 nt, Pseudomonas aeruginosa PA01
ucucgcccaguaccgccacgu

SEQ ID NO: 3481155 - RNA, 21 nt, Pseudomonas aeruginosa PA01
ucucgccgaugcccgggcguu

SEQ ID NO: 3481156 - RNA, 13 nt, Pseudomonas aeruginosa PA01
ucucgccgccgga

SEQ ID NO: 3481157 - RNA, 15 nt, Pseudomonas aeruginosa PA01
ucucgccucccggcu

SEQ ID NO: 3481158 - RNA, 16 nt, Pseudomonas aeruginosa PA01
ucucgcgacccuggcc

SEQ ID NO: 3481159 - RNA, 23 nt, Pseudomonas aeruginosa PA01
ucucgcgcacgcuguagaccagc

SEQ ID NO: 3481160 - RNA, 13 nt, Pseudomonas aeruginosa PA01
ucucgcgccccgg

SEQ ID NO: 3481161 - RNA, 12 nt, Pseudomonas aeruginosa PA01
ucucgcggcgcg

SEQ ID NO: 3481162 - RNA, 14 nt, Pseudomonas aeruginosa PA01
ucucgcggcgcggc

SEQ ID NO: 3481163 - RNA, 15 nt, Pseudomonas aeruginosa PA01
ucucgcggcgcggcg

SEQ ID NO: 3481164 - RNA, 12 nt, Pseudomonas aeruginosa PA01
ucucgcggcgga

SEQ ID NO: 3481165 - RNA, 19 nt, Pseudomonas aeruginosa PA01
ucucgcguucaucgucggc

SEQ ID NO: 3481166 - RNA, 16 nt, Pseudomonas aeruginosa PA01
ucucgcguuccagcac

SEQ ID NO: 3481167 - RNA, 16 nt, Pseudomonas aeruginosa PA01
ucucgcugacccaggc

SEQ ID NO: 3481168 - RNA, 14 nt, Pseudomonas aeruginosa PA01
ucucgcugguggcg

SEQ ID NO: 3481169 - RNA, 16 nt, Pseudomonas aeruginosa PA01
ucucggccaccaccac

SEQ ID NO: 3481170 - RNA, 21 nt, Pseudomonas aeruginosa PA01
ucucggccaccugcuccggcg

SEQ ID NO: 3481171 - RNA, 12 nt, Pseudomonas aeruginosa PA01
ucucggccaggc

SEQ ID NO: 3481172 - RNA, 22 nt, Pseudomonas aeruginosa PA01
ucucggcgaacgacagcaccau

SEQ ID NO: 3481173 - RNA, 12 nt, Pseudomonas aeruginosa PA01
ucucggcugccg

SEQ ID NO: 3481174 - RNA, 14 nt, Pseudomonas aeruginosa PA01
ucucggcugccgcc

SEQ ID NO: 3481175 - RNA, 17 nt, Pseudomonas aeruginosa PA01
ucucggcugccgccagc

SEQ ID NO: 3481176 - RNA, 18 nt, Pseudomonas aeruginosa PA01
ucucggcugccgccagcu

SEQ ID NO: 3481177 - RNA, 13 nt, Pseudomonas aeruginosa PA01
ucucggucgccgc

SEQ ID NO: 3481178 - RNA, 17 nt, Pseudomonas aeruginosa PA01
ucucggucgccgccagc

SEQ ID NO: 3481179 - RNA, 18 nt, Pseudomonas aeruginosa PA01
ucucggugcucaggcggc

SEQ ID NO: 3481180 - RNA, 19 nt, Pseudomonas aeruginosa PA01
ucucgguguccaccaccag

SEQ ID NO: 3481181 - RNA, 21 nt, Pseudomonas aeruginosa PA01
ucucgguguccaccaccagca

SEQ ID NO: 3481182 - RNA, 16 nt, Pseudomonas aeruginosa PA01
ucucgguuuccaggau

SEQ ID NO: 3481183 - RNA, 14 nt, Pseudomonas aeruginosa PA01
ucucguccggcgug

SEQ ID NO: 3481184 - RNA, 13 nt, Pseudomonas aeruginosa PA01
ucucgucgccgac

SEQ ID NO: 3481185 - RNA, 16 nt, Pseudomonas aeruginosa PA01
ucucgugggccagcag

SEQ ID NO: 3481186 - RNA, 17 nt, Pseudomonas aeruginosa PA01
ucucuacuaccgccagc

SEQ ID NO: 3481187 - RNA, 15 nt, Pseudomonas aeruginosa PA01
ucucucgccucggcg

SEQ ID NO: 3481188 - RNA, 15 nt, Pseudomonas aeruginosa PA01
ucucucuucagcagg

SEQ ID NO: 3481189 - RNA, 16 nt, Pseudomonas aeruginosa PA01
ucucugcgagacgggc

SEQ ID NO: 3481190 - RNA, 17 nt, Pseudomonas aeruginosa PA01
ucugauugcguaacguu

SEQ ID NO: 3481191 - RNA, 13 nt, Pseudomonas aeruginosa PA01
ucugcaacgcggc

SEQ ID NO: 3481192 - RNA, 15 nt, Pseudomonas aeruginosa PA01
ucugcaacgcggcgu

SEQ ID NO: 3481193 - RNA, 19 nt, Pseudomonas aeruginosa PA01
ucugcaacgcggcgucagg

SEQ ID NO: 3481194 - RNA, 24 nt, Pseudomonas aeruginosa PA01
ucugcaauugcuugcgcucgagcc

SEQ ID NO: 3481195 - RNA, 15 nt, Pseudomonas aeruginosa PA01
ucugcaccgcccuuu

SEQ ID NO: 3481196 - RNA, 18 nt, Pseudomonas aeruginosa PA01
ucugcaccgugcgcgcgg

SEQ ID NO: 3481197 - RNA, 16 nt, Pseudomonas aeruginosa PA01
ucugcaccucaugcug

SEQ ID NO: 3481198 - RNA, 21 nt, Pseudomonas aeruginosa PA01
ucugcacgucguagcccuucu

SEQ ID NO: 3481199 - RNA, 19 nt, Pseudomonas aeruginosa PA01
ucugcagcuugcgcgccag

SEQ ID NO: 3481200 - RNA, 20 nt, Pseudomonas aeruginosa PA01
ucugcaggacgaagucgccg

SEQ ID NO: 3481201 - RNA, 12 nt, Pseudomonas aeruginosa PA01
ucugcaggccgu

SEQ ID NO: 3481202 - RNA, 23 nt, Pseudomonas aeruginosa PA01
ucugcauggcaccgucaagggcc

SEQ ID NO: 3481203 - RNA, 16 nt, Pseudomonas aeruginosa PA01
ucugccacccggcgcc

SEQ ID NO: 3481204 - RNA, 17 nt, Pseudomonas aeruginosa PA01
ucugccagaaggccugc

SEQ ID NO: 3481205 - RNA, 13 nt, Pseudomonas aeruginosa PA01
ucugcccgccggc

SEQ ID NO: 3481206 - RNA, 14 nt, Pseudomonas aeruginosa PA01
ucugcccgccggcg

SEQ ID NO: 3481207 - RNA, 14 nt, Pseudomonas aeruginosa PA01
ucugcccggcaucg

SEQ ID NO: 3481208 - RNA, 17 nt, Pseudomonas aeruginosa PA01
ucugcccggcuucgcug

SEQ ID NO: 3481209 - RNA, 12 nt, Pseudomonas aeruginosa PA01
ucugccgcagac

SEQ ID NO: 3481210 - RNA, 13 nt, Pseudomonas aeruginosa PA01
ucugccgcgacag

SEQ ID NO: 3481211 - RNA, 20 nt, Pseudomonas aeruginosa PA01
ucugccgguaggucaccagg

SEQ ID NO: 3481212 - RNA, 21 nt, Pseudomonas aeruginosa PA01
ucugccggucggaacgaccac

SEQ ID NO: 3481213 - RNA, 16 nt, Pseudomonas aeruginosa PA01
ucugccucgccgaggc

SEQ ID NO: 3481214 - RNA, 20 nt, Pseudomonas aeruginosa PA01
ucugccucgccgaggcggaa

SEQ ID NO: 3481215 - RNA, 19 nt, Pseudomonas aeruginosa PA01
ucugcgacaucuccaggcc

SEQ ID NO: 3481216 - RNA, 15 nt, Pseudomonas aeruginosa PA01
ucugcgagacgggcg

SEQ ID NO: 3481217 - RNA, 20 nt, Pseudomonas aeruginosa PA01
ucugcgagacgggcgacgcc

SEQ ID NO: 3481218 - RNA, 14 nt, Pseudomonas aeruginosa PA01
ucugcgagccgcgc

SEQ ID NO: 3481219 - RNA, 15 nt, Pseudomonas aeruginosa PA01
ucugcgagccgcgcg

SEQ ID NO: 3481220 - RNA, 14 nt, Pseudomonas aeruginosa PA01
ucugcgaguaguag

SEQ ID NO: 3481221 - RNA, 15 nt, Pseudomonas aeruginosa PA01
ucugcgaucagggcc

SEQ ID NO: 3481222 - RNA, 19 nt, Pseudomonas aeruginosa PA01
ucugcgaucagggccucgc

SEQ ID NO: 3481223 - RNA, 20 nt, Pseudomonas aeruginosa PA01
ucugcgaucagggccucgcc

SEQ ID NO: 3481224 - RNA, 19 nt, Pseudomonas aeruginosa PA01
ucugcgcaccaugcccgcu

SEQ ID NO: 3481225 - RNA, 13 nt, Pseudomonas aeruginosa PA01
ucugcgccaggcg

SEQ ID NO: 3481226 - RNA, 13 nt, Pseudomonas aeruginosa PA01
ucugcgccgcggc

SEQ ID NO: 3481227 - RNA, 14 nt, Pseudomonas aeruginosa PA01
ucugcgccgcggcg

SEQ ID NO: 3481228 - RNA, 16 nt, Pseudomonas aeruginosa PA01
ucugcgccgcggcguu

SEQ ID NO: 3481229 - RNA, 14 nt, Pseudomonas aeruginosa PA01
ucugcgccuccucg

SEQ ID NO: 3481230 - RNA, 16 nt, Pseudomonas aeruginosa PA01
ucugcgccuccucggc

SEQ ID NO: 3481231 - RNA, 17 nt, Pseudomonas aeruginosa PA01
ucugcgccucgcuggcg

SEQ ID NO: 3481232 - RNA, 12 nt, Pseudomonas aeruginosa PA01
ucugcgcggcgu

SEQ ID NO: 3481233 - RNA, 20 nt, Pseudomonas aeruginosa PA01
ucugcgcguugcagcgccug

SEQ ID NO: 3481234 - RNA, 23 nt, Pseudomonas aeruginosa PA01
ucugcggacuaccuucgaucacc

SEQ ID NO: 3481235 - RNA, 13 nt, Pseudomonas aeruginosa PA01
ucugcguaacguu

SEQ ID NO: 3481236 - RNA, 23 nt, Pseudomonas aeruginosa PA01
ucugcuccagcaaugccagcgcc

SEQ ID NO: 3481237 - RNA, 13 nt, Pseudomonas aeruginosa PA01
ucugcuccugcag

SEQ ID NO: 3481238 - RNA, 17 nt, Pseudomonas aeruginosa PA01
ucugcucggccagcgcc

SEQ ID NO: 3481239 - RNA, 13 nt, Pseudomonas aeruginosa PA01
ucugcucggcgau

SEQ ID NO: 3481240 - RNA, 13 nt, Pseudomonas aeruginosa PA01
ucugcucggcgcc

SEQ ID NO: 3481241 - RNA, 21 nt, Pseudomonas aeruginosa PA01
ucugcucggcgcccugggugg

SEQ ID NO: 3481242 - RNA, 16 nt, Pseudomonas aeruginosa PA01
ucugcucguccaggcc

SEQ ID NO: 3481243 - RNA, 16 nt, Pseudomonas aeruginosa PA01
ucugcugcgcgcacca

SEQ ID NO: 3481244 - RNA, 13 nt, Pseudomonas aeruginosa PA01
ucugcuggccacc

SEQ ID NO: 3481245 - RNA, 16 nt, Pseudomonas aeruginosa PA01
ucugcuggccacccuu

SEQ ID NO: 3481246 - RNA, 12 nt, Pseudomonas aeruginosa PA01
ucugcuggccgc

SEQ ID NO: 3481247 - RNA, 14 nt, Pseudomonas aeruginosa PA01
ucugcuggccgcgc

SEQ ID NO: 3481248 - RNA, 12 nt, Pseudomonas aeruginosa PA01
ucugcugguuga

SEQ ID NO: 3481249 - RNA, 13 nt, Pseudomonas aeruginosa PA01
ucugcugguugag

SEQ ID NO: 3481250 - RNA, 19 nt, Pseudomonas aeruginosa PA01
ucugcugguugaggccguc

SEQ ID NO: 3481251 - RNA, 20 nt, Pseudomonas aeruginosa PA01
ucugcugugcgucgagggcc

SEQ ID NO: 3481252 - RNA, 18 nt, Pseudomonas aeruginosa PA01
ucugcuguggagccggug

SEQ ID NO: 3481253 - RNA, 19 nt, Pseudomonas aeruginosa PA01
ucuggaucaguucgaucuu

SEQ ID NO: 3481254 - RNA, 22 nt, Pseudomonas aeruginosa PA01
ucuggaugaacgacuccagcuu

SEQ ID NO: 3481255 - RNA, 18 nt, Pseudomonas aeruginosa PA01
ucuggaugcagccggggc

SEQ ID NO: 3481256 - RNA, 17 nt, Pseudomonas aeruginosa PA01
ucuggaugcggcgcugc

SEQ ID NO: 3481257 - RNA, 16 nt, Pseudomonas aeruginosa PA01
ucuggccagaaggucg

SEQ ID NO: 3481258 - RNA, 17 nt, Pseudomonas aeruginosa PA01
ucuggccagaaggucgg

SEQ ID NO: 3481259 - RNA, 22 nt, Pseudomonas aeruginosa PA01
ucuggccauagaaaccgucuua

SEQ ID NO: 3481260 - RNA, 12 nt, Pseudomonas aeruginosa PA01
ucuggcccagcu

SEQ ID NO: 3481261 - RNA, 15 nt, Pseudomonas aeruginosa PA01
ucuggcccagcuuga

SEQ ID NO: 3481262 - RNA, 17 nt, Pseudomonas aeruginosa PA01
ucuggcccugcaacagg

SEQ ID NO: 3481263 - RNA, 16 nt, Pseudomonas aeruginosa PA01
ucuggccgaugccgac

SEQ ID NO: 3481264 - RNA, 19 nt, Pseudomonas aeruginosa PA01
ucuggccgaugccgaccuu

SEQ ID NO: 3481265 - RNA, 20 nt, Pseudomonas aeruginosa PA01
ucuggcgcauccgcccgauc

SEQ ID NO: 3481266 - RNA, 15 nt, Pseudomonas aeruginosa PA01
ucuggcgccuggccu

SEQ ID NO: 3481267 - RNA, 17 nt, Pseudomonas aeruginosa PA01
ucuggcggcccugguug

SEQ ID NO: 3481268 - RNA, 21 nt, Pseudomonas aeruginosa PA01
ucuggcugaagacccugcaca

SEQ ID NO: 3481269 - RNA, 17 nt, Pseudomonas aeruginosa PA01
ucuggcugucgccgauc

SEQ ID NO: 3481270 - RNA, 15 nt, Pseudomonas aeruginosa PA01
ucugggacggcagcc

SEQ ID NO: 3481271 - RNA, 20 nt, Pseudomonas aeruginosa PA01
ucugggaguuccgcgcaacc

SEQ ID NO: 3481272 - RNA, 19 nt, Pseudomonas aeruginosa PA01
ucugggcauggcuggcgcu

SEQ ID NO: 3481273 - RNA, 20 nt, Pseudomonas aeruginosa PA01
ucugggccaugaccucggcc

SEQ ID NO: 3481274 - RNA, 15 nt, Pseudomonas aeruginosa PA01
ucugggcggccaggu

SEQ ID NO: 3481275 - RNA, 23 nt, Pseudomonas aeruginosa PA01
ucuggggucaguucguugagggc

SEQ ID NO: 3481276 - RNA, 21 nt, Pseudomonas aeruginosa PA01
ucuggggugaggccgagccga

SEQ ID NO: 3481277 - RNA, 19 nt, Pseudomonas aeruginosa PA01
ucugggucgcgcagggcag

SEQ ID NO: 3481278 - RNA, 15 nt, Pseudomonas aeruginosa PA01
ucugggugaccagca

SEQ ID NO: 3481279 - RNA, 16 nt, Pseudomonas aeruginosa PA01
ucuggguuucgucgcg

SEQ ID NO: 3481280 - RNA, 14 nt, Pseudomonas aeruginosa PA01
ucugguagcgggcc

SEQ ID NO: 3481281 - RNA, 16 nt, Pseudomonas aeruginosa PA01
ucugguagcugcggcc

SEQ ID NO: 3481282 - RNA, 19 nt, Pseudomonas aeruginosa PA01
ucugguagcugcggccgag

SEQ ID NO: 3481283 - RNA, 19 nt, Pseudomonas aeruginosa PA01
ucugguugcucaccaaugc

SEQ ID NO: 3481284 - RNA, 18 nt, Pseudomonas aeruginosa PA01
ucugucgcagcgggcuga

SEQ ID NO: 3481285 - RNA, 13 nt, Pseudomonas aeruginosa PA01
ucugucuuguccu

SEQ ID NO: 3481286 - RNA, 14 nt, Pseudomonas aeruginosa PA01
ucugugcggcgaug

SEQ ID NO: 3481287 - RNA, 14 nt, Pseudomonas aeruginosa PA01
ucugugcggugccg

SEQ ID NO: 3481288 - RNA, 13 nt, Pseudomonas aeruginosa PA01
ucugugcuuugcc

SEQ ID NO: 3481289 - RNA, 18 nt, Pseudomonas aeruginosa PA01
ucuguucgaccaguugcc

SEQ ID NO: 3481290 - RNA, 13 nt, Pseudomonas aeruginosa PA01
ucuguucggccag

SEQ ID NO: 3481291 - RNA, 21 nt, Pseudomonas aeruginosa PA01
ucuguugguggggcgccggcu

SEQ ID NO: 3481292 - RNA, 21 nt, Pseudomonas aeruginosa PA01
ucuguuucgggucgcccuuga

SEQ ID NO: 3481293 - RNA, 14 nt, Pseudomonas aeruginosa PA01
ucuucaccaggccg

SEQ ID NO: 3481294 - RNA, 22 nt, Pseudomonas aeruginosa PA01
ucuucacgacgaacucaacgaa

SEQ ID NO: 3481295 - RNA, 15 nt, Pseudomonas aeruginosa PA01
ucuucacgccuugcu

SEQ ID NO: 3481296 - RNA, 18 nt, Pseudomonas aeruginosa PA01
ucuucacuuccagcugcc

SEQ ID NO: 3481297 - RNA, 16 nt, Pseudomonas aeruginosa PA01
ucuucagcacuucggc

SEQ ID NO: 3481298 - RNA, 17 nt, Pseudomonas aeruginosa PA01
ucuucagcagcaggcgc

SEQ ID NO: 3481299 - RNA, 14 nt, Pseudomonas aeruginosa PA01
ucuucagccugggg

SEQ ID NO: 3481300 - RNA, 23 nt, Pseudomonas aeruginosa PA01
ucuucaggcaaggucgucucaga

SEQ ID NO: 3481301 - RNA, 17 nt, Pseudomonas aeruginosa PA01
ucuucaggccguucagg

SEQ ID NO: 3481302 - RNA, 20 nt, Pseudomonas aeruginosa PA01
ucuucaggcugucggccauc

SEQ ID NO: 3481303 - RNA, 23 nt, Pseudomonas aeruginosa PA01
ucuucaguaggccagcggcuccu

SEQ ID NO: 3481304 - RNA, 21 nt, Pseudomonas aeruginosa PA01
ucuuccaccguggcgacgaug

SEQ ID NO: 3481305 - RNA, 15 nt, Pseudomonas aeruginosa PA01
ucuuccacuugcgcc

SEQ ID NO: 3481306 - RNA, 15 nt, Pseudomonas aeruginosa PA01
ucuuccagcaugcuc

SEQ ID NO: 3481307 - RNA, 13 nt, Pseudomonas aeruginosa PA01
ucuuccaggugau

SEQ ID NO: 3481308 - RNA, 17 nt, Pseudomonas aeruginosa PA01
ucuuccaguuggccggg

SEQ ID NO: 3481309 - RNA, 17 nt, Pseudomonas aeruginosa PA01
ucuucccagaccccggc

SEQ ID NO: 3481310 - RNA, 18 nt, Pseudomonas aeruginosa PA01
ucuucccagaccccggcg

SEQ ID NO: 3481311 - RNA, 17 nt, Pseudomonas aeruginosa PA01
ucuuccccuaccggcaa

SEQ ID NO: 3481312 - RNA, 14 nt, Pseudomonas aeruginosa PA01
ucuucccggcucgg

SEQ ID NO: 3481313 - RNA, 12 nt, Pseudomonas aeruginosa PA01
ucuuccggagcc

SEQ ID NO: 3481314 - RNA, 16 nt, Pseudomonas aeruginosa PA01
ucuuccggcucgccgc

SEQ ID NO: 3481315 - RNA, 21 nt, Pseudomonas aeruginosa PA01
ucuuccucgaaggucgcgaug

SEQ ID NO: 3481316 - RNA, 15 nt, Pseudomonas aeruginosa PA01
ucuuccucgcugccu

SEQ ID NO: 3481317 - RNA, 13 nt, Pseudomonas aeruginosa PA01
ucuuccuggccgg

SEQ ID NO: 3481318 - RNA, 14 nt, Pseudomonas aeruginosa PA01
ucuuccuggccggg

SEQ ID NO: 3481319 - RNA, 23 nt, Pseudomonas aeruginosa PA01
ucuuccuggccgggaaccagcau

SEQ ID NO: 3481320 - RNA, 12 nt, Pseudomonas aeruginosa PA01
ucuuccuggguc

SEQ ID NO: 3481321 - RNA, 11 nt, Pseudomonas aeruginosa PA01
ucuuccuuguc

SEQ ID NO: 3481322 - RNA, 20 nt, Pseudomonas aeruginosa PA01
ucuucgaaguuguagguaua

SEQ ID NO: 3481323 - RNA, 14 nt, Pseudomonas aeruginosa PA01
ucuucgaugcgccg

SEQ ID NO: 3481324 - RNA, 12 nt, Pseudomonas aeruginosa PA01
ucuucgauggcg

SEQ ID NO: 3481325 - RNA, 19 nt, Pseudomonas aeruginosa PA01
ucuucgauggcggccgcca

SEQ ID NO: 3481326 - RNA, 14 nt, Pseudomonas aeruginosa PA01
ucuucgccaguucc

SEQ ID NO: 3481327 - RNA, 14 nt, Pseudomonas aeruginosa PA01
ucuucgccuugccc

SEQ ID NO: 3481328 - RNA, 18 nt, Pseudomonas aeruginosa PA01
ucuucgcgugggccaggg

SEQ ID NO: 3481329 - RNA, 22 nt, Pseudomonas aeruginosa PA01
ucuucgcguuggcggugccgca

SEQ ID NO: 3481330 - RNA, 22 nt, Pseudomonas aeruginosa PA01
ucuucggcggccagcggaugcu

SEQ ID NO: 3481331 - RNA, 23 nt, Pseudomonas aeruginosa PA01
ucuucggcggccagcggaugcug

SEQ ID NO: 3481332 - RNA, 15 nt, Pseudomonas aeruginosa PA01
ucuucggcggcgccg

SEQ ID NO: 3481333 - RNA, 15 nt, Pseudomonas aeruginosa PA01
ucuucgguggcggcg

SEQ ID NO: 3481334 - RNA, 16 nt, Pseudomonas aeruginosa PA01
ucuucgguggcggcga

SEQ ID NO: 3481335 - RNA, 13 nt, Pseudomonas aeruginosa PA01
ucuucguagguca

SEQ ID NO: 3481336 - RNA, 22 nt, Pseudomonas aeruginosa PA01
ucuucguggacggacagggaaa

SEQ ID NO: 3481337 - RNA, 16 nt, Pseudomonas aeruginosa PA01
ucuucguuccaucgca

SEQ ID NO: 3481338 - RNA, 22 nt, Pseudomonas aeruginosa PA01
ucuucuggaaaucggcguccug

SEQ ID NO: 3481339 - RNA, 17 nt, Pseudomonas aeruginosa PA01
ucuucugguaggccagc

SEQ ID NO: 3481340 - RNA, 17 nt, Pseudomonas aeruginosa PA01
ucuucuucaaccgcugg

SEQ ID NO: 3481341 - RNA, 21 nt, Pseudomonas aeruginosa PA01
ucuugaagaagcugccggcau

SEQ ID NO: 3481342 - RNA, 14 nt, Pseudomonas aeruginosa PA01
ucuugaucacuucc

SEQ ID NO: 3481343 - RNA, 22 nt, Pseudomonas aeruginosa PA01
ucuugauccgcuccagcgccuc

SEQ ID NO: 3481344 - RNA, 17 nt, Pseudomonas aeruginosa PA01
ucuugcccugccagcgg

SEQ ID NO: 3481345 - RNA, 17 nt, Pseudomonas aeruginosa PA01
ucuugccgcuguuggcg

SEQ ID NO: 3481346 - RNA, 13 nt, Pseudomonas aeruginosa PA01
ucuugcgcaggcg

SEQ ID NO: 3481347 - RNA, 14 nt, Pseudomonas aeruginosa PA01
ucuugcgcagggcg

SEQ ID NO: 3481348 - RNA, 14 nt, Pseudomonas aeruginosa PA01
ucuugcgcauuuug

SEQ ID NO: 3481349 - RNA, 22 nt, Pseudomonas aeruginosa PA01
ucuugcgcauuuugccggagau

SEQ ID NO: 3481350 - RNA, 23 nt, Pseudomonas aeruginosa PA01
ucuugcgcauuuugccggagaug

SEQ ID NO: 3481351 - RNA, 15 nt, Pseudomonas aeruginosa PA01
ucuugcgcccggcgc

SEQ ID NO: 3481352 - RNA, 18 nt, Pseudomonas aeruginosa PA01
ucuugcgcuugccggccg

SEQ ID NO: 3481353 - RNA, 21 nt, Pseudomonas aeruginosa PA01
ucuugcggcaauucuugaucc

SEQ ID NO: 3481354 - RNA, 10 nt, Pseudomonas aeruginosa PA01
ucuuggccag

SEQ ID NO: 3481355 - RNA, 23 nt, Pseudomonas aeruginosa PA01
ucuuggcccauucguagaggcug

SEQ ID NO: 3481356 - RNA, 15 nt, Pseudomonas aeruginosa PA01
ucuugggcucugccu

SEQ ID NO: 3481357 - RNA, 17 nt, Pseudomonas aeruginosa PA01
ucuuguaguucaucuug

SEQ ID NO: 3481358 - RNA, 17 nt, Pseudomonas aeruginosa PA01
ucuuuaacaagucgaau

SEQ ID NO: 3481359 - RNA, 18 nt, Pseudomonas aeruginosa PA01
ucuuucacgguaaaacaa

SEQ ID NO: 3481360 - RNA, 23 nt, Pseudomonas aeruginosa PA01
ucuuucagcugagucgcuucacu

SEQ ID NO: 3481361 - RNA, 20 nt, Pseudomonas aeruginosa PA01
ucuuucauuuucgcgcucag

SEQ ID NO: 3481362 - RNA, 12 nt, Pseudomonas aeruginosa PA01
ucuuuuccugcu

SEQ ID NO: 3481363 - RNA, 12 nt, Pseudomonas aeruginosa PA01
ugaaaaaagggg

SEQ ID NO: 3481364 - RNA, 20 nt, Pseudomonas aeruginosa PA01
ugaaaaagccccgccgaagc

SEQ ID NO: 3481365 - RNA, 16 nt, Pseudomonas aeruginosa PA01
ugaaaaaggccgguug

SEQ ID NO: 3481366 - RNA, 22 nt, Pseudomonas aeruginosa PA01
ugaaaaauggccgcuugaagcg

SEQ ID NO: 3481367 - RNA, 14 nt, Pseudomonas aeruginosa PA01
ugaaaaucaaggau

SEQ ID NO: 3481368 - RNA, 16 nt, Pseudomonas aeruginosa PA01
ugaaaaucaaggauuu

SEQ ID NO: 3481369 - RNA, 14 nt, Pseudomonas aeruginosa PA01
ugaaaaucauccac

SEQ ID NO: 3481370 - RNA, 16 nt, Pseudomonas aeruginosa PA01
ugaaacgacaacccug

SEQ ID NO: 3481371 - RNA, 14 nt, Pseudomonas aeruginosa PA01
ugaaagagccccuc

SEQ ID NO: 3481372 - RNA, 16 nt, Pseudomonas aeruginosa PA01
ugaaagggcggcagca

SEQ ID NO: 3481373 - RNA, 16 nt, Pseudomonas aeruginosa PA01
ugaaauuaaaggaaua

SEQ ID NO: 3481374 - RNA, 22 nt, Pseudomonas aeruginosa PA01
ugaacacauagaccagcagcga

SEQ ID NO: 3481375 - RNA, 12 nt, Pseudomonas aeruginosa PA01
ugaacaccagcg

SEQ ID NO: 3481376 - RNA, 14 nt, Pseudomonas aeruginosa PA01
ugaacaccagcgaa

SEQ ID NO: 3481377 - RNA, 15 nt, Pseudomonas aeruginosa PA01
ugaacaccagcgaag

SEQ ID NO: 3481378 - RNA, 21 nt, Pseudomonas aeruginosa PA01
ugaacaccgcuucgagcaccc

SEQ ID NO: 3481379 - RNA, 23 nt, Pseudomonas aeruginosa PA01
ugaacaccguguugaucgccgcg

SEQ ID NO: 3481380 - RNA, 18 nt, Pseudomonas aeruginosa PA01
ugaacagcaggaugccgc

SEQ ID NO: 3481381 - RNA, 20 nt, Pseudomonas aeruginosa PA01
ugaacagcgacucgaugcgc

SEQ ID NO: 3481382 - RNA, 23 nt, Pseudomonas aeruginosa PA01
ugaacagcuggcgcgucgcugcc

SEQ ID NO: 3481383 - RNA, 22 nt, Pseudomonas aeruginosa PA01
ugaacaggcggauaucggccuc

SEQ ID NO: 3481384 - RNA, 17 nt, Pseudomonas aeruginosa PA01
ugaacagggucuugucu

SEQ ID NO: 3481385 - RNA, 14 nt, Pseudomonas aeruginosa PA01
ugaacagguagcug

SEQ ID NO: 3481386 - RNA, 18 nt, Pseudomonas aeruginosa PA01
ugaacagguagcuggaaa

SEQ ID NO: 3481387 - RNA, 15 nt, Pseudomonas aeruginosa PA01
ugaaccuguugcuca

SEQ ID NO: 3481388 - RNA, 17 nt, Pseudomonas aeruginosa PA01
ugaacgaagaagccggc

SEQ ID NO: 3481389 - RNA, 14 nt, Pseudomonas aeruginosa PA01
ugaacgacuccagc

SEQ ID NO: 3481390 - RNA, 16 nt, Pseudomonas aeruginosa PA01
ugaacgacucgucgcc

SEQ ID NO: 3481391 - RNA, 16 nt, Pseudomonas aeruginosa PA01
ugaacgcggcgagaac

SEQ ID NO: 3481392 - RNA, 19 nt, Pseudomonas aeruginosa PA01
ugaacggcgucacgccgau

SEQ ID NO: 3481393 - RNA, 16 nt, Pseudomonas aeruginosa PA01
ugaacgugucgacgac

SEQ ID NO: 3481394 - RNA, 17 nt, Pseudomonas aeruginosa PA01
ugaacucaugcaggccg

SEQ ID NO: 3481395 - RNA, 14 nt, Pseudomonas aeruginosa PA01
ugaacucgcccggc

SEQ ID NO: 3481396 - RNA, 18 nt, Pseudomonas aeruginosa PA01
ugaacucgcccggcucgg

SEQ ID NO: 3481397 - RNA, 18 nt, Pseudomonas aeruginosa PA01
ugaacucgguguagcuga

SEQ ID NO: 3481398 - RNA, 23 nt, Pseudomonas aeruginosa PA01
ugaacugcagcuugugggcaugc

SEQ ID NO: 3481399 - RNA, 23 nt, Pseudomonas aeruginosa PA01
ugaacugcgguccggcgaagucc

SEQ ID NO: 3481400 - RNA, 18 nt, Pseudomonas aeruginosa PA01
ugaagaagccauugccga

SEQ ID NO: 3481401 - RNA, 15 nt, Pseudomonas aeruginosa PA01
ugaagaagcugccgg

SEQ ID NO: 3481402 - RNA, 16 nt, Pseudomonas aeruginosa PA01
ugaagaagcugccggc

SEQ ID NO: 3481403 - RNA, 20 nt, Pseudomonas aeruginosa PA01
ugaagaaguaaucaccuucc

SEQ ID NO: 3481404 - RNA, 21 nt, Pseudomonas aeruginosa PA01
ugaagacccggcguucgccgg

SEQ ID NO: 3481405 - RNA, 19 nt, Pseudomonas aeruginosa PA01
ugaagacccugcacaucac

SEQ ID NO: 3481406 - RNA, 14 nt, Pseudomonas aeruginosa PA01
ugaagaucaucugg

SEQ ID NO: 3481407 - RNA, 16 nt, Pseudomonas aeruginosa PA01
ugaagcacaccuccag

SEQ ID NO: 3481408 - RNA, 19 nt, Pseudomonas aeruginosa PA01
ugaagcccaccaccaccga

SEQ ID NO: 3481409 - RNA, 20 nt, Pseudomonas aeruginosa PA01
ugaagccccuggcgcugggc

SEQ ID NO: 3481410 - RNA, 16 nt, Pseudomonas aeruginosa PA01
ugaagcccgcggcauc

SEQ ID NO: 3481411 - RNA, 21 nt, Pseudomonas aeruginosa PA01
ugaagcccuucugucuugucc

SEQ ID NO: 3481412 - RNA, 11 nt, Pseudomonas aeruginosa PA01
ugaagccgccg

SEQ ID NO: 3481413 - RNA, 18 nt, Pseudomonas aeruginosa PA01
ugaagccgccgcccagca

SEQ ID NO: 3481414 - RNA, 21 nt, Pseudomonas aeruginosa PA01
ugaagccgccgcccagcagca

SEQ ID NO: 3481415 - RNA, 14 nt, Pseudomonas aeruginosa PA01
ugaagccgcgcgcc

SEQ ID NO: 3481416 - RNA, 15 nt, Pseudomonas aeruginosa PA01
ugaagccgcgcgccg

SEQ ID NO: 3481417 - RNA, 15 nt, Pseudomonas aeruginosa PA01
ugaagcgauccagcg

SEQ ID NO: 3481418 - RNA, 15 nt, Pseudomonas aeruginosa PA01
ugaagcgcaggcggc

SEQ ID NO: 3481419 - RNA, 18 nt, Pseudomonas aeruginosa PA01
ugaagcgcaggcggcugg

SEQ ID NO: 3481420 - RNA, 13 nt, Pseudomonas aeruginosa PA01
ugaagcgccgcag

SEQ ID NO: 3481421 - RNA, 20 nt, Pseudomonas aeruginosa PA01
ugaagcgccgcggcccggcg

SEQ ID NO: 3481422 - RNA, 22 nt, Pseudomonas aeruginosa PA01
ugaagcgccgcggcccggcgcu

SEQ ID NO: 3481423 - RNA, 18 nt, Pseudomonas aeruginosa PA01
ugaagcgcggcggcgcgg

SEQ ID NO: 3481424 - RNA, 14 nt, Pseudomonas aeruginosa PA01
ugaagcggccgccg

SEQ ID NO: 3481425 - RNA, 16 nt, Pseudomonas aeruginosa PA01
ugaagcugcggcuuuc

SEQ ID NO: 3481426 - RNA, 15 nt, Pseudomonas aeruginosa PA01
ugaagcuggagcagc

SEQ ID NO: 3481427 - RNA, 18 nt, Pseudomonas aeruginosa PA01
ugaagcuggagcagcagc

SEQ ID NO: 3481428 - RNA, 17 nt, Pseudomonas aeruginosa PA01
ugaaggaaaccggccag

SEQ ID NO: 3481429 - RNA, 18 nt, Pseudomonas aeruginosa PA01
ugaaggaaaccggccagc

SEQ ID NO: 3481430 - RNA, 22 nt, Pseudomonas aeruginosa PA01
ugaaggaccagcuuguggccgg

SEQ ID NO: 3481431 - RNA, 15 nt, Pseudomonas aeruginosa PA01
ugaaggccgacaccu

SEQ ID NO: 3481432 - RNA, 15 nt, Pseudomonas aeruginosa PA01
ugaaggcgcggggcg

SEQ ID NO: 3481433 - RNA, 18 nt, Pseudomonas aeruginosa PA01
ugaaggcgcggggcgagg

SEQ ID NO: 3481434 - RNA, 20 nt, Pseudomonas aeruginosa PA01
ugaaggcgcugagcgccucg

SEQ ID NO: 3481435 - RNA, 16 nt, Pseudomonas aeruginosa PA01
ugaagggagagggaac

SEQ ID NO: 3481436 - RNA, 15 nt, Pseudomonas aeruginosa PA01
ugaaggucgccgcgc

SEQ ID NO: 3481437 - RNA, 13 nt, Pseudomonas aeruginosa PA01
ugaaggugcccag

SEQ ID NO: 3481438 - RNA, 16 nt, Pseudomonas aeruginosa PA01
ugaagguucaggugaa

SEQ ID NO: 3481439 - RNA, 22 nt, Pseudomonas aeruginosa PA01
ugaaguacuggucgcgcgcggc

SEQ ID NO: 3481440 - RNA, 15 nt, Pseudomonas aeruginosa PA01
ugaaguccuggccga

SEQ ID NO: 3481441 - RNA, 18 nt, Pseudomonas aeruginosa PA01
ugaagugauccaggucga

SEQ ID NO: 3481442 - RNA, 12 nt, Pseudomonas aeruginosa PA01
ugaagugccauu

SEQ ID NO: 3481443 - RNA, 19 nt, Pseudomonas aeruginosa PA01
ugaauagcagccauagcaa

SEQ ID NO: 3481444 - RNA, 19 nt, Pseudomonas aeruginosa PA01
ugacacccugccgcgccgg

SEQ ID NO: 3481445 - RNA, 16 nt, Pseudomonas aeruginosa PA01
ugacauccucccugcc

SEQ ID NO: 3481446 - RNA, 21 nt, Pseudomonas aeruginosa PA01
ugacauccuuggucagggugc

SEQ ID NO: 3481447 - RNA, 16 nt, Pseudomonas aeruginosa PA01
ugaccaccaggcgguc

SEQ ID NO: 3481448 - RNA, 16 nt, Pseudomonas aeruginosa PA01
ugaccaccgccaggcu

SEQ ID NO: 3481449 - RNA, 21 nt, Pseudomonas aeruginosa PA01
ugaccaccuugauccgcgacg

SEQ ID NO: 3481450 - RNA, 20 nt, Pseudomonas aeruginosa PA01
ugaccacgcagagcggcagg

SEQ ID NO: 3481451 - RNA, 14 nt, Pseudomonas aeruginosa PA01
ugaccacgcucagc

SEQ ID NO: 3481452 - RNA, 18 nt, Pseudomonas aeruginosa PA01
ugaccagagccgccgaac

SEQ ID NO: 3481453 - RNA, 14 nt, Pseudomonas aeruginosa PA01
ugaccagcauggcg

SEQ ID NO: 3481454 - RNA, 16 nt, Pseudomonas aeruginosa PA01
ugaccagcccggcggc

SEQ ID NO: 3481455 - RNA, 20 nt, Pseudomonas aeruginosa PA01
ugaccagcgcaucggcgccu

SEQ ID NO: 3481456 - RNA, 20 nt, Pseudomonas aeruginosa PA01
ugaccagcgcgucgaccacc

SEQ ID NO: 3481457 - RNA, 17 nt, Pseudomonas aeruginosa PA01
ugaccagcggcaccgag

SEQ ID NO: 3481458 - RNA, 15 nt, Pseudomonas aeruginosa PA01
ugaccagcggcccgg

SEQ ID NO: 3481459 - RNA, 16 nt, Pseudomonas aeruginosa PA01
ugaccagcggcccggc

SEQ ID NO: 3481460 - RNA, 12 nt, Pseudomonas aeruginosa PA01
ugaccaggcuga

SEQ ID NO: 3481461 - RNA, 15 nt, Pseudomonas aeruginosa PA01
ugaccaggcugauca

SEQ ID NO: 3481462 - RNA, 12 nt, Pseudomonas aeruginosa PA01
ugaccagggugg

SEQ ID NO: 3481463 - RNA, 19 nt, Pseudomonas aeruginosa PA01
ugaccaggguggcggcggc

SEQ ID NO: 3481464 - RNA, 15 nt, Pseudomonas aeruginosa PA01
ugaccagucccggcu

SEQ ID NO: 3481465 - RNA, 23 nt, Pseudomonas aeruginosa PA01
ugaccagucccggcuugccggca

SEQ ID NO: 3481466 - RNA, 23 nt, Pseudomonas aeruginosa PA01
ugaccauaggcuugcgccgaagg

SEQ ID NO: 3481467 - RNA, 19 nt, Pseudomonas aeruginosa PA01
ugaccaucuuuuccugcug

SEQ ID NO: 3481468 - RNA, 15 nt, Pseudomonas aeruginosa PA01
ugaccauggugaugc

SEQ ID NO: 3481469 - RNA, 22 nt, Pseudomonas aeruginosa PA01
ugacccagagccgcucggcggg

SEQ ID NO: 3481470 - RNA, 17 nt, Pseudomonas aeruginosa PA01
ugacccaggcuucggcg

SEQ ID NO: 3481471 - RNA, 15 nt, Pseudomonas aeruginosa PA01
ugaccccggcgaugc

SEQ ID NO: 3481472 - RNA, 20 nt, Pseudomonas aeruginosa PA01
ugaccccggcgaugcugcug

SEQ ID NO: 3481473 - RNA, 15 nt, Pseudomonas aeruginosa PA01
ugacccgacugcagc

SEQ ID NO: 3481474 - RNA, 18 nt, Pseudomonas aeruginosa PA01
ugacccgacugcagcggu

SEQ ID NO: 3481475 - RNA, 17 nt, Pseudomonas aeruginosa PA01
ugacccgcaccuugccc

SEQ ID NO: 3481476 - RNA, 18 nt, Pseudomonas aeruginosa PA01
ugacccgcaguuccuugg

SEQ ID NO: 3481477 - RNA, 14 nt, Pseudomonas aeruginosa PA01
ugacccgccccugc

SEQ ID NO: 3481478 - RNA, 13 nt, Pseudomonas aeruginosa PA01
ugacccgcucgcc

SEQ ID NO: 3481479 - RNA, 15 nt, Pseudomonas aeruginosa PA01
ugacccgcucgccgg

SEQ ID NO: 3481480 - RNA, 13 nt, Pseudomonas aeruginosa PA01
ugacccgcugcug

SEQ ID NO: 3481481 - RNA, 21 nt, Pseudomonas aeruginosa PA01
ugacccgcugcuggauggggc

SEQ ID NO: 3481482 - RNA, 22 nt, Pseudomonas aeruginosa PA01
ugacccgcuguccgccggccuc

SEQ ID NO: 3481483 - RNA, 22 nt, Pseudomonas aeruginosa PA01
ugacccggguuuccugcccgac

SEQ ID NO: 3481484 - RNA, 16 nt, Pseudomonas aeruginosa PA01
ugacccgguacagcgc

SEQ ID NO: 3481485 - RNA, 18 nt, Pseudomonas aeruginosa PA01
ugacccgguacagcgccu

SEQ ID NO: 3481486 - RNA, 15 nt, Pseudomonas aeruginosa PA01
ugacccucugguugg

SEQ ID NO: 3481487 - RNA, 22 nt, Pseudomonas aeruginosa PA01
ugaccgagauucugcaggcgcu

SEQ ID NO: 3481488 - RNA, 20 nt, Pseudomonas aeruginosa PA01
ugaccgccagacaggccagc

SEQ ID NO: 3481489 - RNA, 23 nt, Pseudomonas aeruginosa PA01
ugaccgcccagggggccgggccg

SEQ ID NO: 3481490 - RNA, 15 nt, Pseudomonas aeruginosa PA01
ugaccgccgccgccu

SEQ ID NO: 3481491 - RNA, 20 nt, Pseudomonas aeruginosa PA01
ugaccgcgaauggcagcagg

SEQ ID NO: 3481492 - RNA, 21 nt, Pseudomonas aeruginosa PA01
ugaccgcgaauggcagcaggc

SEQ ID NO: 3481493 - RNA, 20 nt, Pseudomonas aeruginosa PA01
ugaccgcgagcgccgccuug

SEQ ID NO: 3481494 - RNA, 20 nt, Pseudomonas aeruginosa PA01
ugaccgcucccaggcaacgg

SEQ ID NO: 3481495 - RNA, 20 nt, Pseudomonas aeruginosa PA01
ugaccggauguucgaaggcc

SEQ ID NO: 3481496 - RNA, 17 nt, Pseudomonas aeruginosa PA01
ugaccggcaucgaccag

SEQ ID NO: 3481497 - RNA, 21 nt, Pseudomonas aeruginosa PA01
ugaccggcaucgaccagcagc

SEQ ID NO: 3481498 - RNA, 17 nt, Pseudomonas aeruginosa PA01
ugaccgucagccaggcu

SEQ ID NO: 3481499 - RNA, 18 nt, Pseudomonas aeruginosa PA01
ugaccgucagccaggcug

SEQ ID NO: 3481500 - RNA, 14 nt, Pseudomonas aeruginosa PA01
ugaccguccacacc

SEQ ID NO: 3481501 - RNA, 21 nt, Pseudomonas aeruginosa PA01
ugaccguccacggcgcgucgg

SEQ ID NO: 3481502 - RNA, 16 nt, Pseudomonas aeruginosa PA01
ugaccguccagcgcgc

SEQ ID NO: 3481503 - RNA, 18 nt, Pseudomonas aeruginosa PA01
ugaccguccuggcccugc

SEQ ID NO: 3481504 - RNA, 14 nt, Pseudomonas aeruginosa PA01
ugaccgucggcaag

SEQ ID NO: 3481505 - RNA, 19 nt, Pseudomonas aeruginosa PA01
ugaccgucggcaagcaggc

SEQ ID NO: 3481506 - RNA, 17 nt, Pseudomonas aeruginosa PA01
ugaccgugaugcccagc

SEQ ID NO: 3481507 - RNA, 21 nt, Pseudomonas aeruginosa PA01
ugaccgugcgggucgaggccg

SEQ ID NO: 3481508 - RNA, 23 nt, Pseudomonas aeruginosa PA01
ugaccgugcgggucgaggccgaa

SEQ ID NO: 3481509 - RNA, 15 nt, Pseudomonas aeruginosa PA01
ugaccguuucgccgc

SEQ ID NO: 3481510 - RNA, 17 nt, Pseudomonas aeruginosa PA01
ugaccguuucgccgccg

SEQ ID NO: 3481511 - RNA, 18 nt, Pseudomonas aeruginosa PA01
ugaccguuucgccgccgg

SEQ ID NO: 3481512 - RNA, 19 nt, Pseudomonas aeruginosa PA01
ugaccguuucgccgccggc

SEQ ID NO: 3481513 - RNA, 18 nt, Pseudomonas aeruginosa PA01
ugaccucccgcgccagcu

SEQ ID NO: 3481514 - RNA, 13 nt, Pseudomonas aeruginosa PA01
ugaccucgauggc

SEQ ID NO: 3481515 - RNA, 14 nt, Pseudomonas aeruginosa PA01
ugaccucgauggcg

SEQ ID NO: 3481516 - RNA, 13 nt, Pseudomonas aeruginosa PA01
ugaccucggccag

SEQ ID NO: 3481517 - RNA, 18 nt, Pseudomonas aeruginosa PA01
ugaccucggccagccagg

SEQ ID NO: 3481518 - RNA, 13 nt, Pseudomonas aeruginosa PA01
ugaccugcagcgc

SEQ ID NO: 3481519 - RNA, 17 nt, Pseudomonas aeruginosa PA01
ugaccugcugggccagc

SEQ ID NO: 3481520 - RNA, 22 nt, Pseudomonas aeruginosa PA01
ugaccugcugggccagcgccgu

SEQ ID NO: 3481521 - RNA, 13 nt, Pseudomonas aeruginosa PA01
ugaccuggccgcc

SEQ ID NO: 3481522 - RNA, 17 nt, Pseudomonas aeruginosa PA01
ugaccuggccgucccug

SEQ ID NO: 3481523 - RNA, 19 nt, Pseudomonas aeruginosa PA01
ugaccugggauggggcugc

SEQ ID NO: 3481524 - RNA, 21 nt, Pseudomonas aeruginosa PA01
ugaccugguagucgcgguugc

SEQ ID NO: 3481525 - RNA, 20 nt, Pseudomonas aeruginosa PA01
ugaccuggucguugcgcgca

SEQ ID NO: 3481526 - RNA, 20 nt, Pseudomonas aeruginosa PA01
ugaccugguugcgccauugc

SEQ ID NO: 3481527 - RNA, 20 nt, Pseudomonas aeruginosa PA01
ugaccuguccagucaccagg

SEQ ID NO: 3481528 - RNA, 12 nt, Pseudomonas aeruginosa PA01
ugaccuucaacg

SEQ ID NO: 3481529 - RNA, 14 nt, Pseudomonas aeruginosa PA01
ugaccuucacuucg

SEQ ID NO: 3481530 - RNA, 18 nt, Pseudomonas aeruginosa PA01
ugaccuucagcaccugcg

SEQ ID NO: 3481531 - RNA, 23 nt, Pseudomonas aeruginosa PA01
ugaccuucagcaccugcgccgaa

SEQ ID NO: 3481532 - RNA, 18 nt, Pseudomonas aeruginosa PA01
ugaccuucagguagaugu

SEQ ID NO: 3481533 - RNA, 18 nt, Pseudomonas aeruginosa PA01
ugacgaaaccggcguccu

SEQ ID NO: 3481534 - RNA, 16 nt, Pseudomonas aeruginosa PA01
ugacgaacgaagcgcc

SEQ ID NO: 3481535 - RNA, 23 nt, Pseudomonas aeruginosa PA01
ugacgaacugcacgcccaucgcc

SEQ ID NO: 3481536 - RNA, 14 nt, Pseudomonas aeruginosa PA01
ugacgaagccggcg

SEQ ID NO: 3481537 - RNA, 15 nt, Pseudomonas aeruginosa PA01
ugacgaagcgcaccg

SEQ ID NO: 3481538 - RNA, 19 nt, Pseudomonas aeruginosa PA01
ugacgaaggcggcagcggu

SEQ ID NO: 3481539 - RNA, 15 nt, Pseudomonas aeruginosa PA01
ugacgaaggcuggag

SEQ ID NO: 3481540 - RNA, 18 nt, Pseudomonas aeruginosa PA01
ugacgaaggcuggagcgc

SEQ ID NO: 3481541 - RNA, 21 nt, Pseudomonas aeruginosa PA01
ugacgacgugcccauuuucca

SEQ ID NO: 3481542 - RNA, 18 nt, Pseudomonas aeruginosa PA01
ugacgagccgcaggguga

SEQ ID NO: 3481543 - RNA, 15 nt, Pseudomonas aeruginosa PA01
ugacgaggacgccgc

SEQ ID NO: 3481544 - RNA, 20 nt, Pseudomonas aeruginosa PA01
ugacgaggacgccgccgguc

SEQ ID NO: 3481545 - RNA, 17 nt, Pseudomonas aeruginosa PA01
ugacgaggcccgcccag

SEQ ID NO: 3481546 - RNA, 17 nt, Pseudomonas aeruginosa PA01
ugacgagggacugaaga

SEQ ID NO: 3481547 - RNA, 18 nt, Pseudomonas aeruginosa PA01
ugacgagggacugaagag

SEQ ID NO: 3481548 - RNA, 17 nt, Pseudomonas aeruginosa PA01
ugacgauacgcucggcg

SEQ ID NO: 3481549 - RNA, 17 nt, Pseudomonas aeruginosa PA01
ugacgauaucggcgccg

SEQ ID NO: 3481550 - RNA, 18 nt, Pseudomonas aeruginosa PA01
ugacgauaucggcgccgg

SEQ ID NO: 3481551 - RNA, 19 nt, Pseudomonas aeruginosa PA01
ugacgauaucggcgccggc

SEQ ID NO: 3481552 - RNA, 19 nt, Pseudomonas aeruginosa PA01
ugacgaucuucugcacccc

SEQ ID NO: 3481553 - RNA, 22 nt, Pseudomonas aeruginosa PA01
ugacgaucuucugcaccccguc

SEQ ID NO: 3481554 - RNA, 22 nt, Pseudomonas aeruginosa PA01
ugacgaugccguucaggcgcgg

SEQ ID NO: 3481555 - RNA, 16 nt, Pseudomonas aeruginosa PA01
ugacgaugcggcccgc

SEQ ID NO: 3481556 - RNA, 13 nt, Pseudomonas aeruginosa PA01
ugacgauggccag

SEQ ID NO: 3481557 - RNA, 17 nt, Pseudomonas aeruginosa PA01
ugacgauggccagcccg

SEQ ID NO: 3481558 - RNA, 14 nt, Pseudomonas aeruginosa PA01
ugacgauggcccag

SEQ ID NO: 3481559 - RNA, 16 nt, Pseudomonas aeruginosa PA01
ugacgauggcccagau

SEQ ID NO: 3481560 - RNA, 14 nt, Pseudomonas aeruginosa PA01
ugacgauggccgcc

SEQ ID NO: 3481561 - RNA, 17 nt, Pseudomonas aeruginosa PA01
ugacgauggccgccgcc

SEQ ID NO: 3481562 - RNA, 18 nt, Pseudomonas aeruginosa PA01
ugacgauggccgccgccg

SEQ ID NO: 3481563 - RNA, 14 nt, Pseudomonas aeruginosa PA01
ugacgauggcgccu

SEQ ID NO: 3481564 - RNA, 15 nt, Pseudomonas aeruginosa PA01
ugacgauggcgccuu

SEQ ID NO: 3481565 - RNA, 17 nt, Pseudomonas aeruginosa PA01
ugacgcaagcgcucggc

SEQ ID NO: 3481566 - RNA, 24 nt, Pseudomonas aeruginosa PA01
ugacgcagggcgguacgccgcgcu

SEQ ID NO: 3481567 - RNA, 15 nt, Pseudomonas aeruginosa PA01
ugacgcaguuccgcg

SEQ ID NO: 3481568 - RNA, 15 nt, Pseudomonas aeruginosa PA01
ugacgccauccuucg

SEQ ID NO: 3481569 - RNA, 18 nt, Pseudomonas aeruginosa PA01
ugacgccauccuucggcg

SEQ ID NO: 3481570 - RNA, 23 nt, Pseudomonas aeruginosa PA01
ugacgccggcaccgucgagcacc

SEQ ID NO: 3481571 - RNA, 18 nt, Pseudomonas aeruginosa PA01
ugacgcgcagcgccgccg

SEQ ID NO: 3481572 - RNA, 21 nt, Pseudomonas aeruginosa PA01
ugacgcgcagcgccgccgcgu

SEQ ID NO: 3481573 - RNA, 21 nt, Pseudomonas aeruginosa PA01
ugacgcggaugcccuggucgg

SEQ ID NO: 3481574 - RNA, 22 nt, Pseudomonas aeruginosa PA01
ugacgcggcggcuccggcgcca

SEQ ID NO: 3481575 - RNA, 20 nt, Pseudomonas aeruginosa PA01
ugacgcucuucaccucgaug

SEQ ID NO: 3481576 - RNA, 23 nt, Pseudomonas aeruginosa PA01
ugacgcuggcgaaggcgcuccgg

SEQ ID NO: 3481577 - RNA, 20 nt, Pseudomonas aeruginosa PA01
ugacggcaaggaccugcugc

SEQ ID NO: 3481578 - RNA, 23 nt, Pseudomonas aeruginosa PA01
ugacggcaaggaccugcugcccg

SEQ ID NO: 3481579 - RNA, 13 nt, Pseudomonas aeruginosa PA01
ugacggcgccgau

SEQ ID NO: 3481580 - RNA, 12 nt, Pseudomonas aeruginosa PA01
ugacgguccgcg

SEQ ID NO: 3481581 - RNA, 17 nt, Pseudomonas aeruginosa PA01
ugacggugaucgccgcg

SEQ ID NO: 3481582 - RNA, 20 nt, Pseudomonas aeruginosa PA01
ugacggugauucguccggag

SEQ ID NO: 3481583 - RNA, 15 nt, Pseudomonas aeruginosa PA01
ugacggugcagccac

SEQ ID NO: 3481584 - RNA, 19 nt, Pseudomonas aeruginosa PA01
ugacgucgaaaccgaacgg

SEQ ID NO: 3481585 - RNA, 15 nt, Pseudomonas aeruginosa PA01
ugacgucgccgaugc

SEQ ID NO: 3481586 - RNA, 14 nt, Pseudomonas aeruginosa PA01
ugacguucaggcug

SEQ ID NO: 3481587 - RNA, 17 nt, Pseudomonas aeruginosa PA01
ugacguucccguccggg

SEQ ID NO: 3481588 - RNA, 21 nt, Pseudomonas aeruginosa PA01
ugacguucugcccgccggcgc

SEQ ID NO: 3481589 - RNA, 14 nt, Pseudomonas aeruginosa PA01
ugacguugccgcgc

SEQ ID NO: 3481590 - RNA, 15 nt, Pseudomonas aeruginosa PA01
ugacguugcgccgca

SEQ ID NO: 3481591 - RNA, 17 nt, Pseudomonas aeruginosa PA01
ugacguugcgccgcagc

SEQ ID NO: 3481592 - RNA, 16 nt, Pseudomonas aeruginosa PA01
ugagaccgauccagca

SEQ ID NO: 3481593 - RNA, 18 nt, Pseudomonas aeruginosa PA01
ugagaguccuuguccagg

SEQ ID NO: 3481594 - RNA, 13 nt, Pseudomonas aeruginosa PA01
ugagcaauaugau

SEQ ID NO: 3481595 - RNA, 11 nt, Pseudomonas aeruginosa PA01
ugagcaccgga

SEQ ID NO: 3481596 - RNA, 13 nt, Pseudomonas aeruginosa PA01
ugagcaccggcag

SEQ ID NO: 3481597 - RNA, 16 nt, Pseudomonas aeruginosa PA01
ugagcaccggcaguga

SEQ ID NO: 3481598 - RNA, 18 nt, Pseudomonas aeruginosa PA01
ugagcaccggcagugaga

SEQ ID NO: 3481599 - RNA, 15 nt, Pseudomonas aeruginosa PA01
ugagcacgguccgcg

SEQ ID NO: 3481600 - RNA, 14 nt, Pseudomonas aeruginosa PA01
ugagcacgucgccu

SEQ ID NO: 3481601 - RNA, 21 nt, Pseudomonas aeruginosa PA01
ugagcaggaacucgaucagcg

SEQ ID NO: 3481602 - RNA, 20 nt, Pseudomonas aeruginosa PA01
ugagcaggccgacggcgcgc

SEQ ID NO: 3481603 - RNA, 13 nt, Pseudomonas aeruginosa PA01
ugagcagggcguc

SEQ ID NO: 3481604 - RNA, 21 nt, Pseudomonas aeruginosa PA01
ugagcaggguguugaucaccg

SEQ ID NO: 3481605 - RNA, 18 nt, Pseudomonas aeruginosa PA01
ugagcagucgccuggccc

SEQ ID NO: 3481606 - RNA, 15 nt, Pseudomonas aeruginosa PA01
ugagcaguugcgggc

SEQ ID NO: 3481607 - RNA, 20 nt, Pseudomonas aeruginosa PA01
ugagcaguugcgggcgcagg

SEQ ID NO: 3481608 - RNA, 13 nt, Pseudomonas aeruginosa PA01
ugagcaugccgca

SEQ ID NO: 3481609 - RNA, 17 nt, Pseudomonas aeruginosa PA01
ugagccagccugcagcc

SEQ ID NO: 3481610 - RNA, 18 nt, Pseudomonas aeruginosa PA01
ugagccccggcgucggcg

SEQ ID NO: 3481611 - RNA, 23 nt, Pseudomonas aeruginosa PA01
ugagccgggguucuucguuccug

SEQ ID NO: 3481612 - RNA, 18 nt, Pseudomonas aeruginosa PA01
ugagccucuaaggaaaaa

SEQ ID NO: 3481613 - RNA, 22 nt, Pseudomonas aeruginosa PA01
ugagccugucgauuucccccgg

SEQ ID NO: 3481614 - RNA, 16 nt, Pseudomonas aeruginosa PA01
ugagcgacccgcugaa

SEQ ID NO: 3481615 - RNA, 19 nt, Pseudomonas aeruginosa PA01
ugagcgacccgcugaagga

SEQ ID NO: 3481616 - RNA, 18 nt, Pseudomonas aeruginosa PA01
ugagcgaucccaggucgg

SEQ ID NO: 3481617 - RNA, 17 nt, Pseudomonas aeruginosa PA01
ugagcgauguccaggcc

SEQ ID NO: 3481618 - RNA, 18 nt, Pseudomonas aeruginosa PA01
ugagcgcauugacacgga

SEQ ID NO: 3481619 - RNA, 14 nt, Pseudomonas aeruginosa PA01
ugagcgccagcagg

SEQ ID NO: 3481620 - RNA, 18 nt, Pseudomonas aeruginosa PA01
ugagcgcccggcaaucag

SEQ ID NO: 3481621 - RNA, 14 nt, Pseudomonas aeruginosa PA01
ugagcgcgcccagg

SEQ ID NO: 3481622 - RNA, 17 nt, Pseudomonas aeruginosa PA01
ugagcgcgcccaggcag

SEQ ID NO: 3481623 - RNA, 18 nt, Pseudomonas aeruginosa PA01
ugagcggaaacaagcucu

SEQ ID NO: 3481624 - RNA, 16 nt, Pseudomonas aeruginosa PA01
ugagcggaucgucgcg

SEQ ID NO: 3481625 - RNA, 18 nt, Pseudomonas aeruginosa PA01
ugagcggaucgucgcggc

SEQ ID NO: 3481626 - RNA, 19 nt, Pseudomonas aeruginosa PA01
ugagcggaucgucgcggcg

SEQ ID NO: 3481627 - RNA, 15 nt, Pseudomonas aeruginosa PA01
ugagcggcgcccugg

SEQ ID NO: 3481628 - RNA, 16 nt, Pseudomonas aeruginosa PA01
ugagcgugacccgcgc

SEQ ID NO: 3481629 - RNA, 16 nt, Pseudomonas aeruginosa PA01
ugagcugaucgcgaau

SEQ ID NO: 3481630 - RNA, 15 nt, Pseudomonas aeruginosa PA01
ugagcugccgcuucg

SEQ ID NO: 3481631 - RNA, 12 nt, Pseudomonas aeruginosa PA01
ugagcuggccca

SEQ ID NO: 3481632 - RNA, 22 nt, Pseudomonas aeruginosa PA01
ugagcuggcccaguugcccggc

SEQ ID NO: 3481633 - RNA, 13 nt, Pseudomonas aeruginosa PA01
ugagcuggcuguc

SEQ ID NO: 3481634 - RNA, 16 nt, Pseudomonas aeruginosa PA01
ugagcugggcaggcug

SEQ ID NO: 3481635 - RNA, 17 nt, Pseudomonas aeruginosa PA01
ugagcuguuucagccca

SEQ ID NO: 3481636 - RNA, 15 nt, Pseudomonas aeruginosa PA01
ugagcuucgccgggu

SEQ ID NO: 3481637 - RNA, 22 nt, Pseudomonas aeruginosa PA01
ugagcuucgccggguguuuuuc

SEQ ID NO: 3481638 - RNA, 18 nt, Pseudomonas aeruginosa PA01
ugagcuugaugaagcccg

SEQ ID NO: 3481639 - RNA, 22 nt, Pseudomonas aeruginosa PA01
ugaggaacuugucgaccacgcu

SEQ ID NO: 3481640 - RNA, 21 nt, Pseudomonas aeruginosa PA01
ugaggaagagcagcgcggcgg

SEQ ID NO: 3481641 - RNA, 22 nt, Pseudomonas aeruginosa PA01
ugaggaagagcagcgcggcggc

SEQ ID NO: 3481642 - RNA, 18 nt, Pseudomonas aeruginosa PA01
ugaggaaguagugcagcu

SEQ ID NO: 3481643 - RNA, 16 nt, Pseudomonas aeruginosa PA01
ugaggaaguugcgcag

SEQ ID NO: 3481644 - RNA, 19 nt, Pseudomonas aeruginosa PA01
ugaggaaguugcgcagcaa

SEQ ID NO: 3481645 - RNA, 17 nt, Pseudomonas aeruginosa PA01
ugaggaccuggccgcgu

SEQ ID NO: 3481646 - RNA, 19 nt, Pseudomonas aeruginosa PA01
ugaggaucacgauggccgg

SEQ ID NO: 3481647 - RNA, 14 nt, Pseudomonas aeruginosa PA01
ugaggaucagccag

SEQ ID NO: 3481648 - RNA, 16 nt, Pseudomonas aeruginosa PA01
ugaggaucagccagcc

SEQ ID NO: 3481649 - RNA, 15 nt, Pseudomonas aeruginosa PA01
ugaggaugucgcggc

SEQ ID NO: 3481650 - RNA, 15 nt, Pseudomonas aeruginosa PA01
ugaggauuuucuccg

SEQ ID NO: 3481651 - RNA, 14 nt, Pseudomonas aeruginosa PA01
ugaggcccaucagg

SEQ ID NO: 3481652 - RNA, 17 nt, Pseudomonas aeruginosa PA01
ugaggcccaucaggaug

SEQ ID NO: 3481653 - RNA, 15 nt, Pseudomonas aeruginosa PA01
ugaggccgagccgac

SEQ ID NO: 3481654 - RNA, 13 nt, Pseudomonas aeruginosa PA01
ugaggccuggucc

SEQ ID NO: 3481655 - RNA, 19 nt, Pseudomonas aeruginosa PA01
ugaggccuuucuucugcug

SEQ ID NO: 3481656 - RNA, 13 nt, Pseudomonas aeruginosa PA01
ugaggcgcagcag

SEQ ID NO: 3481657 - RNA, 14 nt, Pseudomonas aeruginosa PA01
ugaggcgcagcagc

SEQ ID NO: 3481658 - RNA, 17 nt, Pseudomonas aeruginosa PA01
ugaggcgcgcgccgaac

SEQ ID NO: 3481659 - RNA, 18 nt, Pseudomonas aeruginosa PA01
ugaggcgcgcgccgaacu

SEQ ID NO: 3481660 - RNA, 20 nt, Pseudomonas aeruginosa PA01
ugaggcgggccagcagggug

SEQ ID NO: 3481661 - RNA, 21 nt, Pseudomonas aeruginosa PA01
ugaggcguuccaguucggccg

SEQ ID NO: 3481662 - RNA, 19 nt, Pseudomonas aeruginosa PA01
ugaggcguucgaucuccuc

SEQ ID NO: 3481663 - RNA, 13 nt, Pseudomonas aeruginosa PA01
ugaggcucccagg

SEQ ID NO: 3481664 - RNA, 19 nt, Pseudomonas aeruginosa PA01
ugaggcucccagguggaaa

SEQ ID NO: 3481665 - RNA, 20 nt, Pseudomonas aeruginosa PA01
ugagggcgacguugcgcagg

SEQ ID NO: 3481666 - RNA, 17 nt, Pseudomonas aeruginosa PA01
ugaggggaaucgccguc

SEQ ID NO: 3481667 - RNA, 21 nt, Pseudomonas aeruginosa PA01
ugaggggaaucgccgucaccg

SEQ ID NO: 3481668 - RNA, 17 nt, Pseudomonas aeruginosa PA01
ugagggucagaccagcc

SEQ ID NO: 3481669 - RNA, 12 nt, Pseudomonas aeruginosa PA01
ugagggucagcg

SEQ ID NO: 3481670 - RNA, 20 nt, Pseudomonas aeruginosa PA01
ugagggucagcuugccgcag

SEQ ID NO: 3481671 - RNA, 21 nt, Pseudomonas aeruginosa PA01
ugagggucagcuugccgcagg

SEQ ID NO: 3481672 - RNA, 15 nt, Pseudomonas aeruginosa PA01
ugagggucgcgccga

SEQ ID NO: 3481673 - RNA, 18 nt, Pseudomonas aeruginosa PA01
ugagggucgcgccgacga

SEQ ID NO: 3481674 - RNA, 19 nt, Pseudomonas aeruginosa PA01
ugaggguguucagcggcgc

SEQ ID NO: 3481675 - RNA, 13 nt, Pseudomonas aeruginosa PA01
ugagguaggccag

SEQ ID NO: 3481676 - RNA, 15 nt, Pseudomonas aeruginosa PA01
ugaggucggccucga

SEQ ID NO: 3481677 - RNA, 16 nt, Pseudomonas aeruginosa PA01
ugaggucggcgcgcgg

SEQ ID NO: 3481678 - RNA, 21 nt, Pseudomonas aeruginosa PA01
ugaggucguugaaagucugca

SEQ ID NO: 3481679 - RNA, 17 nt, Pseudomonas aeruginosa PA01
ugaggugggcgcgccgc

SEQ ID NO: 3481680 - RNA, 16 nt, Pseudomonas aeruginosa PA01
ugagguucaugccgcg

SEQ ID NO: 3481681 - RNA, 17 nt, Pseudomonas aeruginosa PA01
ugagguucaugccgcga

SEQ ID NO: 3481682 - RNA, 17 nt, Pseudomonas aeruginosa PA01
ugagguugcgauugucc

SEQ ID NO: 3481683 - RNA, 14 nt, Pseudomonas aeruginosa PA01
ugaguaguuucuga

SEQ ID NO: 3481684 - RNA, 21 nt, Pseudomonas aeruginosa PA01
ugaguucccagaccuggccgc

SEQ ID NO: 3481685 - RNA, 14 nt, Pseudomonas aeruginosa PA01
ugaguugcaggccg

SEQ ID NO: 3481686 - RNA, 17 nt, Pseudomonas aeruginosa PA01
ugaguugcaggccggcg

SEQ ID NO: 3481687 - RNA, 18 nt, Pseudomonas aeruginosa PA01
ugaguugcaggccggcga

SEQ ID NO: 3481688 - RNA, 16 nt, Pseudomonas aeruginosa PA01
ugaguugcagggcuug

SEQ ID NO: 3481689 - RNA, 20 nt, Pseudomonas aeruginosa PA01
ugaguuugcccagcgccgcc

SEQ ID NO: 3481690 - RNA, 14 nt, Pseudomonas aeruginosa PA01
ugauaccgccggcg

SEQ ID NO: 3481691 - RNA, 18 nt, Pseudomonas aeruginosa PA01
ugauaccgccggcggcga

SEQ ID NO: 3481692 - RNA, 17 nt, Pseudomonas aeruginosa PA01
ugauaccgcuggccagg

SEQ ID NO: 3481693 - RNA, 20 nt, Pseudomonas aeruginosa PA01
ugauacgcacgcuggugccg

SEQ ID NO: 3481694 - RNA, 23 nt, Pseudomonas aeruginosa PA01
ugauacggcucuugaaacuggga

SEQ ID NO: 3481695 - RNA, 22 nt, Pseudomonas aeruginosa PA01
ugauagagcacgcccauggaga

SEQ ID NO: 3481696 - RNA, 16 nt, Pseudomonas aeruginosa PA01
ugauagcgcggccuuc

SEQ ID NO: 3481697 - RNA, 20 nt, Pseudomonas aeruginosa PA01
ugauauuagcgauucccagu

SEQ ID NO: 3481698 - RNA, 13 nt, Pseudomonas aeruginosa PA01
ugaucaccagacc

SEQ ID NO: 3481699 - RNA, 14 nt, Pseudomonas aeruginosa PA01
ugaucaccagaccg

SEQ ID NO: 3481700 - RNA, 19 nt, Pseudomonas aeruginosa PA01
ugaucacccgcccgccguc

SEQ ID NO: 3481701 - RNA, 17 nt, Pseudomonas aeruginosa PA01
ugaucaccgccuuggca

SEQ ID NO: 3481702 - RNA, 20 nt, Pseudomonas aeruginosa PA01
ugaucaccuggaucgccagg

SEQ ID NO: 3481703 - RNA, 22 nt, Pseudomonas aeruginosa PA01
ugaucaccuuguacggcagcgg

SEQ ID NO: 3481704 - RNA, 13 nt, Pseudomonas aeruginosa PA01
ugaucacgaacag

SEQ ID NO: 3481705 - RNA, 13 nt, Pseudomonas aeruginosa PA01
ugaucacgucggc

SEQ ID NO: 3481706 - RNA, 20 nt, Pseudomonas aeruginosa PA01
ugaucagccgcaggcagaac

SEQ ID NO: 3481707 - RNA, 12 nt, Pseudomonas aeruginosa PA01
ugaucagcggcc

SEQ ID NO: 3481708 - RNA, 16 nt, Pseudomonas aeruginosa PA01
ugaucagcggccgagc

SEQ ID NO: 3481709 - RNA, 20 nt, Pseudomonas aeruginosa PA01
ugaucagcggccgagcaggc

SEQ ID NO: 3481710 - RNA, 16 nt, Pseudomonas aeruginosa PA01
ugaucagcuccgccuc

SEQ ID NO: 3481711 - RNA, 21 nt, Pseudomonas aeruginosa PA01
ugaucagcuucuucagcagcg

SEQ ID NO: 3481712 - RNA, 21 nt, Pseudomonas aeruginosa PA01
ugaucaggaggaucgccagga

SEQ ID NO: 3481713 - RNA, 16 nt, Pseudomonas aeruginosa PA01
ugaucaggccgagcac

SEQ ID NO: 3481714 - RNA, 22 nt, Pseudomonas aeruginosa PA01
ugaucaggccgagcaccggcag

SEQ ID NO: 3481715 - RNA, 18 nt, Pseudomonas aeruginosa PA01
ugaucagggcaccgccga

SEQ ID NO: 3481716 - RNA, 21 nt, Pseudomonas aeruginosa PA01
ugaucagguucggcagcgccu

SEQ ID NO: 3481717 - RNA, 16 nt, Pseudomonas aeruginosa PA01
ugaucagguugccggc

SEQ ID NO: 3481718 - RNA, 16 nt, Pseudomonas aeruginosa PA01
ugaucaguaccggcag

SEQ ID NO: 3481719 - RNA, 21 nt, Pseudomonas aeruginosa PA01
ugaucaguaccggcagcgccg

SEQ ID NO: 3481720 - RNA, 18 nt, Pseudomonas aeruginosa PA01
ugaucagucgucguccag

SEQ ID NO: 3481721 - RNA, 21 nt, Pseudomonas aeruginosa PA01
ugaucauccaggacaccccga

SEQ ID NO: 3481722 - RNA, 15 nt, Pseudomonas aeruginosa PA01
ugaucaucgccugcu

SEQ ID NO: 3481723 - RNA, 17 nt, Pseudomonas aeruginosa PA01
ugaucaucgccugcugg

SEQ ID NO: 3481724 - RNA, 17 nt, Pseudomonas aeruginosa PA01
ugauccacuugccgccg

SEQ ID NO: 3481725 - RNA, 14 nt, Pseudomonas aeruginosa PA01
ugauccagcuggcg

SEQ ID NO: 3481726 - RNA, 18 nt, Pseudomonas aeruginosa PA01
ugauccagcuggcgcguu

SEQ ID NO: 3481727 - RNA, 24 nt, Pseudomonas aeruginosa PA01
ugauccaggucgaucagcagcagc

SEQ ID NO: 3481728 - RNA, 19 nt, Pseudomonas aeruginosa PA01
ugaucccuagggguucucc

SEQ ID NO: 3481729 - RNA, 17 nt, Pseudomonas aeruginosa PA01
ugauccgcacccgcgac

SEQ ID NO: 3481730 - RNA, 21 nt, Pseudomonas aeruginosa PA01
ugauccgcguuaccguccgcg

SEQ ID NO: 3481731 - RNA, 19 nt, Pseudomonas aeruginosa PA01
ugauccgcuccagcgccuc

SEQ ID NO: 3481732 - RNA, 21 nt, Pseudomonas aeruginosa PA01
ugauccgcuccagcgccucga

SEQ ID NO: 3481733 - RNA, 24 nt, Pseudomonas aeruginosa PA01
ugauccugggcgccagccgccauc

SEQ ID NO: 3481734 - RNA, 15 nt, Pseudomonas aeruginosa PA01
ugaucgaagcccauc

SEQ ID NO: 3481735 - RNA, 17 nt, Pseudomonas aeruginosa PA01
ugaucgaccucgcgggc

SEQ ID NO: 3481736 - RNA, 15 nt, Pseudomonas aeruginosa PA01
ugaucgacgccagcu

SEQ ID NO: 3481737 - RNA, 17 nt, Pseudomonas aeruginosa PA01
ugaucgacgccagcucg

SEQ ID NO: 3481738 - RNA, 16 nt, Pseudomonas aeruginosa PA01
ugaucgacucgauggc

SEQ ID NO: 3481739 - RNA, 19 nt, Pseudomonas aeruginosa PA01
ugaucgacucgauggcgcg

SEQ ID NO: 3481740 - RNA, 21 nt, Pseudomonas aeruginosa PA01
ugaucgacugcaugaccucca

SEQ ID NO: 3481741 - RNA, 15 nt, Pseudomonas aeruginosa PA01
ugaucgagacgccgu

SEQ ID NO: 3481742 - RNA, 16 nt, Pseudomonas aeruginosa PA01
ugaucgagggccacga

SEQ ID NO: 3481743 - RNA, 15 nt, Pseudomonas aeruginosa PA01
ugaucgagucgccgg

SEQ ID NO: 3481744 - RNA, 22 nt, Pseudomonas aeruginosa PA01
ugaucgccaccgcguccuugag

SEQ ID NO: 3481745 - RNA, 23 nt, Pseudomonas aeruginosa PA01
ugaucgccaccgcguccuugagu

SEQ ID NO: 3481746 - RNA, 19 nt, Pseudomonas aeruginosa PA01
ugaucgccaccgggugcag

SEQ ID NO: 3481747 - RNA, 18 nt, Pseudomonas aeruginosa PA01
ugaucgccgcgaggugga

SEQ ID NO: 3481748 - RNA, 15 nt, Pseudomonas aeruginosa PA01
ugaucgccgcgccgc

SEQ ID NO: 3481749 - RNA, 17 nt, Pseudomonas aeruginosa PA01
ugaucgccgcgccgccg

SEQ ID NO: 3481750 - RNA, 12 nt, Pseudomonas aeruginosa PA01
ugaucgcgccgg

SEQ ID NO: 3481751 - RNA, 18 nt, Pseudomonas aeruginosa PA01
ugaucgcgccggaugggc

SEQ ID NO: 3481752 - RNA, 18 nt, Pseudomonas aeruginosa PA01
ugaucgcgugggccacca

SEQ ID NO: 3481753 - RNA, 22 nt, Pseudomonas aeruginosa PA01
ugaucgcgugggccaccaucag

SEQ ID NO: 3481754 - RNA, 18 nt, Pseudomonas aeruginosa PA01
ugaucuccaggucgcccu

SEQ ID NO: 3481755 - RNA, 15 nt, Pseudomonas aeruginosa PA01
ugaucuccgcgccgg

SEQ ID NO: 3481756 - RNA, 22 nt, Pseudomonas aeruginosa PA01
ugaucucgcugaguuugcccag

SEQ ID NO: 3481757 - RNA, 16 nt, Pseudomonas aeruginosa PA01
ugaucuuuuccucguc

SEQ ID NO: 3481758 - RNA, 18 nt, Pseudomonas aeruginosa PA01
ugaugaagcccgcggcau

SEQ ID NO: 3481759 - RNA, 22 nt, Pseudomonas aeruginosa PA01
ugaugaagccgcgaccgggcau

SEQ ID NO: 3481760 - RNA, 13 nt, Pseudomonas aeruginosa PA01
ugaugaagcgcug

SEQ ID NO: 3481761 - RNA, 19 nt, Pseudomonas aeruginosa PA01
ugaugaccguccacggcgc

SEQ ID NO: 3481762 - RNA, 20 nt, Pseudomonas aeruginosa PA01
ugaugacgagggacugaaga

SEQ ID NO: 3481763 - RNA, 20 nt, Pseudomonas aeruginosa PA01
ugaugaucaggucggccgcc

SEQ ID NO: 3481764 - RNA, 17 nt, Pseudomonas aeruginosa PA01
ugaugaugccgcggcga

SEQ ID NO: 3481765 - RNA, 16 nt, Pseudomonas aeruginosa PA01
ugaugcaggcagugug

SEQ ID NO: 3481766 - RNA, 14 nt, Pseudomonas aeruginosa PA01
ugaugcccagcggc

SEQ ID NO: 3481767 - RNA, 15 nt, Pseudomonas aeruginosa PA01
ugaugcccagcggcg

SEQ ID NO: 3481768 - RNA, 21 nt, Pseudomonas aeruginosa PA01
ugaugcccggucaccacccag

SEQ ID NO: 3481769 - RNA, 12 nt, Pseudomonas aeruginosa PA01
ugaugccgacgu

SEQ ID NO: 3481770 - RNA, 15 nt, Pseudomonas aeruginosa PA01
ugaugccgaggcggc

SEQ ID NO: 3481771 - RNA, 19 nt, Pseudomonas aeruginosa PA01
ugaugccgaggcggccgua

SEQ ID NO: 3481772 - RNA, 20 nt, Pseudomonas aeruginosa PA01
ugaugccgccguugacgauc

SEQ ID NO: 3481773 - RNA, 23 nt, Pseudomonas aeruginosa PA01
ugaugccgccguugacgaucagg

SEQ ID NO: 3481774 - RNA, 19 nt, Pseudomonas aeruginosa PA01
ugaugccgcgguaggucag

SEQ ID NO: 3481775 - RNA, 14 nt, Pseudomonas aeruginosa PA01
ugaugccgugcagc

SEQ ID NO: 3481776 - RNA, 13 nt, Pseudomonas aeruginosa PA01
ugaugcgucgcac

SEQ ID NO: 3481777 - RNA, 17 nt, Pseudomonas aeruginosa PA01
ugauggugaccggcuug

SEQ ID NO: 3481778 - RNA, 17 nt, Pseudomonas aeruginosa PA01
ugauggugugcagcagc

SEQ ID NO: 3481779 - RNA, 14 nt, Pseudomonas aeruginosa PA01
ugaugguuucuucc

SEQ ID NO: 3481780 - RNA, 16 nt, Pseudomonas aeruginosa PA01
ugauguacucgcggcc

SEQ ID NO: 3481781 - RNA, 20 nt, Pseudomonas aeruginosa PA01
ugauguaggacgccucgucg

SEQ ID NO: 3481782 - RNA, 14 nt, Pseudomonas aeruginosa PA01
ugaugugccgcacg

SEQ ID NO: 3481783 - RNA, 15 nt, Pseudomonas aeruginosa PA01
ugauguugcgccaga

SEQ ID NO: 3481784 - RNA, 16 nt, Pseudomonas aeruginosa PA01
ugauguugcggucgau

SEQ ID NO: 3481785 - RNA, 13 nt, Pseudomonas aeruginosa PA01
ugauugaaaaaau

SEQ ID NO: 3481786 - RNA, 22 nt, Pseudomonas aeruginosa PA01
ugcaaagcggcgacgccacccg

SEQ ID NO: 3481787 - RNA, 20 nt, Pseudomonas aeruginosa PA01
ugcaacaccuggcgcucgcc

SEQ ID NO: 3481788 - RNA, 18 nt, Pseudomonas aeruginosa PA01
ugcaacacguagcgcagg

SEQ ID NO: 3481789 - RNA, 14 nt, Pseudomonas aeruginosa PA01
ugcaacagcgcggc

SEQ ID NO: 3481790 - RNA, 23 nt, Pseudomonas aeruginosa PA01
ugcaacaguggguaggccaggca

SEQ ID NO: 3481791 - RNA, 17 nt, Pseudomonas aeruginosa PA01
ugcaacccgccgcugau

SEQ ID NO: 3481792 - RNA, 21 nt, Pseudomonas aeruginosa PA01
ugcaacgccagcaggcgcagg

SEQ ID NO: 3481793 - RNA, 16 nt, Pseudomonas aeruginosa PA01
ugcaacgcccgcgagc

SEQ ID NO: 3481794 - RNA, 23 nt, Pseudomonas aeruginosa PA01
ugcaacgcccgcgagccguccug

SEQ ID NO: 3481795 - RNA, 13 nt, Pseudomonas aeruginosa PA01
ugcaacgccggcc

SEQ ID NO: 3481796 - RNA, 21 nt, Pseudomonas aeruginosa PA01
ugcaacgccuggugcaggucg

SEQ ID NO: 3481797 - RNA, 17 nt, Pseudomonas aeruginosa PA01
ugcaacgcggcgucagg

SEQ ID NO: 3481798 - RNA, 19 nt, Pseudomonas aeruginosa PA01
ugcaacucgucguccagcg

SEQ ID NO: 3481799 - RNA, 16 nt, Pseudomonas aeruginosa PA01
ugcaacugacggcgga

SEQ ID NO: 3481800 - RNA, 21 nt, Pseudomonas aeruginosa PA01
ugcaacuggccgagaucgguc

SEQ ID NO: 3481801 - RNA, 16 nt, Pseudomonas aeruginosa PA01
ugcaagaggucgacgg

SEQ ID NO: 3481802 - RNA, 19 nt, Pseudomonas aeruginosa PA01
ugcaauccgugcgccgggc

SEQ ID NO: 3481803 - RNA, 19 nt, Pseudomonas aeruginosa PA01
ugcaauuccaccggcuggc

SEQ ID NO: 3481804 - RNA, 21 nt, Pseudomonas aeruginosa PA01
ugcaauuccaccggcuggccg

SEQ ID NO: 3481805 - RNA, 20 nt, Pseudomonas aeruginosa PA01
ugcaauucgucggccugcuc

SEQ ID NO: 3481806 - RNA, 21 nt, Pseudomonas aeruginosa PA01
ugcaauugcaggcccggccgc

SEQ ID NO: 3481807 - RNA, 22 nt, Pseudomonas aeruginosa PA01
ugcaauugcaggcccggccgcc

SEQ ID NO: 3481808 - RNA, 18 nt, Pseudomonas aeruginosa PA01
ugcacaaacucagggugg

SEQ ID NO: 3481809 - RNA, 20 nt, Pseudomonas aeruginosa PA01
ugcacaacgggugcugcgga

SEQ ID NO: 3481810 - RNA, 18 nt, Pseudomonas aeruginosa PA01
ugcacaccagcuccccgu

SEQ ID NO: 3481811 - RNA, 21 nt, Pseudomonas aeruginosa PA01
ugcacagccauagcgccggca

SEQ ID NO: 3481812 - RNA, 15 nt, Pseudomonas aeruginosa PA01
ugcacagcgcccaga

SEQ ID NO: 3481813 - RNA, 15 nt, Pseudomonas aeruginosa PA01
ugcacaggcguacca

SEQ ID NO: 3481814 - RNA, 12 nt, Pseudomonas aeruginosa PA01
ugcacagggacg

SEQ ID NO: 3481815 - RNA, 17 nt, Pseudomonas aeruginosa PA01
ugcacagguugacgaug

SEQ ID NO: 3481816 - RNA, 22 nt, Pseudomonas aeruginosa PA01
ugcacagguugacgaugcggcc

SEQ ID NO: 3481817 - RNA, 20 nt, Pseudomonas aeruginosa PA01
ugcacauccagcccuggaaa

SEQ ID NO: 3481818 - RNA, 13 nt, Pseudomonas aeruginosa PA01
ugcaccagcaggc

SEQ ID NO: 3481819 - RNA, 23 nt, Pseudomonas aeruginosa PA01
ugcaccagcaggcgacaaaucgg

SEQ ID NO: 3481820 - RNA, 15 nt, Pseudomonas aeruginosa PA01
ugcaccagccagucc

SEQ ID NO: 3481821 - RNA, 18 nt, Pseudomonas aeruginosa PA01
ugcaccagccaguccggc

SEQ ID NO: 3481822 - RNA, 19 nt, Pseudomonas aeruginosa PA01
ugcaccagccaguccggca

SEQ ID NO: 3481823 - RNA, 15 nt, Pseudomonas aeruginosa PA01
ugcaccaggcccugc

SEQ ID NO: 3481824 - RNA, 14 nt, Pseudomonas aeruginosa PA01
ugcaccaggccgcc

SEQ ID NO: 3481825 - RNA, 17 nt, Pseudomonas aeruginosa PA01
ugcaccaggcgaugcgc

SEQ ID NO: 3481826 - RNA, 19 nt, Pseudomonas aeruginosa PA01
ugcaccaggcucgccccgg

SEQ ID NO: 3481827 - RNA, 22 nt, Pseudomonas aeruginosa PA01
ugcaccaggcucgccccggcgg

SEQ ID NO: 3481828 - RNA, 16 nt, Pseudomonas aeruginosa PA01
ugcacccuuggcgcag

SEQ ID NO: 3481829 - RNA, 17 nt, Pseudomonas aeruginosa PA01
ugcacccuuggcgcagg

SEQ ID NO: 3481830 - RNA, 13 nt, Pseudomonas aeruginosa PA01
ugcaccgccgggu

SEQ ID NO: 3481831 - RNA, 16 nt, Pseudomonas aeruginosa PA01
ugcaccgcggcgcgga

SEQ ID NO: 3481832 - RNA, 18 nt, Pseudomonas aeruginosa PA01
ugcaccgcggcgcggaug

SEQ ID NO: 3481833 - RNA, 19 nt, Pseudomonas aeruginosa PA01
ugcaccgcuugccagccgc

SEQ ID NO: 3481834 - RNA, 20 nt, Pseudomonas aeruginosa PA01
ugcaccgcuugccagccgcu

SEQ ID NO: 3481835 - RNA, 23 nt, Pseudomonas aeruginosa PA01
ugcaccgcuugccagccgcuucc

SEQ ID NO: 3481836 - RNA, 20 nt, Pseudomonas aeruginosa PA01
ugcaccggccacucgcagcc

SEQ ID NO: 3481837 - RNA, 21 nt, Pseudomonas aeruginosa PA01
ugcaccgggccgaccugcccg

SEQ ID NO: 3481838 - RNA, 18 nt, Pseudomonas aeruginosa PA01
ugcaccugcucggggccg

SEQ ID NO: 3481839 - RNA, 12 nt, Pseudomonas aeruginosa PA01
ugcaccuggcga

SEQ ID NO: 3481840 - RNA, 19 nt, Pseudomonas aeruginosa PA01
ugcaccuggcgaugcccug

SEQ ID NO: 3481841 - RNA, 16 nt, Pseudomonas aeruginosa PA01
ugcacgcacgcgccug

SEQ ID NO: 3481842 - RNA, 14 nt, Pseudomonas aeruginosa PA01
ugcacgcaggccgc

SEQ ID NO: 3481843 - RNA, 14 nt, Pseudomonas aeruginosa PA01
ugcacgcccaggcg

SEQ ID NO: 3481844 - RNA, 20 nt, Pseudomonas aeruginosa PA01
ugcacgcccaucgccaccag

SEQ ID NO: 3481845 - RNA, 15 nt, Pseudomonas aeruginosa PA01
ugcacgccgauggcg

SEQ ID NO: 3481846 - RNA, 19 nt, Pseudomonas aeruginosa PA01
ugcacgccgauggcguugu

SEQ ID NO: 3481847 - RNA, 16 nt, Pseudomonas aeruginosa PA01
ugcacgccgugcauca

SEQ ID NO: 3481848 - RNA, 20 nt, Pseudomonas aeruginosa PA01
ugcacgccgugcaucaccgg

SEQ ID NO: 3481849 - RNA, 12 nt, Pseudomonas aeruginosa PA01
ugcacgcgccgg

SEQ ID NO: 3481850 - RNA, 16 nt, Pseudomonas aeruginosa PA01
ugcacgcgccgggucg

SEQ ID NO: 3481851 - RNA, 17 nt, Pseudomonas aeruginosa PA01
ugcacgcgccgggucgg

SEQ ID NO: 3481852 - RNA, 15 nt, Pseudomonas aeruginosa PA01
ugcacgcugcgccgg

SEQ ID NO: 3481853 - RNA, 20 nt, Pseudomonas aeruginosa PA01
ugcacgcugcgccggcgcug

SEQ ID NO: 3481854 - RNA, 17 nt, Pseudomonas aeruginosa PA01
ugcacggauaccacccg

SEQ ID NO: 3481855 - RNA, 19 nt, Pseudomonas aeruginosa PA01
ugcacggauaccacccgca

SEQ ID NO: 3481856 - RNA, 14 nt, Pseudomonas aeruginosa PA01
ugcacggccaggcc

SEQ ID NO: 3481857 - RNA, 18 nt, Pseudomonas aeruginosa PA01
ugcacggccaggccacgg

SEQ ID NO: 3481858 - RNA, 15 nt, Pseudomonas aeruginosa PA01
ugcacggcgacccgc

SEQ ID NO: 3481859 - RNA, 16 nt, Pseudomonas aeruginosa PA01
ugcacggcgacccgcc

SEQ ID NO: 3481860 - RNA, 19 nt, Pseudomonas aeruginosa PA01
ugcacggcgacccgccguu

SEQ ID NO: 3481861 - RNA, 16 nt, Pseudomonas aeruginosa PA01
ugcacgugcagcucgg

SEQ ID NO: 3481862 - RNA, 21 nt, Pseudomonas aeruginosa PA01
ugcacgugcagcucggcacgc

SEQ ID NO: 3481863 - RNA, 19 nt, Pseudomonas aeruginosa PA01
ugcacguugcugugcugca

SEQ ID NO: 3481864 - RNA, 14 nt, Pseudomonas aeruginosa PA01
ugcacuugccgcac

SEQ ID NO: 3481865 - RNA, 17 nt, Pseudomonas aeruginosa PA01
ugcagacgguucagcag

SEQ ID NO: 3481866 - RNA, 15 nt, Pseudomonas aeruginosa PA01
ugcagagaaaaggcc

SEQ ID NO: 3481867 - RNA, 18 nt, Pseudomonas aeruginosa PA01
ugcagagaggcuggcgcu

SEQ ID NO: 3481868 - RNA, 21 nt, Pseudomonas aeruginosa PA01
ugcagagcggccaggucgagg

SEQ ID NO: 3481869 - RNA, 16 nt, Pseudomonas aeruginosa PA01
ugcagauccagcggca

SEQ ID NO: 3481870 - RNA, 17 nt, Pseudomonas aeruginosa PA01
ugcagauccagcggcag

SEQ ID NO: 3481871 - RNA, 21 nt, Pseudomonas aeruginosa PA01
ugcagauccagcggcaggugg

SEQ ID NO: 3481872 - RNA, 18 nt, Pseudomonas aeruginosa PA01
ugcagaugaccagcgcau

SEQ ID NO: 3481873 - RNA, 17 nt, Pseudomonas aeruginosa PA01
ugcagauggucgccgga

SEQ ID NO: 3481874 - RNA, 19 nt, Pseudomonas aeruginosa PA01
ugcagcaacucgccgccga

SEQ ID NO: 3481875 - RNA, 15 nt, Pseudomonas aeruginosa PA01
ugcagcaagccgcag

SEQ ID NO: 3481876 - RNA, 17 nt, Pseudomonas aeruginosa PA01
ugcagcaagccgcagcg

SEQ ID NO: 3481877 - RNA, 19 nt, Pseudomonas aeruginosa PA01
ugcagcaagccgcagcgcc

SEQ ID NO: 3481878 - RNA, 16 nt, Pseudomonas aeruginosa PA01
ugcagcacccccagca

SEQ ID NO: 3481879 - RNA, 17 nt, Pseudomonas aeruginosa PA01
ugcagcaccgccugguc

SEQ ID NO: 3481880 - RNA, 24 nt, Pseudomonas aeruginosa PA01
ugcagcaccgccuggucgaucucg

SEQ ID NO: 3481881 - RNA, 14 nt, Pseudomonas aeruginosa PA01
ugcagcagaaguug

SEQ ID NO: 3481882 - RNA, 19 nt, Pseudomonas aeruginosa PA01
ugcagcaggaucagcgcau

SEQ ID NO: 3481883 - RNA, 21 nt, Pseudomonas aeruginosa PA01
ugcagcaggguaccgcuggcg

SEQ ID NO: 3481884 - RNA, 23 nt, Pseudomonas aeruginosa PA01
ugcagcaggguaccgcuggcgcu

SEQ ID NO: 3481885 - RNA, 12 nt, Pseudomonas aeruginosa PA01
ugcagcagguag

SEQ ID NO: 3481886 - RNA, 22 nt, Pseudomonas aeruginosa PA01
ugcagcagguagugcucggcca

SEQ ID NO: 3481887 - RNA, 18 nt, Pseudomonas aeruginosa PA01
ugcagcaguuccaggcgu

SEQ ID NO: 3481888 - RNA, 15 nt, Pseudomonas aeruginosa PA01
ugcagcaucaggcgc

SEQ ID NO: 3481889 - RNA, 16 nt, Pseudomonas aeruginosa PA01
ugcagcaucaggcgcu

SEQ ID NO: 3481890 - RNA, 17 nt, Pseudomonas aeruginosa PA01
ugcagcaucaggcgcuc

SEQ ID NO: 3481891 - RNA, 17 nt, Pseudomonas aeruginosa PA01
ugcagccaccagccgaa

SEQ ID NO: 3481892 - RNA, 17 nt, Pseudomonas aeruginosa PA01
ugcagccacccagcagc

SEQ ID NO: 3481893 - RNA, 18 nt, Pseudomonas aeruginosa PA01
ugcagccacccagcagca

SEQ ID NO: 3481894 - RNA, 23 nt, Pseudomonas aeruginosa PA01
ugcagccacuguccaugaaugcc

SEQ ID NO: 3481895 - RNA, 13 nt, Pseudomonas aeruginosa PA01
ugcagccagccgu

SEQ ID NO: 3481896 - RNA, 15 nt, Pseudomonas aeruginosa PA01
ugcagccagccgucg

SEQ ID NO: 3481897 - RNA, 21 nt, Pseudomonas aeruginosa PA01
ugcagccagcuucagccgacc

SEQ ID NO: 3481898 - RNA, 20 nt, Pseudomonas aeruginosa PA01
ugcagccguugccccagacc

SEQ ID NO: 3481899 - RNA, 21 nt, Pseudomonas aeruginosa PA01
ugcagcgacuccagccaggcg

SEQ ID NO: 3481900 - RNA, 21 nt, Pseudomonas aeruginosa PA01
ugcagcgaggggaagaucucc

SEQ ID NO: 3481901 - RNA, 18 nt, Pseudomonas aeruginosa PA01
ugcagcgagucgccgugg

SEQ ID NO: 3481902 - RNA, 23 nt, Pseudomonas aeruginosa PA01
ugcagcgccauggggaucaccgg

SEQ ID NO: 3481903 - RNA, 14 nt, Pseudomonas aeruginosa PA01
ugcagcgccccagc

SEQ ID NO: 3481904 - RNA, 15 nt, Pseudomonas aeruginosa PA01
ugcagcgcgcgcugg

SEQ ID NO: 3481905 - RNA, 17 nt, Pseudomonas aeruginosa PA01
ugcagcgcuuguagcag

SEQ ID NO: 3481906 - RNA, 24 nt, Pseudomonas aeruginosa PA01
ugcagcggaagcccugcuggcgca

SEQ ID NO: 3481907 - RNA, 10 nt, Pseudomonas aeruginosa PA01
ugcagcggca

SEQ ID NO: 3481908 - RNA, 19 nt, Pseudomonas aeruginosa PA01
ugcagcggcauggucagcc

SEQ ID NO: 3481909 - RNA, 15 nt, Pseudomonas aeruginosa PA01
ugcagcgucgcgcgu

SEQ ID NO: 3481910 - RNA, 21 nt, Pseudomonas aeruginosa PA01
ugcagcgucgcgcguccagcc

SEQ ID NO: 3481911 - RNA, 22 nt, Pseudomonas aeruginosa PA01
ugcagcuccaccgauggcgcgc

SEQ ID NO: 3481912 - RNA, 16 nt, Pseudomonas aeruginosa PA01
ugcagcugcgagaaca

SEQ ID NO: 3481913 - RNA, 18 nt, Pseudomonas aeruginosa PA01
ugcagcuucuccagggaa

SEQ ID NO: 3481914 - RNA, 18 nt, Pseudomonas aeruginosa PA01
ugcagcuugcgcgccagg

SEQ ID NO: 3481915 - RNA, 20 nt, Pseudomonas aeruginosa PA01
ugcagcuugguauccaccuc

SEQ ID NO: 3481916 - RNA, 20 nt, Pseudomonas aeruginosa PA01
ugcagcuugugggcaugcuc

SEQ ID NO: 3481917 - RNA, 23 nt, Pseudomonas aeruginosa PA01
ugcagcuugugggcaugcucggc

SEQ ID NO: 3481918 - RNA, 13 nt, Pseudomonas aeruginosa PA01
ugcaggaacagcc

SEQ ID NO: 3481919 - RNA, 14 nt, Pseudomonas aeruginosa PA01
ugcaggaacagcca

SEQ ID NO: 3481920 - RNA, 15 nt, Pseudomonas aeruginosa PA01
ugcaggaacagccag

SEQ ID NO: 3481921 - RNA, 19 nt, Pseudomonas aeruginosa PA01
ugcaggaagcgccgggccg

SEQ ID NO: 3481922 - RNA, 20 nt, Pseudomonas aeruginosa PA01
ugcaggaagcgccgggccgc

SEQ ID NO: 3481923 - RNA, 22 nt, Pseudomonas aeruginosa PA01
ugcaggaagcgccgggccgcau

SEQ ID NO: 3481924 - RNA, 23 nt, Pseudomonas aeruginosa PA01
ugcaggaagcgccgggccgcauc

SEQ ID NO: 3481925 - RNA, 15 nt, Pseudomonas aeruginosa PA01
ugcaggaaggcgacg

SEQ ID NO: 3481926 - RNA, 22 nt, Pseudomonas aeruginosa PA01
ugcaggacgaagucgccggcau

SEQ ID NO: 3481927 - RNA, 22 nt, Pseudomonas aeruginosa PA01
ugcaggcacggaagcgcugcuc

SEQ ID NO: 3481928 - RNA, 17 nt, Pseudomonas aeruginosa PA01
ugcaggcccggccgccu

SEQ ID NO: 3481929 - RNA, 18 nt, Pseudomonas aeruginosa PA01
ugcaggccgaauccgccg

SEQ ID NO: 3481930 - RNA, 18 nt, Pseudomonas aeruginosa PA01
ugcaggccgacguagccg

SEQ ID NO: 3481931 - RNA, 20 nt, Pseudomonas aeruginosa PA01
ugcaggccgagaccgcagcc

SEQ ID NO: 3481932 - RNA, 23 nt, Pseudomonas aeruginosa PA01
ugcaggccgagaccgcagcccag

SEQ ID NO: 3481933 - RNA, 23 nt, Pseudomonas aeruginosa PA01
ugcaggccgagcugcucgaagca

SEQ ID NO: 3481934 - RNA, 12 nt, Pseudomonas aeruginosa PA01
ugcaggccgcgc

SEQ ID NO: 3481935 - RNA, 22 nt, Pseudomonas aeruginosa PA01
ugcaggccgcgcgauggccggc

SEQ ID NO: 3481936 - RNA, 23 nt, Pseudomonas aeruginosa PA01
ugcaggccgcgcgauggccggcg

SEQ ID NO: 3481937 - RNA, 12 nt, Pseudomonas aeruginosa PA01
ugcaggccggcc

SEQ ID NO: 3481938 - RNA, 13 nt, Pseudomonas aeruginosa PA01
ugcaggccggcga

SEQ ID NO: 3481939 - RNA, 19 nt, Pseudomonas aeruginosa PA01
ugcaggccggcgagccagg

SEQ ID NO: 3481940 - RNA, 14 nt, Pseudomonas aeruginosa PA01
ugcaggcgcccugg

SEQ ID NO: 3481941 - RNA, 17 nt, Pseudomonas aeruginosa PA01
ugcaggcgcccuggccg

SEQ ID NO: 3481942 - RNA, 22 nt, Pseudomonas aeruginosa PA01
ugcaggcgcccuggccgucggc

SEQ ID NO: 3481943 - RNA, 18 nt, Pseudomonas aeruginosa PA01
ugcaggcgguagcgccgc

SEQ ID NO: 3481944 - RNA, 15 nt, Pseudomonas aeruginosa PA01
ugcaggcucagcacc

SEQ ID NO: 3481945 - RNA, 16 nt, Pseudomonas aeruginosa PA01
ugcaggcucagcaccu

SEQ ID NO: 3481946 - RNA, 20 nt, Pseudomonas aeruginosa PA01
ugcaggcucgacaggucggc

SEQ ID NO: 3481947 - RNA, 20 nt, Pseudomonas aeruginosa PA01
ugcaggcucucgcgcagcag

SEQ ID NO: 3481948 - RNA, 21 nt, Pseudomonas aeruginosa PA01
ugcagggccagggaggcgcug

SEQ ID NO: 3481949 - RNA, 13 nt, Pseudomonas aeruginosa PA01
ugcagggccgcca

SEQ ID NO: 3481950 - RNA, 15 nt, Pseudomonas aeruginosa PA01
ugcagggccgccagc

SEQ ID NO: 3481951 - RNA, 19 nt, Pseudomonas aeruginosa PA01
ugcagggccgccagccgcc

SEQ ID NO: 3481952 - RNA, 13 nt, Pseudomonas aeruginosa PA01
ugcagggcgaucc

SEQ ID NO: 3481953 - RNA, 13 nt, Pseudomonas aeruginosa PA01
ugcagggcguagu

SEQ ID NO: 3481954 - RNA, 13 nt, Pseudomonas aeruginosa PA01
ugcagggcgucca

SEQ ID NO: 3481955 - RNA, 17 nt, Pseudomonas aeruginosa PA01
ugcagggcgucgccggg

SEQ ID NO: 3481956 - RNA, 22 nt, Pseudomonas aeruginosa PA01
ugcaggguauuuuccagcaggc

SEQ ID NO: 3481957 - RNA, 15 nt, Pseudomonas aeruginosa PA01
ugcagggucacgcgu

SEQ ID NO: 3481958 - RNA, 15 nt, Pseudomonas aeruginosa PA01
ugcagggucacgcug

SEQ ID NO: 3481959 - RNA, 15 nt, Pseudomonas aeruginosa PA01
ugcagggucaggucg

SEQ ID NO: 3481960 - RNA, 19 nt, Pseudomonas aeruginosa PA01
ugcagggucgccgggucga

SEQ ID NO: 3481961 - RNA, 14 nt, Pseudomonas aeruginosa PA01
ugcagguagcagcc

SEQ ID NO: 3481962 - RNA, 19 nt, Pseudomonas aeruginosa PA01
ugcagguagccgcgccggc

SEQ ID NO: 3481963 - RNA, 20 nt, Pseudomonas aeruginosa PA01
ugcagguagccgcgccggcc

SEQ ID NO: 3481964 - RNA, 23 nt, Pseudomonas aeruginosa PA01
ugcagguagccgcgccggccguc

SEQ ID NO: 3481965 - RNA, 15 nt, Pseudomonas aeruginosa PA01
ugcagguagcgcugc

SEQ ID NO: 3481966 - RNA, 15 nt, Pseudomonas aeruginosa PA01
ugcagguaggcggug

SEQ ID NO: 3481967 - RNA, 16 nt, Pseudomonas aeruginosa PA01
ugcagguaguccagcc

SEQ ID NO: 3481968 - RNA, 18 nt, Pseudomonas aeruginosa PA01
ugcagguaguccagccag

SEQ ID NO: 3481969 - RNA, 19 nt, Pseudomonas aeruginosa PA01
ugcagguaguccagccagu

SEQ ID NO: 3481970 - RNA, 20 nt, Pseudomonas aeruginosa PA01
ugcagguaguccagccagug

SEQ ID NO: 3481971 - RNA, 16 nt, Pseudomonas aeruginosa PA01
ugcaggucgaggcgcu

SEQ ID NO: 3481972 - RNA, 20 nt, Pseudomonas aeruginosa PA01
ugcaggucgcgcggcgccug

SEQ ID NO: 3481973 - RNA, 21 nt, Pseudomonas aeruginosa PA01
ugcaggucgcgcggcgccugc

SEQ ID NO: 3481974 - RNA, 19 nt, Pseudomonas aeruginosa PA01
ugcagguggcgcucacgcu

SEQ ID NO: 3481975 - RNA, 17 nt, Pseudomonas aeruginosa PA01
ugcagguguucggcggc

SEQ ID NO: 3481976 - RNA, 15 nt, Pseudomonas aeruginosa PA01
ugcagguucaccgcc

SEQ ID NO: 3481977 - RNA, 24 nt, Pseudomonas aeruginosa PA01
ugcagguuguccagggcauccauc

SEQ ID NO: 3481978 - RNA, 15 nt, Pseudomonas aeruginosa PA01
ugcaguaccugcuca

SEQ ID NO: 3481979 - RNA, 23 nt, Pseudomonas aeruginosa PA01
ugcaguaccugcucacggccgaa

SEQ ID NO: 3481980 - RNA, 18 nt, Pseudomonas aeruginosa PA01
ugcaguacuuggccagca

SEQ ID NO: 3481981 - RNA, 15 nt, Pseudomonas aeruginosa PA01
ugcagucccgccagg

SEQ ID NO: 3481982 - RNA, 15 nt, Pseudomonas aeruginosa PA01
ugcagucgaaaaccg

SEQ ID NO: 3481983 - RNA, 14 nt, Pseudomonas aeruginosa PA01
ugcagucgcggaag

SEQ ID NO: 3481984 - RNA, 18 nt, Pseudomonas aeruginosa PA01
ugcagucgcggaagcggc

SEQ ID NO: 3481985 - RNA, 19 nt, Pseudomonas aeruginosa PA01
ugcagucgcggaagcggca

SEQ ID NO: 3481986 - RNA, 17 nt, Pseudomonas aeruginosa PA01
ugcagucggcaccgauc

SEQ ID NO: 3481987 - RNA, 12 nt, Pseudomonas aeruginosa PA01
ugcagugcgccg

SEQ ID NO: 3481988 - RNA, 15 nt, Pseudomonas aeruginosa PA01
ugcagugcgccgcag

SEQ ID NO: 3481989 - RNA, 16 nt, Pseudomonas aeruginosa PA01
ugcagugcgccgcagc

SEQ ID NO: 3481990 - RNA, 14 nt, Pseudomonas aeruginosa PA01
ugcaguucgaccuc

SEQ ID NO: 3481991 - RNA, 19 nt, Pseudomonas aeruginosa PA01
ugcaguugagucgcgcgcg

SEQ ID NO: 3481992 - RNA, 20 nt, Pseudomonas aeruginosa PA01
ugcaguugagucgcgcgcgc

SEQ ID NO: 3481993 - RNA, 21 nt, Pseudomonas aeruginosa PA01
ugcaucaccaggcugccgccg

SEQ ID NO: 3481994 - RNA, 13 nt, Pseudomonas aeruginosa PA01
ugcaucaccggca

SEQ ID NO: 3481995 - RNA, 17 nt, Pseudomonas aeruginosa PA01
ugcaucaccggcagcag

SEQ ID NO: 3481996 - RNA, 18 nt, Pseudomonas aeruginosa PA01
ugcaucaccggcagcagc

SEQ ID NO: 3481997 - RNA, 19 nt, Pseudomonas aeruginosa PA01
ugcaucaccggcagcagcg

SEQ ID NO: 3481998 - RNA, 23 nt, Pseudomonas aeruginosa PA01
ugcaucaccuugucgcaccagcc

SEQ ID NO: 3481999 - RNA, 21 nt, Pseudomonas aeruginosa PA01
ugcaucacguacggcgccucg

SEQ ID NO: 3482000 - RNA, 13 nt, Pseudomonas aeruginosa PA01
ugcaucagccugg

SEQ ID NO: 3482001 - RNA, 15 nt, Pseudomonas aeruginosa PA01
ugcaucagccuggcc

SEQ ID NO: 3482002 - RNA, 18 nt, Pseudomonas aeruginosa PA01
ugcaucagccuggccagc

SEQ ID NO: 3482003 - RNA, 15 nt, Pseudomonas aeruginosa PA01
ugcauccgccgcaga

SEQ ID NO: 3482004 - RNA, 14 nt, Pseudomonas aeruginosa PA01
ugcaucggccgcca

SEQ ID NO: 3482005 - RNA, 13 nt, Pseudomonas aeruginosa PA01
ugcaucggcgcgc

SEQ ID NO: 3482006 - RNA, 17 nt, Pseudomonas aeruginosa PA01
ugcaucggcgcgccgaa

SEQ ID NO: 3482007 - RNA, 19 nt, Pseudomonas aeruginosa PA01
ugcaucggcgcgccgaagg

SEQ ID NO: 3482008 - RNA, 16 nt, Pseudomonas aeruginosa PA01
ugcaucugcgccggga

SEQ ID NO: 3482009 - RNA, 16 nt, Pseudomonas aeruginosa PA01
ugcaucuucucccaga

SEQ ID NO: 3482010 - RNA, 14 nt, Pseudomonas aeruginosa PA01
ugcaugaaggcgcu

SEQ ID NO: 3482011 - RNA, 16 nt, Pseudomonas aeruginosa PA01
ugcaugaaggcgcuga

SEQ ID NO: 3482012 - RNA, 18 nt, Pseudomonas aeruginosa PA01
ugcaugaaggcgcugagc

SEQ ID NO: 3482013 - RNA, 19 nt, Pseudomonas aeruginosa PA01
ugcaugagugucgccauca

SEQ ID NO: 3482014 - RNA, 16 nt, Pseudomonas aeruginosa PA01
ugcaugccggccgucg

SEQ ID NO: 3482015 - RNA, 22 nt, Pseudomonas aeruginosa PA01
ugcaugccggccgucgcgcacc

SEQ ID NO: 3482016 - RNA, 13 nt, Pseudomonas aeruginosa PA01
ugcaugccgggga

SEQ ID NO: 3482017 - RNA, 17 nt, Pseudomonas aeruginosa PA01
ugcaugccgggguccgc

SEQ ID NO: 3482018 - RNA, 15 nt, Pseudomonas aeruginosa PA01
ugcaugccguccggg

SEQ ID NO: 3482019 - RNA, 18 nt, Pseudomonas aeruginosa PA01
ugcaugcuuuugaacacc

SEQ ID NO: 3482020 - RNA, 23 nt, Pseudomonas aeruginosa PA01
ugcaugcuuuugaacaccagcga

SEQ ID NO: 3482021 - RNA, 20 nt, Pseudomonas aeruginosa PA01
ugcauggcaccgucaagggc

SEQ ID NO: 3482022 - RNA, 12 nt, Pseudomonas aeruginosa PA01
ugcauggccggg

SEQ ID NO: 3482023 - RNA, 22 nt, Pseudomonas aeruginosa PA01
ugcauggccuguaccaaggugc

SEQ ID NO: 3482024 - RNA, 16 nt, Pseudomonas aeruginosa PA01
ugcaugggcucgcgcg

SEQ ID NO: 3482025 - RNA, 20 nt, Pseudomonas aeruginosa PA01
ugcaugucaccgauugcgcc

SEQ ID NO: 3482026 - RNA, 14 nt, Pseudomonas aeruginosa PA01
ugcauguccgccag

SEQ ID NO: 3482027 - RNA, 14 nt, Pseudomonas aeruginosa PA01
ugcauguccucggc

SEQ ID NO: 3482028 - RNA, 15 nt, Pseudomonas aeruginosa PA01
ugcaugucgcugagc

SEQ ID NO: 3482029 - RNA, 14 nt, Pseudomonas aeruginosa PA01
ugcaugugccaggc

SEQ ID NO: 3482030 - RNA, 17 nt, Pseudomonas aeruginosa PA01
ugcaugugccaggccug

SEQ ID NO: 3482031 - RNA, 16 nt, Pseudomonas aeruginosa PA01
ugcauuuccuggacgu

SEQ ID NO: 3482032 - RNA, 19 nt, Pseudomonas aeruginosa PA01
ugcauuuuucaugcggccg

SEQ ID NO: 3482033 - RNA, 18 nt, Pseudomonas aeruginosa PA01
ugccaacuggcgucccca

SEQ ID NO: 3482034 - RNA, 19 nt, Pseudomonas aeruginosa PA01
ugccaaguugccuggcagg

SEQ ID NO: 3482035 - RNA, 19 nt, Pseudomonas aeruginosa PA01
ugccacaguuucauggugc

SEQ ID NO: 3482036 - RNA, 15 nt, Pseudomonas aeruginosa PA01
ugccacccggcgccc

SEQ ID NO: 3482037 - RNA, 15 nt, Pseudomonas aeruginosa PA01
ugccacccggcucgg

SEQ ID NO: 3482038 - RNA, 14 nt, Pseudomonas aeruginosa PA01
ugccacgcaccacc

SEQ ID NO: 3482039 - RNA, 16 nt, Pseudomonas aeruginosa PA01
ugccacgcaccaccag

SEQ ID NO: 3482040 - RNA, 16 nt, Pseudomonas aeruginosa PA01
ugccacugacgcgcag

SEQ ID NO: 3482041 - RNA, 19 nt, Pseudomonas aeruginosa PA01
ugccacugacgcgcagcgc

SEQ ID NO: 3482042 - RNA, 22 nt, Pseudomonas aeruginosa PA01
ugccacugacgcgcagcgccgc

SEQ ID NO: 3482043 - RNA, 12 nt, Pseudomonas aeruginosa PA01
ugccacugcgcg

SEQ ID NO: 3482044 - RNA, 16 nt, Pseudomonas aeruginosa PA01
ugccacugcgcgccag

SEQ ID NO: 3482045 - RNA, 22 nt, Pseudomonas aeruginosa PA01
ugccacuugcgggugcgcaggc

SEQ ID NO: 3482046 - RNA, 14 nt, Pseudomonas aeruginosa PA01
ugccagaaaaccca

SEQ ID NO: 3482047 - RNA, 17 nt, Pseudomonas aeruginosa PA01
ugccagaaaacccagcg

SEQ ID NO: 3482048 - RNA, 16 nt, Pseudomonas aeruginosa PA01
ugccagaaugugccgg

SEQ ID NO: 3482049 - RNA, 17 nt, Pseudomonas aeruginosa PA01
ugccagaaugugccggu

SEQ ID NO: 3482050 - RNA, 18 nt, Pseudomonas aeruginosa PA01
ugccagaccgagauuggc

SEQ ID NO: 3482051 - RNA, 19 nt, Pseudomonas aeruginosa PA01
ugccagaccguggcgcuac

SEQ ID NO: 3482052 - RNA, 17 nt, Pseudomonas aeruginosa PA01
ugccagacgaucagcgg

SEQ ID NO: 3482053 - RNA, 19 nt, Pseudomonas aeruginosa PA01
ugccagacgaucagcggcc

SEQ ID NO: 3482054 - RNA, 15 nt, Pseudomonas aeruginosa PA01
ugccagacgcucggc

SEQ ID NO: 3482055 - RNA, 21 nt, Pseudomonas aeruginosa PA01
ugccagaggcugcgcuccagg

SEQ ID NO: 3482056 - RNA, 17 nt, Pseudomonas aeruginosa PA01
ugccagaguugccuguc

SEQ ID NO: 3482057 - RNA, 11 nt, Pseudomonas aeruginosa PA01
ugccagcaccu

SEQ ID NO: 3482058 - RNA, 22 nt, Pseudomonas aeruginosa PA01
ugccagcaccuucaucaccagg

SEQ ID NO: 3482059 - RNA, 23 nt, Pseudomonas aeruginosa PA01
ugccagcaccuucaucaccaggu

SEQ ID NO: 3482060 - RNA, 12 nt, Pseudomonas aeruginosa PA01
ugccagcagcgc

SEQ ID NO: 3482061 - RNA, 12 nt, Pseudomonas aeruginosa PA01
ugccagcaggcc

SEQ ID NO: 3482062 - RNA, 18 nt, Pseudomonas aeruginosa PA01
ugccagcaguaucgacga

SEQ ID NO: 3482063 - RNA, 23 nt, Pseudomonas aeruginosa PA01
ugccagcaguaucgacgauggug

SEQ ID NO: 3482064 - RNA, 21 nt, Pseudomonas aeruginosa PA01
ugccagccggccuugcuuugc

SEQ ID NO: 3482065 - RNA, 17 nt, Pseudomonas aeruginosa PA01
ugccagcgccacgccgc

SEQ ID NO: 3482066 - RNA, 14 nt, Pseudomonas aeruginosa PA01
ugccagcgccgccg

SEQ ID NO: 3482067 - RNA, 20 nt, Pseudomonas aeruginosa PA01
ugccagcgcgucggcacgcc

SEQ ID NO: 3482068 - RNA, 21 nt, Pseudomonas aeruginosa PA01
ugccagcgcgucggcacgccg

SEQ ID NO: 3482069 - RNA, 21 nt, Pseudomonas aeruginosa PA01
ugccagcucuggccguccugc

SEQ ID NO: 3482070 - RNA, 13 nt, Pseudomonas aeruginosa PA01
ugccaggaccagc

SEQ ID NO: 3482071 - RNA, 14 nt, Pseudomonas aeruginosa PA01
ugccaggagcacgc

SEQ ID NO: 3482072 - RNA, 19 nt, Pseudomonas aeruginosa PA01
ugccaggagcacgccgugc

SEQ ID NO: 3482073 - RNA, 13 nt, Pseudomonas aeruginosa PA01
ugccaggagcuug

SEQ ID NO: 3482074 - RNA, 20 nt, Pseudomonas aeruginosa PA01
ugccaggaggauucgccagc

SEQ ID NO: 3482075 - RNA, 21 nt, Pseudomonas aeruginosa PA01
ugccaggaggauucgccagcc

SEQ ID NO: 3482076 - RNA, 17 nt, Pseudomonas aeruginosa PA01
ugccaggauuucuccug

SEQ ID NO: 3482077 - RNA, 12 nt, Pseudomonas aeruginosa PA01
ugccaggccggc

SEQ ID NO: 3482078 - RNA, 13 nt, Pseudomonas aeruginosa PA01
ugccaggccggcg

SEQ ID NO: 3482079 - RNA, 22 nt, Pseudomonas aeruginosa PA01
ugccaggccugggucaccagca

SEQ ID NO: 3482080 - RNA, 17 nt, Pseudomonas aeruginosa PA01
ugccaggcgcucgcgcu

SEQ ID NO: 3482081 - RNA, 15 nt, Pseudomonas aeruginosa PA01
ugccaggcggcagcc

SEQ ID NO: 3482082 - RNA, 20 nt, Pseudomonas aeruginosa PA01
ugccaggcucgccgccagca

SEQ ID NO: 3482083 - RNA, 22 nt, Pseudomonas aeruginosa PA01
ugccaggcucgccgccagcagg

SEQ ID NO: 3482084 - RNA, 16 nt, Pseudomonas aeruginosa PA01
ugccagggauacucau

SEQ ID NO: 3482085 - RNA, 14 nt, Pseudomonas aeruginosa PA01
ugccagggcaggga

SEQ ID NO: 3482086 - RNA, 12 nt, Pseudomonas aeruginosa PA01
ugccagggccuu

SEQ ID NO: 3482087 - RNA, 14 nt, Pseudomonas aeruginosa PA01
ugccagggccuugc

SEQ ID NO: 3482088 - RNA, 20 nt, Pseudomonas aeruginosa PA01
ugccagggcggucggccagg

SEQ ID NO: 3482089 - RNA, 21 nt, Pseudomonas aeruginosa PA01
ugccagggcggucggccaggg

SEQ ID NO: 3482090 - RNA, 23 nt, Pseudomonas aeruginosa PA01
ugccagggcggucggccagggga

SEQ ID NO: 3482091 - RNA, 22 nt, Pseudomonas aeruginosa PA01
ugccagggcuucccaggccagc

SEQ ID NO: 3482092 - RNA, 21 nt, Pseudomonas aeruginosa PA01
ugccaggggcuagucgcgcag

SEQ ID NO: 3482093 - RNA, 17 nt, Pseudomonas aeruginosa PA01
ugccagguuggcaacug

SEQ ID NO: 3482094 - RNA, 17 nt, Pseudomonas aeruginosa PA01
ugccagugccucgcgcg

SEQ ID NO: 3482095 - RNA, 15 nt, Pseudomonas aeruginosa PA01
ugccauacagcgccc

SEQ ID NO: 3482096 - RNA, 16 nt, Pseudomonas aeruginosa PA01
ugccauacagcgccca

SEQ ID NO: 3482097 - RNA, 20 nt, Pseudomonas aeruginosa PA01
ugccauaggcauauucuuca

SEQ ID NO: 3482098 - RNA, 19 nt, Pseudomonas aeruginosa PA01
ugccaucaggccgcggccc

SEQ ID NO: 3482099 - RNA, 22 nt, Pseudomonas aeruginosa PA01
ugccaucaggccgcggcccugc

SEQ ID NO: 3482100 - RNA, 14 nt, Pseudomonas aeruginosa PA01
ugccaucaucggac

SEQ ID NO: 3482101 - RNA, 18 nt, Pseudomonas aeruginosa PA01
ugccauccgcgccgacca

SEQ ID NO: 3482102 - RNA, 20 nt, Pseudomonas aeruginosa PA01
ugccauccgcgccgaccagc

SEQ ID NO: 3482103 - RNA, 14 nt, Pseudomonas aeruginosa PA01
ugccauccuccagc

SEQ ID NO: 3482104 - RNA, 16 nt, Pseudomonas aeruginosa PA01
ugccauccuccagcac

SEQ ID NO: 3482105 - RNA, 17 nt, Pseudomonas aeruginosa PA01
ugccauccuccagcacu

SEQ ID NO: 3482106 - RNA, 17 nt, Pseudomonas aeruginosa PA01
ugccaucgaggccaggc

SEQ ID NO: 3482107 - RNA, 21 nt, Pseudomonas aeruginosa PA01
ugccaucgaggccaggccgag

SEQ ID NO: 3482108 - RNA, 17 nt, Pseudomonas aeruginosa PA01
ugccauggaucaccagg

SEQ ID NO: 3482109 - RNA, 12 nt, Pseudomonas aeruginosa PA01
ugccauggcggc

SEQ ID NO: 3482110 - RNA, 13 nt, Pseudomonas aeruginosa PA01
ugccauggcggcg

SEQ ID NO: 3482111 - RNA, 14 nt, Pseudomonas aeruginosa PA01
ugccauggcggcgg

SEQ ID NO: 3482112 - RNA, 16 nt, Pseudomonas aeruginosa PA01
ugccauggcggcggau

SEQ ID NO: 3482113 - RNA, 23 nt, Pseudomonas aeruginosa PA01
ugccauuccuugauuugcccggc

SEQ ID NO: 3482114 - RNA, 22 nt, Pseudomonas aeruginosa PA01
ugcccaagggccugggcgccgc

SEQ ID NO: 3482115 - RNA, 15 nt, Pseudomonas aeruginosa PA01
ugcccaauacggcgg

SEQ ID NO: 3482116 - RNA, 13 nt, Pseudomonas aeruginosa PA01
ugcccaccaacgg

SEQ ID NO: 3482117 - RNA, 20 nt, Pseudomonas aeruginosa PA01
ugcccaccagcgucgccagg

SEQ ID NO: 3482118 - RNA, 22 nt, Pseudomonas aeruginosa PA01
ugcccaccagcgucgccaggcc

SEQ ID NO: 3482119 - RNA, 21 nt, Pseudomonas aeruginosa PA01
ugcccaccccggacugcccga

SEQ ID NO: 3482120 - RNA, 21 nt, Pseudomonas aeruginosa PA01
ugcccaccgggaucugccggu

SEQ ID NO: 3482121 - RNA, 20 nt, Pseudomonas aeruginosa PA01
ugcccaccugaacgcgcccg

SEQ ID NO: 3482122 - RNA, 16 nt, Pseudomonas aeruginosa PA01
ugcccacggccaggcc

SEQ ID NO: 3482123 - RNA, 22 nt, Pseudomonas aeruginosa PA01
ugcccacggccaggcccacgcc

SEQ ID NO: 3482124 - RNA, 13 nt, Pseudomonas aeruginosa PA01
ugcccagacgccg

SEQ ID NO: 3482125 - RNA, 18 nt, Pseudomonas aeruginosa PA01
ugcccagcaggcugcugc

SEQ ID NO: 3482126 - RNA, 14 nt, Pseudomonas aeruginosa PA01
ugcccagccagggc

SEQ ID NO: 3482127 - RNA, 15 nt, Pseudomonas aeruginosa PA01
ugcccagccagggcc

SEQ ID NO: 3482128 - RNA, 18 nt, Pseudomonas aeruginosa PA01
ugcccagccagggccgcg

SEQ ID NO: 3482129 - RNA, 18 nt, Pseudomonas aeruginosa PA01
ugcccagcccgccuucca

SEQ ID NO: 3482130 - RNA, 22 nt, Pseudomonas aeruginosa PA01
ugcccagccgacgcgcagcggu

SEQ ID NO: 3482131 - RNA, 12 nt, Pseudomonas aeruginosa PA01
ugcccagcgcag

SEQ ID NO: 3482132 - RNA, 17 nt, Pseudomonas aeruginosa PA01
ugcccagcgcaggccga

SEQ ID NO: 3482133 - RNA, 15 nt, Pseudomonas aeruginosa PA01
ugcccagcgccgcca

SEQ ID NO: 3482134 - RNA, 17 nt, Pseudomonas aeruginosa PA01
ugcccagcgccgccagc

SEQ ID NO: 3482135 - RNA, 20 nt, Pseudomonas aeruginosa PA01
ugcccagcgccgccagcagg

SEQ ID NO: 3482136 - RNA, 15 nt, Pseudomonas aeruginosa PA01
ugcccagcgccgccu

SEQ ID NO: 3482137 - RNA, 21 nt, Pseudomonas aeruginosa PA01
ugcccagcgccgccugcuggc

SEQ ID NO: 3482138 - RNA, 23 nt, Pseudomonas aeruginosa PA01
ugcccagcgccgccugcuggcug

SEQ ID NO: 3482139 - RNA, 12 nt, Pseudomonas aeruginosa PA01
ugcccagcggcg

SEQ ID NO: 3482140 - RNA, 17 nt, Pseudomonas aeruginosa PA01
ugcccagcggcgccucg

SEQ ID NO: 3482141 - RNA, 16 nt, Pseudomonas aeruginosa PA01
ugcccagcguggccag

SEQ ID NO: 3482142 - RNA, 21 nt, Pseudomonas aeruginosa PA01
ugcccagcuuggccacguccu

SEQ ID NO: 3482143 - RNA, 14 nt, Pseudomonas aeruginosa PA01
ugcccaggccgaag

SEQ ID NO: 3482144 - RNA, 15 nt, Pseudomonas aeruginosa PA01
ugcccaggccgaagu

SEQ ID NO: 3482145 - RNA, 23 nt, Pseudomonas aeruginosa PA01
ugcccaggccgaaguagccggcg

SEQ ID NO: 3482146 - RNA, 13 nt, Pseudomonas aeruginosa PA01
ugcccaggccgcc

SEQ ID NO: 3482147 - RNA, 14 nt, Pseudomonas aeruginosa PA01
ugcccaggcgcugg

SEQ ID NO: 3482148 - RNA, 16 nt, Pseudomonas aeruginosa PA01
ugcccaggcgcuggcg

SEQ ID NO: 3482149 - RNA, 11 nt, Pseudomonas aeruginosa PA01
ugcccaggcuc

SEQ ID NO: 3482150 - RNA, 18 nt, Pseudomonas aeruginosa PA01
ugcccaggcugaggucgc

SEQ ID NO: 3482151 - RNA, 19 nt, Pseudomonas aeruginosa PA01
ugcccaggcugaggucgcg

SEQ ID NO: 3482152 - RNA, 23 nt, Pseudomonas aeruginosa PA01
ugcccaggcugaggucgcgggcg

SEQ ID NO: 3482153 - RNA, 15 nt, Pseudomonas aeruginosa PA01
ugcccagggccagca

SEQ ID NO: 3482154 - RNA, 19 nt, Pseudomonas aeruginosa PA01
ugcccagggccagcagcgg

SEQ ID NO: 3482155 - RNA, 22 nt, Pseudomonas aeruginosa PA01
ugcccagggcccagagcagcac

SEQ ID NO: 3482156 - RNA, 17 nt, Pseudomonas aeruginosa PA01
ugcccagguagccggcg

SEQ ID NO: 3482157 - RNA, 19 nt, Pseudomonas aeruginosa PA01
ugcccagguagccggcgag

SEQ ID NO: 3482158 - RNA, 19 nt, Pseudomonas aeruginosa PA01
ugcccagguagucgcccag

SEQ ID NO: 3482159 - RNA, 23 nt, Pseudomonas aeruginosa PA01
ugcccagguagucgcccagcgcc

SEQ ID NO: 3482160 - RNA, 18 nt, Pseudomonas aeruginosa PA01
ugcccagugggccaccgg

SEQ ID NO: 3482161 - RNA, 19 nt, Pseudomonas aeruginosa PA01
ugcccaguugcgcggcgag

SEQ ID NO: 3482162 - RNA, 14 nt, Pseudomonas aeruginosa PA01
ugcccaucaggcuc

SEQ ID NO: 3482163 - RNA, 20 nt, Pseudomonas aeruginosa PA01
ugcccaucaggcucaggcgu

SEQ ID NO: 3482164 - RNA, 16 nt, Pseudomonas aeruginosa PA01
ugcccauccgcucggc

SEQ ID NO: 3482165 - RNA, 19 nt, Pseudomonas aeruginosa PA01
ugcccauccgcucggcgag

SEQ ID NO: 3482166 - RNA, 19 nt, Pseudomonas aeruginosa PA01
ugcccaucgccuccacggc

SEQ ID NO: 3482167 - RNA, 20 nt, Pseudomonas aeruginosa PA01
ugccccacaggcccugcagc

SEQ ID NO: 3482168 - RNA, 18 nt, Pseudomonas aeruginosa PA01
ugccccacuuccggcccg

SEQ ID NO: 3482169 - RNA, 20 nt, Pseudomonas aeruginosa PA01
ugccccacuuccggcccggc

SEQ ID NO: 3482170 - RNA, 23 nt, Pseudomonas aeruginosa PA01
ugccccacuuccggcccggccag

SEQ ID NO: 3482171 - RNA, 18 nt, Pseudomonas aeruginosa PA01
ugccccagcaucgccggc

SEQ ID NO: 3482172 - RNA, 12 nt, Pseudomonas aeruginosa PA01
ugccccaggcac

SEQ ID NO: 3482173 - RNA, 13 nt, Pseudomonas aeruginosa PA01
ugccccaggccga

SEQ ID NO: 3482174 - RNA, 20 nt, Pseudomonas aeruginosa PA01
ugccccauccgacgccggcu

SEQ ID NO: 3482175 - RNA, 18 nt, Pseudomonas aeruginosa PA01
ugcccccggcaacacccu

SEQ ID NO: 3482176 - RNA, 16 nt, Pseudomonas aeruginosa PA01
ugccccgggcgccggg

SEQ ID NO: 3482177 - RNA, 18 nt, Pseudomonas aeruginosa PA01
ugccccgggcgccggguc

SEQ ID NO: 3482178 - RNA, 17 nt, Pseudomonas aeruginosa PA01
ugccccguagccaugcc

SEQ ID NO: 3482179 - RNA, 21 nt, Pseudomonas aeruginosa PA01
ugccccguagccaugcccggc

SEQ ID NO: 3482180 - RNA, 17 nt, Pseudomonas aeruginosa PA01
ugccccgugcaccgagg

SEQ ID NO: 3482181 - RNA, 22 nt, Pseudomonas aeruginosa PA01
ugccccgugcaccgaggcgcgc

SEQ ID NO: 3482182 - RNA, 17 nt, Pseudomonas aeruginosa PA01
ugccccguggcgggcca

SEQ ID NO: 3482183 - RNA, 22 nt, Pseudomonas aeruginosa PA01
ugccccguggcgggccagcagg

SEQ ID NO: 3482184 - RNA, 22 nt, Pseudomonas aeruginosa PA01
ugccccucacaccaccagcauc

SEQ ID NO: 3482185 - RNA, 20 nt, Pseudomonas aeruginosa PA01
ugccccucguggcgcgaucc

SEQ ID NO: 3482186 - RNA, 13 nt, Pseudomonas aeruginosa PA01
ugccccuucggcu

SEQ ID NO: 3482187 - RNA, 19 nt, Pseudomonas aeruginosa PA01
ugcccgaccgguuccagcg

SEQ ID NO: 3482188 - RNA, 18 nt, Pseudomonas aeruginosa PA01
ugcccgagaagccggggc

SEQ ID NO: 3482189 - RNA, 23 nt, Pseudomonas aeruginosa PA01
ugcccgaggugucgccgcggacg

SEQ ID NO: 3482190 - RNA, 16 nt, Pseudomonas aeruginosa PA01
ugcccgagugccggcg

SEQ ID NO: 3482191 - RNA, 19 nt, Pseudomonas aeruginosa PA01
ugcccgagugccggcgcgu

SEQ ID NO: 3482192 - RNA, 17 nt, Pseudomonas aeruginosa PA01
ugcccgaugccgcgccg

SEQ ID NO: 3482193 - RNA, 21 nt, Pseudomonas aeruginosa PA01
ugcccgaugccgcgccggaag

SEQ ID NO: 3482194 - RNA, 13 nt, Pseudomonas aeruginosa PA01
ugcccgcaggggc

SEQ ID NO: 3482195 - RNA, 16 nt, Pseudomonas aeruginosa PA01
ugcccgcaggggcugc

SEQ ID NO: 3482196 - RNA, 15 nt, Pseudomonas aeruginosa PA01
ugcccgccagcaggc

SEQ ID NO: 3482197 - RNA, 12 nt, Pseudomonas aeruginosa PA01
ugcccgccccgc

SEQ ID NO: 3482198 - RNA, 18 nt, Pseudomonas aeruginosa PA01
ugcccgccccgcaccagc

SEQ ID NO: 3482199 - RNA, 22 nt, Pseudomonas aeruginosa PA01
ugcccgccccgcaccagccagc

SEQ ID NO: 3482200 - RNA, 13 nt, Pseudomonas aeruginosa PA01
ugcccgccggcgc

SEQ ID NO: 3482201 - RNA, 19 nt, Pseudomonas aeruginosa PA01
ugcccgccggcgcccuggg

SEQ ID NO: 3482202 - RNA, 20 nt, Pseudomonas aeruginosa PA01
ugcccgccggcgcccugggc

SEQ ID NO: 3482203 - RNA, 20 nt, Pseudomonas aeruginosa PA01
ugcccgccggcgcgcccagg

SEQ ID NO: 3482204 - RNA, 22 nt, Pseudomonas aeruginosa PA01
ugcccgccggcgcgcccaggcc

SEQ ID NO: 3482205 - RNA, 15 nt, Pseudomonas aeruginosa PA01
ugcccgccucgcgca

SEQ ID NO: 3482206 - RNA, 13 nt, Pseudomonas aeruginosa PA01
ugcccgcgccucg

SEQ ID NO: 3482207 - RNA, 20 nt, Pseudomonas aeruginosa PA01
ugcccgcgccugggccgcga

SEQ ID NO: 3482208 - RNA, 22 nt, Pseudomonas aeruginosa PA01
ugcccgcgccugggccgcgagg

SEQ ID NO: 3482209 - RNA, 21 nt, Pseudomonas aeruginosa PA01
ugcccgcugcaugugccaggc

SEQ ID NO: 3482210 - RNA, 22 nt, Pseudomonas aeruginosa PA01
ugcccgcugcaugugccaggcc

SEQ ID NO: 3482211 - RNA, 18 nt, Pseudomonas aeruginosa PA01
ugcccgcugggcaggugg

SEQ ID NO: 3482212 - RNA, 20 nt, Pseudomonas aeruginosa PA01
ugcccggaccugggcaccag

SEQ ID NO: 3482213 - RNA, 22 nt, Pseudomonas aeruginosa PA01
ugcccggagcggcugccgaggc

SEQ ID NO: 3482214 - RNA, 18 nt, Pseudomonas aeruginosa PA01
ugcccggcagaucucccu

SEQ ID NO: 3482215 - RNA, 17 nt, Pseudomonas aeruginosa PA01
ugcccggcagcgccggg

SEQ ID NO: 3482216 - RNA, 14 nt, Pseudomonas aeruginosa PA01
ugcccggccaggcg

SEQ ID NO: 3482217 - RNA, 19 nt, Pseudomonas aeruginosa PA01
ugcccggccaggcgcggcg

SEQ ID NO: 3482218 - RNA, 19 nt, Pseudomonas aeruginosa PA01
ugcccggccaugccgccga

SEQ ID NO: 3482219 - RNA, 12 nt, Pseudomonas aeruginosa PA01
ugcccggccgca

SEQ ID NO: 3482220 - RNA, 21 nt, Pseudomonas aeruginosa PA01
ugcccggccgcaggcagcaca

SEQ ID NO: 3482221 - RNA, 16 nt, Pseudomonas aeruginosa PA01
ugcccggcgaggucgg

SEQ ID NO: 3482222 - RNA, 22 nt, Pseudomonas aeruginosa PA01
ugcccggcgcgacgcuccaggu

SEQ ID NO: 3482223 - RNA, 15 nt, Pseudomonas aeruginosa PA01
ugcccggcugguugc

SEQ ID NO: 3482224 - RNA, 22 nt, Pseudomonas aeruginosa PA01
ugcccggcugguugccagcagc

SEQ ID NO: 3482225 - RNA, 21 nt, Pseudomonas aeruginosa PA01
ugcccgggguuggcgcugacc

SEQ ID NO: 3482226 - RNA, 19 nt, Pseudomonas aeruginosa PA01
ugcccgggucgucggucgg

SEQ ID NO: 3482227 - RNA, 18 nt, Pseudomonas aeruginosa PA01
ugcccgguauucagccag

SEQ ID NO: 3482228 - RNA, 17 nt, Pseudomonas aeruginosa PA01
ugcccggucaccaccca

SEQ ID NO: 3482229 - RNA, 18 nt, Pseudomonas aeruginosa PA01
ugcccgguggccuccugc

SEQ ID NO: 3482230 - RNA, 15 nt, Pseudomonas aeruginosa PA01
ugcccgguggggcgg

SEQ ID NO: 3482231 - RNA, 17 nt, Pseudomonas aeruginosa PA01
ugcccguaccacgucca

SEQ ID NO: 3482232 - RNA, 16 nt, Pseudomonas aeruginosa PA01
ugcccgucgaccauca

SEQ ID NO: 3482233 - RNA, 22 nt, Pseudomonas aeruginosa PA01
ugcccgucgaccaucaccagcg

SEQ ID NO: 3482234 - RNA, 18 nt, Pseudomonas aeruginosa PA01
ugcccgucuagcgcaggc

SEQ ID NO: 3482235 - RNA, 20 nt, Pseudomonas aeruginosa PA01
ugcccgucuagcgcaggcgg

SEQ ID NO: 3482236 - RNA, 14 nt, Pseudomonas aeruginosa PA01
ugcccgugcgcugc

SEQ ID NO: 3482237 - RNA, 17 nt, Pseudomonas aeruginosa PA01
ugcccguggcgcggacg

SEQ ID NO: 3482238 - RNA, 22 nt, Pseudomonas aeruginosa PA01
ugcccguggcgcggacgggccg

SEQ ID NO: 3482239 - RNA, 13 nt, Pseudomonas aeruginosa PA01
ugcccuccugcuc

SEQ ID NO: 3482240 - RNA, 13 nt, Pseudomonas aeruginosa PA01
ugcccuccugggc

SEQ ID NO: 3482241 - RNA, 16 nt, Pseudomonas aeruginosa PA01
ugcccucgaccagguc

SEQ ID NO: 3482242 - RNA, 21 nt, Pseudomonas aeruginosa PA01
ugcccucgaccagguccggca

SEQ ID NO: 3482243 - RNA, 16 nt, Pseudomonas aeruginosa PA01
ugcccucgcagccggc

SEQ ID NO: 3482244 - RNA, 17 nt, Pseudomonas aeruginosa PA01
ugcccucgcagccggcg

SEQ ID NO: 3482245 - RNA, 18 nt, Pseudomonas aeruginosa PA01
ugcccucgcagccggcgg

SEQ ID NO: 3482246 - RNA, 12 nt, Pseudomonas aeruginosa PA01
ugcccucgcgcu

SEQ ID NO: 3482247 - RNA, 21 nt, Pseudomonas aeruginosa PA01
ugcccucgcggacgcuggcga

SEQ ID NO: 3482248 - RNA, 21 nt, Pseudomonas aeruginosa PA01
ugcccucgcggaucugcuccu

SEQ ID NO: 3482249 - RNA, 13 nt, Pseudomonas aeruginosa PA01
ugcccucgcggcg

SEQ ID NO: 3482250 - RNA, 15 nt, Pseudomonas aeruginosa PA01
ugcccucgcggcggc

SEQ ID NO: 3482251 - RNA, 19 nt, Pseudomonas aeruginosa PA01
ugcccucgcggcggcaggc

SEQ ID NO: 3482252 - RNA, 20 nt, Pseudomonas aeruginosa PA01
ugcccucgcggcggcaggcc

SEQ ID NO: 3482253 - RNA, 22 nt, Pseudomonas aeruginosa PA01
ugcccucgcuacggaaggucgc

SEQ ID NO: 3482254 - RNA, 14 nt, Pseudomonas aeruginosa PA01
ugcccucggcgccc

SEQ ID NO: 3482255 - RNA, 20 nt, Pseudomonas aeruginosa PA01
ugcccucggcgcccgccugc

SEQ ID NO: 3482256 - RNA, 17 nt, Pseudomonas aeruginosa PA01
ugcccuggaagccggca

SEQ ID NO: 3482257 - RNA, 19 nt, Pseudomonas aeruginosa PA01
ugcccuggaagccggcagg

SEQ ID NO: 3482258 - RNA, 20 nt, Pseudomonas aeruginosa PA01
ugcccuggaagccggcaggg

SEQ ID NO: 3482259 - RNA, 15 nt, Pseudomonas aeruginosa PA01
ugcccuggccgacgc

SEQ ID NO: 3482260 - RNA, 21 nt, Pseudomonas aeruginosa PA01
ugcccuggccgacgcugagga

SEQ ID NO: 3482261 - RNA, 18 nt, Pseudomonas aeruginosa PA01
ugcccuggccggcacccu

SEQ ID NO: 3482262 - RNA, 12 nt, Pseudomonas aeruginosa PA01
ugcccuggcuuu

SEQ ID NO: 3482263 - RNA, 19 nt, Pseudomonas aeruginosa PA01
ugcccuggcuuuccagggc

SEQ ID NO: 3482264 - RNA, 15 nt, Pseudomonas aeruginosa PA01
ugcccugggccggcg

SEQ ID NO: 3482265 - RNA, 16 nt, Pseudomonas aeruginosa PA01
ugcccugggccggcgc

SEQ ID NO: 3482266 - RNA, 21 nt, Pseudomonas aeruginosa PA01
ugcccugggcgaacagcaccc

SEQ ID NO: 3482267 - RNA, 22 nt, Pseudomonas aeruginosa PA01
ugcccugggcgaacagcaccca

SEQ ID NO: 3482268 - RNA, 15 nt, Pseudomonas aeruginosa PA01
ugcccuugccgggaa

SEQ ID NO: 3482269 - RNA, 20 nt, Pseudomonas aeruginosa PA01
ugcccuuggccagcgcggcg

SEQ ID NO: 3482270 - RNA, 11 nt, Pseudomonas aeruginosa PA01
ugcccuuggcu

SEQ ID NO: 3482271 - RNA, 21 nt, Pseudomonas aeruginosa PA01
ugcccuuguacagcuucaggc

SEQ ID NO: 3482272 - RNA, 21 nt, Pseudomonas aeruginosa PA01
ugcccuugucgcccuucuucc

SEQ ID NO: 3482273 - RNA, 23 nt, Pseudomonas aeruginosa PA01
ugccgaacaccugcaucaccagg

SEQ ID NO: 3482274 - RNA, 22 nt, Pseudomonas aeruginosa PA01
ugccgaacagcagggaggcgca

SEQ ID NO: 3482275 - RNA, 18 nt, Pseudomonas aeruginosa PA01
ugccgaacaggcguccca

SEQ ID NO: 3482276 - RNA, 15 nt, Pseudomonas aeruginosa PA01
ugccgaacugcaggg

SEQ ID NO: 3482277 - RNA, 22 nt, Pseudomonas aeruginosa PA01
ugccgaacugcagggcgucgcc

SEQ ID NO: 3482278 - RNA, 18 nt, Pseudomonas aeruginosa PA01
ugccgaacuucuccgcca

SEQ ID NO: 3482279 - RNA, 15 nt, Pseudomonas aeruginosa PA01
ugccgaagaccacca

SEQ ID NO: 3482280 - RNA, 23 nt, Pseudomonas aeruginosa PA01
ugccgaagaucgacaggccgccg

SEQ ID NO: 3482281 - RNA, 21 nt, Pseudomonas aeruginosa PA01
ugccgaagcccgauccguagg

SEQ ID NO: 3482282 - RNA, 19 nt, Pseudomonas aeruginosa PA01
ugccgaaggcgucauccgc

SEQ ID NO: 3482283 - RNA, 15 nt, Pseudomonas aeruginosa PA01
ugccgaaggcguggg

SEQ ID NO: 3482284 - RNA, 20 nt, Pseudomonas aeruginosa PA01
ugccgaaggcgugggcgccg

SEQ ID NO: 3482285 - RNA, 15 nt, Pseudomonas aeruginosa PA01
ugccgaagucuuuca

SEQ ID NO: 3482286 - RNA, 12 nt, Pseudomonas aeruginosa PA01
ugccgaauccgc

SEQ ID NO: 3482287 - RNA, 14 nt, Pseudomonas aeruginosa PA01
ugccgacaagccuc

SEQ ID NO: 3482288 - RNA, 19 nt, Pseudomonas aeruginosa PA01
ugccgacaagccuccagcg

SEQ ID NO: 3482289 - RNA, 19 nt, Pseudomonas aeruginosa PA01
ugccgaccacaugggcgac

SEQ ID NO: 3482290 - RNA, 19 nt, Pseudomonas aeruginosa PA01
ugccgaccgagcagcggac

SEQ ID NO: 3482291 - RNA, 18 nt, Pseudomonas aeruginosa PA01
ugccgaccuucaccacca

SEQ ID NO: 3482292 - RNA, 20 nt, Pseudomonas aeruginosa PA01
ugccgaccuucaccaccagc

SEQ ID NO: 3482293 - RNA, 20 nt, Pseudomonas aeruginosa PA01
ugccgaccuucaucaggcgg

SEQ ID NO: 3482294 - RNA, 22 nt, Pseudomonas aeruginosa PA01
ugccgacgagcagcucgccggc

SEQ ID NO: 3482295 - RNA, 17 nt, Pseudomonas aeruginosa PA01
ugccgacgccgcggccg

SEQ ID NO: 3482296 - RNA, 18 nt, Pseudomonas aeruginosa PA01
ugccgacgccgcggccgg

SEQ ID NO: 3482297 - RNA, 20 nt, Pseudomonas aeruginosa PA01
ugccgacgccgcggccggcg

SEQ ID NO: 3482298 - RNA, 24 nt, Pseudomonas aeruginosa PA01
ugccgacgccgcggccggcgaccu

SEQ ID NO: 3482299 - RNA, 20 nt, Pseudomonas aeruginosa PA01
ugccgacgcugaucaucgag

SEQ ID NO: 3482300 - RNA, 13 nt, Pseudomonas aeruginosa PA01
ugccgacggcggc

SEQ ID NO: 3482301 - RNA, 16 nt, Pseudomonas aeruginosa PA01
ugccgacggcggcggc

SEQ ID NO: 3482302 - RNA, 17 nt, Pseudomonas aeruginosa PA01
ugccgacgucgaugacg

SEQ ID NO: 3482303 - RNA, 20 nt, Pseudomonas aeruginosa PA01
ugccgacgucgaugacgaug

SEQ ID NO: 3482304 - RNA, 20 nt, Pseudomonas aeruginosa PA01
ugccgacuuccucgauggug

SEQ ID NO: 3482305 - RNA, 20 nt, Pseudomonas aeruginosa PA01
ugccgagaaucugcccggcc

SEQ ID NO: 3482306 - RNA, 18 nt, Pseudomonas aeruginosa PA01
ugccgagcagggucacgc

SEQ ID NO: 3482307 - RNA, 21 nt, Pseudomonas aeruginosa PA01
ugccgagcagggucacgccga

SEQ ID NO: 3482308 - RNA, 19 nt, Pseudomonas aeruginosa PA01
ugccgagcaucagcgacug

SEQ ID NO: 3482309 - RNA, 20 nt, Pseudomonas aeruginosa PA01
ugccgagcgcgaucagccgc

SEQ ID NO: 3482310 - RNA, 22 nt, Pseudomonas aeruginosa PA01
ugccgagcgcgaucagccgcuc

SEQ ID NO: 3482311 - RNA, 21 nt, Pseudomonas aeruginosa PA01
ugccgagcggaaaagcaggcc

SEQ ID NO: 3482312 - RNA, 19 nt, Pseudomonas aeruginosa PA01
ugccgaggaagucggcggc

SEQ ID NO: 3482313 - RNA, 16 nt, Pseudomonas aeruginosa PA01
ugccgaggccgccgcg

SEQ ID NO: 3482314 - RNA, 19 nt, Pseudomonas aeruginosa PA01
ugccgaggccgccgcgggc

SEQ ID NO: 3482315 - RNA, 17 nt, Pseudomonas aeruginosa PA01
ugccgaggcggccguag

SEQ ID NO: 3482316 - RNA, 23 nt, Pseudomonas aeruginosa PA01
ugccgaggcggccguagccgucg

SEQ ID NO: 3482317 - RNA, 18 nt, Pseudomonas aeruginosa PA01
ugccgaucaccgccacua

SEQ ID NO: 3482318 - RNA, 22 nt, Pseudomonas aeruginosa PA01
ugccgaucagccauuggccgac

SEQ ID NO: 3482319 - RNA, 15 nt, Pseudomonas aeruginosa PA01
ugccgaucagcccgu

SEQ ID NO: 3482320 - RNA, 17 nt, Pseudomonas aeruginosa PA01
ugccgaucagcccgucg

SEQ ID NO: 3482321 - RNA, 17 nt, Pseudomonas aeruginosa PA01
ugccgaucaggcugaag

SEQ ID NO: 3482322 - RNA, 23 nt, Pseudomonas aeruginosa PA01
ugccgaucaggcugaagcggccg

SEQ ID NO: 3482323 - RNA, 22 nt, Pseudomonas aeruginosa PA01
ugccgaucaguggucgcagcuc

SEQ ID NO: 3482324 - RNA, 20 nt, Pseudomonas aeruginosa PA01
ugccgaucaugcucggcggu

SEQ ID NO: 3482325 - RNA, 14 nt, Pseudomonas aeruginosa PA01
ugccgaucgccgcg

SEQ ID NO: 3482326 - RNA, 16 nt, Pseudomonas aeruginosa PA01
ugccgaucgccgcgcg

SEQ ID NO: 3482327 - RNA, 17 nt, Pseudomonas aeruginosa PA01
ugccgaucucgcccagu

SEQ ID NO: 3482328 - RNA, 20 nt, Pseudomonas aeruginosa PA01
ugccgaucucgcccaguacc

SEQ ID NO: 3482329 - RNA, 13 nt, Pseudomonas aeruginosa PA01
ugccgaugacaug

SEQ ID NO: 3482330 - RNA, 21 nt, Pseudomonas aeruginosa PA01
ugccgaugccgccgaccucgg

SEQ ID NO: 3482331 - RNA, 16 nt, Pseudomonas aeruginosa PA01
ugccgaugccggaaag

SEQ ID NO: 3482332 - RNA, 15 nt, Pseudomonas aeruginosa PA01
ugccgaugcugauca

SEQ ID NO: 3482333 - RNA, 16 nt, Pseudomonas aeruginosa PA01
ugccgaugcugaucac

SEQ ID NO: 3482334 - RNA, 14 nt, Pseudomonas aeruginosa PA01
ugccgauggacagg

SEQ ID NO: 3482335 - RNA, 16 nt, Pseudomonas aeruginosa PA01
ugccgauggcgccgcc

SEQ ID NO: 3482336 - RNA, 17 nt, Pseudomonas aeruginosa PA01
ugccgauggcgccgccg

SEQ ID NO: 3482337 - RNA, 21 nt, Pseudomonas aeruginosa PA01
ugccgauggcgccgccgaggu

SEQ ID NO: 3482338 - RNA, 11 nt, Pseudomonas aeruginosa PA01
ugccgaugucg

SEQ ID NO: 3482339 - RNA, 16 nt, Pseudomonas aeruginosa PA01
ugccgaugugcacgcu

SEQ ID NO: 3482340 - RNA, 15 nt, Pseudomonas aeruginosa PA01
ugccgcaaacccccu

SEQ ID NO: 3482341 - RNA, 19 nt, Pseudomonas aeruginosa PA01
ugccgcaaacccccugcgc

SEQ ID NO: 3482342 - RNA, 22 nt, Pseudomonas aeruginosa PA01
ugccgcaaacccccugcgcgga

SEQ ID NO: 3482343 - RNA, 19 nt, Pseudomonas aeruginosa PA01
ugccgcaagcuccccgccg

SEQ ID NO: 3482344 - RNA, 21 nt, Pseudomonas aeruginosa PA01
ugccgcacaguugcgcgccgg

SEQ ID NO: 3482345 - RNA, 17 nt, Pseudomonas aeruginosa PA01
ugccgcaccccauccuc

SEQ ID NO: 3482346 - RNA, 22 nt, Pseudomonas aeruginosa PA01
ugccgcaccccauccucgccgg

SEQ ID NO: 3482347 - RNA, 12 nt, Pseudomonas aeruginosa PA01
ugccgcaccgcc

SEQ ID NO: 3482348 - RNA, 20 nt, Pseudomonas aeruginosa PA01
ugccgcagacgcccugaggc

SEQ ID NO: 3482349 - RNA, 13 nt, Pseudomonas aeruginosa PA01
ugccgcagcgccu

SEQ ID NO: 3482350 - RNA, 19 nt, Pseudomonas aeruginosa PA01
ugccgcaggcaguggcgcc

SEQ ID NO: 3482351 - RNA, 23 nt, Pseudomonas aeruginosa PA01
ugccgcaggcaguggcgccagcc

SEQ ID NO: 3482352 - RNA, 18 nt, Pseudomonas aeruginosa PA01
ugccgcaggccgcggccg

SEQ ID NO: 3482353 - RNA, 20 nt, Pseudomonas aeruginosa PA01
ugccgcaggcgggcgccauc

SEQ ID NO: 3482354 - RNA, 17 nt, Pseudomonas aeruginosa PA01
ugccgcaggucuugucg

SEQ ID NO: 3482355 - RNA, 18 nt, Pseudomonas aeruginosa PA01
ugccgcaggucuugucgc

SEQ ID NO: 3482356 - RNA, 18 nt, Pseudomonas aeruginosa PA01
ugccgcaguagaugccgc

SEQ ID NO: 3482357 - RNA, 15 nt, Pseudomonas aeruginosa PA01
ugccgccagcgcggc

SEQ ID NO: 3482358 - RNA, 16 nt, Pseudomonas aeruginosa PA01
ugccgccagcgcggcg

SEQ ID NO: 3482359 - RNA, 18 nt, Pseudomonas aeruginosa PA01
ugccgccagcgcggcgcu

SEQ ID NO: 3482360 - RNA, 12 nt, Pseudomonas aeruginosa PA01
ugccgccaggcc

SEQ ID NO: 3482361 - RNA, 21 nt, Pseudomonas aeruginosa PA01
ugccgccaggccuuccagaac

SEQ ID NO: 3482362 - RNA, 23 nt, Pseudomonas aeruginosa PA01
ugccgccagguguacaucgggau

SEQ ID NO: 3482363 - RNA, 13 nt, Pseudomonas aeruginosa PA01
ugccgccagucgg

SEQ ID NO: 3482364 - RNA, 17 nt, Pseudomonas aeruginosa PA01
ugccgccagucggccug

SEQ ID NO: 3482365 - RNA, 21 nt, Pseudomonas aeruginosa PA01
ugccgccauagagugcccagg

SEQ ID NO: 3482366 - RNA, 22 nt, Pseudomonas aeruginosa PA01
ugccgccauagagugcccaggc

SEQ ID NO: 3482367 - RNA, 19 nt, Pseudomonas aeruginosa PA01
ugccgccaucgaccaggaa

SEQ ID NO: 3482368 - RNA, 18 nt, Pseudomonas aeruginosa PA01
ugccgccaucgccucgcc

SEQ ID NO: 3482369 - RNA, 19 nt, Pseudomonas aeruginosa PA01
ugccgccaucgccucgccg

SEQ ID NO: 3482370 - RNA, 20 nt, Pseudomonas aeruginosa PA01
ugccgccaucgccucgccgg

SEQ ID NO: 3482371 - RNA, 23 nt, Pseudomonas aeruginosa PA01
ugccgccaucgccucgccggcca

SEQ ID NO: 3482372 - RNA, 13 nt, Pseudomonas aeruginosa PA01
ugccgcccagcac

SEQ ID NO: 3482373 - RNA, 17 nt, Pseudomonas aeruginosa PA01
ugccgcccagcaccgag

SEQ ID NO: 3482374 - RNA, 14 nt, Pseudomonas aeruginosa PA01
ugccgcccgcucaa

SEQ ID NO: 3482375 - RNA, 18 nt, Pseudomonas aeruginosa PA01
ugccgcccgcucaagggc

SEQ ID NO: 3482376 - RNA, 14 nt, Pseudomonas aeruginosa PA01
ugccgcccggccag

SEQ ID NO: 3482377 - RNA, 15 nt, Pseudomonas aeruginosa PA01
ugccgcccggccagg

SEQ ID NO: 3482378 - RNA, 16 nt, Pseudomonas aeruginosa PA01
ugccgcccggccaggc

SEQ ID NO: 3482379 - RNA, 17 nt, Pseudomonas aeruginosa PA01
ugccgcccggccaggcc

SEQ ID NO: 3482380 - RNA, 13 nt, Pseudomonas aeruginosa PA01
ugccgcccggccg

SEQ ID NO: 3482381 - RNA, 15 nt, Pseudomonas aeruginosa PA01
ugccgcccggcgcca

SEQ ID NO: 3482382 - RNA, 16 nt, Pseudomonas aeruginosa PA01
ugccgcccggcgccac

SEQ ID NO: 3482383 - RNA, 22 nt, Pseudomonas aeruginosa PA01
ugccgcccggucuagcgccccg

SEQ ID NO: 3482384 - RNA, 15 nt, Pseudomonas aeruginosa PA01
ugccgcccuccauca

SEQ ID NO: 3482385 - RNA, 17 nt, Pseudomonas aeruginosa PA01
ugccgcccuccaucagc

SEQ ID NO: 3482386 - RNA, 16 nt, Pseudomonas aeruginosa PA01
ugccgcccucgggccg

SEQ ID NO: 3482387 - RNA, 19 nt, Pseudomonas aeruginosa PA01
ugccgcccugcggcaggcg

SEQ ID NO: 3482388 - RNA, 13 nt, Pseudomonas aeruginosa PA01
ugccgcccugggg

SEQ ID NO: 3482389 - RNA, 23 nt, Pseudomonas aeruginosa PA01
ugccgcccuucgaacccgcccuc

SEQ ID NO: 3482390 - RNA, 22 nt, Pseudomonas aeruginosa PA01
ugccgcccuugccauccuccag

SEQ ID NO: 3482391 - RNA, 19 nt, Pseudomonas aeruginosa PA01
ugccgccgcagagccagcc

SEQ ID NO: 3482392 - RNA, 22 nt, Pseudomonas aeruginosa PA01
ugccgccgcagagccagccgca

SEQ ID NO: 3482393 - RNA, 20 nt, Pseudomonas aeruginosa PA01
ugccgccgcgcccggcgcca

SEQ ID NO: 3482394 - RNA, 13 nt, Pseudomonas aeruginosa PA01
ugccgccgcgcug

SEQ ID NO: 3482395 - RNA, 14 nt, Pseudomonas aeruginosa PA01
ugccgccgcgcugc

SEQ ID NO: 3482396 - RNA, 15 nt, Pseudomonas aeruginosa PA01
ugccgccgcgcugca

SEQ ID NO: 3482397 - RNA, 17 nt, Pseudomonas aeruginosa PA01
ugccgccgcgcugcagg

SEQ ID NO: 3482398 - RNA, 16 nt, Pseudomonas aeruginosa PA01
ugccgccgcuggccug

SEQ ID NO: 3482399 - RNA, 22 nt, Pseudomonas aeruginosa PA01
ugccgccgcuggccuggccacc

SEQ ID NO: 3482400 - RNA, 13 nt, Pseudomonas aeruginosa PA01
ugccgccggcauc

SEQ ID NO: 3482401 - RNA, 14 nt, Pseudomonas aeruginosa PA01
ugccgccggcaucc

SEQ ID NO: 3482402 - RNA, 15 nt, Pseudomonas aeruginosa PA01
ugccgccggccacca

SEQ ID NO: 3482403 - RNA, 20 nt, Pseudomonas aeruginosa PA01
ugccgccggccaccagcagc

SEQ ID NO: 3482404 - RNA, 15 nt, Pseudomonas aeruginosa PA01
ugccgccggcgccgc

SEQ ID NO: 3482405 - RNA, 22 nt, Pseudomonas aeruginosa PA01
ugccgccgggcaucaugccgag

SEQ ID NO: 3482406 - RNA, 18 nt, Pseudomonas aeruginosa PA01
ugccgccgggggucucgu

SEQ ID NO: 3482407 - RNA, 22 nt, Pseudomonas aeruginosa PA01
ugccgccgguucgcaggccagg

SEQ ID NO: 3482408 - RNA, 12 nt, Pseudomonas aeruginosa PA01
ugccgccguaga

SEQ ID NO: 3482409 - RNA, 19 nt, Pseudomonas aeruginosa PA01
ugccgccgucgcggccauc

SEQ ID NO: 3482410 - RNA, 17 nt, Pseudomonas aeruginosa PA01
ugccgccuucgcgggcc

SEQ ID NO: 3482411 - RNA, 22 nt, Pseudomonas aeruginosa PA01
ugccgccuucgcgggccaggcc

SEQ ID NO: 3482412 - RNA, 15 nt, Pseudomonas aeruginosa PA01
ugccgcgagccagcc

SEQ ID NO: 3482413 - RNA, 17 nt, Pseudomonas aeruginosa PA01
ugccgcgagccagccgu

SEQ ID NO: 3482414 - RNA, 20 nt, Pseudomonas aeruginosa PA01
ugccgcgagccagccguggc

SEQ ID NO: 3482415 - RNA, 14 nt, Pseudomonas aeruginosa PA01
ugccgcgcaccacc

SEQ ID NO: 3482416 - RNA, 14 nt, Pseudomonas aeruginosa PA01
ugccgcgcagcuug

SEQ ID NO: 3482417 - RNA, 15 nt, Pseudomonas aeruginosa PA01
ugccgcgcccggcca

SEQ ID NO: 3482418 - RNA, 18 nt, Pseudomonas aeruginosa PA01
ugccgcgcccggccaggc

SEQ ID NO: 3482419 - RNA, 12 nt, Pseudomonas aeruginosa PA01
ugccgcgccgga

SEQ ID NO: 3482420 - RNA, 15 nt, Pseudomonas aeruginosa PA01
ugccgcgcgccuggc

SEQ ID NO: 3482421 - RNA, 22 nt, Pseudomonas aeruginosa PA01
ugccgcgcgccuggcuggccag

SEQ ID NO: 3482422 - RNA, 13 nt, Pseudomonas aeruginosa PA01
ugccgcgcucgga

SEQ ID NO: 3482423 - RNA, 19 nt, Pseudomonas aeruginosa PA01
ugccgcgcucggaucaggc

SEQ ID NO: 3482424 - RNA, 19 nt, Pseudomonas aeruginosa PA01
ugccgcggaagugcgccgg

SEQ ID NO: 3482425 - RNA, 18 nt, Pseudomonas aeruginosa PA01
ugccgcggaauggcgcgc

SEQ ID NO: 3482426 - RNA, 20 nt, Pseudomonas aeruginosa PA01
ugccgcggaauggcgcgcaa

SEQ ID NO: 3482427 - RNA, 15 nt, Pseudomonas aeruginosa PA01
ugccgcggaugacgg

SEQ ID NO: 3482428 - RNA, 20 nt, Pseudomonas aeruginosa PA01
ugccgcgggcuauucccgcc

SEQ ID NO: 3482429 - RNA, 15 nt, Pseudomonas aeruginosa PA01
ugccgcggguagcgu

SEQ ID NO: 3482430 - RNA, 17 nt, Pseudomonas aeruginosa PA01
ugccgcuagcccugcug

SEQ ID NO: 3482431 - RNA, 18 nt, Pseudomonas aeruginosa PA01
ugccgcuagcccugcugc

SEQ ID NO: 3482432 - RNA, 14 nt, Pseudomonas aeruginosa PA01
ugccgcuaucgcug

SEQ ID NO: 3482433 - RNA, 17 nt, Pseudomonas aeruginosa PA01
ugccgcuaucgcuggcg

SEQ ID NO: 3482434 - RNA, 21 nt, Pseudomonas aeruginosa PA01
ugccgcuaucgcuggcgcagc

SEQ ID NO: 3482435 - RNA, 23 nt, Pseudomonas aeruginosa PA01
ugccgcuaucgcuggcgcagccg

SEQ ID NO: 3482436 - RNA, 16 nt, Pseudomonas aeruginosa PA01
ugccgcucguggaaaa

SEQ ID NO: 3482437 - RNA, 15 nt, Pseudomonas aeruginosa PA01
ugccgcucguuggcg

SEQ ID NO: 3482438 - RNA, 21 nt, Pseudomonas aeruginosa PA01
ugccgcucguuggcggccagc

SEQ ID NO: 3482439 - RNA, 17 nt, Pseudomonas aeruginosa PA01
ugccgcugcacgccuuc

SEQ ID NO: 3482440 - RNA, 15 nt, Pseudomonas aeruginosa PA01
ugccgcuggccgacc

SEQ ID NO: 3482441 - RNA, 15 nt, Pseudomonas aeruginosa PA01
ugccgcuggcggccu

SEQ ID NO: 3482442 - RNA, 16 nt, Pseudomonas aeruginosa PA01
ugccgcuggcggccuu

SEQ ID NO: 3482443 - RNA, 18 nt, Pseudomonas aeruginosa PA01
ugccgcuggugaucgacc

SEQ ID NO: 3482444 - RNA, 21 nt, Pseudomonas aeruginosa PA01
ugccgcuggugaucgaccaca

SEQ ID NO: 3482445 - RNA, 22 nt, Pseudomonas aeruginosa PA01
ugccggaaagcaguucgcccgg

SEQ ID NO: 3482446 - RNA, 16 nt, Pseudomonas aeruginosa PA01
ugccggaaagccuggc

SEQ ID NO: 3482447 - RNA, 22 nt, Pseudomonas aeruginosa PA01
ugccggaaagccuggccggcga

SEQ ID NO: 3482448 - RNA, 16 nt, Pseudomonas aeruginosa PA01
ugccggacaacaggcc

SEQ ID NO: 3482449 - RNA, 18 nt, Pseudomonas aeruginosa PA01
ugccggacaacaggccgg

SEQ ID NO: 3482450 - RNA, 19 nt, Pseudomonas aeruginosa PA01
ugccggacaacaggccggg

SEQ ID NO: 3482451 - RNA, 20 nt, Pseudomonas aeruginosa PA01
ugccggacaacaggccgggc

SEQ ID NO: 3482452 - RNA, 21 nt, Pseudomonas aeruginosa PA01
ugccggacaacaggccgggcg

SEQ ID NO: 3482453 - RNA, 16 nt, Pseudomonas aeruginosa PA01
ugccggagaacgccgc

SEQ ID NO: 3482454 - RNA, 17 nt, Pseudomonas aeruginosa PA01
ugccggagaacgccgcc

SEQ ID NO: 3482455 - RNA, 18 nt, Pseudomonas aeruginosa PA01
ugccggagacgauggcga

SEQ ID NO: 3482456 - RNA, 16 nt, Pseudomonas aeruginosa PA01
ugccggauagaggaau

SEQ ID NO: 3482457 - RNA, 12 nt, Pseudomonas aeruginosa PA01
ugccggcacgcu

SEQ ID NO: 3482458 - RNA, 14 nt, Pseudomonas aeruginosa PA01
ugccggcacgcuca

SEQ ID NO: 3482459 - RNA, 17 nt, Pseudomonas aeruginosa PA01
ugccggcacgcucaggc

SEQ ID NO: 3482460 - RNA, 18 nt, Pseudomonas aeruginosa PA01
ugccggcagcgaccacca

SEQ ID NO: 3482461 - RNA, 23 nt, Pseudomonas aeruginosa PA01
ugccggcagcgaccaccaccagg

SEQ ID NO: 3482462 - RNA, 16 nt, Pseudomonas aeruginosa PA01
ugccggcauagccgaa

SEQ ID NO: 3482463 - RNA, 15 nt, Pseudomonas aeruginosa PA01
ugccggcaucgguau

SEQ ID NO: 3482464 - RNA, 21 nt, Pseudomonas aeruginosa PA01
ugccggccaggaaggccgcuu

SEQ ID NO: 3482465 - RNA, 19 nt, Pseudomonas aeruginosa PA01
ugccggccagggucgccag

SEQ ID NO: 3482466 - RNA, 23 nt, Pseudomonas aeruginosa PA01
ugccggccagggucgccagcagg

SEQ ID NO: 3482467 - RNA, 12 nt, Pseudomonas aeruginosa PA01
ugccggccaggu

SEQ ID NO: 3482468 - RNA, 17 nt, Pseudomonas aeruginosa PA01
ugccggccagguagcgg

SEQ ID NO: 3482469 - RNA, 17 nt, Pseudomonas aeruginosa PA01
ugccggccaugcaggcc

SEQ ID NO: 3482470 - RNA, 21 nt, Pseudomonas aeruginosa PA01
ugccggccaugcaggccaggg

SEQ ID NO: 3482471 - RNA, 14 nt, Pseudomonas aeruginosa PA01
ugccggccgccagc

SEQ ID NO: 3482472 - RNA, 12 nt, Pseudomonas aeruginosa PA01
ugccggccggca

SEQ ID NO: 3482473 - RNA, 15 nt, Pseudomonas aeruginosa PA01
ugccggccggcagcg

SEQ ID NO: 3482474 - RNA, 17 nt, Pseudomonas aeruginosa PA01
ugccggccggcagcgag

SEQ ID NO: 3482475 - RNA, 13 nt, Pseudomonas aeruginosa PA01
ugccggccggggc

SEQ ID NO: 3482476 - RNA, 15 nt, Pseudomonas aeruginosa PA01
ugccggccggggccg

SEQ ID NO: 3482477 - RNA, 17 nt, Pseudomonas aeruginosa PA01
ugccggccggggccggc

SEQ ID NO: 3482478 - RNA, 22 nt, Pseudomonas aeruginosa PA01
ugccggccggggccggcacccg

SEQ ID NO: 3482479 - RNA, 20 nt, Pseudomonas aeruginosa PA01
ugccggccgucgcgcaccac

SEQ ID NO: 3482480 - RNA, 21 nt, Pseudomonas aeruginosa PA01
ugccggccgucgcgcaccacc

SEQ ID NO: 3482481 - RNA, 12 nt, Pseudomonas aeruginosa PA01
ugccggcgcaga

SEQ ID NO: 3482482 - RNA, 21 nt, Pseudomonas aeruginosa PA01
ugccggcgcagaucgcggcgc

SEQ ID NO: 3482483 - RNA, 22 nt, Pseudomonas aeruginosa PA01
ugccggcgccaucgaucagcag

SEQ ID NO: 3482484 - RNA, 22 nt, Pseudomonas aeruginosa PA01
ugccggcgccuucaucgccacc

SEQ ID NO: 3482485 - RNA, 22 nt, Pseudomonas aeruginosa PA01
ugccggcgcgcacggaggcgcu

SEQ ID NO: 3482486 - RNA, 23 nt, Pseudomonas aeruginosa PA01
ugccggcgcgcacggaggcgcuc

SEQ ID NO: 3482487 - RNA, 13 nt, Pseudomonas aeruginosa PA01
ugccggcgcgcgg

SEQ ID NO: 3482488 - RNA, 20 nt, Pseudomonas aeruginosa PA01
ugccggcgcgucgcugcgca

SEQ ID NO: 3482489 - RNA, 12 nt, Pseudomonas aeruginosa PA01
ugccggcggcgc

SEQ ID NO: 3482490 - RNA, 17 nt, Pseudomonas aeruginosa PA01
ugccggcggcgcugagg

SEQ ID NO: 3482491 - RNA, 20 nt, Pseudomonas aeruginosa PA01
ugccggcggcggacgcaggc

SEQ ID NO: 3482492 - RNA, 23 nt, Pseudomonas aeruginosa PA01
ugccggcgggacgcgcaugcagg

SEQ ID NO: 3482493 - RNA, 16 nt, Pseudomonas aeruginosa PA01
ugccggcguccuugcc

SEQ ID NO: 3482494 - RNA, 20 nt, Pseudomonas aeruginosa PA01
ugccggcgucggcgagcagg

SEQ ID NO: 3482495 - RNA, 18 nt, Pseudomonas aeruginosa PA01
ugccggcgucguccugcg

SEQ ID NO: 3482496 - RNA, 19 nt, Pseudomonas aeruginosa PA01
ugccggcgugaacgcggcg

SEQ ID NO: 3482497 - RNA, 20 nt, Pseudomonas aeruginosa PA01
ugccgggaagcgcaggccgc

SEQ ID NO: 3482498 - RNA, 22 nt, Pseudomonas aeruginosa PA01
ugccgggaagcgcaggccgccg

SEQ ID NO: 3482499 - RNA, 13 nt, Pseudomonas aeruginosa PA01
ugccgggcaacgc

SEQ ID NO: 3482500 - RNA, 19 nt, Pseudomonas aeruginosa PA01
ugccgggcaagcucgacga

SEQ ID NO: 3482501 - RNA, 13 nt, Pseudomonas aeruginosa PA01
ugccgggccgagg

SEQ ID NO: 3482502 - RNA, 12 nt, Pseudomonas aeruginosa PA01
ugccgggccggc

SEQ ID NO: 3482503 - RNA, 14 nt, Pseudomonas aeruginosa PA01
ugccgggccggcca

SEQ ID NO: 3482504 - RNA, 17 nt, Pseudomonas aeruginosa PA01
ugccgggccggccaggg

SEQ ID NO: 3482505 - RNA, 14 nt, Pseudomonas aeruginosa PA01
ugccgggcgucugc

SEQ ID NO: 3482506 - RNA, 22 nt, Pseudomonas aeruginosa PA01
ugccgggcucugguagccgcag

SEQ ID NO: 3482507 - RNA, 20 nt, Pseudomonas aeruginosa PA01
ugccgggcuuuuucucgucg

SEQ ID NO: 3482508 - RNA, 22 nt, Pseudomonas aeruginosa PA01
ugccgggcuuuuucucgucgcg

SEQ ID NO: 3482509 - RNA, 15 nt, Pseudomonas aeruginosa PA01
ugccgggggcggcga

SEQ ID NO: 3482510 - RNA, 16 nt, Pseudomonas aeruginosa PA01
ugccgggggcggcgaa

SEQ ID NO: 3482511 - RNA, 15 nt, Pseudomonas aeruginosa PA01
ugccgggguccgccg

SEQ ID NO: 3482512 - RNA, 17 nt, Pseudomonas aeruginosa PA01
ugccgggguccgccggu

SEQ ID NO: 3482513 - RNA, 22 nt, Pseudomonas aeruginosa PA01
ugccgggguccgccggucacca

SEQ ID NO: 3482514 - RNA, 21 nt, Pseudomonas aeruginosa PA01
ugccgggguggaguaccaggc

SEQ ID NO: 3482515 - RNA, 21 nt, Pseudomonas aeruginosa PA01
ugccgggugcuaugcgccggg

SEQ ID NO: 3482516 - RNA, 17 nt, Pseudomonas aeruginosa PA01
ugccgguaauuggccag

SEQ ID NO: 3482517 - RNA, 13 nt, Pseudomonas aeruginosa PA01
ugccgguagggcg

SEQ ID NO: 3482518 - RNA, 18 nt, Pseudomonas aeruginosa PA01
ugccgguaggucaccagg

SEQ ID NO: 3482519 - RNA, 23 nt, Pseudomonas aeruginosa PA01
ugccgguaucgcgcuuggacagc

SEQ ID NO: 3482520 - RNA, 18 nt, Pseudomonas aeruginosa PA01
ugccggucaggcuggugc

SEQ ID NO: 3482521 - RNA, 21 nt, Pseudomonas aeruginosa PA01
ugccggucaggcuggugccgc

SEQ ID NO: 3482522 - RNA, 17 nt, Pseudomonas aeruginosa PA01
ugccggucggaacgacc

SEQ ID NO: 3482523 - RNA, 22 nt, Pseudomonas aeruginosa PA01
ugccggucugcugcgcgcacca

SEQ ID NO: 3482524 - RNA, 12 nt, Pseudomonas aeruginosa PA01
ugccggucuugc

SEQ ID NO: 3482525 - RNA, 22 nt, Pseudomonas aeruginosa PA01
ugccggugccauacucggacgg

SEQ ID NO: 3482526 - RNA, 22 nt, Pseudomonas aeruginosa PA01
ugccggugcggucguugaucac

SEQ ID NO: 3482527 - RNA, 17 nt, Pseudomonas aeruginosa PA01
ugccggugcucggccug

SEQ ID NO: 3482528 - RNA, 23 nt, Pseudomonas aeruginosa PA01
ugccggugcucggccugaucauc

SEQ ID NO: 3482529 - RNA, 19 nt, Pseudomonas aeruginosa PA01
ugccggugcuggugcggcc

SEQ ID NO: 3482530 - RNA, 20 nt, Pseudomonas aeruginosa PA01
ugccggugcuggugcggccg

SEQ ID NO: 3482531 - RNA, 15 nt, Pseudomonas aeruginosa PA01
ugccgguggcgccca

SEQ ID NO: 3482532 - RNA, 18 nt, Pseudomonas aeruginosa PA01
ugccgguggcgcccagcc

SEQ ID NO: 3482533 - RNA, 21 nt, Pseudomonas aeruginosa PA01
ugccgguggcgcccagccaga

SEQ ID NO: 3482534 - RNA, 13 nt, Pseudomonas aeruginosa PA01
ugccggugugccg

SEQ ID NO: 3482535 - RNA, 15 nt, Pseudomonas aeruginosa PA01
ugccggugugccguc

SEQ ID NO: 3482536 - RNA, 20 nt, Pseudomonas aeruginosa PA01
ugccgguuuguugcaggcug

SEQ ID NO: 3482537 - RNA, 21 nt, Pseudomonas aeruginosa PA01
ugccgguuuguugcaggcugg

SEQ ID NO: 3482538 - RNA, 16 nt, Pseudomonas aeruginosa PA01
ugccguacagcccccg

SEQ ID NO: 3482539 - RNA, 22 nt, Pseudomonas aeruginosa PA01
ugccguacagcccccgccggcc

SEQ ID NO: 3482540 - RNA, 23 nt, Pseudomonas aeruginosa PA01
ugccguacaggucggcgccggug

SEQ ID NO: 3482541 - RNA, 18 nt, Pseudomonas aeruginosa PA01
ugccguacucauggccgc

SEQ ID NO: 3482542 - RNA, 19 nt, Pseudomonas aeruginosa PA01
ugccguacucauggccgca

SEQ ID NO: 3482543 - RNA, 21 nt, Pseudomonas aeruginosa PA01
ugccguacucauggccgcagc

SEQ ID NO: 3482544 - RNA, 24 nt, Pseudomonas aeruginosa PA01
ugccguacucauggccgcagcggc

SEQ ID NO: 3482545 - RNA, 17 nt, Pseudomonas aeruginosa PA01
ugccguacuucagggug

SEQ ID NO: 3482546 - RNA, 20 nt, Pseudomonas aeruginosa PA01
ugccguacuucagggugacg

SEQ ID NO: 3482547 - RNA, 22 nt, Pseudomonas aeruginosa PA01
ugccguacuugaaggugcccag

SEQ ID NO: 3482548 - RNA, 15 nt, Pseudomonas aeruginosa PA01
ugccguagcgaugcg

SEQ ID NO: 3482549 - RNA, 15 nt, Pseudomonas aeruginosa PA01
ugccguaguggcguu

SEQ ID NO: 3482550 - RNA, 16 nt, Pseudomonas aeruginosa PA01
ugccguauccgcggca

SEQ ID NO: 3482551 - RNA, 21 nt, Pseudomonas aeruginosa PA01
ugccguauccgcggcaggggc

SEQ ID NO: 3482552 - RNA, 19 nt, Pseudomonas aeruginosa PA01
ugccgucacuugaaguccc

SEQ ID NO: 3482553 - RNA, 13 nt, Pseudomonas aeruginosa PA01
ugccguccagccg

SEQ ID NO: 3482554 - RNA, 16 nt, Pseudomonas aeruginosa PA01
ugccguccagccggcg

SEQ ID NO: 3482555 - RNA, 17 nt, Pseudomonas aeruginosa PA01
ugccguccagccggcgc

SEQ ID NO: 3482556 - RNA, 18 nt, Pseudomonas aeruginosa PA01
ugccguccagccggcgcu

SEQ ID NO: 3482557 - RNA, 15 nt, Pseudomonas aeruginosa PA01
ugccguccaggcgcg

SEQ ID NO: 3482558 - RNA, 16 nt, Pseudomonas aeruginosa PA01
ugccguccaggcgcga

SEQ ID NO: 3482559 - RNA, 16 nt, Pseudomonas aeruginosa PA01
ugccgucccggaguuc

SEQ ID NO: 3482560 - RNA, 18 nt, Pseudomonas aeruginosa PA01
ugccgucccggaguucca

SEQ ID NO: 3482561 - RNA, 21 nt, Pseudomonas aeruginosa PA01
ugccgucccggaguuccagcg

SEQ ID NO: 3482562 - RNA, 14 nt, Pseudomonas aeruginosa PA01
ugccgucgagcacc

SEQ ID NO: 3482563 - RNA, 16 nt, Pseudomonas aeruginosa PA01
ugccgucgagcaccag

SEQ ID NO: 3482564 - RNA, 17 nt, Pseudomonas aeruginosa PA01
ugccgucgagcaccagc

SEQ ID NO: 3482565 - RNA, 18 nt, Pseudomonas aeruginosa PA01
ugccgucgagcaccagca

SEQ ID NO: 3482566 - RNA, 18 nt, Pseudomonas aeruginosa PA01
ugccgucggcgcccuucg

SEQ ID NO: 3482567 - RNA, 15 nt, Pseudomonas aeruginosa PA01
ugccgucggcgcggg

SEQ ID NO: 3482568 - RNA, 14 nt, Pseudomonas aeruginosa PA01
ugccgugcagcuug

SEQ ID NO: 3482569 - RNA, 13 nt, Pseudomonas aeruginosa PA01
ugccgugccgugg

SEQ ID NO: 3482570 - RNA, 15 nt, Pseudomonas aeruginosa PA01
ugccguggaccaaca

SEQ ID NO: 3482571 - RNA, 16 nt, Pseudomonas aeruginosa PA01
ugccguggcggcgcgc

SEQ ID NO: 3482572 - RNA, 17 nt, Pseudomonas aeruginosa PA01
ugccguggcggcgcgcg

SEQ ID NO: 3482573 - RNA, 19 nt, Pseudomonas aeruginosa PA01
ugccguggcucggcggcag

SEQ ID NO: 3482574 - RNA, 17 nt, Pseudomonas aeruginosa PA01
ugccgugggcgccgccg

SEQ ID NO: 3482575 - RNA, 20 nt, Pseudomonas aeruginosa PA01
ugccguuaccuuggccacga

SEQ ID NO: 3482576 - RNA, 15 nt, Pseudomonas aeruginosa PA01
ugccguucaggccgg

SEQ ID NO: 3482577 - RNA, 16 nt, Pseudomonas aeruginosa PA01
ugccguucaggccggc

SEQ ID NO: 3482578 - RNA, 17 nt, Pseudomonas aeruginosa PA01
ugccguucaggccggcg

SEQ ID NO: 3482579 - RNA, 20 nt, Pseudomonas aeruginosa PA01
ugccguucaggccggcgccg

SEQ ID NO: 3482580 - RNA, 21 nt, Pseudomonas aeruginosa PA01
ugccguucaggccggcgccgc

SEQ ID NO: 3482581 - RNA, 23 nt, Pseudomonas aeruginosa PA01
ugccguucaggccggcgccgccg

SEQ ID NO: 3482582 - RNA, 16 nt, Pseudomonas aeruginosa PA01
ugccguuccagcggca

SEQ ID NO: 3482583 - RNA, 16 nt, Pseudomonas aeruginosa PA01
ugccguucgcccgcgg

SEQ ID NO: 3482584 - RNA, 17 nt, Pseudomonas aeruginosa PA01
ugccguucgcccgcggc

SEQ ID NO: 3482585 - RNA, 18 nt, Pseudomonas aeruginosa PA01
ugccguucgcccgcggcg

SEQ ID NO: 3482586 - RNA, 23 nt, Pseudomonas aeruginosa PA01
ugccguucgcccgcggcggcgac

SEQ ID NO: 3482587 - RNA, 17 nt, Pseudomonas aeruginosa PA01
ugccguucgucaccggc

SEQ ID NO: 3482588 - RNA, 13 nt, Pseudomonas aeruginosa PA01
ugccguucucccg

SEQ ID NO: 3482589 - RNA, 17 nt, Pseudomonas aeruginosa PA01
ugccguucugugcggcg

SEQ ID NO: 3482590 - RNA, 20 nt, Pseudomonas aeruginosa PA01
ugccguucugugcggcgaug

SEQ ID NO: 3482591 - RNA, 23 nt, Pseudomonas aeruginosa PA01
ugccguucugugcggcgaugucg

SEQ ID NO: 3482592 - RNA, 13 nt, Pseudomonas aeruginosa PA01
ugccguugcacga

SEQ ID NO: 3482593 - RNA, 23 nt, Pseudomonas aeruginosa PA01
ugccguugcacgaaaacgaggua

SEQ ID NO: 3482594 - RNA, 18 nt, Pseudomonas aeruginosa PA01
ugccguugcccucgcgcu

SEQ ID NO: 3482595 - RNA, 13 nt, Pseudomonas aeruginosa PA01
ugccguugcuacc

SEQ ID NO: 3482596 - RNA, 15 nt, Pseudomonas aeruginosa PA01
ugccguuggccgagc

SEQ ID NO: 3482597 - RNA, 21 nt, Pseudomonas aeruginosa PA01
ugccguuggccgagcgcgagu

SEQ ID NO: 3482598 - RNA, 16 nt, Pseudomonas aeruginosa PA01
ugccguugggccaggg

SEQ ID NO: 3482599 - RNA, 20 nt, Pseudomonas aeruginosa PA01
ugccguuguggcaggcgcug

SEQ ID NO: 3482600 - RNA, 17 nt, Pseudomonas aeruginosa PA01
ugccuagcacccgggua

SEQ ID NO: 3482601 - RNA, 19 nt, Pseudomonas aeruginosa PA01
ugccucagagucgcaccgg

SEQ ID NO: 3482602 - RNA, 16 nt, Pseudomonas aeruginosa PA01
ugccuccgcucugcug

SEQ ID NO: 3482603 - RNA, 13 nt, Pseudomonas aeruginosa PA01
ugccucgccgagg

SEQ ID NO: 3482604 - RNA, 13 nt, Pseudomonas aeruginosa PA01
ugccugagcuggc

SEQ ID NO: 3482605 - RNA, 18 nt, Pseudomonas aeruginosa PA01
ugccugcagguagcgcug

SEQ ID NO: 3482606 - RNA, 14 nt, Pseudomonas aeruginosa PA01
ugccugcgcagggc

SEQ ID NO: 3482607 - RNA, 13 nt, Pseudomonas aeruginosa PA01
ugccugcgcccuc

SEQ ID NO: 3482608 - RNA, 16 nt, Pseudomonas aeruginosa PA01
ugccugcguuucgccg

SEQ ID NO: 3482609 - RNA, 15 nt, Pseudomonas aeruginosa PA01
ugccugcuucagguc

SEQ ID NO: 3482610 - RNA, 12 nt, Pseudomonas aeruginosa PA01
ugccuggaaaaa

SEQ ID NO: 3482611 - RNA, 13 nt, Pseudomonas aeruginosa PA01
ugccuggaaaaag

SEQ ID NO: 3482612 - RNA, 21 nt, Pseudomonas aeruginosa PA01
ugccuggaaguauucggcggg

SEQ ID NO: 3482613 - RNA, 23 nt, Pseudomonas aeruginosa PA01
ugccuggaaguauucggcgggaa

SEQ ID NO: 3482614 - RNA, 12 nt, Pseudomonas aeruginosa PA01
ugccuggaauuc

SEQ ID NO: 3482615 - RNA, 20 nt, Pseudomonas aeruginosa PA01
ugccuggaauucaggcuucc

SEQ ID NO: 3482616 - RNA, 15 nt, Pseudomonas aeruginosa PA01
ugccuucaccggcgg

SEQ ID NO: 3482617 - RNA, 16 nt, Pseudomonas aeruginosa PA01
ugccuuccaccggcgu

SEQ ID NO: 3482618 - RNA, 18 nt, Pseudomonas aeruginosa PA01
ugccuuccagcaggucga

SEQ ID NO: 3482619 - RNA, 14 nt, Pseudomonas aeruginosa PA01
ugccuuccaggcug

SEQ ID NO: 3482620 - RNA, 17 nt, Pseudomonas aeruginosa PA01
ugccuuccaggcuguag

SEQ ID NO: 3482621 - RNA, 18 nt, Pseudomonas aeruginosa PA01
ugccuuccgcgcccaggc

SEQ ID NO: 3482622 - RNA, 20 nt, Pseudomonas aeruginosa PA01
ugccuuccgcgcccaggcug

SEQ ID NO: 3482623 - RNA, 22 nt, Pseudomonas aeruginosa PA01
ugccuuccgcgcccaggcugcc

SEQ ID NO: 3482624 - RNA, 23 nt, Pseudomonas aeruginosa PA01
ugccuuccugggcgugcuuggcg

SEQ ID NO: 3482625 - RNA, 12 nt, Pseudomonas aeruginosa PA01
ugccuuccuuuu

SEQ ID NO: 3482626 - RNA, 12 nt, Pseudomonas aeruginosa PA01
ugccuucgaagc

SEQ ID NO: 3482627 - RNA, 21 nt, Pseudomonas aeruginosa PA01
ugccuucgggagagcccgggc

SEQ ID NO: 3482628 - RNA, 23 nt, Pseudomonas aeruginosa PA01
ugccuucguaggugaagcccagg

SEQ ID NO: 3482629 - RNA, 24 nt, Pseudomonas aeruginosa PA01
ugccuucguaggugaagcccaggc

SEQ ID NO: 3482630 - RNA, 22 nt, Pseudomonas aeruginosa PA01
ugccuucgucgcuggggugcag

SEQ ID NO: 3482631 - RNA, 20 nt, Pseudomonas aeruginosa PA01
ugccuugaggccuuucuucu

SEQ ID NO: 3482632 - RNA, 13 nt, Pseudomonas aeruginosa PA01
ugccuugcagcgc

SEQ ID NO: 3482633 - RNA, 21 nt, Pseudomonas aeruginosa PA01
ugccuugccaagguguggccg

SEQ ID NO: 3482634 - RNA, 13 nt, Pseudomonas aeruginosa PA01
ugcgaaaagcccg

SEQ ID NO: 3482635 - RNA, 22 nt, Pseudomonas aeruginosa PA01
ugcgaacacaccgaccgcgagu

SEQ ID NO: 3482636 - RNA, 20 nt, Pseudomonas aeruginosa PA01
ugcgaaccgagacccuggcg

SEQ ID NO: 3482637 - RNA, 15 nt, Pseudomonas aeruginosa PA01
ugcgaauguccggcg

SEQ ID NO: 3482638 - RNA, 18 nt, Pseudomonas aeruginosa PA01
ugcgaauugcgcuggaag

SEQ ID NO: 3482639 - RNA, 14 nt, Pseudomonas aeruginosa PA01
ugcgacaucuccag

SEQ ID NO: 3482640 - RNA, 17 nt, Pseudomonas aeruginosa PA01
ugcgacaucuccaggcc

SEQ ID NO: 3482641 - RNA, 11 nt, Pseudomonas aeruginosa PA01
ugcgaccuggc

SEQ ID NO: 3482642 - RNA, 16 nt, Pseudomonas aeruginosa PA01
ugcgaccuggcgccga

SEQ ID NO: 3482643 - RNA, 18 nt, Pseudomonas aeruginosa PA01
ugcgacgcacaccgucga

SEQ ID NO: 3482644 - RNA, 17 nt, Pseudomonas aeruginosa PA01
ugcgacuggaugcagcc

SEQ ID NO: 3482645 - RNA, 18 nt, Pseudomonas aeruginosa PA01
ugcgacuggaugcagccg

SEQ ID NO: 3482646 - RNA, 21 nt, Pseudomonas aeruginosa PA01
ugcgacuggaugcagccgaug

SEQ ID NO: 3482647 - RNA, 24 nt, Pseudomonas aeruginosa PA01
ugcgacuggaugcagccgauggcg

SEQ ID NO: 3482648 - RNA, 18 nt, Pseudomonas aeruginosa PA01
ugcgagacgggcgacgcc

SEQ ID NO: 3482649 - RNA, 18 nt, Pseudomonas aeruginosa PA01
ugcgagcaccaugccgau

SEQ ID NO: 3482650 - RNA, 20 nt, Pseudomonas aeruginosa PA01
ugcgagcgcacaacgccuuc

SEQ ID NO: 3482651 - RNA, 22 nt, Pseudomonas aeruginosa PA01
ugcgagcgcuucauccugcgcg

SEQ ID NO: 3482652 - RNA, 19 nt, Pseudomonas aeruginosa PA01
ugcgaggcccguauggcgg

SEQ ID NO: 3482653 - RNA, 16 nt, Pseudomonas aeruginosa PA01
ugcgaggcggugcagc

SEQ ID NO: 3482654 - RNA, 19 nt, Pseudomonas aeruginosa PA01
ugcgaggcggugcagcgga

SEQ ID NO: 3482655 - RNA, 15 nt, Pseudomonas aeruginosa PA01
ugcgaggcgucgauc

SEQ ID NO: 3482656 - RNA, 23 nt, Pseudomonas aeruginosa PA01
ugcgagggauguuccaggcccgc

SEQ ID NO: 3482657 - RNA, 18 nt, Pseudomonas aeruginosa PA01
ugcgagggcucgggcgcg

SEQ ID NO: 3482658 - RNA, 20 nt, Pseudomonas aeruginosa PA01
ugcgagggcucgggcgcgga

SEQ ID NO: 3482659 - RNA, 23 nt, Pseudomonas aeruginosa PA01
ugcgaguaguagcguuccuggcg

SEQ ID NO: 3482660 - RNA, 20 nt, Pseudomonas aeruginosa PA01
ugcgagucaccccgaccagc

SEQ ID NO: 3482661 - RNA, 21 nt, Pseudomonas aeruginosa PA01
ugcgagucaccccgaccagcg

SEQ ID NO: 3482662 - RNA, 20 nt, Pseudomonas aeruginosa PA01
ugcgagucggcgacgaugcc

SEQ ID NO: 3482663 - RNA, 20 nt, Pseudomonas aeruginosa PA01
ugcgauagaccaggaaggcc

SEQ ID NO: 3482664 - RNA, 17 nt, Pseudomonas aeruginosa PA01
ugcgaucagggccucgc

SEQ ID NO: 3482665 - RNA, 20 nt, Pseudomonas aeruginosa PA01
ugcgaucagggccucgccac

SEQ ID NO: 3482666 - RNA, 19 nt, Pseudomonas aeruginosa PA01
ugcgaucgaggaugaucgg

SEQ ID NO: 3482667 - RNA, 20 nt, Pseudomonas aeruginosa PA01
ugcgauggaacgagcgcgac

SEQ ID NO: 3482668 - RNA, 22 nt, Pseudomonas aeruginosa PA01
ugcgauggaaguugcgcacccg

SEQ ID NO: 3482669 - RNA, 23 nt, Pseudomonas aeruginosa PA01
ugcgauggaaguugcgcacccgc

SEQ ID NO: 3482670 - RNA, 17 nt, Pseudomonas aeruginosa PA01
ugcgaugggugccgcgc

SEQ ID NO: 3482671 - RNA, 20 nt, Pseudomonas aeruginosa PA01
ugcgaugggugccgcgcagg

SEQ ID NO: 3482672 - RNA, 19 nt, Pseudomonas aeruginosa PA01
ugcgcaacgggacgccagg

SEQ ID NO: 3482673 - RNA, 15 nt, Pseudomonas aeruginosa PA01
ugcgcaacgggcggc

SEQ ID NO: 3482674 - RNA, 14 nt, Pseudomonas aeruginosa PA01
ugcgcaacugccgg

SEQ ID NO: 3482675 - RNA, 15 nt, Pseudomonas aeruginosa PA01
ugcgcaaggaacugg

SEQ ID NO: 3482676 - RNA, 14 nt, Pseudomonas aeruginosa PA01
ugcgcaccagggcc

SEQ ID NO: 3482677 - RNA, 17 nt, Pseudomonas aeruginosa PA01
ugcgcaccagggccagg

SEQ ID NO: 3482678 - RNA, 18 nt, Pseudomonas aeruginosa PA01
ugcgcaccagggccagga

SEQ ID NO: 3482679 - RNA, 19 nt, Pseudomonas aeruginosa PA01
ugcgcaccagggccaggag

SEQ ID NO: 3482680 - RNA, 15 nt, Pseudomonas aeruginosa PA01
ugcgcaccaggucgc

SEQ ID NO: 3482681 - RNA, 18 nt, Pseudomonas aeruginosa PA01
ugcgcacccgcucggccu

SEQ ID NO: 3482682 - RNA, 15 nt, Pseudomonas aeruginosa PA01
ugcgcaccgcgccgg

SEQ ID NO: 3482683 - RNA, 17 nt, Pseudomonas aeruginosa PA01
ugcgcaccgcgccggga

SEQ ID NO: 3482684 - RNA, 15 nt, Pseudomonas aeruginosa PA01
ugcgcaccucggcca

SEQ ID NO: 3482685 - RNA, 16 nt, Pseudomonas aeruginosa PA01
ugcgcaccucggccag

SEQ ID NO: 3482686 - RNA, 18 nt, Pseudomonas aeruginosa PA01
ugcgcaccucggccaggc

SEQ ID NO: 3482687 - RNA, 21 nt, Pseudomonas aeruginosa PA01
ugcgcacgcaauggcgcagcc

SEQ ID NO: 3482688 - RNA, 19 nt, Pseudomonas aeruginosa PA01
ugcgcacggucuccgggga

SEQ ID NO: 3482689 - RNA, 16 nt, Pseudomonas aeruginosa PA01
ugcgcagaugcggggc

SEQ ID NO: 3482690 - RNA, 15 nt, Pseudomonas aeruginosa PA01
ugcgcagcaacgcga

SEQ ID NO: 3482691 - RNA, 20 nt, Pseudomonas aeruginosa PA01
ugcgcagcaacgcgacgauc

SEQ ID NO: 3482692 - RNA, 18 nt, Pseudomonas aeruginosa PA01
ugcgcagcaacuggucgc

SEQ ID NO: 3482693 - RNA, 21 nt, Pseudomonas aeruginosa PA01
ugcgcagcaacuggucgccgc

SEQ ID NO: 3482694 - RNA, 14 nt, Pseudomonas aeruginosa PA01
ugcgcagcagcguc

SEQ ID NO: 3482695 - RNA, 20 nt, Pseudomonas aeruginosa PA01
ugcgcagccacccgcucgac

SEQ ID NO: 3482696 - RNA, 16 nt, Pseudomonas aeruginosa PA01
ugcgcagcgcgggggc

SEQ ID NO: 3482697 - RNA, 12 nt, Pseudomonas aeruginosa PA01
ugcgcagcgcgu

SEQ ID NO: 3482698 - RNA, 15 nt, Pseudomonas aeruginosa PA01
ugcgcagcuucugca

SEQ ID NO: 3482699 - RNA, 18 nt, Pseudomonas aeruginosa PA01
ugcgcagcuucugcaggg

SEQ ID NO: 3482700 - RNA, 21 nt, Pseudomonas aeruginosa PA01
ugcgcagcuucugcagggcgg

SEQ ID NO: 3482701 - RNA, 17 nt, Pseudomonas aeruginosa PA01
ugcgcaggccgagaagg

SEQ ID NO: 3482702 - RNA, 21 nt, Pseudomonas aeruginosa PA01
ugcgcaggcgcucgcgggccg

SEQ ID NO: 3482703 - RNA, 15 nt, Pseudomonas aeruginosa PA01
ugcgcaggcgguagg

SEQ ID NO: 3482704 - RNA, 13 nt, Pseudomonas aeruginosa PA01
ugcgcaggcugcc

SEQ ID NO: 3482705 - RNA, 17 nt, Pseudomonas aeruginosa PA01
ugcgcaggcugguaugc

SEQ ID NO: 3482706 - RNA, 13 nt, Pseudomonas aeruginosa PA01
ugcgcagggcggc

SEQ ID NO: 3482707 - RNA, 20 nt, Pseudomonas aeruginosa PA01
ugcgcagggcgucgaaggcg

SEQ ID NO: 3482708 - RNA, 23 nt, Pseudomonas aeruginosa PA01
ugcgcagggcgucgaaggcggcg

SEQ ID NO: 3482709 - RNA, 16 nt, Pseudomonas aeruginosa PA01
ugcgcaggggcgcggc

SEQ ID NO: 3482710 - RNA, 17 nt, Pseudomonas aeruginosa PA01
ugcgcaggggcgcggcg

SEQ ID NO: 3482711 - RNA, 20 nt, Pseudomonas aeruginosa PA01
ugcgcaggggcgcggcgcgg

SEQ ID NO: 3482712 - RNA, 19 nt, Pseudomonas aeruginosa PA01
ugcgcagguacucgccggc

SEQ ID NO: 3482713 - RNA, 12 nt, Pseudomonas aeruginosa PA01
ugcgcaggucgc

SEQ ID NO: 3482714 - RNA, 13 nt, Pseudomonas aeruginosa PA01
ugcgcaggucgcg

SEQ ID NO: 3482715 - RNA, 18 nt, Pseudomonas aeruginosa PA01
ugcgcaggucgcgacagg

SEQ ID NO: 3482716 - RNA, 20 nt, Pseudomonas aeruginosa PA01
ugcgcaggucgcgacagguu

SEQ ID NO: 3482717 - RNA, 22 nt, Pseudomonas aeruginosa PA01
ugcgcaggugcuugucacgcuc

SEQ ID NO: 3482718 - RNA, 16 nt, Pseudomonas aeruginosa PA01
ugcgcaucaggucggu

SEQ ID NO: 3482719 - RNA, 16 nt, Pseudomonas aeruginosa PA01
ugcgcaucgccugggc

SEQ ID NO: 3482720 - RNA, 22 nt, Pseudomonas aeruginosa PA01
ugcgcaucgccugggccggcgu

SEQ ID NO: 3482721 - RNA, 14 nt, Pseudomonas aeruginosa PA01
ugcgcaugcgcagc

SEQ ID NO: 3482722 - RNA, 16 nt, Pseudomonas aeruginosa PA01
ugcgcaugucguccag

SEQ ID NO: 3482723 - RNA, 20 nt, Pseudomonas aeruginosa PA01
ugcgcaugucguccaggcug

SEQ ID NO: 3482724 - RNA, 14 nt, Pseudomonas aeruginosa PA01
ugcgcauuguucgg

SEQ ID NO: 3482725 - RNA, 21 nt, Pseudomonas aeruginosa PA01
ugcgcauuuucauugccucga

SEQ ID NO: 3482726 - RNA, 19 nt, Pseudomonas aeruginosa PA01
ugcgcauuuugccggagau

SEQ ID NO: 3482727 - RNA, 18 nt, Pseudomonas aeruginosa PA01
ugcgccagaccagcccca

SEQ ID NO: 3482728 - RNA, 19 nt, Pseudomonas aeruginosa PA01
ugcgccagaccagccccag

SEQ ID NO: 3482729 - RNA, 21 nt, Pseudomonas aeruginosa PA01
ugcgccagaccagccccaguc

SEQ ID NO: 3482730 - RNA, 20 nt, Pseudomonas aeruginosa PA01
ugcgccagagcaggcggauc

SEQ ID NO: 3482731 - RNA, 11 nt, Pseudomonas aeruginosa PA01
ugcgccagcau

SEQ ID NO: 3482732 - RNA, 20 nt, Pseudomonas aeruginosa PA01
ugcgccagcaucgcaucggc

SEQ ID NO: 3482733 - RNA, 21 nt, Pseudomonas aeruginosa PA01
ugcgccagcaucgcaucggcg

SEQ ID NO: 3482734 - RNA, 20 nt, Pseudomonas aeruginosa PA01
ugcgccagccgacuggcggu

SEQ ID NO: 3482735 - RNA, 13 nt, Pseudomonas aeruginosa PA01
ugcgccagcggcc

SEQ ID NO: 3482736 - RNA, 17 nt, Pseudomonas aeruginosa PA01
ugcgccagcggcccggc

SEQ ID NO: 3482737 - RNA, 21 nt, Pseudomonas aeruginosa PA01
ugcgccaggaccauuugcgcc

SEQ ID NO: 3482738 - RNA, 15 nt, Pseudomonas aeruginosa PA01
ugcgccaggcccggc

SEQ ID NO: 3482739 - RNA, 13 nt, Pseudomonas aeruginosa PA01
ugcgccaggccgu

SEQ ID NO: 3482740 - RNA, 21 nt, Pseudomonas aeruginosa PA01
ugcgccaggccguucucgaag

SEQ ID NO: 3482741 - RNA, 21 nt, Pseudomonas aeruginosa PA01
ugcgccaggcuuuccgccgag

SEQ ID NO: 3482742 - RNA, 19 nt, Pseudomonas aeruginosa PA01
ugcgccagguagccuggau

SEQ ID NO: 3482743 - RNA, 23 nt, Pseudomonas aeruginosa PA01
ugcgccagguguucguccagaug

SEQ ID NO: 3482744 - RNA, 17 nt, Pseudomonas aeruginosa PA01
ugcgccaugcgcccgcu

SEQ ID NO: 3482745 - RNA, 19 nt, Pseudomonas aeruginosa PA01
ugcgccauugccgccaggu

SEQ ID NO: 3482746 - RNA, 14 nt, Pseudomonas aeruginosa PA01
ugcgcccagcagca

SEQ ID NO: 3482747 - RNA, 16 nt, Pseudomonas aeruginosa PA01
ugcgcccagcagcagg

SEQ ID NO: 3482748 - RNA, 17 nt, Pseudomonas aeruginosa PA01
ugcgcccagcagcaggc

SEQ ID NO: 3482749 - RNA, 21 nt, Pseudomonas aeruginosa PA01
ugcgcccagcagcaggccggc

SEQ ID NO: 3482750 - RNA, 16 nt, Pseudomonas aeruginosa PA01
ugcgcccagggacgcg

SEQ ID NO: 3482751 - RNA, 19 nt, Pseudomonas aeruginosa PA01
ugcgcccagggacgcgccg

SEQ ID NO: 3482752 - RNA, 17 nt, Pseudomonas aeruginosa PA01
ugcgccccagcgccugg

SEQ ID NO: 3482753 - RNA, 21 nt, Pseudomonas aeruginosa PA01
ugcgccccagcgccugggccg

SEQ ID NO: 3482754 - RNA, 15 nt, Pseudomonas aeruginosa PA01
ugcgccccagcucag

SEQ ID NO: 3482755 - RNA, 15 nt, Pseudomonas aeruginosa PA01
ugcgccccaggugca

SEQ ID NO: 3482756 - RNA, 17 nt, Pseudomonas aeruginosa PA01
ugcgccccaggugcagc

SEQ ID NO: 3482757 - RNA, 19 nt, Pseudomonas aeruginosa PA01
ugcgccccaggugcagcga

SEQ ID NO: 3482758 - RNA, 14 nt, Pseudomonas aeruginosa PA01
ugcgcccccagcgc

SEQ ID NO: 3482759 - RNA, 15 nt, Pseudomonas aeruginosa PA01
ugcgcccccagcgcc

SEQ ID NO: 3482760 - RNA, 18 nt, Pseudomonas aeruginosa PA01
ugcgcccccagcgcccgc

SEQ ID NO: 3482761 - RNA, 20 nt, Pseudomonas aeruginosa PA01
ugcgccccgggucgcugcuc

SEQ ID NO: 3482762 - RNA, 22 nt, Pseudomonas aeruginosa PA01
ugcgccccggucucgcgcagcg

SEQ ID NO: 3482763 - RNA, 16 nt, Pseudomonas aeruginosa PA01
ugcgcccgccgcgagc

SEQ ID NO: 3482764 - RNA, 14 nt, Pseudomonas aeruginosa PA01
ugcgcccgcucgac

SEQ ID NO: 3482765 - RNA, 14 nt, Pseudomonas aeruginosa PA01
ugcgcccgcugaag

SEQ ID NO: 3482766 - RNA, 13 nt, Pseudomonas aeruginosa PA01
ugcgcccggcgcg

SEQ ID NO: 3482767 - RNA, 14 nt, Pseudomonas aeruginosa PA01
ugcgcccggcgcga

SEQ ID NO: 3482768 - RNA, 22 nt, Pseudomonas aeruginosa PA01
ugcgcccggcgcgaccgucggc

SEQ ID NO: 3482769 - RNA, 22 nt, Pseudomonas aeruginosa PA01
ugcgcccggcuucggcggcgcg

SEQ ID NO: 3482770 - RNA, 13 nt, Pseudomonas aeruginosa PA01
ugcgcccgucgaa

SEQ ID NO: 3482771 - RNA, 13 nt, Pseudomonas aeruginosa PA01
ugcgcccucccgc

SEQ ID NO: 3482772 - RNA, 16 nt, Pseudomonas aeruginosa PA01
ugcgcccucgaacggc

SEQ ID NO: 3482773 - RNA, 18 nt, Pseudomonas aeruginosa PA01
ugcgcccucgaacggcgu

SEQ ID NO: 3482774 - RNA, 22 nt, Pseudomonas aeruginosa PA01
ugcgccgaaggaaucaccacuc

SEQ ID NO: 3482775 - RNA, 15 nt, Pseudomonas aeruginosa PA01
ugcgccgaccgcgcg

SEQ ID NO: 3482776 - RNA, 16 nt, Pseudomonas aeruginosa PA01
ugcgccgaccgcgcgc

SEQ ID NO: 3482777 - RNA, 18 nt, Pseudomonas aeruginosa PA01
ugcgccgacgccaccagc

SEQ ID NO: 3482778 - RNA, 21 nt, Pseudomonas aeruginosa PA01
ugcgccgacgccaccagccag

SEQ ID NO: 3482779 - RNA, 22 nt, Pseudomonas aeruginosa PA01
ugcgccgacgccaccagccagg

SEQ ID NO: 3482780 - RNA, 13 nt, Pseudomonas aeruginosa PA01
ugcgccgagcgcu

SEQ ID NO: 3482781 - RNA, 17 nt, Pseudomonas aeruginosa PA01
ugcgccgagcgcucgcc

SEQ ID NO: 3482782 - RNA, 12 nt, Pseudomonas aeruginosa PA01
ugcgccgcagcg

SEQ ID NO: 3482783 - RNA, 13 nt, Pseudomonas aeruginosa PA01
ugcgccgcagcgg

SEQ ID NO: 3482784 - RNA, 14 nt, Pseudomonas aeruginosa PA01
ugcgccgcagcggc

SEQ ID NO: 3482785 - RNA, 16 nt, Pseudomonas aeruginosa PA01
ugcgccgcagcggcca

SEQ ID NO: 3482786 - RNA, 21 nt, Pseudomonas aeruginosa PA01
ugcgccgcagcggccagggaa

SEQ ID NO: 3482787 - RNA, 22 nt, Pseudomonas aeruginosa PA01
ugcgccgccggcuccuugcgcc

SEQ ID NO: 3482788 - RNA, 18 nt, Pseudomonas aeruginosa PA01
ugcgccgccucgcgcaac

SEQ ID NO: 3482789 - RNA, 22 nt, Pseudomonas aeruginosa PA01
ugcgccgcgggucaccagcgcc

SEQ ID NO: 3482790 - RNA, 21 nt, Pseudomonas aeruginosa PA01
ugcgccgcgguuccagcucgu

SEQ ID NO: 3482791 - RNA, 15 nt, Pseudomonas aeruginosa PA01
ugcgccgcucgcgca

SEQ ID NO: 3482792 - RNA, 19 nt, Pseudomonas aeruginosa PA01
ugcgccgcucgcgcacggc

SEQ ID NO: 3482793 - RNA, 14 nt, Pseudomonas aeruginosa PA01
ugcgccgcugcggc

SEQ ID NO: 3482794 - RNA, 14 nt, Pseudomonas aeruginosa PA01
ugcgccggcacggc

SEQ ID NO: 3482795 - RNA, 18 nt, Pseudomonas aeruginosa PA01
ugcgccggcaucgccaug

SEQ ID NO: 3482796 - RNA, 20 nt, Pseudomonas aeruginosa PA01
ugcgccggcccagcaggccg

SEQ ID NO: 3482797 - RNA, 22 nt, Pseudomonas aeruginosa PA01
ugcgccggcccagcaggccggc

SEQ ID NO: 3482798 - RNA, 12 nt, Pseudomonas aeruginosa PA01
ugcgccggcggg

SEQ ID NO: 3482799 - RNA, 16 nt, Pseudomonas aeruginosa PA01
ugcgccggcugccgcg

SEQ ID NO: 3482800 - RNA, 21 nt, Pseudomonas aeruginosa PA01
ugcgccgggaugcucaccgcg

SEQ ID NO: 3482801 - RNA, 18 nt, Pseudomonas aeruginosa PA01
ugcgccgggccucggcaa

SEQ ID NO: 3482802 - RNA, 22 nt, Pseudomonas aeruginosa PA01
ugcgccgguugcugcuugcgcg

SEQ ID NO: 3482803 - RNA, 16 nt, Pseudomonas aeruginosa PA01
ugcgccguggcaccag

SEQ ID NO: 3482804 - RNA, 20 nt, Pseudomonas aeruginosa PA01
ugcgccguuucgacgaugcu

SEQ ID NO: 3482805 - RNA, 12 nt, Pseudomonas aeruginosa PA01
ugcgccucccgc

SEQ ID NO: 3482806 - RNA, 14 nt, Pseudomonas aeruginosa PA01
ugcgccuccucggc

SEQ ID NO: 3482807 - RNA, 16 nt, Pseudomonas aeruginosa PA01
ugcgccucgccgcccg

SEQ ID NO: 3482808 - RNA, 12 nt, Pseudomonas aeruginosa PA01
ugcgccucggcc

SEQ ID NO: 3482809 - RNA, 20 nt, Pseudomonas aeruginosa PA01
ugcgccucggcccuggcggc

SEQ ID NO: 3482810 - RNA, 22 nt, Pseudomonas aeruginosa PA01
ugcgccucgucgacgcccuggc

SEQ ID NO: 3482811 - RNA, 18 nt, Pseudomonas aeruginosa PA01
ugcgccugcuucagcccg

SEQ ID NO: 3482812 - RNA, 13 nt, Pseudomonas aeruginosa PA01
ugcgccuggccgc

SEQ ID NO: 3482813 - RNA, 16 nt, Pseudomonas aeruginosa PA01
ugcgccuggccgcgca

SEQ ID NO: 3482814 - RNA, 22 nt, Pseudomonas aeruginosa PA01
ugcgcgaagccaggaagcggcg

SEQ ID NO: 3482815 - RNA, 15 nt, Pseudomonas aeruginosa PA01
ugcgcgaaugguuca

SEQ ID NO: 3482816 - RNA, 17 nt, Pseudomonas aeruginosa PA01
ugcgcgagcaccgcgca

SEQ ID NO: 3482817 - RNA, 20 nt, Pseudomonas aeruginosa PA01
ugcgcgagcaccgcgcagac

SEQ ID NO: 3482818 - RNA, 22 nt, Pseudomonas aeruginosa PA01
ugcgcgaggagccguagggcgc

SEQ ID NO: 3482819 - RNA, 12 nt, Pseudomonas aeruginosa PA01
ugcgcgaggcgu

SEQ ID NO: 3482820 - RNA, 22 nt, Pseudomonas aeruginosa PA01
ugcgcgaggggcggagcagccu

SEQ ID NO: 3482821 - RNA, 19 nt, Pseudomonas aeruginosa PA01
ugcgcgaucccccgccccu

SEQ ID NO: 3482822 - RNA, 17 nt, Pseudomonas aeruginosa PA01
ugcgcgcaacuggucgc

SEQ ID NO: 3482823 - RNA, 22 nt, Pseudomonas aeruginosa PA01
ugcgcgcaacuggucgcggcug

SEQ ID NO: 3482824 - RNA, 16 nt, Pseudomonas aeruginosa PA01
ugcgcgcaccaggccu

SEQ ID NO: 3482825 - RNA, 18 nt, Pseudomonas aeruginosa PA01
ugcgcgcaguaggcgcug

SEQ ID NO: 3482826 - RNA, 21 nt, Pseudomonas aeruginosa PA01
ugcgcgcaguaggcgcugccg

SEQ ID NO: 3482827 - RNA, 12 nt, Pseudomonas aeruginosa PA01
ugcgcgccacca

SEQ ID NO: 3482828 - RNA, 14 nt, Pseudomonas aeruginosa PA01
ugcgcgccaccacc

SEQ ID NO: 3482829 - RNA, 13 nt, Pseudomonas aeruginosa PA01
ugcgcgccaccag

SEQ ID NO: 3482830 - RNA, 15 nt, Pseudomonas aeruginosa PA01
ugcgcgccaccagcg

SEQ ID NO: 3482831 - RNA, 13 nt, Pseudomonas aeruginosa PA01
ugcgcgccagggc

SEQ ID NO: 3482832 - RNA, 18 nt, Pseudomonas aeruginosa PA01
ugcgcgccauuccgcggc

SEQ ID NO: 3482833 - RNA, 13 nt, Pseudomonas aeruginosa PA01
ugcgcgcccuagg

SEQ ID NO: 3482834 - RNA, 19 nt, Pseudomonas aeruginosa PA01
ugcgcgcccuaggguuccg

SEQ ID NO: 3482835 - RNA, 12 nt, Pseudomonas aeruginosa PA01
ugcgcgcccuga

SEQ ID NO: 3482836 - RNA, 14 nt, Pseudomonas aeruginosa PA01
ugcgcgcccugacg

SEQ ID NO: 3482837 - RNA, 12 nt, Pseudomonas aeruginosa PA01
ugcgcgccgcaa

SEQ ID NO: 3482838 - RNA, 14 nt, Pseudomonas aeruginosa PA01
ugcgcgccgccgcc

SEQ ID NO: 3482839 - RNA, 21 nt, Pseudomonas aeruginosa PA01
ugcgcgccgccgggcgcccgg

SEQ ID NO: 3482840 - RNA, 14 nt, Pseudomonas aeruginosa PA01
ugcgcgccggcggg

SEQ ID NO: 3482841 - RNA, 14 nt, Pseudomonas aeruginosa PA01
ugcgcgccgggucg

SEQ ID NO: 3482842 - RNA, 17 nt, Pseudomonas aeruginosa PA01
ugcgcgccucgccccag

SEQ ID NO: 3482843 - RNA, 20 nt, Pseudomonas aeruginosa PA01
ugcgcgccucgccccagacc

SEQ ID NO: 3482844 - RNA, 13 nt, Pseudomonas aeruginosa PA01
ugcgcgcggccug

SEQ ID NO: 3482845 - RNA, 19 nt, Pseudomonas aeruginosa PA01
ugcgcgcggccuguucggc

SEQ ID NO: 3482846 - RNA, 19 nt, Pseudomonas aeruginosa PA01
ugcgcgcggguuuccgugc

SEQ ID NO: 3482847 - RNA, 13 nt, Pseudomonas aeruginosa PA01
ugcgcggcagcag

SEQ ID NO: 3482848 - RNA, 22 nt, Pseudomonas aeruginosa PA01
ugcgcggcagcaggcgggcgaa

SEQ ID NO: 3482849 - RNA, 16 nt, Pseudomonas aeruginosa PA01
ugcgcggcagguggcu

SEQ ID NO: 3482850 - RNA, 18 nt, Pseudomonas aeruginosa PA01
ugcgcggccugcgccgga

SEQ ID NO: 3482851 - RNA, 19 nt, Pseudomonas aeruginosa PA01
ugcgcggcgaguugcgcga

SEQ ID NO: 3482852 - RNA, 14 nt, Pseudomonas aeruginosa PA01
ugcgcggcgccggu

SEQ ID NO: 3482853 - RNA, 18 nt, Pseudomonas aeruginosa PA01
ugcgcggcguucgcccug

SEQ ID NO: 3482854 - RNA, 20 nt, Pseudomonas aeruginosa PA01
ugcgcgggauaaacggcgga

SEQ ID NO: 3482855 - RNA, 13 nt, Pseudomonas aeruginosa PA01
ugcgcgggcaugc

SEQ ID NO: 3482856 - RNA, 17 nt, Pseudomonas aeruginosa PA01
ugcgcgggguaggggug

SEQ ID NO: 3482857 - RNA, 23 nt, Pseudomonas aeruginosa PA01
ugcgcgggguagggguggccagg

SEQ ID NO: 3482858 - RNA, 22 nt, Pseudomonas aeruginosa PA01
ugcgcgggucguccuccacccc

SEQ ID NO: 3482859 - RNA, 21 nt, Pseudomonas aeruginosa PA01
ugcgcgggugucgcgacggug

SEQ ID NO: 3482860 - RNA, 23 nt, Pseudomonas aeruginosa PA01
ugcgcggucaccagggucacgcc

SEQ ID NO: 3482861 - RNA, 17 nt, Pseudomonas aeruginosa PA01
ugcgcgucgccgaacgg

SEQ ID NO: 3482862 - RNA, 18 nt, Pseudomonas aeruginosa PA01
ugcgcgugcuggugccga

SEQ ID NO: 3482863 - RNA, 22 nt, Pseudomonas aeruginosa PA01
ugcgcguguacccccaccgggc

SEQ ID NO: 3482864 - RNA, 17 nt, Pseudomonas aeruginosa PA01
ugcgcguguugcgccgc

SEQ ID NO: 3482865 - RNA, 23 nt, Pseudomonas aeruginosa PA01
ugcgcguguugcgccgcaccacg

SEQ ID NO: 3482866 - RNA, 15 nt, Pseudomonas aeruginosa PA01
ugcgcguugcagcgc

SEQ ID NO: 3482867 - RNA, 18 nt, Pseudomonas aeruginosa PA01
ugcgcguuucucagcgcc

SEQ ID NO: 3482868 - RNA, 18 nt, Pseudomonas aeruginosa PA01
ugcgcuacggcaucaccg

SEQ ID NO: 3482869 - RNA, 14 nt, Pseudomonas aeruginosa PA01
ugcgcucagggaca

SEQ ID NO: 3482870 - RNA, 18 nt, Pseudomonas aeruginosa PA01
ugcgcuccacccaggcgc

SEQ ID NO: 3482871 - RNA, 19 nt, Pseudomonas aeruginosa PA01
ugcgcuccacccaggcgcc

SEQ ID NO: 3482872 - RNA, 22 nt, Pseudomonas aeruginosa PA01
ugcgcuccacccaggcgccgau

SEQ ID NO: 3482873 - RNA, 13 nt, Pseudomonas aeruginosa PA01
ugcgcuccaggcg

SEQ ID NO: 3482874 - RNA, 15 nt, Pseudomonas aeruginosa PA01
ugcgcuccgguggcg

SEQ ID NO: 3482875 - RNA, 22 nt, Pseudomonas aeruginosa PA01
ugcgcuccuguugcuggccggu

SEQ ID NO: 3482876 - RNA, 17 nt, Pseudomonas aeruginosa PA01
ugcgcuccuuggcuggc

SEQ ID NO: 3482877 - RNA, 19 nt, Pseudomonas aeruginosa PA01
ugcgcuccuuggcuggcca

SEQ ID NO: 3482878 - RNA, 18 nt, Pseudomonas aeruginosa PA01
ugcgcucgagccggcuga

SEQ ID NO: 3482879 - RNA, 15 nt, Pseudomonas aeruginosa PA01
ugcgcucguagaacu

SEQ ID NO: 3482880 - RNA, 14 nt, Pseudomonas aeruginosa PA01
ugcgcucuggcgca

SEQ ID NO: 3482881 - RNA, 15 nt, Pseudomonas aeruginosa PA01
ugcgcugagcaggac

SEQ ID NO: 3482882 - RNA, 16 nt, Pseudomonas aeruginosa PA01
ugcgcugagcaggacc

SEQ ID NO: 3482883 - RNA, 10 nt, Pseudomonas aeruginosa PA01
ugcgcugcca

SEQ ID NO: 3482884 - RNA, 17 nt, Pseudomonas aeruginosa PA01
ugcgcugccagcgccgc

SEQ ID NO: 3482885 - RNA, 17 nt, Pseudomonas aeruginosa PA01
ugcgcugcuugaacacc

SEQ ID NO: 3482886 - RNA, 12 nt, Pseudomonas aeruginosa PA01
ugcgcuggaagu

SEQ ID NO: 3482887 - RNA, 13 nt, Pseudomonas aeruginosa PA01
ugcgcuggccggc

SEQ ID NO: 3482888 - RNA, 14 nt, Pseudomonas aeruginosa PA01
ugcgcuggccggca

SEQ ID NO: 3482889 - RNA, 17 nt, Pseudomonas aeruginosa PA01
ugcgcuggcgcagcagc

SEQ ID NO: 3482890 - RNA, 14 nt, Pseudomonas aeruginosa PA01
ugcgcuggcgccag

SEQ ID NO: 3482891 - RNA, 16 nt, Pseudomonas aeruginosa PA01
ugcgcugggcgccgau

SEQ ID NO: 3482892 - RNA, 19 nt, Pseudomonas aeruginosa PA01
ugcgcugguaccugccggc

SEQ ID NO: 3482893 - RNA, 23 nt, Pseudomonas aeruginosa PA01
ugcgcugguagcgcuccagcucc

SEQ ID NO: 3482894 - RNA, 23 nt, Pseudomonas aeruginosa PA01
ugcgcuggucguucagugccagc

SEQ ID NO: 3482895 - RNA, 12 nt, Pseudomonas aeruginosa PA01
ugcgcugguugg

SEQ ID NO: 3482896 - RNA, 18 nt, Pseudomonas aeruginosa PA01
ugcgcuguuccgccgugg

SEQ ID NO: 3482897 - RNA, 14 nt, Pseudomonas aeruginosa PA01
ugcgcuuccggcag

SEQ ID NO: 3482898 - RNA, 20 nt, Pseudomonas aeruginosa PA01
ugcgcuuccggcagccagcc

SEQ ID NO: 3482899 - RNA, 17 nt, Pseudomonas aeruginosa PA01
ugcggaaaccgcggccg

SEQ ID NO: 3482900 - RNA, 18 nt, Pseudomonas aeruginosa PA01
ugcggaaaccgcggccgg

SEQ ID NO: 3482901 - RNA, 15 nt, Pseudomonas aeruginosa PA01
ugcggaaaccgggau

SEQ ID NO: 3482902 - RNA, 22 nt, Pseudomonas aeruginosa PA01
ugcggaacgcggcuucggucag

SEQ ID NO: 3482903 - RNA, 22 nt, Pseudomonas aeruginosa PA01
ugcggaagaaacugcgguugaa

SEQ ID NO: 3482904 - RNA, 16 nt, Pseudomonas aeruginosa PA01
ugcggaccacagggca

SEQ ID NO: 3482905 - RNA, 17 nt, Pseudomonas aeruginosa PA01
ugcggaccacagggcaa

SEQ ID NO: 3482906 - RNA, 22 nt, Pseudomonas aeruginosa PA01
ugcggacuaccuucgaucaccc

SEQ ID NO: 3482907 - RNA, 14 nt, Pseudomonas aeruginosa PA01
ugcggagggucagg

SEQ ID NO: 3482908 - RNA, 18 nt, Pseudomonas aeruginosa PA01
ugcggagggucaggccga

SEQ ID NO: 3482909 - RNA, 22 nt, Pseudomonas aeruginosa PA01
ugcggaucaacuccgccaggcg

SEQ ID NO: 3482910 - RNA, 17 nt, Pseudomonas aeruginosa PA01
ugcggauggcgcggggc

SEQ ID NO: 3482911 - RNA, 19 nt, Pseudomonas aeruginosa PA01
ugcggauucaucggcggca

SEQ ID NO: 3482912 - RNA, 21 nt, Pseudomonas aeruginosa PA01
ugcggauucaucggcggcagg

SEQ ID NO: 3482913 - RNA, 15 nt, Pseudomonas aeruginosa PA01
ugcggcaacgacggc

SEQ ID NO: 3482914 - RNA, 17 nt, Pseudomonas aeruginosa PA01
ugcggcaacgacggcaa

SEQ ID NO: 3482915 - RNA, 15 nt, Pseudomonas aeruginosa PA01
ugcggcaaggcgauc

SEQ ID NO: 3482916 - RNA, 18 nt, Pseudomonas aeruginosa PA01
ugcggcacgaaccauugc

SEQ ID NO: 3482917 - RNA, 14 nt, Pseudomonas aeruginosa PA01
ugcggcacgcugcu

SEQ ID NO: 3482918 - RNA, 18 nt, Pseudomonas aeruginosa PA01
ugcggcacgcugcuugcg

SEQ ID NO: 3482919 - RNA, 13 nt, Pseudomonas aeruginosa PA01
ugcggcagacgug

SEQ ID NO: 3482920 - RNA, 20 nt, Pseudomonas aeruginosa PA01
ugcggcagacgugcugguag

SEQ ID NO: 3482921 - RNA, 13 nt, Pseudomonas aeruginosa PA01
ugcggcagcaggc

SEQ ID NO: 3482922 - RNA, 13 nt, Pseudomonas aeruginosa PA01
ugcggcagcaucc

SEQ ID NO: 3482923 - RNA, 21 nt, Pseudomonas aeruginosa PA01
ugcggcagcauccguaccagg

SEQ ID NO: 3482924 - RNA, 22 nt, Pseudomonas aeruginosa PA01
ugcggcagucgguagaaauccu

SEQ ID NO: 3482925 - RNA, 12 nt, Pseudomonas aeruginosa PA01
ugcggccagcgc

SEQ ID NO: 3482926 - RNA, 15 nt, Pseudomonas aeruginosa PA01
ugcggccagcgccag

SEQ ID NO: 3482927 - RNA, 18 nt, Pseudomonas aeruginosa PA01
ugcggccagcgccaggag

SEQ ID NO: 3482928 - RNA, 20 nt, Pseudomonas aeruginosa PA01
ugcggccagcgccaggagca

SEQ ID NO: 3482929 - RNA, 22 nt, Pseudomonas aeruginosa PA01
ugcggccagcgccaggagcagg

SEQ ID NO: 3482930 - RNA, 21 nt, Pseudomonas aeruginosa PA01
ugcggcccccagaccguggau

SEQ ID NO: 3482931 - RNA, 20 nt, Pseudomonas aeruginosa PA01
ugcggcccgagggcggcagg

SEQ ID NO: 3482932 - RNA, 15 nt, Pseudomonas aeruginosa PA01
ugcggcccgccggcg

SEQ ID NO: 3482933 - RNA, 16 nt, Pseudomonas aeruginosa PA01
ugcggcccgccggcga

SEQ ID NO: 3482934 - RNA, 12 nt, Pseudomonas aeruginosa PA01
ugcggcccgccu

SEQ ID NO: 3482935 - RNA, 16 nt, Pseudomonas aeruginosa PA01
ugcggcccgccucggc

SEQ ID NO: 3482936 - RNA, 20 nt, Pseudomonas aeruginosa PA01
ugcggcccgccucggcggcu

SEQ ID NO: 3482937 - RNA, 19 nt, Pseudomonas aeruginosa PA01
ugcggcccuucaucauuuc

SEQ ID NO: 3482938 - RNA, 15 nt, Pseudomonas aeruginosa PA01
ugcggcccuugcuca

SEQ ID NO: 3482939 - RNA, 19 nt, Pseudomonas aeruginosa PA01
ugcggcccuugcucagguc

SEQ ID NO: 3482940 - RNA, 16 nt, Pseudomonas aeruginosa PA01
ugcggcccuuguucgc

SEQ ID NO: 3482941 - RNA, 23 nt, Pseudomonas aeruginosa PA01
ugcggccgagcauguaggcgcac

SEQ ID NO: 3482942 - RNA, 13 nt, Pseudomonas aeruginosa PA01
ugcggccgaucau

SEQ ID NO: 3482943 - RNA, 23 nt, Pseudomonas aeruginosa PA01
ugcggccgaucaucggcuggucg

SEQ ID NO: 3482944 - RNA, 22 nt, Pseudomonas aeruginosa PA01
ugcggccgaugcuaucgcgugg

SEQ ID NO: 3482945 - RNA, 17 nt, Pseudomonas aeruginosa PA01
ugcggccgcaaccagcc

SEQ ID NO: 3482946 - RNA, 18 nt, Pseudomonas aeruginosa PA01
ugcggccgcaaccagccc

SEQ ID NO: 3482947 - RNA, 19 nt, Pseudomonas aeruginosa PA01
ugcggccgcaaccagcccu

SEQ ID NO: 3482948 - RNA, 20 nt, Pseudomonas aeruginosa PA01
ugcggccgcaaccagcccug

SEQ ID NO: 3482949 - RNA, 23 nt, Pseudomonas aeruginosa PA01
ugcggccgcaaccagcccuggcg

SEQ ID NO: 3482950 - RNA, 20 nt, Pseudomonas aeruginosa PA01
ugcggccuacuugaucagcc

SEQ ID NO: 3482951 - RNA, 19 nt, Pseudomonas aeruginosa PA01
ugcggccugcaacgccgcc

SEQ ID NO: 3482952 - RNA, 20 nt, Pseudomonas aeruginosa PA01
ugcggccugcaacgccgcca

SEQ ID NO: 3482953 - RNA, 17 nt, Pseudomonas aeruginosa PA01
ugcggcgaaacggcgga

SEQ ID NO: 3482954 - RNA, 14 nt, Pseudomonas aeruginosa PA01
ugcggcgcaggcgg

SEQ ID NO: 3482955 - RNA, 14 nt, Pseudomonas aeruginosa PA01
ugcggcgcccgcca

SEQ ID NO: 3482956 - RNA, 12 nt, Pseudomonas aeruginosa PA01
ugcggcgccgag

SEQ ID NO: 3482957 - RNA, 20 nt, Pseudomonas aeruginosa PA01
ugcggcgccgguugcugcug

SEQ ID NO: 3482958 - RNA, 11 nt, Pseudomonas aeruginosa PA01
ugcggcgcugc

SEQ ID NO: 3482959 - RNA, 13 nt, Pseudomonas aeruginosa PA01
ugcggcgcugcca

SEQ ID NO: 3482960 - RNA, 16 nt, Pseudomonas aeruginosa PA01
ugcggcggaaggcggc

SEQ ID NO: 3482961 - RNA, 18 nt, Pseudomonas aeruginosa PA01
ugcggcggaaggcggcgu

SEQ ID NO: 3482962 - RNA, 15 nt, Pseudomonas aeruginosa PA01
ugcggcggcaccacg

SEQ ID NO: 3482963 - RNA, 16 nt, Pseudomonas aeruginosa PA01
ugcggcggcaggucgg

SEQ ID NO: 3482964 - RNA, 23 nt, Pseudomonas aeruginosa PA01
ugcggcggcaggucggacaggca

SEQ ID NO: 3482965 - RNA, 12 nt, Pseudomonas aeruginosa PA01
ugcggcgggcgc

SEQ ID NO: 3482966 - RNA, 21 nt, Pseudomonas aeruginosa PA01
ugcggcguggaaggccacuau

SEQ ID NO: 3482967 - RNA, 17 nt, Pseudomonas aeruginosa PA01
ugcggcguucgccgcgg

SEQ ID NO: 3482968 - RNA, 20 nt, Pseudomonas aeruginosa PA01
ugcggcguucgccgcgggcg

SEQ ID NO: 3482969 - RNA, 19 nt, Pseudomonas aeruginosa PA01
ugcggcuacucgcccgacc

SEQ ID NO: 3482970 - RNA, 13 nt, Pseudomonas aeruginosa PA01
ugcggcucgccga

SEQ ID NO: 3482971 - RNA, 14 nt, Pseudomonas aeruginosa PA01
ugcggcucgccgau

SEQ ID NO: 3482972 - RNA, 15 nt, Pseudomonas aeruginosa PA01
ugcggcucgccgauu

SEQ ID NO: 3482973 - RNA, 19 nt, Pseudomonas aeruginosa PA01
ugcggcucgccgauugcaa

SEQ ID NO: 3482974 - RNA, 18 nt, Pseudomonas aeruginosa PA01
ugcggcugcagggccagg

SEQ ID NO: 3482975 - RNA, 13 nt, Pseudomonas aeruginosa PA01
ugcggcuggcgaa

SEQ ID NO: 3482976 - RNA, 17 nt, Pseudomonas aeruginosa PA01
ugcggcuggcgcgcgcg

SEQ ID NO: 3482977 - RNA, 16 nt, Pseudomonas aeruginosa PA01
ugcggcugggugucga

SEQ ID NO: 3482978 - RNA, 18 nt, Pseudomonas aeruginosa PA01
ugcggcugugcucgagga

SEQ ID NO: 3482979 - RNA, 15 nt, Pseudomonas aeruginosa PA01
ugcggcuugcccugc

SEQ ID NO: 3482980 - RNA, 22 nt, Pseudomonas aeruginosa PA01
ugcggcuuucgguuugcgccga

SEQ ID NO: 3482981 - RNA, 16 nt, Pseudomonas aeruginosa PA01
ugcgggaacuggcguu

SEQ ID NO: 3482982 - RNA, 21 nt, Pseudomonas aeruginosa PA01
ugcgggaacuuggcgcgcagg

SEQ ID NO: 3482983 - RNA, 17 nt, Pseudomonas aeruginosa PA01
ugcgggcagacaccacc

SEQ ID NO: 3482984 - RNA, 20 nt, Pseudomonas aeruginosa PA01
ugcgggcagacaccaccagg

SEQ ID NO: 3482985 - RNA, 22 nt, Pseudomonas aeruginosa PA01
ugcgggcagacaccaccagguu

SEQ ID NO: 3482986 - RNA, 16 nt, Pseudomonas aeruginosa PA01
ugcgggcaguccuggc

SEQ ID NO: 3482987 - RNA, 17 nt, Pseudomonas aeruginosa PA01
ugcgggcaguccuggcg

SEQ ID NO: 3482988 - RNA, 22 nt, Pseudomonas aeruginosa PA01
ugcgggcaguccuggcgguagc

SEQ ID NO: 3482989 - RNA, 13 nt, Pseudomonas aeruginosa PA01
ugcgggccucguu

SEQ ID NO: 3482990 - RNA, 17 nt, Pseudomonas aeruginosa PA01
ugcgggccuugaccacc

SEQ ID NO: 3482991 - RNA, 21 nt, Pseudomonas aeruginosa PA01
ugcgggccuugaccaccgcca

SEQ ID NO: 3482992 - RNA, 14 nt, Pseudomonas aeruginosa PA01
ugcgggcgagcagg

SEQ ID NO: 3482993 - RNA, 17 nt, Pseudomonas aeruginosa PA01
ugcgggcgagcagggag

SEQ ID NO: 3482994 - RNA, 12 nt, Pseudomonas aeruginosa PA01
ugcgggcgaucu

SEQ ID NO: 3482995 - RNA, 17 nt, Pseudomonas aeruginosa PA01
ugcgggcgaugaggcug

SEQ ID NO: 3482996 - RNA, 21 nt, Pseudomonas aeruginosa PA01
ugcgggcgaugaggcugucca

SEQ ID NO: 3482997 - RNA, 12 nt, Pseudomonas aeruginosa PA01
ugcgggcgaugu

SEQ ID NO: 3482998 - RNA, 23 nt, Pseudomonas aeruginosa PA01
ugcgggcgcagguugagggccgc

SEQ ID NO: 3482999 - RNA, 13 nt, Pseudomonas aeruginosa PA01
ugcgggcgccgcc

SEQ ID NO: 3483000 - RNA, 12 nt, Pseudomonas aeruginosa PA01
ugcgggcgcugc

SEQ ID NO: 3483001 - RNA, 17 nt, Pseudomonas aeruginosa PA01
ugcgggcguagcgcggc

SEQ ID NO: 3483002 - RNA, 19 nt, Pseudomonas aeruginosa PA01
ugcgggcguagcgcggcag

SEQ ID NO: 3483003 - RNA, 20 nt, Pseudomonas aeruginosa PA01
ugcggggaaagcuccucggc

SEQ ID NO: 3483004 - RNA, 22 nt, Pseudomonas aeruginosa PA01
ugcggggaaagcuccucggccu

SEQ ID NO: 3483005 - RNA, 18 nt, Pseudomonas aeruginosa PA01
ugcggggcgaccagcauc

SEQ ID NO: 3483006 - RNA, 15 nt, Pseudomonas aeruginosa PA01
ugcggggcgcucagg

SEQ ID NO: 3483007 - RNA, 17 nt, Pseudomonas aeruginosa PA01
ugcggggcgcucgcccu

SEQ ID NO: 3483008 - RNA, 14 nt, Pseudomonas aeruginosa PA01
ugcggggugaucuu

SEQ ID NO: 3483009 - RNA, 14 nt, Pseudomonas aeruginosa PA01
ugcgggucgaggcc

SEQ ID NO: 3483010 - RNA, 17 nt, Pseudomonas aeruginosa PA01
ugcggguggucgccgcc

SEQ ID NO: 3483011 - RNA, 18 nt, Pseudomonas aeruginosa PA01
ugcggguggucgccgccc

SEQ ID NO: 3483012 - RNA, 15 nt, Pseudomonas aeruginosa PA01
ugcggguugccgcag

SEQ ID NO: 3483013 - RNA, 16 nt, Pseudomonas aeruginosa PA01
ugcggguuggucggca

SEQ ID NO: 3483014 - RNA, 17 nt, Pseudomonas aeruginosa PA01
ugcgguagucgcugcug

SEQ ID NO: 3483015 - RNA, 21 nt, Pseudomonas aeruginosa PA01
ugcggucauccgccggcgcgu

SEQ ID NO: 3483016 - RNA, 22 nt, Pseudomonas aeruginosa PA01
ugcggucauccgccggcgcgua

SEQ ID NO: 3483017 - RNA, 12 nt, Pseudomonas aeruginosa PA01
ugcgguccagcg

SEQ ID NO: 3483018 - RNA, 16 nt, Pseudomonas aeruginosa PA01
ugcgguccagcgagcg

SEQ ID NO: 3483019 - RNA, 19 nt, Pseudomonas aeruginosa PA01
ugcggucgauguccugggc

SEQ ID NO: 3483020 - RNA, 15 nt, Pseudomonas aeruginosa PA01
ugcggucgcgcccgc

SEQ ID NO: 3483021 - RNA, 12 nt, Pseudomonas aeruginosa PA01
ugcggucuuuca

SEQ ID NO: 3483022 - RNA, 16 nt, Pseudomonas aeruginosa PA01
ugcggugccgcgcagc

SEQ ID NO: 3483023 - RNA, 18 nt, Pseudomonas aeruginosa PA01
ugcgguuauccgccgccg

SEQ ID NO: 3483024 - RNA, 23 nt, Pseudomonas aeruginosa PA01
ugcgguuauccgccgccgggcuu

SEQ ID NO: 3483025 - RNA, 17 nt, Pseudomonas aeruginosa PA01
ugcgguuauccgccgug

SEQ ID NO: 3483026 - RNA, 13 nt, Pseudomonas aeruginosa PA01
ugcgguuccuggc

SEQ ID NO: 3483027 - RNA, 20 nt, Pseudomonas aeruginosa PA01
ugcgguugccggagacgaug

SEQ ID NO: 3483028 - RNA, 21 nt, Pseudomonas aeruginosa PA01
ugcgguuuuccugccccgugc

SEQ ID NO: 3483029 - RNA, 14 nt, Pseudomonas aeruginosa PA01
ugcguaccagcgcg

SEQ ID NO: 3483030 - RNA, 15 nt, Pseudomonas aeruginosa PA01
ugcguaccagcgcgc

SEQ ID NO: 3483031 - RNA, 15 nt, Pseudomonas aeruginosa PA01
ugcguagcgacaggc

SEQ ID NO: 3483032 - RNA, 23 nt, Pseudomonas aeruginosa PA01
ugcguagggcgaguaagcgcggu

SEQ ID NO: 3483033 - RNA, 13 nt, Pseudomonas aeruginosa PA01
ugcguccauccag

SEQ ID NO: 3483034 - RNA, 21 nt, Pseudomonas aeruginosa PA01
ugcguccauccaggcuuucca

SEQ ID NO: 3483035 - RNA, 14 nt, Pseudomonas aeruginosa PA01
ugcguccgcgcagg

SEQ ID NO: 3483036 - RNA, 12 nt, Pseudomonas aeruginosa PA01
ugcgucgcacca

SEQ ID NO: 3483037 - RNA, 20 nt, Pseudomonas aeruginosa PA01
ugcgucgcauccaccagcgg

SEQ ID NO: 3483038 - RNA, 20 nt, Pseudomonas aeruginosa PA01
ugcgucgucgcggcgccugg

SEQ ID NO: 3483039 - RNA, 13 nt, Pseudomonas aeruginosa PA01
ugcgucucagcgg

SEQ ID NO: 3483040 - RNA, 19 nt, Pseudomonas aeruginosa PA01
ugcgucuucgccgaugcgc

SEQ ID NO: 3483041 - RNA, 20 nt, Pseudomonas aeruginosa PA01
ugcgugccagggcuucccag

SEQ ID NO: 3483042 - RNA, 21 nt, Pseudomonas aeruginosa PA01
ugcgugccagggcuucccagg

SEQ ID NO: 3483043 - RNA, 21 nt, Pseudomonas aeruginosa PA01
ugcgugcgagggcggcggcuc

SEQ ID NO: 3483044 - RNA, 16 nt, Pseudomonas aeruginosa PA01
ugcgugcgccguagca

SEQ ID NO: 3483045 - RNA, 19 nt, Pseudomonas aeruginosa PA01
ugcgugcguugcgcggcag

SEQ ID NO: 3483046 - RNA, 17 nt, Pseudomonas aeruginosa PA01
ugcguggaaccgcggcg

SEQ ID NO: 3483047 - RNA, 15 nt, Pseudomonas aeruginosa PA01
ugcguggguccacgc

SEQ ID NO: 3483048 - RNA, 18 nt, Pseudomonas aeruginosa PA01
ugcguggugcauccgccg

SEQ ID NO: 3483049 - RNA, 21 nt, Pseudomonas aeruginosa PA01
ugcguggugcauccgccgcag

SEQ ID NO: 3483050 - RNA, 14 nt, Pseudomonas aeruginosa PA01
ugcguguucggcgg

SEQ ID NO: 3483051 - RNA, 13 nt, Pseudomonas aeruginosa PA01
ugcguuccuccuc

SEQ ID NO: 3483052 - RNA, 16 nt, Pseudomonas aeruginosa PA01
ugcguuccuccucguc

SEQ ID NO: 3483053 - RNA, 12 nt, Pseudomonas aeruginosa PA01
ugcguucgccga

SEQ ID NO: 3483054 - RNA, 22 nt, Pseudomonas aeruginosa PA01
ugcguugcucgcaccaggccag

SEQ ID NO: 3483055 - RNA, 16 nt, Pseudomonas aeruginosa PA01
ugcguuucgccgggca

SEQ ID NO: 3483056 - RNA, 18 nt, Pseudomonas aeruginosa PA01
ugcuaugcgccgggccuc

SEQ ID NO: 3483057 - RNA, 23 nt, Pseudomonas aeruginosa PA01
ugcucacgccgaacuuguagggc

SEQ ID NO: 3483058 - RNA, 18 nt, Pseudomonas aeruginosa PA01
ugcucagcacggcgacgg

SEQ ID NO: 3483059 - RNA, 19 nt, Pseudomonas aeruginosa PA01
ugcucagcacggcgacggu

SEQ ID NO: 3483060 - RNA, 15 nt, Pseudomonas aeruginosa PA01
ugcucagccgcgccg

SEQ ID NO: 3483061 - RNA, 16 nt, Pseudomonas aeruginosa PA01
ugcucagccgcgccgg

SEQ ID NO: 3483062 - RNA, 19 nt, Pseudomonas aeruginosa PA01
ugcucagccgcgccggggc

SEQ ID NO: 3483063 - RNA, 16 nt, Pseudomonas aeruginosa PA01
ugcucagcgccggcca

SEQ ID NO: 3483064 - RNA, 19 nt, Pseudomonas aeruginosa PA01
ugcucagcgcgcucggccu

SEQ ID NO: 3483065 - RNA, 22 nt, Pseudomonas aeruginosa PA01
ugcucagcgcgcucggccuggu

SEQ ID NO: 3483066 - RNA, 23 nt, Pseudomonas aeruginosa PA01
ugcucagcgcgcucggccuggug

SEQ ID NO: 3483067 - RNA, 19 nt, Pseudomonas aeruginosa PA01
ugcucagcggcccagcgcc

SEQ ID NO: 3483068 - RNA, 23 nt, Pseudomonas aeruginosa PA01
ugcucagcggcccagcgccccgc

SEQ ID NO: 3483069 - RNA, 19 nt, Pseudomonas aeruginosa PA01
ugcucagcguccucagccu

SEQ ID NO: 3483070 - RNA, 20 nt, Pseudomonas aeruginosa PA01
ugcucaggacguccuggccg

SEQ ID NO: 3483071 - RNA, 22 nt, Pseudomonas aeruginosa PA01
ugcucaggucgaacugcacccg

SEQ ID NO: 3483072 - RNA, 15 nt, Pseudomonas aeruginosa PA01
ugcucauucggccag

SEQ ID NO: 3483073 - RNA, 21 nt, Pseudomonas aeruginosa PA01
ugcucauucggccagcgcggc

SEQ ID NO: 3483074 - RNA, 21 nt, Pseudomonas aeruginosa PA01
ugcuccagaucgcauuguugc

SEQ ID NO: 3483075 - RNA, 22 nt, Pseudomonas aeruginosa PA01
ugcuccagcaccguggcgccau

SEQ ID NO: 3483076 - RNA, 21 nt, Pseudomonas aeruginosa PA01
ugcuccagcagggccagcgcc

SEQ ID NO: 3483077 - RNA, 22 nt, Pseudomonas aeruginosa PA01
ugcuccagcagggccagcgccu

SEQ ID NO: 3483078 - RNA, 14 nt, Pseudomonas aeruginosa PA01
ugcuccagcccggc

SEQ ID NO: 3483079 - RNA, 18 nt, Pseudomonas aeruginosa PA01
ugcuccagcccggcucgg

SEQ ID NO: 3483080 - RNA, 14 nt, Pseudomonas aeruginosa PA01
ugcuccagggagcg

SEQ ID NO: 3483081 - RNA, 18 nt, Pseudomonas aeruginosa PA01
ugcuccagggagcgcucg

SEQ ID NO: 3483082 - RNA, 18 nt, Pseudomonas aeruginosa PA01
ugcuccagguucggcgcc

SEQ ID NO: 3483083 - RNA, 12 nt, Pseudomonas aeruginosa PA01
ugcucccgagca

SEQ ID NO: 3483084 - RNA, 14 nt, Pseudomonas aeruginosa PA01
ugcuccgccuggcg

SEQ ID NO: 3483085 - RNA, 15 nt, Pseudomonas aeruginosa PA01
ugcuccgugucggcg

SEQ ID NO: 3483086 - RNA, 16 nt, Pseudomonas aeruginosa PA01
ugcuccgugucggcgg

SEQ ID NO: 3483087 - RNA, 21 nt, Pseudomonas aeruginosa PA01
ugcuccgugucggcggcgccu

SEQ ID NO: 3483088 - RNA, 23 nt, Pseudomonas aeruginosa PA01
ugcuccguugaacucggcgccca

SEQ ID NO: 3483089 - RNA, 15 nt, Pseudomonas aeruginosa PA01
ugcuccuccaggcuc

SEQ ID NO: 3483090 - RNA, 20 nt, Pseudomonas aeruginosa PA01
ugcuccuccccguccuggcg

SEQ ID NO: 3483091 - RNA, 21 nt, Pseudomonas aeruginosa PA01
ugcuccucggcagcgcuggcg

SEQ ID NO: 3483092 - RNA, 18 nt, Pseudomonas aeruginosa PA01
ugcuccugcaggcccugc

SEQ ID NO: 3483093 - RNA, 17 nt, Pseudomonas aeruginosa PA01
ugcuccugcggcuggcg

SEQ ID NO: 3483094 - RNA, 22 nt, Pseudomonas aeruginosa PA01
ugcuccuuucggaacagcgccu

SEQ ID NO: 3483095 - RNA, 22 nt, Pseudomonas aeruginosa PA01
ugcucgaaagccuccagcagcu

SEQ ID NO: 3483096 - RNA, 15 nt, Pseudomonas aeruginosa PA01
ugcucgaacggcgga

SEQ ID NO: 3483097 - RNA, 22 nt, Pseudomonas aeruginosa PA01
ugcucgaaugcuguuccucguc

SEQ ID NO: 3483098 - RNA, 23 nt, Pseudomonas aeruginosa PA01
ugcucgaccaccucggcgucggc

SEQ ID NO: 3483099 - RNA, 21 nt, Pseudomonas aeruginosa PA01
ugcucgacccgguacagccaa

SEQ ID NO: 3483100 - RNA, 13 nt, Pseudomonas aeruginosa PA01
ugcucgaccgccu

SEQ ID NO: 3483101 - RNA, 15 nt, Pseudomonas aeruginosa PA01
ugcucgacggcacca

SEQ ID NO: 3483102 - RNA, 16 nt, Pseudomonas aeruginosa PA01
ugcucgacggcaccag

SEQ ID NO: 3483103 - RNA, 17 nt, Pseudomonas aeruginosa PA01
ugcucgacggcaccagc

SEQ ID NO: 3483104 - RNA, 18 nt, Pseudomonas aeruginosa PA01
ugcucgacgggcgcuucc

SEQ ID NO: 3483105 - RNA, 21 nt, Pseudomonas aeruginosa PA01
ugcucgagccguuccaggcgg

SEQ ID NO: 3483106 - RNA, 13 nt, Pseudomonas aeruginosa PA01
ugcucgaggaagc

SEQ ID NO: 3483107 - RNA, 15 nt, Pseudomonas aeruginosa PA01
ugcucgaggauggca

SEQ ID NO: 3483108 - RNA, 18 nt, Pseudomonas aeruginosa PA01
ugcucgaucaaccccugg

SEQ ID NO: 3483109 - RNA, 15 nt, Pseudomonas aeruginosa PA01
ugcucgauccagccg

SEQ ID NO: 3483110 - RNA, 17 nt, Pseudomonas aeruginosa PA01
ugcucgauccagccggc

SEQ ID NO: 3483111 - RNA, 15 nt, Pseudomonas aeruginosa PA01
ugcucgaugaucgac

SEQ ID NO: 3483112 - RNA, 18 nt, Pseudomonas aeruginosa PA01
ugcucgauggcggccugg

SEQ ID NO: 3483113 - RNA, 20 nt, Pseudomonas aeruginosa PA01
ugcucgauggcggccuggua

SEQ ID NO: 3483114 - RNA, 21 nt, Pseudomonas aeruginosa PA01
ugcucgauggcggccugguag

SEQ ID NO: 3483115 - RNA, 17 nt, Pseudomonas aeruginosa PA01
ugcucgcaccaggccag

SEQ ID NO: 3483116 - RNA, 15 nt, Pseudomonas aeruginosa PA01
ugcucgccgcugaag

SEQ ID NO: 3483117 - RNA, 14 nt, Pseudomonas aeruginosa PA01
ugcucgccggcgcg

SEQ ID NO: 3483118 - RNA, 19 nt, Pseudomonas aeruginosa PA01
ugcucgccucgggccauga

SEQ ID NO: 3483119 - RNA, 19 nt, Pseudomonas aeruginosa PA01
ugcucgccugguaggcggc

SEQ ID NO: 3483120 - RNA, 21 nt, Pseudomonas aeruginosa PA01
ugcucgccugguaggcggcga

SEQ ID NO: 3483121 - RNA, 13 nt, Pseudomonas aeruginosa PA01
ugcucgcgcaccg

SEQ ID NO: 3483122 - RNA, 17 nt, Pseudomonas aeruginosa PA01
ugcucgcgcaccgcggc

SEQ ID NO: 3483123 - RNA, 18 nt, Pseudomonas aeruginosa PA01
ugcucgcgcaccgcggcc

SEQ ID NO: 3483124 - RNA, 19 nt, Pseudomonas aeruginosa PA01
ugcucgcgcaccgcggcca

SEQ ID NO: 3483125 - RNA, 14 nt, Pseudomonas aeruginosa PA01
ugcucgcgcagcca

SEQ ID NO: 3483126 - RNA, 22 nt, Pseudomonas aeruginosa PA01
ugcucgcgcagccaggcgagga

SEQ ID NO: 3483127 - RNA, 24 nt, Pseudomonas aeruginosa PA01
ugcucgcgcaugaucgccucggcg

SEQ ID NO: 3483128 - RNA, 19 nt, Pseudomonas aeruginosa PA01
ugcucgcggaccagcuccg

SEQ ID NO: 3483129 - RNA, 17 nt, Pseudomonas aeruginosa PA01
ugcucgcggcuggccgc

SEQ ID NO: 3483130 - RNA, 13 nt, Pseudomonas aeruginosa PA01
ugcucgcuccgag

SEQ ID NO: 3483131 - RNA, 19 nt, Pseudomonas aeruginosa PA01
ugcucgcuccgagcaggcc

SEQ ID NO: 3483132 - RNA, 19 nt, Pseudomonas aeruginosa PA01
ugcucggaaaccucgccgg

SEQ ID NO: 3483133 - RNA, 11 nt, Pseudomonas aeruginosa PA01
ugcucggccag

SEQ ID NO: 3483134 - RNA, 15 nt, Pseudomonas aeruginosa PA01
ugcucggccagcgcc

SEQ ID NO: 3483135 - RNA, 15 nt, Pseudomonas aeruginosa PA01
ugcucggccagcucg

SEQ ID NO: 3483136 - RNA, 18 nt, Pseudomonas aeruginosa PA01
ugcucggccagcucgccg

SEQ ID NO: 3483137 - RNA, 19 nt, Pseudomonas aeruginosa PA01
ugcucggccagcucgccga

SEQ ID NO: 3483138 - RNA, 17 nt, Pseudomonas aeruginosa PA01
ugcucggccugaucauc

SEQ ID NO: 3483139 - RNA, 20 nt, Pseudomonas aeruginosa PA01
ugcucggccugcugcgccgg

SEQ ID NO: 3483140 - RNA, 23 nt, Pseudomonas aeruginosa PA01
ugcucggcgaucucgcccagggc

SEQ ID NO: 3483141 - RNA, 20 nt, Pseudomonas aeruginosa PA01
ugcucggcgcccuggguggu

SEQ ID NO: 3483142 - RNA, 15 nt, Pseudomonas aeruginosa PA01
ugcucggcucgcggu

SEQ ID NO: 3483143 - RNA, 16 nt, Pseudomonas aeruginosa PA01
ugcucgggcgucuccu

SEQ ID NO: 3483144 - RNA, 12 nt, Pseudomonas aeruginosa PA01
ugcucggggccg

SEQ ID NO: 3483145 - RNA, 16 nt, Pseudomonas aeruginosa PA01
ugcucggggucgucgc

SEQ ID NO: 3483146 - RNA, 20 nt, Pseudomonas aeruginosa PA01
ugcucgguauggcugcugug

SEQ ID NO: 3483147 - RNA, 21 nt, Pseudomonas aeruginosa PA01
ugcucggugugaucaccagcc

SEQ ID NO: 3483148 - RNA, 17 nt, Pseudomonas aeruginosa PA01
ugcucgguugccaggcc

SEQ ID NO: 3483149 - RNA, 18 nt, Pseudomonas aeruginosa PA01
ugcucgguugccaggccg

SEQ ID NO: 3483150 - RNA, 14 nt, Pseudomonas aeruginosa PA01
ugcucguccaggcc

SEQ ID NO: 3483151 - RNA, 17 nt, Pseudomonas aeruginosa PA01
ugcucguccaggccgca

SEQ ID NO: 3483152 - RNA, 18 nt, Pseudomonas aeruginosa PA01
ugcucgucgaugcugccg

SEQ ID NO: 3483153 - RNA, 16 nt, Pseudomonas aeruginosa PA01
ugcucgugcagguagc

SEQ ID NO: 3483154 - RNA, 23 nt, Pseudomonas aeruginosa PA01
ugcucgugcagguagccgcgccg

SEQ ID NO: 3483155 - RNA, 18 nt, Pseudomonas aeruginosa PA01
ugcucuccacuaccgccg

SEQ ID NO: 3483156 - RNA, 17 nt, Pseudomonas aeruginosa PA01
ugcucugggcauggcug

SEQ ID NO: 3483157 - RNA, 13 nt, Pseudomonas aeruginosa PA01
ugcucuuccagcg

SEQ ID NO: 3483158 - RNA, 20 nt, Pseudomonas aeruginosa PA01
ugcucuucgauugucuccag

SEQ ID NO: 3483159 - RNA, 19 nt, Pseudomonas aeruginosa PA01
ugcucuucuggcugaucag

SEQ ID NO: 3483160 - RNA, 20 nt, Pseudomonas aeruginosa PA01
ugcucuugaggucggcgcgc

SEQ ID NO: 3483161 - RNA, 18 nt, Pseudomonas aeruginosa PA01
ugcugaacaucagguucc

SEQ ID NO: 3483162 - RNA, 17 nt, Pseudomonas aeruginosa PA01
ugcugaagccccagucc

SEQ ID NO: 3483163 - RNA, 14 nt, Pseudomonas aeruginosa PA01
ugcugacguugagg

SEQ ID NO: 3483164 - RNA, 17 nt, Pseudomonas aeruginosa PA01
ugcugagcagucgccug

SEQ ID NO: 3483165 - RNA, 22 nt, Pseudomonas aeruginosa PA01
ugcugagcagucgccuggcccu

SEQ ID NO: 3483166 - RNA, 23 nt, Pseudomonas aeruginosa PA01
ugcugagcagucgccuggcccug

SEQ ID NO: 3483167 - RNA, 16 nt, Pseudomonas aeruginosa PA01
ugcugauaagcucggc

SEQ ID NO: 3483168 - RNA, 14 nt, Pseudomonas aeruginosa PA01
ugcugaucacccgc

SEQ ID NO: 3483169 - RNA, 14 nt, Pseudomonas aeruginosa PA01
ugcugaucaggagg

SEQ ID NO: 3483170 - RNA, 14 nt, Pseudomonas aeruginosa PA01
ugcugcaccgggag

SEQ ID NO: 3483171 - RNA, 20 nt, Pseudomonas aeruginosa PA01
ugcugcagcaucaggcgcuc

SEQ ID NO: 3483172 - RNA, 13 nt, Pseudomonas aeruginosa PA01
ugcugcagggccu

SEQ ID NO: 3483173 - RNA, 18 nt, Pseudomonas aeruginosa PA01
ugcugcagguggcguugc

SEQ ID NO: 3483174 - RNA, 21 nt, Pseudomonas aeruginosa PA01
ugcugcccggagcggcugccg

SEQ ID NO: 3483175 - RNA, 12 nt, Pseudomonas aeruginosa PA01
ugcugcccuggc

SEQ ID NO: 3483176 - RNA, 14 nt, Pseudomonas aeruginosa PA01
ugcugccgaggccg

SEQ ID NO: 3483177 - RNA, 16 nt, Pseudomonas aeruginosa PA01
ugcugccggcuugcug

SEQ ID NO: 3483178 - RNA, 17 nt, Pseudomonas aeruginosa PA01
ugcugccggcuugcugc

SEQ ID NO: 3483179 - RNA, 13 nt, Pseudomonas aeruginosa PA01
ugcugccguagcg

SEQ ID NO: 3483180 - RNA, 17 nt, Pseudomonas aeruginosa PA01
ugcugccguagcgcuuc

SEQ ID NO: 3483181 - RNA, 20 nt, Pseudomonas aeruginosa PA01
ugcugcgccggcacggcauc

SEQ ID NO: 3483182 - RNA, 14 nt, Pseudomonas aeruginosa PA01
ugcugcgccuggcc

SEQ ID NO: 3483183 - RNA, 20 nt, Pseudomonas aeruginosa PA01
ugcugcgccuggccgcgcag

SEQ ID NO: 3483184 - RNA, 14 nt, Pseudomonas aeruginosa PA01
ugcugcgcgcacca

SEQ ID NO: 3483185 - RNA, 15 nt, Pseudomonas aeruginosa PA01
ugcugcgcgcggccc

SEQ ID NO: 3483186 - RNA, 16 nt, Pseudomonas aeruginosa PA01
ugcugcgcgggugucg

SEQ ID NO: 3483187 - RNA, 23 nt, Pseudomonas aeruginosa PA01
ugcugcgcguguacccccaccgg

SEQ ID NO: 3483188 - RNA, 12 nt, Pseudomonas aeruginosa PA01
ugcugcggcaac

SEQ ID NO: 3483189 - RNA, 18 nt, Pseudomonas aeruginosa PA01
ugcugcggcaacgacggc

SEQ ID NO: 3483190 - RNA, 15 nt, Pseudomonas aeruginosa PA01
ugcugcggcagguag

SEQ ID NO: 3483191 - RNA, 12 nt, Pseudomonas aeruginosa PA01
ugcugcgggcgc

SEQ ID NO: 3483192 - RNA, 21 nt, Pseudomonas aeruginosa PA01
ugcugcgggcgccgccgcugg

SEQ ID NO: 3483193 - RNA, 15 nt, Pseudomonas aeruginosa PA01
ugcugcggggccgga

SEQ ID NO: 3483194 - RNA, 17 nt, Pseudomonas aeruginosa PA01
ugcugcggggccugcug

SEQ ID NO: 3483195 - RNA, 18 nt, Pseudomonas aeruginosa PA01
ugcugcggggccugcugc

SEQ ID NO: 3483196 - RNA, 19 nt, Pseudomonas aeruginosa PA01
ugcugcggggccugcugcg

SEQ ID NO: 3483197 - RNA, 24 nt, Pseudomonas aeruginosa PA01
ugcugcuccaucaguugcgcgcgg

SEQ ID NO: 3483198 - RNA, 18 nt, Pseudomonas aeruginosa PA01
ugcugcucgaccgccugc

SEQ ID NO: 3483199 - RNA, 15 nt, Pseudomonas aeruginosa PA01
ugcugcucgcagagg

SEQ ID NO: 3483200 - RNA, 19 nt, Pseudomonas aeruginosa PA01
ugcugcugaucaggaggau

SEQ ID NO: 3483201 - RNA, 15 nt, Pseudomonas aeruginosa PA01
ugcugcugcggcuuc

SEQ ID NO: 3483202 - RNA, 14 nt, Pseudomonas aeruginosa PA01
ugcugcugcggggc

SEQ ID NO: 3483203 - RNA, 16 nt, Pseudomonas aeruginosa PA01
ugcugcugcggggccu

SEQ ID NO: 3483204 - RNA, 13 nt, Pseudomonas aeruginosa PA01
ugcugcuggccuu

SEQ ID NO: 3483205 - RNA, 16 nt, Pseudomonas aeruginosa PA01
ugcuggacucgcgcca

SEQ ID NO: 3483206 - RNA, 18 nt, Pseudomonas aeruginosa PA01
ugcuggacuucccggcgu

SEQ ID NO: 3483207 - RNA, 16 nt, Pseudomonas aeruginosa PA01
ugcuggauccucgccu

SEQ ID NO: 3483208 - RNA, 17 nt, Pseudomonas aeruginosa PA01
ugcuggauccucgccuc

SEQ ID NO: 3483209 - RNA, 14 nt, Pseudomonas aeruginosa PA01
ugcuggauggggcu

SEQ ID NO: 3483210 - RNA, 12 nt, Pseudomonas aeruginosa PA01
ugcuggccaccc

SEQ ID NO: 3483211 - RNA, 20 nt, Pseudomonas aeruginosa PA01
ugcuggccacccuugcgucc

SEQ ID NO: 3483212 - RNA, 23 nt, Pseudomonas aeruginosa PA01
ugcuggccacccuugcguccugc

SEQ ID NO: 3483213 - RNA, 15 nt, Pseudomonas aeruginosa PA01
ugcuggccaccgcgg

SEQ ID NO: 3483214 - RNA, 12 nt, Pseudomonas aeruginosa PA01
ugcuggccgccc

SEQ ID NO: 3483215 - RNA, 13 nt, Pseudomonas aeruginosa PA01
ugcuggccgcgca

SEQ ID NO: 3483216 - RNA, 14 nt, Pseudomonas aeruginosa PA01
ugcuggccggcagc

SEQ ID NO: 3483217 - RNA, 11 nt, Pseudomonas aeruginosa PA01
ugcuggccggu

SEQ ID NO: 3483218 - RNA, 12 nt, Pseudomonas aeruginosa PA01
ugcuggccuggg

SEQ ID NO: 3483219 - RNA, 17 nt, Pseudomonas aeruginosa PA01
ugcuggccuucgucggc

SEQ ID NO: 3483220 - RNA, 22 nt, Pseudomonas aeruginosa PA01
ugcuggcgcaacagaucuuccu

SEQ ID NO: 3483221 - RNA, 18 nt, Pseudomonas aeruginosa PA01
ugcuggcgcagccaggcg

SEQ ID NO: 3483222 - RNA, 16 nt, Pseudomonas aeruginosa PA01
ugcuggcgccgcuggc

SEQ ID NO: 3483223 - RNA, 22 nt, Pseudomonas aeruginosa PA01
ugcuggcggauguaguccagcg

SEQ ID NO: 3483224 - RNA, 22 nt, Pseudomonas aeruginosa PA01
ugcuggcuguaggugcccggcg

SEQ ID NO: 3483225 - RNA, 12 nt, Pseudomonas aeruginosa PA01
ugcugggccagc

SEQ ID NO: 3483226 - RNA, 18 nt, Pseudomonas aeruginosa PA01
ugcugggccuugaucacc

SEQ ID NO: 3483227 - RNA, 13 nt, Pseudomonas aeruginosa PA01
ugcugggcggcga

SEQ ID NO: 3483228 - RNA, 21 nt, Pseudomonas aeruginosa PA01
ugcugggcggcgaggccgacc

SEQ ID NO: 3483229 - RNA, 23 nt, Pseudomonas aeruginosa PA01
ugcuggggaacugggcgagcauc

SEQ ID NO: 3483230 - RNA, 17 nt, Pseudomonas aeruginosa PA01
ugcuggguacgguuggc

SEQ ID NO: 3483231 - RNA, 23 nt, Pseudomonas aeruginosa PA01
ugcuggguacgguuggccagcga

SEQ ID NO: 3483232 - RNA, 15 nt, Pseudomonas aeruginosa PA01
ugcugggucuccgcu

SEQ ID NO: 3483233 - RNA, 14 nt, Pseudomonas aeruginosa PA01
ugcugggucuccuc

SEQ ID NO: 3483234 - RNA, 19 nt, Pseudomonas aeruginosa PA01
ugcugguagcugcugccgg

SEQ ID NO: 3483235 - RNA, 19 nt, Pseudomonas aeruginosa PA01
ugcugguagugcuggcgca

SEQ ID NO: 3483236 - RNA, 17 nt, Pseudomonas aeruginosa PA01
ugcugguccuggcgcga

SEQ ID NO: 3483237 - RNA, 14 nt, Pseudomonas aeruginosa PA01
ugcuggugcggccg

SEQ ID NO: 3483238 - RNA, 17 nt, Pseudomonas aeruginosa PA01
ugcugguggcccugggc

SEQ ID NO: 3483239 - RNA, 17 nt, Pseudomonas aeruginosa PA01
ugcugguugaagccgau

SEQ ID NO: 3483240 - RNA, 21 nt, Pseudomonas aeruginosa PA01
ugcuguaguugacgucgccga

SEQ ID NO: 3483241 - RNA, 22 nt, Pseudomonas aeruginosa PA01
ugcuguaguugacgucgccgau

SEQ ID NO: 3483242 - RNA, 16 nt, Pseudomonas aeruginosa PA01
ugcuguauuccuugcg

SEQ ID NO: 3483243 - RNA, 13 nt, Pseudomonas aeruginosa PA01
ugcugucccaacc

SEQ ID NO: 3483244 - RNA, 23 nt, Pseudomonas aeruginosa PA01
ugcugucccaaccguucugccgc

SEQ ID NO: 3483245 - RNA, 22 nt, Pseudomonas aeruginosa PA01
ugcugugcagggaggcauugca

SEQ ID NO: 3483246 - RNA, 12 nt, Pseudomonas aeruginosa PA01
ugcugugcucuu

SEQ ID NO: 3483247 - RNA, 14 nt, Pseudomonas aeruginosa PA01
ugcugugcugcacc

SEQ ID NO: 3483248 - RNA, 14 nt, Pseudomonas aeruginosa PA01
ugcuguggagccgg

SEQ ID NO: 3483249 - RNA, 15 nt, Pseudomonas aeruginosa PA01
ugcuguguccggcgg

SEQ ID NO: 3483250 - RNA, 21 nt, Pseudomonas aeruginosa PA01
ugcuguucagcgggugccgaa

SEQ ID NO: 3483251 - RNA, 14 nt, Pseudomonas aeruginosa PA01
ugcuguuccucguc

SEQ ID NO: 3483252 - RNA, 15 nt, Pseudomonas aeruginosa PA01
ugcuguugccguggc

SEQ ID NO: 3483253 - RNA, 16 nt, Pseudomonas aeruginosa PA01
ugcuguugccguggcg

SEQ ID NO: 3483254 - RNA, 23 nt, Pseudomonas aeruginosa PA01
ugcuguuguugccggucuugccg

SEQ ID NO: 3483255 - RNA, 20 nt, Pseudomonas aeruginosa PA01
ugcuuacaagagcagacaca

SEQ ID NO: 3483256 - RNA, 20 nt, Pseudomonas aeruginosa PA01
ugcuuaccuugccggugcgg

SEQ ID NO: 3483257 - RNA, 18 nt, Pseudomonas aeruginosa PA01
ugcuucagcccggcacca

SEQ ID NO: 3483258 - RNA, 22 nt, Pseudomonas aeruginosa PA01
ugcuucagcccggcaccaggcc

SEQ ID NO: 3483259 - RNA, 16 nt, Pseudomonas aeruginosa PA01
ugcuucaggcgcgcgg

SEQ ID NO: 3483260 - RNA, 19 nt, Pseudomonas aeruginosa PA01
ugcuucaggcgcgcggcca

SEQ ID NO: 3483261 - RNA, 16 nt, Pseudomonas aeruginosa PA01
ugcuucagguagugca

SEQ ID NO: 3483262 - RNA, 23 nt, Pseudomonas aeruginosa PA01
ugcuucagguagugcaacaccug

SEQ ID NO: 3483263 - RNA, 18 nt, Pseudomonas aeruginosa PA01
ugcuucaucggcccggcu

SEQ ID NO: 3483264 - RNA, 21 nt, Pseudomonas aeruginosa PA01
ugcuucaugaagucagccagg

SEQ ID NO: 3483265 - RNA, 16 nt, Pseudomonas aeruginosa PA01
ugcuuccguaggugga

SEQ ID NO: 3483266 - RNA, 12 nt, Pseudomonas aeruginosa PA01
ugcuucucggcu

SEQ ID NO: 3483267 - RNA, 21 nt, Pseudomonas aeruginosa PA01
ugcuucugguugcucaccaau

SEQ ID NO: 3483268 - RNA, 16 nt, Pseudomonas aeruginosa PA01
ugcuugaccgccgccu

SEQ ID NO: 3483269 - RNA, 15 nt, Pseudomonas aeruginosa PA01
ugcuugaccuugcuc

SEQ ID NO: 3483270 - RNA, 17 nt, Pseudomonas aeruginosa PA01
ugcuugacgaaggcggc

SEQ ID NO: 3483271 - RNA, 20 nt, Pseudomonas aeruginosa PA01
ugcuugacgaaggcggcagc

SEQ ID NO: 3483272 - RNA, 16 nt, Pseudomonas aeruginosa PA01
ugcuugaucgccagcc

SEQ ID NO: 3483273 - RNA, 14 nt, Pseudomonas aeruginosa PA01
ugcuugccgcucag

SEQ ID NO: 3483274 - RNA, 12 nt, Pseudomonas aeruginosa PA01
ugcuugccggcg

SEQ ID NO: 3483275 - RNA, 15 nt, Pseudomonas aeruginosa PA01
ugcuugccggcgccu

SEQ ID NO: 3483276 - RNA, 16 nt, Pseudomonas aeruginosa PA01
ugcuugcgcgccgccg

SEQ ID NO: 3483277 - RNA, 22 nt, Pseudomonas aeruginosa PA01
ugcuugcgcgccgccgccgcgg

SEQ ID NO: 3483278 - RNA, 16 nt, Pseudomonas aeruginosa PA01
ugcuugcgcgcggcgu

SEQ ID NO: 3483279 - RNA, 17 nt, Pseudomonas aeruginosa PA01
ugcuugcgcgcggcguc

SEQ ID NO: 3483280 - RNA, 16 nt, Pseudomonas aeruginosa PA01
ugcuugcgcucgagcc

SEQ ID NO: 3483281 - RNA, 13 nt, Pseudomonas aeruginosa PA01
ugcuuggccaggc

SEQ ID NO: 3483282 - RNA, 14 nt, Pseudomonas aeruginosa PA01
ugcuuggcgaggcg

SEQ ID NO: 3483283 - RNA, 23 nt, Pseudomonas aeruginosa PA01
ugcuuguccuuccagcucucgcu

SEQ ID NO: 3483284 - RNA, 15 nt, Pseudomonas aeruginosa PA01
ugcuuguguccgccg

SEQ ID NO: 3483285 - RNA, 16 nt, Pseudomonas aeruginosa PA01
ugcuuguguccgccga

SEQ ID NO: 3483286 - RNA, 22 nt, Pseudomonas aeruginosa PA01
uggaaaaguuuuucgcggcgcg

SEQ ID NO: 3483287 - RNA, 18 nt, Pseudomonas aeruginosa PA01
uggaaaccccggccuggc

SEQ ID NO: 3483288 - RNA, 17 nt, Pseudomonas aeruginosa PA01
uggaaaccucgccgauc

SEQ ID NO: 3483289 - RNA, 13 nt, Pseudomonas aeruginosa PA01
uggaaacgcccau

SEQ ID NO: 3483290 - RNA, 16 nt, Pseudomonas aeruginosa PA01
uggaaaggccucggcg

SEQ ID NO: 3483291 - RNA, 17 nt, Pseudomonas aeruginosa PA01
uggaacagcagccaggc

SEQ ID NO: 3483292 - RNA, 17 nt, Pseudomonas aeruginosa PA01
uggaacagcgcgucgcg

SEQ ID NO: 3483293 - RNA, 23 nt, Pseudomonas aeruginosa PA01
uggaacccgcuucgucggucgcg

SEQ ID NO: 3483294 - RNA, 12 nt, Pseudomonas aeruginosa PA01
uggaaccgaggg

SEQ ID NO: 3483295 - RNA, 21 nt, Pseudomonas aeruginosa PA01
uggaaccgaggguacguucca

SEQ ID NO: 3483296 - RNA, 20 nt, Pseudomonas aeruginosa PA01
uggaaccgauggccaggggg

SEQ ID NO: 3483297 - RNA, 13 nt, Pseudomonas aeruginosa PA01
uggaaccgcggcg

SEQ ID NO: 3483298 - RNA, 18 nt, Pseudomonas aeruginosa PA01
uggaacgaggcgacccgg

SEQ ID NO: 3483299 - RNA, 22 nt, Pseudomonas aeruginosa PA01
uggaacuagcccucgaccuggc

SEQ ID NO: 3483300 - RNA, 22 nt, Pseudomonas aeruginosa PA01
uggaacuggucggggcgcaagg

SEQ ID NO: 3483301 - RNA, 15 nt, Pseudomonas aeruginosa PA01
uggaagaaggcgauc

SEQ ID NO: 3483302 - RNA, 21 nt, Pseudomonas aeruginosa PA01
uggaagaaggcgaucaucgcc

SEQ ID NO: 3483303 - RNA, 22 nt, Pseudomonas aeruginosa PA01
uggaagaaggcgaucaucgcca

SEQ ID NO: 3483304 - RNA, 14 nt, Pseudomonas aeruginosa PA01
uggaagagcgccgc

SEQ ID NO: 3483305 - RNA, 16 nt, Pseudomonas aeruginosa PA01
uggaagagcgccgcgg

SEQ ID NO: 3483306 - RNA, 18 nt, Pseudomonas aeruginosa PA01
uggaagagcgccgcggcg

SEQ ID NO: 3483307 - RNA, 19 nt, Pseudomonas aeruginosa PA01
uggaagagcgccgcggcgg

SEQ ID NO: 3483308 - RNA, 16 nt, Pseudomonas aeruginosa PA01
uggaagaggaucgcga

SEQ ID NO: 3483309 - RNA, 18 nt, Pseudomonas aeruginosa PA01
uggaagaggaucgcgaag

SEQ ID NO: 3483310 - RNA, 19 nt, Pseudomonas aeruginosa PA01
uggaagaggaucuccuggc

SEQ ID NO: 3483311 - RNA, 18 nt, Pseudomonas aeruginosa PA01
uggaagccgaucggcaug

SEQ ID NO: 3483312 - RNA, 20 nt, Pseudomonas aeruginosa PA01
uggaagccgaucggcauguu

SEQ ID NO: 3483313 - RNA, 14 nt, Pseudomonas aeruginosa PA01
uggaagccguggcg

SEQ ID NO: 3483314 - RNA, 18 nt, Pseudomonas aeruginosa PA01
uggaaggaucgagccagc

SEQ ID NO: 3483315 - RNA, 21 nt, Pseudomonas aeruginosa PA01
uggaaggcgcugggcggcugg

SEQ ID NO: 3483316 - RNA, 22 nt, Pseudomonas aeruginosa PA01
uggaaguauugcuccacccgca

SEQ ID NO: 3483317 - RNA, 15 nt, Pseudomonas aeruginosa PA01
uggaagucguccagc

SEQ ID NO: 3483318 - RNA, 17 nt, Pseudomonas aeruginosa PA01
uggaaguugccgccagc

SEQ ID NO: 3483319 - RNA, 19 nt, Pseudomonas aeruginosa PA01
uggaaguugccgccagcgc

SEQ ID NO: 3483320 - RNA, 15 nt, Pseudomonas aeruginosa PA01
uggaauccagggccg

SEQ ID NO: 3483321 - RNA, 16 nt, Pseudomonas aeruginosa PA01
uggaauccagggccga

SEQ ID NO: 3483322 - RNA, 21 nt, Pseudomonas aeruginosa PA01
uggaaugccggccggggccgg

SEQ ID NO: 3483323 - RNA, 21 nt, Pseudomonas aeruginosa PA01
uggaauguccugccgcaggcg

SEQ ID NO: 3483324 - RNA, 15 nt, Pseudomonas aeruginosa PA01
uggaauucgccgcgc

SEQ ID NO: 3483325 - RNA, 15 nt, Pseudomonas aeruginosa PA01
uggaauugcugacgg

SEQ ID NO: 3483326 - RNA, 18 nt, Pseudomonas aeruginosa PA01
uggacaagcgucgccggc

SEQ ID NO: 3483327 - RNA, 20 nt, Pseudomonas aeruginosa PA01
uggacaagguuugcgccgcc

SEQ ID NO: 3483328 - RNA, 20 nt, Pseudomonas aeruginosa PA01
uggacaccgaugccgaaggc

SEQ ID NO: 3483329 - RNA, 21 nt, Pseudomonas aeruginosa PA01
uggacaccgaugccgaaggcg

SEQ ID NO: 3483330 - RNA, 16 nt, Pseudomonas aeruginosa PA01
uggacaccucccgggc

SEQ ID NO: 3483331 - RNA, 19 nt, Pseudomonas aeruginosa PA01
uggacagcucgcgggacag

SEQ ID NO: 3483332 - RNA, 16 nt, Pseudomonas aeruginosa PA01
uggacagcuuggccag

SEQ ID NO: 3483333 - RNA, 17 nt, Pseudomonas aeruginosa PA01
uggacaggcgccccugg

SEQ ID NO: 3483334 - RNA, 21 nt, Pseudomonas aeruginosa PA01
uggacaggcgccccugguccu

SEQ ID NO: 3483335 - RNA, 22 nt, Pseudomonas aeruginosa PA01
uggacaggucgacggcccugac

SEQ ID NO: 3483336 - RNA, 21 nt, Pseudomonas aeruginosa PA01
uggacauacaggcgcgccugg

SEQ ID NO: 3483337 - RNA, 22 nt, Pseudomonas aeruginosa PA01
uggacaucccgggguugcccag

SEQ ID NO: 3483338 - RNA, 23 nt, Pseudomonas aeruginosa PA01
uggacaucccgggguugcccagc

SEQ ID NO: 3483339 - RNA, 16 nt, Pseudomonas aeruginosa PA01
uggaccaacagccggc

SEQ ID NO: 3483340 - RNA, 15 nt, Pseudomonas aeruginosa PA01
uggaccaccguggcg

SEQ ID NO: 3483341 - RNA, 17 nt, Pseudomonas aeruginosa PA01
uggaccaccguggcgcc

SEQ ID NO: 3483342 - RNA, 19 nt, Pseudomonas aeruginosa PA01
uggaccaccguggcgccgg

SEQ ID NO: 3483343 - RNA, 13 nt, Pseudomonas aeruginosa PA01
uggaccagcgccg

SEQ ID NO: 3483344 - RNA, 16 nt, Pseudomonas aeruginosa PA01
uggaccagcgccgcca

SEQ ID NO: 3483345 - RNA, 18 nt, Pseudomonas aeruginosa PA01
uggaccaggcggccggug

SEQ ID NO: 3483346 - RNA, 15 nt, Pseudomonas aeruginosa PA01
uggaccauggccggc

SEQ ID NO: 3483347 - RNA, 13 nt, Pseudomonas aeruginosa PA01
uggacccgggccu

SEQ ID NO: 3483348 - RNA, 13 nt, Pseudomonas aeruginosa PA01
uggacccgugcgc

SEQ ID NO: 3483349 - RNA, 16 nt, Pseudomonas aeruginosa PA01
uggaccggcucgucgg

SEQ ID NO: 3483350 - RNA, 13 nt, Pseudomonas aeruginosa PA01
uggaccuccgcca

SEQ ID NO: 3483351 - RNA, 15 nt, Pseudomonas aeruginosa PA01
uggaccuccgccagg

SEQ ID NO: 3483352 - RNA, 14 nt, Pseudomonas aeruginosa PA01
uggaccuggccggc

SEQ ID NO: 3483353 - RNA, 13 nt, Pseudomonas aeruginosa PA01
uggacgaaccaga

SEQ ID NO: 3483354 - RNA, 16 nt, Pseudomonas aeruginosa PA01
uggacgccggugaccc

SEQ ID NO: 3483355 - RNA, 20 nt, Pseudomonas aeruginosa PA01
uggacgcgcuuguccuccag

SEQ ID NO: 3483356 - RNA, 13 nt, Pseudomonas aeruginosa PA01
uggacgcggccug

SEQ ID NO: 3483357 - RNA, 18 nt, Pseudomonas aeruginosa PA01
uggacgcggccugggccg

SEQ ID NO: 3483358 - RNA, 23 nt, Pseudomonas aeruginosa PA01
uggacgcggccugggccgaaggc

SEQ ID NO: 3483359 - RNA, 23 nt, Pseudomonas aeruginosa PA01
uggacggacagggaaagccccgc

SEQ ID NO: 3483360 - RNA, 18 nt, Pseudomonas aeruginosa PA01
uggacggucucgccgccg

SEQ ID NO: 3483361 - RNA, 21 nt, Pseudomonas aeruginosa PA01
uggacggucucgccgccgagc

SEQ ID NO: 3483362 - RNA, 12 nt, Pseudomonas aeruginosa PA01
uggacgguuccc

SEQ ID NO: 3483363 - RNA, 15 nt, Pseudomonas aeruginosa PA01
uggacgucgucggcg

SEQ ID NO: 3483364 - RNA, 13 nt, Pseudomonas aeruginosa PA01
uggacgugcagga

SEQ ID NO: 3483365 - RNA, 17 nt, Pseudomonas aeruginosa PA01
uggacgugggaaaucac

SEQ ID NO: 3483366 - RNA, 14 nt, Pseudomonas aeruginosa PA01
uggacucgcgccag

SEQ ID NO: 3483367 - RNA, 17 nt, Pseudomonas aeruginosa PA01
uggacuucggucucguc

SEQ ID NO: 3483368 - RNA, 14 nt, Pseudomonas aeruginosa PA01
uggacuugucgaag

SEQ ID NO: 3483369 - RNA, 20 nt, Pseudomonas aeruginosa PA01
uggagaacguugcccaccga

SEQ ID NO: 3483370 - RNA, 18 nt, Pseudomonas aeruginosa PA01
uggagaaugaaaaaggga

SEQ ID NO: 3483371 - RNA, 16 nt, Pseudomonas aeruginosa PA01
uggagaggucgccgac

SEQ ID NO: 3483372 - RNA, 12 nt, Pseudomonas aeruginosa PA01
uggagaugccga

SEQ ID NO: 3483373 - RNA, 18 nt, Pseudomonas aeruginosa PA01
uggagaugcucaggcgcu

SEQ ID NO: 3483374 - RNA, 19 nt, Pseudomonas aeruginosa PA01
uggagaugcucaggcgcug

SEQ ID NO: 3483375 - RNA, 21 nt, Pseudomonas aeruginosa PA01
uggagcagaaccgccagcagu

SEQ ID NO: 3483376 - RNA, 21 nt, Pseudomonas aeruginosa PA01
uggagcagaacuugcgcaccg

SEQ ID NO: 3483377 - RNA, 23 nt, Pseudomonas aeruginosa PA01
uggagccgcccucggggccgagg

SEQ ID NO: 3483378 - RNA, 12 nt, Pseudomonas aeruginosa PA01
uggagcgcugcg

SEQ ID NO: 3483379 - RNA, 14 nt, Pseudomonas aeruginosa PA01
uggagcggaucacg

SEQ ID NO: 3483380 - RNA, 15 nt, Pseudomonas aeruginosa PA01
uggagcgggcgccgg

SEQ ID NO: 3483381 - RNA, 21 nt, Pseudomonas aeruginosa PA01
uggagcugcgcgcgaucacau

SEQ ID NO: 3483382 - RNA, 14 nt, Pseudomonas aeruginosa PA01
uggaggacgcgggc

SEQ ID NO: 3483383 - RNA, 21 nt, Pseudomonas aeruginosa PA01
uggaggaucuccaacuggcgg

SEQ ID NO: 3483384 - RNA, 12 nt, Pseudomonas aeruginosa PA01
uggaggcccaga

SEQ ID NO: 3483385 - RNA, 13 nt, Pseudomonas aeruginosa PA01
uggaggcgucggc

SEQ ID NO: 3483386 - RNA, 16 nt, Pseudomonas aeruginosa PA01
uggaggucugccacca

SEQ ID NO: 3483387 - RNA, 14 nt, Pseudomonas aeruginosa PA01
uggagguucggcag

SEQ ID NO: 3483388 - RNA, 17 nt, Pseudomonas aeruginosa PA01
uggaguaucgcccuggc

SEQ ID NO: 3483389 - RNA, 15 nt, Pseudomonas aeruginosa PA01
uggagucaggcgccg

SEQ ID NO: 3483390 - RNA, 14 nt, Pseudomonas aeruginosa PA01
uggaguuggaacug

SEQ ID NO: 3483391 - RNA, 13 nt, Pseudomonas aeruginosa PA01
uggaguugugcca

SEQ ID NO: 3483392 - RNA, 14 nt, Pseudomonas aeruginosa PA01
uggauaagccgcgc

SEQ ID NO: 3483393 - RNA, 16 nt, Pseudomonas aeruginosa PA01
uggauacgcucggcca

SEQ ID NO: 3483394 - RNA, 17 nt, Pseudomonas aeruginosa PA01
uggauacgggcgccagg

SEQ ID NO: 3483395 - RNA, 14 nt, Pseudomonas aeruginosa PA01
uggauaggcggcgg

SEQ ID NO: 3483396 - RNA, 14 nt, Pseudomonas aeruginosa PA01
uggauaucgucggg

SEQ ID NO: 3483397 - RNA, 16 nt, Pseudomonas aeruginosa PA01
uggaucaccgccaagg

SEQ ID NO: 3483398 - RNA, 22 nt, Pseudomonas aeruginosa PA01
uggaucaccgccaaggccucgg

SEQ ID NO: 3483399 - RNA, 16 nt, Pseudomonas aeruginosa PA01
uggaucaccgcggcgc

SEQ ID NO: 3483400 - RNA, 15 nt, Pseudomonas aeruginosa PA01
uggaucacguaggac

SEQ ID NO: 3483401 - RNA, 16 nt, Pseudomonas aeruginosa PA01
uggaucagcgccucga

SEQ ID NO: 3483402 - RNA, 21 nt, Pseudomonas aeruginosa PA01
uggaucaugggugaagaccag

SEQ ID NO: 3483403 - RNA, 21 nt, Pseudomonas aeruginosa PA01
uggauccgugccaggcgcucg

SEQ ID NO: 3483404 - RNA, 20 nt, Pseudomonas aeruginosa PA01
uggaucgcccgaacgccgac

SEQ ID NO: 3483405 - RNA, 21 nt, Pseudomonas aeruginosa PA01
uggaucgcccggcugcacagg

SEQ ID NO: 3483406 - RNA, 13 nt, Pseudomonas aeruginosa PA01
uggaucgcggcgu

SEQ ID NO: 3483407 - RNA, 20 nt, Pseudomonas aeruginosa PA01
uggaucgcggcguaggcgcg

SEQ ID NO: 3483408 - RNA, 13 nt, Pseudomonas aeruginosa PA01
uggaucggcagcu

SEQ ID NO: 3483409 - RNA, 18 nt, Pseudomonas aeruginosa PA01
uggaucggccucgcggcg

SEQ ID NO: 3483410 - RNA, 19 nt, Pseudomonas aeruginosa PA01
uggaucggccucgcggcgc

SEQ ID NO: 3483411 - RNA, 22 nt, Pseudomonas aeruginosa PA01
uggaucggccucgcggcgcucg

SEQ ID NO: 3483412 - RNA, 20 nt, Pseudomonas aeruginosa PA01
uggaucucccguaccagcgc

SEQ ID NO: 3483413 - RNA, 12 nt, Pseudomonas aeruginosa PA01
uggaucucggcg

SEQ ID NO: 3483414 - RNA, 19 nt, Pseudomonas aeruginosa PA01
uggaucugguggaacagca

SEQ ID NO: 3483415 - RNA, 19 nt, Pseudomonas aeruginosa PA01
uggaugaaacgggcgaucu

SEQ ID NO: 3483416 - RNA, 19 nt, Pseudomonas aeruginosa PA01
uggaugaacgugucgacga

SEQ ID NO: 3483417 - RNA, 18 nt, Pseudomonas aeruginosa PA01
uggaugaccacgucgcga

SEQ ID NO: 3483418 - RNA, 18 nt, Pseudomonas aeruginosa PA01
uggaugcagccgauggcg

SEQ ID NO: 3483419 - RNA, 13 nt, Pseudomonas aeruginosa PA01
uggaugccgacca

SEQ ID NO: 3483420 - RNA, 15 nt, Pseudomonas aeruginosa PA01
uggaugccgguggcg

SEQ ID NO: 3483421 - RNA, 12 nt, Pseudomonas aeruginosa PA01
uggaugcgcggc

SEQ ID NO: 3483422 - RNA, 13 nt, Pseudomonas aeruginosa PA01
uggaugcgcggca

SEQ ID NO: 3483423 - RNA, 15 nt, Pseudomonas aeruginosa PA01
uggaugcgcggcagc

SEQ ID NO: 3483424 - RNA, 17 nt, Pseudomonas aeruginosa PA01
uggaugcuccgcgccuc

SEQ ID NO: 3483425 - RNA, 15 nt, Pseudomonas aeruginosa PA01
uggauguucgccgcc

SEQ ID NO: 3483426 - RNA, 17 nt, Pseudomonas aeruginosa PA01
uggauguugccgccgcc

SEQ ID NO: 3483427 - RNA, 12 nt, Pseudomonas aeruginosa PA01
uggauucgaagg

SEQ ID NO: 3483428 - RNA, 20 nt, Pseudomonas aeruginosa PA01
uggauucguugaggcccauc

SEQ ID NO: 3483429 - RNA, 17 nt, Pseudomonas aeruginosa PA01
uggauuucagcaggccg

SEQ ID NO: 3483430 - RNA, 21 nt, Pseudomonas aeruginosa PA01
uggcaaaaaugcccuuggcuu

SEQ ID NO: 3483431 - RNA, 14 nt, Pseudomonas aeruginosa PA01
uggcaaccgacgag

SEQ ID NO: 3483432 - RNA, 17 nt, Pseudomonas aeruginosa PA01
uggcaacugccgcccgc

SEQ ID NO: 3483433 - RNA, 21 nt, Pseudomonas aeruginosa PA01
uggcaacugcguccgaugucg

SEQ ID NO: 3483434 - RNA, 12 nt, Pseudomonas aeruginosa PA01
uggcaagccucg

SEQ ID NO: 3483435 - RNA, 15 nt, Pseudomonas aeruginosa PA01
uggcaaucaucgcgu

SEQ ID NO: 3483436 - RNA, 19 nt, Pseudomonas aeruginosa PA01
uggcaaucaucgcgucgcc

SEQ ID NO: 3483437 - RNA, 17 nt, Pseudomonas aeruginosa PA01
uggcacccaggccacgc

SEQ ID NO: 3483438 - RNA, 13 nt, Pseudomonas aeruginosa PA01
uggcaccggccag

SEQ ID NO: 3483439 - RNA, 16 nt, Pseudomonas aeruginosa PA01
uggcaccggccaggcg

SEQ ID NO: 3483440 - RNA, 18 nt, Pseudomonas aeruginosa PA01
uggcaccggccaggcgcu

SEQ ID NO: 3483441 - RNA, 20 nt, Pseudomonas aeruginosa PA01
uggcaccgucaagggccagg

SEQ ID NO: 3483442 - RNA, 19 nt, Pseudomonas aeruginosa PA01
uggcacgacgcucggacag

SEQ ID NO: 3483443 - RNA, 22 nt, Pseudomonas aeruginosa PA01
uggcacgacgcucggacagcuu

SEQ ID NO: 3483444 - RNA, 14 nt, Pseudomonas aeruginosa PA01
uggcacggccggcg

SEQ ID NO: 3483445 - RNA, 20 nt, Pseudomonas aeruginosa PA01
uggcacguacguccagggca

SEQ ID NO: 3483446 - RNA, 15 nt, Pseudomonas aeruginosa PA01
uggcagaacaucgcc

SEQ ID NO: 3483447 - RNA, 15 nt, Pseudomonas aeruginosa PA01
uggcagacgcugcuc

SEQ ID NO: 3483448 - RNA, 15 nt, Pseudomonas aeruginosa PA01
uggcagagcuggaag

SEQ ID NO: 3483449 - RNA, 13 nt, Pseudomonas aeruginosa PA01
uggcagcaggcac

SEQ ID NO: 3483450 - RNA, 19 nt, Pseudomonas aeruginosa PA01
uggcagccuuggccacggc

SEQ ID NO: 3483451 - RNA, 14 nt, Pseudomonas aeruginosa PA01
uggcaggccuggaa

SEQ ID NO: 3483452 - RNA, 18 nt, Pseudomonas aeruginosa PA01
uggcaggccuggaauacc

SEQ ID NO: 3483453 - RNA, 19 nt, Pseudomonas aeruginosa PA01
uggcaggccuggaauaccc

SEQ ID NO: 3483454 - RNA, 14 nt, Pseudomonas aeruginosa PA01
uggcaggcgcccgg

SEQ ID NO: 3483455 - RNA, 15 nt, Pseudomonas aeruginosa PA01
uggcaggcgcccggu

SEQ ID NO: 3483456 - RNA, 17 nt, Pseudomonas aeruginosa PA01
uggcaggcgcccgguca

SEQ ID NO: 3483457 - RNA, 17 nt, Pseudomonas aeruginosa PA01
uggcaggcgcugcagcc

SEQ ID NO: 3483458 - RNA, 22 nt, Pseudomonas aeruginosa PA01
uggcagggcgcguccagcucca

SEQ ID NO: 3483459 - RNA, 23 nt, Pseudomonas aeruginosa PA01
uggcagguaucgcugggcgccuc

SEQ ID NO: 3483460 - RNA, 19 nt, Pseudomonas aeruginosa PA01
uggcaggugccgcucgucc

SEQ ID NO: 3483461 - RNA, 19 nt, Pseudomonas aeruginosa PA01
uggcagguugcacggccgg

SEQ ID NO: 3483462 - RNA, 16 nt, Pseudomonas aeruginosa PA01
uggcaguccagggcgg

SEQ ID NO: 3483463 - RNA, 14 nt, Pseudomonas aeruginosa PA01
uggcagugcgccgg

SEQ ID NO: 3483464 - RNA, 15 nt, Pseudomonas aeruginosa PA01
uggcagugcgccggc

SEQ ID NO: 3483465 - RNA, 23 nt, Pseudomonas aeruginosa PA01
uggcauaaccggaagcgaucucc

SEQ ID NO: 3483466 - RNA, 19 nt, Pseudomonas aeruginosa PA01
uggcauccccuuuuuucag

SEQ ID NO: 3483467 - RNA, 21 nt, Pseudomonas aeruginosa PA01
uggcaugcaagaggucgacgg

SEQ ID NO: 3483468 - RNA, 16 nt, Pseudomonas aeruginosa PA01
uggcauggcuuuccag

SEQ ID NO: 3483469 - RNA, 14 nt, Pseudomonas aeruginosa PA01
uggcaugggccagu

SEQ ID NO: 3483470 - RNA, 23 nt, Pseudomonas aeruginosa PA01
uggcaugguguccggcggcgaug

SEQ ID NO: 3483471 - RNA, 14 nt, Pseudomonas aeruginosa PA01
uggcauucgucgcc

SEQ ID NO: 3483472 - RNA, 16 nt, Pseudomonas aeruginosa PA01
uggcauucgucgccgc

SEQ ID NO: 3483473 - RNA, 23 nt, Pseudomonas aeruginosa PA01
uggcauuggugcugcgcgcggcc

SEQ ID NO: 3483474 - RNA, 16 nt, Pseudomonas aeruginosa PA01
uggccaaccaggaagg

SEQ ID NO: 3483475 - RNA, 13 nt, Pseudomonas aeruginosa PA01
uggccaccagcac

SEQ ID NO: 3483476 - RNA, 15 nt, Pseudomonas aeruginosa PA01
uggccaccagcaccu

SEQ ID NO: 3483477 - RNA, 19 nt, Pseudomonas aeruginosa PA01
uggccacccuugcgcccgg

SEQ ID NO: 3483478 - RNA, 17 nt, Pseudomonas aeruginosa PA01
uggccacccuuggagcc

SEQ ID NO: 3483479 - RNA, 15 nt, Pseudomonas aeruginosa PA01
uggccaccgaaucgg

SEQ ID NO: 3483480 - RNA, 14 nt, Pseudomonas aeruginosa PA01
uggccaccgccagg

SEQ ID NO: 3483481 - RNA, 17 nt, Pseudomonas aeruginosa PA01
uggccaccgccaggacc

SEQ ID NO: 3483482 - RNA, 13 nt, Pseudomonas aeruginosa PA01
uggccaccgcggc

SEQ ID NO: 3483483 - RNA, 14 nt, Pseudomonas aeruginosa PA01
uggccaccgcggcg

SEQ ID NO: 3483484 - RNA, 20 nt, Pseudomonas aeruginosa PA01
uggccaccgcggcguccgcg

SEQ ID NO: 3483485 - RNA, 22 nt, Pseudomonas aeruginosa PA01
uggccaccgcggcguccgcguc

SEQ ID NO: 3483486 - RNA, 21 nt, Pseudomonas aeruginosa PA01
uggccaccgggaucagcggcg

SEQ ID NO: 3483487 - RNA, 22 nt, Pseudomonas aeruginosa PA01
uggccaccgucggauggccguc

SEQ ID NO: 3483488 - RNA, 17 nt, Pseudomonas aeruginosa PA01
uggccacgacccugcug

SEQ ID NO: 3483489 - RNA, 18 nt, Pseudomonas aeruginosa PA01
uggccacgacccugcugg

SEQ ID NO: 3483490 - RNA, 23 nt, Pseudomonas aeruginosa PA01
uggccacgacccugcuggccggu

SEQ ID NO: 3483491 - RNA, 13 nt, Pseudomonas aeruginosa PA01
uggccacgccuuc

SEQ ID NO: 3483492 - RNA, 22 nt, Pseudomonas aeruginosa PA01
uggccacgccuucgggcgaugc

SEQ ID NO: 3483493 - RNA, 13 nt, Pseudomonas aeruginosa PA01
uggccacgcugcg

SEQ ID NO: 3483494 - RNA, 18 nt, Pseudomonas aeruginosa PA01
uggccacguagggcgugg

SEQ ID NO: 3483495 - RNA, 15 nt, Pseudomonas aeruginosa PA01
uggccacguccagcg

SEQ ID NO: 3483496 - RNA, 19 nt, Pseudomonas aeruginosa PA01
uggccacgucgccccaggg

SEQ ID NO: 3483497 - RNA, 14 nt, Pseudomonas aeruginosa PA01
uggccacuccgggc

SEQ ID NO: 3483498 - RNA, 16 nt, Pseudomonas aeruginosa PA01
uggccacuccgggcug

SEQ ID NO: 3483499 - RNA, 20 nt, Pseudomonas aeruginosa PA01
uggccagaauuccagcaggu

SEQ ID NO: 3483500 - RNA, 23 nt, Pseudomonas aeruginosa PA01
uggccagcaccagucccuggccg

SEQ ID NO: 3483501 - RNA, 15 nt, Pseudomonas aeruginosa PA01
uggccagcagcaucg

SEQ ID NO: 3483502 - RNA, 15 nt, Pseudomonas aeruginosa PA01
uggccagcagccagg

SEQ ID NO: 3483503 - RNA, 16 nt, Pseudomonas aeruginosa PA01
uggccagcagccaggc

SEQ ID NO: 3483504 - RNA, 15 nt, Pseudomonas aeruginosa PA01
uggccagcaggccga

SEQ ID NO: 3483505 - RNA, 16 nt, Pseudomonas aeruginosa PA01
uggccagcaggcgccg

SEQ ID NO: 3483506 - RNA, 20 nt, Pseudomonas aeruginosa PA01
uggccagcaggcgccgcgca

SEQ ID NO: 3483507 - RNA, 19 nt, Pseudomonas aeruginosa PA01
uggccagcaggcuggcggc

SEQ ID NO: 3483508 - RNA, 17 nt, Pseudomonas aeruginosa PA01
uggccagcccggagccg

SEQ ID NO: 3483509 - RNA, 23 nt, Pseudomonas aeruginosa PA01
uggccagcccuuucagcggcugc

SEQ ID NO: 3483510 - RNA, 19 nt, Pseudomonas aeruginosa PA01
uggccagcgaacccaggcc

SEQ ID NO: 3483511 - RNA, 15 nt, Pseudomonas aeruginosa PA01
uggccagcgccacca

SEQ ID NO: 3483512 - RNA, 20 nt, Pseudomonas aeruginosa PA01
uggccagcgccaccagcagg

SEQ ID NO: 3483513 - RNA, 20 nt, Pseudomonas aeruginosa PA01
uggccagcgcccaggccggg

SEQ ID NO: 3483514 - RNA, 23 nt, Pseudomonas aeruginosa PA01
uggccagcgcccaggccgggucg

SEQ ID NO: 3483515 - RNA, 16 nt, Pseudomonas aeruginosa PA01
uggccagcgcggcgcg

SEQ ID NO: 3483516 - RNA, 12 nt, Pseudomonas aeruginosa PA01
uggccagcgcgu

SEQ ID NO: 3483517 - RNA, 19 nt, Pseudomonas aeruginosa PA01
uggccagcgcuuccaccgc

SEQ ID NO: 3483518 - RNA, 17 nt, Pseudomonas aeruginosa PA01
uggccagcgucgccugc

SEQ ID NO: 3483519 - RNA, 21 nt, Pseudomonas aeruginosa PA01
uggccagcucgaccuugcccu

SEQ ID NO: 3483520 - RNA, 13 nt, Pseudomonas aeruginosa PA01
uggccaggaagcg

SEQ ID NO: 3483521 - RNA, 15 nt, Pseudomonas aeruginosa PA01
uggccaggaagcggg

SEQ ID NO: 3483522 - RNA, 15 nt, Pseudomonas aeruginosa PA01
uggccaggccccagg

SEQ ID NO: 3483523 - RNA, 19 nt, Pseudomonas aeruginosa PA01
uggccaggccccaggccgc

SEQ ID NO: 3483524 - RNA, 20 nt, Pseudomonas aeruginosa PA01
uggccaggccccaggccgcc

SEQ ID NO: 3483525 - RNA, 11 nt, Pseudomonas aeruginosa PA01
uggccaggcgc

SEQ ID NO: 3483526 - RNA, 17 nt, Pseudomonas aeruginosa PA01
uggccaggcgcaccagc

SEQ ID NO: 3483527 - RNA, 18 nt, Pseudomonas aeruginosa PA01
uggccaggcgcaccagca

SEQ ID NO: 3483528 - RNA, 20 nt, Pseudomonas aeruginosa PA01
uggccaggcgcaccagcagg

SEQ ID NO: 3483529 - RNA, 22 nt, Pseudomonas aeruginosa PA01
uggccaggcgcaccagcaggcg

SEQ ID NO: 3483530 - RNA, 14 nt, Pseudomonas aeruginosa PA01
uggccaggcgcgac

SEQ ID NO: 3483531 - RNA, 16 nt, Pseudomonas aeruginosa PA01
uggccaggcgcgacag

SEQ ID NO: 3483532 - RNA, 18 nt, Pseudomonas aeruginosa PA01
uggccaggcgcuccucca

SEQ ID NO: 3483533 - RNA, 14 nt, Pseudomonas aeruginosa PA01
uggccagggcaugu

SEQ ID NO: 3483534 - RNA, 16 nt, Pseudomonas aeruginosa PA01
uggccagggggccugg

SEQ ID NO: 3483535 - RNA, 16 nt, Pseudomonas aeruginosa PA01
uggccagggucacgcc

SEQ ID NO: 3483536 - RNA, 19 nt, Pseudomonas aeruginosa PA01
uggccaggucgcgcagggc

SEQ ID NO: 3483537 - RNA, 14 nt, Pseudomonas aeruginosa PA01
uggccagucaucgc

SEQ ID NO: 3483538 - RNA, 15 nt, Pseudomonas aeruginosa PA01
uggccaguugcaccg

SEQ ID NO: 3483539 - RNA, 17 nt, Pseudomonas aeruginosa PA01
uggccaguugcaccgca

SEQ ID NO: 3483540 - RNA, 15 nt, Pseudomonas aeruginosa PA01
uggccaucagcgccg

SEQ ID NO: 3483541 - RNA, 16 nt, Pseudomonas aeruginosa PA01
uggccaucagcgccgc

SEQ ID NO: 3483542 - RNA, 22 nt, Pseudomonas aeruginosa PA01
uggccaucuucucgaagcgcgc

SEQ ID NO: 3483543 - RNA, 16 nt, Pseudomonas aeruginosa PA01
uggccaugauccggug

SEQ ID NO: 3483544 - RNA, 19 nt, Pseudomonas aeruginosa PA01
uggccaugaugugcgcagg

SEQ ID NO: 3483545 - RNA, 16 nt, Pseudomonas aeruginosa PA01
uggccauggcgcuugc

SEQ ID NO: 3483546 - RNA, 19 nt, Pseudomonas aeruginosa PA01
uggccaugggcacgccggu

SEQ ID NO: 3483547 - RNA, 20 nt, Pseudomonas aeruginosa PA01
uggccauucgcuucggccac

SEQ ID NO: 3483548 - RNA, 15 nt, Pseudomonas aeruginosa PA01
uggcccaauccgcgc

SEQ ID NO: 3483549 - RNA, 19 nt, Pseudomonas aeruginosa PA01
uggcccagaccuuggagcc

SEQ ID NO: 3483550 - RNA, 16 nt, Pseudomonas aeruginosa PA01
uggcccagauauccag

SEQ ID NO: 3483551 - RNA, 18 nt, Pseudomonas aeruginosa PA01
uggcccagauauccaggg

SEQ ID NO: 3483552 - RNA, 21 nt, Pseudomonas aeruginosa PA01
uggcccagauauccagggcca

SEQ ID NO: 3483553 - RNA, 15 nt, Pseudomonas aeruginosa PA01
uggcccagcuugaug

SEQ ID NO: 3483554 - RNA, 16 nt, Pseudomonas aeruginosa PA01
uggccccagcgcgagc

SEQ ID NO: 3483555 - RNA, 19 nt, Pseudomonas aeruginosa PA01
uggcccccacggaggccuu

SEQ ID NO: 3483556 - RNA, 13 nt, Pseudomonas aeruginosa PA01
uggccccgccgag

SEQ ID NO: 3483557 - RNA, 14 nt, Pseudomonas aeruginosa PA01
uggccccgccgagg

SEQ ID NO: 3483558 - RNA, 15 nt, Pseudomonas aeruginosa PA01
uggccccgccgagga

SEQ ID NO: 3483559 - RNA, 12 nt, Pseudomonas aeruginosa PA01
uggccccggcga

SEQ ID NO: 3483560 - RNA, 13 nt, Pseudomonas aeruginosa PA01
uggccccggcgau

SEQ ID NO: 3483561 - RNA, 14 nt, Pseudomonas aeruginosa PA01
uggccccggcgauc

SEQ ID NO: 3483562 - RNA, 15 nt, Pseudomonas aeruginosa PA01
uggccccggcgaucc

SEQ ID NO: 3483563 - RNA, 19 nt, Pseudomonas aeruginosa PA01
uggccccggcgauccgcgc

SEQ ID NO: 3483564 - RNA, 13 nt, Pseudomonas aeruginosa PA01
uggcccggcgcgg

SEQ ID NO: 3483565 - RNA, 21 nt, Pseudomonas aeruginosa PA01
uggcccgguggaauaccgcug

SEQ ID NO: 3483566 - RNA, 17 nt, Pseudomonas aeruginosa PA01
uggcccgguuggccagg

SEQ ID NO: 3483567 - RNA, 15 nt, Pseudomonas aeruginosa PA01
uggcccuccauccag

SEQ ID NO: 3483568 - RNA, 16 nt, Pseudomonas aeruginosa PA01
uggcccucucucgccu

SEQ ID NO: 3483569 - RNA, 19 nt, Pseudomonas aeruginosa PA01
uggcccugcaucgcgacag

SEQ ID NO: 3483570 - RNA, 22 nt, Pseudomonas aeruginosa PA01
uggcccugcaucgcgacagggc

SEQ ID NO: 3483571 - RNA, 18 nt, Pseudomonas aeruginosa PA01
uggcccuggauaucuggg

SEQ ID NO: 3483572 - RNA, 19 nt, Pseudomonas aeruginosa PA01
uggcccuggauaucugggc

SEQ ID NO: 3483573 - RNA, 20 nt, Pseudomonas aeruginosa PA01
uggcccuggauaucugggcc

SEQ ID NO: 3483574 - RNA, 12 nt, Pseudomonas aeruginosa PA01
uggcccuggccu

SEQ ID NO: 3483575 - RNA, 13 nt, Pseudomonas aeruginosa PA01
uggcccuggccuu

SEQ ID NO: 3483576 - RNA, 13 nt, Pseudomonas aeruginosa PA01
uggcccuggcgca

SEQ ID NO: 3483577 - RNA, 12 nt, Pseudomonas aeruginosa PA01
uggcccugggcg

SEQ ID NO: 3483578 - RNA, 16 nt, Pseudomonas aeruginosa PA01
uggcccugggcggcga

SEQ ID NO: 3483579 - RNA, 14 nt, Pseudomonas aeruginosa PA01
uggcccuucgcccu

SEQ ID NO: 3483580 - RNA, 21 nt, Pseudomonas aeruginosa PA01
uggcccuugacgucguucagc

SEQ ID NO: 3483581 - RNA, 19 nt, Pseudomonas aeruginosa PA01
uggccgaaagcacugcggc

SEQ ID NO: 3483582 - RNA, 20 nt, Pseudomonas aeruginosa PA01
uggccgaaagcacugcggcg

SEQ ID NO: 3483583 - RNA, 24 nt, Pseudomonas aeruginosa PA01
uggccgaaauugaccagguacgga

SEQ ID NO: 3483584 - RNA, 21 nt, Pseudomonas aeruginosa PA01
uggccgaaucgaacagggcga

SEQ ID NO: 3483585 - RNA, 19 nt, Pseudomonas aeruginosa PA01
uggccgaccaguaccaggc

SEQ ID NO: 3483586 - RNA, 16 nt, Pseudomonas aeruginosa PA01
uggccgacccgcagcg

SEQ ID NO: 3483587 - RNA, 19 nt, Pseudomonas aeruginosa PA01
uggccgacccgugcgccgc

SEQ ID NO: 3483588 - RNA, 21 nt, Pseudomonas aeruginosa PA01
uggccgacccgugcgccgcgg

SEQ ID NO: 3483589 - RNA, 14 nt, Pseudomonas aeruginosa PA01
uggccgaccgccag

SEQ ID NO: 3483590 - RNA, 15 nt, Pseudomonas aeruginosa PA01
uggccgaccgccagg

SEQ ID NO: 3483591 - RNA, 18 nt, Pseudomonas aeruginosa PA01
uggccgaccgccaggccg

SEQ ID NO: 3483592 - RNA, 19 nt, Pseudomonas aeruginosa PA01
uggccgaccgccaggccga

SEQ ID NO: 3483593 - RNA, 13 nt, Pseudomonas aeruginosa PA01
uggccgacgccgc

SEQ ID NO: 3483594 - RNA, 21 nt, Pseudomonas aeruginosa PA01
uggccgacgccgcuggaaccg

SEQ ID NO: 3483595 - RNA, 14 nt, Pseudomonas aeruginosa PA01
uggccgacgcugag

SEQ ID NO: 3483596 - RNA, 18 nt, Pseudomonas aeruginosa PA01
uggccgagcccagcggca

SEQ ID NO: 3483597 - RNA, 20 nt, Pseudomonas aeruginosa PA01
uggccgagcccagcggcagg

SEQ ID NO: 3483598 - RNA, 21 nt, Pseudomonas aeruginosa PA01
uggccgagcccagcggcaggg

SEQ ID NO: 3483599 - RNA, 22 nt, Pseudomonas aeruginosa PA01
uggccgagcccagcggcagggc

SEQ ID NO: 3483600 - RNA, 21 nt, Pseudomonas aeruginosa PA01
uggccgagccgcuuggagcgg

SEQ ID NO: 3483601 - RNA, 22 nt, Pseudomonas aeruginosa PA01
uggccgagcgcgagugcagcga

SEQ ID NO: 3483602 - RNA, 18 nt, Pseudomonas aeruginosa PA01
uggccgagcugccgcacc

SEQ ID NO: 3483603 - RNA, 20 nt, Pseudomonas aeruginosa PA01
uggccgagcugccgcaccgc

SEQ ID NO: 3483604 - RNA, 14 nt, Pseudomonas aeruginosa PA01
uggccgaggacccg

SEQ ID NO: 3483605 - RNA, 16 nt, Pseudomonas aeruginosa PA01
uggccgaggacccggc

SEQ ID NO: 3483606 - RNA, 17 nt, Pseudomonas aeruginosa PA01
uggccgaggaggccagc

SEQ ID NO: 3483607 - RNA, 15 nt, Pseudomonas aeruginosa PA01
uggccgagggcgcgc

SEQ ID NO: 3483608 - RNA, 17 nt, Pseudomonas aeruginosa PA01
uggccgagggcgcgcag

SEQ ID NO: 3483609 - RNA, 16 nt, Pseudomonas aeruginosa PA01
uggccgaguggccgaa

SEQ ID NO: 3483610 - RNA, 21 nt, Pseudomonas aeruginosa PA01
uggccgaucaccuggccauuc

SEQ ID NO: 3483611 - RNA, 20 nt, Pseudomonas aeruginosa PA01
uggccgaucagcuuggccuu

SEQ ID NO: 3483612 - RNA, 14 nt, Pseudomonas aeruginosa PA01
uggccgaugccgac

SEQ ID NO: 3483613 - RNA, 15 nt, Pseudomonas aeruginosa PA01
uggccgaugccgacc

SEQ ID NO: 3483614 - RNA, 21 nt, Pseudomonas aeruginosa PA01
uggccgauuucgaugacgcca

SEQ ID NO: 3483615 - RNA, 12 nt, Pseudomonas aeruginosa PA01
uggccgcagcag

SEQ ID NO: 3483616 - RNA, 13 nt, Pseudomonas aeruginosa PA01
uggccgcagcagc

SEQ ID NO: 3483617 - RNA, 17 nt, Pseudomonas aeruginosa PA01
uggccgcagcagcggca

SEQ ID NO: 3483618 - RNA, 13 nt, Pseudomonas aeruginosa PA01
uggccgcagcggc

SEQ ID NO: 3483619 - RNA, 13 nt, Pseudomonas aeruginosa PA01
uggccgccagcag

SEQ ID NO: 3483620 - RNA, 14 nt, Pseudomonas aeruginosa PA01
uggccgccagcagg

SEQ ID NO: 3483621 - RNA, 15 nt, Pseudomonas aeruginosa PA01
uggccgccagcaggc

SEQ ID NO: 3483622 - RNA, 12 nt, Pseudomonas aeruginosa PA01
uggccgcccagg

SEQ ID NO: 3483623 - RNA, 20 nt, Pseudomonas aeruginosa PA01
uggccgcccuugcggcccgc

SEQ ID NO: 3483624 - RNA, 14 nt, Pseudomonas aeruginosa PA01
uggccgccgccgcc

SEQ ID NO: 3483625 - RNA, 15 nt, Pseudomonas aeruginosa PA01
uggccgccgccgccg

SEQ ID NO: 3483626 - RNA, 13 nt, Pseudomonas aeruginosa PA01
uggccgccugcag

SEQ ID NO: 3483627 - RNA, 18 nt, Pseudomonas aeruginosa PA01
uggccgccugcucggccu

SEQ ID NO: 3483628 - RNA, 19 nt, Pseudomonas aeruginosa PA01
uggccgccugcucggccug

SEQ ID NO: 3483629 - RNA, 12 nt, Pseudomonas aeruginosa PA01
uggccgccuggc

SEQ ID NO: 3483630 - RNA, 16 nt, Pseudomonas aeruginosa PA01
uggccgccuggccggc

SEQ ID NO: 3483631 - RNA, 18 nt, Pseudomonas aeruginosa PA01
uggccgccuggccggcca

SEQ ID NO: 3483632 - RNA, 20 nt, Pseudomonas aeruginosa PA01
uggccgccuggccggccagc

SEQ ID NO: 3483633 - RNA, 13 nt, Pseudomonas aeruginosa PA01
uggccgccuggcg

SEQ ID NO: 3483634 - RNA, 12 nt, Pseudomonas aeruginosa PA01
uggccgcgcagg

SEQ ID NO: 3483635 - RNA, 21 nt, Pseudomonas aeruginosa PA01
uggccgcgccccacggcgcgg

SEQ ID NO: 3483636 - RNA, 22 nt, Pseudomonas aeruginosa PA01
uggccgcgccgcccuggccgcc

SEQ ID NO: 3483637 - RNA, 15 nt, Pseudomonas aeruginosa PA01
uggccgcgcgaccgc

SEQ ID NO: 3483638 - RNA, 18 nt, Pseudomonas aeruginosa PA01
uggccgcgcgaccgcggc

SEQ ID NO: 3483639 - RNA, 17 nt, Pseudomonas aeruginosa PA01
uggccgcgggaggccgc

SEQ ID NO: 3483640 - RNA, 18 nt, Pseudomonas aeruginosa PA01
uggccgcgggaggccgcc

SEQ ID NO: 3483641 - RNA, 13 nt, Pseudomonas aeruginosa PA01
uggccgcguacca

SEQ ID NO: 3483642 - RNA, 24 nt, Pseudomonas aeruginosa PA01
uggccgcguaccaguagcgacagc

SEQ ID NO: 3483643 - RNA, 20 nt, Pseudomonas aeruginosa PA01
uggccgcguucgccgaggcg

SEQ ID NO: 3483644 - RNA, 18 nt, Pseudomonas aeruginosa PA01
uggccgcuacgcggcggg

SEQ ID NO: 3483645 - RNA, 15 nt, Pseudomonas aeruginosa PA01
uggccgcugagcagc

SEQ ID NO: 3483646 - RNA, 18 nt, Pseudomonas aeruginosa PA01
uggccgcugagcagcagg

SEQ ID NO: 3483647 - RNA, 16 nt, Pseudomonas aeruginosa PA01
uggccgcugccgcucu

SEQ ID NO: 3483648 - RNA, 19 nt, Pseudomonas aeruginosa PA01
uggccgcugccgcucuggc

SEQ ID NO: 3483649 - RNA, 15 nt, Pseudomonas aeruginosa PA01
uggccgcuguggaag

SEQ ID NO: 3483650 - RNA, 17 nt, Pseudomonas aeruginosa PA01
uggccgcuucaagcggc

SEQ ID NO: 3483651 - RNA, 17 nt, Pseudomonas aeruginosa PA01
uggccgcuugaagcggc

SEQ ID NO: 3483652 - RNA, 14 nt, Pseudomonas aeruginosa PA01
uggccggcaccagc

SEQ ID NO: 3483653 - RNA, 23 nt, Pseudomonas aeruginosa PA01
uggccggcaccagcaguagugcg

SEQ ID NO: 3483654 - RNA, 22 nt, Pseudomonas aeruginosa PA01
uggccggcacccugaccgcgag

SEQ ID NO: 3483655 - RNA, 15 nt, Pseudomonas aeruginosa PA01
uggccggcagcagcg

SEQ ID NO: 3483656 - RNA, 16 nt, Pseudomonas aeruginosa PA01
uggccggcagcagcgc

SEQ ID NO: 3483657 - RNA, 19 nt, Pseudomonas aeruginosa PA01
uggccggcagcagcgccag

SEQ ID NO: 3483658 - RNA, 17 nt, Pseudomonas aeruginosa PA01
uggccggccagccaggc

SEQ ID NO: 3483659 - RNA, 16 nt, Pseudomonas aeruginosa PA01
uggccggccucggcgg

SEQ ID NO: 3483660 - RNA, 19 nt, Pseudomonas aeruginosa PA01
uggccggccucggcggcgc

SEQ ID NO: 3483661 - RNA, 21 nt, Pseudomonas aeruginosa PA01
uggccggccucggcggcgcga

SEQ ID NO: 3483662 - RNA, 22 nt, Pseudomonas aeruginosa PA01
uggccggcgaccuuguccaggc

SEQ ID NO: 3483663 - RNA, 15 nt, Pseudomonas aeruginosa PA01
uggccggcgaucaga

SEQ ID NO: 3483664 - RNA, 17 nt, Pseudomonas aeruginosa PA01
uggccggcgauggccgc

SEQ ID NO: 3483665 - RNA, 18 nt, Pseudomonas aeruginosa PA01
uggccggcgauggccgcc

SEQ ID NO: 3483666 - RNA, 14 nt, Pseudomonas aeruginosa PA01
uggccggcggagau

SEQ ID NO: 3483667 - RNA, 15 nt, Pseudomonas aeruginosa PA01
uggccggcggagaua

SEQ ID NO: 3483668 - RNA, 22 nt, Pseudomonas aeruginosa PA01
uggccggcguacuucggcgcgg

SEQ ID NO: 3483669 - RNA, 14 nt, Pseudomonas aeruginosa PA01
uggccggcugcucc

SEQ ID NO: 3483670 - RNA, 19 nt, Pseudomonas aeruginosa PA01
uggccggcugcuccgggcg

SEQ ID NO: 3483671 - RNA, 15 nt, Pseudomonas aeruginosa PA01
uggccgggaaccagc

SEQ ID NO: 3483672 - RNA, 16 nt, Pseudomonas aeruginosa PA01
uggccgggcagacuuc

SEQ ID NO: 3483673 - RNA, 15 nt, Pseudomonas aeruginosa PA01
uggccgggccgaugc

SEQ ID NO: 3483674 - RNA, 17 nt, Pseudomonas aeruginosa PA01
uggccgggcuucuucag

SEQ ID NO: 3483675 - RNA, 18 nt, Pseudomonas aeruginosa PA01
uggccgggggucgcggcg

SEQ ID NO: 3483676 - RNA, 18 nt, Pseudomonas aeruginosa PA01
uggccgggguauccgggc

SEQ ID NO: 3483677 - RNA, 14 nt, Pseudomonas aeruginosa PA01
uggccggugccgcc

SEQ ID NO: 3483678 - RNA, 17 nt, Pseudomonas aeruginosa PA01
uggccggugccgcccug

SEQ ID NO: 3483679 - RNA, 18 nt, Pseudomonas aeruginosa PA01
uggccggugccgcccugg

SEQ ID NO: 3483680 - RNA, 19 nt, Pseudomonas aeruginosa PA01
uggccggugccgcccuggg

SEQ ID NO: 3483681 - RNA, 22 nt, Pseudomonas aeruginosa PA01
uggccguagccggugccgaucu

SEQ ID NO: 3483682 - RNA, 15 nt, Pseudomonas aeruginosa PA01
uggccguccaggcug

SEQ ID NO: 3483683 - RNA, 21 nt, Pseudomonas aeruginosa PA01
uggccgucgaagggcacgccg

SEQ ID NO: 3483684 - RNA, 13 nt, Pseudomonas aeruginosa PA01
uggccgucgaccc

SEQ ID NO: 3483685 - RNA, 19 nt, Pseudomonas aeruginosa PA01
uggccgucgacccgccuca

SEQ ID NO: 3483686 - RNA, 14 nt, Pseudomonas aeruginosa PA01
uggccgucgggaua

SEQ ID NO: 3483687 - RNA, 21 nt, Pseudomonas aeruginosa PA01
uggccgucuccaggcgcgccg

SEQ ID NO: 3483688 - RNA, 14 nt, Pseudomonas aeruginosa PA01
uggccgugcucgau

SEQ ID NO: 3483689 - RNA, 18 nt, Pseudomonas aeruginosa PA01
uggccguggcgccccagg

SEQ ID NO: 3483690 - RNA, 21 nt, Pseudomonas aeruginosa PA01
uggccguggcgccccaggcgg

SEQ ID NO: 3483691 - RNA, 15 nt, Pseudomonas aeruginosa PA01
uggccgugggccgcc

SEQ ID NO: 3483692 - RNA, 16 nt, Pseudomonas aeruginosa PA01
uggccgugggccgccg

SEQ ID NO: 3483693 - RNA, 14 nt, Pseudomonas aeruginosa PA01
uggccguucuccag

SEQ ID NO: 3483694 - RNA, 19 nt, Pseudomonas aeruginosa PA01
uggccguucuccaggucga

SEQ ID NO: 3483695 - RNA, 17 nt, Pseudomonas aeruginosa PA01
uggccguugaccagcgc

SEQ ID NO: 3483696 - RNA, 18 nt, Pseudomonas aeruginosa PA01
uggccguugaccagcgcg

SEQ ID NO: 3483697 - RNA, 19 nt, Pseudomonas aeruginosa PA01
uggccguugaccagcgcgu

SEQ ID NO: 3483698 - RNA, 15 nt, Pseudomonas aeruginosa PA01
uggccguugagcacc

SEQ ID NO: 3483699 - RNA, 15 nt, Pseudomonas aeruginosa PA01
uggccguugcgcagg

SEQ ID NO: 3483700 - RNA, 14 nt, Pseudomonas aeruginosa PA01
uggccguuggcgaa

SEQ ID NO: 3483701 - RNA, 16 nt, Pseudomonas aeruginosa PA01
uggccucagggcgcga

SEQ ID NO: 3483702 - RNA, 14 nt, Pseudomonas aeruginosa PA01
uggccuccacccgc

SEQ ID NO: 3483703 - RNA, 18 nt, Pseudomonas aeruginosa PA01
uggccuccggacgcugca

SEQ ID NO: 3483704 - RNA, 20 nt, Pseudomonas aeruginosa PA01
uggccuccggacgcugcaug

SEQ ID NO: 3483705 - RNA, 23 nt, Pseudomonas aeruginosa PA01
uggccuccugcaacgccuggugc

SEQ ID NO: 3483706 - RNA, 13 nt, Pseudomonas aeruginosa PA01
uggccucggcgau

SEQ ID NO: 3483707 - RNA, 24 nt, Pseudomonas aeruginosa PA01
uggccucguugaucggcaacgagc

SEQ ID NO: 3483708 - RNA, 13 nt, Pseudomonas aeruginosa PA01
uggccugcagcag

SEQ ID NO: 3483709 - RNA, 21 nt, Pseudomonas aeruginosa PA01
uggccugcagcaggucgagca

SEQ ID NO: 3483710 - RNA, 15 nt, Pseudomonas aeruginosa PA01
uggccugccgauggg

SEQ ID NO: 3483711 - RNA, 13 nt, Pseudomonas aeruginosa PA01
uggccuggccacc

SEQ ID NO: 3483712 - RNA, 14 nt, Pseudomonas aeruginosa PA01
uggccuggccaccc

SEQ ID NO: 3483713 - RNA, 14 nt, Pseudomonas aeruginosa PA01
uggccuggcccggc

SEQ ID NO: 3483714 - RNA, 16 nt, Pseudomonas aeruginosa PA01
uggccuggcgcucagc

SEQ ID NO: 3483715 - RNA, 17 nt, Pseudomonas aeruginosa PA01
uggccuggcgcucagcg

SEQ ID NO: 3483716 - RNA, 14 nt, Pseudomonas aeruginosa PA01
uggccugggcgcuc

SEQ ID NO: 3483717 - RNA, 18 nt, Pseudomonas aeruginosa PA01
uggccugggguagccggc

SEQ ID NO: 3483718 - RNA, 20 nt, Pseudomonas aeruginosa PA01
uggccugggguagccggccg

SEQ ID NO: 3483719 - RNA, 13 nt, Pseudomonas aeruginosa PA01
uggccuggucggc

SEQ ID NO: 3483720 - RNA, 15 nt, Pseudomonas aeruginosa PA01
uggccuggucggcgc

SEQ ID NO: 3483721 - RNA, 15 nt, Pseudomonas aeruginosa PA01
uggccuucgucggcu

SEQ ID NO: 3483722 - RNA, 14 nt, Pseudomonas aeruginosa PA01
uggccuugagcagg

SEQ ID NO: 3483723 - RNA, 15 nt, Pseudomonas aeruginosa PA01
uggccuugagcaggc

SEQ ID NO: 3483724 - RNA, 16 nt, Pseudomonas aeruginosa PA01
uggccuugaugccggc

SEQ ID NO: 3483725 - RNA, 20 nt, Pseudomonas aeruginosa PA01
uggccuugaugccggcgaug

SEQ ID NO: 3483726 - RNA, 14 nt, Pseudomonas aeruginosa PA01
uggccuugauggug

SEQ ID NO: 3483727 - RNA, 14 nt, Pseudomonas aeruginosa PA01
uggccuugccgucc

SEQ ID NO: 3483728 - RNA, 23 nt, Pseudomonas aeruginosa PA01
uggccuugccguccagccggcgc

SEQ ID NO: 3483729 - RNA, 13 nt, Pseudomonas aeruginosa PA01
uggccuuggccac

SEQ ID NO: 3483730 - RNA, 16 nt, Pseudomonas aeruginosa PA01
uggcgaaacuccagca

SEQ ID NO: 3483731 - RNA, 17 nt, Pseudomonas aeruginosa PA01
uggcgaaacuccagcag

SEQ ID NO: 3483732 - RNA, 16 nt, Pseudomonas aeruginosa PA01
uggcgaaaucgagcug

SEQ ID NO: 3483733 - RNA, 14 nt, Pseudomonas aeruginosa PA01
uggcgaacagcacc

SEQ ID NO: 3483734 - RNA, 15 nt, Pseudomonas aeruginosa PA01
uggcgaacagcaccu

SEQ ID NO: 3483735 - RNA, 16 nt, Pseudomonas aeruginosa PA01
uggcgaacagcaccuu

SEQ ID NO: 3483736 - RNA, 17 nt, Pseudomonas aeruginosa PA01
uggcgaacaggcagcgg

SEQ ID NO: 3483737 - RNA, 20 nt, Pseudomonas aeruginosa PA01
uggcgaacaugaagccgcgc

SEQ ID NO: 3483738 - RNA, 16 nt, Pseudomonas aeruginosa PA01
uggcgaacgauggugg

SEQ ID NO: 3483739 - RNA, 21 nt, Pseudomonas aeruginosa PA01
uggcgaacgaugguggucggc

SEQ ID NO: 3483740 - RNA, 15 nt, Pseudomonas aeruginosa PA01
uggcgaacgcccggc

SEQ ID NO: 3483741 - RNA, 16 nt, Pseudomonas aeruginosa PA01
uggcgaacggcugguc

SEQ ID NO: 3483742 - RNA, 23 nt, Pseudomonas aeruginosa PA01
uggcgaacggcuggucggcuucc

SEQ ID NO: 3483743 - RNA, 18 nt, Pseudomonas aeruginosa PA01
uggcgaacuucaggccgg

SEQ ID NO: 3483744 - RNA, 21 nt, Pseudomonas aeruginosa PA01
uggcgaacuucaggccggcgc

SEQ ID NO: 3483745 - RNA, 13 nt, Pseudomonas aeruginosa PA01
uggcgaagccagc

SEQ ID NO: 3483746 - RNA, 20 nt, Pseudomonas aeruginosa PA01
uggcgaagcgcuugcccagg

SEQ ID NO: 3483747 - RNA, 16 nt, Pseudomonas aeruginosa PA01
uggcgaagcuggggcu

SEQ ID NO: 3483748 - RNA, 17 nt, Pseudomonas aeruginosa PA01
uggcgaagcuggggcug

SEQ ID NO: 3483749 - RNA, 15 nt, Pseudomonas aeruginosa PA01
uggcgaaggcgcucc

SEQ ID NO: 3483750 - RNA, 16 nt, Pseudomonas aeruginosa PA01
uggcgaaguucccgcc

SEQ ID NO: 3483751 - RNA, 19 nt, Pseudomonas aeruginosa PA01
uggcgaaguucccgccgcu

SEQ ID NO: 3483752 - RNA, 20 nt, Pseudomonas aeruginosa PA01
uggcgaaguugccgccgcug

SEQ ID NO: 3483753 - RNA, 20 nt, Pseudomonas aeruginosa PA01
uggcgaauagccggcgcugg

SEQ ID NO: 3483754 - RNA, 14 nt, Pseudomonas aeruginosa PA01
uggcgaaugccuuc

SEQ ID NO: 3483755 - RNA, 18 nt, Pseudomonas aeruginosa PA01
uggcgacaggcgaucgac

SEQ ID NO: 3483756 - RNA, 19 nt, Pseudomonas aeruginosa PA01
uggcgaccaggacagcacg

SEQ ID NO: 3483757 - RNA, 20 nt, Pseudomonas aeruginosa PA01
uggcgaccugguggcgccgg

SEQ ID NO: 3483758 - RNA, 19 nt, Pseudomonas aeruginosa PA01
uggcgacgaagacgcugcg

SEQ ID NO: 3483759 - RNA, 22 nt, Pseudomonas aeruginosa PA01
uggcgacgacgggagcgcgagg

SEQ ID NO: 3483760 - RNA, 19 nt, Pseudomonas aeruginosa PA01
uggcgacgcagcacggcgg

SEQ ID NO: 3483761 - RNA, 12 nt, Pseudomonas aeruginosa PA01
uggcgacgccgg

SEQ ID NO: 3483762 - RNA, 14 nt, Pseudomonas aeruginosa PA01
uggcgacgcgcagg

SEQ ID NO: 3483763 - RNA, 18 nt, Pseudomonas aeruginosa PA01
uggcgacgcgcaggccgg

SEQ ID NO: 3483764 - RNA, 22 nt, Pseudomonas aeruginosa PA01
uggcgacgcgcaggccggugau

SEQ ID NO: 3483765 - RNA, 19 nt, Pseudomonas aeruginosa PA01
uggcgacgucccuuccccg

SEQ ID NO: 3483766 - RNA, 14 nt, Pseudomonas aeruginosa PA01
uggcgagcgcgauc

SEQ ID NO: 3483767 - RNA, 20 nt, Pseudomonas aeruginosa PA01
uggcgaggaacacccagaag

SEQ ID NO: 3483768 - RNA, 15 nt, Pseudomonas aeruginosa PA01
uggcgaggacgccgg

SEQ ID NO: 3483769 - RNA, 17 nt, Pseudomonas aeruginosa PA01
uggcgaggacgccgggc

SEQ ID NO: 3483770 - RNA, 18 nt, Pseudomonas aeruginosa PA01
uggcgaggacgccgggcu

SEQ ID NO: 3483771 - RNA, 19 nt, Pseudomonas aeruginosa PA01
uggcgaggacgccgggcug

SEQ ID NO: 3483772 - RNA, 19 nt, Pseudomonas aeruginosa PA01
uggcgaggaugaucagggc

SEQ ID NO: 3483773 - RNA, 13 nt, Pseudomonas aeruginosa PA01
uggcgaggcgcgc

SEQ ID NO: 3483774 - RNA, 16 nt, Pseudomonas aeruginosa PA01
uggcgaggcgcgccug

SEQ ID NO: 3483775 - RNA, 17 nt, Pseudomonas aeruginosa PA01
uggcgaggcgcgccugg

SEQ ID NO: 3483776 - RNA, 19 nt, Pseudomonas aeruginosa PA01
uggcgagggcgucccgcug

SEQ ID NO: 3483777 - RNA, 21 nt, Pseudomonas aeruginosa PA01
uggcgagggcgucccgcugcg

SEQ ID NO: 3483778 - RNA, 12 nt, Pseudomonas aeruginosa PA01
uggcgaggucgc

SEQ ID NO: 3483779 - RNA, 16 nt, Pseudomonas aeruginosa PA01
uggcgauaucgaaggc

SEQ ID NO: 3483780 - RNA, 19 nt, Pseudomonas aeruginosa PA01
uggcgaucaggcagcgcgc

SEQ ID NO: 3483781 - RNA, 21 nt, Pseudomonas aeruginosa PA01
uggcgaucaggcagcgcgcgg

SEQ ID NO: 3483782 - RNA, 15 nt, Pseudomonas aeruginosa PA01
uggcgaucaggccaa

SEQ ID NO: 3483783 - RNA, 14 nt, Pseudomonas aeruginosa PA01
uggcgaucaugccu

SEQ ID NO: 3483784 - RNA, 17 nt, Pseudomonas aeruginosa PA01
uggcgaucucggcgcgg

SEQ ID NO: 3483785 - RNA, 19 nt, Pseudomonas aeruginosa PA01
uggcgaugaucuggccacc

SEQ ID NO: 3483786 - RNA, 16 nt, Pseudomonas aeruginosa PA01
uggcgaugcccuggcc

SEQ ID NO: 3483787 - RNA, 17 nt, Pseudomonas aeruginosa PA01
uggcgaugcccuggccg

SEQ ID NO: 3483788 - RNA, 14 nt, Pseudomonas aeruginosa PA01
uggcgaugcugacc

SEQ ID NO: 3483789 - RNA, 19 nt, Pseudomonas aeruginosa PA01
uggcgauguagcugccggc

SEQ ID NO: 3483790 - RNA, 18 nt, Pseudomonas aeruginosa PA01
uggcgauguucaccgcgg

SEQ ID NO: 3483791 - RNA, 21 nt, Pseudomonas aeruginosa PA01
uggcgauguucaccgcggccu

SEQ ID NO: 3483792 - RNA, 16 nt, Pseudomonas aeruginosa PA01
uggcgauucuccuggg

SEQ ID NO: 3483793 - RNA, 16 nt, Pseudomonas aeruginosa PA01
uggcgcaacaggcgca

SEQ ID NO: 3483794 - RNA, 15 nt, Pseudomonas aeruginosa PA01
uggcgcaacgccggc

SEQ ID NO: 3483795 - RNA, 22 nt, Pseudomonas aeruginosa PA01
uggcgcaacugcgccagccgac

SEQ ID NO: 3483796 - RNA, 18 nt, Pseudomonas aeruginosa PA01
uggcgcaaggugccgagg

SEQ ID NO: 3483797 - RNA, 16 nt, Pseudomonas aeruginosa PA01
uggcgcacgccgcgga

SEQ ID NO: 3483798 - RNA, 14 nt, Pseudomonas aeruginosa PA01
uggcgcacggccug

SEQ ID NO: 3483799 - RNA, 15 nt, Pseudomonas aeruginosa PA01
uggcgcacggccugc

SEQ ID NO: 3483800 - RNA, 19 nt, Pseudomonas aeruginosa PA01
uggcgcacugccaggagca

SEQ ID NO: 3483801 - RNA, 15 nt, Pseudomonas aeruginosa PA01
uggcgcagacaggcc

SEQ ID NO: 3483802 - RNA, 19 nt, Pseudomonas aeruginosa PA01
uggcgcagacaggccucca

SEQ ID NO: 3483803 - RNA, 20 nt, Pseudomonas aeruginosa PA01
uggcgcagacaggccuccag

SEQ ID NO: 3483804 - RNA, 22 nt, Pseudomonas aeruginosa PA01
uggcgcagacgaucuccugcug

SEQ ID NO: 3483805 - RNA, 15 nt, Pseudomonas aeruginosa PA01
uggcgcagcagcagg

SEQ ID NO: 3483806 - RNA, 16 nt, Pseudomonas aeruginosa PA01
uggcgcagcagcaggu

SEQ ID NO: 3483807 - RNA, 13 nt, Pseudomonas aeruginosa PA01
uggcgcagccagg

SEQ ID NO: 3483808 - RNA, 15 nt, Pseudomonas aeruginosa PA01
uggcgcagccaggcg

SEQ ID NO: 3483809 - RNA, 19 nt, Pseudomonas aeruginosa PA01
uggcgcagccgcugggcca

SEQ ID NO: 3483810 - RNA, 22 nt, Pseudomonas aeruginosa PA01
uggcgcagccgcugggccacgu

SEQ ID NO: 3483811 - RNA, 15 nt, Pseudomonas aeruginosa PA01
uggcgcagccgucca

SEQ ID NO: 3483812 - RNA, 14 nt, Pseudomonas aeruginosa PA01
uggcgcagcggcag

SEQ ID NO: 3483813 - RNA, 15 nt, Pseudomonas aeruginosa PA01
uggcgcagcggcagc

SEQ ID NO: 3483814 - RNA, 17 nt, Pseudomonas aeruginosa PA01
uggcgcagcggcagcgc

SEQ ID NO: 3483815 - RNA, 20 nt, Pseudomonas aeruginosa PA01
uggcgcagcggcagcgccag

SEQ ID NO: 3483816 - RNA, 21 nt, Pseudomonas aeruginosa PA01
uggcgcaggaccgccauggcg

SEQ ID NO: 3483817 - RNA, 12 nt, Pseudomonas aeruginosa PA01
uggcgcaggccg

SEQ ID NO: 3483818 - RNA, 19 nt, Pseudomonas aeruginosa PA01
uggcgcaggccgggcggac

SEQ ID NO: 3483819 - RNA, 21 nt, Pseudomonas aeruginosa PA01
uggcgcaggccgggcggacgc

SEQ ID NO: 3483820 - RNA, 13 nt, Pseudomonas aeruginosa PA01
uggcgcaggcggc

SEQ ID NO: 3483821 - RNA, 13 nt, Pseudomonas aeruginosa PA01
uggcgcagggcgu

SEQ ID NO: 3483822 - RNA, 19 nt, Pseudomonas aeruginosa PA01
uggcgcaugaggccugguc

SEQ ID NO: 3483823 - RNA, 16 nt, Pseudomonas aeruginosa PA01
uggcgccacucggcgu

SEQ ID NO: 3483824 - RNA, 13 nt, Pseudomonas aeruginosa PA01
uggcgccagccag

SEQ ID NO: 3483825 - RNA, 13 nt, Pseudomonas aeruginosa PA01
uggcgccaggccg

SEQ ID NO: 3483826 - RNA, 16 nt, Pseudomonas aeruginosa PA01
uggcgccauccuccag

SEQ ID NO: 3483827 - RNA, 17 nt, Pseudomonas aeruginosa PA01
uggcgccauccuccagc

SEQ ID NO: 3483828 - RNA, 21 nt, Pseudomonas aeruginosa PA01
uggcgccauccuccagcgccg

SEQ ID NO: 3483829 - RNA, 23 nt, Pseudomonas aeruginosa PA01
uggcgccauugugcgcgcgcaga

SEQ ID NO: 3483830 - RNA, 22 nt, Pseudomonas aeruginosa PA01
uggcgcccaacgucuucaggcg

SEQ ID NO: 3483831 - RNA, 12 nt, Pseudomonas aeruginosa PA01
uggcgcccagcc

SEQ ID NO: 3483832 - RNA, 14 nt, Pseudomonas aeruginosa PA01
uggcgcccagccag

SEQ ID NO: 3483833 - RNA, 21 nt, Pseudomonas aeruginosa PA01
uggcgccccagaucgccagcg

SEQ ID NO: 3483834 - RNA, 22 nt, Pseudomonas aeruginosa PA01
uggcgcccgccuuguucgccag

SEQ ID NO: 3483835 - RNA, 23 nt, Pseudomonas aeruginosa PA01
uggcgccgaaaaaaaggggcccg

SEQ ID NO: 3483836 - RNA, 15 nt, Pseudomonas aeruginosa PA01
uggcgccgaccucca

SEQ ID NO: 3483837 - RNA, 23 nt, Pseudomonas aeruginosa PA01
uggcgccgccgagguugcgcagg

SEQ ID NO: 3483838 - RNA, 14 nt, Pseudomonas aeruginosa PA01
uggcgccgccggcg

SEQ ID NO: 3483839 - RNA, 15 nt, Pseudomonas aeruginosa PA01
uggcgccggccagag

SEQ ID NO: 3483840 - RNA, 16 nt, Pseudomonas aeruginosa PA01
uggcgccggcugacgc

SEQ ID NO: 3483841 - RNA, 20 nt, Pseudomonas aeruginosa PA01
uggcgccggcugacgcuggc

SEQ ID NO: 3483842 - RNA, 21 nt, Pseudomonas aeruginosa PA01
uggcgccggcugacgcuggcg

SEQ ID NO: 3483843 - RNA, 15 nt, Pseudomonas aeruginosa PA01
uggcgccgggcgcga

SEQ ID NO: 3483844 - RNA, 16 nt, Pseudomonas aeruginosa PA01
uggcgccgggcgcgau

SEQ ID NO: 3483845 - RNA, 20 nt, Pseudomonas aeruginosa PA01
uggcgccgggcgcgaugccg

SEQ ID NO: 3483846 - RNA, 20 nt, Pseudomonas aeruginosa PA01
uggcgccggugcaugaaggc

SEQ ID NO: 3483847 - RNA, 13 nt, Pseudomonas aeruginosa PA01
uggcgccucgcaa

SEQ ID NO: 3483848 - RNA, 23 nt, Pseudomonas aeruginosa PA01
uggcgccucgcaaaggucggcga

SEQ ID NO: 3483849 - RNA, 13 nt, Pseudomonas aeruginosa PA01
uggcgccuggccu

SEQ ID NO: 3483850 - RNA, 17 nt, Pseudomonas aeruginosa PA01
uggcgcgaaucuucggc

SEQ ID NO: 3483851 - RNA, 12 nt, Pseudomonas aeruginosa PA01
uggcgcgaccgc

SEQ ID NO: 3483852 - RNA, 22 nt, Pseudomonas aeruginosa PA01
uggcgcgacgaggcgcggcgga

SEQ ID NO: 3483853 - RNA, 20 nt, Pseudomonas aeruginosa PA01
uggcgcgacugucgagcagg

SEQ ID NO: 3483854 - RNA, 20 nt, Pseudomonas aeruginosa PA01
uggcgcgagaagccagccag

SEQ ID NO: 3483855 - RNA, 22 nt, Pseudomonas aeruginosa PA01
uggcgcgagaagccagccaggu

SEQ ID NO: 3483856 - RNA, 13 nt, Pseudomonas aeruginosa PA01
uggcgcgauccgc

SEQ ID NO: 3483857 - RNA, 15 nt, Pseudomonas aeruginosa PA01
uggcgcgaucggggc

SEQ ID NO: 3483858 - RNA, 23 nt, Pseudomonas aeruginosa PA01
uggcgcgaugcucccgagcaaga

SEQ ID NO: 3483859 - RNA, 20 nt, Pseudomonas aeruginosa PA01
uggcgcgcaaaaaaagggga

SEQ ID NO: 3483860 - RNA, 16 nt, Pseudomonas aeruginosa PA01
uggcgcgcaccaccug

SEQ ID NO: 3483861 - RNA, 18 nt, Pseudomonas aeruginosa PA01
uggcgcgcaccaccuggc

SEQ ID NO: 3483862 - RNA, 19 nt, Pseudomonas aeruginosa PA01
uggcgcgcagggcaucgau

SEQ ID NO: 3483863 - RNA, 23 nt, Pseudomonas aeruginosa PA01
uggcgcgcagggcaucgaugacc

SEQ ID NO: 3483864 - RNA, 16 nt, Pseudomonas aeruginosa PA01
uggcgcgcgcgccagg

SEQ ID NO: 3483865 - RNA, 18 nt, Pseudomonas aeruginosa PA01
uggcgcgcggccgcgucc

SEQ ID NO: 3483866 - RNA, 17 nt, Pseudomonas aeruginosa PA01
uggcgcgcugcggcagg

SEQ ID NO: 3483867 - RNA, 23 nt, Pseudomonas aeruginosa PA01
uggcgcgcuuuccggcgcggccu

SEQ ID NO: 3483868 - RNA, 19 nt, Pseudomonas aeruginosa PA01
uggcgcggcaaagugcggu

SEQ ID NO: 3483869 - RNA, 19 nt, Pseudomonas aeruginosa PA01
uggcgcggcugaucggccg

SEQ ID NO: 3483870 - RNA, 18 nt, Pseudomonas aeruginosa PA01
uggcgcggggccccggca

SEQ ID NO: 3483871 - RNA, 16 nt, Pseudomonas aeruginosa PA01
uggcgcguacgcccgc

SEQ ID NO: 3483872 - RNA, 17 nt, Pseudomonas aeruginosa PA01
uggcgcguacgcccgca

SEQ ID NO: 3483873 - RNA, 19 nt, Pseudomonas aeruginosa PA01
uggcgcguacgcccgcagc

SEQ ID NO: 3483874 - RNA, 19 nt, Pseudomonas aeruginosa PA01
uggcgcgucaugccgccgu

SEQ ID NO: 3483875 - RNA, 15 nt, Pseudomonas aeruginosa PA01
uggcgcgucgcugcc

SEQ ID NO: 3483876 - RNA, 21 nt, Pseudomonas aeruginosa PA01
uggcgcgucgcugccgccgcg

SEQ ID NO: 3483877 - RNA, 14 nt, Pseudomonas aeruginosa PA01
uggcgcgucggccg

SEQ ID NO: 3483878 - RNA, 16 nt, Pseudomonas aeruginosa PA01
uggcgcuacgcucgcc

SEQ ID NO: 3483879 - RNA, 19 nt, Pseudomonas aeruginosa PA01
uggcgcuacgcucgccgac

SEQ ID NO: 3483880 - RNA, 16 nt, Pseudomonas aeruginosa PA01
uggcgcucagcgccgc

SEQ ID NO: 3483881 - RNA, 19 nt, Pseudomonas aeruginosa PA01
uggcgcucagcgccgcuuc

SEQ ID NO: 3483882 - RNA, 19 nt, Pseudomonas aeruginosa PA01
uggcgcuccagggcgcuga

SEQ ID NO: 3483883 - RNA, 19 nt, Pseudomonas aeruginosa PA01
uggcgcucgaagcuccagc

SEQ ID NO: 3483884 - RNA, 22 nt, Pseudomonas aeruginosa PA01
uggcgcucgagcuugaggucgg

SEQ ID NO: 3483885 - RNA, 15 nt, Pseudomonas aeruginosa PA01
uggcgcucgccgugg

SEQ ID NO: 3483886 - RNA, 13 nt, Pseudomonas aeruginosa PA01
uggcgcucggcca

SEQ ID NO: 3483887 - RNA, 16 nt, Pseudomonas aeruginosa PA01
uggcgcucggccacau

SEQ ID NO: 3483888 - RNA, 19 nt, Pseudomonas aeruginosa PA01
uggcgcucucgaacaccag

SEQ ID NO: 3483889 - RNA, 18 nt, Pseudomonas aeruginosa PA01
uggcgcucugcagugugg

SEQ ID NO: 3483890 - RNA, 17 nt, Pseudomonas aeruginosa PA01
uggcgcugaacaagccc

SEQ ID NO: 3483891 - RNA, 21 nt, Pseudomonas aeruginosa PA01
uggcgcugaacaagcccuggu

SEQ ID NO: 3483892 - RNA, 23 nt, Pseudomonas aeruginosa PA01
uggcgcugaacaagcccuggugg

SEQ ID NO: 3483893 - RNA, 21 nt, Pseudomonas aeruginosa PA01
uggcgcugaggaagagcagcg

SEQ ID NO: 3483894 - RNA, 13 nt, Pseudomonas aeruginosa PA01
uggcgcuggccga

SEQ ID NO: 3483895 - RNA, 14 nt, Pseudomonas aeruginosa PA01
uggcgcugggccuu

SEQ ID NO: 3483896 - RNA, 17 nt, Pseudomonas aeruginosa PA01
uggcgcuguaggcgagc

SEQ ID NO: 3483897 - RNA, 20 nt, Pseudomonas aeruginosa PA01
uggcgcuguaggcgagcagc

SEQ ID NO: 3483898 - RNA, 21 nt, Pseudomonas aeruginosa PA01
uggcgcuguaggcgagcagcg

SEQ ID NO: 3483899 - RNA, 23 nt, Pseudomonas aeruginosa PA01
uggcgcuguaggcgagcagcggc

SEQ ID NO: 3483900 - RNA, 18 nt, Pseudomonas aeruginosa PA01
uggcgcugucgccgguca

SEQ ID NO: 3483901 - RNA, 20 nt, Pseudomonas aeruginosa PA01
uggcgcuucguugcgauggg

SEQ ID NO: 3483902 - RNA, 16 nt, Pseudomonas aeruginosa PA01
uggcgcuugagcagcc

SEQ ID NO: 3483903 - RNA, 19 nt, Pseudomonas aeruginosa PA01
uggcgcuugagcagccagg

SEQ ID NO: 3483904 - RNA, 21 nt, Pseudomonas aeruginosa PA01
uggcgcuugagcagccaggcg

SEQ ID NO: 3483905 - RNA, 15 nt, Pseudomonas aeruginosa PA01
uggcgcuugccgcgc

SEQ ID NO: 3483906 - RNA, 16 nt, Pseudomonas aeruginosa PA01
uggcgcuugcgcagca

SEQ ID NO: 3483907 - RNA, 16 nt, Pseudomonas aeruginosa PA01
uggcggaaaagcccgc

SEQ ID NO: 3483908 - RNA, 16 nt, Pseudomonas aeruginosa PA01
uggcggaauaacucag

SEQ ID NO: 3483909 - RNA, 21 nt, Pseudomonas aeruginosa PA01
uggcggacaacccggcgcugg

SEQ ID NO: 3483910 - RNA, 13 nt, Pseudomonas aeruginosa PA01
uggcggaccgccu

SEQ ID NO: 3483911 - RNA, 16 nt, Pseudomonas aeruginosa PA01
uggcggaccgccucga

SEQ ID NO: 3483912 - RNA, 22 nt, Pseudomonas aeruginosa PA01
uggcggagaaacuuucuucgcc

SEQ ID NO: 3483913 - RNA, 16 nt, Pseudomonas aeruginosa PA01
uggcggauaaccgcaa

SEQ ID NO: 3483914 - RNA, 18 nt, Pseudomonas aeruginosa PA01
uggcggauaaccgcaagc

SEQ ID NO: 3483915 - RNA, 16 nt, Pseudomonas aeruginosa PA01
uggcggauagccgcaa

SEQ ID NO: 3483916 - RNA, 20 nt, Pseudomonas aeruginosa PA01
uggcggauagccgcaagcgg

SEQ ID NO: 3483917 - RNA, 16 nt, Pseudomonas aeruginosa PA01
uggcggaucaccggcu

SEQ ID NO: 3483918 - RNA, 17 nt, Pseudomonas aeruginosa PA01
uggcggaucaccggcug

SEQ ID NO: 3483919 - RNA, 21 nt, Pseudomonas aeruginosa PA01
uggcggaucaccggcuggccc

SEQ ID NO: 3483920 - RNA, 19 nt, Pseudomonas aeruginosa PA01
uggcggauguaguccagcg

SEQ ID NO: 3483921 - RNA, 17 nt, Pseudomonas aeruginosa PA01
uggcggcaaggcacacg

SEQ ID NO: 3483922 - RNA, 18 nt, Pseudomonas aeruginosa PA01
uggcggcaaggcacacgc

SEQ ID NO: 3483923 - RNA, 22 nt, Pseudomonas aeruginosa PA01
uggcggcaaggcacacgcccgg

SEQ ID NO: 3483924 - RNA, 13 nt, Pseudomonas aeruginosa PA01
uggcggcaucgcg

SEQ ID NO: 3483925 - RNA, 17 nt, Pseudomonas aeruginosa PA01
uggcggcaucgcguagg

SEQ ID NO: 3483926 - RNA, 23 nt, Pseudomonas aeruginosa PA01
uggcggcaugccguugggccagg

SEQ ID NO: 3483927 - RNA, 21 nt, Pseudomonas aeruginosa PA01
uggcggcauugagcgccagca

SEQ ID NO: 3483928 - RNA, 17 nt, Pseudomonas aeruginosa PA01
uggcggcauugagggcg

SEQ ID NO: 3483929 - RNA, 19 nt, Pseudomonas aeruginosa PA01
uggcggccaucaggcgcug

SEQ ID NO: 3483930 - RNA, 13 nt, Pseudomonas aeruginosa PA01
uggcggccgacgg

SEQ ID NO: 3483931 - RNA, 21 nt, Pseudomonas aeruginosa PA01
uggcggccgaguucgcgcagg

SEQ ID NO: 3483932 - RNA, 14 nt, Pseudomonas aeruginosa PA01
uggcggccgccgcg

SEQ ID NO: 3483933 - RNA, 18 nt, Pseudomonas aeruginosa PA01
uggcggccgccgcgcagc

SEQ ID NO: 3483934 - RNA, 20 nt, Pseudomonas aeruginosa PA01
uggcggccgccgcgcagcac

SEQ ID NO: 3483935 - RNA, 20 nt, Pseudomonas aeruginosa PA01
uggcggccgccggcgcccug

SEQ ID NO: 3483936 - RNA, 21 nt, Pseudomonas aeruginosa PA01
uggcggccgccggcgcccugc

SEQ ID NO: 3483937 - RNA, 20 nt, Pseudomonas aeruginosa PA01
uggcggcgacgaagcccagg

SEQ ID NO: 3483938 - RNA, 21 nt, Pseudomonas aeruginosa PA01
uggcggcgacgaagcccaggc

SEQ ID NO: 3483939 - RNA, 19 nt, Pseudomonas aeruginosa PA01
uggcggcgacgaaggucgg

SEQ ID NO: 3483940 - RNA, 13 nt, Pseudomonas aeruginosa PA01
uggcggcgaucgc

SEQ ID NO: 3483941 - RNA, 16 nt, Pseudomonas aeruginosa PA01
uggcggcgaucgcccc

SEQ ID NO: 3483942 - RNA, 18 nt, Pseudomonas aeruginosa PA01
uggcggcgaucgccccgu

SEQ ID NO: 3483943 - RNA, 11 nt, Pseudomonas aeruginosa PA01
uggcggcgcca

SEQ ID NO: 3483944 - RNA, 15 nt, Pseudomonas aeruginosa PA01
uggcggcgccauagg

SEQ ID NO: 3483945 - RNA, 20 nt, Pseudomonas aeruginosa PA01
uggcggcgcgcgucguccag

SEQ ID NO: 3483946 - RNA, 12 nt, Pseudomonas aeruginosa PA01
uggcggcgcuca

SEQ ID NO: 3483947 - RNA, 13 nt, Pseudomonas aeruginosa PA01
uggcgggccagca

SEQ ID NO: 3483948 - RNA, 15 nt, Pseudomonas aeruginosa PA01
uggcgggccagcagg

SEQ ID NO: 3483949 - RNA, 21 nt, Pseudomonas aeruginosa PA01
uggcgggccagcaggcgcucg

SEQ ID NO: 3483950 - RNA, 20 nt, Pseudomonas aeruginosa PA01
uggcgggccuugcgaccagg

SEQ ID NO: 3483951 - RNA, 13 nt, Pseudomonas aeruginosa PA01
uggcgggcggccc

SEQ ID NO: 3483952 - RNA, 21 nt, Pseudomonas aeruginosa PA01
uggcgggcguuuucguuggcg

SEQ ID NO: 3483953 - RNA, 15 nt, Pseudomonas aeruginosa PA01
uggcggggaacagca

SEQ ID NO: 3483954 - RNA, 17 nt, Pseudomonas aeruginosa PA01
uggcggggaacagcaug

SEQ ID NO: 3483955 - RNA, 22 nt, Pseudomonas aeruginosa PA01
uggcggggucgcgccgguggcg

SEQ ID NO: 3483956 - RNA, 23 nt, Pseudomonas aeruginosa PA01
uggcgguacagcccccaggcacc

SEQ ID NO: 3483957 - RNA, 20 nt, Pseudomonas aeruginosa PA01
uggcgguacgcugcaugucc

SEQ ID NO: 3483958 - RNA, 18 nt, Pseudomonas aeruginosa PA01
uggcgguagcccggcagc

SEQ ID NO: 3483959 - RNA, 20 nt, Pseudomonas aeruginosa PA01
uggcgguagcccggcagcuc

SEQ ID NO: 3483960 - RNA, 14 nt, Pseudomonas aeruginosa PA01
uggcggucgccgac

SEQ ID NO: 3483961 - RNA, 13 nt, Pseudomonas aeruginosa PA01
uggcggugccgca

SEQ ID NO: 3483962 - RNA, 15 nt, Pseudomonas aeruginosa PA01
uggcgguggccgugg

SEQ ID NO: 3483963 - RNA, 19 nt, Pseudomonas aeruginosa PA01
uggcgguugaugccgacgu

SEQ ID NO: 3483964 - RNA, 22 nt, Pseudomonas aeruginosa PA01
uggcgguugaugccgacgucga

SEQ ID NO: 3483965 - RNA, 19 nt, Pseudomonas aeruginosa PA01
uggcguagaggcucggcgg

SEQ ID NO: 3483966 - RNA, 13 nt, Pseudomonas aeruginosa PA01
uggcguccaccgc

SEQ ID NO: 3483967 - RNA, 17 nt, Pseudomonas aeruginosa PA01
uggcguccaccgcuucg

SEQ ID NO: 3483968 - RNA, 21 nt, Pseudomonas aeruginosa PA01
uggcguccccaugcccggccu

SEQ ID NO: 3483969 - RNA, 23 nt, Pseudomonas aeruginosa PA01
uggcgucgaaugcggcguggaag

SEQ ID NO: 3483970 - RNA, 13 nt, Pseudomonas aeruginosa PA01
uggcgucgaccgc

SEQ ID NO: 3483971 - RNA, 14 nt, Pseudomonas aeruginosa PA01
uggcgucgaccgcc

SEQ ID NO: 3483972 - RNA, 16 nt, Pseudomonas aeruginosa PA01
uggcgucgaccgccug

SEQ ID NO: 3483973 - RNA, 11 nt, Pseudomonas aeruginosa PA01
uggcgucgauc

SEQ ID NO: 3483974 - RNA, 12 nt, Pseudomonas aeruginosa PA01
uggcgucgauca

SEQ ID NO: 3483975 - RNA, 21 nt, Pseudomonas aeruginosa PA01
uggcgucgaucaggcgggcgu

SEQ ID NO: 3483976 - RNA, 14 nt, Pseudomonas aeruginosa PA01
uggcgucgaugccg

SEQ ID NO: 3483977 - RNA, 15 nt, Pseudomonas aeruginosa PA01
uggcgucgaugccga

SEQ ID NO: 3483978 - RNA, 13 nt, Pseudomonas aeruginosa PA01
uggcgucgaugcg

SEQ ID NO: 3483979 - RNA, 14 nt, Pseudomonas aeruginosa PA01
uggcgucgcacugc

SEQ ID NO: 3483980 - RNA, 16 nt, Pseudomonas aeruginosa PA01
uggcgucgcacugcug

SEQ ID NO: 3483981 - RNA, 15 nt, Pseudomonas aeruginosa PA01
uggcgucgccuucca

SEQ ID NO: 3483982 - RNA, 21 nt, Pseudomonas aeruginosa PA01
uggcgucgccuuccaccacca

SEQ ID NO: 3483983 - RNA, 23 nt, Pseudomonas aeruginosa PA01
uggcgucgccuuccaccaccagg

SEQ ID NO: 3483984 - RNA, 19 nt, Pseudomonas aeruginosa PA01
uggcgucgggcuucuucac

SEQ ID NO: 3483985 - RNA, 19 nt, Pseudomonas aeruginosa PA01
uggcgugaaguagccgccg

SEQ ID NO: 3483986 - RNA, 12 nt, Pseudomonas aeruginosa PA01
uggcgugccgcc

SEQ ID NO: 3483987 - RNA, 16 nt, Pseudomonas aeruginosa PA01
uggcgugccgccaggc

SEQ ID NO: 3483988 - RNA, 14 nt, Pseudomonas aeruginosa PA01
uggcgugcucggcg

SEQ ID NO: 3483989 - RNA, 17 nt, Pseudomonas aeruginosa PA01
uggcgugcucggcgauc

SEQ ID NO: 3483990 - RNA, 18 nt, Pseudomonas aeruginosa PA01
uggcgugcucggcgaucu

SEQ ID NO: 3483991 - RNA, 13 nt, Pseudomonas aeruginosa PA01
uggcguggccggc

SEQ ID NO: 3483992 - RNA, 15 nt, Pseudomonas aeruginosa PA01
uggcguggccggcga

SEQ ID NO: 3483993 - RNA, 20 nt, Pseudomonas aeruginosa PA01
uggcguucucgaucaucgcc

SEQ ID NO: 3483994 - RNA, 17 nt, Pseudomonas aeruginosa PA01
uggcguucucggccagg

SEQ ID NO: 3483995 - RNA, 18 nt, Pseudomonas aeruginosa PA01
uggcguucucggccaggu

SEQ ID NO: 3483996 - RNA, 17 nt, Pseudomonas aeruginosa PA01
uggcguucugcgacauc

SEQ ID NO: 3483997 - RNA, 16 nt, Pseudomonas aeruginosa PA01
uggcguugacugccug

SEQ ID NO: 3483998 - RNA, 14 nt, Pseudomonas aeruginosa PA01
uggcguugccgugc

SEQ ID NO: 3483999 - RNA, 18 nt, Pseudomonas aeruginosa PA01
uggcguugucggcaaccg

SEQ ID NO: 3484000 - RNA, 22 nt, Pseudomonas aeruginosa PA01
uggcguugucggcaaccgggcg

SEQ ID NO: 3484001 - RNA, 19 nt, Pseudomonas aeruginosa PA01
uggcguuguugccgccgaa

SEQ ID NO: 3484002 - RNA, 20 nt, Pseudomonas aeruginosa PA01
uggcguuguuggucaggcug

SEQ ID NO: 3484003 - RNA, 15 nt, Pseudomonas aeruginosa PA01
uggcguuuucccagg

SEQ ID NO: 3484004 - RNA, 15 nt, Pseudomonas aeruginosa PA01
uggcuauucgcccag

SEQ ID NO: 3484005 - RNA, 14 nt, Pseudomonas aeruginosa PA01
uggcucaguugcug

SEQ ID NO: 3484006 - RNA, 18 nt, Pseudomonas aeruginosa PA01
uggcucaucucguugagg

SEQ ID NO: 3484007 - RNA, 23 nt, Pseudomonas aeruginosa PA01
uggcucauggcauggccauggca

SEQ ID NO: 3484008 - RNA, 20 nt, Pseudomonas aeruginosa PA01
uggcuccacugcuuggccag

SEQ ID NO: 3484009 - RNA, 21 nt, Pseudomonas aeruginosa PA01
uggcuccacugcuuggccagg

SEQ ID NO: 3484010 - RNA, 22 nt, Pseudomonas aeruginosa PA01
uggcuccacugcuuggccaggc

SEQ ID NO: 3484011 - RNA, 17 nt, Pseudomonas aeruginosa PA01
uggcuccgggccgaggg

SEQ ID NO: 3484012 - RNA, 24 nt, Pseudomonas aeruginosa PA01
uggcuccgggccgagggcugagac

SEQ ID NO: 3484013 - RNA, 14 nt, Pseudomonas aeruginosa PA01
uggcucgaucagcc

SEQ ID NO: 3484014 - RNA, 15 nt, Pseudomonas aeruginosa PA01
uggcucgaucggcag

SEQ ID NO: 3484015 - RNA, 15 nt, Pseudomonas aeruginosa PA01
uggcucggcggcagg

SEQ ID NO: 3484016 - RNA, 15 nt, Pseudomonas aeruginosa PA01
uggcucuugccgcga

SEQ ID NO: 3484017 - RNA, 16 nt, Pseudomonas aeruginosa PA01
uggcugaggcguucca

SEQ ID NO: 3484018 - RNA, 22 nt, Pseudomonas aeruginosa PA01
uggcugcagguaggcgguggcg

SEQ ID NO: 3484019 - RNA, 23 nt, Pseudomonas aeruginosa PA01
uggcugccggagucucgggaagg

SEQ ID NO: 3484020 - RNA, 13 nt, Pseudomonas aeruginosa PA01
uggcugcgcgcca

SEQ ID NO: 3484021 - RNA, 14 nt, Pseudomonas aeruginosa PA01
uggcugcgcgccac

SEQ ID NO: 3484022 - RNA, 16 nt, Pseudomonas aeruginosa PA01
uggcugcgcgccacca

SEQ ID NO: 3484023 - RNA, 18 nt, Pseudomonas aeruginosa PA01
uggcugcgcgccaccacc

SEQ ID NO: 3484024 - RNA, 16 nt, Pseudomonas aeruginosa PA01
uggcugcucgccucgg

SEQ ID NO: 3484025 - RNA, 19 nt, Pseudomonas aeruginosa PA01
uggcugcuggcgaagcugg

SEQ ID NO: 3484026 - RNA, 15 nt, Pseudomonas aeruginosa PA01
uggcuggccagcagg

SEQ ID NO: 3484027 - RNA, 13 nt, Pseudomonas aeruginosa PA01
uggcuggccagcc

SEQ ID NO: 3484028 - RNA, 18 nt, Pseudomonas aeruginosa PA01
uggcuggccagcccuggu

SEQ ID NO: 3484029 - RNA, 18 nt, Pseudomonas aeruginosa PA01
uggcuggccucagggcgc

SEQ ID NO: 3484030 - RNA, 20 nt, Pseudomonas aeruginosa PA01
uggcuggccucagggcgcga

SEQ ID NO: 3484031 - RNA, 13 nt, Pseudomonas aeruginosa PA01
uggcuggcgccgc

SEQ ID NO: 3484032 - RNA, 15 nt, Pseudomonas aeruginosa PA01
uggcuggcgccgcgg

SEQ ID NO: 3484033 - RNA, 24 nt, Pseudomonas aeruginosa PA01
uggcuggcgcuaccgcgcauggcg

SEQ ID NO: 3484034 - RNA, 12 nt, Pseudomonas aeruginosa PA01
uggcuggcguag

SEQ ID NO: 3484035 - RNA, 20 nt, Pseudomonas aeruginosa PA01
uggcugguaacgggcgaacc

SEQ ID NO: 3484036 - RNA, 17 nt, Pseudomonas aeruginosa PA01
uggcuguagcucugcug

SEQ ID NO: 3484037 - RNA, 14 nt, Pseudomonas aeruginosa PA01
uggcuguagggaca

SEQ ID NO: 3484038 - RNA, 21 nt, Pseudomonas aeruginosa PA01
uggcugucgccgaucugcagg

SEQ ID NO: 3484039 - RNA, 13 nt, Pseudomonas aeruginosa PA01
uggcugucggcgc

SEQ ID NO: 3484040 - RNA, 14 nt, Pseudomonas aeruginosa PA01
uggcugugcuggcc

SEQ ID NO: 3484041 - RNA, 17 nt, Pseudomonas aeruginosa PA01
uggcugugcuggccacc

SEQ ID NO: 3484042 - RNA, 14 nt, Pseudomonas aeruginosa PA01
uggcuuccagccag

SEQ ID NO: 3484043 - RNA, 16 nt, Pseudomonas aeruginosa PA01
uggcuuccgagcaguu

SEQ ID NO: 3484044 - RNA, 17 nt, Pseudomonas aeruginosa PA01
uggcuucguccagcgag

SEQ ID NO: 3484045 - RNA, 14 nt, Pseudomonas aeruginosa PA01
uggcuuuccagcau

SEQ ID NO: 3484046 - RNA, 18 nt, Pseudomonas aeruginosa PA01
uggcuuuccagggccugg

SEQ ID NO: 3484047 - RNA, 14 nt, Pseudomonas aeruginosa PA01
uggcuuuucucgcc

SEQ ID NO: 3484048 - RNA, 21 nt, Pseudomonas aeruginosa PA01
ugggaaagaaacgguggaggc

SEQ ID NO: 3484049 - RNA, 16 nt, Pseudomonas aeruginosa PA01
ugggaaccucggcagg

SEQ ID NO: 3484050 - RNA, 22 nt, Pseudomonas aeruginosa PA01
ugggaagagcaucucgccggca

SEQ ID NO: 3484051 - RNA, 17 nt, Pseudomonas aeruginosa PA01
ugggaauggcggauagc

SEQ ID NO: 3484052 - RNA, 16 nt, Pseudomonas aeruginosa PA01
ugggaauugcgcacgc

SEQ ID NO: 3484053 - RNA, 18 nt, Pseudomonas aeruginosa PA01
ugggacaggaagagcagg

SEQ ID NO: 3484054 - RNA, 13 nt, Pseudomonas aeruginosa PA01
ugggacgaccuca

SEQ ID NO: 3484055 - RNA, 15 nt, Pseudomonas aeruginosa PA01
ugggacgaccucaga

SEQ ID NO: 3484056 - RNA, 22 nt, Pseudomonas aeruginosa PA01
ugggacggaacgucggccuggg

SEQ ID NO: 3484057 - RNA, 16 nt, Pseudomonas aeruginosa PA01
ugggacggcagccugg

SEQ ID NO: 3484058 - RNA, 14 nt, Pseudomonas aeruginosa PA01
ugggacggcguggu

SEQ ID NO: 3484059 - RNA, 14 nt, Pseudomonas aeruginosa PA01
ugggacggcugccc

SEQ ID NO: 3484060 - RNA, 20 nt, Pseudomonas aeruginosa PA01
ugggagaacuuuucccagcg

SEQ ID NO: 3484061 - RNA, 22 nt, Pseudomonas aeruginosa PA01
ugggaguccagguacaccaggg

SEQ ID NO: 3484062 - RNA, 18 nt, Pseudomonas aeruginosa PA01
ugggauagcuuuccaggg

SEQ ID NO: 3484063 - RNA, 14 nt, Pseudomonas aeruginosa PA01
ugggaucggcgauc

SEQ ID NO: 3484064 - RNA, 15 nt, Pseudomonas aeruginosa PA01
ugggaucggcgauca

SEQ ID NO: 3484065 - RNA, 21 nt, Pseudomonas aeruginosa PA01
ugggaucgucgaagcucggcg

SEQ ID NO: 3484066 - RNA, 14 nt, Pseudomonas aeruginosa PA01
ugggauggccagcc

SEQ ID NO: 3484067 - RNA, 15 nt, Pseudomonas aeruginosa PA01
ugggauggccagcca

SEQ ID NO: 3484068 - RNA, 13 nt, Pseudomonas aeruginosa PA01
ugggauggcgcgg

SEQ ID NO: 3484069 - RNA, 22 nt, Pseudomonas aeruginosa PA01
ugggauucagugggucgaugcc

SEQ ID NO: 3484070 - RNA, 15 nt, Pseudomonas aeruginosa PA01
ugggcaagcugcacg

SEQ ID NO: 3484071 - RNA, 17 nt, Pseudomonas aeruginosa PA01
ugggcaccgcgccggcg

SEQ ID NO: 3484072 - RNA, 18 nt, Pseudomonas aeruginosa PA01
ugggcaccgcgccggcgg

SEQ ID NO: 3484073 - RNA, 16 nt, Pseudomonas aeruginosa PA01
ugggcacgaugcugaa

SEQ ID NO: 3484074 - RNA, 16 nt, Pseudomonas aeruginosa PA01
ugggcacgccgguggc

SEQ ID NO: 3484075 - RNA, 21 nt, Pseudomonas aeruginosa PA01
ugggcacgccgguggccaggc

SEQ ID NO: 3484076 - RNA, 19 nt, Pseudomonas aeruginosa PA01
ugggcagcagcgaacgccg

SEQ ID NO: 3484077 - RNA, 14 nt, Pseudomonas aeruginosa PA01
ugggcagccacgaa

SEQ ID NO: 3484078 - RNA, 13 nt, Pseudomonas aeruginosa PA01
ugggcagcgccgc

SEQ ID NO: 3484079 - RNA, 18 nt, Pseudomonas aeruginosa PA01
ugggcagcggucgccggu

SEQ ID NO: 3484080 - RNA, 18 nt, Pseudomonas aeruginosa PA01
ugggcagcgucgccgggc

SEQ ID NO: 3484081 - RNA, 19 nt, Pseudomonas aeruginosa PA01
ugggcagcgucgccgggcg

SEQ ID NO: 3484082 - RNA, 19 nt, Pseudomonas aeruginosa PA01
ugggcagcgugcaccagca

SEQ ID NO: 3484083 - RNA, 21 nt, Pseudomonas aeruginosa PA01
ugggcaggauaucgcccaggg

SEQ ID NO: 3484084 - RNA, 17 nt, Pseudomonas aeruginosa PA01
ugggcaggcgcaugucc

SEQ ID NO: 3484085 - RNA, 17 nt, Pseudomonas aeruginosa PA01
ugggcagggugucgacg

SEQ ID NO: 3484086 - RNA, 23 nt, Pseudomonas aeruginosa PA01
ugggcaucagcucgucuuucagg

SEQ ID NO: 3484087 - RNA, 19 nt, Pseudomonas aeruginosa PA01
ugggcaugcucggccaggu

SEQ ID NO: 3484088 - RNA, 13 nt, Pseudomonas aeruginosa PA01
ugggcauggcugg

SEQ ID NO: 3484089 - RNA, 14 nt, Pseudomonas aeruginosa PA01
ugggcauggcuggc

SEQ ID NO: 3484090 - RNA, 23 nt, Pseudomonas aeruginosa PA01
ugggccaacgguagcggaucagc

SEQ ID NO: 3484091 - RNA, 16 nt, Pseudomonas aeruginosa PA01
ugggccaccuggcucu

SEQ ID NO: 3484092 - RNA, 19 nt, Pseudomonas aeruginosa PA01
ugggccacguucugcagga

SEQ ID NO: 3484093 - RNA, 22 nt, Pseudomonas aeruginosa PA01
ugggccacuucgcgguccaggg

SEQ ID NO: 3484094 - RNA, 12 nt, Pseudomonas aeruginosa PA01
ugggccagccca

SEQ ID NO: 3484095 - RNA, 18 nt, Pseudomonas aeruginosa PA01
ugggccagcgccguacgc

SEQ ID NO: 3484096 - RNA, 20 nt, Pseudomonas aeruginosa PA01
ugggccagcgccguacgcac

SEQ ID NO: 3484097 - RNA, 20 nt, Pseudomonas aeruginosa PA01
ugggccagggauuccuuggu

SEQ ID NO: 3484098 - RNA, 16 nt, Pseudomonas aeruginosa PA01
ugggccaucgccggcc

SEQ ID NO: 3484099 - RNA, 18 nt, Pseudomonas aeruginosa PA01
ugggccaucgccggcccg

SEQ ID NO: 3484100 - RNA, 22 nt, Pseudomonas aeruginosa PA01
ugggccaucgccggcccgcgcg

SEQ ID NO: 3484101 - RNA, 18 nt, Pseudomonas aeruginosa PA01
ugggccaugaccucggcc

SEQ ID NO: 3484102 - RNA, 21 nt, Pseudomonas aeruginosa PA01
ugggccaugaccucggccagc

SEQ ID NO: 3484103 - RNA, 23 nt, Pseudomonas aeruginosa PA01
ugggccaugaccucggccagcca

SEQ ID NO: 3484104 - RNA, 15 nt, Pseudomonas aeruginosa PA01
ugggccccggccagg

SEQ ID NO: 3484105 - RNA, 16 nt, Pseudomonas aeruginosa PA01
ugggccccggccaggu

SEQ ID NO: 3484106 - RNA, 13 nt, Pseudomonas aeruginosa PA01
ugggccccggccg

SEQ ID NO: 3484107 - RNA, 16 nt, Pseudomonas aeruginosa PA01
ugggccgaaggccagg

SEQ ID NO: 3484108 - RNA, 17 nt, Pseudomonas aeruginosa PA01
ugggccgaaggccaggc

SEQ ID NO: 3484109 - RNA, 21 nt, Pseudomonas aeruginosa PA01
ugggccgaaggccaggccggc

SEQ ID NO: 3484110 - RNA, 15 nt, Pseudomonas aeruginosa PA01
ugggccgccgaacgg

SEQ ID NO: 3484111 - RNA, 20 nt, Pseudomonas aeruginosa PA01
ugggccggaacggcuugcug

SEQ ID NO: 3484112 - RNA, 15 nt, Pseudomonas aeruginosa PA01
ugggccggccgacga

SEQ ID NO: 3484113 - RNA, 16 nt, Pseudomonas aeruginosa PA01
ugggccggcgccagca

SEQ ID NO: 3484114 - RNA, 15 nt, Pseudomonas aeruginosa PA01
ugggccggcgcgccg

SEQ ID NO: 3484115 - RNA, 16 nt, Pseudomonas aeruginosa PA01
ugggccggcgcgccgu

SEQ ID NO: 3484116 - RNA, 19 nt, Pseudomonas aeruginosa PA01
ugggccgguugcggcgccg

SEQ ID NO: 3484117 - RNA, 19 nt, Pseudomonas aeruginosa PA01
ugggccgugaaaagcggcg

SEQ ID NO: 3484118 - RNA, 12 nt, Pseudomonas aeruginosa PA01
ugggccucgcug

SEQ ID NO: 3484119 - RNA, 16 nt, Pseudomonas aeruginosa PA01
ugggccucgcugcgca

SEQ ID NO: 3484120 - RNA, 17 nt, Pseudomonas aeruginosa PA01
ugggccugcuccucggc

SEQ ID NO: 3484121 - RNA, 19 nt, Pseudomonas aeruginosa PA01
ugggccugcuccucggcag

SEQ ID NO: 3484122 - RNA, 16 nt, Pseudomonas aeruginosa PA01
ugggccuugagcaggc

SEQ ID NO: 3484123 - RNA, 21 nt, Pseudomonas aeruginosa PA01
ugggcgaacagcacccaggau

SEQ ID NO: 3484124 - RNA, 18 nt, Pseudomonas aeruginosa PA01
ugggcgaacagcgagacc

SEQ ID NO: 3484125 - RNA, 18 nt, Pseudomonas aeruginosa PA01
ugggcgaagccggcggcg

SEQ ID NO: 3484126 - RNA, 20 nt, Pseudomonas aeruginosa PA01
ugggcgaagccggcggcgcg

SEQ ID NO: 3484127 - RNA, 15 nt, Pseudomonas aeruginosa PA01
ugggcgaagucgacg

SEQ ID NO: 3484128 - RNA, 20 nt, Pseudomonas aeruginosa PA01
ugggcgaaguugaaacggcg

SEQ ID NO: 3484129 - RNA, 22 nt, Pseudomonas aeruginosa PA01
ugggcgaccuucagcgggucga

SEQ ID NO: 3484130 - RNA, 21 nt, Pseudomonas aeruginosa PA01
ugggcgagaccggggaucagc

SEQ ID NO: 3484131 - RNA, 19 nt, Pseudomonas aeruginosa PA01
ugggcgagcgacggugaua

SEQ ID NO: 3484132 - RNA, 14 nt, Pseudomonas aeruginosa PA01
ugggcgaggcgcuc

SEQ ID NO: 3484133 - RNA, 18 nt, Pseudomonas aeruginosa PA01
ugggcgaggcgcucgacg

SEQ ID NO: 3484134 - RNA, 12 nt, Pseudomonas aeruginosa PA01
ugggcgagggcg

SEQ ID NO: 3484135 - RNA, 14 nt, Pseudomonas aeruginosa PA01
ugggcgaugcgccg

SEQ ID NO: 3484136 - RNA, 12 nt, Pseudomonas aeruginosa PA01
ugggcgaugcgg

SEQ ID NO: 3484137 - RNA, 17 nt, Pseudomonas aeruginosa PA01
ugggcgcacuccgggca

SEQ ID NO: 3484138 - RNA, 11 nt, Pseudomonas aeruginosa PA01
ugggcgccagc

SEQ ID NO: 3484139 - RNA, 14 nt, Pseudomonas aeruginosa PA01
ugggcgccgccagc

SEQ ID NO: 3484140 - RNA, 18 nt, Pseudomonas aeruginosa PA01
ugggcgccgccagccaga

SEQ ID NO: 3484141 - RNA, 21 nt, Pseudomonas aeruginosa PA01
ugggcgccgccagccagagca

SEQ ID NO: 3484142 - RNA, 17 nt, Pseudomonas aeruginosa PA01
ugggcgccgccggugca

SEQ ID NO: 3484143 - RNA, 22 nt, Pseudomonas aeruginosa PA01
ugggcgccgccggugcaccagg

SEQ ID NO: 3484144 - RNA, 14 nt, Pseudomonas aeruginosa PA01
ugggcgccgcugug

SEQ ID NO: 3484145 - RNA, 12 nt, Pseudomonas aeruginosa PA01
ugggcgccggcg

SEQ ID NO: 3484146 - RNA, 15 nt, Pseudomonas aeruginosa PA01
ugggcgccggcgcgc

SEQ ID NO: 3484147 - RNA, 19 nt, Pseudomonas aeruginosa PA01
ugggcgccucgccgcggca

SEQ ID NO: 3484148 - RNA, 18 nt, Pseudomonas aeruginosa PA01
ugggcgccucgucgacgc

SEQ ID NO: 3484149 - RNA, 12 nt, Pseudomonas aeruginosa PA01
ugggcgcgcgcc

SEQ ID NO: 3484150 - RNA, 15 nt, Pseudomonas aeruginosa PA01
ugggcgcgcgccggg

SEQ ID NO: 3484151 - RNA, 16 nt, Pseudomonas aeruginosa PA01
ugggcgcgcgccgggc

SEQ ID NO: 3484152 - RNA, 21 nt, Pseudomonas aeruginosa PA01
ugggcgcgcgccgggcucagc

SEQ ID NO: 3484153 - RNA, 21 nt, Pseudomonas aeruginosa PA01
ugggcgcguucucccugagcc

SEQ ID NO: 3484154 - RNA, 15 nt, Pseudomonas aeruginosa PA01
ugggcgcucagcauc

SEQ ID NO: 3484155 - RNA, 13 nt, Pseudomonas aeruginosa PA01
ugggcggccaggu

SEQ ID NO: 3484156 - RNA, 17 nt, Pseudomonas aeruginosa PA01
ugggcggccggccaggu

SEQ ID NO: 3484157 - RNA, 14 nt, Pseudomonas aeruginosa PA01
ugggcggccucgua

SEQ ID NO: 3484158 - RNA, 23 nt, Pseudomonas aeruginosa PA01
ugggcggccucguaggcggcgcg

SEQ ID NO: 3484159 - RNA, 19 nt, Pseudomonas aeruginosa PA01
ugggcggcgaccauccagc

SEQ ID NO: 3484160 - RNA, 23 nt, Pseudomonas aeruginosa PA01
ugggcggcgaccgaacagcgcgc

SEQ ID NO: 3484161 - RNA, 15 nt, Pseudomonas aeruginosa PA01
ugggcggcgaccugc

SEQ ID NO: 3484162 - RNA, 14 nt, Pseudomonas aeruginosa PA01
ugggcggucggcga

SEQ ID NO: 3484163 - RNA, 15 nt, Pseudomonas aeruginosa PA01
ugggcggucggcgag

SEQ ID NO: 3484164 - RNA, 16 nt, Pseudomonas aeruginosa PA01
ugggcggucggcucag

SEQ ID NO: 3484165 - RNA, 19 nt, Pseudomonas aeruginosa PA01
ugggcguacaggccccagg

SEQ ID NO: 3484166 - RNA, 14 nt, Pseudomonas aeruginosa PA01
ugggcguccgguag

SEQ ID NO: 3484167 - RNA, 15 nt, Pseudomonas aeruginosa PA01
ugggcguccgguagg

SEQ ID NO: 3484168 - RNA, 22 nt, Pseudomonas aeruginosa PA01
ugggcgucgcuguagcggcucg

SEQ ID NO: 3484169 - RNA, 21 nt, Pseudomonas aeruginosa PA01
ugggcgugcuuggcgaggcgc

SEQ ID NO: 3484170 - RNA, 22 nt, Pseudomonas aeruginosa PA01
ugggcgugcuuggcgaggcgcg

SEQ ID NO: 3484171 - RNA, 10 nt, Pseudomonas aeruginosa PA01
ugggcguggc

SEQ ID NO: 3484172 - RNA, 13 nt, Pseudomonas aeruginosa PA01
ugggcguggcggc

SEQ ID NO: 3484173 - RNA, 15 nt, Pseudomonas aeruginosa PA01
ugggcguggcggccg

SEQ ID NO: 3484174 - RNA, 16 nt, Pseudomonas aeruginosa PA01
ugggcguggcggccgc

SEQ ID NO: 3484175 - RNA, 15 nt, Pseudomonas aeruginosa PA01
ugggcguugcccaug

SEQ ID NO: 3484176 - RNA, 15 nt, Pseudomonas aeruginosa PA01
ugggcguuggccagc

SEQ ID NO: 3484177 - RNA, 18 nt, Pseudomonas aeruginosa PA01
ugggcguuggccagcgcc

SEQ ID NO: 3484178 - RNA, 22 nt, Pseudomonas aeruginosa PA01
ugggcguuggccagcgccacca

SEQ ID NO: 3484179 - RNA, 17 nt, Pseudomonas aeruginosa PA01
ugggcuaccgcaucgcc

SEQ ID NO: 3484180 - RNA, 21 nt, Pseudomonas aeruginosa PA01
ugggcuaccgcaucgccaccg

SEQ ID NO: 3484181 - RNA, 11 nt, Pseudomonas aeruginosa PA01
ugggcucagau

SEQ ID NO: 3484182 - RNA, 23 nt, Pseudomonas aeruginosa PA01
ugggcucagauuaucugcgacug

SEQ ID NO: 3484183 - RNA, 14 nt, Pseudomonas aeruginosa PA01
ugggcucuaugcaa

SEQ ID NO: 3484184 - RNA, 20 nt, Pseudomonas aeruginosa PA01
ugggcugggucggcuggcag

SEQ ID NO: 3484185 - RNA, 14 nt, Pseudomonas aeruginosa PA01
ugggcuucgccgcc

SEQ ID NO: 3484186 - RNA, 17 nt, Pseudomonas aeruginosa PA01
ugggcuucgccgccgcg

SEQ ID NO: 3484187 - RNA, 13 nt, Pseudomonas aeruginosa PA01
uggggaaaucggu

SEQ ID NO: 3484188 - RNA, 17 nt, Pseudomonas aeruginosa PA01
uggggaagacggccagg

SEQ ID NO: 3484189 - RNA, 18 nt, Pseudomonas aeruginosa PA01
uggggaaucugcgccagg

SEQ ID NO: 3484190 - RNA, 21 nt, Pseudomonas aeruginosa PA01
uggggaaucugcgccaggugu

SEQ ID NO: 3484191 - RNA, 21 nt, Pseudomonas aeruginosa PA01
uggggacggaagcauggccgg

SEQ ID NO: 3484192 - RNA, 13 nt, Pseudomonas aeruginosa PA01
uggggaugcgcga

SEQ ID NO: 3484193 - RNA, 20 nt, Pseudomonas aeruginosa PA01
uggggauggccggcgcggcg

SEQ ID NO: 3484194 - RNA, 21 nt, Pseudomonas aeruginosa PA01
uggggcaucucggccaccugc

SEQ ID NO: 3484195 - RNA, 21 nt, Pseudomonas aeruginosa PA01
uggggcgaauaaccauugcgc

SEQ ID NO: 3484196 - RNA, 12 nt, Pseudomonas aeruginosa PA01
uggggcgccggc

SEQ ID NO: 3484197 - RNA, 20 nt, Pseudomonas aeruginosa PA01
uggggcgccggcucgcccag

SEQ ID NO: 3484198 - RNA, 23 nt, Pseudomonas aeruginosa PA01
uggggcggauaagcaagcgcaac

SEQ ID NO: 3484199 - RNA, 19 nt, Pseudomonas aeruginosa PA01
uggggcuauagcucagcug

SEQ ID NO: 3484200 - RNA, 22 nt, Pseudomonas aeruginosa PA01
uggggcuauagcucagcuggga

SEQ ID NO: 3484201 - RNA, 21 nt, Pseudomonas aeruginosa PA01
uggggcucggcuuccaucacc

SEQ ID NO: 3484202 - RNA, 17 nt, Pseudomonas aeruginosa PA01
uggggcugcccaccacc

SEQ ID NO: 3484203 - RNA, 21 nt, Pseudomonas aeruginosa PA01
uggggcugcccaccaccagga

SEQ ID NO: 3484204 - RNA, 23 nt, Pseudomonas aeruginosa PA01
uggggcugcccaccaccaggacc

SEQ ID NO: 3484205 - RNA, 23 nt, Pseudomonas aeruginosa PA01
ugggggaggggagguaagugauu

SEQ ID NO: 3484206 - RNA, 20 nt, Pseudomonas aeruginosa PA01
ugggggauuuccucgucgcc

SEQ ID NO: 3484207 - RNA, 16 nt, Pseudomonas aeruginosa PA01
ugggguagccggccga

SEQ ID NO: 3484208 - RNA, 17 nt, Pseudomonas aeruginosa PA01
uggggugaggccgagcc

SEQ ID NO: 3484209 - RNA, 13 nt, Pseudomonas aeruginosa PA01
uggggugcagcag

SEQ ID NO: 3484210 - RNA, 17 nt, Pseudomonas aeruginosa PA01
ugggguugcggcgcccg

SEQ ID NO: 3484211 - RNA, 18 nt, Pseudomonas aeruginosa PA01
ugggguugcggcgcccgc

SEQ ID NO: 3484212 - RNA, 18 nt, Pseudomonas aeruginosa PA01
ugggguuucugcuggcca

SEQ ID NO: 3484213 - RNA, 22 nt, Pseudomonas aeruginosa PA01
ugggguuucugcuggccaccgc

SEQ ID NO: 3484214 - RNA, 14 nt, Pseudomonas aeruginosa PA01
uggguaccgaacuu

SEQ ID NO: 3484215 - RNA, 17 nt, Pseudomonas aeruginosa PA01
uggguacgcaccggcuu

SEQ ID NO: 3484216 - RNA, 13 nt, Pseudomonas aeruginosa PA01
uggguaggccagg

SEQ ID NO: 3484217 - RNA, 14 nt, Pseudomonas aeruginosa PA01
uggguaggccaggc

SEQ ID NO: 3484218 - RNA, 18 nt, Pseudomonas aeruginosa PA01
uggguauagaccagcacc

SEQ ID NO: 3484219 - RNA, 16 nt, Pseudomonas aeruginosa PA01
uggguauccagcggcc

SEQ ID NO: 3484220 - RNA, 16 nt, Pseudomonas aeruginosa PA01
ugggucacggugagga

SEQ ID NO: 3484221 - RNA, 15 nt, Pseudomonas aeruginosa PA01
ugggucagcgccagc

SEQ ID NO: 3484222 - RNA, 18 nt, Pseudomonas aeruginosa PA01
ugggucagcgccagcaac

SEQ ID NO: 3484223 - RNA, 22 nt, Pseudomonas aeruginosa PA01
ugggucagcggguuggcuucca

SEQ ID NO: 3484224 - RNA, 22 nt, Pseudomonas aeruginosa PA01
ugggucaucgaacaucucgaag

SEQ ID NO: 3484225 - RNA, 17 nt, Pseudomonas aeruginosa PA01
ugggucuccuccuccau

SEQ ID NO: 3484226 - RNA, 16 nt, Pseudomonas aeruginosa PA01
ugggugaacagcggcc

SEQ ID NO: 3484227 - RNA, 18 nt, Pseudomonas aeruginosa PA01
ugggugaacagcggcccg

SEQ ID NO: 3484228 - RNA, 23 nt, Pseudomonas aeruginosa PA01
ugggugaagaccagucggccguu

SEQ ID NO: 3484229 - RNA, 13 nt, Pseudomonas aeruginosa PA01
ugggugaccagca

SEQ ID NO: 3484230 - RNA, 17 nt, Pseudomonas aeruginosa PA01
ugggugaugaccccggc

SEQ ID NO: 3484231 - RNA, 15 nt, Pseudomonas aeruginosa PA01
ugggugccgcgcagg

SEQ ID NO: 3484232 - RNA, 21 nt, Pseudomonas aeruginosa PA01
ugggugcggugggcgagggcg

SEQ ID NO: 3484233 - RNA, 16 nt, Pseudomonas aeruginosa PA01
ugggugucggcgauca

SEQ ID NO: 3484234 - RNA, 15 nt, Pseudomonas aeruginosa PA01
uggguucaggcucca

SEQ ID NO: 3484235 - RNA, 16 nt, Pseudomonas aeruginosa PA01
uggguucccagcagca

SEQ ID NO: 3484236 - RNA, 12 nt, Pseudomonas aeruginosa PA01
ugguacagcacc

SEQ ID NO: 3484237 - RNA, 20 nt, Pseudomonas aeruginosa PA01
ugguaccgcugcgugccagg

SEQ ID NO: 3484238 - RNA, 17 nt, Pseudomonas aeruginosa PA01
ugguacucguccuccca

SEQ ID NO: 3484239 - RNA, 16 nt, Pseudomonas aeruginosa PA01
ugguagcccaggccga

SEQ ID NO: 3484240 - RNA, 15 nt, Pseudomonas aeruginosa PA01
ugguagcgcuccagc

SEQ ID NO: 3484241 - RNA, 20 nt, Pseudomonas aeruginosa PA01
ugguaggacagggccaggcc

SEQ ID NO: 3484242 - RNA, 19 nt, Pseudomonas aeruginosa PA01
ugguaggcgucgucgaccu

SEQ ID NO: 3484243 - RNA, 22 nt, Pseudomonas aeruginosa PA01
ugguaggcgucgucgaccucga

SEQ ID NO: 3484244 - RNA, 23 nt, Pseudomonas aeruginosa PA01
ugguaggcucccccgcgccgccg

SEQ ID NO: 3484245 - RNA, 15 nt, Pseudomonas aeruginosa PA01
ugguagucgagccgg

SEQ ID NO: 3484246 - RNA, 13 nt, Pseudomonas aeruginosa PA01
ugguaucgccguc

SEQ ID NO: 3484247 - RNA, 18 nt, Pseudomonas aeruginosa PA01
ugguaucggcgcucaccg

SEQ ID NO: 3484248 - RNA, 22 nt, Pseudomonas aeruginosa PA01
ugguauggcggucggccaggcg

SEQ ID NO: 3484249 - RNA, 22 nt, Pseudomonas aeruginosa PA01
ugguauugcgcccagaguucgc

SEQ ID NO: 3484250 - RNA, 16 nt, Pseudomonas aeruginosa PA01
ugguauuggucgcgau

SEQ ID NO: 3484251 - RNA, 15 nt, Pseudomonas aeruginosa PA01
uggucaacaccagcg

SEQ ID NO: 3484252 - RNA, 17 nt, Pseudomonas aeruginosa PA01
uggucaacaccagcgcc

SEQ ID NO: 3484253 - RNA, 19 nt, Pseudomonas aeruginosa PA01
uggucaacaccagcgccgc

SEQ ID NO: 3484254 - RNA, 23 nt, Pseudomonas aeruginosa PA01
uggucaacaccagcgccgccagg

SEQ ID NO: 3484255 - RNA, 20 nt, Pseudomonas aeruginosa PA01
uggucaccacguugcgccgc

SEQ ID NO: 3484256 - RNA, 15 nt, Pseudomonas aeruginosa PA01
uggucaccagcgugg

SEQ ID NO: 3484257 - RNA, 14 nt, Pseudomonas aeruginosa PA01
uggucaccaugauc

SEQ ID NO: 3484258 - RNA, 20 nt, Pseudomonas aeruginosa PA01
uggucaccaugaucaucggc

SEQ ID NO: 3484259 - RNA, 14 nt, Pseudomonas aeruginosa PA01
uggucaccgccagc

SEQ ID NO: 3484260 - RNA, 15 nt, Pseudomonas aeruginosa PA01
uggucaccuugaccu

SEQ ID NO: 3484261 - RNA, 16 nt, Pseudomonas aeruginosa PA01
uggucacgccguucag

SEQ ID NO: 3484262 - RNA, 23 nt, Pseudomonas aeruginosa PA01
uggucacgccguucagggucagg

SEQ ID NO: 3484263 - RNA, 18 nt, Pseudomonas aeruginosa PA01
uggucacuggcgaggcug

SEQ ID NO: 3484264 - RNA, 19 nt, Pseudomonas aeruginosa PA01
uggucacuggcgaggcugc

SEQ ID NO: 3484265 - RNA, 21 nt, Pseudomonas aeruginosa PA01
uggucagcaccagggccaggg

SEQ ID NO: 3484266 - RNA, 12 nt, Pseudomonas aeruginosa PA01
uggucaggacgc

SEQ ID NO: 3484267 - RNA, 22 nt, Pseudomonas aeruginosa PA01
uggucaggaucacaucgcccgg

SEQ ID NO: 3484268 - RNA, 14 nt, Pseudomonas aeruginosa PA01
uggucaggcccugc

SEQ ID NO: 3484269 - RNA, 17 nt, Pseudomonas aeruginosa PA01
uggucaggccgaccagc

SEQ ID NO: 3484270 - RNA, 20 nt, Pseudomonas aeruginosa PA01
uggucaggccgaccagcgcc

SEQ ID NO: 3484271 - RNA, 14 nt, Pseudomonas aeruginosa PA01
uggucaggccggcg

SEQ ID NO: 3484272 - RNA, 15 nt, Pseudomonas aeruginosa PA01
uggucaggcgccagg

SEQ ID NO: 3484273 - RNA, 15 nt, Pseudomonas aeruginosa PA01
uggucaggcuggccc

SEQ ID NO: 3484274 - RNA, 18 nt, Pseudomonas aeruginosa PA01
uggucaggucgacgccgc

SEQ ID NO: 3484275 - RNA, 20 nt, Pseudomonas aeruginosa PA01
uggucaggucgacgccgccg

SEQ ID NO: 3484276 - RNA, 19 nt, Pseudomonas aeruginosa PA01
uggucaguucggcccagca

SEQ ID NO: 3484277 - RNA, 20 nt, Pseudomonas aeruginosa PA01
uggucaguucggcccagcag

SEQ ID NO: 3484278 - RNA, 13 nt, Pseudomonas aeruginosa PA01
uggucaucaccuu

SEQ ID NO: 3484279 - RNA, 15 nt, Pseudomonas aeruginosa PA01
uggucaucaccuucg

SEQ ID NO: 3484280 - RNA, 21 nt, Pseudomonas aeruginosa PA01
uggucaucaccuucgccagca

SEQ ID NO: 3484281 - RNA, 13 nt, Pseudomonas aeruginosa PA01
ugguccaccagcc

SEQ ID NO: 3484282 - RNA, 11 nt, Pseudomonas aeruginosa PA01
ugguccagcac

SEQ ID NO: 3484283 - RNA, 18 nt, Pseudomonas aeruginosa PA01
ugguccagcacgcuggcg

SEQ ID NO: 3484284 - RNA, 13 nt, Pseudomonas aeruginosa PA01
ugguccgccagca

SEQ ID NO: 3484285 - RNA, 13 nt, Pseudomonas aeruginosa PA01
ugguccggcacuu

SEQ ID NO: 3484286 - RNA, 21 nt, Pseudomonas aeruginosa PA01
ugguccguucggcgcccaggu

SEQ ID NO: 3484287 - RNA, 16 nt, Pseudomonas aeruginosa PA01
ugguccugaggcuccc

SEQ ID NO: 3484288 - RNA, 15 nt, Pseudomonas aeruginosa PA01
ugguccugcggcggc

SEQ ID NO: 3484289 - RNA, 15 nt, Pseudomonas aeruginosa PA01
ugguccuuauucggc

SEQ ID NO: 3484290 - RNA, 13 nt, Pseudomonas aeruginosa PA01
uggucgaagcgga

SEQ ID NO: 3484291 - RNA, 14 nt, Pseudomonas aeruginosa PA01
uggucgaccaggcg

SEQ ID NO: 3484292 - RNA, 21 nt, Pseudomonas aeruginosa PA01
uggucgacguaggcggcgagg

SEQ ID NO: 3484293 - RNA, 22 nt, Pseudomonas aeruginosa PA01
uggucgagcuuguuggccagca

SEQ ID NO: 3484294 - RNA, 22 nt, Pseudomonas aeruginosa PA01
uggucgauauagcccugggcgc

SEQ ID NO: 3484295 - RNA, 17 nt, Pseudomonas aeruginosa PA01
uggucgauccgcgccug

SEQ ID NO: 3484296 - RNA, 19 nt, Pseudomonas aeruginosa PA01
uggucgaucucgucgaagc

SEQ ID NO: 3484297 - RNA, 22 nt, Pseudomonas aeruginosa PA01
uggucgaugaucuugucgugcc

SEQ ID NO: 3484298 - RNA, 23 nt, Pseudomonas aeruginosa PA01
uggucgaugggcgagcgacggug

SEQ ID NO: 3484299 - RNA, 15 nt, Pseudomonas aeruginosa PA01
uggucgcagccgcgc

SEQ ID NO: 3484300 - RNA, 14 nt, Pseudomonas aeruginosa PA01
uggucgcagcucca

SEQ ID NO: 3484301 - RNA, 17 nt, Pseudomonas aeruginosa PA01
uggucgcagcuccagcg

SEQ ID NO: 3484302 - RNA, 15 nt, Pseudomonas aeruginosa PA01
uggucgccgaaguac

SEQ ID NO: 3484303 - RNA, 18 nt, Pseudomonas aeruginosa PA01
uggucgccgcagguccgg

SEQ ID NO: 3484304 - RNA, 12 nt, Pseudomonas aeruginosa PA01
uggucgccgccc

SEQ ID NO: 3484305 - RNA, 16 nt, Pseudomonas aeruginosa PA01
uggucgccgcccacgc

SEQ ID NO: 3484306 - RNA, 20 nt, Pseudomonas aeruginosa PA01
uggucgccgcgaccucguug

SEQ ID NO: 3484307 - RNA, 17 nt, Pseudomonas aeruginosa PA01
uggucgccguccaccaa

SEQ ID NO: 3484308 - RNA, 18 nt, Pseudomonas aeruginosa PA01
uggucgcgaucaccgcgu

SEQ ID NO: 3484309 - RNA, 19 nt, Pseudomonas aeruginosa PA01
uggucgcgaucaccgcguc

SEQ ID NO: 3484310 - RNA, 20 nt, Pseudomonas aeruginosa PA01
uggucgcgaucaccgcgucc

SEQ ID NO: 3484311 - RNA, 22 nt, Pseudomonas aeruginosa PA01
uggucgcgcaggcgguggagca

SEQ ID NO: 3484312 - RNA, 13 nt, Pseudomonas aeruginosa PA01
uggucgcgcgcgg

SEQ ID NO: 3484313 - RNA, 14 nt, Pseudomonas aeruginosa PA01
uggucgcgcgcggc

SEQ ID NO: 3484314 - RNA, 16 nt, Pseudomonas aeruginosa PA01
uggucgcgcgcggcca

SEQ ID NO: 3484315 - RNA, 14 nt, Pseudomonas aeruginosa PA01
uggucgcuccagcc

SEQ ID NO: 3484316 - RNA, 16 nt, Pseudomonas aeruginosa PA01
uggucgcugaggccgc

SEQ ID NO: 3484317 - RNA, 23 nt, Pseudomonas aeruginosa PA01
uggucgcugaggccgcccuggcc

SEQ ID NO: 3484318 - RNA, 14 nt, Pseudomonas aeruginosa PA01
uggucggcagcucu

SEQ ID NO: 3484319 - RNA, 16 nt, Pseudomonas aeruginosa PA01
uggucggccaggucgc

SEQ ID NO: 3484320 - RNA, 21 nt, Pseudomonas aeruginosa PA01
uggucggccaggucgcgggug

SEQ ID NO: 3484321 - RNA, 13 nt, Pseudomonas aeruginosa PA01
uggucggcgcggc

SEQ ID NO: 3484322 - RNA, 16 nt, Pseudomonas aeruginosa PA01
uggucggcgcggcgcu

SEQ ID NO: 3484323 - RNA, 14 nt, Pseudomonas aeruginosa PA01
uggucggcggccuc

SEQ ID NO: 3484324 - RNA, 14 nt, Pseudomonas aeruginosa PA01
uggucggcggccuu

SEQ ID NO: 3484325 - RNA, 13 nt, Pseudomonas aeruginosa PA01
uggucggcuuccg

SEQ ID NO: 3484326 - RNA, 17 nt, Pseudomonas aeruginosa PA01
uggucggcuuccgccgc

SEQ ID NO: 3484327 - RNA, 18 nt, Pseudomonas aeruginosa PA01
uggucggcuuccgccgcc

SEQ ID NO: 3484328 - RNA, 15 nt, Pseudomonas aeruginosa PA01
uggucgggauggcga

SEQ ID NO: 3484329 - RNA, 23 nt, Pseudomonas aeruginosa PA01
uggucgggcgccgcgccuucugc

SEQ ID NO: 3484330 - RNA, 15 nt, Pseudomonas aeruginosa PA01
uggucggugacccgc

SEQ ID NO: 3484331 - RNA, 16 nt, Pseudomonas aeruginosa PA01
uggucguagcagcgga

SEQ ID NO: 3484332 - RNA, 22 nt, Pseudomonas aeruginosa PA01
uggucguaggcgcgggcggcgg

SEQ ID NO: 3484333 - RNA, 19 nt, Pseudomonas aeruginosa PA01
uggucgucguaguggccgu

SEQ ID NO: 3484334 - RNA, 18 nt, Pseudomonas aeruginosa PA01
uggucguucucgcgcauc

SEQ ID NO: 3484335 - RNA, 22 nt, Pseudomonas aeruginosa PA01
uggucguucucgcgcaucgcgg

SEQ ID NO: 3484336 - RNA, 20 nt, Pseudomonas aeruginosa PA01
uggucguugcgcgccagcgc

SEQ ID NO: 3484337 - RNA, 17 nt, Pseudomonas aeruginosa PA01
uggucuccgugcuggcc

SEQ ID NO: 3484338 - RNA, 14 nt, Pseudomonas aeruginosa PA01
uggucugcucggcg

SEQ ID NO: 3484339 - RNA, 15 nt, Pseudomonas aeruginosa PA01
uggucugcucggcga

SEQ ID NO: 3484340 - RNA, 19 nt, Pseudomonas aeruginosa PA01
uggucugcucggcgauggc

SEQ ID NO: 3484341 - RNA, 19 nt, Pseudomonas aeruginosa PA01
uggucuucccagaccccgg

SEQ ID NO: 3484342 - RNA, 15 nt, Pseudomonas aeruginosa PA01
uggucuuccucggug

SEQ ID NO: 3484343 - RNA, 16 nt, Pseudomonas aeruginosa PA01
uggugaacgccaggca

SEQ ID NO: 3484344 - RNA, 17 nt, Pseudomonas aeruginosa PA01
uggugaagcccaccacc

SEQ ID NO: 3484345 - RNA, 19 nt, Pseudomonas aeruginosa PA01
uggugaagcgcuccggcag

SEQ ID NO: 3484346 - RNA, 12 nt, Pseudomonas aeruginosa PA01
uggugacggucc

SEQ ID NO: 3484347 - RNA, 18 nt, Pseudomonas aeruginosa PA01
uggugacgguccgcgcca

SEQ ID NO: 3484348 - RNA, 20 nt, Pseudomonas aeruginosa PA01
uggugacgguccgcgccacg

SEQ ID NO: 3484349 - RNA, 19 nt, Pseudomonas aeruginosa PA01
uggugauacguccguucag

SEQ ID NO: 3484350 - RNA, 12 nt, Pseudomonas aeruginosa PA01
uggugaucaccg

SEQ ID NO: 3484351 - RNA, 14 nt, Pseudomonas aeruginosa PA01
uggugaucgaccac

SEQ ID NO: 3484352 - RNA, 20 nt, Pseudomonas aeruginosa PA01
uggugaugccgcggacggca

SEQ ID NO: 3484353 - RNA, 15 nt, Pseudomonas aeruginosa PA01
uggugaugcgcaugc

SEQ ID NO: 3484354 - RNA, 18 nt, Pseudomonas aeruginosa PA01
uggugaugucgcggcagg

SEQ ID NO: 3484355 - RNA, 15 nt, Pseudomonas aeruginosa PA01
uggugcacgcgccgg

SEQ ID NO: 3484356 - RNA, 22 nt, Pseudomonas aeruginosa PA01
uggugcaggucgcgcggcgccu

SEQ ID NO: 3484357 - RNA, 16 nt, Pseudomonas aeruginosa PA01
uggugcauccgccgca

SEQ ID NO: 3484358 - RNA, 16 nt, Pseudomonas aeruginosa PA01
uggugccacaggugga

SEQ ID NO: 3484359 - RNA, 14 nt, Pseudomonas aeruginosa PA01
uggugcccagcagg

SEQ ID NO: 3484360 - RNA, 20 nt, Pseudomonas aeruginosa PA01
uggugcccagcaggcugcug

SEQ ID NO: 3484361 - RNA, 16 nt, Pseudomonas aeruginosa PA01
uggugcccugggcggc

SEQ ID NO: 3484362 - RNA, 19 nt, Pseudomonas aeruginosa PA01
uggugccgaucagcccguc

SEQ ID NO: 3484363 - RNA, 23 nt, Pseudomonas aeruginosa PA01
uggugcgcucgcggaccucugcg

SEQ ID NO: 3484364 - RNA, 15 nt, Pseudomonas aeruginosa PA01
uggugcggcaccagc

SEQ ID NO: 3484365 - RNA, 14 nt, Pseudomonas aeruginosa PA01
uggugcgggugccg

SEQ ID NO: 3484366 - RNA, 16 nt, Pseudomonas aeruginosa PA01
uggugcgguggcuggc

SEQ ID NO: 3484367 - RNA, 13 nt, Pseudomonas aeruginosa PA01
uggugcguuaccg

SEQ ID NO: 3484368 - RNA, 19 nt, Pseudomonas aeruginosa PA01
uggugcugcaugugggcga

SEQ ID NO: 3484369 - RNA, 20 nt, Pseudomonas aeruginosa PA01
uggugcugcaugugggcgaa

SEQ ID NO: 3484370 - RNA, 13 nt, Pseudomonas aeruginosa PA01
uggugcugcgcgc

SEQ ID NO: 3484371 - RNA, 14 nt, Pseudomonas aeruginosa PA01
uggugcuggugggc

SEQ ID NO: 3484372 - RNA, 20 nt, Pseudomonas aeruginosa PA01
ugguggaacagccgcagcgg

SEQ ID NO: 3484373 - RNA, 16 nt, Pseudomonas aeruginosa PA01
ugguggacacccugcu

SEQ ID NO: 3484374 - RNA, 18 nt, Pseudomonas aeruginosa PA01
ugguggacacccugcugc

SEQ ID NO: 3484375 - RNA, 15 nt, Pseudomonas aeruginosa PA01
ugguggaccagcgcc

SEQ ID NO: 3484376 - RNA, 20 nt, Pseudomonas aeruginosa PA01
ugguggaccagcgccgccaa

SEQ ID NO: 3484377 - RNA, 23 nt, Pseudomonas aeruginosa PA01
ugguggacggucucgccgccgag

SEQ ID NO: 3484378 - RNA, 15 nt, Pseudomonas aeruginosa PA01
ugguggaugacccgc

SEQ ID NO: 3484379 - RNA, 19 nt, Pseudomonas aeruginosa PA01
ugguggauguucgccgcca

SEQ ID NO: 3484380 - RNA, 12 nt, Pseudomonas aeruginosa PA01
ugguggccgcgc

SEQ ID NO: 3484381 - RNA, 15 nt, Pseudomonas aeruginosa PA01
ugguggccgcgccgc

SEQ ID NO: 3484382 - RNA, 14 nt, Pseudomonas aeruginosa PA01
ugguggccguggcg

SEQ ID NO: 3484383 - RNA, 20 nt, Pseudomonas aeruginosa PA01
ugguggccguugagcaccuc

SEQ ID NO: 3484384 - RNA, 17 nt, Pseudomonas aeruginosa PA01
ugguggcgaacagcacc

SEQ ID NO: 3484385 - RNA, 13 nt, Pseudomonas aeruginosa PA01
uggugggcggcgg

SEQ ID NO: 3484386 - RNA, 17 nt, Pseudomonas aeruginosa PA01
uggugguaugggugccc

SEQ ID NO: 3484387 - RNA, 17 nt, Pseudomonas aeruginosa PA01
ugguggucaccgccagc

SEQ ID NO: 3484388 - RNA, 12 nt, Pseudomonas aeruginosa PA01
ugguggucggca

SEQ ID NO: 3484389 - RNA, 14 nt, Pseudomonas aeruginosa PA01
ugguggucggcagc

SEQ ID NO: 3484390 - RNA, 15 nt, Pseudomonas aeruginosa PA01
ugguggucggcagcu

SEQ ID NO: 3484391 - RNA, 16 nt, Pseudomonas aeruginosa PA01
ugguggugauccaggc

SEQ ID NO: 3484392 - RNA, 23 nt, Pseudomonas aeruginosa PA01
ugguguagcgcagguugcgcugg

SEQ ID NO: 3484393 - RNA, 17 nt, Pseudomonas aeruginosa PA01
uggugucggccgccagg

SEQ ID NO: 3484394 - RNA, 23 nt, Pseudomonas aeruginosa PA01
uggugucgugccgacaggcgucu

SEQ ID NO: 3484395 - RNA, 14 nt, Pseudomonas aeruginosa PA01
ugguguugaugguc

SEQ ID NO: 3484396 - RNA, 14 nt, Pseudomonas aeruginosa PA01
ugguucucggucgg

SEQ ID NO: 3484397 - RNA, 18 nt, Pseudomonas aeruginosa PA01
ugguucugguccaccagc

SEQ ID NO: 3484398 - RNA, 17 nt, Pseudomonas aeruginosa PA01
ugguugaccugcagcgc

SEQ ID NO: 3484399 - RNA, 12 nt, Pseudomonas aeruginosa PA01
ugguugcccagg

SEQ ID NO: 3484400 - RNA, 21 nt, Pseudomonas aeruginosa PA01
ugguugccugcuguguccggc

SEQ ID NO: 3484401 - RNA, 20 nt, Pseudomonas aeruginosa PA01
ugguugcggaacggcucgcg

SEQ ID NO: 3484402 - RNA, 24 nt, Pseudomonas aeruginosa PA01
ugguuuaccaggaccagcgccugc

SEQ ID NO: 3484403 - RNA, 13 nt, Pseudomonas aeruginosa PA01
ugguuuccaggcu

SEQ ID NO: 3484404 - RNA, 14 nt, Pseudomonas aeruginosa PA01
ugguuuccaggcuc

SEQ ID NO: 3484405 - RNA, 12 nt, Pseudomonas aeruginosa PA01
ugguuucuuccc

SEQ ID NO: 3484406 - RNA, 14 nt, Pseudomonas aeruginosa PA01
ugguuuucgcuccu

SEQ ID NO: 3484407 - RNA, 17 nt, Pseudomonas aeruginosa PA01
uguaagcgucggugccg

SEQ ID NO: 3484408 - RNA, 19 nt, Pseudomonas aeruginosa PA01
uguacagcucaccccagga

SEQ ID NO: 3484409 - RNA, 18 nt, Pseudomonas aeruginosa PA01
uguacagcuucaggcgca

SEQ ID NO: 3484410 - RNA, 22 nt, Pseudomonas aeruginosa PA01
uguacaucgggauaccggccau

SEQ ID NO: 3484411 - RNA, 19 nt, Pseudomonas aeruginosa PA01
uguaccaccagcuugcguc

SEQ ID NO: 3484412 - RNA, 13 nt, Pseudomonas aeruginosa PA01
uguaccaccgcca

SEQ ID NO: 3484413 - RNA, 19 nt, Pseudomonas aeruginosa PA01
uguacccagggugcgccgg

SEQ ID NO: 3484414 - RNA, 14 nt, Pseudomonas aeruginosa PA01
uguacccccaccgg

SEQ ID NO: 3484415 - RNA, 23 nt, Pseudomonas aeruginosa PA01
uguaccgcuccccacucggccag

SEQ ID NO: 3484416 - RNA, 14 nt, Pseudomonas aeruginosa PA01
uguaccgcucugca

SEQ ID NO: 3484417 - RNA, 15 nt, Pseudomonas aeruginosa PA01
uguacggcaccacca

SEQ ID NO: 3484418 - RNA, 15 nt, Pseudomonas aeruginosa PA01
uguacguaucccagc

SEQ ID NO: 3484419 - RNA, 13 nt, Pseudomonas aeruginosa PA01
uguagaccaccag

SEQ ID NO: 3484420 - RNA, 15 nt, Pseudomonas aeruginosa PA01
uguagaccaccagca

SEQ ID NO: 3484421 - RNA, 22 nt, Pseudomonas aeruginosa PA01
uguagaccagauagaccaaggc

SEQ ID NO: 3484422 - RNA, 23 nt, Pseudomonas aeruginosa PA01
uguagaucggcagcaucagccgc

SEQ ID NO: 3484423 - RNA, 12 nt, Pseudomonas aeruginosa PA01
uguagcccaggg

SEQ ID NO: 3484424 - RNA, 22 nt, Pseudomonas aeruginosa PA01
uguagccggcgaugugcggcgu

SEQ ID NO: 3484425 - RNA, 13 nt, Pseudomonas aeruginosa PA01
uguagcgcgccga

SEQ ID NO: 3484426 - RNA, 17 nt, Pseudomonas aeruginosa PA01
uguagcgcuccuucucc

SEQ ID NO: 3484427 - RNA, 16 nt, Pseudomonas aeruginosa PA01
uguagcggcucgccga

SEQ ID NO: 3484428 - RNA, 16 nt, Pseudomonas aeruginosa PA01
uguagcucugcuggcu

SEQ ID NO: 3484429 - RNA, 18 nt, Pseudomonas aeruginosa PA01
uguagcugcagcgcccca

SEQ ID NO: 3484430 - RNA, 13 nt, Pseudomonas aeruginosa PA01
uguagcugccggc

SEQ ID NO: 3484431 - RNA, 21 nt, Pseudomonas aeruginosa PA01
uguagcugguguagaggcuca

SEQ ID NO: 3484432 - RNA, 23 nt, Pseudomonas aeruginosa PA01
uguagcugguguagaggcucaac

SEQ ID NO: 3484433 - RNA, 22 nt, Pseudomonas aeruginosa PA01
uguaggacagguucaggucgau

SEQ ID NO: 3484434 - RNA, 14 nt, Pseudomonas aeruginosa PA01
uguaggccaugauc

SEQ ID NO: 3484435 - RNA, 18 nt, Pseudomonas aeruginosa PA01
uguaggccaugaucaucg

SEQ ID NO: 3484436 - RNA, 21 nt, Pseudomonas aeruginosa PA01
uguaggcgagcagcggcacgc

SEQ ID NO: 3484437 - RNA, 14 nt, Pseudomonas aeruginosa PA01
uguaggcgcaccag

SEQ ID NO: 3484438 - RNA, 21 nt, Pseudomonas aeruginosa PA01
uguaggcgcaccaggccaggc

SEQ ID NO: 3484439 - RNA, 21 nt, Pseudomonas aeruginosa PA01
uguagggucgcagcaggccgc

SEQ ID NO: 3484440 - RNA, 19 nt, Pseudomonas aeruginosa PA01
uguaggguucgcugccccg

SEQ ID NO: 3484441 - RNA, 20 nt, Pseudomonas aeruginosa PA01
uguaguaggcgguggccacg

SEQ ID NO: 3484442 - RNA, 15 nt, Pseudomonas aeruginosa PA01
uguaguccagcgccg

SEQ ID NO: 3484443 - RNA, 19 nt, Pseudomonas aeruginosa PA01
uguaguccagcgccgcgcu

SEQ ID NO: 3484444 - RNA, 18 nt, Pseudomonas aeruginosa PA01
uguagucgacgccggucu

SEQ ID NO: 3484445 - RNA, 20 nt, Pseudomonas aeruginosa PA01
uguaguucaccguccacugg

SEQ ID NO: 3484446 - RNA, 16 nt, Pseudomonas aeruginosa PA01
uguauccguacuggcg

SEQ ID NO: 3484447 - RNA, 18 nt, Pseudomonas aeruginosa PA01
uguauccguacuggcgcc

SEQ ID NO: 3484448 - RNA, 12 nt, Pseudomonas aeruginosa PA01
ugucaccggcag

SEQ ID NO: 3484449 - RNA, 20 nt, Pseudomonas aeruginosa PA01
ugucacgguaucccacuucc

SEQ ID NO: 3484450 - RNA, 19 nt, Pseudomonas aeruginosa PA01
ugucagacacgaaaaagcc

SEQ ID NO: 3484451 - RNA, 22 nt, Pseudomonas aeruginosa PA01
ugucagggcuugcgcgccacca

SEQ ID NO: 3484452 - RNA, 14 nt, Pseudomonas aeruginosa PA01
ugucagggguugca

SEQ ID NO: 3484453 - RNA, 19 nt, Pseudomonas aeruginosa PA01
ugucagggguugcaauaga

SEQ ID NO: 3484454 - RNA, 21 nt, Pseudomonas aeruginosa PA01
ugucagggguugcaauagaaa

SEQ ID NO: 3484455 - RNA, 23 nt, Pseudomonas aeruginosa PA01
uguccaccaccagcaggcccagu

SEQ ID NO: 3484456 - RNA, 18 nt, Pseudomonas aeruginosa PA01
uguccaccgccgccagca

SEQ ID NO: 3484457 - RNA, 21 nt, Pseudomonas aeruginosa PA01
uguccaccgccgccagcaaca

SEQ ID NO: 3484458 - RNA, 15 nt, Pseudomonas aeruginosa PA01
uguccaccggcccgg

SEQ ID NO: 3484459 - RNA, 15 nt, Pseudomonas aeruginosa PA01
uguccacgccgaagu

SEQ ID NO: 3484460 - RNA, 19 nt, Pseudomonas aeruginosa PA01
uguccacggaaaaauaccc

SEQ ID NO: 3484461 - RNA, 20 nt, Pseudomonas aeruginosa PA01
uguccacggaaaaauacccc

SEQ ID NO: 3484462 - RNA, 22 nt, Pseudomonas aeruginosa PA01
uguccacgucguaggccgagcc

SEQ ID NO: 3484463 - RNA, 22 nt, Pseudomonas aeruginosa PA01
uguccagcaccaucggguugau

SEQ ID NO: 3484464 - RNA, 20 nt, Pseudomonas aeruginosa PA01
uguccagcgcuccuugcgcc

SEQ ID NO: 3484465 - RNA, 18 nt, Pseudomonas aeruginosa PA01
uguccaggcgaugguugc

SEQ ID NO: 3484466 - RNA, 14 nt, Pseudomonas aeruginosa PA01
uguccaggcgcugc

SEQ ID NO: 3484467 - RNA, 16 nt, Pseudomonas aeruginosa PA01
uguccaggcuguggcg

SEQ ID NO: 3484468 - RNA, 18 nt, Pseudomonas aeruginosa PA01
uguccaggcuguggcgcg

SEQ ID NO: 3484469 - RNA, 19 nt, Pseudomonas aeruginosa PA01
uguccaggcuguggcgcgg

SEQ ID NO: 3484470 - RNA, 21 nt, Pseudomonas aeruginosa PA01
uguccagggcgaaccacucgg

SEQ ID NO: 3484471 - RNA, 20 nt, Pseudomonas aeruginosa PA01
uguccagggugaucacaccg

SEQ ID NO: 3484472 - RNA, 14 nt, Pseudomonas aeruginosa PA01
uguccagucaccag

SEQ ID NO: 3484473 - RNA, 14 nt, Pseudomonas aeruginosa PA01
uguccaucagccgc

SEQ ID NO: 3484474 - RNA, 18 nt, Pseudomonas aeruginosa PA01
uguccaucagccgcgcgc

SEQ ID NO: 3484475 - RNA, 20 nt, Pseudomonas aeruginosa PA01
uguccaugaagacguacagc

SEQ ID NO: 3484476 - RNA, 18 nt, Pseudomonas aeruginosa PA01
uguccccucacggcgcga

SEQ ID NO: 3484477 - RNA, 20 nt, Pseudomonas aeruginosa PA01
ugucccgccgcgccgcucag

SEQ ID NO: 3484478 - RNA, 19 nt, Pseudomonas aeruginosa PA01
ugucccggacgggugcgcg

SEQ ID NO: 3484479 - RNA, 22 nt, Pseudomonas aeruginosa PA01
ugucccggacgggugcgcgcca

SEQ ID NO: 3484480 - RNA, 16 nt, Pseudomonas aeruginosa PA01
ugucccggguguccuu

SEQ ID NO: 3484481 - RNA, 23 nt, Pseudomonas aeruginosa PA01
uguccgaacagggcgaaggccac

SEQ ID NO: 3484482 - RNA, 17 nt, Pseudomonas aeruginosa PA01
uguccgaccacuucggc

SEQ ID NO: 3484483 - RNA, 21 nt, Pseudomonas aeruginosa PA01
uguccgagcaggucgcggaac

SEQ ID NO: 3484484 - RNA, 14 nt, Pseudomonas aeruginosa PA01
uguccgcaggcagg

SEQ ID NO: 3484485 - RNA, 15 nt, Pseudomonas aeruginosa PA01
uguccgccaguuccg

SEQ ID NO: 3484486 - RNA, 12 nt, Pseudomonas aeruginosa PA01
uguccgccgccc

SEQ ID NO: 3484487 - RNA, 12 nt, Pseudomonas aeruginosa PA01
uguccgccgccg

SEQ ID NO: 3484488 - RNA, 18 nt, Pseudomonas aeruginosa PA01
uguccgcgccgcgucgcc

SEQ ID NO: 3484489 - RNA, 22 nt, Pseudomonas aeruginosa PA01
uguccgcgccgcgucgccgcca

SEQ ID NO: 3484490 - RNA, 23 nt, Pseudomonas aeruginosa PA01
uguccgcgccgcgucgccgccag

SEQ ID NO: 3484491 - RNA, 18 nt, Pseudomonas aeruginosa PA01
uguccgcgcgcuuccagg

SEQ ID NO: 3484492 - RNA, 17 nt, Pseudomonas aeruginosa PA01
uguccggcaccaccagc

SEQ ID NO: 3484493 - RNA, 15 nt, Pseudomonas aeruginosa PA01
uguccggcccggagc

SEQ ID NO: 3484494 - RNA, 16 nt, Pseudomonas aeruginosa PA01
uguccggcgaccacca

SEQ ID NO: 3484495 - RNA, 13 nt, Pseudomonas aeruginosa PA01
uguccggcgcuga

SEQ ID NO: 3484496 - RNA, 16 nt, Pseudomonas aeruginosa PA01
uguccggcggcgauga

SEQ ID NO: 3484497 - RNA, 19 nt, Pseudomonas aeruginosa PA01
uguccgggaaguccgggcg

SEQ ID NO: 3484498 - RNA, 19 nt, Pseudomonas aeruginosa PA01
uguccgggaugccggugcu

SEQ ID NO: 3484499 - RNA, 21 nt, Pseudomonas aeruginosa PA01
uguccggguaguccagcgagu

SEQ ID NO: 3484500 - RNA, 17 nt, Pseudomonas aeruginosa PA01
uguccgggugaugcccg

SEQ ID NO: 3484501 - RNA, 15 nt, Pseudomonas aeruginosa PA01
uguccuccagcggcg

SEQ ID NO: 3484502 - RNA, 23 nt, Pseudomonas aeruginosa PA01
uguccugccgcaggcgggcgcca

SEQ ID NO: 3484503 - RNA, 14 nt, Pseudomonas aeruginosa PA01
uguccugcggccgg

SEQ ID NO: 3484504 - RNA, 16 nt, Pseudomonas aeruginosa PA01
uguccugcuccugaag

SEQ ID NO: 3484505 - RNA, 19 nt, Pseudomonas aeruginosa PA01
uguccuggauaagccgcgc

SEQ ID NO: 3484506 - RNA, 12 nt, Pseudomonas aeruginosa PA01
uguccugggcca

SEQ ID NO: 3484507 - RNA, 16 nt, Pseudomonas aeruginosa PA01
uguccugggccaccug

SEQ ID NO: 3484508 - RNA, 17 nt, Pseudomonas aeruginosa PA01
uguccugggccaccugg

SEQ ID NO: 3484509 - RNA, 12 nt, Pseudomonas aeruginosa PA01
uguccuguggcg

SEQ ID NO: 3484510 - RNA, 14 nt, Pseudomonas aeruginosa PA01
uguccuucggccag

SEQ ID NO: 3484511 - RNA, 17 nt, Pseudomonas aeruginosa PA01
uguccuuguucggcugg

SEQ ID NO: 3484512 - RNA, 13 nt, Pseudomonas aeruginosa PA01
ugucgaaccccau

SEQ ID NO: 3484513 - RNA, 19 nt, Pseudomonas aeruginosa PA01
ugucgaagcgcaggugcac

SEQ ID NO: 3484514 - RNA, 18 nt, Pseudomonas aeruginosa PA01
ugucgaaguagccggaaa

SEQ ID NO: 3484515 - RNA, 17 nt, Pseudomonas aeruginosa PA01
ugucgaccagcggcggu

SEQ ID NO: 3484516 - RNA, 20 nt, Pseudomonas aeruginosa PA01
ugucgaccauucccacgacc

SEQ ID NO: 3484517 - RNA, 14 nt, Pseudomonas aeruginosa PA01
ugucgaccuccgcc

SEQ ID NO: 3484518 - RNA, 16 nt, Pseudomonas aeruginosa PA01
ugucgaccuccgccgc

SEQ ID NO: 3484519 - RNA, 20 nt, Pseudomonas aeruginosa PA01
ugucgacgacgaaaggccgc

SEQ ID NO: 3484520 - RNA, 24 nt, Pseudomonas aeruginosa PA01
ugucgacgacgaaaggccgcgccg

SEQ ID NO: 3484521 - RNA, 21 nt, Pseudomonas aeruginosa PA01
ugucgagcagggucgcgagca

SEQ ID NO: 3484522 - RNA, 16 nt, Pseudomonas aeruginosa PA01
ugucgauaccagcgcc

SEQ ID NO: 3484523 - RNA, 15 nt, Pseudomonas aeruginosa PA01
ugucgaugcgcccgc

SEQ ID NO: 3484524 - RNA, 13 nt, Pseudomonas aeruginosa PA01
ugucgaugggcga

SEQ ID NO: 3484525 - RNA, 17 nt, Pseudomonas aeruginosa PA01
ugucgauuucccccggu

SEQ ID NO: 3484526 - RNA, 23 nt, Pseudomonas aeruginosa PA01
ugucgauuucccccgguccggug

SEQ ID NO: 3484527 - RNA, 16 nt, Pseudomonas aeruginosa PA01
ugucgcaccagccuuc

SEQ ID NO: 3484528 - RNA, 19 nt, Pseudomonas aeruginosa PA01
ugucgcccgggcgccaccg

SEQ ID NO: 3484529 - RNA, 17 nt, Pseudomonas aeruginosa PA01
ugucgcccucgcggagc

SEQ ID NO: 3484530 - RNA, 14 nt, Pseudomonas aeruginosa PA01
ugucgccgaucugc

SEQ ID NO: 3484531 - RNA, 19 nt, Pseudomonas aeruginosa PA01
ugucgccgcggacggccgg

SEQ ID NO: 3484532 - RNA, 15 nt, Pseudomonas aeruginosa PA01
ugucgccgcugggca

SEQ ID NO: 3484533 - RNA, 19 nt, Pseudomonas aeruginosa PA01
ugucgccgcugggcagcac

SEQ ID NO: 3484534 - RNA, 16 nt, Pseudomonas aeruginosa PA01
ugucgcgauccaccgc

SEQ ID NO: 3484535 - RNA, 14 nt, Pseudomonas aeruginosa PA01
ugucgcggacccgc

SEQ ID NO: 3484536 - RNA, 19 nt, Pseudomonas aeruginosa PA01
ugucgcggacccgcgccgg

SEQ ID NO: 3484537 - RNA, 21 nt, Pseudomonas aeruginosa PA01
ugucgcggacccgcgccggca

SEQ ID NO: 3484538 - RNA, 16 nt, Pseudomonas aeruginosa PA01
ugucgcggcaggcggc

SEQ ID NO: 3484539 - RNA, 17 nt, Pseudomonas aeruginosa PA01
ugucgcggcccuguaca

SEQ ID NO: 3484540 - RNA, 23 nt, Pseudomonas aeruginosa PA01
ugucgcggcgcuuguagcccagg

SEQ ID NO: 3484541 - RNA, 23 nt, Pseudomonas aeruginosa PA01
ugucgcggcugaaggccgaacgg

SEQ ID NO: 3484542 - RNA, 16 nt, Pseudomonas aeruginosa PA01
ugucgcggcugacgaa

SEQ ID NO: 3484543 - RNA, 17 nt, Pseudomonas aeruginosa PA01
ugucgcgggcaugcugc

SEQ ID NO: 3484544 - RNA, 14 nt, Pseudomonas aeruginosa PA01
ugucgcgguugccg

SEQ ID NO: 3484545 - RNA, 17 nt, Pseudomonas aeruginosa PA01
ugucgcgguugcgcugc

SEQ ID NO: 3484546 - RNA, 13 nt, Pseudomonas aeruginosa PA01
ugucgcucccuac

SEQ ID NO: 3484547 - RNA, 14 nt, Pseudomonas aeruginosa PA01
ugucgcuggccagc

SEQ ID NO: 3484548 - RNA, 17 nt, Pseudomonas aeruginosa PA01
ugucgcuggccagcuug

SEQ ID NO: 3484549 - RNA, 23 nt, Pseudomonas aeruginosa PA01
ugucggagagggagcgccuggcg

SEQ ID NO: 3484550 - RNA, 16 nt, Pseudomonas aeruginosa PA01
ugucggcacgacacca

SEQ ID NO: 3484551 - RNA, 14 nt, Pseudomonas aeruginosa PA01
ugucggccagcagc

SEQ ID NO: 3484552 - RNA, 14 nt, Pseudomonas aeruginosa PA01
ugucggccgccagg

SEQ ID NO: 3484553 - RNA, 14 nt, Pseudomonas aeruginosa PA01
ugucggccugcagc

SEQ ID NO: 3484554 - RNA, 17 nt, Pseudomonas aeruginosa PA01
ugucggcgaacuggcca

SEQ ID NO: 3484555 - RNA, 16 nt, Pseudomonas aeruginosa PA01
ugucggcucgcgccgg

SEQ ID NO: 3484556 - RNA, 17 nt, Pseudomonas aeruginosa PA01
ugucggcucgcgccggc

SEQ ID NO: 3484557 - RNA, 13 nt, Pseudomonas aeruginosa PA01
ugucgggggcugc

SEQ ID NO: 3484558 - RNA, 16 nt, Pseudomonas aeruginosa PA01
ugucgggggcugcgca

SEQ ID NO: 3484559 - RNA, 18 nt, Pseudomonas aeruginosa PA01
ugucgggggcugcgcauc

SEQ ID NO: 3484560 - RNA, 14 nt, Pseudomonas aeruginosa PA01
ugucggguagggcg

SEQ ID NO: 3484561 - RNA, 12 nt, Pseudomonas aeruginosa PA01
ugucggucaggu

SEQ ID NO: 3484562 - RNA, 18 nt, Pseudomonas aeruginosa PA01
ugucggugcccucgcgga

SEQ ID NO: 3484563 - RNA, 15 nt, Pseudomonas aeruginosa PA01
ugucguauuccaggg

SEQ ID NO: 3484564 - RNA, 13 nt, Pseudomonas aeruginosa PA01
ugucguccaggcu

SEQ ID NO: 3484565 - RNA, 14 nt, Pseudomonas aeruginosa PA01
ugucguccaucgac

SEQ ID NO: 3484566 - RNA, 17 nt, Pseudomonas aeruginosa PA01
ugucgucgaggguggcg

SEQ ID NO: 3484567 - RNA, 15 nt, Pseudomonas aeruginosa PA01
ugucguggacgccgg

SEQ ID NO: 3484568 - RNA, 19 nt, Pseudomonas aeruginosa PA01
ugucguggacgccggugac

SEQ ID NO: 3484569 - RNA, 22 nt, Pseudomonas aeruginosa PA01
ugucguggacgccggugaccca

SEQ ID NO: 3484570 - RNA, 21 nt, Pseudomonas aeruginosa PA01
ugucguggucgccguccacca

SEQ ID NO: 3484571 - RNA, 17 nt, Pseudomonas aeruginosa PA01
ugucguucuugcgcggu

SEQ ID NO: 3484572 - RNA, 17 nt, Pseudomonas aeruginosa PA01
ugucuacucgacgcugc

SEQ ID NO: 3484573 - RNA, 20 nt, Pseudomonas aeruginosa PA01
ugucuaucccgugccgggcc

SEQ ID NO: 3484574 - RNA, 13 nt, Pseudomonas aeruginosa PA01
ugucucgccagcc

SEQ ID NO: 3484575 - RNA, 20 nt, Pseudomonas aeruginosa PA01
ugucucgccagcccggcagg

SEQ ID NO: 3484576 - RNA, 22 nt, Pseudomonas aeruginosa PA01
ugucugcaacccuuugauggcg

SEQ ID NO: 3484577 - RNA, 16 nt, Pseudomonas aeruginosa PA01
ugugaaaacggcgcau

SEQ ID NO: 3484578 - RNA, 15 nt, Pseudomonas aeruginosa PA01
ugugaaagggcggca

SEQ ID NO: 3484579 - RNA, 18 nt, Pseudomonas aeruginosa PA01
ugugaccgagauucugca

SEQ ID NO: 3484580 - RNA, 21 nt, Pseudomonas aeruginosa PA01
ugugaccgagauucugcaggc

SEQ ID NO: 3484581 - RNA, 14 nt, Pseudomonas aeruginosa PA01
ugugaccuucaacg

SEQ ID NO: 3484582 - RNA, 19 nt, Pseudomonas aeruginosa PA01
ugugacgucuguugcggug

SEQ ID NO: 3484583 - RNA, 16 nt, Pseudomonas aeruginosa PA01
ugugaucaccagccac

SEQ ID NO: 3484584 - RNA, 23 nt, Pseudomonas aeruginosa PA01
ugugaucaggcuguccacgccga

SEQ ID NO: 3484585 - RNA, 23 nt, Pseudomonas aeruginosa PA01
ugugcacccagaccuuccagccg

SEQ ID NO: 3484586 - RNA, 16 nt, Pseudomonas aeruginosa PA01
ugugcagagaggcugg

SEQ ID NO: 3484587 - RNA, 17 nt, Pseudomonas aeruginosa PA01
ugugcagagaggcuggc

SEQ ID NO: 3484588 - RNA, 14 nt, Pseudomonas aeruginosa PA01
ugugcaggaaggcg

SEQ ID NO: 3484589 - RNA, 19 nt, Pseudomonas aeruginosa PA01
ugugcagggcagcggcccu

SEQ ID NO: 3484590 - RNA, 22 nt, Pseudomonas aeruginosa PA01
ugugcagggucagucgagcagu

SEQ ID NO: 3484591 - RNA, 15 nt, Pseudomonas aeruginosa PA01
ugugccauuccuggg

SEQ ID NO: 3484592 - RNA, 14 nt, Pseudomonas aeruginosa PA01
ugugccgaggccgc

SEQ ID NO: 3484593 - RNA, 17 nt, Pseudomonas aeruginosa PA01
ugugccgaggccgccgc

SEQ ID NO: 3484594 - RNA, 13 nt, Pseudomonas aeruginosa PA01
ugugccgccaccu

SEQ ID NO: 3484595 - RNA, 14 nt, Pseudomonas aeruginosa PA01
ugugccgcccugcu

SEQ ID NO: 3484596 - RNA, 14 nt, Pseudomonas aeruginosa PA01
ugugccggccaugc

SEQ ID NO: 3484597 - RNA, 18 nt, Pseudomonas aeruginosa PA01
ugugccgguagcuggcca

SEQ ID NO: 3484598 - RNA, 17 nt, Pseudomonas aeruginosa PA01
ugugccgucaggcaccu

SEQ ID NO: 3484599 - RNA, 17 nt, Pseudomonas aeruginosa PA01
ugugcgaauguccggcg

SEQ ID NO: 3484600 - RNA, 17 nt, Pseudomonas aeruginosa PA01
ugugcgagacccccggg

SEQ ID NO: 3484601 - RNA, 15 nt, Pseudomonas aeruginosa PA01
ugugcgcaggcuggc

SEQ ID NO: 3484602 - RNA, 14 nt, Pseudomonas aeruginosa PA01
ugugcgccaggccg

SEQ ID NO: 3484603 - RNA, 15 nt, Pseudomonas aeruginosa PA01
ugugcggugccgcgc

SEQ ID NO: 3484604 - RNA, 14 nt, Pseudomonas aeruginosa PA01
ugugcugcaccagc

SEQ ID NO: 3484605 - RNA, 15 nt, Pseudomonas aeruginosa PA01
ugugcugcaccagca

SEQ ID NO: 3484606 - RNA, 17 nt, Pseudomonas aeruginosa PA01
ugugcugcaccagcagg

SEQ ID NO: 3484607 - RNA, 14 nt, Pseudomonas aeruginosa PA01
ugugcugccugcgg

SEQ ID NO: 3484608 - RNA, 13 nt, Pseudomonas aeruginosa PA01
ugugcuggccacc

SEQ ID NO: 3484609 - RNA, 13 nt, Pseudomonas aeruginosa PA01
ugugcuggcggaa

SEQ ID NO: 3484610 - RNA, 18 nt, Pseudomonas aeruginosa PA01
ugugcugguuggacaccu

SEQ ID NO: 3484611 - RNA, 13 nt, Pseudomonas aeruginosa PA01
ugugcuugaccgc

SEQ ID NO: 3484612 - RNA, 20 nt, Pseudomonas aeruginosa PA01
uguggagccggugccggcgg

SEQ ID NO: 3484613 - RNA, 14 nt, Pseudomonas aeruginosa PA01
uguggauaacgucc

SEQ ID NO: 3484614 - RNA, 16 nt, Pseudomonas aeruginosa PA01
uguggauaacguccgc

SEQ ID NO: 3484615 - RNA, 17 nt, Pseudomonas aeruginosa PA01
uguggauaacguccgcg

SEQ ID NO: 3484616 - RNA, 15 nt, Pseudomonas aeruginosa PA01
uguggcaggcgcugc

SEQ ID NO: 3484617 - RNA, 19 nt, Pseudomonas aeruginosa PA01
uguggccccagcgcgagcg

SEQ ID NO: 3484618 - RNA, 14 nt, Pseudomonas aeruginosa PA01
uguggccgagcccc

SEQ ID NO: 3484619 - RNA, 17 nt, Pseudomonas aeruginosa PA01
uguggccugggcgcuca

SEQ ID NO: 3484620 - RNA, 19 nt, Pseudomonas aeruginosa PA01
uguggcgcagcaucaucuc

SEQ ID NO: 3484621 - RNA, 15 nt, Pseudomonas aeruginosa PA01
uguggcgcggcugga

SEQ ID NO: 3484622 - RNA, 18 nt, Pseudomonas aeruginosa PA01
uguggcggcguggcucga

SEQ ID NO: 3484623 - RNA, 21 nt, Pseudomonas aeruginosa PA01
uguggcuauccuccaggccgc

SEQ ID NO: 3484624 - RNA, 23 nt, Pseudomonas aeruginosa PA01
ugugggcuaccgcaucgccaccg

SEQ ID NO: 3484625 - RNA, 15 nt, Pseudomonas aeruginosa PA01
uguggucaggcgcca

SEQ ID NO: 3484626 - RNA, 15 nt, Pseudomonas aeruginosa PA01
uguggucguggcgga

SEQ ID NO: 3484627 - RNA, 21 nt, Pseudomonas aeruginosa PA01
uguguccgccgaggugcugca

SEQ ID NO: 3484628 - RNA, 12 nt, Pseudomonas aeruginosa PA01
uguguggccugg

SEQ ID NO: 3484629 - RNA, 22 nt, Pseudomonas aeruginosa PA01
uguuacugagcgugacccgcgc

SEQ ID NO: 3484630 - RNA, 13 nt, Pseudomonas aeruginosa PA01
uguuauggccgac

SEQ ID NO: 3484631 - RNA, 16 nt, Pseudomonas aeruginosa PA01
uguucaccagcgcugc

SEQ ID NO: 3484632 - RNA, 19 nt, Pseudomonas aeruginosa PA01
uguucaccagguugugauc

SEQ ID NO: 3484633 - RNA, 15 nt, Pseudomonas aeruginosa PA01
uguucaccgcggccu

SEQ ID NO: 3484634 - RNA, 15 nt, Pseudomonas aeruginosa PA01
uguucagcggcgcgu

SEQ ID NO: 3484635 - RNA, 19 nt, Pseudomonas aeruginosa PA01
uguucaggguggcgaccgc

SEQ ID NO: 3484636 - RNA, 15 nt, Pseudomonas aeruginosa PA01
uguucaggugcugga

SEQ ID NO: 3484637 - RNA, 15 nt, Pseudomonas aeruginosa PA01
uguucaguucggcgg

SEQ ID NO: 3484638 - RNA, 18 nt, Pseudomonas aeruginosa PA01
uguucaguucggcggaaa

SEQ ID NO: 3484639 - RNA, 23 nt, Pseudomonas aeruginosa PA01
uguuccaaggugcugccgaucag

SEQ ID NO: 3484640 - RNA, 16 nt, Pseudomonas aeruginosa PA01
uguuccacgagagaaa

SEQ ID NO: 3484641 - RNA, 11 nt, Pseudomonas aeruginosa PA01
uguuccagcaa

SEQ ID NO: 3484642 - RNA, 21 nt, Pseudomonas aeruginosa PA01
uguuccaggcccgccgcggcg

SEQ ID NO: 3484643 - RNA, 21 nt, Pseudomonas aeruginosa PA01
uguucccucaggauagccggc

SEQ ID NO: 3484644 - RNA, 22 nt, Pseudomonas aeruginosa PA01
uguuccggcuggacgugcagga

SEQ ID NO: 3484645 - RNA, 18 nt, Pseudomonas aeruginosa PA01
uguucgaaggccaguccg

SEQ ID NO: 3484646 - RNA, 18 nt, Pseudomonas aeruginosa PA01
uguucgaggcgccgacca

SEQ ID NO: 3484647 - RNA, 21 nt, Pseudomonas aeruginosa PA01
uguucgaggcgccgaccacga

SEQ ID NO: 3484648 - RNA, 23 nt, Pseudomonas aeruginosa PA01
uguucgaucucgcguuccagcac

SEQ ID NO: 3484649 - RNA, 22 nt, Pseudomonas aeruginosa PA01
uguucgcaaagcucgcgcaagc

SEQ ID NO: 3484650 - RNA, 23 nt, Pseudomonas aeruginosa PA01
uguucgcagucgcuuccgcgcgg

SEQ ID NO: 3484651 - RNA, 18 nt, Pseudomonas aeruginosa PA01
uguucgccacgcugcugc

SEQ ID NO: 3484652 - RNA, 15 nt, Pseudomonas aeruginosa PA01
uguucgcggcgaugc

SEQ ID NO: 3484653 - RNA, 17 nt, Pseudomonas aeruginosa PA01
uguucgcggcucuggcg

SEQ ID NO: 3484654 - RNA, 14 nt, Pseudomonas aeruginosa PA01
uguucgcugccuuc

SEQ ID NO: 3484655 - RNA, 17 nt, Pseudomonas aeruginosa PA01
uguucggccagccggcg

SEQ ID NO: 3484656 - RNA, 21 nt, Pseudomonas aeruginosa PA01
uguucggccagccggcgccgc

SEQ ID NO: 3484657 - RNA, 13 nt, Pseudomonas aeruginosa PA01
uguucggcgcuga

SEQ ID NO: 3484658 - RNA, 12 nt, Pseudomonas aeruginosa PA01
uguucggcggcg

SEQ ID NO: 3484659 - RNA, 14 nt, Pseudomonas aeruginosa PA01
uguucggcgggauc

SEQ ID NO: 3484660 - RNA, 20 nt, Pseudomonas aeruginosa PA01
uguucggcuggaccuccugg

SEQ ID NO: 3484661 - RNA, 19 nt, Pseudomonas aeruginosa PA01
uguucgggguggcgaaggc

SEQ ID NO: 3484662 - RNA, 19 nt, Pseudomonas aeruginosa PA01
uguucgguguaguucaccg

SEQ ID NO: 3484663 - RNA, 22 nt, Pseudomonas aeruginosa PA01
uguucucuacgccguaggccac

SEQ ID NO: 3484664 - RNA, 22 nt, Pseudomonas aeruginosa PA01
uguucuucaguuuauguauucg

SEQ ID NO: 3484665 - RNA, 16 nt, Pseudomonas aeruginosa PA01
uguugaagccgccauc

SEQ ID NO: 3484666 - RNA, 14 nt, Pseudomonas aeruginosa PA01
uguugacgauggcc

SEQ ID NO: 3484667 - RNA, 18 nt, Pseudomonas aeruginosa PA01
uguugacgauggcccaga

SEQ ID NO: 3484668 - RNA, 17 nt, Pseudomonas aeruginosa PA01
uguugagcuggccgagc

SEQ ID NO: 3484669 - RNA, 20 nt, Pseudomonas aeruginosa PA01
uguugaucaccaccggcugg

SEQ ID NO: 3484670 - RNA, 19 nt, Pseudomonas aeruginosa PA01
uguugaucgccgcgccgcc

SEQ ID NO: 3484671 - RNA, 14 nt, Pseudomonas aeruginosa PA01
uguugaugccgauc

SEQ ID NO: 3484672 - RNA, 16 nt, Pseudomonas aeruginosa PA01
uguugauggucaccuu

SEQ ID NO: 3484673 - RNA, 15 nt, Pseudomonas aeruginosa PA01
uguugcaggcuggga

SEQ ID NO: 3484674 - RNA, 12 nt, Pseudomonas aeruginosa PA01
uguugccaggga

SEQ ID NO: 3484675 - RNA, 14 nt, Pseudomonas aeruginosa PA01
uguugcccaccucc

SEQ ID NO: 3484676 - RNA, 15 nt, Pseudomonas aeruginosa PA01
uguugccgcugcagg

SEQ ID NO: 3484677 - RNA, 20 nt, Pseudomonas aeruginosa PA01
uguugccgcugcaggccacc

SEQ ID NO: 3484678 - RNA, 23 nt, Pseudomonas aeruginosa PA01
uguugccggcaaacgccgccacc

SEQ ID NO: 3484679 - RNA, 20 nt, Pseudomonas aeruginosa PA01
uguugccguucugugcggcg

SEQ ID NO: 3484680 - RNA, 23 nt, Pseudomonas aeruginosa PA01
uguugccguucugugcggcgaug

SEQ ID NO: 3484681 - RNA, 22 nt, Pseudomonas aeruginosa PA01
uguugcgauggaaguugcgcac

SEQ ID NO: 3484682 - RNA, 17 nt, Pseudomonas aeruginosa PA01
uguugcgcagggugccc

SEQ ID NO: 3484683 - RNA, 18 nt, Pseudomonas aeruginosa PA01
uguugcggcgggucacgc

SEQ ID NO: 3484684 - RNA, 20 nt, Pseudomonas aeruginosa PA01
uguugcggcgguggccgcgu

SEQ ID NO: 3484685 - RNA, 23 nt, Pseudomonas aeruginosa PA01
uguugcucaccgcauaggucaug

SEQ ID NO: 3484686 - RNA, 17 nt, Pseudomonas aeruginosa PA01
uguuggccaaccaggaa

SEQ ID NO: 3484687 - RNA, 15 nt, Pseudomonas aeruginosa PA01
uguuggccagcagcc

SEQ ID NO: 3484688 - RNA, 14 nt, Pseudomonas aeruginosa PA01
uguuggcggccugg

SEQ ID NO: 3484689 - RNA, 21 nt, Pseudomonas aeruginosa PA01
uguugggcagggugucgacga

SEQ ID NO: 3484690 - RNA, 16 nt, Pseudomonas aeruginosa PA01
uguuguggcuggccuc

SEQ ID NO: 3484691 - RNA, 18 nt, Pseudomonas aeruginosa PA01
uguuguggcuggccucgg

SEQ ID NO: 3484692 - RNA, 15 nt, Pseudomonas aeruginosa PA01
uguuguucgccagca

SEQ ID NO: 3484693 - RNA, 15 nt, Pseudomonas aeruginosa PA01
uguuguugcccacca

SEQ ID NO: 3484694 - RNA, 19 nt, Pseudomonas aeruginosa PA01
uguuguugccggucuugcc

SEQ ID NO: 3484695 - RNA, 12 nt, Pseudomonas aeruginosa PA01
uguuuccgaacu

SEQ ID NO: 3484696 - RNA, 21 nt, Pseudomonas aeruginosa PA01
uguuucgaugagcuucgccgg

SEQ ID NO: 3484697 - RNA, 14 nt, Pseudomonas aeruginosa PA01
uguuuuccuggccc

SEQ ID NO: 3484698 - RNA, 16 nt, Pseudomonas aeruginosa PA01
uuaacaguugagcugu

SEQ ID NO: 3484699 - RNA, 18 nt, Pseudomonas aeruginosa PA01
uuaccugaguaguuucug

SEQ ID NO: 3484700 - RNA, 16 nt, Pseudomonas aeruginosa PA01
uuaccuugccggugcg

SEQ ID NO: 3484701 - RNA, 13 nt, Pseudomonas aeruginosa PA01
uuaccuuggccac

SEQ ID NO: 3484702 - RNA, 23 nt, Pseudomonas aeruginosa PA01
uuacgaaacggcgcgucuccaug

SEQ ID NO: 3484703 - RNA, 18 nt, Pseudomonas aeruginosa PA01
uuacgcuauucugauugc

SEQ ID NO: 3484704 - RNA, 16 nt, Pseudomonas aeruginosa PA01
uuacggagaagggcgc

SEQ ID NO: 3484705 - RNA, 13 nt, Pseudomonas aeruginosa PA01
uuacuuaaauuca

SEQ ID NO: 3484706 - RNA, 15 nt, Pseudomonas aeruginosa PA01
uuagaggcucagccg

SEQ ID NO: 3484707 - RNA, 13 nt, Pseudomonas aeruginosa PA01
uuagccggcgauc

SEQ ID NO: 3484708 - RNA, 22 nt, Pseudomonas aeruginosa PA01
uuaguuaucacaaccuuucgga

SEQ ID NO: 3484709 - RNA, 14 nt, Pseudomonas aeruginosa PA01
uuauccgcccugcg

SEQ ID NO: 3484710 - RNA, 12 nt, Pseudomonas aeruginosa PA01
uuauccgccgau

SEQ ID NO: 3484711 - RNA, 17 nt, Pseudomonas aeruginosa PA01
uuauccgccgccuaucc

SEQ ID NO: 3484712 - RNA, 21 nt, Pseudomonas aeruginosa PA01
uuauggccgacccgugcgccg

SEQ ID NO: 3484713 - RNA, 22 nt, Pseudomonas aeruginosa PA01
uucaaccaggcgauaucccgcc

SEQ ID NO: 3484714 - RNA, 15 nt, Pseudomonas aeruginosa PA01
uucaaccgcuggucg

SEQ ID NO: 3484715 - RNA, 15 nt, Pseudomonas aeruginosa PA01
uucaaccguggcucg

SEQ ID NO: 3484716 - RNA, 17 nt, Pseudomonas aeruginosa PA01
uucaccaccagcgagga

SEQ ID NO: 3484717 - RNA, 16 nt, Pseudomonas aeruginosa PA01
uucaccaccccacaaa

SEQ ID NO: 3484718 - RNA, 18 nt, Pseudomonas aeruginosa PA01
uucaccccgcccuuggcg

SEQ ID NO: 3484719 - RNA, 13 nt, Pseudomonas aeruginosa PA01
uucacccgcagcg

SEQ ID NO: 3484720 - RNA, 17 nt, Pseudomonas aeruginosa PA01
uucacccgcagcggcag

SEQ ID NO: 3484721 - RNA, 23 nt, Pseudomonas aeruginosa PA01
uucaccgccucggagaacagcag

SEQ ID NO: 3484722 - RNA, 14 nt, Pseudomonas aeruginosa PA01
uucaccgcgccgcg

SEQ ID NO: 3484723 - RNA, 15 nt, Pseudomonas aeruginosa PA01
uucaccggcacgccc

SEQ ID NO: 3484724 - RNA, 17 nt, Pseudomonas aeruginosa PA01
uucaccguucccagcag

SEQ ID NO: 3484725 - RNA, 18 nt, Pseudomonas aeruginosa PA01
uucacgcaguacagcugc

SEQ ID NO: 3484726 - RNA, 13 nt, Pseudomonas aeruginosa PA01
uucacgccuggcg

SEQ ID NO: 3484727 - RNA, 13 nt, Pseudomonas aeruginosa PA01
uucacgguaaaac

SEQ ID NO: 3484728 - RNA, 22 nt, Pseudomonas aeruginosa PA01
uucacguaggagccggccaggc

SEQ ID NO: 3484729 - RNA, 18 nt, Pseudomonas aeruginosa PA01
uucagcacuucggcgcgc

SEQ ID NO: 3484730 - RNA, 17 nt, Pseudomonas aeruginosa PA01
uucagcagcaggcgcuc

SEQ ID NO: 3484731 - RNA, 22 nt, Pseudomonas aeruginosa PA01
uucagcagcaugucgccgggga

SEQ ID NO: 3484732 - RNA, 22 nt, Pseudomonas aeruginosa PA01
uucagcagcgggcguccggcga

SEQ ID NO: 3484733 - RNA, 13 nt, Pseudomonas aeruginosa PA01
uucagcaggggga

SEQ ID NO: 3484734 - RNA, 20 nt, Pseudomonas aeruginosa PA01
uucagcagggggacgaaaac

SEQ ID NO: 3484735 - RNA, 23 nt, Pseudomonas aeruginosa PA01
uucagccagaccggcagcgccgc

SEQ ID NO: 3484736 - RNA, 22 nt, Pseudomonas aeruginosa PA01
uucagccagagcccgucgaagc

SEQ ID NO: 3484737 - RNA, 14 nt, Pseudomonas aeruginosa PA01
uucagcccaccccc

SEQ ID NO: 3484738 - RNA, 23 nt, Pseudomonas aeruginosa PA01
uucagcccgccgugcgcuccgcc

SEQ ID NO: 3484739 - RNA, 18 nt, Pseudomonas aeruginosa PA01
uucagccgaccguccgcc

SEQ ID NO: 3484740 - RNA, 13 nt, Pseudomonas aeruginosa PA01
uucagcgccagca

SEQ ID NO: 3484741 - RNA, 17 nt, Pseudomonas aeruginosa PA01
uucagcgccagcagucg

SEQ ID NO: 3484742 - RNA, 12 nt, Pseudomonas aeruginosa PA01
uucagcgccggg

SEQ ID NO: 3484743 - RNA, 14 nt, Pseudomonas aeruginosa PA01
uucagcgccucgac

SEQ ID NO: 3484744 - RNA, 16 nt, Pseudomonas aeruginosa PA01
uucagcgccucgagga

SEQ ID NO: 3484745 - RNA, 22 nt, Pseudomonas aeruginosa PA01
uucagcgcgaaggccacgccga

SEQ ID NO: 3484746 - RNA, 17 nt, Pseudomonas aeruginosa PA01
uucagcgcgccccggcg

SEQ ID NO: 3484747 - RNA, 15 nt, Pseudomonas aeruginosa PA01
uucagcgcgccgagc

SEQ ID NO: 3484748 - RNA, 16 nt, Pseudomonas aeruginosa PA01
uucagcgcuuccuugc

SEQ ID NO: 3484749 - RNA, 15 nt, Pseudomonas aeruginosa PA01
uucagcggcguaugc

SEQ ID NO: 3484750 - RNA, 22 nt, Pseudomonas aeruginosa PA01
uucagcggcguaugcgccucca

SEQ ID NO: 3484751 - RNA, 20 nt, Pseudomonas aeruginosa PA01
uucagcggguucuugccgcu

SEQ ID NO: 3484752 - RNA, 13 nt, Pseudomonas aeruginosa PA01
uucagcuccagca

SEQ ID NO: 3484753 - RNA, 21 nt, Pseudomonas aeruginosa PA01
uuccgcgcccggcuggccauc

SEQ ID NO: 3484754 - RNA, 19 nt, Pseudomonas aeruginosa PA01
uuccgcgcggcgcccugcc

SEQ ID NO: 3484755 - RNA, 17 nt, Pseudomonas aeruginosa PA01
uuccgcggagucgccgg

SEQ ID NO: 3484756 - RNA, 14 nt, Pseudomonas aeruginosa PA01
uuccgcggccggca

SEQ ID NO: 3484757 - RNA, 19 nt, Pseudomonas aeruginosa PA01
uuccgcggccggcaggccg

SEQ ID NO: 3484758 - RNA, 15 nt, Pseudomonas aeruginosa PA01
uuccgcggcgacggc

SEQ ID NO: 3484759 - RNA, 22 nt, Pseudomonas aeruginosa PA01
uuccgcggcgacggcucuuccc

SEQ ID NO: 3484760 - RNA, 22 nt, Pseudomonas aeruginosa PA01
uuccgcggcguaaucgcgccag

SEQ ID NO: 3484761 - RNA, 17 nt, Pseudomonas aeruginosa PA01
uuccggacugcccagcg

SEQ ID NO: 3484762 - RNA, 21 nt, Pseudomonas aeruginosa PA01
uuccggacugcccagcgccgc

SEQ ID NO: 3484763 - RNA, 16 nt, Pseudomonas aeruginosa PA01
uuccggagccggauag

SEQ ID NO: 3484764 - RNA, 14 nt, Pseudomonas aeruginosa PA01
uuccggcagccagc

SEQ ID NO: 3484765 - RNA, 18 nt, Pseudomonas aeruginosa PA01
uuccggcagguucagcag

SEQ ID NO: 3484766 - RNA, 16 nt, Pseudomonas aeruginosa PA01
uuccggccaggcgcgg

SEQ ID NO: 3484767 - RNA, 13 nt, Pseudomonas aeruginosa PA01
uuccggcccacgc

SEQ ID NO: 3484768 - RNA, 17 nt, Pseudomonas aeruginosa PA01
uuccggcccggccaggu

SEQ ID NO: 3484769 - RNA, 19 nt, Pseudomonas aeruginosa PA01
uuccggcgcagcggaggau

SEQ ID NO: 3484770 - RNA, 12 nt, Pseudomonas aeruginosa PA01
uuccggcgcgga

SEQ ID NO: 3484771 - RNA, 23 nt, Pseudomonas aeruginosa PA01
uuccgggaccggcugcuuggcca

SEQ ID NO: 3484772 - RNA, 22 nt, Pseudomonas aeruginosa PA01
uuccggggugcauaggguccag

SEQ ID NO: 3484773 - RNA, 15 nt, Pseudomonas aeruginosa PA01
uuccgggucgcugcc

SEQ ID NO: 3484774 - RNA, 21 nt, Pseudomonas aeruginosa PA01
uuccggucacgcaggcgcugg

SEQ ID NO: 3484775 - RNA, 20 nt, Pseudomonas aeruginosa PA01
uuccgucacgcccugccccu

SEQ ID NO: 3484776 - RNA, 15 nt, Pseudomonas aeruginosa PA01
uuccgugcggaaacc

SEQ ID NO: 3484777 - RNA, 17 nt, Pseudomonas aeruginosa PA01
uuccguucaaagcccgc

SEQ ID NO: 3484778 - RNA, 19 nt, Pseudomonas aeruginosa PA01
uuccguuguggcggcgcuc

SEQ ID NO: 3484779 - RNA, 20 nt, Pseudomonas aeruginosa PA01
uuccuacgaagguuucgucc

SEQ ID NO: 3484780 - RNA, 13 nt, Pseudomonas aeruginosa PA01
uuccucagcgccg

SEQ ID NO: 3484781 - RNA, 22 nt, Pseudomonas aeruginosa PA01
uuccucagugcgggcaguccug

SEQ ID NO: 3484782 - RNA, 22 nt, Pseudomonas aeruginosa PA01
uuccuccagggugccgaccaac

SEQ ID NO: 3484783 - RNA, 16 nt, Pseudomonas aeruginosa PA01
uuccucccaugaaaaa

SEQ ID NO: 3484784 - RNA, 15 nt, Pseudomonas aeruginosa PA01
uuccuccucgccgcc

SEQ ID NO: 3484785 - RNA, 17 nt, Pseudomonas aeruginosa PA01
uuccucgaaggucgcga

SEQ ID NO: 3484786 - RNA, 11 nt, Pseudomonas aeruginosa PA01
uuccucgcgcc

SEQ ID NO: 3484787 - RNA, 13 nt, Pseudomonas aeruginosa PA01
uuccucgcucgcu

SEQ ID NO: 3484788 - RNA, 22 nt, Pseudomonas aeruginosa PA01
uuccucggccaugccggccagg

SEQ ID NO: 3484789 - RNA, 23 nt, Pseudomonas aeruginosa PA01
uuccucggccaugccggccagga

SEQ ID NO: 3484790 - RNA, 19 nt, Pseudomonas aeruginosa PA01
uuccucggccgccaggcgc

SEQ ID NO: 3484791 - RNA, 14 nt, Pseudomonas aeruginosa PA01
uuccucggugaugc

SEQ ID NO: 3484792 - RNA, 17 nt, Pseudomonas aeruginosa PA01
uuccucguggggccaga

SEQ ID NO: 3484793 - RNA, 12 nt, Pseudomonas aeruginosa PA01
uuccugacgaau

SEQ ID NO: 3484794 - RNA, 23 nt, Pseudomonas aeruginosa PA01
uuccugcccgaccgguuccagcg

SEQ ID NO: 3484795 - RNA, 21 nt, Pseudomonas aeruginosa PA01
uuccugcggcuugcccaucuu

SEQ ID NO: 3484796 - RNA, 15 nt, Pseudomonas aeruginosa PA01
uuccugcuggcuggc

SEQ ID NO: 3484797 - RNA, 17 nt, Pseudomonas aeruginosa PA01
uuccugcuggcuggcag

SEQ ID NO: 3484798 - RNA, 11 nt, Pseudomonas aeruginosa PA01
uuccuggcccu

SEQ ID NO: 3484799 - RNA, 14 nt, Pseudomonas aeruginosa PA01
uuccuggcgccggu

SEQ ID NO: 3484800 - RNA, 13 nt, Pseudomonas aeruginosa PA01
uuccuggcuggag

SEQ ID NO: 3484801 - RNA, 12 nt, Pseudomonas aeruginosa PA01
uuccugggaugc

SEQ ID NO: 3484802 - RNA, 15 nt, Pseudomonas aeruginosa PA01
uuccugggaugccgg

SEQ ID NO: 3484803 - RNA, 13 nt, Pseudomonas aeruginosa PA01
uuccugggcgugc

SEQ ID NO: 3484804 - RNA, 21 nt, Pseudomonas aeruginosa PA01
uuccugggcuucguccgccug

SEQ ID NO: 3484805 - RNA, 20 nt, Pseudomonas aeruginosa PA01
uuccugguacucguccuccc

SEQ ID NO: 3484806 - RNA, 17 nt, Pseudomonas aeruginosa PA01
uuccuguccauuuccac

SEQ ID NO: 3484807 - RNA, 14 nt, Pseudomonas aeruginosa PA01
uuccugucuccgca

SEQ ID NO: 3484808 - RNA, 13 nt, Pseudomonas aeruginosa PA01
uuccuguucgcug

SEQ ID NO: 3484809 - RNA, 15 nt, Pseudomonas aeruginosa PA01
uuccuguucgcugcc

SEQ ID NO: 3484810 - RNA, 18 nt, Pseudomonas aeruginosa PA01
uuccuguucgcugccuuc

SEQ ID NO: 3484811 - RNA, 18 nt, Pseudomonas aeruginosa PA01
uuccuuagaggcucagcc

SEQ ID NO: 3484812 - RNA, 13 nt, Pseudomonas aeruginosa PA01
uuccuuccagggu

SEQ ID NO: 3484813 - RNA, 15 nt, Pseudomonas aeruginosa PA01
uuccuucucccggcu

SEQ ID NO: 3484814 - RNA, 16 nt, Pseudomonas aeruginosa PA01
uuccuucuugacccgc

SEQ ID NO: 3484815 - RNA, 15 nt, Pseudomonas aeruginosa PA01
uuccuugauccacuc

SEQ ID NO: 3484816 - RNA, 17 nt, Pseudomonas aeruginosa PA01
uuccuugcgcggcaggc

SEQ ID NO: 3484817 - RNA, 23 nt, Pseudomonas aeruginosa PA01
uuccuugcugaagcccaggcguc

SEQ ID NO: 3484818 - RNA, 15 nt, Pseudomonas aeruginosa PA01
uuccuugucguaugc

SEQ ID NO: 3484819 - RNA, 18 nt, Pseudomonas aeruginosa PA01
uucgaacaaucccagcuc

SEQ ID NO: 3484820 - RNA, 22 nt, Pseudomonas aeruginosa PA01
uucgaaccguggcggccgccgc

SEQ ID NO: 3484821 - RNA, 17 nt, Pseudomonas aeruginosa PA01
uucgaagcgccaggcgu

SEQ ID NO: 3484822 - RNA, 13 nt, Pseudomonas aeruginosa PA01
uucgaagcucggc

SEQ ID NO: 3484823 - RNA, 15 nt, Pseudomonas aeruginosa PA01
uucgaagcucucgcc

SEQ ID NO: 3484824 - RNA, 23 nt, Pseudomonas aeruginosa PA01
uucgaaguccacugucucgccga

SEQ ID NO: 3484825 - RNA, 20 nt, Pseudomonas aeruginosa PA01
uucgacaaggagacucagcg

SEQ ID NO: 3484826 - RNA, 22 nt, Pseudomonas aeruginosa PA01
uucgacagcagguggcugguca

SEQ ID NO: 3484827 - RNA, 22 nt, Pseudomonas aeruginosa PA01
uucgacaugggccgcgcagauc

SEQ ID NO: 3484828 - RNA, 14 nt, Pseudomonas aeruginosa PA01
uucgacccgccgac

SEQ ID NO: 3484829 - RNA, 16 nt, Pseudomonas aeruginosa PA01
uucgaccggcgcgccu

SEQ ID NO: 3484830 - RNA, 15 nt, Pseudomonas aeruginosa PA01
uucgaccuccaggcc

SEQ ID NO: 3484831 - RNA, 16 nt, Pseudomonas aeruginosa PA01
uucgaccuccaggccg

SEQ ID NO: 3484832 - RNA, 20 nt, Pseudomonas aeruginosa PA01
uucgacgaagggcucagccc

SEQ ID NO: 3484833 - RNA, 23 nt, Pseudomonas aeruginosa PA01
uucgacgaagggcucagcccagg

SEQ ID NO: 3484834 - RNA, 23 nt, Pseudomonas aeruginosa PA01
uucgacgaugcucgguugccagg

SEQ ID NO: 3484835 - RNA, 14 nt, Pseudomonas aeruginosa PA01
uucgacgcagcgcg

SEQ ID NO: 3484836 - RNA, 23 nt, Pseudomonas aeruginosa PA01
uucgacgcgccacgcaggaacag

SEQ ID NO: 3484837 - RNA, 13 nt, Pseudomonas aeruginosa PA01
uucgacgcgcggc

SEQ ID NO: 3484838 - RNA, 22 nt, Pseudomonas aeruginosa PA01
uucgacgcucugcucggccagc

SEQ ID NO: 3484839 - RNA, 19 nt, Pseudomonas aeruginosa PA01
uucgagcagcucguucgcc

SEQ ID NO: 3484840 - RNA, 17 nt, Pseudomonas aeruginosa PA01
uucgagccuggccaggc

SEQ ID NO: 3484841 - RNA, 14 nt, Pseudomonas aeruginosa PA01
uucgaggcgccgac

SEQ ID NO: 3484842 - RNA, 19 nt, Pseudomonas aeruginosa PA01
uucgaggcgccgaccacga

SEQ ID NO: 3484843 - RNA, 19 nt, Pseudomonas aeruginosa PA01
uucgaggcgggcgucggcg

SEQ ID NO: 3484844 - RNA, 13 nt, Pseudomonas aeruginosa PA01
uucgaucccguca

SEQ ID NO: 3484845 - RNA, 17 nt, Pseudomonas aeruginosa PA01
uucgaucuccucgcgca

SEQ ID NO: 3484846 - RNA, 13 nt, Pseudomonas aeruginosa PA01
uucgaugccgcgc

SEQ ID NO: 3484847 - RNA, 14 nt, Pseudomonas aeruginosa PA01
uucgaugccgcgcg

SEQ ID NO: 3484848 - RNA, 19 nt, Pseudomonas aeruginosa PA01
uucgcaaagcgagcgcccg

SEQ ID NO: 3484849 - RNA, 20 nt, Pseudomonas aeruginosa PA01
uucgcaaagcgagcgcccgc

SEQ ID NO: 3484850 - RNA, 17 nt, Pseudomonas aeruginosa PA01
uucgcaaagcucgcgca

SEQ ID NO: 3484851 - RNA, 20 nt, Pseudomonas aeruginosa PA01
uucgcaaagcucgcgcaagc

SEQ ID NO: 3484852 - RNA, 14 nt, Pseudomonas aeruginosa PA01
uucgcaccagccgg

SEQ ID NO: 3484853 - RNA, 15 nt, Pseudomonas aeruginosa PA01
uucgcagagaucggc

SEQ ID NO: 3484854 - RNA, 13 nt, Pseudomonas aeruginosa PA01
uucgcaggccagg

SEQ ID NO: 3484855 - RNA, 20 nt, Pseudomonas aeruginosa PA01
uucgccacgcugcugccggc

SEQ ID NO: 3484856 - RNA, 17 nt, Pseudomonas aeruginosa PA01
uucgugccaggcggcag

SEQ ID NO: 3484857 - RNA, 22 nt, Pseudomonas aeruginosa PA01
uucguucgcuguucuucaguuu

SEQ ID NO: 3484858 - RNA, 21 nt, Pseudomonas aeruginosa PA01
uucguugagggccuugagcac

SEQ ID NO: 3484859 - RNA, 18 nt, Pseudomonas aeruginosa PA01
uucguugccauagccgac

SEQ ID NO: 3484860 - RNA, 18 nt, Pseudomonas aeruginosa PA01
uucguuucagcgccagca

SEQ ID NO: 3484861 - RNA, 22 nt, Pseudomonas aeruginosa PA01
uucuaaaauggcugccgaagaa

SEQ ID NO: 3484862 - RNA, 16 nt, Pseudomonas aeruginosa PA01
uucuaccuggcgcuga

SEQ ID NO: 3484863 - RNA, 21 nt, Pseudomonas aeruginosa PA01
uucuauuccggggacgcuguc

SEQ ID NO: 3484864 - RNA, 20 nt, Pseudomonas aeruginosa PA01
uucucaccgaggaucggcac

SEQ ID NO: 3484865 - RNA, 15 nt, Pseudomonas aeruginosa PA01
uucuccagaaucucc

SEQ ID NO: 3484866 - RNA, 17 nt, Pseudomonas aeruginosa PA01
uucuccaggcccauccu

SEQ ID NO: 3484867 - RNA, 19 nt, Pseudomonas aeruginosa PA01
uucuccaggcccauccugg

SEQ ID NO: 3484868 - RNA, 12 nt, Pseudomonas aeruginosa PA01
uucuccaggcuu

SEQ ID NO: 3484869 - RNA, 22 nt, Pseudomonas aeruginosa PA01
uucuccaggucgaacagcggcu

SEQ ID NO: 3484870 - RNA, 22 nt, Pseudomonas aeruginosa PA01
uucucccacagucgaugacgag

SEQ ID NO: 3484871 - RNA, 23 nt, Pseudomonas aeruginosa PA01
uucuccgaccagguagagcagcc

SEQ ID NO: 3484872 - RNA, 23 nt, Pseudomonas aeruginosa PA01
uucuccgccagccagccgcgcgc

SEQ ID NO: 3484873 - RNA, 24 nt, Pseudomonas aeruginosa PA01
uucuccgccgcgugcgcgcccucg

SEQ ID NO: 3484874 - RNA, 22 nt, Pseudomonas aeruginosa PA01
uucuccgggucgugcccgagcg

SEQ ID NO: 3484875 - RNA, 16 nt, Pseudomonas aeruginosa PA01
uucucgaacagcuccu

SEQ ID NO: 3484876 - RNA, 17 nt, Pseudomonas aeruginosa PA01
uucucgaacagcuccuc

SEQ ID NO: 3484877 - RNA, 21 nt, Pseudomonas aeruginosa PA01
uucucgacgaaggcgcgcucg

SEQ ID NO: 3484878 - RNA, 15 nt, Pseudomonas aeruginosa PA01
uucucgcagcaggcg

SEQ ID NO: 3484879 - RNA, 16 nt, Pseudomonas aeruginosa PA01
uucucggucgccgcca

SEQ ID NO: 3484880 - RNA, 14 nt, Pseudomonas aeruginosa PA01
uucucgucgccgcc

SEQ ID NO: 3484881 - RNA, 17 nt, Pseudomonas aeruginosa PA01
uucucgucgccgcccgg

SEQ ID NO: 3484882 - RNA, 13 nt, Pseudomonas aeruginosa PA01
uucucguucgggc

SEQ ID NO: 3484883 - RNA, 21 nt, Pseudomonas aeruginosa PA01
uucugcaauugcuugcgcucg

SEQ ID NO: 3484884 - RNA, 22 nt, Pseudomonas aeruginosa PA01
uucugcaccuuggccacgcugc

SEQ ID NO: 3484885 - RNA, 15 nt, Pseudomonas aeruginosa PA01
uucugcccgccggcg

SEQ ID NO: 3484886 - RNA, 17 nt, Pseudomonas aeruginosa PA01
uucugccgcgacaggau

SEQ ID NO: 3484887 - RNA, 14 nt, Pseudomonas aeruginosa PA01
uucugcgccuccuc

SEQ ID NO: 3484888 - RNA, 19 nt, Pseudomonas aeruginosa PA01
uucugcuccggacugccga

SEQ ID NO: 3484889 - RNA, 22 nt, Pseudomonas aeruginosa PA01
uucugcucgaacaucagcagcg

SEQ ID NO: 3484890 - RNA, 16 nt, Pseudomonas aeruginosa PA01
uucugcucggccugga

SEQ ID NO: 3484891 - RNA, 15 nt, Pseudomonas aeruginosa PA01
uucugcuggccaccg

SEQ ID NO: 3484892 - RNA, 20 nt, Pseudomonas aeruginosa PA01
uucugcuggccaccgcggcg

SEQ ID NO: 3484893 - RNA, 14 nt, Pseudomonas aeruginosa PA01
uucugcuguggagc

SEQ ID NO: 3484894 - RNA, 16 nt, Pseudomonas aeruginosa PA01
uucugcuuuccggccc

SEQ ID NO: 3484895 - RNA, 18 nt, Pseudomonas aeruginosa PA01
uucuggaugcagccgggg

SEQ ID NO: 3484896 - RNA, 16 nt, Pseudomonas aeruginosa PA01
uucuuccacuugcgcc

SEQ ID NO: 3484897 - RNA, 19 nt, Pseudomonas aeruginosa PA01
uucuuccacuugcgccggc

SEQ ID NO: 3484898 - RNA, 16 nt, Pseudomonas aeruginosa PA01
uucuuccuggccggga

SEQ ID NO: 3484899 - RNA, 16 nt, Pseudomonas aeruginosa PA01
uucuucgccuugcccu

SEQ ID NO: 3484900 - RNA, 23 nt, Pseudomonas aeruginosa PA01
uucuucgccuugcccuggccggc

SEQ ID NO: 3484901 - RNA, 19 nt, Pseudomonas aeruginosa PA01
uucuugaucaccgcggugc

SEQ ID NO: 3484902 - RNA, 13 nt, Pseudomonas aeruginosa PA01
uucuuuucuuccg

SEQ ID NO: 3484903 - RNA, 19 nt, Pseudomonas aeruginosa PA01
uugaacacaucgaccaggu

SEQ ID NO: 3484904 - RNA, 20 nt, Pseudomonas aeruginosa PA01
uugaacaccugaucgaagcc

SEQ ID NO: 3484905 - RNA, 19 nt, Pseudomonas aeruginosa PA01
uugaagacgcucacguagc

SEQ ID NO: 3484906 - RNA, 14 nt, Pseudomonas aeruginosa PA01
uugaagagcagcac

SEQ ID NO: 3484907 - RNA, 13 nt, Pseudomonas aeruginosa PA01
uugaagccggcgu

SEQ ID NO: 3484908 - RNA, 15 nt, Pseudomonas aeruginosa PA01
uugaagcggccguac

SEQ ID NO: 3484909 - RNA, 20 nt, Pseudomonas aeruginosa PA01
uugacagccucaagccucgc

SEQ ID NO: 3484910 - RNA, 20 nt, Pseudomonas aeruginosa PA01
uugacaugcccgcgcgcauc

SEQ ID NO: 3484911 - RNA, 13 nt, Pseudomonas aeruginosa PA01
uugaccagcggcc

SEQ ID NO: 3484912 - RNA, 22 nt, Pseudomonas aeruginosa PA01
uugaccaguuucuucgcguggg

SEQ ID NO: 3484913 - RNA, 16 nt, Pseudomonas aeruginosa PA01
uugacccgcaguuccu

SEQ ID NO: 3484914 - RNA, 21 nt, Pseudomonas aeruginosa PA01
uugacccgccccugcuccucg

SEQ ID NO: 3484915 - RNA, 17 nt, Pseudomonas aeruginosa PA01
uugacccguugcgccuc

SEQ ID NO: 3484916 - RNA, 18 nt, Pseudomonas aeruginosa PA01
uugacccguugcgccucg

SEQ ID NO: 3484917 - RNA, 17 nt, Pseudomonas aeruginosa PA01
uugacccucugguuggc

SEQ ID NO: 3484918 - RNA, 19 nt, Pseudomonas aeruginosa PA01
uugaccgucggcaagcagg

SEQ ID NO: 3484919 - RNA, 16 nt, Pseudomonas aeruginosa PA01
uugaccucgacgccga

SEQ ID NO: 3484920 - RNA, 23 nt, Pseudomonas aeruginosa PA01
uugacgaaauacucgucgacggc

SEQ ID NO: 3484921 - RNA, 16 nt, Pseudomonas aeruginosa PA01
uugacgaacaguucga

SEQ ID NO: 3484922 - RNA, 16 nt, Pseudomonas aeruginosa PA01
uugacgaagccggcga

SEQ ID NO: 3484923 - RNA, 23 nt, Pseudomonas aeruginosa PA01
uugacgaugaagcgguucucguc

SEQ ID NO: 3484924 - RNA, 16 nt, Pseudomonas aeruginosa PA01
uugacgauggccagcc

SEQ ID NO: 3484925 - RNA, 15 nt, Pseudomonas aeruginosa PA01
uugacgauggcccag

SEQ ID NO: 3484926 - RNA, 16 nt, Pseudomonas aeruginosa PA01
uugacgauggcgccau

SEQ ID NO: 3484927 - RNA, 12 nt, Pseudomonas aeruginosa PA01
uugacggcgccg

SEQ ID NO: 3484928 - RNA, 15 nt, Pseudomonas aeruginosa PA01
uugacgucgccgaug

SEQ ID NO: 3484929 - RNA, 16 nt, Pseudomonas aeruginosa PA01
uugacguucaggcugu

SEQ ID NO: 3484930 - RNA, 12 nt, Pseudomonas aeruginosa PA01
uugacuggcagu

SEQ ID NO: 3484931 - RNA, 20 nt, Pseudomonas aeruginosa PA01
uugacuuuuuuaucgauggc

SEQ ID NO: 3484932 - RNA, 22 nt, Pseudomonas aeruginosa PA01
uugagcacccgggcgaccugcu

SEQ ID NO: 3484933 - RNA, 13 nt, Pseudomonas aeruginosa PA01
uugagcaccggca

SEQ ID NO: 3484934 - RNA, 14 nt, Pseudomonas aeruginosa PA01
uugagcacgguccg

SEQ ID NO: 3484935 - RNA, 24 nt, Pseudomonas aeruginosa PA01
uugagcagggcgucgcccucggcg

SEQ ID NO: 3484936 - RNA, 22 nt, Pseudomonas aeruginosa PA01
uugagcaggguguugaucaccg

SEQ ID NO: 3484937 - RNA, 12 nt, Pseudomonas aeruginosa PA01
uugagccuugcc

SEQ ID NO: 3484938 - RNA, 22 nt, Pseudomonas aeruginosa PA01
uugagcgcgcccaggcaggcga

SEQ ID NO: 3484939 - RNA, 18 nt, Pseudomonas aeruginosa PA01
uugagcggcgcccuggcu

SEQ ID NO: 3484940 - RNA, 17 nt, Pseudomonas aeruginosa PA01
uugaggaaguagugcag

SEQ ID NO: 3484941 - RNA, 19 nt, Pseudomonas aeruginosa PA01
uugaggccgucgaagugga

SEQ ID NO: 3484942 - RNA, 19 nt, Pseudomonas aeruginosa PA01
uugagguagagcacgccgu

SEQ ID NO: 3484943 - RNA, 20 nt, Pseudomonas aeruginosa PA01
uugagguagagcacgccguc

SEQ ID NO: 3484944 - RNA, 17 nt, Pseudomonas aeruginosa PA01
uugaggucgugcagcac

SEQ ID NO: 3484945 - RNA, 13 nt, Pseudomonas aeruginosa PA01
uugaguagaaaag

SEQ ID NO: 3484946 - RNA, 18 nt, Pseudomonas aeruginosa PA01
uugagucgcgcgcgcuuc

SEQ ID NO: 3484947 - RNA, 23 nt, Pseudomonas aeruginosa PA01
uugagucgcgcgcgcuucuuguc

SEQ ID NO: 3484948 - RNA, 16 nt, Pseudomonas aeruginosa PA01
uugauacccaccggcu

SEQ ID NO: 3484949 - RNA, 22 nt, Pseudomonas aeruginosa PA01
uugauacgguuugaggcguugg

SEQ ID NO: 3484950 - RNA, 20 nt, Pseudomonas aeruginosa PA01
uugaucaccaccacgccguc

SEQ ID NO: 3484951 - RNA, 19 nt, Pseudomonas aeruginosa PA01
uugaucaccaccggcuggc

SEQ ID NO: 3484952 - RNA, 23 nt, Pseudomonas aeruginosa PA01
uugaucagcgcgcguuccagguc

SEQ ID NO: 3484953 - RNA, 22 nt, Pseudomonas aeruginosa PA01
uugaucagguucggcagcgccu

SEQ ID NO: 3484954 - RNA, 23 nt, Pseudomonas aeruginosa PA01
uugaucagguucggcagcgccuc

SEQ ID NO: 3484955 - RNA, 20 nt, Pseudomonas aeruginosa PA01
uugauccgcuccagcgccuc

SEQ ID NO: 3484956 - RNA, 17 nt, Pseudomonas aeruginosa PA01
uugaucgacgccagcuc

SEQ ID NO: 3484957 - RNA, 12 nt, Pseudomonas aeruginosa PA01
uugaucgagaaa

SEQ ID NO: 3484958 - RNA, 15 nt, Pseudomonas aeruginosa PA01
uugcgcuccuuggcu

SEQ ID NO: 3484959 - RNA, 13 nt, Pseudomonas aeruginosa PA01
uugcgcucgagcc

SEQ ID NO: 3484960 - RNA, 21 nt, Pseudomonas aeruginosa PA01
uugcgcucgagccggcugaug

SEQ ID NO: 3484961 - RNA, 15 nt, Pseudomonas aeruginosa PA01
uugcgcuggccggca

SEQ ID NO: 3484962 - RNA, 19 nt, Pseudomonas aeruginosa PA01
uugcgcuggcgcagcagca

SEQ ID NO: 3484963 - RNA, 20 nt, Pseudomonas aeruginosa PA01
uugcgcuggcgcagcagcag

SEQ ID NO: 3484964 - RNA, 21 nt, Pseudomonas aeruginosa PA01
uugcgcuugccggccgccagc

SEQ ID NO: 3484965 - RNA, 16 nt, Pseudomonas aeruginosa PA01
uugcggaacccgcgca

SEQ ID NO: 3484966 - RNA, 15 nt, Pseudomonas aeruginosa PA01
uugcggcgccgaggc

SEQ ID NO: 3484967 - RNA, 13 nt, Pseudomonas aeruginosa PA01
uugcggcgccggu

SEQ ID NO: 3484968 - RNA, 12 nt, Pseudomonas aeruginosa PA01
uugcggcgcggc

SEQ ID NO: 3484969 - RNA, 19 nt, Pseudomonas aeruginosa PA01
uugcgggcgaugaggcugu

SEQ ID NO: 3484970 - RNA, 18 nt, Pseudomonas aeruginosa PA01
uugcgggucagaccacga

SEQ ID NO: 3484971 - RNA, 14 nt, Pseudomonas aeruginosa PA01
uugcgggugcgcag

SEQ ID NO: 3484972 - RNA, 20 nt, Pseudomonas aeruginosa PA01
uugcggucauccgccggcgc

SEQ ID NO: 3484973 - RNA, 17 nt, Pseudomonas aeruginosa PA01
uugcgguccagcgagcg

SEQ ID NO: 3484974 - RNA, 15 nt, Pseudomonas aeruginosa PA01
uugcgucccuuggcg

SEQ ID NO: 3484975 - RNA, 21 nt, Pseudomonas aeruginosa PA01
uugcucaccaaugccagugcc

SEQ ID NO: 3484976 - RNA, 16 nt, Pseudomonas aeruginosa PA01
uugcucgcaccaggcc

SEQ ID NO: 3484977 - RNA, 20 nt, Pseudomonas aeruginosa PA01
uugcucgcaccaggccaggu

SEQ ID NO: 3484978 - RNA, 21 nt, Pseudomonas aeruginosa PA01
uugcucugugcgauuucgcug

SEQ ID NO: 3484979 - RNA, 22 nt, Pseudomonas aeruginosa PA01
uugcugaaagcgauagccgggg

SEQ ID NO: 3484980 - RNA, 21 nt, Pseudomonas aeruginosa PA01
uugcugaagcccaggcgucgc

SEQ ID NO: 3484981 - RNA, 15 nt, Pseudomonas aeruginosa PA01
uugcugacggcgugg

SEQ ID NO: 3484982 - RNA, 20 nt, Pseudomonas aeruginosa PA01
uugcugacggcguggcggau

SEQ ID NO: 3484983 - RNA, 23 nt, Pseudomonas aeruginosa PA01
uugcugaucaggccgaggaugcu

SEQ ID NO: 3484984 - RNA, 17 nt, Pseudomonas aeruginosa PA01
uugcugaucgcuccgcu

SEQ ID NO: 3484985 - RNA, 14 nt, Pseudomonas aeruginosa PA01
uugcugcccuggcg

SEQ ID NO: 3484986 - RNA, 21 nt, Pseudomonas aeruginosa PA01
uugcugcccuggcgcgcgccc

SEQ ID NO: 3484987 - RNA, 12 nt, Pseudomonas aeruginosa PA01
uugcuggcacag

SEQ ID NO: 3484988 - RNA, 16 nt, Pseudomonas aeruginosa PA01
uugcuggcacaggucc

SEQ ID NO: 3484989 - RNA, 20 nt, Pseudomonas aeruginosa PA01
uugcuggcgcgauccgcgcg

SEQ ID NO: 3484990 - RNA, 19 nt, Pseudomonas aeruginosa PA01
uugcuguugccgcugcagg

SEQ ID NO: 3484991 - RNA, 19 nt, Pseudomonas aeruginosa PA01
uugcuugcgcucgagccgg

SEQ ID NO: 3484992 - RNA, 20 nt, Pseudomonas aeruginosa PA01
uugcuugcgcucgagccggc

SEQ ID NO: 3484993 - RNA, 13 nt, Pseudomonas aeruginosa PA01
uuggaacuguugg

SEQ ID NO: 3484994 - RNA, 20 nt, Pseudomonas aeruginosa PA01
uuggacagguccuggaacag

SEQ ID NO: 3484995 - RNA, 16 nt, Pseudomonas aeruginosa PA01
uuggacgcggccuggg

SEQ ID NO: 3484996 - RNA, 17 nt, Pseudomonas aeruginosa PA01
uuggacgcggccugggc

SEQ ID NO: 3484997 - RNA, 20 nt, Pseudomonas aeruginosa PA01
uuggagcgggcgccggacca

SEQ ID NO: 3484998 - RNA, 13 nt, Pseudomonas aeruginosa PA01
uuggcacccugga

SEQ ID NO: 3484999 - RNA, 17 nt, Pseudomonas aeruginosa PA01
uuggcagauuccuggac

SEQ ID NO: 3485000 - RNA, 22 nt, Pseudomonas aeruginosa PA01
uuggcagauuccuggaccccgc

SEQ ID NO: 3485001 - RNA, 16 nt, Pseudomonas aeruginosa PA01
uuggcaugaccgagca

SEQ ID NO: 3485002 - RNA, 22 nt, Pseudomonas aeruginosa PA01
uuggccacgcugcggaucaacu

SEQ ID NO: 3485003 - RNA, 20 nt, Pseudomonas aeruginosa PA01
uuggccacguagggcguggu

SEQ ID NO: 3485004 - RNA, 16 nt, Pseudomonas aeruginosa PA01
uuggccagcaggccga

SEQ ID NO: 3485005 - RNA, 15 nt, Pseudomonas aeruginosa PA01
uuggccagccgcgcg

SEQ ID NO: 3485006 - RNA, 13 nt, Pseudomonas aeruginosa PA01
uuggccagcgcca

SEQ ID NO: 3485007 - RNA, 14 nt, Pseudomonas aeruginosa PA01
uuggccagcgccac

SEQ ID NO: 3485008 - RNA, 15 nt, Pseudomonas aeruginosa PA01
uuggccagcgcggug

SEQ ID NO: 3485009 - RNA, 21 nt, Pseudomonas aeruginosa PA01
uuggccaggaagcgggccucg

SEQ ID NO: 3485010 - RNA, 17 nt, Pseudomonas aeruginosa PA01
uuggccaucagcgccgc

SEQ ID NO: 3485011 - RNA, 14 nt, Pseudomonas aeruginosa PA01
uuggccaugggcac

SEQ ID NO: 3485012 - RNA, 21 nt, Pseudomonas aeruginosa PA01
uuggccauguacguaucccag

SEQ ID NO: 3485013 - RNA, 19 nt, Pseudomonas aeruginosa PA01
uuggcccaauccgcgccgg

SEQ ID NO: 3485014 - RNA, 13 nt, Pseudomonas aeruginosa PA01
uuggcccagaccu

SEQ ID NO: 3485015 - RNA, 14 nt, Pseudomonas aeruginosa PA01
uuggcccgcgccgu

SEQ ID NO: 3485016 - RNA, 19 nt, Pseudomonas aeruginosa PA01
uuggcccgguuggccagga

SEQ ID NO: 3485017 - RNA, 13 nt, Pseudomonas aeruginosa PA01
uuggcccuggccu

SEQ ID NO: 3485018 - RNA, 18 nt, Pseudomonas aeruginosa PA01
uuggccgaaagcacugcg

SEQ ID NO: 3485019 - RNA, 21 nt, Pseudomonas aeruginosa PA01
uuggccgagcgcgagugcagc

SEQ ID NO: 3485020 - RNA, 13 nt, Pseudomonas aeruginosa PA01
uuggccgggccga

SEQ ID NO: 3485021 - RNA, 17 nt, Pseudomonas aeruginosa PA01
uuggccuugagcaggcg

SEQ ID NO: 3485022 - RNA, 23 nt, Pseudomonas aeruginosa PA01
uuggcgaaauugccuccgcucug

SEQ ID NO: 3485023 - RNA, 13 nt, Pseudomonas aeruginosa PA01
uuggcgaacucca

SEQ ID NO: 3485024 - RNA, 21 nt, Pseudomonas aeruginosa PA01
uuggcgaacuucaggccggcg

SEQ ID NO: 3485025 - RNA, 20 nt, Pseudomonas aeruginosa PA01
uuggcgaaguugccgccgcu

SEQ ID NO: 3485026 - RNA, 18 nt, Pseudomonas aeruginosa PA01
uuggcgaauagccggcgc

SEQ ID NO: 3485027 - RNA, 16 nt, Pseudomonas aeruginosa PA01
uuggcgaggcgcgccu

SEQ ID NO: 3485028 - RNA, 17 nt, Pseudomonas aeruginosa PA01
uuggcgaggcgcgccug

SEQ ID NO: 3485029 - RNA, 16 nt, Pseudomonas aeruginosa PA01
uuggcgcaggccgggc

SEQ ID NO: 3485030 - RNA, 14 nt, Pseudomonas aeruginosa PA01
uuggcgcgaccgcc

SEQ ID NO: 3485031 - RNA, 20 nt, Pseudomonas aeruginosa PA01
uuggcgcgaccgcccgccuc

SEQ ID NO: 3485032 - RNA, 14 nt, Pseudomonas aeruginosa PA01
uuggcgcgcuggca

SEQ ID NO: 3485033 - RNA, 11 nt, Pseudomonas aeruginosa PA01
uuggcggcgcc

SEQ ID NO: 3485034 - RNA, 13 nt, Pseudomonas aeruginosa PA01
uuggcggcgccau

SEQ ID NO: 3485035 - RNA, 19 nt, Pseudomonas aeruginosa PA01
uuggcucaguugcugauca

SEQ ID NO: 3485036 - RNA, 14 nt, Pseudomonas aeruginosa PA01
uuggcuccgggccg

SEQ ID NO: 3485037 - RNA, 13 nt, Pseudomonas aeruginosa PA01
uuggcuucgaaga

SEQ ID NO: 3485038 - RNA, 19 nt, Pseudomonas aeruginosa PA01
uugggaccgggcauuuccu

SEQ ID NO: 3485039 - RNA, 19 nt, Pseudomonas aeruginosa PA01
uugggaucggcgaucagcg

SEQ ID NO: 3485040 - RNA, 15 nt, Pseudomonas aeruginosa PA01
uugggaucgucgaaa

SEQ ID NO: 3485041 - RNA, 22 nt, Pseudomonas aeruginosa PA01
uugggcacgcggaucuggcccu

SEQ ID NO: 3485042 - RNA, 23 nt, Pseudomonas aeruginosa PA01
uugggcagccacgaagccucuuc

SEQ ID NO: 3485043 - RNA, 12 nt, Pseudomonas aeruginosa PA01
uugggcaucgag

SEQ ID NO: 3485044 - RNA, 16 nt, Pseudomonas aeruginosa PA01
uugggccaggcaucca

SEQ ID NO: 3485045 - RNA, 14 nt, Pseudomonas aeruginosa PA01
uugggcgaccugcu

SEQ ID NO: 3485046 - RNA, 19 nt, Pseudomonas aeruginosa PA01
uugggcgccucgccgcggc

SEQ ID NO: 3485047 - RNA, 22 nt, Pseudomonas aeruginosa PA01
uuggggacagggcggcagcgug

SEQ ID NO: 3485048 - RNA, 16 nt, Pseudomonas aeruginosa PA01
uugggucaucgaacau

SEQ ID NO: 3485049 - RNA, 18 nt, Pseudomonas aeruginosa PA01
uugguacagcucgcgcaa

SEQ ID NO: 3485050 - RNA, 20 nt, Pseudomonas aeruginosa PA01
uugguauccaccucgcccuc

SEQ ID NO: 3485051 - RNA, 22 nt, Pseudomonas aeruginosa PA01
uuggucaggcccugcuucugua

SEQ ID NO: 3485052 - RNA, 12 nt, Pseudomonas aeruginosa PA01
uuggucaggccg

SEQ ID NO: 3485053 - RNA, 13 nt, Pseudomonas aeruginosa PA01
uuggucaggccga

SEQ ID NO: 3485054 - RNA, 17 nt, Pseudomonas aeruginosa PA01
uuggucaggcugcgcac

SEQ ID NO: 3485055 - RNA, 20 nt, Pseudomonas aeruginosa PA01
uuggucaggcugcgcaccuc

SEQ ID NO: 3485056 - RNA, 23 nt, Pseudomonas aeruginosa PA01
uuggucaggucgacgccgccgag

SEQ ID NO: 3485057 - RNA, 17 nt, Pseudomonas aeruginosa PA01
uuggucggcaccagggc

SEQ ID NO: 3485058 - RNA, 18 nt, Pseudomonas aeruginosa PA01
uuggucgggcgccgcgcc

SEQ ID NO: 3485059 - RNA, 11 nt, Pseudomonas aeruginosa PA01
uuggucugcuc

SEQ ID NO: 3485060 - RNA, 12 nt, Pseudomonas aeruginosa PA01
uuggucugcucg

SEQ ID NO: 3485061 - RNA, 23 nt, Pseudomonas aeruginosa PA01
uuuugccggagaugugcgcggug

SEQ ID NO: 3485062 - RNA, 15 nt, Pseudomonas aeruginosa PA01
uuuuucaugcgcggg

SEQ ID NO: 3485063 - RNA, 19 nt, Pseudomonas aeruginosa PA01
uuuuucauuucgcgcggua

SEQ ID NO: 3485064 - RNA, 16 nt, Pseudomonas aeruginosa PA01
uuuuuccucuauggga

SEQ ID NO: 3485065 - RNA, 14 nt, Pseudomonas aeruginosa PA01
uuuuucgucgccag

SEQ ID NO: 3485066 - RNA, 21 nt, Pseudomonas aeruginosa PA01
gguaacgcggauacuccuuca

SEQ ID NO: 3485067 - RNA, 14 nt, Pseudomonas aeruginosa PA01
gguaacuggccagg

SEQ ID NO: 3485068 - RNA, 17 nt, Pseudomonas aeruginosa PA01
gguaacuggccagggca

SEQ ID NO: 3485069 - RNA, 16 nt, Pseudomonas aeruginosa PA01
gguaaggauguccggg

SEQ ID NO: 3485070 - RNA, 21 nt, Pseudomonas aeruginosa PA01
gguaaggcaccaccgccgcca

SEQ ID NO: 3485071 - RNA, 22 nt, Pseudomonas aeruginosa PA01
gguaaggcaccaccgccgccag

SEQ ID NO: 3485072 - RNA, 15 nt, Pseudomonas aeruginosa PA01
gguaaggcaugccca

SEQ ID NO: 3485073 - RNA, 16 nt, Pseudomonas aeruginosa PA01
gguaauaucacccgca

SEQ ID NO: 3485074 - RNA, 21 nt, Pseudomonas aeruginosa PA01
gguaauguucuccucccgccc

SEQ ID NO: 3485075 - RNA, 12 nt, Pseudomonas aeruginosa PA01
gguacagccccc

SEQ ID NO: 3485076 - RNA, 14 nt, Pseudomonas aeruginosa PA01
gguacagcccccag

SEQ ID NO: 3485077 - RNA, 18 nt, Pseudomonas aeruginosa PA01
gguacagcgacucgcugc

SEQ ID NO: 3485078 - RNA, 21 nt, Pseudomonas aeruginosa PA01
gguacagcgacucgcugccgg

SEQ ID NO: 3485079 - RNA, 21 nt, Pseudomonas aeruginosa PA01
gguacagcgccuggucggcgg

SEQ ID NO: 3485080 - RNA, 17 nt, Pseudomonas aeruginosa PA01
gguacaguucaggcugg

SEQ ID NO: 3485081 - RNA, 19 nt, Pseudomonas aeruginosa PA01
gguaccagggaagcgcgcg

SEQ ID NO: 3485082 - RNA, 18 nt, Pseudomonas aeruginosa PA01
gguacccgccggccaugc

SEQ ID NO: 3485083 - RNA, 20 nt, Pseudomonas aeruginosa PA01
gguacccgccggccaugccg

SEQ ID NO: 3485084 - RNA, 15 nt, Pseudomonas aeruginosa PA01
gguacccggcagggc

SEQ ID NO: 3485085 - RNA, 20 nt, Pseudomonas aeruginosa PA01
gguacccguacgcugccagg

SEQ ID NO: 3485086 - RNA, 19 nt, Pseudomonas aeruginosa PA01
gguaccgacggucggcagg

SEQ ID NO: 3485087 - RNA, 19 nt, Pseudomonas aeruginosa PA01
gguaccgcugcgugccagg

SEQ ID NO: 3485088 - RNA, 22 nt, Pseudomonas aeruginosa PA01
gguaccgcugcgugccagggcu

SEQ ID NO: 3485089 - RNA, 15 nt, Pseudomonas aeruginosa PA01
gguaccgcuggcgcu

SEQ ID NO: 3485090 - RNA, 15 nt, Pseudomonas aeruginosa PA01
gguaccggccaggcg

SEQ ID NO: 3485091 - RNA, 19 nt, Pseudomonas aeruginosa PA01
gguaccguugcgcaggcgu

SEQ ID NO: 3485092 - RNA, 15 nt, Pseudomonas aeruginosa PA01
gguacgcccccuccc

SEQ ID NO: 3485093 - RNA, 19 nt, Pseudomonas aeruginosa PA01
gguacgcccuccagcaccc

SEQ ID NO: 3485094 - RNA, 19 nt, Pseudomonas aeruginosa PA01
gguacggaugccgcgagcc

SEQ ID NO: 3485095 - RNA, 13 nt, Pseudomonas aeruginosa PA01
gguacggucgagg

SEQ ID NO: 3485096 - RNA, 17 nt, Pseudomonas aeruginosa PA01
gguacgguuggccagcg

SEQ ID NO: 3485097 - RNA, 18 nt, Pseudomonas aeruginosa PA01
gguacuaucccggucggg

SEQ ID NO: 3485098 - RNA, 20 nt, Pseudomonas aeruginosa PA01
gguacuccggguugaccgcc

SEQ ID NO: 3485099 - RNA, 12 nt, Pseudomonas aeruginosa PA01
gguacucggccc

SEQ ID NO: 3485100 - RNA, 20 nt, Pseudomonas aeruginosa PA01
gguacucggcccgggccugg

SEQ ID NO: 3485101 - RNA, 21 nt, Pseudomonas aeruginosa PA01
gguacucggcccgggccuggu

SEQ ID NO: 3485102 - RNA, 17 nt, Pseudomonas aeruginosa PA01
gguagaaacgcuugagc

SEQ ID NO: 3485103 - RNA, 13 nt, Pseudomonas aeruginosa PA01
gguagaaauccuc

SEQ ID NO: 3485104 - RNA, 15 nt, Pseudomonas aeruginosa PA01
gguagaaauggugga

SEQ ID NO: 3485105 - RNA, 21 nt, Pseudomonas aeruginosa PA01
gguagaacuccuugccguggc

SEQ ID NO: 3485106 - RNA, 22 nt, Pseudomonas aeruginosa PA01
gguagaaggugcccagcggcgc

SEQ ID NO: 3485107 - RNA, 18 nt, Pseudomonas aeruginosa PA01
gguagaccacgcaggcca

SEQ ID NO: 3485108 - RNA, 13 nt, Pseudomonas aeruginosa PA01
gguagacgccucc

SEQ ID NO: 3485109 - RNA, 15 nt, Pseudomonas aeruginosa PA01
gguagagacggcggc

SEQ ID NO: 3485110 - RNA, 18 nt, Pseudomonas aeruginosa PA01
gguagagaugcagcaggu

SEQ ID NO: 3485111 - RNA, 19 nt, Pseudomonas aeruginosa PA01
gguagagcgcggcgcaggc

SEQ ID NO: 3485112 - RNA, 18 nt, Pseudomonas aeruginosa PA01
gguagagucgcucgcgca

SEQ ID NO: 3485113 - RNA, 23 nt, Pseudomonas aeruginosa PA01
gguagaugaacuggucgcuccag

SEQ ID NO: 3485114 - RNA, 20 nt, Pseudomonas aeruginosa PA01
gguagaugccacugacgcgc

SEQ ID NO: 3485115 - RNA, 17 nt, Pseudomonas aeruginosa PA01
gguagcagccguccagc

SEQ ID NO: 3485116 - RNA, 17 nt, Pseudomonas aeruginosa PA01
gguagccaggggucagg

SEQ ID NO: 3485117 - RNA, 13 nt, Pseudomonas aeruginosa PA01
gguagccauggcg

SEQ ID NO: 3485118 - RNA, 15 nt, Pseudomonas aeruginosa PA01
gguagccauggcgga

SEQ ID NO: 3485119 - RNA, 17 nt, Pseudomonas aeruginosa PA01
gguagcccgcggcgagc

SEQ ID NO: 3485120 - RNA, 16 nt, Pseudomonas aeruginosa PA01
gguagccgaggcggcc

SEQ ID NO: 3485121 - RNA, 15 nt, Pseudomonas aeruginosa PA01
gguagccgaucaacg

SEQ ID NO: 3485122 - RNA, 20 nt, Pseudomonas aeruginosa PA01
gguagccgaucaacgcggcc

SEQ ID NO: 3485123 - RNA, 19 nt, Pseudomonas aeruginosa PA01
gguagccgcccaccgcggg

SEQ ID NO: 3485124 - RNA, 22 nt, Pseudomonas aeruginosa PA01
gguagccgccccacgggucguc

SEQ ID NO: 3485125 - RNA, 14 nt, Pseudomonas aeruginosa PA01
gguagccgcgccgg

SEQ ID NO: 3485126 - RNA, 16 nt, Pseudomonas aeruginosa PA01
gguagccgcgccggcc

SEQ ID NO: 3485127 - RNA, 17 nt, Pseudomonas aeruginosa PA01
gguagccgcgccggccg

SEQ ID NO: 3485128 - RNA, 23 nt, Pseudomonas aeruginosa PA01
gguagccggccaaccaccggcgc

SEQ ID NO: 3485129 - RNA, 12 nt, Pseudomonas aeruginosa PA01
gguagccggccg

SEQ ID NO: 3485130 - RNA, 14 nt, Pseudomonas aeruginosa PA01
gguagccggcgagc

SEQ ID NO: 3485131 - RNA, 17 nt, Pseudomonas aeruginosa PA01
gguagccguucgacgcu

SEQ ID NO: 3485132 - RNA, 17 nt, Pseudomonas aeruginosa PA01
gguagccugcggccagc

SEQ ID NO: 3485133 - RNA, 20 nt, Pseudomonas aeruginosa PA01
gguagcgaaucugcagggca

SEQ ID NO: 3485134 - RNA, 14 nt, Pseudomonas aeruginosa PA01
gguagcgcuccagc

SEQ ID NO: 3485135 - RNA, 14 nt, Pseudomonas aeruginosa PA01
gguagcgcucgccu

SEQ ID NO: 3485136 - RNA, 15 nt, Pseudomonas aeruginosa PA01
gguagcgcugcgccc

SEQ ID NO: 3485137 - RNA, 17 nt, Pseudomonas aeruginosa PA01
gguagcgcugcgcccgc

SEQ ID NO: 3485138 - RNA, 15 nt, Pseudomonas aeruginosa PA01
gguagcggaucagcc

SEQ ID NO: 3485139 - RNA, 18 nt, Pseudomonas aeruginosa PA01
gguagcggaucagccggc

SEQ ID NO: 3485140 - RNA, 19 nt, Pseudomonas aeruginosa PA01
gguagcggcgcaccgacgc

SEQ ID NO: 3485141 - RNA, 20 nt, Pseudomonas aeruginosa PA01
gguagcggcguucgccgagc

SEQ ID NO: 3485142 - RNA, 14 nt, Pseudomonas aeruginosa PA01
gguagcgggccagc

SEQ ID NO: 3485143 - RNA, 14 nt, Pseudomonas aeruginosa PA01
gguagcggucgggu

SEQ ID NO: 3485144 - RNA, 17 nt, Pseudomonas aeruginosa PA01
gguagcguugcgccaga

SEQ ID NO: 3485145 - RNA, 19 nt, Pseudomonas aeruginosa PA01
gguagcguugcgccagacc

SEQ ID NO: 3485146 - RNA, 18 nt, Pseudomonas aeruginosa PA01
gguagcguuggaguaggg

SEQ ID NO: 3485147 - RNA, 15 nt, Pseudomonas aeruginosa PA01
gguagcugcgcaggg

SEQ ID NO: 3485148 - RNA, 14 nt, Pseudomonas aeruginosa PA01
gguagcugcggccg

SEQ ID NO: 3485149 - RNA, 15 nt, Pseudomonas aeruginosa PA01
gguagcugcggccga

SEQ ID NO: 3485150 - RNA, 18 nt, Pseudomonas aeruginosa PA01
gguagcugcggccgagca

SEQ ID NO: 3485151 - RNA, 16 nt, Pseudomonas aeruginosa PA01
gguagcugcuccagcc

SEQ ID NO: 3485152 - RNA, 19 nt, Pseudomonas aeruginosa PA01
gguagcugcuccagcccgg

SEQ ID NO: 3485153 - RNA, 15 nt, Pseudomonas aeruginosa PA01
gguaggacagggcca

SEQ ID NO: 3485154 - RNA, 20 nt, Pseudomonas aeruginosa PA01
gguaggagccgucgccggcg

SEQ ID NO: 3485155 - RNA, 15 nt, Pseudomonas aeruginosa PA01
gguaggagcgagagc

SEQ ID NO: 3485156 - RNA, 11 nt, Pseudomonas aeruginosa PA01
gguaggaggaa

SEQ ID NO: 3485157 - RNA, 13 nt, Pseudomonas aeruginosa PA01
gguaggcaucgac

SEQ ID NO: 3485158 - RNA, 15 nt, Pseudomonas aeruginosa PA01
gguaggccagcaggg

SEQ ID NO: 3485159 - RNA, 18 nt, Pseudomonas aeruginosa PA01
gguaggccagcagggucu

SEQ ID NO: 3485160 - RNA, 21 nt, Pseudomonas aeruginosa PA01
gguaggccagccccagauggg

SEQ ID NO: 3485161 - RNA, 18 nt, Pseudomonas aeruginosa PA01
gguaggccaugagguugg

SEQ ID NO: 3485162 - RNA, 19 nt, Pseudomonas aeruginosa PA01
gguaggccaugagguuggc

SEQ ID NO: 3485163 - RNA, 16 nt, Pseudomonas aeruginosa PA01
gguaggccggcgugcc

SEQ ID NO: 3485164 - RNA, 20 nt, Pseudomonas aeruginosa PA01
gguaggcgacgaagcuggcg

SEQ ID NO: 3485165 - RNA, 14 nt, Pseudomonas aeruginosa PA01
gguaggcgcgggcg

SEQ ID NO: 3485166 - RNA, 16 nt, Pseudomonas aeruginosa PA01
gguaggcgcgggcgua

SEQ ID NO: 3485167 - RNA, 14 nt, Pseudomonas aeruginosa PA01
gguaggcgguggcg

SEQ ID NO: 3485168 - RNA, 16 nt, Pseudomonas aeruginosa PA01
gguaggcgucgucgac

SEQ ID NO: 3485169 - RNA, 20 nt, Pseudomonas aeruginosa PA01
gguaggcucccccgcgccgc

SEQ ID NO: 3485170 - RNA, 21 nt, Pseudomonas aeruginosa PA01
gguaggcucccccgcgccgcc

SEQ ID NO: 3485171 - RNA, 15 nt, Pseudomonas aeruginosa PA01
gguaggcucugcucc

SEQ ID NO: 3485172 - RNA, 18 nt, Pseudomonas aeruginosa PA01
gguaggcucugcuccagc

SEQ ID NO: 3485173 - RNA, 23 nt, Pseudomonas aeruginosa PA01
gguaggggucguugccgucgagc

SEQ ID NO: 3485174 - RNA, 20 nt, Pseudomonas aeruginosa PA01
gguaguaggguucgccgacg

SEQ ID NO: 3485175 - RNA, 15 nt, Pseudomonas aeruginosa PA01
gguaguccagccagu

SEQ ID NO: 3485176 - RNA, 14 nt, Pseudomonas aeruginosa PA01
gguagucgcccggc

SEQ ID NO: 3485177 - RNA, 18 nt, Pseudomonas aeruginosa PA01
gguagucgccggucagag

SEQ ID NO: 3485178 - RNA, 21 nt, Pseudomonas aeruginosa PA01
gguagucgcucauggcgccgc

SEQ ID NO: 3485179 - RNA, 13 nt, Pseudomonas aeruginosa PA01
gguagucggggca

SEQ ID NO: 3485180 - RNA, 23 nt, Pseudomonas aeruginosa PA01
gguagucggggcauucguccagc

SEQ ID NO: 3485181 - RNA, 21 nt, Pseudomonas aeruginosa PA01
gguagucggugaagcgcggcg

SEQ ID NO: 3485182 - RNA, 15 nt, Pseudomonas aeruginosa PA01
gguagugcucggcca

SEQ ID NO: 3485183 - RNA, 23 nt, Pseudomonas aeruginosa PA01
gguagugggcgaggcgcucgacg

SEQ ID NO: 3485184 - RNA, 23 nt, Pseudomonas aeruginosa PA01
gguaguguuugcgcagggcgucg

SEQ ID NO: 3485185 - RNA, 21 nt, Pseudomonas aeruginosa PA01
gguaguucagucgguuagaau

SEQ ID NO: 3485186 - RNA, 17 nt, Pseudomonas aeruginosa PA01
gguauagcucauggcca

SEQ ID NO: 3485187 - RNA, 14 nt, Pseudomonas aeruginosa PA01
gguaucaugcgccc

SEQ ID NO: 3485188 - RNA, 17 nt, Pseudomonas aeruginosa PA01
gguauccaccucgcccu

SEQ ID NO: 3485189 - RNA, 14 nt, Pseudomonas aeruginosa PA01
gguauccagcggcc

SEQ ID NO: 3485190 - RNA, 17 nt, Pseudomonas aeruginosa PA01
gguauccagcggccgcg

SEQ ID NO: 3485191 - RNA, 12 nt, Pseudomonas aeruginosa PA01
gguaucccggcu

SEQ ID NO: 3485192 - RNA, 14 nt, Pseudomonas aeruginosa PA01
gguaucccggcuga

SEQ ID NO: 3485193 - RNA, 23 nt, Pseudomonas aeruginosa PA01
gguaucccggcugagcgccaggc

SEQ ID NO: 3485194 - RNA, 12 nt, Pseudomonas aeruginosa PA01
gguauccgccgg

SEQ ID NO: 3485195 - RNA, 14 nt, Pseudomonas aeruginosa PA01
gguauccgccggcc

SEQ ID NO: 3485196 - RNA, 15 nt, Pseudomonas aeruginosa PA01
gguauccgccggccg

SEQ ID NO: 3485197 - RNA, 15 nt, Pseudomonas aeruginosa PA01
gguauccgggcacuu

SEQ ID NO: 3485198 - RNA, 16 nt, Pseudomonas aeruginosa PA01
gguauccgggcacuug

SEQ ID NO: 3485199 - RNA, 18 nt, Pseudomonas aeruginosa PA01
gguaucgaucucgaucga

SEQ ID NO: 3485200 - RNA, 11 nt, Pseudomonas aeruginosa PA01
gguaucggcca

SEQ ID NO: 3485201 - RNA, 18 nt, Pseudomonas aeruginosa PA01
gguaucggcuugccggcg

SEQ ID NO: 3485202 - RNA, 14 nt, Pseudomonas aeruginosa PA01
gguaugcaggauca

SEQ ID NO: 3485203 - RNA, 21 nt, Pseudomonas aeruginosa PA01
gguaugccgaucaugcucggc

SEQ ID NO: 3485204 - RNA, 23 nt, Pseudomonas aeruginosa PA01
gguaugcgcggucaccaggguca

SEQ ID NO: 3485205 - RNA, 15 nt, Pseudomonas aeruginosa PA01
gguauggcagcucug

SEQ ID NO: 3485206 - RNA, 21 nt, Pseudomonas aeruginosa PA01
gguauucgcgcucggcgaggc

SEQ ID NO: 3485207 - RNA, 21 nt, Pseudomonas aeruginosa PA01
gguauucgcguucggucaggc

SEQ ID NO: 3485208 - RNA, 21 nt, Pseudomonas aeruginosa PA01
gguauugcgcguggcgucggc

SEQ ID NO: 3485209 - RNA, 14 nt, Pseudomonas aeruginosa PA01
gguauuggucgcga

SEQ ID NO: 3485210 - RNA, 22 nt, Pseudomonas aeruginosa PA01
gguauuguggccccagcgcgag

SEQ ID NO: 3485211 - RNA, 21 nt, Pseudomonas aeruginosa PA01
ggucaacaagaauaggaacag

SEQ ID NO: 3485212 - RNA, 14 nt, Pseudomonas aeruginosa PA01
ggucaacaccagcg

SEQ ID NO: 3485213 - RNA, 15 nt, Pseudomonas aeruginosa PA01
ggucaacaccagcgc

SEQ ID NO: 3485214 - RNA, 17 nt, Pseudomonas aeruginosa PA01
ggucaacaccagcgccg

SEQ ID NO: 3485215 - RNA, 19 nt, Pseudomonas aeruginosa PA01
ggucaacaccagcgccgcc

SEQ ID NO: 3485216 - RNA, 20 nt, Pseudomonas aeruginosa PA01
ggucaacaccagcgccgcca

SEQ ID NO: 3485217 - RNA, 20 nt, Pseudomonas aeruginosa PA01
ggucaauucgcggacgccga

SEQ ID NO: 3485218 - RNA, 19 nt, Pseudomonas aeruginosa PA01
ggucaccacguugcgccgc

SEQ ID NO: 3485219 - RNA, 23 nt, Pseudomonas aeruginosa PA01
ggucaccacguugcgccgcagca

SEQ ID NO: 3485220 - RNA, 14 nt, Pseudomonas aeruginosa PA01
ggucaccagcacca

SEQ ID NO: 3485221 - RNA, 23 nt, Pseudomonas aeruginosa PA01
ggucaccagcaccacccggcgca

SEQ ID NO: 3485222 - RNA, 13 nt, Pseudomonas aeruginosa PA01
ggucaccagguug

SEQ ID NO: 3485223 - RNA, 17 nt, Pseudomonas aeruginosa PA01
ggucaccgccagcggga

SEQ ID NO: 3485224 - RNA, 19 nt, Pseudomonas aeruginosa PA01
ggucaccgccagcgggacg

SEQ ID NO: 3485225 - RNA, 14 nt, Pseudomonas aeruginosa PA01
ggucaccgcgccgg

SEQ ID NO: 3485226 - RNA, 19 nt, Pseudomonas aeruginosa PA01
ggucaccgucugcaccgcc

SEQ ID NO: 3485227 - RNA, 23 nt, Pseudomonas aeruginosa PA01
ggucaccguggagaggucgccga

SEQ ID NO: 3485228 - RNA, 21 nt, Pseudomonas aeruginosa PA01
ggucaccguggucauggcgca

SEQ ID NO: 3485229 - RNA, 15 nt, Pseudomonas aeruginosa PA01
ggucaccuugaccuu

SEQ ID NO: 3485230 - RNA, 24 nt, Pseudomonas aeruginosa PA01
ggucaccuugaccuugucggccga

SEQ ID NO: 3485231 - RNA, 15 nt, Pseudomonas aeruginosa PA01
ggucacgaaggcgau

SEQ ID NO: 3485232 - RNA, 17 nt, Pseudomonas aeruginosa PA01
ggucacgccgagggcgc

SEQ ID NO: 3485233 - RNA, 21 nt, Pseudomonas aeruginosa PA01
ggucacgccgagggcgcggcg

SEQ ID NO: 3485234 - RNA, 18 nt, Pseudomonas aeruginosa PA01
ggucacgccgcggcugau

SEQ ID NO: 3485235 - RNA, 17 nt, Pseudomonas aeruginosa PA01
ggucacggucagcucgg

SEQ ID NO: 3485236 - RNA, 14 nt, Pseudomonas aeruginosa PA01
ggucacggugacgg

SEQ ID NO: 3485237 - RNA, 16 nt, Pseudomonas aeruginosa PA01
ggucacggugacggug

SEQ ID NO: 3485238 - RNA, 18 nt, Pseudomonas aeruginosa PA01
ggucacuggcgaggcugc

SEQ ID NO: 3485239 - RNA, 15 nt, Pseudomonas aeruginosa PA01
ggucacuuccuugcg

SEQ ID NO: 3485240 - RNA, 17 nt, Pseudomonas aeruginosa PA01
ggucagaccacgaagcg

SEQ ID NO: 3485241 - RNA, 22 nt, Pseudomonas aeruginosa PA01
ggucagaccacgaagcgaccga

SEQ ID NO: 3485242 - RNA, 16 nt, Pseudomonas aeruginosa PA01
ggucagaccagcccug

SEQ ID NO: 3485243 - RNA, 20 nt, Pseudomonas aeruginosa PA01
ggucagaccagcccuggcgc

SEQ ID NO: 3485244 - RNA, 23 nt, Pseudomonas aeruginosa PA01
ggucagaccagcccuggcgcggc

SEQ ID NO: 3485245 - RNA, 18 nt, Pseudomonas aeruginosa PA01
ggucagagggugaucagc

SEQ ID NO: 3485246 - RNA, 23 nt, Pseudomonas aeruginosa PA01
ggucagagggugaucagcuccgc

SEQ ID NO: 3485247 - RNA, 17 nt, Pseudomonas aeruginosa PA01
ggucagcaccagggcca

SEQ ID NO: 3485248 - RNA, 19 nt, Pseudomonas aeruginosa PA01
ggucagcaccagggccagg

SEQ ID NO: 3485249 - RNA, 19 nt, Pseudomonas aeruginosa PA01
ggucagcagcaccgcgagc

SEQ ID NO: 3485250 - RNA, 15 nt, Pseudomonas aeruginosa PA01
ggucagcagcagggu

SEQ ID NO: 3485251 - RNA, 14 nt, Pseudomonas aeruginosa PA01
ggucagcagcgcca

SEQ ID NO: 3485252 - RNA, 17 nt, Pseudomonas aeruginosa PA01
ggucagcaggcccgagc

SEQ ID NO: 3485253 - RNA, 13 nt, Pseudomonas aeruginosa PA01
ggucagcaggcug

SEQ ID NO: 3485254 - RNA, 16 nt, Pseudomonas aeruginosa PA01
ggucagcaggcugccg

SEQ ID NO: 3485255 - RNA, 22 nt, Pseudomonas aeruginosa PA01
ggucagcagugcggggcgcucg

SEQ ID NO: 3485256 - RNA, 16 nt, Pseudomonas aeruginosa PA01
ggucagcaguugccgg

SEQ ID NO: 3485257 - RNA, 18 nt, Pseudomonas aeruginosa PA01
ggucagcaguugccgggu

SEQ ID NO: 3485258 - RNA, 11 nt, Pseudomonas aeruginosa PA01
ggucagccagc

SEQ ID NO: 3485259 - RNA, 22 nt, Pseudomonas aeruginosa PA01
ggucagcccauacaccaggccg

SEQ ID NO: 3485260 - RNA, 21 nt, Pseudomonas aeruginosa PA01
ggucagcccguguucggccag

SEQ ID NO: 3485261 - RNA, 17 nt, Pseudomonas aeruginosa PA01
ggucagccgaugcucgc

SEQ ID NO: 3485262 - RNA, 18 nt, Pseudomonas aeruginosa PA01
ggucagccgaugcucgcg

SEQ ID NO: 3485263 - RNA, 18 nt, Pseudomonas aeruginosa PA01
ggucagcgaguugaccuu

SEQ ID NO: 3485264 - RNA, 15 nt, Pseudomonas aeruginosa PA01
ggucagcgccagcaa

SEQ ID NO: 3485265 - RNA, 20 nt, Pseudomonas aeruginosa PA01
ggucagcgccagcaacccgc

SEQ ID NO: 3485266 - RNA, 14 nt, Pseudomonas aeruginosa PA01
ggucagcggcgcag

SEQ ID NO: 3485267 - RNA, 18 nt, Pseudomonas aeruginosa PA01
ggucagcgguaugccgca

SEQ ID NO: 3485268 - RNA, 21 nt, Pseudomonas aeruginosa PA01
ggucagcgguaugccgcaggc

SEQ ID NO: 3485269 - RNA, 20 nt, Pseudomonas aeruginosa PA01
ggucagcucgacagcgucgu

SEQ ID NO: 3485270 - RNA, 18 nt, Pseudomonas aeruginosa PA01
ggucagcuucgccgcccu

SEQ ID NO: 3485271 - RNA, 22 nt, Pseudomonas aeruginosa PA01
ggucagcuucgccgcccuggau

SEQ ID NO: 3485272 - RNA, 19 nt, Pseudomonas aeruginosa PA01
ggucagcuugcccucaggg

SEQ ID NO: 3485273 - RNA, 18 nt, Pseudomonas aeruginosa PA01
ggucagcuugccgcaggu
